United States Patent 7,709,616 (MICRORNAS AND USES THEREOF) - sequence listing, part 16

SEQ ID NO: 471994 - RNA, 62 nt, hsa
gcauuaaaaaugcuuauuaauaacuuuggucauuuaaaaaaugcuacaaugacuuccuauua

SEQ ID NO: 471995 - RNA, 62 nt, hsa
cugguauucuacuacuugugcaauauauauguuuuaaaaaacaaauuugagaauacauuuaa

SEQ ID NO: 471996 - RNA, 62 nt, hsa
gguuaagauguauuagaauuauacaauaucaguuuaaaaaucuguaugcauaaagaaugcac

SEQ ID NO: 471997 - RNA, 62 nt, hsa
agauacauuuuauggugguuucaguaggucauuuuaaaaaccaaugugcauuaguuuucaag

SEQ ID NO: 471998 - RNA, 62 nt, hsa
auuuuaguaauuuaauaaaaggauaauguuuauuuaaaaaaccugacuuuuccagaguaauu

SEQ ID NO: 471999 - RNA, 62 nt, hsa
gugaguguacuuaaugccacugcaacuguauauuuaaaaauaguuaaaaugauaaauuuuac

SEQ ID NO: 472000 - RNA, 62 nt, hsa
gaaacugauaaauauauauguggaauauucuuuuuaaaaacaauuuuauaaacaaaucaagg

SEQ ID NO: 472001 - RNA, 62 nt, hsa
ucucgugcaugaagcugacagcuaaagaagauuuuaaaaauugaguuaaagaugacugugua

SEQ ID NO: 472002 - RNA, 62 nt, hsa
auaaaaccaaagugcuauuuuuaaaagcaucauuuaaaaaaaaaugacaugccugaacaacu

SEQ ID NO: 472003 - RNA, 62 nt, hsa
gaaugacagauucaggugguuuauuaauuacauuuaaaaaguuuucugaaaaaacuuuugca

SEQ ID NO: 472004 - RNA, 62 nt, hsa
aaagguuuuuguccuuuccuucacugauuugcuuuaaaaaaaauaaaagauaaugauuuauu

SEQ ID NO: 472005 - RNA, 62 nt, hsa
gcuggucagacuuuuuuuguuagauucucucauuuaaaaaaaauacuguuuguuuaaagcau

SEQ ID NO: 472006 - RNA, 62 nt, hsa
aaaauuuaaaguaucuugcacugauaaauauauuuaaaaauuauauguuuauaaaguuauua

SEQ ID NO: 472007 - RNA, 62 nt, hsa
agggggaaaaacacauaaagucaaacaaauguuuuaaaaauucauaacagcaaccuugaaaa

SEQ ID NO: 472008 - RNA, 62 nt, hsa
gggaauggcaaacgauuuuacuagacuuuauguuuaaaaauaaauaaauaagggaaauuccu

SEQ ID NO: 472009 - RNA, 62 nt, hsa
uaaugugauauuauacauaacacauaucgauuuuuaaaaauuaaaucaaccuugcuuugaug

SEQ ID NO: 472010 - RNA, 62 nt, hsa
uuaacuuaauugcuauguuuugacauuuuuaguuuaaaaaccuuguauaucuuguuuuggug

SEQ ID NO: 472011 - RNA, 62 nt, hsa
uaacucacucauauaauagauuuaccuuacuuuuuaaaaacuacaaaguagcauaauuuguu

SEQ ID NO: 472012 - RNA, 62 nt, hsa
caaugaaaugcaguuuuuuuucucguuuuuaauuuaaaaagauauuaaccucaucacuacua

SEQ ID NO: 472013 - RNA, 62 nt, hsa
uguuuauguugauguauggaaaagagcaugauuuuaaaaaaucaaucauaggaggaaaagaa

SEQ ID NO: 472014 - RNA, 62 nt, hsa
caagcagaaaacucauagucaauacaaguauuuuuaaaaaugucuaauauuuuaucaaaucu

SEQ ID NO: 472015 - RNA, 62 nt, hsa
auggugcucauaaaaggccccagucggggguauuuaaaaaggacugaacagaaauccuuagc

SEQ ID NO: 472016 - RNA, 62 nt, hsa
aauguuuguauaugcaaaacugcuagcuugauuuuaaaaaaaaacaaaucuuuaaaaucugc

SEQ ID NO: 472017 - RNA, 62 nt, hsa
cuucugucucuccuuccucccuuccuuuacaguuuaaaaaaaaaaucuaaaaauaguuaagc

SEQ ID NO: 472018 - RNA, 62 nt, hsa
auaaugcuuuuuguaaacaagagcagaacaguuuuaaaaaucuaauuagaauuuccaaauaa

SEQ ID NO: 472019 - RNA, 62 nt, hsa
ugaucaacaccuuaaaauucauuuaauacuuauuuaaaaagaagaugagagauucaaaaaua

SEQ ID NO: 472020 - RNA, 62 nt, hsa
ugcagaauuuuugcaugacaacauagaaauaauuuaaaaauaguguuuguucugaauguugg

SEQ ID NO: 472021 - RNA, 62 nt, hsa
auuuaagaaaaaaaaaaaagaaaaaaagauuguuuaaaaaaaaaaggaauccauaccaugau

SEQ ID NO: 472022 - RNA, 62 nt, hsa
aagagccacauuuacaaacaacaaacuugaucuuuaaaaauguuuuuaaaacucucugaguc

SEQ ID NO: 472023 - RNA, 62 nt, hsa
auuuguggcuagaaauuuuaaucuaaacuuuuuuuaaaaaaaaucauaauaguuaggauagu

SEQ ID NO: 472024 - RNA, 62 nt, hsa
auugugaauacaauguauguccaauuggauuguuuaaaaacuacuuauaauuaaucacuagc

SEQ ID NO: 472025 - RNA, 62 nt, hsa
cuggggccaaacacaugaacuuguuacaacaauuuaaaaauaauaauaacaaaaggaaagca

SEQ ID NO: 472026 - RNA, 62 nt, hsa
agagggcagucauucuucucacugaguuuuuguuuaaaaaccaggaaauuucuacaaucaug

SEQ ID NO: 472027 - RNA, 62 nt, hsa
gaagaguaauaccaaaugccuaaaauuuuauuuuuaaaaaggaaaauuguuuaaaguauuau

SEQ ID NO: 472028 - RNA, 62 nt, hsa
uugaauauggcccgacacaaauucguaaacuuuuuaaaaaacauuguaagauucuuucugug

SEQ ID NO: 472029 - RNA, 62 nt, hsa
cucaauuaaguguugggaacuaauuucaagauuuuaaaaaauguuaugcaggcuuaacgugu

SEQ ID NO: 472030 - RNA, 62 nt, hsa
uugcaguguuuaagucagcaaaucuucuguuuuuuaaaaauaagccacauaucuagauuuuu

SEQ ID NO: 472031 - RNA, 62 nt, hsa
uaauguguuuuaacauuuuuuaaucaacaucguuuaaaaauaauuuacuaaggauuagauua

SEQ ID NO: 472032 - RNA, 62 nt, hsa
uuaaaauauguaaugucaaaaaugacucaccuuuuaaaaauuaugcaugaaaacagguggua

SEQ ID NO: 472033 - RNA, 62 nt, hsa
aucagcuuuauucuaagcaaaucugugucuacuuuaaaaaacuggaaauggaaaaaaaaaua

SEQ ID NO: 472034 - RNA, 62 nt, hsa
uuuuaauauacuagucaugauguguguuguauuuuaaaaauuaucugcaaccuuaauucagc

SEQ ID NO: 472035 - RNA, 62 nt, hsa
gaaacacuaaauaguguaauauuucuuuugcuuuuaaaaaaauuccugguagcaaaucaaga

SEQ ID NO: 472036 - RNA, 62 nt, hsa
caagaauaaauaaaacaaacuuaaucuucaucuuuaaaaaaaagaaaaaagaaaccaaaaug

SEQ ID NO: 472037 - RNA, 62 nt, hsa
uuuuuaaugcuuaauacauacauggugcaaaauuuaaaaagcgcaaauagguaucuagugga

SEQ ID NO: 472038 - RNA, 62 nt, hsa
ugugauuaaauucauugugauugcacaaaaauuuuaaaaacacgugauguaaacuugcaagc

SEQ ID NO: 472039 - RNA, 62 nt, hsa
uguuugggugguuggaauaauuuuauuuuucuuuuaaaaaagcuaacaucagaccccuuuau

SEQ ID NO: 472040 - RNA, 62 nt, hsa
ccugcuacugcaaauauaaaacauaaaguuuguuuaaaaaaaugcaaaucauucuuuaccuu

SEQ ID NO: 472041 - RNA, 62 nt, hsa
aauaugaacaaagaaaaaaauauauuuuaugauuuaaaaaauaaauauaauugggauuuuaa

SEQ ID NO: 472042 - RNA, 62 nt, hsa
uuuaugauuuaaaaaauaaauauaauugggauuuuaaaaacaugagaaaugugaacugugau

SEQ ID NO: 472043 - RNA, 62 nt, hsa
ucgggagaggauuagguuccauccuuuacguguuuaaaaaaaagcauaaaaacauuuuaaaa

SEQ ID NO: 472044 - RNA, 62 nt, hsa
cuuuacguguuuaaaaaaaagcauaaaaacauuuuaaaaacauagaaaaauucagcaaacca

SEQ ID NO: 472045 - RNA, 62 nt, hsa
guuccgaugaauucuuauccccugccccuuccuuuaaaaaacuuagugacaaaauagacaau

SEQ ID NO: 472046 - RNA, 62 nt, hsa
gcuuugggccauguagcauuuuaagacucaauuuuaaaaaauuauuaaucuguugcugacuc

SEQ ID NO: 472047 - RNA, 62 nt, hsa
uguggguguguauauaucugauuugggaagaauuuaaaaaacacauagcuuuuuaauuuguu

SEQ ID NO: 472048 - RNA, 62 nt, hsa
aacaagauaaaacucacaggggaauguacuuuuuuaaaaaaaaaugaaaaagaaaaaaaaag

SEQ ID NO: 472049 - RNA, 62 nt, hsa
uguauuuugaaaugaugugucaggaaaaguuuuuuaaaaacuuguauguuuuugcaaauccc

SEQ ID NO: 472050 - RNA, 62 nt, hsa
aaguuguggcaaaggaaacuauacuuuucauuuuuaaaaauguaaauagaaaaguuuuuaac

SEQ ID NO: 472051 - RNA, 62 nt, hsa
aaagaagagauaacuuccaaaagagugcuguuuuuaaaaauaauaauuaggaaauguuuauu

SEQ ID NO: 472052 - RNA, 62 nt, hsa
ucuuugauguugacaucaaauaaaguaugugguuuaaaaaaaucuccaaauaccuuuuuuuc

SEQ ID NO: 472053 - RNA, 62 nt, hsa
ucaugcacugaaaaaugcuguuaucuuuuguuuuuaaaaaaugcaauuaaaacuagaaauag

SEQ ID NO: 472054 - RNA, 62 nt, hsa
aaugaagcuuauauuaauuguugcuucaauaguuuaaaaaauuuauggagauagguagguca

SEQ ID NO: 472055 - RNA, 62 nt, hsa
ugccaaauauauguacauauauauuuauauauuuuaaaaauaaacauuuuuuaaaucgucag

SEQ ID NO: 472056 - RNA, 62 nt, hsa
caaaggaggaaacaggaaaaauugccguccauuuuaaaaauuuagguuuguuguuuuaaacc

SEQ ID NO: 472057 - RNA, 62 nt, hsa
uucuuuaaguaauuuaacaacagauuugcuaauuuaaaaaaaaaugaaaaaaaaaaucuuac

SEQ ID NO: 472058 - RNA, 62 nt, hsa
uuuaagaugucuauuauauuuacuuauuaguuuuuaaaaauugcgcuacuugccugggaaac

SEQ ID NO: 472059 - RNA, 62 nt, hsa
aacauagcagaccucguuucuacuaaaaauuuuuuaaaaaagaaaauuagggcaaggugugg

SEQ ID NO: 472060 - RNA, 62 nt, hsa
caugaugugaaaacccaucucuacaaaaauuuuuuaaaaaauaagccagggauuguggcaug

SEQ ID NO: 472061 - RNA, 62 nt, hsa
acuucugaauaagaugauagacgagaauuuuuuuuaaaaaaggaauuuaaaggaaucuugug

SEQ ID NO: 472062 - RNA, 62 nt, hsa
cuuccaaacccaaucuaguaggauguucucauuuuaaaaacgaggggaaaagaccagaguuu

SEQ ID NO: 472063 - RNA, 62 nt, hsa
aaguaauuuaagaauauccaaaaaaauuagacuuuaaaaaguuaucuugguacaacaccgug

SEQ ID NO: 472064 - RNA, 62 nt, hsa
acagcaacugccaaugaaggaugaauccccuuuuuaaaaaguuguuguuguuguuguuuauu

SEQ ID NO: 472065 - RNA, 62 nt, hsa
uuuugaguuaggagggauaauagagaaguccauuuaaaaauuauuuuuagaagcuaaagaaa

SEQ ID NO: 472066 - RNA, 62 nt, hsa
auacaaucauguacucuuuaacagaaauugcuuuuaaaaaauaucuggaacuaucuuuaaaa

SEQ ID NO: 472067 - RNA, 62 nt, hsa
gaaauugcuuuuaaaaaauaucuggaacuaucuuuaaaaaaacuuuauuaauaaucauguau

SEQ ID NO: 472068 - RNA, 62 nt, hsa
uuacauuuuacugauuaacaaauaaauuggaauuuaaaaauaucgauaucaccaugauuuaa

SEQ ID NO: 472069 - RNA, 62 nt, hsa
aauaagaguaaaaauaugugaaucuggauauauuuaaaaaaagaaauuugaugcccagauaa

SEQ ID NO: 472070 - RNA, 62 nt, hsa
gaaaggccuuuuggagugugucuuucuguguguuuaaaaacagugggaaaauccacaccaca

SEQ ID NO: 472071 - RNA, 62 nt, hsa
uucacauuaaguuccccuugcacacuuaccuauuuaaaaaacuaaacuugcacugcaacuga

SEQ ID NO: 472072 - RNA, 62 nt, hsa
ugaggaccaaaccaugcacauaaagcuuguaguuuaaaaaagaaaagcaaaaaaauaauuau

SEQ ID NO: 472073 - RNA, 62 nt, hsa
ggauuuuuugaugcuuugcucuaauggaacuguuuaaaaaauuuuuuuuucuuuuuaauauu

SEQ ID NO: 472074 - RNA, 62 nt, hsa
uuucuuguuggauagaaccuuuguauuuguucuuuaaaaacauuuuuuuuaauguugguaac

SEQ ID NO: 472075 - RNA, 62 nt, hsa
uuugggcugucuguauguuuuuauagcugguuuuuaaaaagcauaauaugccuauagcugaa

SEQ ID NO: 472076 - RNA, 62 nt, hsa
auauugucauacaauguuaaauaaccuauuuuuuuaaaaaaguucaacuuaagguagaaguu

SEQ ID NO: 472077 - RNA, 62 nt, hsa
cuacacaucagaccauaguugcuuaggaaaccuuuaaaaauuccaguuaagcaauguugaaa

SEQ ID NO: 472078 - RNA, 62 nt, hsa
ugaguaacacacauauagugggagucguuuuuuuuaaaaaaauuuuuuaauuaaauucaagu

SEQ ID NO: 472079 - RNA, 62 nt, hsa
uuauuuuugcuauucugaucauuugucccccuuuuaaaaauaaacuucccaugucuuccauu

SEQ ID NO: 472080 - RNA, 62 nt, hsa
uucagguuauugaaaacuuuucauuuuauucauuuaaaaacuagaauaacagauauauaaaa

SEQ ID NO: 472081 - RNA, 62 nt, hsa
uuguaauuuuguaaggccaacuauuuacaaguuuuaaaaauugcuaucauguauauuuacac

SEQ ID NO: 472082 - RNA, 62 nt, hsa
gaagaagaaagaauaaagcuuaguccugugucuuuaaaaauuaaaaauuuuacuugauuccc

SEQ ID NO: 472083 - RNA, 62 nt, hsa
aagcacaagauaaagaacagcuguuaauauuuuuuaaaaaucuauuuuaaaaugugauuuuc

SEQ ID NO: 472084 - RNA, 62 nt, hsa
cgugagccaccaugcccagccucaaauauguuuuuaaaaaauaucauuguccuccuccucuu

SEQ ID NO: 472085 - RNA, 62 nt, hsa
aaaaauacguguuuguuauuugagaaagcauguuuaaaaauugcagaugagaaauauugucg

SEQ ID NO: 472086 - RNA, 62 nt, hsa
ucaaucuuagcuacauauuagccuggcagagcuuuaaaaaauugauaccuggguccuauucc

SEQ ID NO: 472087 - RNA, 62 nt, hsa
uuaaauuguaaauuuucaaaauuaauugauguuuuaaaaauguugagaccaaaguaguauag

SEQ ID NO: 472088 - RNA, 62 nt, hsa
uaaaaaacaaaguugugaaaacaugccuccuuuuuaaaaaauaaccccuccauccaggauau

SEQ ID NO: 472089 - RNA, 62 nt, hsa
aaaauauuuuuuggaagagcugcuaauuuuauuuuaaaaaacaaaguugugaaaacaugccu

SEQ ID NO: 472090 - RNA, 62 nt, hsa
ggucuuuuguguuuaucaaacuuauucuuaaguuuaaaaaagaaauuaaaagggugguuuuu

SEQ ID NO: 472091 - RNA, 62 nt, hsa
uuuaagcaauagauuuugcuuggguuuucuuuuuuaaaaacauaauacugugcaggcaaggc

SEQ ID NO: 472092 - RNA, 62 nt, hsa
gguuuuaaaauugucaagaguuauucuguuuguuuaaaaaauaagaaaccucuuuaagcaau

SEQ ID NO: 472093 - RNA, 62 nt, hsa
gccaaaauauuucagcauauuccagugauaacuuuaaaaauuagauacauuuucuuaacauu

SEQ ID NO: 472094 - RNA, 62 nt, hsa
uuuuuaaggguccuucuuuccagcacauuuuuuuuaaaaacucagguuagaacaaaaauguc

SEQ ID NO: 472095 - RNA, 62 nt, hsa
aaucuuuuuuuuauuuuuaagggaauaaaaauuuuaaaaauuaagagauauacagaugacuu

SEQ ID NO: 472096 - RNA, 62 nt, hsa
ggucaaauucuggaaguaagcauuuccucuuuuuuaaaaauuugguuugagccuuaugccca

SEQ ID NO: 472097 - RNA, 62 nt, hsa
acuucaacuugcauucucagaaugauagugccuuuaaaaauuuuuuuauuuuuuaaagcaua

SEQ ID NO: 472098 - RNA, 62 nt, hsa
acagaagcuaauuagcaaguuuuuaagaaguauuuaaaaaucuuacuaggauugacauuuuu

SEQ ID NO: 472099 - RNA, 62 nt, hsa
agcccaauuaccagaaacaucaugaaagauauuuuaaaaacuaauuauuuacuacaguguau

SEQ ID NO: 472100 - RNA, 62 nt, hsa
gagauauggaaggaugccuuuuuuucucugcauuuaaaaaaaucccccagcacuucccacag

SEQ ID NO: 472101 - RNA, 62 nt, hsa
augggacacauggucugucaaugagagcauaauuuaaaaauauauuuauaaggaaauuuuac

SEQ ID NO: 472102 - RNA, 57 nt, hsa
auuccauuuugugguguuaagugucuuuuuaaaaauuguuauuuaaauccugaagag

SEQ ID NO: 472103 - RNA, 62 nt, hsa
agaauggaauaucagaguacauuuucaugaaguuuaaaaaucaaggacuguuccugauuaga

SEQ ID NO: 472104 - RNA, 62 nt, hsa
uguuauaaugccauuagcaguuacuuaaaugcuuuaaaaauugcugauuaguuuucaauguc

SEQ ID NO: 472105 - RNA, 62 nt, hsa
cagauucaguguguggaacaggaaggaugugcuuuaaaaaaagguggaaucccucaaaaaau

SEQ ID NO: 472106 - RNA, 62 nt, hsa
aaaggcuaauggcauuuuaaacaucuuacauuuuuaaaaauuuauauugccucugccaaaca

SEQ ID NO: 472107 - RNA, 62 nt, hsa
uccucuugccuuuuacuuaaauuccucugacuuuuaaaaauggugacacucuuaucguaaag

SEQ ID NO: 472108 - RNA, 62 nt, hsa
auuugaacuacuuaaacaguauuaaagcccuuuuuaaaaagcaccuauuugggaucauuuga

SEQ ID NO: 472109 - RNA, 62 nt, hsa
cugaauuugaacagcucaccacugugccuacauuuaaaaauacuucucucucuuuucuaaaa

SEQ ID NO: 472110 - RNA, 62 nt, hsa
acugcaguucauccgcacuguaaauacauguauuuaaaaaaacaaucccaaguaaaaauuuc

SEQ ID NO: 472111 - RNA, 62 nt, hsa
aacucuuucuuuccguuuuuuuuucuuuuucuuuuaaaaaaugucuucuuauuuugguuuca

SEQ ID NO: 472112 - RNA, 62 nt, hsa
ugacugaacauuaguugcacuaacugcugguuuuuaaaaaauguuuucuggggaaaggggac

SEQ ID NO: 472113 - RNA, 62 nt, hsa
agggacaucuuuggaaaacgcugguuuugguuuuuaaaaagcccaacuuuuuuuuuuuaauu

SEQ ID NO: 472114 - RNA, 62 nt, hsa
ccuuccccgugguggccccgcucccuaaauuuuuuaaaaagacaaaaacaaaacaacaacaa

SEQ ID NO: 472115 - RNA, 62 nt, hsa
uagagauguagcgauguaagugucgauguuuuuuuaaaaaaaaaugcaaaaaaauucuuaug

SEQ ID NO: 472116 - RNA, 62 nt, hsa
agcaagaugaaaaaaaggaaaagcaggugcuuuuuaaaaaucagaacugagguagcuuagag

SEQ ID NO: 472117 - RNA, 62 nt, hsa
guuuauacacuggaaauguugcguuuaugcuuuuuaaaaacacacguuaacuucagaggaag

SEQ ID NO: 472118 - RNA, 62 nt, hsa
aacagagaaagagacuaauguguccaaucauuuuuaaaaaucauccaugaaaaagugucuug

SEQ ID NO: 472119 - RNA, 62 nt, hsa
guuuaaucuuuuuaaaaaagguuuaaacuuuuuuuaaaaaaaaaaucuuuaaacuggccuuu

SEQ ID NO: 472120 - RNA, 62 nt, hsa
guaccuuuuugcuagccugauuguuuaaucuuuuuaaaaaagguuuaaacuuuuuuuaaaaa

SEQ ID NO: 472121 - RNA, 62 nt, hsa
uauuuuacagggcuaacauaaagcuggcuccauuuaaaaacuggaguacuuccuagugcagc

SEQ ID NO: 472122 - RNA, 62 nt, hsa
augacuucuaaugcuuauaucucaagguauuuuuuaaaaaagcaacggucccuaauagagua

SEQ ID NO: 472123 - RNA, 62 nt, hsa
caagauaugcaaaaacaaugcaauaauauucauuuaaaaauacaauugugaguuguguuggc

SEQ ID NO: 472124 - RNA, 62 nt, hsa
aauugugaguuguguuggcauuaaaacuguauuuuaaaaaaagacagaaauuuaagggaaaa

SEQ ID NO: 472125 - RNA, 62 nt, hsa
cuguugggucuuggcugaaaaaaaaaaaugcuuuuaaaaaagauaaaaugaaaaggagagcu

SEQ ID NO: 472126 - RNA, 62 nt, hsa
uacacaaauauuccaggauacaaaaaaaaacauuuaaaaauccgagacccagaacacuucug

SEQ ID NO: 472127 - RNA, 62 nt, hsa
cuugaugaagcaaggaagauauacaugaaaauuuuaaaaauacauaucgcugacuucaugga

SEQ ID NO: 472128 - RNA, 62 nt, hsa
uaaugucccuuucagagacagcugauacuucauuuaaaaaaaucacaaaaauuugaacacug

SEQ ID NO: 472129 - RNA, 62 nt, hsa
cuaaaguuuguuagauagcugcauguggcuuuuuuaaaaaagcaacagaaaccuauccucac

SEQ ID NO: 472130 - RNA, 62 nt, hsa
guuccacgauacauaaaucauuucucauuugcuuuaaaaaauuuaaaaguguaaaaauuaug

SEQ ID NO: 472131 - RNA, 62 nt, hsa
auccauuugaucuauagcaaugugauuuuauuuuuaaaaagaaaagcaguguguuuucuuuu

SEQ ID NO: 472132 - RNA, 62 nt, hsa
ggugguaguuguauucuaaaugauguagaagguuuaaaaauaauuacauuaugcuucuauuc

SEQ ID NO: 472133 - RNA, 62 nt, hsa
cagauguuaaaccuuuuaauguuuugauuugcuuuaaaaauggccuuccuacacauuagcuc

SEQ ID NO: 472134 - RNA, 62 nt, hsa
uaaauguuugagaaugcauaaaauuauaccaauuuaaaaauauaaauuuuugccacuguuuu

SEQ ID NO: 472135 - RNA, 62 nt, hsa
uuuaaaaugucaaauauauaauauguaauuuuuuuaaaaaccaccagauacagaaaugugcu

SEQ ID NO: 472136 - RNA, 62 nt, hsa
augaagacaauuucuguaaugguuuuaagagauuuaaaaagaaauucacugguucuuuacaa

SEQ ID NO: 472137 - RNA, 62 nt, hsa
gagauuuucucaccccacaucgcuccccuuuuuuuaaaaaggacuguuuugcuagugugaua

SEQ ID NO: 472138 - RNA, 62 nt, hsa
ucugaucucugagugaaucccuuuguucucuguuuaaaaaaaucuaaaaagaaaaaggaaaa

SEQ ID NO: 472139 - RNA, 62 nt, hsa
auuuacaaaaccguuuaagcugguuugaauaauuuaaaaaaguuucagcacaccuauacccc

SEQ ID NO: 472140 - RNA, 62 nt, hsa
uuucuauucaccguacuuauccaaaaaucucuuuuaaaaaguaaauuugugcaacaacguuu

SEQ ID NO: 472141 - RNA, 62 nt, hsa
caguuugaaacuauucauuucuacacacuauuuuuaaaaauugccuacuaggugaaacauaa

SEQ ID NO: 472142 - RNA, 62 nt, hsa
ccugugcugaaauuugggggaaguuuagguccuuuaaaaaaacauauuaaucauugacuaca

SEQ ID NO: 472143 - RNA, 62 nt, hsa
uuaaaguagaaauuuaauuuguagauauaaccuuuaaaaauuuucucauuaagacaauguuu

SEQ ID NO: 472144 - RNA, 62 nt, hsa
aguuuauuuauuugguucuuuagauggaggaauuuaaaaaaucaaauuuuucucuucaccuu

SEQ ID NO: 472145 - RNA, 62 nt, hsa
uucagccuguuucuaaaagcugaaaaucucaguuuaaaaaucaaaauguuaacacaaagcua

SEQ ID NO: 472146 - RNA, 62 nt, hsa
aaucguauuauuuuuuucuuaacagaaauauuuuuaaaaaugaaaaaguacucaaaagugag

SEQ ID NO: 472147 - RNA, 62 nt, hsa
ucaccaucuccugaagaccuuucuuaccuuuuuuuaaaaacaaaaaaugaaauuauuuugca

SEQ ID NO: 472148 - RNA, 62 nt, hsa
guauugaagauugaaaggguuuuucuuucuuuuuuaaaaaagaaaaacaaacuauugauugu

SEQ ID NO: 472149 - RNA, 62 nt, hsa
uauuuuccucaauggcaaauuuuaaauuaguuuuuaaaaacuuacuuauuuggguaguuaaa

SEQ ID NO: 472150 - RNA, 62 nt, hsa
auaucuauaaaucugaaguuuaacaugauuaauuuaaaaaguauuuagugcuugacaaagua

SEQ ID NO: 472151 - RNA, 62 nt, hsa
accuuggaaaaguuauuucccuuuguaauaccuuuaaaaauccagaguauuauauucauuuu

SEQ ID NO: 472152 - RNA, 62 nt, hsa
guaaauuauuuauuuauguuagcauuuaaaaguuuaaaaaaaaugcauuugaccaggauaaa

SEQ ID NO: 472153 - RNA, 62 nt, hsa
ucauauaaugacuuuuuuuuaagagucucuuuuuuaaaaaaacuuaauucucuaaaaccgaa

SEQ ID NO: 472154 - RNA, 62 nt, hsa
auucucuaaaaccgaaaugguucaugcuucuuuuuaaaaaugauuguauaaaauguauggaa

SEQ ID NO: 472155 - RNA, 62 nt, hsa
gaagucaacauuuaugaaauauugccugacuauuuaaaaagaaaaaaguagcucuccauuau

SEQ ID NO: 472156 - RNA, 62 nt, hsa
uaugcucuuuuuacuuaaguuuuaauuuguccuuuaaaaaaaggugaaacaaaccaagaaca

SEQ ID NO: 472157 - RNA, 62 nt, hsa
cauuauauucuaaucuugaauauucuaccauauuuaaaaauaucucaagguuucuguucauu

SEQ ID NO: 472158 - RNA, 62 nt, hsa
aucuuaaaauugcugaauuuacccucauauucuuuaaaaaacuuaaagcauuaugaauguag

SEQ ID NO: 472159 - RNA, 62 nt, hsa
uugcauguuuuucagaugcuuucaaaucuuuuuuuaaaaaaauaguguaaaauauuuuaaua

SEQ ID NO: 472160 - RNA, 62 nt, hsa
uauaguuaaaacauuuguucuacaaauuaaccuuuaaaaauauaauuacugcuaaaaauaga

SEQ ID NO: 472161 - RNA, 62 nt, hsa
caucaaauaaaaauggaaaaaaugaucauggcuuuaaaaaaaaaacaaaaacacacacacau

SEQ ID NO: 472162 - RNA, 62 nt, hsa
uuuaauuguaaaagccguuaauguagaaaacuuuuaaaaaaauuaauauggcagaauacgag

SEQ ID NO: 472163 - RNA, 62 nt, hsa
augauuugccugugacuuauuuuuaaaacuuuuuuaaaaaagauuuagcuuuaaaauaguug

SEQ ID NO: 472164 - RNA, 62 nt, hsa
ucuuagagguuuuuugcacucuuuaaauuugcuuuaaaaauauugugucugugugcauaguc

SEQ ID NO: 472165 - RNA, 62 nt, hsa
ccugaucuuuccuaauccucacuuuuuucuuuuuuaaaaagcaguuucuccacugcuaaaug

SEQ ID NO: 472166 - RNA, 62 nt, hsa
acuguuauaaaguauaacaacacacaucagguuuuaaaaagccuugaauggcccuugucuua

SEQ ID NO: 472167 - RNA, 62 nt, hsa
uuuuugccuugguauacauuuuaaaauaugaauuuaaaaaauuuuuguaaaaauaaaauuca

SEQ ID NO: 472168 - RNA, 62 nt, hsa
acaucagauuaaauaauuacacuguucaggcuuuuaaaaaaauaccacugugagaauaaagc

SEQ ID NO: 472169 - RNA, 62 nt, hsa
uaaagcgcuagcaagauacaucacuuacugauuuuaaaaauacagaaagauuuugaguaaau

SEQ ID NO: 472170 - RNA, 62 nt, hsa
uauguaaguuauuaaaugguuaaucauggccuuuuaaaaauaaaauaaagugauaccuuuac

SEQ ID NO: 472171 - RNA, 62 nt, hsa
acauuaauuuuauuuuuucagacauacuguaauuuaaaaauuaaugugagcguuuguuuuaa

SEQ ID NO: 472172 - RNA, 62 nt, hsa
caucuaauuuccugcuuaccuuaacugggaauuuuaaaaaguuggccuaaaaauguuccaug

SEQ ID NO: 472173 - RNA, 62 nt, hsa
gcauuucuuaaaaaagaguaauaaaaaggauuuuuaaaaaguaauuccuuaaacauaccauc

SEQ ID NO: 472174 - RNA, 62 nt, hsa
caauucaacacaucaucuguuacuaacgcagcuuuaaaaaaugcauaaacgauuauacuaca

SEQ ID NO: 472175 - RNA, 62 nt, hsa
aaaugcauaaacgauuauacuacauuaauuuuuuuaaaaaguauccuguuuauggucugauu

SEQ ID NO: 472176 - RNA, 62 nt, hsa
gcugggaugauggagaaagcucgaggugaaguuuuaaaaaaaaaguuguggaaaggaaaguu

SEQ ID NO: 472177 - RNA, 62 nt, hsa
gaaagaauuaucuggcacauuagguauuggaguuuaaaaaaaaagccaaauuucacagucuu

SEQ ID NO: 472178 - RNA, 62 nt, hsa
aaaagccaaauuucacagucuuaauaacuuuuuuuaaaaaaaacuaaaaggcgcuucauguc

SEQ ID NO: 472179 - RNA, 62 nt, hsa
aaaacccccuuccaggagaggaugggcaggcauuuaaaaaguaccauuuuugugguuguuug

SEQ ID NO: 472180 - RNA, 62 nt, hsa
auacuuuuauaagaugagcugaauccucuuacuuuaaaaacuggucuuuuuauuuacccucu

SEQ ID NO: 472181 - RNA, 62 nt, hsa
acacuuaaucuuagcggauuacuucagauguuuuuaaaaaguauauuaagaugccuuuucac

SEQ ID NO: 472182 - RNA, 62 nt, hsa
caacaggcgcucacugaaguguaugaauauuuuuuaaaaagguuuuugcaguaagcuagucu

SEQ ID NO: 472183 - RNA, 62 nt, hsa
auucuuuauagaaaugugaacacugaauuuauuuuaaaaaauaauaauaaaaauuuaaaaaa

SEQ ID NO: 472184 - RNA, 62 nt, hsa
acugaauuuauuuuaaaaaauaauaauaaaaauuuaaaaaaauuaaaaauaaaaaaaaccac

SEQ ID NO: 472185 - RNA, 62 nt, hsa
auauuuuccaacagcugaaguagggauaguuuuuuaaaaaauuuaaugauggguaaucaaaa

SEQ ID NO: 472186 - RNA, 62 nt, hsa
guaaucaaaacauucacauuuauucugcuggauuuaaaaauauguacuuuuuuuuuuuuuuu

SEQ ID NO: 472187 - RNA, 62 nt, hsa
uucugcccucccuauuuuuaacuagaugauguuuuaaaaauuacuuuucccucucuauauag

SEQ ID NO: 472188 - RNA, 62 nt, hsa
cccugagugcucauguaccauuuagcuuguguuuuaaaaaucuacuuuuucugcccucccua

SEQ ID NO: 472189 - RNA, 62 nt, hsa
gguaucacguaaaauuuuuuccaaaggguuacuuuaaaaaucuguuaccacaauuaugagau

SEQ ID NO: 472190 - RNA, 62 nt, hsa
aacccccuauuuucaggggguuaaaaaucagcuuuaaaaaaauacauaaaaauuucaucuua

SEQ ID NO: 472191 - RNA, 62 nt, hsa
uuuugcccucuuuggggaaguggguggguagauuuaaaaaaucccuuccugaguaauaaaga

SEQ ID NO: 472192 - RNA, 62 nt, hsa
uuauuaagacuggcuuuagaaccguagguuuuuuuaaaaaauuauuauuuauuuuugcccuc

SEQ ID NO: 472193 - RNA, 62 nt, hsa
gccuuaaagacaaaaauccuuguugaaguuuuuuuaaaaaaagcuaaauuacauagacuuag

SEQ ID NO: 472194 - RNA, 62 nt, hsa
uugcuuuuguuucuuaagaaaacaaacucuuuuuuaaaaauuacuuuuaaauauuaacucaa

SEQ ID NO: 472195 - RNA, 62 nt, hsa
uauuaccuaaauauugccacacuauuuugugauuuaaaaauucuuacuaaggaauaaaaacu

SEQ ID NO: 472196 - RNA, 62 nt, hsa
gcuugguacaagcuuaugcugucuuaaauuauuuuaaaaaaauaaauacugucugugagaaa

SEQ ID NO: 472197 - RNA, 62 nt, hsa
aaugauaguggauaauagacaaagugaaaacauuuaaaaaggaagagaaacuucagccuuuc

SEQ ID NO: 472198 - RNA, 62 nt, hsa
aauuugaauauacauauauauauauauguauauuuaaaaagugaauauaauuugaggcacag

SEQ ID NO: 472199 - RNA, 62 nt, hsa
aauguuuuauacauuuuuggagauaguaaaaauuuaaaaauguaauagggaaaauauuuaau

SEQ ID NO: 472200 - RNA, 62 nt, hsa
ucugugacuugauauuuuguuuuauuuggcuauuuaaaaacauaaaucuaaaaugucuuaug

SEQ ID NO: 472201 - RNA, 62 nt, hsa
aaagaaaaaauaaacuuuauguauuaguguccuuuaaaaauagacuuugcuaacuuacuagu

SEQ ID NO: 472202 - RNA, 62 nt, hsa
auuuuacacaucauaccuagcagguaauaaaauuuaaaaaauaaaaauuaaauauuagaaug

SEQ ID NO: 472203 - RNA, 62 nt, hsa
auuaaaaggguagacacaguugagaguuuuauuuuaaaaagcuaagucuuauaauuaugacc

SEQ ID NO: 472204 - RNA, 62 nt, hsa
aagaaaaucuuaagugauugaugcuguuuucuuuuaaaaaaaaaaaaaaaaauucauuuucu

SEQ ID NO: 472205 - RNA, 62 nt, hsa
aaugcagugacuuauacuaagacaauuuauuguuuaaaaaaaaaauuggcaagacaacuaua

SEQ ID NO: 472206 - RNA, 62 nt, hsa
cuaaggcaaauugaaaauuagaaugguugugguuuaaaaagacauuaagugaauucuaggua

SEQ ID NO: 472207 - RNA, 62 nt, hsa
gaaaagugacacuucaaaagugugcuuacauuuuuaaaaagacaaauaaaaacaguguuuua

SEQ ID NO: 472208 - RNA, 62 nt, hsa
uuucaguuuggagcuuuuaggcauuauguauauuuaaaaaauauauucuucaaaaaugcauu

SEQ ID NO: 472209 - RNA, 62 nt, hsa
uaaagagaaaaacucauucagaaaucauggauuuuaaaaauauuuuacugcagccaaguuuu

SEQ ID NO: 472210 - RNA, 62 nt, hsa
ucaaaugcaauacuuuggguugguuucuuuccuuuaaaaaaauuuguauaaaacuggaagug

SEQ ID NO: 472211 - RNA, 62 nt, hsa
aaucugggaaagacaccaaaucaugggcucacuuuaaaaaaagaaagaauaaaaaaaccuuc

SEQ ID NO: 472212 - RNA, 62 nt, hsa
cuugaugcuccugucaaaagggaaaugaggcuuuuaaaaauaaaguaccuuaauucuuuauu

SEQ ID NO: 472213 - RNA, 62 nt, hsa
aaacccacccacuucucuugcccaggcugcuuuuuaaaaauauuuuuuuauuuuuuacuuau

SEQ ID NO: 472214 - RNA, 62 nt, hsa
uccaguugugaagcuggagaagagaaauggguuuuaaaaauuaagugaggggaggccgggug

SEQ ID NO: 472215 - RNA, 62 nt, hsa
gcaucccaaauguuuuuaaucuuuguauauuuuuuaaaaauccuuuucuccucaucauugcc

SEQ ID NO: 472216 - RNA, 62 nt, hsa
cuaauagccaaauagauaacacuaaugcuuuguuuaaaaaaacgaaaaaaacaaaacaaaac

SEQ ID NO: 472217 - RNA, 62 nt, hsa
aagacacacuuguacgaauguagauuuauuuuuuuaaaaaaaaaaaagcaaagcuuucugcc

SEQ ID NO: 472218 - RNA, 62 nt, hsa
uuuaaaaauuaggcuuauugcuagacuguaaguuuaaaaacaauucauguucaaaggagcuu

SEQ ID NO: 472219 - RNA, 62 nt, hsa
cugauuguacagggagaaauuaagcauucuguuuuaaaaauuaggcuuauugcuagacugua

SEQ ID NO: 472220 - RNA, 62 nt, hsa
cauuaaagagaaaauuucacauuaaaggaagguuuaaaaaucuauuuucagauuauaaaagg

SEQ ID NO: 472221 - RNA, 62 nt, hsa
agguuaauaauguccucaucuccuacucuccauuuaaaaaacaaacuucauuguaguaaauu

SEQ ID NO: 472222 - RNA, 62 nt, hsa
uaaaacauuaauaguuuaagcagcaucauuuuuuuaaaaaauguaauugaauaagugugaau

SEQ ID NO: 472223 - RNA, 62 nt, hsa
uuaaaauuaugcagggccccuaugugggauuuuuuaaaaagcaaacugguguguauucucau

SEQ ID NO: 472224 - RNA, 62 nt, hsa
cagcucugggggaauggugucauccaccucgcuuuaaaaauaagcacaugauggcugggcac

SEQ ID NO: 472225 - RNA, 62 nt, hsa
auuuugcacaaacuauuugcagucucuguguauuuaaaaaguaaagaaaguugcauccagaa

SEQ ID NO: 472226 - RNA, 62 nt, hsa
uuuuaguucuauggauggaaauauuucaugcuuuuaaaaagauguuuguguuccugugguua

SEQ ID NO: 472227 - RNA, 62 nt, hsa
aacuuaaaaaaaauuuaaaaaauaaaaaaaguuuuaaaaacugaucaaguuagugugugucu

SEQ ID NO: 472228 - RNA, 62 nt, hsa
guagauaauauaaaauaaaaacuuaaaaaaaauuuaaaaaauaaaaaaaguuuuaaaaacug

SEQ ID NO: 472229 - RNA, 62 nt, hsa
auuugaaagaauacaaaaauaugugaaguucauuuaaaaaaauaacuacaguauagcgcugg

SEQ ID NO: 472230 - RNA, 62 nt, hsa
uuuugugcaaaaauaaaugaauggcaauagauuuuaaaaaaucuuauuauguacuucugugu

SEQ ID NO: 472231 - RNA, 62 nt, hsa
acacaaaaaauaaaaaaccccuacaaaaaaacuuuaaaaaaaauggcagcaaaggguaguuu

SEQ ID NO: 472232 - RNA, 62 nt, hsa
uuuguaucuaauguguacaguguaaaauugacuuuaaaaauauugcagugcuauuuuuucuu

SEQ ID NO: 472233 - RNA, 62 nt, hsa
guacuugaaguugagccuuuguggugggacuuuuuaaaaaaaugccuuuuuaaagcauuaau

SEQ ID NO: 472234 - RNA, 62 nt, hsa
guggguuaccugaacuccauaaucugggacuuuuuaaaaauaagaaccagcucaaguacaug

SEQ ID NO: 472235 - RNA, 62 nt, hsa
cuuuuuaaaaauuuuccaaaacuuuucuccauuuuaaaaagcccuguuauaaacguugaacu

SEQ ID NO: 472236 - RNA, 62 nt, hsa
gauccuguacucuaauaaaucauaaguuucuuuuuaaaaauuuuccaaaacuuuucuccauu

SEQ ID NO: 472237 - RNA, 62 nt, hsa
cuccauuuuaaaugacuacuuuuauuuuuuaauuuaaaaaaucuacuucaguaucaugagua

SEQ ID NO: 472238 - RNA, 62 nt, hsa
gacuuguucuacauuguaaauacaauucaguuuuuaaaaaauaaagcuuaauagcuuccaua

SEQ ID NO: 472239 - RNA, 62 nt, hsa
uuaugcucaggaaucucuuguauauuuuacuauuuaaaaagcauuauuuuuaaauaguaucu

SEQ ID NO: 472240 - RNA, 62 nt, hsa
gaaaggggucaccgugucugacaaaguguaacuuuaaaaagcacguugauuuuuuacaaaug

SEQ ID NO: 472241 - RNA, 62 nt, hsa
uucccacaaccgaguucuaguucccugaggucuuuaaaaacaaaaacagaauguuguacgug

SEQ ID NO: 472242 - RNA, 62 nt, hsa
aaauauaaugcuaguccuagauuacuuauugauuuaaaaacaaaaaaaagauuacuuaauuu

SEQ ID NO: 472243 - RNA, 62 nt, hsa
uuaaaaacaaaaaaaagauuacuuaauuuugauuuaaaaacaaaaaaucguaaaauacaaaa

SEQ ID NO: 472244 - RNA, 62 nt, hsa
aauuuuuuuaauauauaggucuuaaguggugcuuuaaaaagaacccucacaaguuaaaaauu

SEQ ID NO: 472245 - RNA, 62 nt, hsa
aaauauuagaaauagcacaaagucauggaguuuuuaaaaauuguuauaauuaaguaaaaaua

SEQ ID NO: 472246 - RNA, 62 nt, hsa
aucuuuccaaauaacauuuaauuauaauguuuuuuaaaaaauauauuccucuucagucauug

SEQ ID NO: 472247 - RNA, 62 nt, hsa
ucuuauacuuucuccuaggaaaacuuuaaaacuuuaaaaaggcaaaccuaccaauaggaaua

SEQ ID NO: 472248 - RNA, 62 nt, hsa
agugaacugguacaauguggucccucucaauauuuaaaaauauaauuuguaacagugcuuac

SEQ ID NO: 472249 - RNA, 62 nt, hsa
ucuuaggcagcucugcacuucauguucaguuuuuuaaaaauagacuguaguauccuuucauu

SEQ ID NO: 472250 - RNA, 62 nt, hsa
aaaacacaacagucauuaucugugaaccauaauuuaaaaaucuuucuagaauaacaacagca

SEQ ID NO: 472251 - RNA, 62 nt, hsa
uugguccuuuaauaaguaaagaaaauaauauguuuaaaaauguaaauguuuuacaaauuuga

SEQ ID NO: 472252 - RNA, 62 nt, hsa
ucugacaucagaaaauaaaauugaggcugauuuuuaaaaauuucuaguagauuuuuggccuu

SEQ ID NO: 472253 - RNA, 62 nt, hsa
aaauuucuaguagauuuuuggccuuuccuguuuuuaaaaaucaguuucauuuucauauuuca

SEQ ID NO: 472254 - RNA, 62 nt, hsa
acuguuuucuuuuuagaaacccacuguuaaaauuuaaaaaggugcuuuaaaauaaaacgccu

SEQ ID NO: 472255 - RNA, 62 nt, hsa
gugaaaacuuaaauuguaaaacauguugaaauuuuaaaaauuaauguuaauauggaaaugca

SEQ ID NO: 472256 - RNA, 62 nt, hsa
ccauacucaggguguagggagaauacuuugcauuuaaaaacccuguccaccugucaccagca

SEQ ID NO: 472257 - RNA, 62 nt, hsa
acaagauugaaaaucuuguguaaauccugccauuuaaaaaguuguagcagauuguuuccucu

SEQ ID NO: 472258 - RNA, 62 nt, hsa
aggaaaaucacuuugucuaacucagaauuauuuuuaaaaagaaaucuggucuuguuagaaaa

SEQ ID NO: 472259 - RNA, 62 nt, hsa
gggcagauauguauguuauauacaacuauuuuuuuaaaaaacuuauauccauguugggagua

SEQ ID NO: 472260 - RNA, 62 nt, hsa
ggagaauguauuuuuguauuuauaaaucaacuuuuaaaaacugucucauucaaaagggaaua

SEQ ID NO: 472261 - RNA, 62 nt, hsa
ucacaaauagccauugaacaaauguguggguuuuuaaaaauuauauacauauaugaguugcc

SEQ ID NO: 472262 - RNA, 62 nt, hsa
uuuagagggaaggaauaaucauucaaaugaacuuuaaaaaagcaaauuucaugcacugauua

SEQ ID NO: 472263 - RNA, 62 nt, hsa
accucuuacaauaagcuaaacgcaaugucauuuuuaaaaagaaggacuuagggugucguuuu

SEQ ID NO: 472264 - RNA, 62 nt, hsa
aaauauguguuguaugucuuuuuugcuuuuuuuuuaaaaaaaagaauaacuuuuuuugccuc

SEQ ID NO: 472265 - RNA, 62 nt, hsa
agugguguuuugaagaggguauuuuauuguuuuuuaaaaaaagguucuuaaacauuauuuga

SEQ ID NO: 472266 - RNA, 62 nt, hsa
cuguauccuuccuucuaccuauuauucugauuuuuaaaaaugcaguuaauguaccauuuauu

SEQ ID NO: 472267 - RNA, 62 nt, hsa
aauaucuauaaagcaaaaaauguagucucuuguuuaaaaaaucuggagcgggaaugcaagga

SEQ ID NO: 472268 - RNA, 62 nt, hsa
guuagaccacccaauaaaucuagaaaucagcuuuuaaaaauauugucugaagucuaacaaaa

SEQ ID NO: 472269 - RNA, 62 nt, hsa
gugugcuuuuggggagauacacuagcaauuuuuuuaaaaacuggaacagugugauaggaagc

SEQ ID NO: 472270 - RNA, 62 nt, hsa
acuauguaaacaaaaaguagauaguuucacuuuuuaaaaaauccauuacuguuuugcauuuc

SEQ ID NO: 472271 - RNA, 62 nt, hsa
uauacaguaccuacauaguuuuuaaauuauuguuuaaaaaacaaaacagcuguuauaaauga

SEQ ID NO: 472272 - RNA, 62 nt, hsa
cugaccacuuacaauuaaaauauuuugucuucuuuaaaaaaauaaguaaaggagaaauauuu

SEQ ID NO: 472273 - RNA, 62 nt, hsa
uauuugcuguagcagagcuuuauugcaggcauuuuaaaaauugaauaaccaugugaaauaau

SEQ ID NO: 472274 - RNA, 62 nt, hsa
uacccauauuccagacucugagcuguuuccuuuuuaaaaaucauauagacaauuagcuguuu

SEQ ID NO: 472275 - RNA, 62 nt, hsa
gguuguugauuuuguuacuucauacuggaacuuuuaaaaagauuucaucaaauaaaguuuug

SEQ ID NO: 472276 - RNA, 62 nt, hsa
uuuuccuauuauguuugauaauuauauguauuuuuaaaaacugugagaggaaaaauuaguca

SEQ ID NO: 472277 - RNA, 62 nt, hsa
ccuccauuuauauuuuguaucuuaaaauguaguuuaaaaauaggaccauguaugagacacuu

SEQ ID NO: 472278 - RNA, 62 nt, hsa
uuuauugguacauugcaguuuuuuuuuugaaauuuaaaaauuucuguaaaacuuugucuuca

SEQ ID NO: 472279 - RNA, 62 nt, hsa
cuucaaguaaucugacagcauuaaauauugcauuuaaaaauuauacuguagcaaauacauuu

SEQ ID NO: 472280 - RNA, 62 nt, hsa
uugcauuuaaaaauuauacuguagcaaauacauuuaaaaauuaaucacaacguuaagaugaa

SEQ ID NO: 472281 - RNA, 62 nt, hsa
aaaaaagcaaauauaaauuuuuaaugacuccauuuaaaaauaucacagggugggggcaagga

SEQ ID NO: 472282 - RNA, 62 nt, hsa
cuuuuauucauuuauuuaacauacugucuaauuuuaaaaauagguuuuuaaagcuuucauuu

SEQ ID NO: 472283 - RNA, 62 nt, hsa
ucacuaaacuuuuacacacucccaaacgucuuuuuaaaaauugcuugggaaauuauuaaaug

SEQ ID NO: 472284 - RNA, 62 nt, hsa
acuauguucugaaaacacugcauuuaagaauuuuuaaaaauugguuuucuaaaauuaaaaug

SEQ ID NO: 472285 - RNA, 62 nt, hsa
ccugagguguaauuucauuagacuaguuuuaguuuaaaaagaccuucuucagauuggaccaa

SEQ ID NO: 472286 - RNA, 62 nt, hsa
uaucagucauccagaaguacacguuucuguauuuuaaaaaauacuuugaugcauuuauuuuu

SEQ ID NO: 472287 - RNA, 62 nt, hsa
ggacauuuaaccaagauacuaagaagguuuuuuuuaaaaaaagagauuugauuauuuuuccc

SEQ ID NO: 472288 - RNA, 62 nt, hsa
cauuaggcaauuuaugcuuuaauggucaagcuuuuaaaaauuuguauuugauaacauccuga

SEQ ID NO: 472289 - RNA, 62 nt, hsa
uguugauaaaauacgaagaaauuccugcaauuuuuaaaaaacaaguuuggaauuuuuuucag

SEQ ID NO: 472290 - RNA, 62 nt, hsa
guacuuuuaucugucuuugaaagugucugaacuuuaaaaaguuuacauuuuguuucaaauau

SEQ ID NO: 472291 - RNA, 62 nt, hsa
uauuccacuccgcagugcaaacaaucucuuccuuuaaaaaggaauaauaauacaauauuuaa

SEQ ID NO: 472292 - RNA, 62 nt, hsa
aaauauauacaccuaccauguacccauaaaaauuuaaaaagaaauggaauggcaaauaaugg

SEQ ID NO: 472293 - RNA, 62 nt, hsa
agggugacuacagucaacaauaacuuuauacauuuaaaaauaaaagaguguaauugggacgu

SEQ ID NO: 472294 - RNA, 62 nt, hsa
uuagauaaaauugaaguacuuaauugaagcuuuuuaaaaauuguaaaguaaaugaaagcuau

SEQ ID NO: 472295 - RNA, 62 nt, hsa
aaaggaagauguucuguagcaagggggaauauuuuaaaaauaaaccagaucaaauuaauaca

SEQ ID NO: 472296 - RNA, 62 nt, hsa
aaaauugcauuguuauuuuuuuuuaaacucaguuuaaaaagacuaaaacguucuuucaaaag

SEQ ID NO: 472297 - RNA, 62 nt, hsa
uauugcugcacuuuuaaguuuucaaaacaguguuuaaaaauugcauuguuauuuuuuuuuaa

SEQ ID NO: 472298 - RNA, 62 nt, hsa
gucugacccaguuauuaaugaaagaauauggauuuaaaaauuuuuaaacuaaauaauuugug

SEQ ID NO: 472299 - RNA, 62 nt, hsa
gcaaaagucuaaaauacccauuggugauguuuuuuaaaaaaaucuugcuuucagcuuucagg

SEQ ID NO: 472300 - RNA, 62 nt, hsa
caagaaacuugguuauugaauaaacagauaaguuuaaaaaaaaaaaaaaacuacuucaucua

SEQ ID NO: 472301 - RNA, 62 nt, hsa
aaaaguaaaaaaaacaaaaaaaaaacaaaaaauuuaaaaaaaagguuugcuaaucugauagu

SEQ ID NO: 472302 - RNA, 62 nt, hsa
acacauuguucaaacaaucucaagcacuuguguuuaaaaaagguucugaaaucuugcuucuc

SEQ ID NO: 472303 - RNA, 62 nt, hsa
uacccaucuacucccaacauggauauaaguuuuuuaaaaaaauaguuguauauaacauacau

SEQ ID NO: 472304 - RNA, 62 nt, hsa
acucauuugauuucccccacccccgccaaccauuuaaaaaaguuugccggcuaggugcggug

SEQ ID NO: 472305 - RNA, 61 nt, hsa
auuguuuuccuguuuuuccuuacuauaaaucauuuaaaaacugaauucauuuucuuagaug

SEQ ID NO: 472306 - RNA, 62 nt, hsa
ugcuguagaaaauauuccuugaagaugugagauuuaaaaauuuuucccuuucaauguuguua

SEQ ID NO: 472307 - RNA, 62 nt, hsa
augacauuggacuuuuaguaacaaacuuaauuuuuaaaaagguguagacaauggugguuaaa

SEQ ID NO: 472308 - RNA, 62 nt, hsa
caguguuuaaauuagugcuauuuuuccuuguuuuuaaaaaugaaucucguacuguaucuuac

SEQ ID NO: 472309 - RNA, 62 nt, hsa
aaguuuguaccaucuguuugaguauaugcacauuuaaaaaauaucauauaguaaaugcaaac

SEQ ID NO: 472310 - RNA, 62 nt, hsa
uuuuggaauuacauaguuauguaaguaaaauuuuuaaaaaucauaaagggagcaccauugua

SEQ ID NO: 472311 - RNA, 62 nt, hsa
uaaacaauaauugaaaugaaaagcuuaccuauuuuaaaaagccaaauuuaaauaaauauaga

SEQ ID NO: 472312 - RNA, 62 nt, hsa
uagguuuucugaaauguuauauucucuaugcauuuaaaaaaaaauguaaacuugacauuuua

SEQ ID NO: 472313 - RNA, 62 nt, hsa
auuauuuauaauaaaauugcauucaguggcuuuuuaaaaaaauguuugauucaaaacuuuaa

SEQ ID NO: 472314 - RNA, 62 nt, hsa
acaugugccagcugaauuuaaaauauaauacuuuuaaaaagaaaauuauuacauccuuuaca

SEQ ID NO: 472315 - RNA, 62 nt, hsa
ugcucaaaguuuaauucuucuucuugggauauuuuaaaaaugcuacugagauucugcuguaa

SEQ ID NO: 472316 - RNA, 62 nt, hsa
cccuauagauuaauuacaauuggauuucaucauuuaaaaaccauacuuguauauguaguuau

SEQ ID NO: 472317 - RNA, 62 nt, hsa
caacauagggagacccagucucuacaaaaaaauuuaaaaagccaggcauugguggugugugc

SEQ ID NO: 472318 - RNA, 62 nt, hsa
acuccaaucuggcaacagagcgagaccuugucuuuaaaaauaaaaauaaaaacaucuuuaca

SEQ ID NO: 472319 - RNA, 62 nt, hsa
caacuauuaaaagcgccauuuuauuuauuucauuuaaaaaauaaucuaugcagcauuucaag

SEQ ID NO: 472320 - RNA, 62 nt, hsa
ugcuucuugaggugguaaugagaaaaaaguuuuuuaaaaaagugugccuugcuguauuucuu

SEQ ID NO: 472321 - RNA, 62 nt, hsa
aaaguaaauugggaggacuuaauggaaggucuuuuaaaaaguuaacuuggagcuucuguaug

SEQ ID NO: 472322 - RNA, 62 nt, hsa
auagggugguuuuuguuucuguuccuaauuccuuuaaaaaauagggggaauaguauuuuaga

SEQ ID NO: 472323 - RNA, 62 nt, hsa
uuaaacuuaauuucuggccugugacuagaauguuuaaaaaaaaaaaagucggacuaaauguu

SEQ ID NO: 472324 - RNA, 62 nt, hsa
auauacaugcacacacaccgauacauuuaccuuuuaaaaaaaugauuuauaagugaacuguu

SEQ ID NO: 472325 - RNA, 62 nt, hsa
ucuagaaaagaugugguuuguuuuggcacuguuuuaaaaacucaaauauuuuaaacauuugu

SEQ ID NO: 472326 - RNA, 62 nt, hsa
uuuccucucuauucgcuuucuccuguuuuuuuuuuaaaaaaaaagcaugaaaaaggaagaga

SEQ ID NO: 472327 - RNA, 62 nt, hsa
uaauuuuacaugauccucaauaucaacuccaguuuaaaaaguguuauuuuuaaaacauuuga

SEQ ID NO: 472328 - RNA, 62 nt, hsa
aggagauugccuaccaaggacaaaacaauaaauuuaaaaaucaaacgauuucuccauacgcu

SEQ ID NO: 472329 - RNA, 62 nt, hsa
caauagaugacacugaugguuuuacuccuuuuuuuaaaaacacaugcgcgcgcacacacaca

SEQ ID NO: 472330 - RNA, 62 nt, hsa
ccuuucuuauuacuuuccuaauuuuucuauauuuuaaaaacuacaguuuccaugauaaaagg

SEQ ID NO: 472331 - RNA, 62 nt, hsa
gaagccccaaaaaagaaaagugccuugcaucauuuaaaaaaaauaauuaaauccucauggcc

SEQ ID NO: 472332 - RNA, 62 nt, hsa
agccucaucauuagcaacuuuauauacacagcuuuaaaaaauuugcuuuaaacuguuucaga

SEQ ID NO: 472333 - RNA, 62 nt, hsa
gagcugagguagaaaaaaaacaagaaaaaaauuuuaaaaauagcguuaaaaugcauuuuagg

SEQ ID NO: 472334 - RNA, 62 nt, hsa
uuaaguauucaguaaaaugaugguuaacauguuuuaaaaaaucuuuaauggagaaguuaaau

SEQ ID NO: 472335 - RNA, 62 nt, hsa
uauucuuaauaguaugugcagaaguuacaucauuuaaaaaacccuugcuguaaaguaggaua

SEQ ID NO: 472336 - RNA, 62 nt, hsa
aaauacaguuuugaguuauuuugauguggcuuuuuaaaaaaguuaauggguagcuaauguug

SEQ ID NO: 472337 - RNA, 62 nt, hsa
uuuaaauaaaacuucucuacuuuagucuuuacuuuaaaaauauguacuguuuccuuuuuugu

SEQ ID NO: 472338 - RNA, 62 nt, hsa
aaacuguaaauaacuugcccugggggccuuuuuuuaaaaaacaaaaaccacaaaaauuccca

SEQ ID NO: 472339 - RNA, 62 nt, hsa
cuguaauuuauacgguguacuauauaaugggauuuaaaaaaagugcuaucuuuucuauuuca

SEQ ID NO: 472340 - RNA, 62 nt, hsa
gaucaauguuuggaaaauacaacaaugacuuauuuaaaaauuacccuuccugcuauuuagac

SEQ ID NO: 472341 - RNA, 62 nt, hsa
cacaucaaagcuggccaaaauaaugaauuuuuuuuaaaaagcaauaccugguuuccaccuug

SEQ ID NO: 472342 - RNA, 62 nt, hsa
cagugucaacacucugguuuagcaauaauggguuuaaaaacaaacaauuugauccaagcagg

SEQ ID NO: 472343 - RNA, 62 nt, hsa
gcuaucugauuaaguguuuccuuacauuauuuuuuaaaaaccaaaucauuuuucuuuaacua

SEQ ID NO: 472344 - RNA, 62 nt, hsa
caguugcauuaacuauuucaaaaauuacugccuuuaaaaaaaacaaccucaagcuauauuug

SEQ ID NO: 472345 - RNA, 62 nt, hsa
aauuugucaguacauuuuacguguagaagcauuuuaaaaaucauuucuagcaagcacuugac

SEQ ID NO: 472346 - RNA, 62 nt, hsa
uuuuucuuuuuuuuuucuuccagaaugucuuauuuaaaaagaaagcuaaaagcauacuucua

SEQ ID NO: 472347 - RNA, 62 nt, hsa
uccacccaauuuugcuaugagccuaaaaccucuuuaaaaacggucaguuaacuaaaaaauaa

SEQ ID NO: 472348 - RNA, 62 nt, hsa
gacaucugaaagagacguauuaaguuaacauuuuuaaaaauccaaaugaaaguaaauggaau

SEQ ID NO: 472349 - RNA, 62 nt, hsa
gguuuaccaugauuccaaacaaaacuaacuuguuuaaaaauauuuggaguaaaguuuuauuu

SEQ ID NO: 472350 - RNA, 62 nt, hsa
augccacagauucccuuuuaaacuuauuuugcuuuaaaaaaaaaaaaaaagaaaaagaaaau

SEQ ID NO: 472351 - RNA, 62 nt, hsa
acuuuuccuaguuuucaguauuacuuucauguuuuaaaaaucccuuuaauuucuugcuugaa

SEQ ID NO: 472352 - RNA, 62 nt, hsa
cccuuuaacacaaaaaaagcaaggugauguauuuuaaaaaaggaaguggaaauaaaaaaauc

SEQ ID NO: 472353 - RNA, 62 nt, hsa
uauuuuacugcuagcuugcaaaguuaugagaguuuaaaaaauaaaauauaugaaaauaugua

SEQ ID NO: 472354 - RNA, 62 nt, hsa
uggaauuuuucauugaguuauuuccucauucuuuuaaaaaauaagggacuauaaaucaguua

SEQ ID NO: 472355 - RNA, 62 nt, hsa
ugauauuuuccagauuuguuggaucuauuugguuuaaaaaguauucuaucuuaaggccaacu

SEQ ID NO: 472356 - RNA, 62 nt, hsa
cuuuaaaaaaaaaaaagaaucugcgguauuuuuuuaaaaaaaaaguuuaccgcuguagugug

SEQ ID NO: 472357 - RNA, 62 nt, hsa
acuuguuaacuucuuacagcaguaguaccuucuuuaaaaaaaaaaaagaaucugcgguauuu

SEQ ID NO: 472358 - RNA, 58 nt, hsa
aacauggaaaaaauuuuugagcugauuuuuuaaaaauuuaaguuuuguaagagcuuua

SEQ ID NO: 472359 - RNA, 62 nt, hsa
guauuuuuaaaaaugaagguuguuauugcaaguuuaaaaagguaacagaauuuuaacuguug

SEQ ID NO: 472360 - RNA, 62 nt, hsa
aaagcugauaccucaaucuuuacuacuguauuuuuaaaaaugaagguuguuauugcaaguuu

SEQ ID NO: 472361 - RNA, 62 nt, hsa
ugcuacauaaaacacuucuuaaacuuuuuuuuuuuaaaaacugcuccuuguggagcaggacu

SEQ ID NO: 472362 - RNA, 62 nt, hsa
cagguaaauccugguaauuaaaaacgcauguuuuuaaaaauuagccugguaaggccgggugc

SEQ ID NO: 472363 - RNA, 62 nt, hsa
aggaguuauaugucugcuaucuguguugcucauuuaaaaaaaguauacauugaauaaggcug

SEQ ID NO: 472364 - RNA, 62 nt, hsa
uuccagagagaagagaaaacucacccaggaaguuuaaaaauucuuuaaacagguauuuugau

SEQ ID NO: 472365 - RNA, 62 nt, hsa
aucugaaauuuguaauaaaaucaacuucauauuuuaaaaauuccaacuaucugcuugcauug

SEQ ID NO: 472366 - RNA, 62 nt, hsa
aauaucauuuagaguguagauacuuuugccuuuuuaaaaaagccauuauuuuaugagacuua

SEQ ID NO: 472367 - RNA, 62 nt, hsa
cuuuggucauguuuauuaaaccaccagugacauuuaaaaauauauuuuuagcagucguaaug

SEQ ID NO: 472368 - RNA, 62 nt, hsa
gaauaauucuacaugaaguuaaaaguuagcaauuuaaaaaauuuugcugcauaauaaagaua

SEQ ID NO: 472369 - RNA, 62 nt, hsa
ccauaguugcaaguccuuaggaucuuccuuguuuuaaaaaacuaucaaaguagguuaaauua

SEQ ID NO: 472370 - RNA, 62 nt, hsa
cauccauccugaauuuuauaaaugauuuuuuauuuaaaaauuugagauuuuuaaaauuuuuc

SEQ ID NO: 472371 - RNA, 62 nt, hsa
uuaaggacauugaaagcgacauaaauagucacuuuaaaaaggaaaugauucuggaugguucu

SEQ ID NO: 472372 - RNA, 62 nt, hsa
ugaaaauuuuaugacaucuauuauguaucaguuuuaaaaauuagaauuguaugaaauuaaga

SEQ ID NO: 472373 - RNA, 62 nt, hsa
aauuccuaauguccugaguauuaauaauaaaguuuaaaaaugcuuuuauaucaaaggugcau

SEQ ID NO: 472374 - RNA, 62 nt, hsa
cuuugcaaacauaaucauuguucucacccucuuuuaaaaaaaaaaaucggucuucaaagauc

SEQ ID NO: 472375 - RNA, 62 nt, hsa
aaaaaaaaacuuuuuguaacgacuauuugcaguuuaaaaaucaauaaaccccguuuuuucaa

SEQ ID NO: 472376 - RNA, 62 nt, hsa
gguuauuuuauuuuaaaaaaaugaaaaauuaauuuaaaaaaaugcaaaaaacuguuggauua

SEQ ID NO: 472377 - RNA, 62 nt, hsa
uuuguaacuuuacacuuuuuugguuauuuuauuuuaaaaaaaugaaaaauuaauuuaaaaaa

SEQ ID NO: 472378 - RNA, 62 nt, hsa
gcuaaaguuccccaguucauaugugacaucuuuuuaaaaaaaauaacaacaaaaaaaaaaug

SEQ ID NO: 472379 - RNA, 62 nt, hsa
cuuuuguguguuugcugccuguggcauccuuuuuuaaaaagacuguuacauauuaaaauagu

SEQ ID NO: 472380 - RNA, 62 nt, hsa
caggcgugaaccaccgugccuggccggaagucuuuaaaaaauaaagugauucuacucuucua

SEQ ID NO: 472381 - RNA, 62 nt, hsa
uucauuaggggcuuaagcuagcuccuuuggcuuuuaaaaaaaauuuuuuuucaaauuucuuc

SEQ ID NO: 472382 - RNA, 62 nt, hsa
uuuugcuuugcuuuggauaagaaauccuuaccuuuaaaaaaagcuucuagucuccauaaccc

SEQ ID NO: 472383 - RNA, 62 nt, hsa
ugcuucuaauccuuccuuugcuaaaucucaccuuuaaaaacgaaggugacucacuuugcuuu

SEQ ID NO: 472384 - RNA, 62 nt, hsa
aaagucccuauaguauaugauuauaaugcuauuuuaaaaaauauauauauaaaauauuuuuu

SEQ ID NO: 472385 - RNA, 62 nt, hsa
guuaaagguaugauuauaagagagcuuauuguuuuaaaaaguuauauaaaggcaaggaaauu

SEQ ID NO: 472386 - RNA, 62 nt, hsa
aggagagggagggaacagagaugaccuuaacuuuuaaaaaagggacugcugugggccaaagc

SEQ ID NO: 472387 - RNA, 62 nt, hsa
aaaguaaucaucguucaggcccaacccuuagguuuaaaaagucagguuguccaucccauugg

SEQ ID NO: 472388 - RNA, 62 nt, hsa
ugaugaaaacauuucauuaaaagauugcugcauuuaaaaauacaauuaauucguucccuaug

SEQ ID NO: 472389 - RNA, 62 nt, hsa
cucagcauaugccugaggcgaucuuuuaugcuuuuaaaaauguuucccguuggucucauugg

SEQ ID NO: 472390 - RNA, 62 nt, hsa
aucugagacgaauacaacuuuuaaaaauuguuuuuaaaaauagacuuuuuuuuuuagagcag

SEQ ID NO: 472391 - RNA, 62 nt, hsa
gauaauauuuugaaucugagacgaauacaacuuuuaaaaauuguuuuuaaaaauagacuuuu

SEQ ID NO: 472392 - RNA, 62 nt, hsa
ccgauuuggaaccuuagaugucuauuugauuuuuuaaaaaaccuuaauguaagauaugacca

SEQ ID NO: 472393 - RNA, 62 nt, hsa
aaacgaguuuuugagcaaauuaggugacuuguuuuaaaaauauuuaauuccgauuuggaacc

SEQ ID NO: 472394 - RNA, 62 nt, hsa
uaaaauuucugucauauguauacugaagacauuuuaaaaaccagaauauguagucuacggau

SEQ ID NO: 472395 - RNA, 62 nt, hsa
uauauguugucugcuuuaaacaauuuuuaaauuuuaaaaaugcauuaacgucuuuuuauauc

SEQ ID NO: 472396 - RNA, 62 nt, hsa
ugagagaugaaucaauaaugaaacaugucuguuuuaaaaacuaccacaugugacuccuauuu

SEQ ID NO: 472397 - RNA, 62 nt, hsa
uaguguaguuaugauguggauccuacguauuuuuuaaaaaacucuccagauaauuuugaugu

SEQ ID NO: 472398 - RNA, 62 nt, hsa
uucugguuagcuaauugaacuuuugugaccuguuuaaaaacaaaucaaauuuauugaacaaa

SEQ ID NO: 472399 - RNA, 62 nt, hsa
auacuuucagaauuguauuucaguuuugaagauuuaaaaaaaaugugaaaauaaauauauau

SEQ ID NO: 472400 - RNA, 62 nt, hsa
ggacagcgggaaaaaucgaugagcgccaccucuuuaaaaacucacuuacguuuguccuuuuu

SEQ ID NO: 472401 - RNA, 62 nt, hsa
ugcucuuuuaaauguuugguuuauauauuuucuuuaaaaauccugggcuggcacauugacug

SEQ ID NO: 472402 - RNA, 62 nt, hsa
ugugauuauuuauauuuauguugaaagcggacuuuaaaaaaaauaaugugcuguaacacagu

SEQ ID NO: 472403 - RNA, 62 nt, hsa
uuguagccuggauagcagacuguguucaacuuuuuaaaaagauguuuccuuucuaaagauua

SEQ ID NO: 472404 - RNA, 62 nt, hsa
uaagcauauuacucuggagcuuuguauuauucuuuaaaaaugaaucuugcuucauuugauga

SEQ ID NO: 472405 - RNA, 62 nt, hsa
agcugaagaccucacuggagugggucuuaauuuuuaaaaagugucucacuacauuuaagaca

SEQ ID NO: 472406 - RNA, 62 nt, hsa
gcuaaucuuuaauauaauauuauacugcuauauuuaaaaagcugacuacuugauauaauuac

SEQ ID NO: 472407 - RNA, 62 nt, hsa
uuaaugugcugcugcuuuuccauaaccaacauuuuaaaaauaaaugaaaaacaggaauuggg

SEQ ID NO: 472408 - RNA, 62 nt, hsa
augucauguuauuaacaguuauuagguugucauuuaaaaauaaaguuccuuuauauuucugu

SEQ ID NO: 472409 - RNA, 62 nt, hsa
uuauuuuaugagccccaguuuucugggcuuaguuuaaaaaaaaaaucaagucuaaacauugc

SEQ ID NO: 472410 - RNA, 62 nt, hsa
aagcuuuuguucuuggauaaaaagucauacacuuuaaaaaaaaaaaaaacuuuuuccaggaa

SEQ ID NO: 472411 - RNA, 62 nt, hsa
auucaguauucuuuuaucauaaauuuuuagcauuuaaaaauucacugauguacauuaagcca

SEQ ID NO: 472412 - RNA, 62 nt, hsa
cuuaucuuuguuccucuuuacauaauguuccuuuuaaaaaaaaucacugauuaugaugugcc

SEQ ID NO: 472413 - RNA, 62 nt, hsa
uugucucacagcucacuuguauucuguugacuuuuaaaaaauuaugcuuucuguuucacugu

SEQ ID NO: 472414 - RNA, 62 nt, hsa
ccuccccaaaagaaaccaugacaaaccuagcuuuuaaaaaauauuuuaagaaagagaaugaa

SEQ ID NO: 472415 - RNA, 62 nt, hsa
ccuuuguauuauaauuguugauauuuucccuuuuuaaaaaauaccauugaaaucagcaugac

SEQ ID NO: 472416 - RNA, 62 nt, hsa
ugauucaguaucuuagaguuuacaguuuguguuuuaaaaaaacugaagguuuuuuuuuuaag

SEQ ID NO: 472417 - RNA, 62 nt, hsa
guuuuuugguuuuuguuuuuuguuuucuuguuuuuaaaaaaaggauuucacagugagaaagu

SEQ ID NO: 472418 - RNA, 62 nt, hsa
cacuucuuuuaagguuuaccccuguggugugguuuaaaaaucuauaggccugggaauuccga

SEQ ID NO: 472419 - RNA, 62 nt, hsa
gagcauauaacuucugauuugauaguauuuauuuuaaaaaauuauguuuucaucauucauuu

SEQ ID NO: 472420 - RNA, 62 nt, hsa
uuugugaacugagagcagcaacaacauuauuuuuuaaaaaucuuaaauccucucaauggaug

SEQ ID NO: 472421 - RNA, 62 nt, hsa
uuauuacugcuugagguugagccuuuugaguauuuaaaaaauauauaccaacagaacuacuc

SEQ ID NO: 472422 - RNA, 62 nt, hsa
ggaaggaaaaaaaaagaaaaaauuuaaaaaauuuuaaaaauauaacgagggauaaauuuuug

SEQ ID NO: 472423 - RNA, 62 nt, hsa
acaaaaaaaaggaaggaaaaaaaaagaaaaaauuuaaaaaauuuuaaaaauauaacgaggga

SEQ ID NO: 472424 - RNA, 62 nt, hsa
aaggaauuuggguaauuuuuaauuuuuuguuuuuuaaaaaauaaccuagacuaugcaaaaca

SEQ ID NO: 472425 - RNA, 62 nt, hsa
aagaagcuuaggggcaagguucauucuccugcuuuaaaaagugcaugaacuguagugcuuua

SEQ ID NO: 472426 - RNA, 62 nt, hsa
uauguucauuauuuguacauaaaauaaaaccauuuaaaaaguaaugcugauauuuauucuuu

SEQ ID NO: 472427 - RNA, 62 nt, hsa
agcgccuuuuaaaaguuguuaugugguuuucuuuuaaaaagcuccuguuuuuggaaaguaga

SEQ ID NO: 472428 - RNA, 62 nt, hsa
acuguuacauuaagugcaucuguguauccugguuuaaaaaaauguaaucuuuuuugaaauaa

SEQ ID NO: 472429 - RNA, 62 nt, hsa
gacuugcuugagaguucugucagacuuuucuuuuuaaaaauuuaacaugauugcuuuucuca

SEQ ID NO: 472430 - RNA, 62 nt, hsa
gaugaauguuacagguuaauaaaguuaauaccuuuaaaaacuuggugaaauuccauuacaga

SEQ ID NO: 472431 - RNA, 62 nt, hsa
auaacuugaggacuguaccauggaaaacuaaauuuaaaaaaacaguuauaacaguguuuaau

SEQ ID NO: 472432 - RNA, 62 nt, hsa
auaauucauugguaaaguguaauaaugcguuuuuuaaaaaugcuuugagagguaauuacuug

SEQ ID NO: 472433 - RNA, 62 nt, hsa
uccauccuugaucagagauaaacuauuaaaacuuuaaaaaauacucaaaaauauguaaguuu

SEQ ID NO: 472434 - RNA, 62 nt, hsa
aaucuauauagucuaaugcugacaacuucuauuuuaaaaaacaagacuuuacuuucuucugc

SEQ ID NO: 472435 - RNA, 62 nt, hsa
auauauauauauauuuaucugaaacgugauauuuuaaaaacauguagguuuaacaaaccuuc

SEQ ID NO: 472436 - RNA, 62 nt, hsa
guagauguuuugccaaaauacuucuucauuccuuuaaaaacuacaucuuuccuaugcaagag

SEQ ID NO: 472437 - RNA, 62 nt, hsa
uucccucuuaagccacucccccacccugcccuuuuaaaaauaauuaaggauuugaggucuag

SEQ ID NO: 472438 - RNA, 62 nt, hsa
uguuuacuaacuuugggacauccccuggaguuuuuaaaaauaaauaaauauauauauauaua

SEQ ID NO: 472439 - RNA, 62 nt, hsa
caacuuuaagagaaaagaacuggguuuaaugguuuaaaaaaaagcacagcuuuuucaccuuc

SEQ ID NO: 472440 - RNA, 62 nt, hsa
auagaaaaaugcuuauuuaaaucuuugcaugauuuaaaaacagauuuuccauuuucuuacaa

SEQ ID NO: 472441 - RNA, 62 nt, hsa
ccauaaaugaggcccgcugaccucugcgggacuuuaaaaaucuauucagauauuuccgagua

SEQ ID NO: 472442 - RNA, 62 nt, hsa
cuguacguuggggacugccuguauuuggaagauuuaaaaaccuagcauccuguucucacccu

SEQ ID NO: 472443 - RNA, 62 nt, hsa
aaguucuguauucauuauagauguagcccuuauuuaaaaaagugaauuccauacuaaaacua

SEQ ID NO: 472444 - RNA, 62 nt, hsa
aaaucauggaagauugcauaccugugugguauuuuaaaaacaaguugacuuuuucaguuucu

SEQ ID NO: 472445 - RNA, 62 nt, hsa
cuuuuucaguuucuugaacgguuaaggguggauuuaaaaacuagacaguuuaguuuugggga

SEQ ID NO: 472446 - RNA, 62 nt, hsa
uuugagaaaaaaaaauguuuacucuuccaucauuuaaaaaaaauguaaaagacaaaaaaaaa

SEQ ID NO: 472447 - RNA, 62 nt, hsa
gagcaugguucucaggaaaaccaguuccccaguuuaaaaaaaaaaaaaaaaauuccuuguag

SEQ ID NO: 472448 - RNA, 62 nt, hsa
cucuucaguuaagccuuuggaaacagcucgacuuuaaaaagcuccaaaugcagcuuuaaaaa

SEQ ID NO: 472449 - RNA, 62 nt, hsa
acagcucgacuuuaaaaagcuccaaaugcagcuuuaaaaaauuaaucugggccagaauuuca

SEQ ID NO: 472450 - RNA, 62 nt, hsa
uggugaugauccuucagaaaaggaugccucuguuuaaaaacaaauugcuuuugugucccuga

SEQ ID NO: 472451 - RNA, 62 nt, hsa
aagaaaugggugaaugagcuugucaaugugauuuuaaaaaauugacuaccuggaggaaugau

SEQ ID NO: 472452 - RNA, 62 nt, hsa
ucaaccaacugcaaauggaaaauacgauuuuuuuuaaaaaaaggaugguuacauccguauug

SEQ ID NO: 472453 - RNA, 62 nt, hsa
uaucuaaaagaaaugucuauuaaggugauauauuuaaaaauauuuuuggguguuccuggcag

SEQ ID NO: 472454 - RNA, 62 nt, hsa
uauuuaaaaauauuuuuggguguuccuggcaguuuaaaaaaauugguuggagaauuuagguu

SEQ ID NO: 472455 - RNA, 62 nt, hsa
uuucuuccacuuuaauuuaaaaguucaugucauuuaaaaacaagucaagaaauuaaaauugu

SEQ ID NO: 472456 - RNA, 62 nt, hsa
acaggcuggcuucuguuuuauucagggauuuuuuuaaaaagucaaucagaaaagggauacug

SEQ ID NO: 472457 - RNA, 62 nt, hsa
aaauggacugaagucugaauaaggucauugcauuuaaaaagcauauaacuguacuugacuga

SEQ ID NO: 472458 - RNA, 62 nt, hsa
uugcagauuuucuuaaggaauuuugucucacuuuuaaaaagaaggggagaagucagcuacuc

SEQ ID NO: 472459 - RNA, 62 nt, hsa
acucuaguucuguuguuuuguguauauaauuuuuuaaaaaaaauuugugugcuucugcucau

SEQ ID NO: 472460 - RNA, 62 nt, hsa
gccauaacagaauaauaaaccacaugugggguuuuaaaaaugaaauuuggcuaauaggagca

SEQ ID NO: 472461 - RNA, 62 nt, hsa
cauucagcuuuaauaagguucauuuucuucuguuuaaaaagacacaaaacuugaaaaucagc

SEQ ID NO: 472462 - RNA, 62 nt, hsa
cugagaucuugugguuccaugagaauuauuacuuuaaaaacaaaacaaaauauaaaaaacug

SEQ ID NO: 472463 - RNA, 62 nt, hsa
uagccaaugcaaaucuguuuuaaaacaaauaguuuaaaaaaagaacaaguuuuuaagggcuu

SEQ ID NO: 472464 - RNA, 62 nt, hsa
augaguuucaggaaugaaguagaagguaguuauuuaaaaauaaaaaacacaguccgucccua

SEQ ID NO: 472465 - RNA, 62 nt, hsa
gaacaaccaaagaaggccugcucuuugcugcuuuuaaaaaaugacaauuaaaugugcagauu

SEQ ID NO: 472466 - RNA, 62 nt, hsa
cuugaaacuuccagugugaguugaccccaucauuuaaaaauaaaguccccggguuccuuaau

SEQ ID NO: 472467 - RNA, 62 nt, hsa
aggccccucgugcuaccaacacuuacccuguguuuaaaaagaucuuguaccaagccaacggc

SEQ ID NO: 472468 - RNA, 62 nt, hsa
ugcuggucaggacauuaaaauauugaaguguuuuuaaaaauuaaagaagaagaaaaguaaaa

SEQ ID NO: 472469 - RNA, 62 nt, hsa
gugacagucaugugcacacaugggcgggggcuuuuaaaaaccuuucaggaagucaaugauuu

SEQ ID NO: 472470 - RNA, 62 nt, hsa
gcagauagcugcuucgauaaaggaauuuggaguuuaaaaaucaacuugugaaaacaagguug

SEQ ID NO: 472471 - RNA, 62 nt, hsa
auaucuuuuuacuuuuaugcauuuuaauaagauuuaaaaauauuuagauuaaagcccccuuu

SEQ ID NO: 472472 - RNA, 62 nt, hsa
cugacgugugaaauuuaaggaaagagccauuuuuuaaaaaugccgagcagggcaaugcaagu

SEQ ID NO: 472473 - RNA, 62 nt, hsa
aaaguagcuaauccaguguaaucuuuuaccuuuuuaaaaaccaagauagaguaucuauuaga

SEQ ID NO: 472474 - RNA, 62 nt, hsa
auauuguaaaacagcuuuaaaaauauuuauauuuuaaaaacuguaugugacauuaauaugcc

SEQ ID NO: 472475 - RNA, 62 nt, hsa
uggguguucuuguuaucauauuguaaaacagcuuuaaaaauauuuauauuuuaaaaacugua

SEQ ID NO: 472476 - RNA, 62 nt, hsa
cauagugagacccugucucuacuaaaaauaaauuuaaaaaaaauuagcugagugugguggug

SEQ ID NO: 472477 - RNA, 62 nt, hsa
cacaguauuuguaauuaaaagcaaaucauuuguuuaaaaaggcaguuugcaaaaaauguuuu

SEQ ID NO: 472478 - RNA, 62 nt, hsa
aggaaacaguugcauguaguaacacuaauauauuuaaaaauaagucaacaguaaaccacuga

SEQ ID NO: 472479 - RNA, 62 nt, hsa
uuuucgccaugugaugaagaccacugugauuuuuuaaaaaaguagauaauacuuaaaauggc

SEQ ID NO: 472480 - RNA, 62 nt, hsa
ucagguuaagagaaaaacgaaauuuuaaaaacuuuaaaaaauacugauaaauucggaucaaa

SEQ ID NO: 472481 - RNA, 62 nt, hsa
cagguuuucucagguuaagagaaaaacgaaauuuuaaaaacuuuaaaaaauacugauaaauu

SEQ ID NO: 472482 - RNA, 62 nt, hsa
uauacuauuuuuuuccuuuuuuaauucaguuuuuuaaaaaaacaaauguauuguggcuucca

SEQ ID NO: 472483 - RNA, 62 nt, hsa
gcuaucaguuuuuuggggcaggggagaugaacuuuaaaaaaaaaaaaaaaacuucauuggcu

SEQ ID NO: 472484 - RNA, 62 nt, hsa
cuucuuugaugaauguaacccaauuuuacuucuuuaaaaagucucaauucaagcuggauuag

SEQ ID NO: 472485 - RNA, 62 nt, hsa
ucuuugggaaugcuacauacccauuucugguauuuaaaaaauaucuaggaggagcuaaauga

SEQ ID NO: 472486 - RNA, 62 nt, hsa
acuucaaaggguucaagggcaaagacaucuguuuuaaaaagguccuuuaugacuucagguca

SEQ ID NO: 472487 - RNA, 62 nt, hsa
acuugaaaaugggaagcgaugacaaaucugacuuuaaaaaaaaucuuugauuugcacuguua

SEQ ID NO: 472488 - RNA, 62 nt, hsa
auuuacauacguugucuagaaguaccauaggguuuaaaaaccugggcuggcauuggucacac

SEQ ID NO: 472489 - RNA, 62 nt, hsa
auauugauuuaaacuguguuucacuuacaaguuuuaaaaaaaugacaggguuuaauggagcg

SEQ ID NO: 472490 - RNA, 62 nt, hsa
uguuaagaguucacugaagauauugacacaauuuuaaaaaaucaguaaaggaauguauauaa

SEQ ID NO: 472491 - RNA, 62 nt, hsa
acaagacuuacuccgaauacaagaggaaaagcuuuaaaaacaagauugcaucauaaccccca

SEQ ID NO: 472492 - RNA, 62 nt, hsa
uuuuucucauaaaauagucugauaagcuaauuuuuaaaaagaaaugccauuaacuguguugu

SEQ ID NO: 472493 - RNA, 62 nt, hsa
aaaauaauauuugauuuugaaucuuaaauguuuuuaaaaauuagacuugaaugggcacaaag

SEQ ID NO: 472494 - RNA, 62 nt, hsa
aguauuuugcagagcuaucaauguccaaauaauuuaaaaaaaaaaauaaagguauuuaagca

SEQ ID NO: 472495 - RNA, 62 nt, hsa
uguuaaccuuacguuuucugucuguauauuuuuuuaaaaaucugguaguuucuggaaaaaaa

SEQ ID NO: 472496 - RNA, 62 nt, hsa
cauccaagacguagagcuugaaugugacguuauuuaaaaacaacaacaaagaaggcagagcc

SEQ ID NO: 472497 - RNA, 62 nt, hsa
auacuaagggacaauuauuuuaagaccauggauuuaaaaaaaaaaaaaaaaacucuguuucu

SEQ ID NO: 472498 - RNA, 62 nt, hsa
uugaacuucccuuccuuaaaguacucuaaaccuuuaaaaaaaaaucugauuuaugcagcaga

SEQ ID NO: 472499 - RNA, 62 nt, hsa
ggcagggacagcagucagaaucgacauaaagcuuuaaaaacucaagguuuuuucaaccuacu

SEQ ID NO: 472500 - RNA, 62 nt, hsa
gcugcagggcuuaauacauuagugguaacugguuuaaaaaacaaagacuguaagccugugug

SEQ ID NO: 472501 - RNA, 62 nt, hsa
acugcuuccuugaaacauuuuugugcuauuguuuuaaaaaaauaauuaaaaaacaguuggcg

SEQ ID NO: 472502 - RNA, 62 nt, hsa
cacaaccucuccuccagcacauuccagcucuauuuaaaaaguaaagacacccaccgacuccu

SEQ ID NO: 472503 - RNA, 62 nt, hsa
auuguauaauagacaauugugucuacuacauguuuaaaaacacauugcuuguuauuuuugag

SEQ ID NO: 472504 - RNA, 62 nt, hsa
cagugggaagaaaaauaaaauuuccuucagguuuuaaaaacaugcagagagguguuuuaauc

SEQ ID NO: 472505 - RNA, 62 nt, hsa
gaggagagaaauaauaacuaaaaaauauacccuuuaaaaaaaccuauauuucucugucuaaa

SEQ ID NO: 472506 - RNA, 62 nt, hsa
ucuuguguugguacauuggcagagacauaugcuuuaaaaacuuaaauauuucggaggcacau

SEQ ID NO: 472507 - RNA, 62 nt, hsa
auacugagaacggcauaaagugaagaucgacauuuaaaaaaugaggugaaagaaagcuauag

SEQ ID NO: 472508 - RNA, 62 nt, hsa
uuuuuguaaaacuuuugauauuucuguauacauuuaaaaaaucaauugccacuacaguaguu

SEQ ID NO: 472509 - RNA, 62 nt, hsa
cuaaucauuuccuggguuccacuuacucuugauuuaaaaaaaaaaaaacaacaaaagaguuu

SEQ ID NO: 472510 - RNA, 62 nt, hsa
uaauuuuugaauuuuaaaacuaaucuauuuuauuuaaaaaaaaucaaguacuuuggaaguga

SEQ ID NO: 472511 - RNA, 62 nt, hsa
gauauuuucccuaccuaagaauuucacugucuuuuaaaaaacaaaaaguaaaguaaugcauu

SEQ ID NO: 472512 - RNA, 62 nt, hsa
auauauauuuuugugaauuauacuuuguuguuuuuaaaaagaaaaucaguugauuaaguuaa

SEQ ID NO: 472513 - RNA, 62 nt, hsa
caagccagcuggcuuaugcugguucucagcuguuuaaaaaaaaaaaaaaaaaggaauagaaa

SEQ ID NO: 472514 - RNA, 62 nt, hsa
gugaucugggaacuuuuugcuguacaaaucuguuuaaaaaaaaaaaaaaguaacucauugaa

SEQ ID NO: 472515 - RNA, 62 nt, hsa
acacuucagacacaggaaaaauaaacguggauuuuaaaaaaucaaucaauggugcaaaaaaa

SEQ ID NO: 472516 - RNA, 62 nt, hsa
ucuaccuuccuuauauuuuuuuccucaacaguuuuaaaaagaaaaaaaggucuauuuuuuuu

SEQ ID NO: 472517 - RNA, 62 nt, hsa
aucgauaaaaguucaucuuuggacagaaagccuuuaaaaaaaaaaucacucccucuuccccc

SEQ ID NO: 472518 - RNA, 62 nt, hsa
aaaaagaaaaaaaaaauccuguuguauuaacauuuaaaaacagaauuguguuaugugaucag

SEQ ID NO: 472519 - RNA, 62 nt, hsa
acugcuguggcuagagaguuugaggauugcuuuuuaaaaaagacagcaaacuuuuuuuuuua

SEQ ID NO: 472520 - RNA, 62 nt, hsa
uuuuuaaaaaagacagcaaacuuuuuuuuuuauuuaaaaaaagauauauuaacaguuuuaga

SEQ ID NO: 472521 - RNA, 62 nt, hsa
cauccuucaauuucuguauaaaagcagaucuuuuuaaaaagauacuucuguaacuuaagaaa

SEQ ID NO: 472522 - RNA, 62 nt, hsa
uuuuuauagagcugcauugucggugauuccaauuuaaaaauccauauucaaaaauacccuca

SEQ ID NO: 472523 - RNA, 62 nt, hsa
acgcuaagcuguauuuuuagugagcuaccccuuuuaaaaaggugaaaucuuucuuaacaggg

SEQ ID NO: 472524 - RNA, 62 nt, hsa
auacccauauuauggaacagugugagaguaauuuuaaaaacgacuuauaucuaugcuagcug

SEQ ID NO: 472525 - RNA, 62 nt, hsa
acauacuuccaccagcaguccaacaauauauguuuaaaaauuuaaaacauauauacucuuag

SEQ ID NO: 472526 - RNA, 62 nt, hsa
agcgagacucagucucaaaaaaaauuuaaaaauuuaaaaaaauaaaaagaauccaaccccgg

SEQ ID NO: 472527 - RNA, 62 nt, hsa
gacgacagagcgagacucagucucaaaaaaaauuuaaaaauuuaaaaaaauaaaaagaaucc

SEQ ID NO: 472528 - RNA, 62 nt, hsa
ccacuaauuuuuuuauuuugauauuagucuuuuuuaaaaaauuuuacaguagucauugaaag

SEQ ID NO: 472529 - RNA, 62 nt, hsa
aguggugguucuuuuccauguuuguuuugcacuuuaaaaaagagagaacacaugcaaaugaa

SEQ ID NO: 472530 - RNA, 62 nt, hsa
aagcauuaugcaaaaagucacuuuuaagggcauuuaaaaauuuuuaaguaaagccauucuuu

SEQ ID NO: 472531 - RNA, 62 nt, hsa
aucuggauggcaagaccguuuaucauuuuuuauuuaaaaaaaucaaaccucaaaaaagucau

SEQ ID NO: 472532 - RNA, 62 nt, hsa
agcaaaaaaauauagcguaaauacuuauuuuuuuuaaaaacuuacuuaaauuuguguguaaa

SEQ ID NO: 472533 - RNA, 62 nt, hsa
agcuguccucagcccagcguaguuguaauugcuuuaaaaaaaaaguugaauucaucucuaac

SEQ ID NO: 472534 - RNA, 62 nt, hsa
uuaguagagcuuguucuuguauugugaccuuuuuuaaaaaaaaggaacugagguucagaaug

SEQ ID NO: 472535 - RNA, 62 nt, hsa
uuuuagaaaacagggaguugaaguccaaccuauuuaaaaaccccaccauuuggagaauuaca

SEQ ID NO: 472536 - RNA, 62 nt, hsa
cuacugaaaguuaauccuuuuuaaaaacuuuauuuaaaaagaaaaauuagcagccaggugca

SEQ ID NO: 472537 - RNA, 62 nt, hsa
uaauauguaaaaccuacugaaaguuaauccuuuuuaaaaacuuuauuuaaaaagaaaaauua

SEQ ID NO: 472538 - RNA, 62 nt, hsa
uaguuuuauuaagcauggagaaauugccaauuuuuaaaaacugcaguuuuccaaacuuuucu

SEQ ID NO: 472539 - RNA, 62 nt, hsa
uuuuaaauagaaacuuuaguuuuuuguaaauuuuuaaaaaaauauuucauugauaugcaucu

SEQ ID NO: 472540 - RNA, 62 nt, hsa
cauuguaguugacuuuuuaaaaaaaaaaaaaauuuaaaaaaaaucuacaaauuguguuuugc

SEQ ID NO: 472541 - RNA, 62 nt, hsa
aucccgauggaauauagcauuguaguugacuuuuuaaaaaaaaaaaaaauuuaaaaaaaauc

SEQ ID NO: 472542 - RNA, 62 nt, hsa
ugauacuuaaauaaagaaagugugaggucuacuuuaaaaaaauucaaaugaagagaaaaaga

SEQ ID NO: 472543 - RNA, 62 nt, hsa
ugaacacuggauaaccuaauuuuuuuuaaugcuuuaaaaaaauggcaaaaagacgucaggcc

SEQ ID NO: 472544 - RNA, 62 nt, hsa
ccaacaugggucuauuuugugcuuaaaaauaauuuaaaaaucauacaauauuagguugguua

SEQ ID NO: 472545 - RNA, 62 nt, hsa
auaaacauucaauaaugauuacaguuuucauuuuuaaaaauuuaggaugaaggaaacaagga

SEQ ID NO: 472546 - RNA, 62 nt, hsa
agccuugcugaacuaaguuuuguguguauauauuuaaaaaaaaaaucaguguuuaaauaaag

SEQ ID NO: 472547 - RNA, 62 nt, hsa
uggaacuuuagggggugggagggggcguuggauuuaaaaaugccaaaacuuaccuauaaauu

SEQ ID NO: 472548 - RNA, 62 nt, hsa
auuuacaaugaaaaguuuuuaaaaauaaaauuuuuaaaaaucuaaauauggaccugcucaaa

SEQ ID NO: 472549 - RNA, 62 nt, hsa
uuuuucaugaaaguuauuuacaaugaaaaguuuuuaaaaauaaaauuuuuaaaaaucuaaau

SEQ ID NO: 472550 - RNA, 62 nt, hsa
guagccuuugugaaauuuuccuaauugggccuuuuaaaaacauggcuggguggaacauuucu

SEQ ID NO: 472551 - RNA, 62 nt, hsa
gucuuuaacucuuaaauuguuugguccuauuuuuuaaaaaggaaagggcccuaaguagcuca

SEQ ID NO: 472552 - RNA, 62 nt, hsa
gcugcccuauauaaagguggcagaaagacauuuuuaaaaagcuuauuauuucuugcauuauu

SEQ ID NO: 472553 - RNA, 62 nt, hsa
auuuuuaaaaagcuuauuauuucuugcauuauuuuaaaaaguucagaguugaaaugccuuuc

SEQ ID NO: 472554 - RNA, 62 nt, hsa
augguuauuaacacugugcuguuaagcauccauuuaaaaauauuuguuaucuucuuugccug

SEQ ID NO: 472555 - RNA, 62 nt, hsa
aaauauuuguuaucuucuuugccugccuguauuuuaaaaagaaauacaaaguuguaaaagua

SEQ ID NO: 472556 - RNA, 62 nt, hsa
acaacuauagacagucacuucugcagucccaauuuaaaaaugcagaacugcuuuauccaaga

SEQ ID NO: 472557 - RNA, 62 nt, hsa
ugaaagaauuuuugccuuaucaagaguuguuuuuuaaaaauuuaauaaauucauaaaaaaga

SEQ ID NO: 472558 - RNA, 62 nt, hsa
ugcauuagagcauguuggcagacugguagguauuuaaaaaguugagaaucugcuaacagcgc

SEQ ID NO: 472559 - RNA, 62 nt, hsa
guaugcuguuuuauaauaaauuagcaauauacuuuaaaaaaaauccaguuucuccuauaaca

SEQ ID NO: 472560 - RNA, 62 nt, hsa
guuaaguuguaaagacuuuggaauaaguuucuuuuaaaaauaugacauagccagugaugugu

SEQ ID NO: 472561 - RNA, 62 nt, hsa
aacucuaaugaauauucaagauauuuuagccuuuuaaaaaguugagauuuagcucauggaua

SEQ ID NO: 472562 - RNA, 62 nt, hsa
uuagagcuuugcacauuccuauucacugagauuuuaaaaauuucaccuuuauucgagggaag

SEQ ID NO: 472563 - RNA, 62 nt, hsa
uuaaagggaaauuaaaccauucaugaauaaacuuuaaaaaugugaaguguccuuuuccuuuu

SEQ ID NO: 472564 - RNA, 62 nt, hsa
ccugcuuacuacuaaacgcaauccaaaaggccuuuaaaaauacaguguauauuuuuuguacu

SEQ ID NO: 472565 - RNA, 62 nt, hsa
auucaguacaacucugucauuucuuuguaauauuuaaaaaauauuaguaaaggagugaauua

SEQ ID NO: 472566 - RNA, 62 nt, hsa
uguguauauaagaaugaguugggaccucugucuuuaaaaaucuauuuuuagguaauguucua

SEQ ID NO: 472567 - RNA, 62 nt, hsa
aaacauuacuuucuguaauucacaauacuuguuuuaaaaacauagugucuucauuagugugc

SEQ ID NO: 472568 - RNA, 62 nt, hsa
ccuugccugcuauggaauauugagagagauuuuuuaaaaaagauuuugcauuuuguccaaaa

SEQ ID NO: 472569 - RNA, 62 nt, hsa
agauauuuuucuuccauguauacaauaauuuuuuuaaaaagugcaauuugcguugcagcaau

SEQ ID NO: 472570 - RNA, 62 nt, hsa
ggauguccuauggaaaccuauuucaccagaguuuuaaaaauaaaaaggguauuguuuugucu

SEQ ID NO: 472571 - RNA, 62 nt, hsa
aaguaugcuuuguguuuuaacuguuaaaauaauuuaaaaauuaauuauuuuacauaauuaaa

SEQ ID NO: 472572 - RNA, 62 nt, hsa
aucagaucuaugcuguggcauauuuugcuuuauuuaaaaauuuuuuuuuagagaugaguucu

SEQ ID NO: 472573 - RNA, 62 nt, hsa
cacugaacuaguagaugucaauaauuauuauuuuuaaaaauuuuuauuuguuggccgggcau

SEQ ID NO: 472574 - RNA, 62 nt, hsa
guguugcccagccugggugucaauaauuauuuuuuaaaaaaaauuuuuaaaaagguuuuuug

SEQ ID NO: 472575 - RNA, 62 nt, hsa
ugggugucaauaauuauuuuuuaaaaaaaauuuuuaaaaagguuuuuugagacagauucuug

SEQ ID NO: 472576 - RNA, 62 nt, hsa
ugagaaauacauguuuaacauucaauaauaauuuuaaaaauuugagaaauaaacucucauaa

SEQ ID NO: 472577 - RNA, 62 nt, hsa
gacuagugagauuucuguaauaauuuuaauucuuuaaaaagugaaagcuuguuguaaagaua

SEQ ID NO: 472578 - RNA, 62 nt, hsa
gauuuguuuaaaauuuuguauaucaccaaauuuuuaaaaagugauagucacagugcuaaguu

SEQ ID NO: 472579 - RNA, 62 nt, hsa
uugagcauuuucuuucaguuacauggguguaauuuaaaaaacagcuccuuuuuaagacuuuu

SEQ ID NO: 472580 - RNA, 62 nt, hsa
guaaucuucuacuugcuucaagauuugauuuuuuuaaaaaagccugcgaccuauucaauaca

SEQ ID NO: 472581 - RNA, 62 nt, hsa
ggaguggaauaauuucuucauuaaaaaauguuuuuaaaaacacuauaucuugggugguuuau

SEQ ID NO: 472582 - RNA, 62 nt, hsa
cguugaaaccugcaacacauuagaaacuuauauuuaaaaacagaauuaaucacacugaccaa

SEQ ID NO: 472583 - RNA, 62 nt, hsa
auuacagaggaauuguuauaacuacuaauguuuuuaaaaaauuuauuaaacauuauuaaacu

SEQ ID NO: 472584 - RNA, 62 nt, hsa
ggugucaugucacuaaguuuaaugcugcuguuuuuaaaaaaaaaaaaaaguuuuuuuaaaaa

SEQ ID NO: 472585 - RNA, 62 nt, hsa
ugcugcuguuuuuaaaaaaaaaaaaaaguuuuuuuaaaaagccaaucuauguacuaaauugc

SEQ ID NO: 472586 - RNA, 62 nt, hsa
gucagcaaggugucuuggguuuauuuugguucuuuaaaaaagggaagucuugagguuuuaga

SEQ ID NO: 472587 - RNA, 62 nt, hsa
uauacacugaagaugaguuuuuaaucucuuacuuuaaaaagauuuauuuagaaucgugaauu

SEQ ID NO: 472588 - RNA, 62 nt, hsa
guuuuaguugcuauucauauucucauucguuuuuuaaaaacugauauauucugaauuuauuc

SEQ ID NO: 472589 - RNA, 62 nt, hsa
gcaaaguaagacccagcauuuuaaaagcccuuuuuaaaaacuagacuucguacugugaguau

SEQ ID NO: 472590 - RNA, 62 nt, hsa
auuuuauaauguauuaaauacaauaaacucuguuuaaaaaauaaggucugugugaaacacac

SEQ ID NO: 472591 - RNA, 62 nt, hsa
cuuuuuuccuuugucuuucuuuuuccuuuuuuuuuaaaaaaacaaaacaaacaaaacaccuu

SEQ ID NO: 472592 - RNA, 62 nt, hsa
uuuaagagcaguuacagugugacucacucauguuuaaaaaaaaucgaagagcuaaaaaauac

SEQ ID NO: 472593 - RNA, 62 nt, hsa
aagguaauaucaaccgucagcaaacaugucaguuuaaaaauaaguucgguuaacaaggaagu

SEQ ID NO: 472594 - RNA, 62 nt, hsa
aagcuuuuaaccccuuuaccacuuugcuuauuuuuaaaaaauuuauuggcaaaacuggggau

SEQ ID NO: 472595 - RNA, 62 nt, hsa
cacauuuacaguucuguaaugcaaggaugcaguuuaaaaaugugaaguagugaugguuuuug

SEQ ID NO: 472596 - RNA, 62 nt, hsa
uaauuuccauaugggcuaaagaauccaaauauuuuaaaaaucugucucucuuuucuucucuc

SEQ ID NO: 472597 - RNA, 62 nt, hsa
auaagucucugaaagccaguggcuuuaugacuuuuaaaaaaaauuacaaaccaagaauuuuu

SEQ ID NO: 472598 - RNA, 62 nt, hsa
uucguuugcucaacaugguuuacuacuaacauuuuaaaaauauaaauacuuuagcaaaaaca

SEQ ID NO: 472599 - RNA, 62 nt, hsa
gccagauaauugcauucucuccaccugagugguuuaaaaaggacuuuuaaguauucuucagu

SEQ ID NO: 472600 - RNA, 62 nt, hsa
caguucagaagagccaaaaaaaaguaucuucauuuaaaaagaaaucaagucaguuuuuuuaa

SEQ ID NO: 472601 - RNA, 62 nt, hsa
uauaugugauauaaauuaaugugugcaaauuguuuaaaaauuagauguguugcaguuuugca

SEQ ID NO: 472602 - RNA, 62 nt, hsa
aaucuauaagucugcccuuuuuacaaugaugauuuaaaaaaaacaacagcguaaauauuagc

SEQ ID NO: 472603 - RNA, 62 nt, hsa
agugguuaucccuagauaaaauuaaaaggauuuuuaaaaaguaauuacugcacauaaaauga

SEQ ID NO: 472604 - RNA, 62 nt, hsa
caugggguuucuuuuggaaagaguuucauugcuuuaaaaagaagcucagaaagucuuuauaa

SEQ ID NO: 472605 - RNA, 62 nt, hsa
uguuauucuacacauaauuaugaauucagaauuuuaaaaauugggggaaaagccauuuauuu

SEQ ID NO: 472606 - RNA, 62 nt, hsa
augcuagaauuacuuccacauauuuaucccuuuuuaaaaaagcuaaucuauaaauaccguuu

SEQ ID NO: 472607 - RNA, 62 nt, hsa
uacacaggucuguacuucugccacuuucuccuuuuaaaaaaacaaaacuaugcauauuaugu

SEQ ID NO: 472608 - RNA, 62 nt, hsa
gaucuuccagcaacguuuauauauuuaguaauuuuaaaaauuccuauuugauacaauuaaau

SEQ ID NO: 472609 - RNA, 62 nt, hsa
cgacaacuuccaucauuccagagaaaagccacuuuaaaaacagcugaagugaccuuagcaga

SEQ ID NO: 472610 - RNA, 62 nt, hsa
uauuuuuuuaaagagaaaucaguuuaccuguuuuuaaaaaaauuaaaucuaguucaccuugc

SEQ ID NO: 472611 - RNA, 62 nt, hsa
ggagggcugaaggaaacguucacauuuuagaguuuaaaaaaaacaccucgacauuuaaaaaa

SEQ ID NO: 472612 - RNA, 62 nt, hsa
acauuuuagaguuuaaaaaaaacaccucgacauuuaaaaaaucaaccaacacaagaucaaaa

SEQ ID NO: 472613 - RNA, 62 nt, hsa
caaacagauuugucuaaacauuuguauauaacuuuaaaaauagaauauuuuuuggaggguua

SEQ ID NO: 472614 - RNA, 62 nt, hsa
aucuauacauuucugaguucugaauaaauauuuuuaaaaauuuuaauauauuuuucuuugaa

SEQ ID NO: 472615 - RNA, 62 nt, hsa
uaugaaaguuaauccauuucugauacgugguuuuuaaaaauaugaaauggauuuauauauac

SEQ ID NO: 472616 - RNA, 62 nt, hsa
aaacugaauaagcauuuagcuuuuuaaaucauuuuaaaaauuaagucuaauuuugaagcuuu

SEQ ID NO: 472617 - RNA, 62 nt, hsa
gaauucuuuacaagcuguuguaaacauuuaguuuuaaaaagaaaagcaugcugaaacauguu

SEQ ID NO: 472618 - RNA, 62 nt, hsa
cugcucuuccuacugacucaaauaguuuauuuuuuaaaaauacuuauauaauacaugcagag

SEQ ID NO: 472619 - RNA, 62 nt, hsa
guccauaguaagugcucaguaaacuuagcuguuuuaaaaacuuuguauuugaacauugaaaa

SEQ ID NO: 472620 - RNA, 62 nt, hsa
caugaaugaauaggccagcugggacaaaugaauuuaaaaaaucagaaaaaugcaagauuuau

SEQ ID NO: 472621 - RNA, 62 nt, hsa
aagaauuagaaaacuuugcaagauuugacuuguuuaaaaaucacauuuauaagugaaccgua

SEQ ID NO: 472622 - RNA, 62 nt, hsa
cugacuguuuuuguaugguccaugaucuagaauuuaaaaaaauuuuaaaggguugaaaaaag

SEQ ID NO: 472623 - RNA, 62 nt, hsa
cacagaagguacuaaugucagcucacguggccuuuaaaaaccuacuuccccgcccgcaggag

SEQ ID NO: 472624 - RNA, 62 nt, hsa
ugcacucaacuggaaccaauuuucaccaugauuuuaaaaauuaaaaaaaccuggcagagccc

SEQ ID NO: 472625 - RNA, 62 nt, hsa
aagcaacaaaaaaagaaaacacacagaagagauuuaaaaaaaaaaaaggaaaaaaaaaaaag

SEQ ID NO: 472626 - RNA, 62 nt, hsa
gucuggacauugcaucgcccuaguuuucuuucuuuaaaaaaaaaaaauuccaacagaagcca

SEQ ID NO: 472627 - RNA, 62 nt, hsa
accuagguggggccugggguaggaggaacagguuuaaaaauccccaaaaaagcgaaccguga

SEQ ID NO: 472628 - RNA, 62 nt, hsa
ugguucuucucguuuuccuuuuuuuuuuuuuuuuuaaaaaaaaacuauuuaauuuuuuaauu

SEQ ID NO: 472629 - RNA, 62 nt, hsa
ggaagccauuuguuaaaaaaaaaaaaaaaaguuuuaaaaauaccuuuuaauuuucugguaau

SEQ ID NO: 472630 - RNA, 62 nt, hsa
guucuuuuuuccuugaaaagaaguacagauuuuuuaaaaagcuaauauugcugugauucaac

SEQ ID NO: 472631 - RNA, 62 nt, hsa
uaaacauaaaauaaaucauacuggugaggaacuuuaaaaaugcgaaaaaugugacaaaaucu

SEQ ID NO: 472632 - RNA, 62 nt, hsa
uguaaaacacaagauucugaagacuuaguuauuuuaaaaaaguuaaguaucucaauuuuuca

SEQ ID NO: 472633 - RNA, 62 nt, hsa
caugaaauuauagccaguuuaaaaugaauuauuuuaaaaaaaauuucuggcugggcccggug

SEQ ID NO: 472634 - RNA, 62 nt, hsa
aggugcaugccaacacgcccggcuaauuuuuuuuuaaaaauauuuuuaguagagacaggguu

SEQ ID NO: 472635 - RNA, 62 nt, hsa
uauauauuuucuacuuuuaaucacucagaagauuuaaaaaacucaugagaagaguaaucugu

SEQ ID NO: 472636 - RNA, 62 nt, hsa
ccaugagccaccaugaccaacguguuucuuaauuuaaaaaaaaaaaaauagaccaggugcuc

SEQ ID NO: 472637 - RNA, 62 nt, hsa
uuuauuccuaaacaagauaguuacaaagauuuuuuaaaaagcuacauaugccccucccaaac

SEQ ID NO: 472638 - RNA, 62 nt, hsa
uugguucaguaauaaauaugugagacuuuucauuuaaaaaaagucaaaugacuuaauucugu

SEQ ID NO: 472639 - RNA, 62 nt, hsa
accugaugcccuuauuugaagcuccauuauuuuuuaaaaagaaauuauauaaaaauacuuua

SEQ ID NO: 472640 - RNA, 62 nt, hsa
aaccugggcaauauagggagauccugucucuauuuaaaaaaagaaguuauggccgggcgcgg

SEQ ID NO: 472641 - RNA, 62 nt, hsa
acaugaugagaccccaucucuacaaacaauuuuuuaaaaaugagccaggugugguagugugc

SEQ ID NO: 472642 - RNA, 62 nt, hsa
cauucgucaucaguuguucuugaacauggucuuuuaaaaacuagucagaugaauuguuuuca

SEQ ID NO: 472643 - RNA, 62 nt, hsa
ucuuauuuuuuuccuaaaagauaauguuuauuuuuaaaaaggaaggaaggagcaagugaagu

SEQ ID NO: 472644 - RNA, 62 nt, hsa
cacuacaaaaauacaauuacucaccaaaaagcuuuaaaaaauaaagcugugucuuuagggag

SEQ ID NO: 472645 - RNA, 62 nt, hsa
acaagugagggcuuuuuaacuugauuaugccuuuuaaaaauacuauguauguaaaauauuua

SEQ ID NO: 472646 - RNA, 62 nt, hsa
auauagagacuucuaaaucauaaucauccuuuuuuaaaaaaaagaauuuuaaaaaagaugga

SEQ ID NO: 472647 - RNA, 62 nt, hsa
aaucauaaucauccuuuuuuaaaaaaaagaauuuuaaaaaagauggauuugacacacucacc

SEQ ID NO: 472648 - RNA, 62 nt, hsa
gcugagauguuuaguagcugauaaagaaaccuuuuaaaaaaauaauauaaaugaaugaaaua

SEQ ID NO: 472649 - RNA, 62 nt, hsa
uuuuauuccuuuuacauuuguugcuucugggauuuaaaaaauuacuaaauucauaagauagu

SEQ ID NO: 472650 - RNA, 62 nt, hsa
aguuaaacuccuacuaauuuaaacuaagacaguuuaaaaaggaagccugaaaaagacucaua

SEQ ID NO: 472651 - RNA, 62 nt, hsa
uuggcuguuucaugcaggacuuaauuauugcuuuuaaaaauucacaaugaaaagacgauucu

SEQ ID NO: 472652 - RNA, 62 nt, hsa
gcuaugauucacauguaacauuuaaacauuaauuuaaaaagggaaccuuggagaauucuuuu

SEQ ID NO: 472653 - RNA, 62 nt, hsa
acaaggucaguauuuaccaaaguguaucugauuuuaaaaauuccuuuagucuguaaaacucc

SEQ ID NO: 472654 - RNA, 62 nt, hsa
ggaaugcuuuuccagggagagaggccaguuaauuuaaaaaaaacagucgcuaguuaacagcg

SEQ ID NO: 472655 - RNA, 62 nt, hsa
caauagcuuucaauuguucuuucuggaagacuuuuaaaaaaauauaaauaugcauauauaua

SEQ ID NO: 472656 - RNA, 62 nt, hsa
caggagccaaccucccccuuugcagggcugcauuuaaaaauuagguuugggacaguucuugu

SEQ ID NO: 472657 - RNA, 62 nt, hsa
ccagauucuguuauuugcaauuaaagcaaguuuuuaaaaaaugcaagaggcaguuguuaguc

SEQ ID NO: 472658 - RNA, 62 nt, hsa
aauuaguaguuaagucugauagccaaguaaguuuuaaaaaccaaagcauccaggaugcacac

SEQ ID NO: 472659 - RNA, 62 nt, hsa
cugccuucaagaaacaaugaccugauucugucuuuaaaaaaaaaaaucucagaauucuuuuu

SEQ ID NO: 472660 - RNA, 62 nt, hsa
ucacaugcuaaugugcagcugagugcacuuuauuuaaaaagaauggauaaaugcaauauucu

SEQ ID NO: 472661 - RNA, 62 nt, hsa
cccuuugccuauaugguagagcaauaaugcuuuuuaaaaauaaacuucugaaaacccaaggc

SEQ ID NO: 472662 - RNA, 62 nt, hsa
gauuauuuguuuagauguaggcauuuuaauuuuuuaaaaauuccucuaccagaacuaagcac

SEQ ID NO: 472663 - RNA, 62 nt, hsa
auggggaaauaaacuuaaaaaaaaaucaggaauuuaaaaaaacgagcaauuugaagagaauc

SEQ ID NO: 472664 - RNA, 62 nt, hsa
agaaauagaauggugcucuuaucuuucuugacuuuaaaaaaauuauuaaaaacaaaaaaaaa

SEQ ID NO: 472665 - RNA, 62 nt, hsa
agaaugauauaaaggagauacauguuucuuccuuuaaaaaauaaacggaaguuacauuguua

SEQ ID NO: 472666 - RNA, 62 nt, hsa
guuuuuucuuuguauugcuguuuauuuuauauuuuaaaaauauuuaaaaaaaugucgagaug

SEQ ID NO: 472667 - RNA, 62 nt, hsa
uguauugcuguuuauuuuauauuuuaaaaauauuuaaaaaaaugucgagauggggucucacu

SEQ ID NO: 472668 - RNA, 62 nt, hsa
aauuucauauguucuaaaaugacuagcaaugguuuaaaaaggaagaagaguggaagugaaga

SEQ ID NO: 472669 - RNA, 62 nt, hsa
ucagagcuauccugaaacugaacagcugaaacuuuaaaaaauaauugguauuauuuugugcc

SEQ ID NO: 472670 - RNA, 62 nt, hsa
gaauaauaauauucauauuugcuaugaauccuuuuaaaaaaaucuuuggauaaaugcugaca

SEQ ID NO: 472671 - RNA, 62 nt, hsa
cauuaagaauaucuugaauguuguguauauauuuuaaaaagcacuuugcaaaauaguuugua

SEQ ID NO: 472672 - RNA, 62 nt, hsa
aaauuugucuuguuauuugugaguacaguacauuuaaaaaacauccuuaucgguuauuuuuu

SEQ ID NO: 472673 - RNA, 62 nt, hsa
aagucaauugugacugcaauuccaaguuaguauuuaaaaauagagaaauugcacuuccugga

SEQ ID NO: 472674 - RNA, 62 nt, hsa
uuuguuauuuauucuuuuaauaauggaauuuuuuuaaaaaguauuuuguaacugaggaauuu

SEQ ID NO: 472675 - RNA, 62 nt, hsa
ucuaggcauaaaaauaaaaguuggcuaaaaauuuuaaaaaaucaacaucuugagguugugua

SEQ ID NO: 472676 - RNA, 62 nt, hsa
gaaaaauuauggucuuauugcugaauaaaacuuuuaaaaaguacagaauaauugugcuugcu

SEQ ID NO: 472677 - RNA, 62 nt, hsa
uggcugaauggcugaaugagauaaaauuuaauuuuaaaaaaugguuaugaaauaauguucca

SEQ ID NO: 472678 - RNA, 62 nt, hsa
uuuuaaauaagaauuuuaauaaaaauccuguguuuaaaaaagaaaaaaagaaaaaaucccug

SEQ ID NO: 472679 - RNA, 62 nt, hsa
cacuuuaaaaauacagagaauuucuuccuuuuuuuaaaaaaaaauaagaaaaugcuaaauau

SEQ ID NO: 472680 - RNA, 62 nt, hsa
gucagccgucuucuaaagcaaguggagaacacuuuaaaaauacagagaauuucuuccuuuuu

SEQ ID NO: 472681 - RNA, 62 nt, hsa
uuuccugcguuuccuuugccauuuauuuauucuuuaaaaauaaacauuuugugguguguuua

SEQ ID NO: 472682 - RNA, 62 nt, hsa
gaaacccauacucuagucguuucugcauuuccuuuaaaaauagcaugggaucauauuuaaac

SEQ ID NO: 472683 - RNA, 62 nt, hsa
ucagugagucccagggacuaauuaagguuuauuuuaaaaagugucuaccuugguacgcagcc

SEQ ID NO: 472684 - RNA, 62 nt, hsa
uuugauuuaggcaggguagcuugggauaccuuuuuaaaaacaccagauauuaaaaugucugg

SEQ ID NO: 472685 - RNA, 62 nt, hsa
aucuuuuggaaagaauuucuggaaguggucacuuuaaaaauuauuuuccacccuugcaaaau

SEQ ID NO: 472686 - RNA, 62 nt, hsa
uaguuuggauguacaauuauuauuaguggcuuuuuaaaaaaugaaacaguguuaagugaaau

SEQ ID NO: 472687 - RNA, 62 nt, hsa
uuuaucuuguucugggcauuggaguuucaguuuuuaaaaaauucuugaaaauguauucugug

SEQ ID NO: 472688 - RNA, 62 nt, hsa
uugguuugaccgccacgauuuagguuagucaguuuaaaaauuguucauguuguuuggauggu

SEQ ID NO: 472689 - RNA, 62 nt, hsa
uaaggagaaaccccauaacuuuuuagcucucuuuuaaaaauaaaugucuccuucuguguucu

SEQ ID NO: 472690 - RNA, 62 nt, hsa
aguuggauuggaaaggaauauuuuaagugccuuuuaaaaauacuaauaguccggccaggcgc

SEQ ID NO: 472691 - RNA, 62 nt, hsa
aaaugaaaagucugcuuaacuccaauuucucuuuuaaaaaagcagacuuacagcuuucaggc

SEQ ID NO: 472692 - RNA, 62 nt, hsa
uugaaaccaguuuaaugggauacaaccagcauuuuaaaaaaugaaauagaauacagcaugga

SEQ ID NO: 472693 - RNA, 62 nt, hsa
ggguacauuuuugcacugaaaucuaaagauguuuuaaaaaacacuuuucacaaaaauagucc

SEQ ID NO: 472694 - RNA, 62 nt, hsa
uagaucucugguguucucuuugguuucauuuuuuuaaaaaauuaccuucuuuggguggggau

SEQ ID NO: 472695 - RNA, 62 nt, hsa
uauaaaaugaucucuguuuuuccugucagagauuuaaaaaacugaaaagguauaccucaacc

SEQ ID NO: 472696 - RNA, 62 nt, hsa
aagguuuguuuugguuuguuauggcuuccuuuuuuaaaaaauuacccuguagugccaguuua

SEQ ID NO: 472697 - RNA, 62 nt, hsa
acggccuagagaguugacaaguugcuuguaguuuuaaaaaaauaauaaaguauacccuucug

SEQ ID NO: 472698 - RNA, 62 nt, hsa
agguccuaaaaauacgggcaagcucuuaacuauuuaaaaaugaaauuacaggcccgggcacg

SEQ ID NO: 472699 - RNA, 62 nt, hsa
cugcacuccagccuggugacagcgugagacucuuuaaaaaaagaaauuaaaagaguugagac

SEQ ID NO: 472700 - RNA, 62 nt, hsa
acuagaaauuugcaacuuauaaaaaaguuacuuuuaaaaauauaaguuagggcuaggcacag

SEQ ID NO: 472701 - RNA, 62 nt, hsa
auauaccauacacuuaagaaauuugagcagaauuuaaaaaagaaagaaaauaaauuguuuuu

SEQ ID NO: 472702 - RNA, 62 nt, hsa
aaugaaaugcuagggggccagggaaacaaaauuuuaaaaauaauaaaauucaccauagcaau

SEQ ID NO: 472703 - RNA, 62 nt, hsa
aagcauggaaauuaaguguuucguacaaaaauuuuaaaaaguuaccaaagguuuuuauucuu

SEQ ID NO: 472704 - RNA, 62 nt, hsa
guguuacuccccgugaaaguuauuacuuuuccuuuaaaaaugguuuuauaauaagacuguuu

SEQ ID NO: 472705 - RNA, 62 nt, hsa
ugaaacuuaaagaucaguggaaaaaaaaaacauuuaaaaauguuguaggagacuuucaauuu

SEQ ID NO: 472706 - RNA, 62 nt, hsa
uauuucuauuaaugguuuaauuucuuuguauauuuaaaaauaaauaugaaaaaccccuaaau

SEQ ID NO: 472707 - RNA, 62 nt, hsa
gcuuuuuuuuucuuguguauuaaauuaacauuuuuaaaaagcagauauuuugucaaggggcu

SEQ ID NO: 472708 - RNA, 62 nt, hsa
uggauaggguugaagaagguuacuauuaauuguuuaaaaacagcuuagggauuaauguccuc

SEQ ID NO: 472709 - RNA, 62 nt, hsa
uaacaaagcuuucuuuuuucguguccuccuuauuuaaaaagguauacuuacaaugugaagua

SEQ ID NO: 472710 - RNA, 62 nt, hsa
aagacuaaugggaugccuuuuacuuugcuaauuuuaaaaacuggugauagaugucaaaucca

SEQ ID NO: 472711 - RNA, 62 nt, hsa
uuugucuggaugaaaguuuugcccaguuguguuuuaaaaacaauuccucaugaacacuaaga

SEQ ID NO: 472712 - RNA, 62 nt, hsa
ucaagugcaaggauaucagaaguuuuuuuuuauuuaaaaaauuuuuuuuucgagauggaguu

SEQ ID NO: 472713 - RNA, 62 nt, hsa
acuuuaaaaugacuuuuccaaccugcuuuguuuuuaaaaauuauauuccaguuuuaaucauu

SEQ ID NO: 472714 - RNA, 62 nt, hsa
aggagaaaaaaugaguuacaaugucagguguuuuuaaaaauuccuuuuagagacagucuuuu

SEQ ID NO: 472715 - RNA, 62 nt, hsa
uguucuuuaacacugacuacuaaacuuuaaguuuuaaaaaauagguuuucauuuauggcuuu

SEQ ID NO: 472716 - RNA, 62 nt, hsa
aucuaaacauagguucugcauaucuguuagauuuuaaaaaugacugguguuuugucuucaca

SEQ ID NO: 472717 - RNA, 62 nt, hsa
ccuaaaccuuuaugcuacauuuucgaagauuuuuuaaaaauaauauuguuaaucaguaaaaa

SEQ ID NO: 472718 - RNA, 62 nt, hsa
cgacgucacuaugcagggcacacguggcuugguuuaaaaaggucaucuuagauuuaucuuag

SEQ ID NO: 472719 - RNA, 62 nt, hsa
auguuuucaaauaaaaucucccuaaagcaauauuuaaaaauuggucaaaacaaggucuggga

SEQ ID NO: 472720 - RNA, 62 nt, hsa
aauuuaagauguucuaguucugcucucuuuguuuuaaaaaucacugcuucaaucuacuucaa

SEQ ID NO: 472721 - RNA, 62 nt, hsa
caaaaucuucaaguuacauuuaacccauaagguuuaaaaaaaaggaaaaaaaacgguugugg

SEQ ID NO: 472722 - RNA, 62 nt, hsa
uaaauucuccugacuccaguuuauaacauccuuuuaaaaaauuuaaaaacaaacagccacac

SEQ ID NO: 472723 - RNA, 62 nt, hsa
cugacuccaguuuauaacauccuuuuaaaaaauuuaaaaacaaacagccacaccccuccucc

SEQ ID NO: 472724 - RNA, 62 nt, hsa
uuuuuuucucugggugcaaagauguucauucuuuuaaaaaauguuuaaaaaaaaaaaaaaac

SEQ ID NO: 472725 - RNA, 62 nt, hsa
gggugcaaagauguucauucuuuuaaaaaauguuuaaaaaaaaaaaaaaacugccuuucuuc

SEQ ID NO: 472726 - RNA, 62 nt, hsa
aaaaagugaaaguuaggguuaggacauccuuuuuuaaaaauuacaaauuuaguccguuuugg

SEQ ID NO: 472727 - RNA, 62 nt, hsa
gcaacauagcaagacccugucuguacacaaaauuuaaaaauuaguucaucgggguggcacac

SEQ ID NO: 472728 - RNA, 62 nt, hsa
ucacuagcauuuaucacuuuuuuccuucucuuuuuaaaaauaaaaccagacucuguucugaa

SEQ ID NO: 472729 - RNA, 62 nt, hsa
uccucucuguuaguccccaaauccuuacuuauuuuaaaaagacuagacccucucuaaagacu

SEQ ID NO: 472730 - RNA, 62 nt, hsa
uaagcauaaaagaugaaagagcaguuggacuuuuuaaaaauucagcaaagugguucccucuc

SEQ ID NO: 472731 - RNA, 62 nt, hsa
aucuuaauacuaaggaaccaacaaucuuccuguuuaaaaaaccacauggcacagagauucug

SEQ ID NO: 472732 - RNA, 62 nt, hsa
caugaaauugaguguuauuuuuuucuuucuuuuuuaaaaaaauauguaaagugcagucuucu

SEQ ID NO: 472733 - RNA, 62 nt, hsa
ucucgcuccccacgaccccagaaugaaacagcuuuaaaaauagccuuaagcaaaaggauguu

SEQ ID NO: 472734 - RNA, 62 nt, hsa
augguccuggcaaccucagaaaccccugaaguuuuaaaaacuuucucgcuccccacgacccc

SEQ ID NO: 472735 - RNA, 62 nt, hsa
uuaauuuaaagggggggaaccucaaaaguuuuuuuaaaaaagaaacuugucugccacaguau

SEQ ID NO: 472736 - RNA, 62 nt, hsa
ugggaaaauauaaacgagggaagaaaacaaacuuuaaaaaaaagcgagagggauaaaaaauu

SEQ ID NO: 472737 - RNA, 62 nt, hsa
acaaaaaaagagaaaaaacauaacaaguaaauuuuaaaaaaaagaacaaaauauaagaggaa

SEQ ID NO: 472738 - RNA, 62 nt, hsa
auuaaagagcaaagcuuuuuauuacuuuguaauuuaaaaaacugaaaaaaaaaaaacugaag

SEQ ID NO: 472739 - RNA, 62 nt, hsa
cuucucccuucuagugucuucacuguauuuucuuuaaaaaaaaaaaaaaaaaaaaaaaggca

SEQ ID NO: 472740 - RNA, 62 nt, hsa
caaaaaaauuauuaaaaauacauuaaagaugauuuaaaaaaaagaaaauuccugggcauuug

SEQ ID NO: 472741 - RNA, 62 nt, hsa
agggauggguugggggcgggguaauuauuuuauuuaaaaaaauaccgagcagcaaaagggga

SEQ ID NO: 472742 - RNA, 62 nt, hsa
uauuaugcugauggagcaugcuuuuuaaauccuuuaaaaacacucaccauauaaacuugcau

SEQ ID NO: 472743 - RNA, 62 nt, hsa
uucuaccaguguuucaauuuaaagugcuaguguuuaaaaacauuuucaagggauaaggccuu

SEQ ID NO: 472744 - RNA, 62 nt, hsa
ugacccugucucuaaagaaaaacuauagaaaauuuaaaaaauuaaaaaacggguaacauggu

SEQ ID NO: 472745 - RNA, 62 nt, hsa
auaaugagaccuguccucuaugaaaaaacuuuuuuaaaaauuuagcuggguguggugguacg

SEQ ID NO: 472746 - RNA, 62 nt, hsa
gcaguauagugagaucuuuucucuacaaaaaauuuaaaaauuagccaagugugguggugugc

SEQ ID NO: 472747 - RNA, 62 nt, hsa
gaaugggacauugguguguuuagagauuuuaguuuaaaaacaaaacaaaaagauugaucaaa

SEQ ID NO: 472748 - RNA, 62 nt, hsa
gagagaaacauauuuuuucaggaaaaacaaacuuuaaaaaaaaaagaggagaaauaaaaccu

SEQ ID NO: 472749 - RNA, 62 nt, hsa
gggauaaaauagcuguuucacaaacaguuuuauuuaaaaaaacaaaaaacaaaaaaaaucaa

SEQ ID NO: 472750 - RNA, 62 nt, hsa
uuguaaauuguauaauuuuuaaauaucugaguuuuaaaaaaagaaaaaaguacaaaaaaauc

SEQ ID NO: 472751 - RNA, 62 nt, hsa
aucagacauagagagcuuugugugauucauguuuuaaaaagaaccgaagaagccacaggcag

SEQ ID NO: 472752 - RNA, 62 nt, hsa
aaagaucuuuuuuaaauaaucuuuuugcuguuuuuaaaaaauuaaacaaggcuuuguguucc

SEQ ID NO: 472753 - RNA, 62 nt, hsa
gcuuuucuguuuuuuaaccuuuuguuccgccauuuaaaaaaagaaaaaaaaaaagcuuaugu

SEQ ID NO: 472754 - RNA, 62 nt, hsa
caauuauuuucagaaaaacacugacugugucauuuaaaaagaaauaaaugauauguuauuau

SEQ ID NO: 472755 - RNA, 62 nt, hsa
uuuuuggaaaggcggggaagaaggaugaaaccuuuaaaaacaaaaacaaaaacaucaaugag

SEQ ID NO: 472756 - RNA, 62 nt, hsa
uugaagauugaaaagggucagcugggaaaauuuuuaaaaagacuguuuuuaaaaaggugcua

SEQ ID NO: 472757 - RNA, 62 nt, hsa
ggucagcugggaaaauuuuuaaaaagacuguuuuuaaaaaggugcuacaaaauaaagugcua

SEQ ID NO: 472758 - RNA, 62 nt, hsa
ucucaugauuugaaaaguacaccuugcaaaguuuuaaaaauaaaguuuuuaggcaaaugcga

SEQ ID NO: 472759 - RNA, 62 nt, hsa
uagcagaguuucucuauuuuauauuucauagauuuaaaaaacccaaauaaagauggauuuaa

SEQ ID NO: 472760 - RNA, 62 nt, hsa
aucuauguuguguaggggaaauuuuuucauuuuuuaaaaauucuacuuugguuuuguuguug

SEQ ID NO: 472761 - RNA, 62 nt, hsa
uuguagaacuauguuauaguccagucuacuucuuuaaaaaccauuuaaacugcuagauagua

SEQ ID NO: 472762 - RNA, 62 nt, hsa
uaguccaauagaaaauucauucuuuauaggucuuuaaaaauuacuuuuauuauauuguuuac

SEQ ID NO: 472763 - RNA, 62 nt, hsa
uuuauucucacccgaaguauucacacaaucuuuuuaaaaaaaauuugaaauggcauuuugua

SEQ ID NO: 472764 - RNA, 62 nt, hsa
gucuuucaagaaugacggaauaagagaccuguuuuaaaaaggaacugcagcaaucuuugaaa

SEQ ID NO: 472765 - RNA, 62 nt, hsa
cauuauagacauugaggaccucauccaaacaauuuaaaaaugagugugaagggggaacaagu

SEQ ID NO: 472766 - RNA, 62 nt, hsa
augaugguuacacuuuugguuccuaaauaaaauuuaaaaaauuaacagccaagucacaaagg

SEQ ID NO: 472767 - RNA, 62 nt, hsa
uuaauguuuaaagaguuuucuauuguuugaguuuuaaaaaagacuuuauguacagugcccag

SEQ ID NO: 472768 - RNA, 62 nt, hsa
cuaaaacuguagaagcccaaucaccagcaguuuuuaaaaaggugauaacuuuuauuagcucu

SEQ ID NO: 472769 - RNA, 62 nt, hsa
uaauuuaccaggaagcagaggagagcuacuuguuuaaaaauccacauucuuggacccaaucc

SEQ ID NO: 472770 - RNA, 62 nt, hsa
cucaggaauauaacauauaagggagauguuaauuuaaaaauuuccacuacacuuauuaucua

SEQ ID NO: 472771 - RNA, 62 nt, hsa
cagucauuuggcuucugaauguuugaaacgauuuuaaaaaauaaguagugcuaugguuguuu

SEQ ID NO: 472772 - RNA, 62 nt, hsa
aucuaguuuuagaagggaaacaguugaaacuguuuaaaaauagaugugccuuauuuauugca

SEQ ID NO: 472773 - RNA, 62 nt, hsa
ugaacaaguaauuuuauauugugcuuuaauuuuuuaaaaaguauucuuuauucauauguaua

SEQ ID NO: 472774 - RNA, 62 nt, hsa
uucucugggugaggcaucugguuacugguuauuuuaaaaagaauaaagacauuccuggaauc

SEQ ID NO: 472775 - RNA, 62 nt, hsa
gggccuauaaauauagaacaaauucagggauuuuuaaaaaauuguguuacuacugauauaug

SEQ ID NO: 472776 - RNA, 62 nt, hsa
auuuacacaauuauaaucaccagcagugugaguuuaaaaaacuucguuguuuuuacaccaaa

SEQ ID NO: 472777 - RNA, 62 nt, hsa
uguaaacuuuguucuugcauuagacugaccaguuuaaaaauaugaacuaaaaccuaauggcu

SEQ ID NO: 472778 - RNA, 62 nt, hsa
ucauuucaacuuggcuuuuugucuuuuaaauuuuuaaaaaaugcaguaguguguuagagacu

SEQ ID NO: 472779 - RNA, 62 nt, hsa
gccuuaaaaguuaaaaacauuuucaguuuuuuuuuaaaaaacguacucuuauuaucuggaac

SEQ ID NO: 472780 - RNA, 62 nt, hsa
auguuucccggggcuaccccuucauagcugcauuuaaaaaugguguucaggccacuauggcu

SEQ ID NO: 472781 - RNA, 62 nt, hsa
caagcauggaucuccauauuucaaaggaaaguuuuaaaaauguuuuuaaaacuucaaauauc

SEQ ID NO: 472782 - RNA, 62 nt, hsa
aaaauugcaauuuguuuaauucagaauguguauuuaaaaagaaaaggaauuuaacaauuugc

SEQ ID NO: 472783 - RNA, 62 nt, hsa
uuacugaaccaacaaucaaaaaaugguucuguuuuaaaaaggauuuuguuugauuugaaauu

SEQ ID NO: 472784 - RNA, 62 nt, hsa
uccagugcauccuuacuuagguauuauacuucuuuaaaaagcucugaagcugcuacaauaga

SEQ ID NO: 472785 - RNA, 62 nt, hsa
uuccuuuuguccacuuauauaguuauuuucucuuuaaaaaaaaauuuuuuuuaauguauuag

SEQ ID NO: 472786 - RNA, 62 nt, hsa
acuggauuauucaggcuuuaggcauaugcuucuuuaaaaaagcuauaaauuauauuccucuu

SEQ ID NO: 472787 - RNA, 62 nt, hsa
uuguguguucacuaaacucugaauaagcacuuuuuaaaaaacuuucuacucauuuuaaugau

SEQ ID NO: 472788 - RNA, 62 nt, hsa
uuagagaauaguuauauuuucuauuacacaaguuuaaaaauauuauuaacuuguauuuucuu

SEQ ID NO: 472789 - RNA, 62 nt, hsa
gacuguaguuuaauacuuuuuacccaaauauguuuaaaaacuucgugcauuuguuacagcuc

SEQ ID NO: 472790 - RNA, 62 nt, hsa
ucccauuuuucuugacaacaauaaauaccacuuuuaaaaaugacacauauuuaaacacuuag

SEQ ID NO: 472791 - RNA, 62 nt, hsa
augacaaaaugaaaaugcuuaaacuacagaaauuuaaaaaugccauaacaaucuugcgagac

SEQ ID NO: 472792 - RNA, 62 nt, hsa
uccucccaaccaggcuaauaaccuaacacauguuuaaaaaaaaucugccuaagccgggugug

SEQ ID NO: 472793 - RNA, 62 nt, hsa
agccaaggcccauuagccaguuuagcauuuacuuuaaaaaugacaugaggcagauucuuauc

SEQ ID NO: 472794 - RNA, 62 nt, hsa
gcaagaaaagaagaauaguuguuuaaauauuuuuuaaaaaacacuugaauaagaaucaguag

SEQ ID NO: 472795 - RNA, 62 nt, hsa
ugaauaagaaucaguaggguauaaacuagaaguuuaaaaaugcuucauagaacguccagggu

SEQ ID NO: 472796 - RNA, 62 nt, hsa
ccggcuaaaacauugcaaauuuaaaugagaguuuuaaaaauuaaauaaugacugcccuguuu

SEQ ID NO: 472797 - RNA, 62 nt, hsa
uuggcuuuugaaucgauuauuucaugcuuuuuuuuaaaaaaaaaaaaaaacaaaauaacaau

SEQ ID NO: 472798 - RNA, 62 nt, hsa
gguuucagaaauauauugaaaguuuaacaauguuuaaaaauagaaaagcaugaguguucaug

SEQ ID NO: 472799 - RNA, 62 nt, hsa
aaaccacuggaaaguuuaugguuguauuauuuuuuaaaaaaauuccaagugauugaaaccua

SEQ ID NO: 472800 - RNA, 62 nt, hsa
agguaaaagcaucacaugaacuuguaaaggaauuuaaaaauccuacuuucauaauaaguugc

SEQ ID NO: 472801 - RNA, 62 nt, hsa
uguaaauuaucaagcuucaaaaagcuuuuuuuuuuaaaaaaaaacaugcauauucuaaaaau

SEQ ID NO: 472802 - RNA, 62 nt, hsa
aucugcacaguuugguuuuugcacaaaagucauuuaaaaaaaucugaguaauugucaaauau

SEQ ID NO: 472803 - RNA, 62 nt, hsa
auugagauauucugcagcugauagagcagcauuuuaaaaauguaacagguggaaaauuacac

SEQ ID NO: 472804 - RNA, 62 nt, hsa
aaagaaaaaguguucuagaguguuguugcuuuuuuaaaaaaagcgcugaaguuagaccaagg

SEQ ID NO: 472805 - RNA, 62 nt, hsa
gcugagaugagguuuuggaaaacccugacaccuuuaaaaagcaguuuuugaaagacaaaauu

SEQ ID NO: 472806 - RNA, 62 nt, hsa
ccuaauuuuccagagaagccuauuuuuauauuuuuaaaaaacugacagggcccaguuaaaua

SEQ ID NO: 472807 - RNA, 62 nt, hsa
gacaaaaucugauauauuggacuucuucaaaauuuaaaaacuugugauuuaagaagaggaaa

SEQ ID NO: 472808 - RNA, 62 nt, hsa
auagugagacucuugucucuacaaaaaguuuuuuuaaaaaauuaacugggcaccaugacaca

SEQ ID NO: 472809 - RNA, 62 nt, hsa
aauaaaaccauaaaugaaacacuugagcacacuuuaaaaaguacauaaauccaugaguccau

SEQ ID NO: 472810 - RNA, 62 nt, hsa
auaaaucauaguaauaauauugaacauucuacuuuaaaaauuauuaauaaaaccauaaauga

SEQ ID NO: 472811 - RNA, 62 nt, hsa
ugacauugaaguuguuggaggaauguacuguauuuaaaaaaaccuucugugacacauucaaa

SEQ ID NO: 472812 - RNA, 62 nt, hsa
gagaaaaauauauccaguaauaguauugacuguuuaaaaaauugagcucaucaaaaauauug

SEQ ID NO: 472813 - RNA, 62 nt, hsa
augaucaaaaauauaguuauaauuuuuugaauuuuaaaaaugugauugcucuaauaaagaau

SEQ ID NO: 472814 - RNA, 62 nt, hsa
auauugaaacccauuuccuguguguuaaaauauuuaaaaaguggauauuccaggaauguuuu

SEQ ID NO: 472815 - RNA, 62 nt, hsa
gucuuugugugcuagaauauuauugguaauguuuuaaaaauuccuuugauugauagagaagg

SEQ ID NO: 472816 - RNA, 62 nt, hsa
aaaaaugacaacauucacaaaauuuauuacuuuuuaaaaaauaacaugccuauuaacugguu

SEQ ID NO: 472817 - RNA, 62 nt, hsa
auucugacaguguugugauucuguauaggauuuuuaaaaaugacaacauucacaaaauuuau

SEQ ID NO: 472818 - RNA, 62 nt, hsa
gcacugccuaguuaacagaagucuuauaaaaauuuaaaaagacacauuucuuacaaaaaaga

SEQ ID NO: 472819 - RNA, 62 nt, hsa
acauaucaaaugaauggaaacuuuguugaaacuuuaaaaagcaaauuuacuccaaagacuug

SEQ ID NO: 472820 - RNA, 62 nt, hsa
agccugggaaaugugguaaaacuccgacucuauuuaaaaaaaaaacaaaaacaaaaaaaccu

SEQ ID NO: 472821 - RNA, 62 nt, hsa
cacaaauaguaugugcucauuguaguacauuuuuuaaaaaccacaaaugagcaaagauuuuu

SEQ ID NO: 472822 - RNA, 62 nt, hsa
uaagaugugauaugguacugugguuauguuguuuuaaaaaaugauuaucuuuuagagaagua

SEQ ID NO: 472823 - RNA, 62 nt, hsa
gcuauuagaggggaacacaaagugaagguuuuuuuaaaaaagaggacuugcaucagcugccu

SEQ ID NO: 472824 - RNA, 62 nt, hsa
uugcacccccacauccaaaggauguggagcucuuuaaaaauaaauugcucuggucccaccuc

SEQ ID NO: 472825 - RNA, 62 nt, hsa
agaaucguuuguaaagcuuuuucuuuuuccuuuuuaaaaaguaaagcaauauauacacaggu

SEQ ID NO: 472826 - RNA, 62 nt, hsa
uaucugcagcuggauacucuucuuuaaaaauguuuaaaaauuauuuagauugauucucccca

SEQ ID NO: 472827 - RNA, 62 nt, hsa
uaacugcugcuaucugcagcuggauacucuucuuuaaaaauguuuaaaaauuauuuagauug

SEQ ID NO: 472828 - RNA, 62 nt, hsa
cuucaaauucuauccucuuugauacuugauuuuuuaaaaauacuguucagaaugcuuuaaua

SEQ ID NO: 472829 - RNA, 62 nt, hsa
uagugauccacugaucucuaaucagaaauauuuuuaaaaaauacaauuuagaucucugaaaa

SEQ ID NO: 472830 - RNA, 62 nt, hsa
aagugacuauuugauuaacacauuaaaaauuuuuuaaaaauuuccccuuuaaguuaugaugg

SEQ ID NO: 472831 - RNA, 62 nt, hsa
acauaguauuuuugcagccuaagaguucauuauuuaaaaauaaacuaaagaaauaugucacc

SEQ ID NO: 472832 - RNA, 62 nt, hsa
caaugccgcuacuuugcuguggacaccccugcuuuaaaaacccuuuugcuagcugugcuauu

SEQ ID NO: 472833 - RNA, 62 nt, hsa
auauaaauuaccauuguuuguggaggauuacauuuaaaaaagcaaaaagugaaaaaaaaaag

SEQ ID NO: 472834 - RNA, 62 nt, hsa
acauacacaucagccaucaacuaaaguuguacuuuaaaaauuuacuacaauauguacauuuc

SEQ ID NO: 472835 - RNA, 62 nt, hsa
uagcuguguuauuauagagcagaaauucuguuuuuaaaaauuagccuaagauauacuuguuu

SEQ ID NO: 472836 - RNA, 62 nt, hsa
cacagaucuaucauaauugcuuuucugaugcauuuaaaaauaaauggaacacuuaaauguau

SEQ ID NO: 472837 - RNA, 62 nt, hsa
aacauuucaguuacuuuucaguuaauuauuccuuuaaaaagaaaauacagcagaaccucacu

SEQ ID NO: 472838 - RNA, 62 nt, hsa
aaaauaguuugccuuaggucacgccuuaggauuuuaaaaaaauuacauugaaacaucaaacu

SEQ ID NO: 472839 - RNA, 62 nt, hsa
uacacacaugcacauaugucaaauauaauuuuuuuaaaaauugaguggcacaucaaagaaau

SEQ ID NO: 472840 - RNA, 62 nt, hsa
caggagaaguagcuuaaauucacuaauauuaauuuaaaaagcagcaugaacccucuacuuau

SEQ ID NO: 472841 - RNA, 62 nt, hsa
aaaaggcuuuuaaauuaguacaacuguuacuauuuaaaaaaaaaauacccuaaguacucugu

SEQ ID NO: 472842 - RNA, 62 nt, hsa
uuaacuuucuuuccaauuuaaggaguugagaguuuaaaaauauuccagcccuaaguuuuuau

SEQ ID NO: 472843 - RNA, 62 nt, hsa
uaacuauuucacaugagucaaaacaaagcagcuuuaaaaaaauaauuggaagcacaagugca

SEQ ID NO: 472844 - RNA, 62 nt, hsa
aguagguauuaaucuuauuguuuaaucuuuuuuuuaaaaaaacuggauauuucaaucuuuua

SEQ ID NO: 472845 - RNA, 62 nt, hsa
uguaauaacacauuguaaagaacagaaauuacuuuaaaaaauaaacagaaauggagaccuga

SEQ ID NO: 472846 - RNA, 62 nt, hsa
gguccagacaccaagaaucauagggguuuuuuuuuaaaaaaccuaauagaaguagggugacc

SEQ ID NO: 472847 - RNA, 62 nt, hsa
gaugccuauaaauguggguuuugcaaauauuguuuaaaaaccaaacuugaagccaggcaugg

SEQ ID NO: 472848 - RNA, 62 nt, hsa
uguaaacuaguauguaugugcuuugcuuacuuuuuaaaaaaauguaguuagacugugaggag

SEQ ID NO: 472849 - RNA, 62 nt, hsa
ugagcuuaauugcuuaaauaaguucuagaaaauuuaaaaaucauuuuaguagaauucaguac

SEQ ID NO: 472850 - RNA, 62 nt, hsa
caguauucccacuccuggcauuuucuggcagguuuaaaaauauucagcauaaauccagcaga

SEQ ID NO: 472851 - RNA, 62 nt, hsa; identical to SEQ ID NO: 472782

SEQ ID NO: 472852 - RNA, 62 nt, hsa
uuacugaagcaacaaucgaaaaaugguucuguuuuaaaaaggauuuuguuugauuugaaauu

SEQ ID NO: 472853 - RNA, 62 nt, hsa
ggacaacaucugaaggguauguugcaugcauuuuuaaaaaaaucaucucauaugcauuguau

SEQ ID NO: 472854 - RNA, 62 nt, hsa
uggagaguuucuguuaggaaaagccauacauuuuuaaaaauguagcaaaaugucaagggaaa

SEQ ID NO: 472855 - RNA, 62 nt, hsa
gauccgcagauucaugcagcauuccauauuuuuuuaaaaaaagguuacacugugcaccgacg

SEQ ID NO: 472856 - RNA, 62 nt, hsa
aaucauaguaauaauauuauugaacauucuacuuuaaaaauuauuaauaaaaccauaaauga

SEQ ID NO: 472857 - RNA, 62 nt, hsa
aauaaaaccauaaaugaaacacuugagcacacuuuaaaaaguacauaaacccaugaguccau

SEQ ID NO: 472858 - RNA, 62 nt, hsa
augagcuaaaacauggaacaaucacugaauaauuuaaaaagaguuuaccuggcagagugugu

SEQ ID NO: 472859 - RNA, 62 nt, hsa
uuaaauguuuaaaggguuucccaauguuugaguuuaaaaaagacuuucugaaaaaauccacu

SEQ ID NO: 472860 - RNA, 62 nt, hsa
gauagcaaauuuaaaucucuccucgaucagcuuuuaaaaaauguguacuauuaucugaggaa

SEQ ID NO: 472861 - RNA, 62 nt, hsa
cuuuuacaacugccucgaaacacagaaaccuuuuuaaaaauagacacuccccgaagucuuuu

SEQ ID NO: 472862 - RNA, 62 nt, hsa
uuuuauacucuuucuguauauacuuuuuuuucuuuaaaaaacaacuauggaucagaauagcc

SEQ ID NO: 472863 - RNA, 64 nt, hsa; identical to SEQ ID NO: 154765

SEQ ID NO: 472864 - RNA, 64 nt, hsa; identical to SEQ ID NO: 154766

SEQ ID NO: 472865 - RNA, 64 nt, hsa; identical to SEQ ID NO: 154767

SEQ ID NO: 472866 - RNA, 64 nt, hsa; identical to SEQ ID NO: 154768

SEQ ID NO: 472867 - RNA, 64 nt, hsa; identical to SEQ ID NO: 154769

SEQ ID NO: 472868 - RNA, 64 nt, hsa; identical to SEQ ID NO: 154770

SEQ ID NO: 472869 - RNA, 64 nt, hsa; identical to SEQ ID NO: 154771

SEQ ID NO: 472870 - RNA, 64 nt, hsa; identical to SEQ ID NO: 154772

SEQ ID NO: 472871 - RNA, 64 nt, hsa; identical to SEQ ID NO: 154770

SEQ ID NO: 472872 - RNA, 64 nt, hsa; identical to SEQ ID NO: 154769

SEQ ID NO: 472873 - RNA, 64 nt, hsa; identical to SEQ ID NO: 154775

SEQ ID NO: 472874 - RNA, 64 nt, hsa; identical to SEQ ID NO: 154776

SEQ ID NO: 472875 - RNA, 64 nt, hsa; identical to SEQ ID NO: 96889

SEQ ID NO: 472876 - RNA, 64 nt, hsa; identical to SEQ ID NO: 96890

SEQ ID NO: 472877 - RNA, 64 nt, hsa; identical to SEQ ID NO: 96891

SEQ ID NO: 472878 - RNA, 64 nt, hsa; identical to SEQ ID NO: 96892

SEQ ID NO: 472879 - RNA, 64 nt, hsa; identical to SEQ ID NO: 96893

SEQ ID NO: 472880 - RNA, 64 nt, hsa; identical to SEQ ID NO: 96894

SEQ ID NO: 472881 - RNA, 64 nt, hsa; identical to SEQ ID NO: 96895

SEQ ID NO: 472882 - RNA, 64 nt, hsa; identical to SEQ ID NO: 96896

SEQ ID NO: 472883 - RNA, 64 nt, hsa; identical to SEQ ID NO: 96897

SEQ ID NO: 472884 - RNA, 64 nt, hsa; identical to SEQ ID NO: 96898

SEQ ID NO: 472885 - RNA, 64 nt, hsa; identical to SEQ ID NO: 96899

SEQ ID NO: 472886 - RNA, 64 nt, hsa; identical to SEQ ID NO: 96900

SEQ ID NO: 472887 - RNA, 64 nt, hsa; identical to SEQ ID NO: 96901

SEQ ID NO: 472888 - RNA, 64 nt, hsa; identical to SEQ ID NO: 96902

SEQ ID NO: 472889 - RNA, 64 nt, hsa; identical to SEQ ID NO: 96903

SEQ ID NO: 472890 - RNA, 64 nt, hsa; identical to SEQ ID NO: 96904

SEQ ID NO: 472891 - RNA, 64 nt, hsa; identical to SEQ ID NO: 96905

SEQ ID NO: 472892 - RNA, 64 nt, hsa; identical to SEQ ID NO: 96906

SEQ ID NO: 472893 - RNA, 64 nt, hsa; identical to SEQ ID NO: 96907

SEQ ID NO: 472894 - RNA, 64 nt, hsa; identical to SEQ ID NO: 96908

SEQ ID NO: 472895 - RNA, 64 nt, hsa; identical to SEQ ID NO: 96909

SEQ ID NO: 472896 - RNA, 64 nt, hsa; identical to SEQ ID NO: 96910

SEQ ID NO: 472897 - RNA, 64 nt, hsa; identical to SEQ ID NO: 96911

SEQ ID NO: 472898 - RNA, 64 nt, hsa; identical to SEQ ID NO: 96912

SEQ ID NO: 472899 - RNA, 64 nt, hsa; identical to SEQ ID NO: 96913

SEQ ID NO: 472900 - RNA, 64 nt, hsa; identical to SEQ ID NO: 96914

SEQ ID NO: 472901 - RNA, 64 nt, hsa; identical to SEQ ID NO: 96915

SEQ ID NO: 472902 - RNA, 64 nt, hsa; identical to SEQ ID NO: 96916

SEQ ID NO: 472903 - RNA, 64 nt, hsa
uuaugugccuuuuuguuuuuguaaaaaaggaacacccggaaagacugaaagaauacauuuuaua

SEQ ID NO: 472904 - RNA, 64 nt, hsa
aggaaggauggagguggacucucaccccauuccccccggaaaugaacaaagccgggcccuuucc

SEQ ID NO: 472905 - RNA, 64 nt, hsa
gcuguccacggaacauggcagaggggcaccccggcccggaaagacgccagagccagcaggggcu

SEQ ID NO: 472906 - RNA, 64 nt, hsa
aauggcuuugacuaaauuacccccauccuccuugcccggaaaagggagagcuagagccacucac

SEQ ID NO: 472907 - RNA, 64 nt, hsa
ggggcuguuuagaaauauauggccaaaucuguaacccggaaacagcaaaaaacuucuuagcaaa

SEQ ID NO: 472908 - RNA, 64 nt, hsa
aacgcaguuuggaugucuuugaggacagacauugcccggaaacucagucuauuuauucuucagc

SEQ ID NO: 472909 - RNA, 50 nt, hsa
gcguggagugcagcgucugacccggaaacccuuucacuucucugcucccg

SEQ ID NO: 472910 - RNA, 64 nt, hsa
cagagcgggccgcacugucugucuguccgucugucccggaaagaacuauaaagcgcuggaagcg

SEQ ID NO: 472911 - RNA, 64 nt, hsa
guccucagagcauugcgugugugucuugcuguagcccggaaaagguuuuguguaaagauucugg

SEQ ID NO: 472912 - RNA, 64 nt, hsa
gauucccggccacacuuugcauuucaacacucagcccggaaagaugcucguucgguuguuggac

SEQ ID NO: 472913 - RNA, 64 nt, hsa
ugagugccucuguuuuccagaagauuucacaauccccggaaaacugguauggcuauucuugaag

SEQ ID NO: 472914 - RNA, 64 nt, hsa
aggagcucuccagccucggcgccugggcagagggcccggaaacccucggaccagagugugugga

SEQ ID NO: 472915 - RNA, 64 nt, hsa
gaccuggucaccccagcaagugcuauggacaguucccggaaacgguugcccacuucacaggucc

SEQ ID NO: 472916 - RNA, 64 nt, hsa
aaaacuaaaaaggaccagagaauucuuagauuggcccggaaaggccaauaaagaguuagaauga

SEQ ID NO: 472917 - RNA, 64 nt, hsa
gccaagggcaagugauuugacagguaucugagcucccggaaacgcuaucaaacccaaaggcucu

SEQ ID NO: 472918 - RNA, 64 nt, hsa
ccccccgcgcgcccacccacacucacuccaugcucccggaaaucgagaggaagauccauuaguu

SEQ ID NO: 472919 - RNA, 64 nt, hsa
cccaacucugccacagcucauccucggaggcaaucccggaaaccucuuuuauaagugugauuuu

SEQ ID NO: 472920 - RNA, 64 nt, hsa
ggccgugcgcacuguguuccgugcccuggggacccccggaaaagcagcccagucagauguggga

SEQ ID NO: 472921 - RNA, 64 nt, hsa
gaugcauggaggauggugugagcuuuucagcaggcccggaaagguacgcaggugacgccuuagc

SEQ ID NO: 472922 - RNA, 64 nt, hsa
gaaaugaaaagggaaaaccacauagaaggguaaucccggaaaugcuucaucugguggacugugg

SEQ ID NO: 472923 - RNA, 64 nt, hsa
ccuuuccuuucccagaaaaacugaggaaacuggccccggaaaagcaugucuuugggguugguuc

SEQ ID NO: 472924 - RNA, 64 nt, hsa
acacccggcccacgcgugcugcagauguggggagcccggaaacaccuggcccaugccuguucag

SEQ ID NO: 472925 - RNA, 64 nt, hsa
gcuccugccccaccccaccuccuccgggcuuccucccggaaacucagcgccugcugcacuugcc

SEQ ID NO: 472926 - RNA, 62 nt, hsa
guggccccuucguuccuuguaaauaaaucccgcccccggaaaugacgucuccaccuucgugg

SEQ ID NO: 472927 - RNA, 64 nt, hsa
cuuggacaugggccccagauaccaugaugcugagcccggaaacuccacauccugugggaccugg

SEQ ID NO: 472928 - RNA, 64 nt, hsa
agacacucaguugacacuuguuauaucaugggaccccggaaauuggagugaagcuagaaacaga

SEQ ID NO: 472929 - RNA, 64 nt, hsa
acaaaugugucugagucuuggaaaacaccccaaccccggaaaugugugggaaaaagaaaacaaa

SEQ ID NO: 472930 - RNA, 64 nt, hsa
ggggaaagggaggaagauauggcacuucuccaaccccggaaaacauugcuuuugaaaacugcug

SEQ ID NO: 472931 - RNA, 64 nt, hsa
gacagaguagaagcuggagugccucaccacacggcccggaaacagcgggaaguaacuggaaaga

SEQ ID NO: 472932 - RNA, 64 nt, hsa
agggccugagcucucuuccccagcauugcccccacccggaaaccccaccuuuggagaguuaauu

SEQ ID NO: 472933 - RNA, 64 nt, hsa
cuugccugugcugugcuuccaggucacagagccccccggaaacucacaggggcccucuucccag

SEQ ID NO: 472934 - RNA, 64 nt, hsa
auuaguuugucauaaaguuuuaggaaagguaggacccggaaagaaguucuaauuaguugucuaa

SEQ ID NO: 472935 - RNA, 64 nt, hsa
gcauuacuucuaccuuagguuuaggaguaauauacccggaaaucuaagcucauggaaacauguu

SEQ ID NO: 472936 - RNA, 64 nt, hsa
aggccugaggagcccagagcacuugacugagcuucccggaaacuggcccuaaccugucugucuc

SEQ ID NO: 472937 - RNA, 64 nt, hsa
cucggcucgcccucucccccggaggccgcgcccucccggaaaagccggguccuccagaccccga

SEQ ID NO: 472938 - RNA, 61 nt, hsa
guccuggccuggaggugugaaggugcuguaucccggaaaucuaucuggacccuggacugca

SEQ ID NO: 472939 - RNA, 64 nt, hsa
ucaguggacccagugcugagaaaagcccccacaucccggaaaacccacuuuccuuucacgaccc

SEQ ID NO: 472940 - RNA, 64 nt, hsa
gcauguucauugcaaacagaagguuccuugagcacccggaaacggucacgagacccagaggaag

SEQ ID NO: 472941 - RNA, 64 nt, hsa
gcacccgaauuucuguccguucccaaagaucggccccggaaaaagucugccccagaaacucuca

SEQ ID NO: 472942 - RNA, 64 nt, hsa
ucgccuaaccugguuucuagcuuugcccucacuccccggaaaaacugacacugacacaggggcc

SEQ ID NO: 472943 - RNA, 64 nt, hsa
guggggggacaggagggggcccuggggccugggccccggaaaaaucuaucugcccucccccaca

SEQ ID NO: 472944 - RNA, 64 nt, hsa
uggcucccucccacccaaccaacuuuccccccaacccggaaacagacaagcaacccaaacugaa

SEQ ID NO: 472945 - RNA, 64 nt, hsa
cagauccuguugaagaaagagcuuaccccuuucccccggaaaacuugcaauccuguaguuccca

SEQ ID NO: 472946 - RNA, 64 nt, hsa
uuggccucugccguccacaggacgcccucuugcucccggaaacguguggucacccgccguccac

SEQ ID NO: 472947 - RNA, 64 nt, hsa
gggcagggugcugccuucccauuggacagcugcucccggaaaugcaaaugagacuccuggaaac

SEQ ID NO: 472948 - RNA, 64 nt, hsa
cugguguucuaagagcccccgugcaaaucggagacccggaaacugaucagggcagcugcucugu

SEQ ID NO: 472949 - RNA, 64 nt, hsa
gugaaugagugaggaagagcagaguauguggauacccggaaacacacacacacacacaucauca

SEQ ID NO: 472950 - RNA, 64 nt, hsa
ucccggucccagucccaccaggcaacuccuuccacccggaaauucuucccuucccuuagccugu

SEQ ID NO: 472951 - RNA, 64 nt, hsa
ucacagggugggaaacgaaauucgagggaaauuccccggaaauaugagggaaaucucugcauug

SEQ ID NO: 472952 - RNA, 64 nt, hsa
caaaacaaaacaaaacaaaugacaguaacccuuccccggaaagaaauagaacaaucauggagcc

SEQ ID NO: 472953 - RNA, 64 nt, hsa
uauguaagcuaaaaagcugugugaacccaggugucccggaaaggggcugcaggacacagcaaaa

SEQ ID NO: 472954 - RNA, 64 nt, hsa
ucuuuuaagugcugaacuuauuuuucaaccauuucacaaggaggacaaguugaauggaccuuuu

SEQ ID NO: 472955 - RNA, 64 nt, hsa
cuauucccaccauggggagcgaaaacguuaaaaucacaaggaauugcccaaucuaagcagacuu

SEQ ID NO: 472956 - RNA, 64 nt, hsa
agggagcugggagcgagcaagcugaggccacguccacaaggagcuuuucaugccccugugccgc

SEQ ID NO: 472957 - RNA, 64 nt, hsa
aaggaucagggggccaggccagcagcucgggggccacaaggagauggauaaugugccuguuuuu

SEQ ID NO: 472958 - RNA, 64 nt, hsa
auggugccccaggaccagcucaggacagaugccacacaaggauagaugcuggcccagggcccag

SEQ ID NO: 472959 - RNA, 64 nt, hsa
gaaauccauucacaguucuuugggccagacaugccacaaggacuuccuguccagcuccaaccug

SEQ ID NO: 472960 - RNA, 64 nt, hsa
ugacacaaggacuccacacugugcucucuaguagcacaaggaggaaguuggacagaacauuggg

SEQ ID NO: 472961 - RNA, 64 nt, hsa
cagguggcuguucagguggaccaaagcaccuugacacaaggacuccacacugugcucucuagua

SEQ ID NO: 472962 - RNA, 64 nt, hsa
cucuuuucuuuagauggugccaccuaugcccaccacaacagagauuuuacauggaaaccgggcu

SEQ ID NO: 472963 - RNA, 55 nt, hsa
uagggaaagaugaguugugagagccacaacagaggcuucagaccauuuucuuuuc

SEQ ID NO: 472964 - RNA, 64 nt, hsa
cuagaacaaauuaccacaaacuggguggcuuuaaacaacagaaauuuauucucuuaacaguucc

SEQ ID NO: 472965 - RNA, 64 nt, hsa
auacuauauauguuacauacuaacauauauauacacaacagaaaguuuauuggauuuaguacug

SEQ ID NO: 472966 - RNA, 64 nt, hsa
aaaugcguauacugggaacaggaugccuuagcccacaacagaaccagaaugaaucuuugaaggc

SEQ ID NO: 472967 - RNA, 64 nt, hsa
ucuuuucacauggaugaaauaauuccugcuaccaacaacagagcuucaccaggaaguugaguuu

SEQ ID NO: 472968 - RNA, 64 nt, hsa
caaagaauugaaacuccuagcacauccaguuuuuacaacagauuugcagcucauuccuuacccu

SEQ ID NO: 472969 - RNA, 64 nt, hsa
cagcaggguguucucagcucccagcgaagccuccacaacagaauggggccacagggcagccggg

SEQ ID NO: 472970 - RNA, 64 nt, hsa
gagcaaaaaucucagaacuugaccaugaagauacacaacagacucgcaaaaauaaagugggaaa

SEQ ID NO: 472971 - RNA, 64 nt, hsa
ugugaagugaauuucuauauguccaggagugaauacaacagaaagaguuggaucuuauuuauuu

SEQ ID NO: 472972 - RNA, 63 nt, hsa
aauguguacacgacuacuuacuacccaagcccccugaacaaacacagcuuccggcccgaggcc

SEQ ID NO: 472973 - RNA, 63 nt, hsa
aaugaaaaguacacacccauggaauucaagacccugaacaagaauaacuugaucccugaugac

SEQ ID NO: 472974 - RNA, 63 nt, hsa
cagugccuuccucucucuaccagucuauuuccacugaacaaaaccuacgcacauaccuucaug

SEQ ID NO: 472975 - RNA, 63 nt, hsa
cacugccuuccucucucuaccagucuauuuccacugaacaaaaccuacacacauaccuucaug

SEQ ID NO: 472976 - RNA, 63 nt, hsa
uuugcucagcuggcugagacacugaagaagucacugaacaaaaccuacacacguaccuucaug

SEQ ID NO: 472977 - RNA, 63 nt, hsa
uuauaucuuccuaauaagguguggucuguuugucugaacaaagugcuagacuuucuggaguga

SEQ ID NO: 472978 - RNA, 63 nt, hsa
agagugugaaaugaaaauauugccuugccauuucugaacaaaagaaaacugaauuguaaagau

SEQ ID NO: 472979 - RNA, 63 nt, hsa
agcaauuuagacuuaaguggugcuuugugguaucugaacaauucauaacauguaaauaaugug

SEQ ID NO: 472980 - RNA, 63 nt, hsa
gcuuaaacucuaauagcuguuucccuuucuauucugaacaacugucuccauuuuucaagugug

SEQ ID NO: 472981 - RNA, 63 nt, hsa
ugugacugaauguaagauuaacuuuauuuuggucugaacaaaccuuguaaaguuccauuguau

SEQ ID NO: 472982 - RNA, 63 nt, hsa
ggugaucagauaaaauauauuuugggaaauuaacugaacaaauaaaaaguuuuugauauaacu

SEQ ID NO: 472983 - RNA, 63 nt, hsa
ucauuucagucaaaucacugcagucaugaaauacugaacaauugccuuaagucuuugcuugac

SEQ ID NO: 472984 - RNA, 63 nt, hsa
cuguagaacaguuuuauuuuuauuaaaacuugacugaacaaaaggggaccaucaacauuguag

SEQ ID NO: 472985 - RNA, 63 nt, hsa
guuuaaccugcucuuggucauuggaaauuuacacugaacaaagugcaauuaacuguagaacag

SEQ ID NO: 472986 - RNA, 63 nt, hsa
aauacagugugugugugugcaccugugugccugcugaacaacuugacaguguaacagauaagg

SEQ ID NO: 472987 - RNA, 63 nt, hsa
aguauuauucuuguuuucugaauucugagucuccugaacaaaaggcuuacuauccauggucuu

SEQ ID NO: 472988 - RNA, 63 nt, hsa
uucuguggcuccagugagaacaaggcuuugaaacugaacaagauaacuucuagaaaugaacug

SEQ ID NO: 472989 - RNA, 63 nt, hsa
aggauccaggaguauuuucuucuugggugggcccugaacaaagccaaaaauuguagaaaccag

SEQ ID NO: 472990 - RNA, 63 nt, hsa
accaugacaacccugcaggugcucacccugcugcugaacaaauuuaggguaagccuggucagg

SEQ ID NO: 472991 - RNA, 63 nt, hsa
guuuugaggaaagggcuuugaauuccccagauacugaacaauuuguguuugugacugauggag

SEQ ID NO: 472992 - RNA, 63 nt, hsa
uuuaaaagcaucauuuaaaaaaaaaugacaugccugaacaacuuuuccacuuuccacgugcuu

SEQ ID NO: 472993 - RNA, 63 nt, hsa
uaaaggguaguuguuuuacaaugaagacuaaaacugaacaagauguugcaugcucuugaggcc

SEQ ID NO: 472994 - RNA, 63 nt, hsa
gugucaaguuacucaaaguuauugcuguuggaacugaacaauaauauuucccagauagcuggc

SEQ ID NO: 472995 - RNA, 63 nt, hsa
cauaauuaaagcaguugaacuauagggaaagcacugaacaaaccacuuuggaguaaauagcua

SEQ ID NO: 472996 - RNA, 64 nt, hsa
uuuucuucucagcugguccccaggcccacgggcacagggagagggacaacugcagcagugggga

SEQ ID NO: 472997 - RNA, 64 nt, hsa
cagugaacaucauugaagcgugacugccugucugcagggagaaggauuccauuuuucuucucag

SEQ ID NO: 472998 - RNA, 64 nt, hsa
gucugcuccuuguugggcagacaccagcggugugcagggagagaccaaguaccaucuuuaucua

SEQ ID NO: 472999 - RNA, 64 nt, hsa
augugcuuccauacagugguuucugaagcuuuugcagggagagaagauggcuuaguguuuagac

SEQ ID NO: 473000 - RNA, 64 nt, hsa
ugugugucucagucccuguaagucauguccuucacagggagaauuaacccuucgauauacaugg

SEQ ID NO: 473001 - RNA, 64 nt, hsa
cuaaucagugacuuaagagagauuuucuuguauacagggagagugagauaacuuauugugaagg

SEQ ID NO: 473002 - RNA, 64 nt, hsa
ugcccagaaguggaugaugugggaguugacaggccagggagagggugaagcagguaucagaguc

SEQ ID NO: 473003 - RNA, 64 nt, hsa
uggaacaugaaaaccuccacagcaacaucgaaaccagggagaaagugauccuugcucccugcag

SEQ ID NO: 473004 - RNA, 64 nt, hsa
uuaguuuauuuuuagagauuacagaauuuuuaaacagggagacgugugauauacucccucccuu

SEQ ID NO: 473005 - RNA, 64 nt, hsa
acacuggucagucauuucagaggcagcagaugcccagggagacccaagaaagagucagguuagg

SEQ ID NO: 473006 - RNA, 64 nt, hsa
aggcccacaagccccuccccugggcucucccaggcagggagaauggggagagggaccuccuugu

SEQ ID NO: 473007 - RNA, 64 nt, hsa
acagacauucccucaguguggggggcaggggacacagggagaggaugguugucccuggggaggg

SEQ ID NO: 473008 - RNA, 64 nt, hsa
accuuagccccucagaacagggagucccaggacccagggagaguguggggacaggacagccugu

SEQ ID NO: 473009 - RNA, 64 nt, hsa
agaaaaaaaaacaugaauucuuuuucuggaaaaucagggagacauggguaauaauagguacuaa

SEQ ID NO: 473010 - RNA, 64 nt, hsa
gcucaccuaggugagugcacagccugugacgcuacagggagaggcugaguaaaccgagauccag

SEQ ID NO: 473011 - RNA, 64 nt, hsa
gaaaguucccugugcucauggagcuuacauucuacagggagaaagagauagccaauacauagga

SEQ ID NO: 473012 - RNA, 64 nt, hsa
aagugagaacuugcucuacguggucaggaaagagcagggagaccaagcagagucgugggcaggg

SEQ ID NO: 473013 - RNA, 64 nt, hsa
agccugucuagaugugggacucauugccccaaaccagggagaggaagagcucccacagggagag

SEQ ID NO: 473014 - RNA, 64 nt, hsa
cauugccccaaaccagggagaggaagagcucccacagggagagcccaggcucucuuugcagccu

SEQ ID NO: 473015 - RNA, 64 nt, hsa
uugauguuuauuggcucauguggacagaaauguacagggagaauuacauuauuuuaacacacag

SEQ ID NO: 473016 - RNA, 64 nt, hsa
agauuucuuguucuauggaagaggaagcugagcucagggagauaugagcuccacagccacagcu

SEQ ID NO: 473017 - RNA, 64 nt, hsa
ugcccagaccugcgugucagcccuuggugguggccagggagaggcgcccggugcagauggcccc

SEQ ID NO: 473018 - RNA, 64 nt, hsa
guguccccgcucggggagggcccggccgagcgggcagggagagccaguccugucggcugggccc

SEQ ID NO: 473019 - RNA, 64 nt, hsa
ggccaaacccaagaaggucuggcaaagucaggcucagggagacucugcccugcugcagaccucg

SEQ ID NO: 473020 - RNA, 64 nt, hsa
gcugcggccccgugggguaggagggacagagagacagggagagucagccuccacauucagaggc

SEQ ID NO: 473021 - RNA, 64 nt, hsa
uagauccaggacgcccugcaggacucagccuguacagggagaugaagugccccagguugggagc

SEQ ID NO: 473022 - RNA, 64 nt, hsa
ccuccugaacuggccacuccccagugcucccgugcagggagaggaagcacccaguuugagagug

SEQ ID NO: 473023 - RNA, 64 nt, hsa
uaggucaugaaggacacucugcagggugaagcaccagggagaggccucggcugucuccuguccc

SEQ ID NO: 473024 - RNA, 64 nt, hsa
agaggucaucccuuccuccucuccuggaaacagacagggagaaguugagcagguaucaacuagg

SEQ ID NO: 473025 - RNA, 53 nt, hsa
aauucggccuccugaaaugacagcagggagacuugggucggccuccugaaaug

SEQ ID NO: 473026 - RNA, 64 nt, hsa
cagggagacuugggucggccuccugaaaugacagcagggagacuugggugaccccccuuccagg

SEQ ID NO: 473027 - RNA, 64 nt, hsa
ccugagcugcugugaaagccccugcacaaucagccagggagaacugggcggguuuaguggcccc

SEQ ID NO: 473028 - RNA, 64 nt, hsa
agucuuaggccuacgaugccacacaaagguuguucagggagaagggggugcaggaggcagaggg

SEQ ID NO: 473029 - RNA, 64 nt, hsa
ccgggcuccugggcccuguucuuaggaucaguggcagggagaaacggguaucucuuuucucucu

SEQ ID NO: 473030 - RNA, 64 nt, hsa
ccacucugagguuuccccaagagaaccagauuggcagggagaagcauuguggggcaauuguucc

SEQ ID NO: 473031 - RNA, 64 nt, hsa
ugagccgaggaguucaagaccagccuggguaucacagggagaccccgucucuacaaaauaaaaa

SEQ ID NO: 473032 - RNA, 53 nt, hsa
aaacaggacuguugcuaugacaacagggagaaccccaucuccagcuggaacgu

SEQ ID NO: 473033 - RNA, 64 nt, hsa
gcacggugaggccugacauccuggggaagggcaacagggagaccuacaggauguuggcugcuug

SEQ ID NO: 473034 - RNA, 64 nt, hsa
uaccugggugguugaggggacugacauuugaggacagggagauggagcagugucauugucagug

SEQ ID NO: 473035 - RNA, 64 nt, hsa
gcaguggcauuguuucugcuguggugggaacuggcagggagagggucaccuccacucugguugg

SEQ ID NO: 473036 - RNA, 64 nt, hsa
cuuuggugcacucaccguccaccguuccccaaggcagggagagggaguggcccgucccugggag

SEQ ID NO: 473037 - RNA, 64 nt, hsa
ucaucugcggcuuaaacucaucucgcuugaagggcagggagaaacccaugaaucucaggcacgg

SEQ ID NO: 473038 - RNA, 64 nt, hsa
uucucuaacaaaucuguaguaaguauacggacuccagggagagaggcugggcuucuuucucuca

SEQ ID NO: 473039 - RNA, 64 nt, hsa
ccagagcgagcagcguggagcucagugacagcagcagggagaaauccacugaaggaaaaaaccc

SEQ ID NO: 473040 - RNA, 64 nt, hsa
acuaaucagugggcacaccaagggcccugaggggcagggagaugccaccaugcuucucugucac

SEQ ID NO: 473041 - RNA, 64 nt, hsa
gagaccucgggagugaggacgcagggguaugaggcagggagagggugugccgcucguacuccug

SEQ ID NO: 473042 - RNA, 64 nt, hsa
uguguguuucucuacugagccuggggucucuagccagggagaccccaucuuauucaccaugucc

SEQ ID NO: 473043 - RNA, 64 nt, hsa
auuuauucagggaggaggaaaaguggugcagggacagggagauggggcgcuagggguucuuagu

SEQ ID NO: 473044 - RNA, 64 nt, hsa
uccaaacgauggaguagccagugguaauacaaagcagggagaacagaaagguagaguuacuaag

SEQ ID NO: 473045 - RNA, 64 nt, hsa
gaauauacuugagaaagcacuaguggcuuguguucagggagaggagcuggcaguuuuuaaccac

SEQ ID NO: 473046 - RNA, 64 nt, hsa
gaggugggcaccggccccaagugcagagucaaggcagggagaggccggcuggagccaggccccc

SEQ ID NO: 473047 - RNA, 64 nt, hsa
gacaugagucaggggcaccauggaccucacgugccagggagacuugaauguggcugucacucuu

SEQ ID NO: 473048 - RNA, 64 nt, hsa
ggccuggcuucuccuuuggaagugaggcauugcacagggagacguacguaucagcggccccuug

SEQ ID NO: 473049 - RNA, 64 nt, hsa
uuugagauggacacacugguguggauuaaccugccagggagacagagcucacaauaaaaauggc

SEQ ID NO: 473050 - RNA, 64 nt, hsa
uuaaaccucaucuuguacuaaaggaggacacacucagggagaagaccucugugggcagggcuug

SEQ ID NO: 473051 - RNA, 64 nt, hsa
gauguaugggcaaagcuuuugugaucacacaccacagggagaaucugcauguggggacacugug

SEQ ID NO: 473052 - RNA, 64 nt, hsa
cggggaccucacaggcaggacggcgacacuaaugcagggagagggagucuggccccagcuuuuc

SEQ ID NO: 473053 - RNA, 64 nt, hsa
ggaugcugccaggugacccgaggugcacucgccccagggagauggaguagacagccuggccugg

SEQ ID NO: 473054 - RNA, 64 nt, hsa
uggggcagcccccagaaggaccacugcuggaucccagggagaaccugcuggcguuggcugugau

SEQ ID NO: 473055 - RNA, 64 nt, hsa
gacacccucccccuggagcugaugucugugacuacagggagauuagcacuucgucuagugaaac

SEQ ID NO: 473056 - RNA, 64 nt, hsa
aagagcugcagcuggagccugacccucccuggaacagggagaggcuggcccgugucacugccuc

SEQ ID NO: 473057 - RNA, 64 nt, hsa
ugaagaugcagggcagaggaauugcccauggacagugacgcaaggacuaggcugggagggagcg

SEQ ID NO: 473058 - RNA, 64 nt, hsa
gccuuuuuguugcuccgcucccaggagagugagggugacgcaauugauuaaaaccauuuuguuc

SEQ ID NO: 473059 - RNA, 64 nt, hsa
gcuuacaacuuauccccacucauuggagugaacagugacgcaagcucaauagacuucauaagug

SEQ ID NO: 473060 - RNA, 64 nt, hsa
gagaagaagaugcugaugauauugauaagaugucgugacgcaaagaaauuggaaaacaugauga

SEQ ID NO: 473061 - RNA, 64 nt, hsa
guuggcagaugagcaccaaugacugcagcguggagugacgcacugcauggucuguuuauucucu

SEQ ID NO: 473062 - RNA, 64 nt, hsa
acccccuuaacuguauagcucuuuuccuagaauagugacgcaaaucugcaugaacagcuaauug

SEQ ID NO: 473063 - RNA, 64 nt, hsa
gguucauuuuuguauuuauuucauuuaaaaucaugugacgcagaauaguuuugcaauguguaua

SEQ ID NO: 473064 - RNA, 64 nt, hsa
cagcagaacaaaggaguucacuggcuuagcuacagugacgcauugaaacuugaguaauuccugu

SEQ ID NO: 473065 - RNA, 64 nt, hsa
auauugagauguaauucagauuaggacacagugugugacgcagauaacugguuacucagcuccc

SEQ ID NO: 473066 - RNA, 64 nt, hsa
ggccuaggccuuguugaaggcuucaucaggaaaugugacgcagagauugugcugcugugcuuca

SEQ ID NO: 473067 - RNA, 64 nt, hsa
gugaugagaaauaauuaauuggacgggagacagagugacgcacugacucaccuagaggcuggaa

SEQ ID NO: 473068 - RNA, 64 nt, hsa
cuucggggcucagagaggugaugacgugcccaaggugacgcaacucgugaacagccgugccugc

SEQ ID NO: 473069 - RNA, 64 nt, hsa
cagucacuauucaugccggauaauagagaacuaugugacgcaguccucucaggagucugaguuu

SEQ ID NO: 473070 - RNA, 64 nt, hsa
gagaguaugugcugagaugcuuccgaccuuucaggugacgcaggaacacugggggagucugaau

SEQ ID NO: 473071 - RNA, 50 nt, hsa
gcugcuguguagcacacugagugacgcaaucaauguuuacucgaacagaa

SEQ ID NO: 473072 - RNA, 64 nt, hsa
cuuacagcacaucaccucuuugcccccgacggcugugacgcagccggagggaggcacuagucac

SEQ ID NO: 473073 - RNA, 64 nt, hsa
gccugaugucuaccagaagcccuguguguggauggugacgcagaggacgucucuaugccgguga

SEQ ID NO: 473074 - RNA, 64 nt, hsa
agaaaaggcaucauuguccgcuccauuaagaacagugacgcaccugcuacuucccuucacagac

SEQ ID NO: 473075 - RNA, 64 nt, hsa
aggaggccguaugaagacagaggcagagauuggagugacgcaucuccaagccaaggaauuccaa

SEQ ID NO: 473076 - RNA, 64 nt, hsa
cucuacuaaaaauacaaaaaauuagcugaguguagugacgcaugcccucaaucccagcuacuca

SEQ ID NO: 473077 - RNA, 64 nt, hsa
gcauuggauaggggaacagcaggcagggcucugggugacgcaugccucuggucuaauaaacugg

SEQ ID NO: 473078 - RNA, 64 nt, hsa
ucugugaaccguagcagcgccuccggccccuccugugacgcacagcacuccuguaacugucuca

SEQ ID NO: 473079 - RNA, 64 nt, hsa
cggggucaaacacuguugcccaggcuggagugcagugacgcaauccuaacugacuguaaccuca

SEQ ID NO: 473080 - RNA, 64 nt, hsa
aacucugucucaaaaaaaaaauuagccagauguggugacgcaugccuguaguccuagcuacuca

SEQ ID NO: 473081 - RNA, 64 nt, hsa
gaaggcugaacucuucagaacacacagacuuucugugacgcagacagaggggauggggauagag

SEQ ID NO: 473082 - RNA, 64 nt, hsa
ccccaguggcugcagguagcuggacuuccugccugugacgcacagagagcagcggacuccggag

SEQ ID NO: 473083 - RNA, 64 nt, hsa
aaaaaacuuuuccgacaucuguucuuggucuuuugugacgcagguugaagggggaggaauagaa

SEQ ID NO: 473084 - RNA, 64 nt, hsa
ugauaggccuggcccacgccgccgcccccgcugagugacgcaaucgcaccacggggcugcgcuc

SEQ ID NO: 473085 - RNA, 64 nt, hsa
agaaggcgugcuggcaggcaagacgcgagugcuggugacgcacggcauuagcuuccugccccag

SEQ ID NO: 473086 - RNA, 64 nt, hsa
guaguggaggaagcgaaggaagugaacgcugaaugugacgcauuucugaagagcucagcuguca

SEQ ID NO: 473087 - RNA, 64 nt, hsa
caccuccugggcaggguucugggacccucugugggugacgcacacccugggauggggcuaguag

SEQ ID NO: 473088 - RNA, 64 nt, hsa
aauccuugccucaagcaaaagcauuucugaaucugugacgcaagaaugugcaguuacaggcugg

SEQ ID NO: 473089 - RNA, 64 nt, hsa
aucucuacuaaaaauacaaaauuagcugaggguggugacgcaugccuguaaucccagcuacucg

SEQ ID NO: 473090 - RNA, 64 nt, hsa
cugcccgggacaccaccauuaucauucuccucuagugacgcagcagcugguucugggaguuaaa

SEQ ID NO: 473091 - RNA, 64 nt, hsa
accagcuaaaucauggcaccuucaauuugccaucgugacgcagaccuguauaaauuagguuaaa

SEQ ID NO: 473092 - RNA, 64 nt, hsa; identical to SEQ ID NO: 226265

SEQ ID NO: 473093 - RNA, 64 nt, hsa; identical to SEQ ID NO: 226266

SEQ ID NO: 473094 - RNA, 64 nt, hsa; identical to SEQ ID NO: 226267

SEQ ID NO: 473095 - RNA, 64 nt, hsa; identical to SEQ ID NO: 226268

SEQ ID NO: 473096 - RNA, 64 nt, hsa; identical to SEQ ID NO: 226269

SEQ ID NO: 473097 - RNA, 64 nt, hsa; identical to SEQ ID NO: 226270

SEQ ID NO: 473098 - RNA, 64 nt, hsa; identical to SEQ ID NO: 226271

SEQ ID NO: 473099 - RNA, 64 nt, hsa; identical to SEQ ID NO: 226272

SEQ ID NO: 473100 - RNA, 64 nt, hsa; identical to SEQ ID NO: 226273

SEQ ID NO: 473101 - RNA, 64 nt, hsa; identical to SEQ ID NO: 226274

SEQ ID NO: 473102 - RNA, 64 nt, hsa; identical to SEQ ID NO: 226275

SEQ ID NO: 473103 - RNA, 64 nt, hsa; identical to SEQ ID NO: 226276

SEQ ID NO: 473104 - RNA, 64 nt, hsa; identical to SEQ ID NO: 226277

SEQ ID NO: 473105 - RNA, 64 nt, hsa; identical to SEQ ID NO: 226278

SEQ ID NO: 473106 - RNA, 64 nt, hsa; identical to SEQ ID NO: 226279

SEQ ID NO: 473107 - RNA, 64 nt, hsa; identical to SEQ ID NO: 226280

SEQ ID NO: 473108 - RNA, 64 nt, hsa; identical to SEQ ID NO: 226281

SEQ ID NO: 473109 - RNA, 64 nt, hsa; identical to SEQ ID NO: 226282

SEQ ID NO: 473110 - RNA, 64 nt, hsa; identical to SEQ ID NO: 226283

SEQ ID NO: 473111 - RNA, 64 nt, hsa; identical to SEQ ID NO: 226284

SEQ ID NO: 473112 - RNA, 64 nt, hsa; identical to SEQ ID NO: 226285

SEQ ID NO: 473113 - RNA, 64 nt, hsa; identical to SEQ ID NO: 226286

SEQ ID NO: 473114 - RNA, 64 nt, hsa; identical to SEQ ID NO: 226287

SEQ ID NO: 473115 - RNA, 64 nt, hsa; identical to SEQ ID NO: 226288

SEQ ID NO: 473116 - RNA, 64 nt, hsa; identical to SEQ ID NO: 226289

SEQ ID NO: 473117 - RNA, 64 nt, hsa; identical to SEQ ID NO: 226290

SEQ ID NO: 473118 - RNA, 64 nt, hsa; identical to SEQ ID NO: 226291

SEQ ID NO: 473119 - RNA, 64 nt, hsa; identical to SEQ ID NO: 226292

SEQ ID NO: 473120 - RNA, 64 nt, hsa; identical to SEQ ID NO: 226293

SEQ ID NO: 473121 - RNA, 64 nt, hsa; identical to SEQ ID NO: 226294

SEQ ID NO: 473122 - RNA, 64 nt, hsa; identical to SEQ ID NO: 226295

SEQ ID NO: 473123 - RNA, 64 nt, hsa; identical to SEQ ID NO: 226296

SEQ ID NO: 473124 - RNA, 64 nt, hsa; identical to SEQ ID NO: 226297

SEQ ID NO: 473125 - RNA, 64 nt, hsa; identical to SEQ ID NO: 226298

SEQ ID NO: 473126 - RNA, 64 nt, hsa; identical to SEQ ID NO: 226299

SEQ ID NO: 473127 - RNA, 64 nt, hsa; identical to SEQ ID NO: 226300

SEQ ID NO: 473128 - RNA, 64 nt, hsa; identical to SEQ ID NO: 226301

SEQ ID NO: 473129 - RNA, 64 nt, hsa; identical to SEQ ID NO: 226302

SEQ ID NO: 473130 - RNA, 64 nt, hsa; identical to SEQ ID NO: 226303

SEQ ID NO: 473131 - RNA, 64 nt, hsa; identical to SEQ ID NO: 226304

SEQ ID NO: 473132 - RNA, 64 nt, hsa; identical to SEQ ID NO: 226305

SEQ ID NO: 473133 - RNA, 64 nt, hsa; identical to SEQ ID NO: 226306

SEQ ID NO: 473134 - RNA, 64 nt, hsa; identical to SEQ ID NO: 226307

SEQ ID NO: 473135 - RNA, 64 nt, hsa; identical to SEQ ID NO: 226308

SEQ ID NO: 473136 - RNA, 64 nt, hsa; identical to SEQ ID NO: 226309

SEQ ID NO: 473137 - RNA, 64 nt, hsa; identical to SEQ ID NO: 226310

SEQ ID NO: 473138 - RNA, 64 nt, hsa; identical to SEQ ID NO: 226311

SEQ ID NO: 473139 - RNA, 64 nt, hsa; identical to SEQ ID NO: 226312

SEQ ID NO: 473140 - RNA, 64 nt, hsa; identical to SEQ ID NO: 226313

SEQ ID NO: 473141 - RNA, 64 nt, hsa
cuaguacuauugcuauuacuaguacuauuacuaguacuaguacuaugacacuguuaauaguacu

SEQ ID NO: 473142 - RNA, 64 nt, hsa
cuaguacuaguacuauugcuauuacuaguacuauuacuaguacuaguacuaugacacuguuaau

SEQ ID NO: 473143 - RNA, 64 nt, hsa
auaguacuauugcuaguacuaguacuauugcuauuacuaguacuauuacuaguacuaguacuau

SEQ ID NO: 473144 - RNA, 64 nt, hsa
uuuaccuuuaaaauaauaauaguacuauugcuaguacuaguacuauugcuauuacuaguacuau

SEQ ID NO: 473145 - RNA, 64 nt, hsa
auuggcuggcuguaauuugcauugagagaccuuuuacuaguagcuaguguuaggaagugaaccu

SEQ ID NO: 473146 - RNA, 64 nt, hsa
uuugaaaagaguauacuuuuuacuuuuauuuauguacuaguagauguaaaauuucacauugaag

SEQ ID NO: 473147 - RNA, 64 nt, hsa; identical to SEQ ID NO: 108992

SEQ ID NO: 473148 - RNA, 64 nt, hsa; identical to SEQ ID NO: 108993

SEQ ID NO: 473149 - RNA, 64 nt, hsa; identical to SEQ ID NO: 108994

SEQ ID NO: 473150 - RNA, 64 nt, hsa; identical to SEQ ID NO: 108995

SEQ ID NO: 473151 - RNA, 64 nt, hsa; identical to SEQ ID NO: 108996

SEQ ID NO: 473152 - RNA, 64 nt, hsa; identical to SEQ ID NO: 108997

SEQ ID NO: 473153 - RNA, 64 nt, hsa; identical to SEQ ID NO: 108998

SEQ ID NO: 473154 - RNA, 64 nt, hsa; identical to SEQ ID NO: 108999

SEQ ID NO: 473155 - RNA, 64 nt, hsa; identical to SEQ ID NO: 109000

SEQ ID NO: 473156 - RNA, 64 nt, hsa; identical to SEQ ID NO: 109001

SEQ ID NO: 473157 - RNA, 64 nt, hsa; identical to SEQ ID NO: 109002

SEQ ID NO: 473158 - RNA, 64 nt, hsa; identical to SEQ ID NO: 109003

SEQ ID NO: 473159 - RNA, 64 nt, hsa; identical to SEQ ID NO: 109004

SEQ ID NO: 473160 - RNA, 64 nt, hsa; identical to SEQ ID NO: 109005

SEQ ID NO: 473161 - RNA, 64 nt, hsa; identical to SEQ ID NO: 109006

SEQ ID NO: 473162 - RNA, 64 nt, hsa; identical to SEQ ID NO: 109007

SEQ ID NO: 473163 - RNA, 64 nt, hsa; identical to SEQ ID NO: 109008

SEQ ID NO: 473164 - RNA, 64 nt, hsa; identical to SEQ ID NO: 109009

SEQ ID NO: 473165 - RNA, 64 nt, hsa; identical to SEQ ID NO: 109010

SEQ ID NO: 473166 - RNA, 64 nt, hsa; identical to SEQ ID NO: 109011

SEQ ID NO: 473167 - RNA, 64 nt, hsa; identical to SEQ ID NO: 109012

SEQ ID NO: 473168 - RNA, 64 nt, hsa; identical to SEQ ID NO: 109013

SEQ ID NO: 473169 - RNA, 64 nt, hsa; identical to SEQ ID NO: 109014

SEQ ID NO: 473170 - RNA, 64 nt, hsa; identical to SEQ ID NO: 109015

SEQ ID NO: 473171 - RNA, 64 nt, hsa; identical to SEQ ID NO: 109016

SEQ ID NO: 473172 - RNA, 64 nt, hsa; identical to SEQ ID NO: 109017

SEQ ID NO: 473173 - RNA, 64 nt, hsa; identical to SEQ ID NO: 109018

SEQ ID NO: 473174 - RNA, 64 nt, hsa; identical to SEQ ID NO: 109019

SEQ ID NO: 473175 - RNA, 64 nt, hsa; identical to SEQ ID NO: 109020

SEQ ID NO: 473176 - RNA, 64 nt, hsa; identical to SEQ ID NO: 109021

SEQ ID NO: 473177 - RNA, 64 nt, hsa; identical to SEQ ID NO: 109022

SEQ ID NO: 473178 - RNA, 64 nt, hsa; identical to SEQ ID NO: 109023

SEQ ID NO: 473179 - RNA, 64 nt, hsa; identical to SEQ ID NO: 109024

SEQ ID NO: 473180 - RNA, 64 nt, hsa; identical to SEQ ID NO: 109025

SEQ ID NO: 473181 - RNA, 64 nt, hsa; identical to SEQ ID NO: 109026

SEQ ID NO: 473182 - RNA, 64 nt, hsa; identical to SEQ ID NO: 109027

SEQ ID NO: 473183 - RNA, 64 nt, hsa; identical to SEQ ID NO: 109028

SEQ ID NO: 473184 - RNA, 64 nt, hsa; identical to SEQ ID NO: 109029

SEQ ID NO: 473185 - RNA, 64 nt, hsa; identical to SEQ ID NO: 109030

SEQ ID NO: 473186 - RNA, 64 nt, hsa; identical to SEQ ID NO: 109031

SEQ ID NO: 473187 - RNA, 64 nt, hsa; identical to SEQ ID NO: 109032

SEQ ID NO: 473188 - RNA, 64 nt, hsa; identical to SEQ ID NO: 109033

SEQ ID NO: 473189 - RNA, 64 nt, hsa; identical to SEQ ID NO: 109034

SEQ ID NO: 473190 - RNA, 64 nt, hsa; identical to SEQ ID NO: 109035

SEQ ID NO: 473191 - RNA, 64 nt, hsa; identical to SEQ ID NO: 109036

SEQ ID NO: 473192 - RNA, 64 nt, hsa; identical to SEQ ID NO: 109037

SEQ ID NO: 473193 - RNA, 64 nt, hsa; identical to SEQ ID NO: 109038

SEQ ID NO: 473194 - RNA, 64 nt, hsa; identical to SEQ ID NO: 109039

SEQ ID NO: 473195 - RNA, 64 nt, hsa; identical to SEQ ID NO: 109040

SEQ ID NO: 473196 - RNA, 64 nt, hsa; identical to SEQ ID NO: 109041

SEQ ID NO: 473197 - RNA, 64 nt, hsa; identical to SEQ ID NO: 109042

SEQ ID NO: 473198 - RNA, 64 nt, hsa; identical to SEQ ID NO: 109043

SEQ ID NO: 473199 - RNA, 64 nt, hsa; identical to SEQ ID NO: 109044

SEQ ID NO: 473200 - RNA, 64 nt, hsa; identical to SEQ ID NO: 109045

SEQ ID NO: 473201 - RNA, 64 nt, hsa; identical to SEQ ID NO: 109046

SEQ ID NO: 473202 - RNA, 64 nt, hsa; identical to SEQ ID NO: 109047

SEQ ID NO: 473203 - RNA, 64 nt, hsa; identical to SEQ ID NO: 109048

SEQ ID NO: 473204 - RNA, 64 nt, hsa; identical to SEQ ID NO: 109049

SEQ ID NO: 473205 - RNA, 64 nt, hsa; identical to SEQ ID NO: 109050

SEQ ID NO: 473206 - RNA, 64 nt, hsa; identical to SEQ ID NO: 109051

SEQ ID NO: 473207 - RNA, 64 nt, hsa; identical to SEQ ID NO: 109052

SEQ ID NO: 473208 - RNA, 64 nt, hsa; identical to SEQ ID NO: 109053

SEQ ID NO: 473209 - RNA, 64 nt, hsa; identical to SEQ ID NO: 109054

SEQ ID NO: 473210 - RNA, 64 nt, hsa; identical to SEQ ID NO: 109055

SEQ ID NO: 473211 - RNA, 64 nt, hsa; identical to SEQ ID NO: 109056

SEQ ID NO: 473212 - RNA, 64 nt, hsa; identical to SEQ ID NO: 109057

SEQ ID NO: 473213 - RNA, 64 nt, hsa; identical to SEQ ID NO: 109058

SEQ ID NO: 473214 - RNA, 64 nt, hsa; identical to SEQ ID NO: 109059

SEQ ID NO: 473215 - RNA, 64 nt, hsa; identical to SEQ ID NO: 109060

SEQ ID NO: 473216 - RNA, 64 nt, hsa; identical to SEQ ID NO: 109061

SEQ ID NO: 473217 - RNA, 64 nt, hsa; identical to SEQ ID NO: 109062

SEQ ID NO: 473218 - RNA, 64 nt, hsa; identical to SEQ ID NO: 109063

SEQ ID NO: 473219 - RNA, 64 nt, hsa; identical to SEQ ID NO: 109064

SEQ ID NO: 473220 - RNA, 64 nt, hsa; identical to SEQ ID NO: 109065

SEQ ID NO: 473221 - RNA, 64 nt, hsa; identical to SEQ ID NO: 109066

SEQ ID NO: 473222 - RNA, 64 nt, hsa; identical to SEQ ID NO: 109067

SEQ ID NO: 473223 - RNA, 64 nt, hsa; identical to SEQ ID NO: 109068

SEQ ID NO: 473224 - RNA, 64 nt, hsa; identical to SEQ ID NO: 109069

SEQ ID NO: 473225 - RNA, 64 nt, hsa; identical to SEQ ID NO: 109070

SEQ ID NO: 473226 - RNA, 64 nt, hsa; identical to SEQ ID NO: 109071

SEQ ID NO: 473227 - RNA, 64 nt, hsa; identical to SEQ ID NO: 109072

SEQ ID NO: 473228 - RNA, 64 nt, hsa; identical to SEQ ID NO: 109073

SEQ ID NO: 473229 - RNA, 64 nt, hsa; identical to SEQ ID NO: 109074

SEQ ID NO: 473230 - RNA, 64 nt, hsa; identical to SEQ ID NO: 109075

SEQ ID NO: 473231 - RNA, 64 nt, hsa; identical to SEQ ID NO: 109076

SEQ ID NO: 473232 - RNA, 64 nt, hsa; identical to SEQ ID NO: 109077

SEQ ID NO: 473233 - RNA, 64 nt, hsa; identical to SEQ ID NO: 109078

SEQ ID NO: 473234 - RNA, 64 nt, hsa; identical to SEQ ID NO: 109079

SEQ ID NO: 473235 - RNA, 64 nt, hsa; identical to SEQ ID NO: 109080

SEQ ID NO: 473236 - RNA, 64 nt, hsa; identical to SEQ ID NO: 109081

SEQ ID NO: 473237 - RNA, 64 nt, hsa; identical to SEQ ID NO: 109082

SEQ ID NO: 473238 - RNA, 64 nt, hsa; identical to SEQ ID NO: 109083

SEQ ID NO: 473239 - RNA, 64 nt, hsa; identical to SEQ ID NO: 109084

SEQ ID NO: 473240 - RNA, 64 nt, hsa; identical to SEQ ID NO: 109085

SEQ ID NO: 473241 - RNA, 64 nt, hsa; identical to SEQ ID NO: 109086

SEQ ID NO: 473242 - RNA, 64 nt, hsa; identical to SEQ ID NO: 109087

SEQ ID NO: 473243 - RNA, 64 nt, hsa; identical to SEQ ID NO: 109088

SEQ ID NO: 473244 - RNA, 64 nt, hsa; identical to SEQ ID NO: 109089

SEQ ID NO: 473245 - RNA, 64 nt, hsa; identical to SEQ ID NO: 109090

SEQ ID NO: 473246 - RNA, 64 nt, hsa; identical to SEQ ID NO: 109091

SEQ ID NO: 473247 - RNA, 64 nt, hsa; identical to SEQ ID NO: 109092

SEQ ID NO: 473248 - RNA, 64 nt, hsa; identical to SEQ ID NO: 109093

SEQ ID NO: 473249 - RNA, 64 nt, hsa; identical to SEQ ID NO: 109094

SEQ ID NO: 473250 - RNA, 64 nt, hsa; identical to SEQ ID NO: 109095

SEQ ID NO: 473251 - RNA, 64 nt, hsa; identical to SEQ ID NO: 109096

SEQ ID NO: 473252 - RNA, 64 nt, hsa; identical to SEQ ID NO: 109097

SEQ ID NO: 473253 - RNA, 64 nt, hsa; identical to SEQ ID NO: 109098

SEQ ID NO: 473254 - RNA, 64 nt, hsa; identical to SEQ ID NO: 109099

SEQ ID NO: 473255 - RNA, 64 nt, hsa; identical to SEQ ID NO: 109100

SEQ ID NO: 473256 - RNA, 64 nt, hsa; identical to SEQ ID NO: 109101

SEQ ID NO: 473257 - RNA, 64 nt, hsa; identical to SEQ ID NO: 109102

SEQ ID NO: 473258 - RNA, 64 nt, hsa; identical to SEQ ID NO: 109103

SEQ ID NO: 473259 - RNA, 64 nt, hsa; identical to SEQ ID NO: 109104

SEQ ID NO: 473260 - RNA, 64 nt, hsa; identical to SEQ ID NO: 109105

SEQ ID NO: 473261 - RNA, 64 nt, hsa; identical to SEQ ID NO: 109106

SEQ ID NO: 473262 - RNA, 64 nt, hsa; identical to SEQ ID NO: 109107

SEQ ID NO: 473263 - RNA, 64 nt, hsa; identical to SEQ ID NO: 109108

SEQ ID NO: 473264 - RNA, 64 nt, hsa; identical to SEQ ID NO: 109109

SEQ ID NO: 473265 - RNA, 64 nt, hsa; identical to SEQ ID NO: 109110

SEQ ID NO: 473266 - RNA, 64 nt, hsa; identical to SEQ ID NO: 109111

SEQ ID NO: 473267 - RNA, 64 nt, hsa; identical to SEQ ID NO: 109112

SEQ ID NO: 473268 - RNA, 64 nt, hsa; identical to SEQ ID NO: 109113

SEQ ID NO: 473269 - RNA, 64 nt, hsa; identical to SEQ ID NO: 109114

SEQ ID NO: 473270 - RNA, 64 nt, hsa; identical to SEQ ID NO: 109115

SEQ ID NO: 473271 - RNA, 64 nt, hsa; identical to SEQ ID NO: 109116

SEQ ID NO: 473272 - RNA, 64 nt, hsa; identical to SEQ ID NO: 109117

SEQ ID NO: 473273 - RNA, 64 nt, hsa; identical to SEQ ID NO: 109118

SEQ ID NO: 473274 - RNA, 64 nt, hsa; identical to SEQ ID NO: 109119

SEQ ID NO: 473275 - RNA, 64 nt, hsa; identical to SEQ ID NO: 109120

SEQ ID NO: 473276 - RNA, 64 nt, hsa; identical to SEQ ID NO: 109121

SEQ ID NO: 473277 - RNA, 64 nt, hsa; identical to SEQ ID NO: 109122

SEQ ID NO: 473278 - RNA, 64 nt, hsa; identical to SEQ ID NO: 109123

SEQ ID NO: 473279 - RNA, 64 nt, hsa; identical to SEQ ID NO: 109124

SEQ ID NO: 473280 - RNA, 64 nt, hsa; identical to SEQ ID NO: 109125

SEQ ID NO: 473281 - RNA, 64 nt, hsa; identical to SEQ ID NO: 109126

SEQ ID NO: 473282 - RNA, 64 nt, hsa; identical to SEQ ID NO: 109127

SEQ ID NO: 473283 - RNA, 64 nt, hsa; identical to SEQ ID NO: 109128

SEQ ID NO: 473284 - RNA, 64 nt, hsa; identical to SEQ ID NO: 109129

SEQ ID NO: 473285 - RNA, 64 nt, hsa; identical to SEQ ID NO: 109130

SEQ ID NO: 473286 - RNA, 64 nt, hsa; identical to SEQ ID NO: 109131

SEQ ID NO: 473287 - RNA, 64 nt, hsa; identical to SEQ ID NO: 109132

SEQ ID NO: 473288 - RNA, 64 nt, hsa; identical to SEQ ID NO: 109133

SEQ ID NO: 473289 - RNA, 64 nt, hsa; identical to SEQ ID NO: 109134

SEQ ID NO: 473290 - RNA, 64 nt, hsa; identical to SEQ ID NO: 109135

SEQ ID NO: 473291 - RNA, 64 nt, hsa; identical to SEQ ID NO: 109136

SEQ ID NO: 473292 - RNA, 64 nt, hsa; identical to SEQ ID NO: 109137

SEQ ID NO: 473293 - RNA, 64 nt, hsa; identical to SEQ ID NO: 109138

SEQ ID NO: 473294 - RNA, 64 nt, hsa; identical to SEQ ID NO: 109139

SEQ ID NO: 473295 - RNA, 64 nt, hsa; identical to SEQ ID NO: 109140

SEQ ID NO: 473296 - RNA, 64 nt, hsa; identical to SEQ ID NO: 109141

SEQ ID NO: 473297 - RNA, 64 nt, hsa; identical to SEQ ID NO: 109142

SEQ ID NO: 473298 - RNA, 64 nt, hsa; identical to SEQ ID NO: 109143

SEQ ID NO: 473299 - RNA, 64 nt, hsa; identical to SEQ ID NO: 109144

SEQ ID NO: 473300 - RNA, 64 nt, hsa; identical to SEQ ID NO: 109145

SEQ ID NO: 473301 - RNA, 64 nt, hsa; identical to SEQ ID NO: 109146

SEQ ID NO: 473302 - RNA, 64 nt, hsa; identical to SEQ ID NO: 109147

SEQ ID NO: 473303 - RNA, 64 nt, hsa; identical to SEQ ID NO: 109148

SEQ ID NO: 473304 - RNA, 64 nt, hsa; identical to SEQ ID NO: 109149

SEQ ID NO: 473305 - RNA, 64 nt, hsa; identical to SEQ ID NO: 109150

SEQ ID NO: 473306 - RNA, 64 nt, hsa; identical to SEQ ID NO: 109151

SEQ ID NO: 473307 - RNA, 64 nt, hsa; identical to SEQ ID NO: 109152

SEQ ID NO: 473308 - RNA, 64 nt, hsa; identical to SEQ ID NO: 109153

SEQ ID NO: 473309 - RNA, 64 nt, hsa; identical to SEQ ID NO: 109154

SEQ ID NO: 473310 - RNA, 64 nt, hsa; identical to SEQ ID NO: 109155

SEQ ID NO: 473311 - RNA, 64 nt, hsa; identical to SEQ ID NO: 109156

SEQ ID NO: 473312 - RNA, 64 nt, hsa; identical to SEQ ID NO: 109157

SEQ ID NO: 473313 - RNA, 64 nt, hsa; identical to SEQ ID NO: 109158

SEQ ID NO: 473314 - RNA, 64 nt, hsa; identical to SEQ ID NO: 109159

SEQ ID NO: 473315 - RNA, 64 nt, hsa; identical to SEQ ID NO: 109160

SEQ ID NO: 473316 - RNA, 64 nt, hsa; identical to SEQ ID NO: 109161

SEQ ID NO: 473317 - RNA, 64 nt, hsa; identical to SEQ ID NO: 109162

SEQ ID NO: 473318 - RNA, 64 nt, hsa; identical to SEQ ID NO: 109163

SEQ ID NO: 473319 - RNA, 64 nt, hsa; identical to SEQ ID NO: 109164

SEQ ID NO: 473320 - RNA, 64 nt, hsa; identical to SEQ ID NO: 109165

SEQ ID NO: 473321 - RNA, 64 nt, hsa; identical to SEQ ID NO: 109166

SEQ ID NO: 473322 - RNA, 64 nt, hsa; identical to SEQ ID NO: 109167

SEQ ID NO: 473323 - RNA, 64 nt, hsa; identical to SEQ ID NO: 109168

SEQ ID NO: 473324 - RNA, 64 nt, hsa; identical to SEQ ID NO: 109169

SEQ ID NO: 473325 - RNA, 64 nt, hsa; identical to SEQ ID NO: 109170

SEQ ID NO: 473326 - RNA, 64 nt, hsa; identical to SEQ ID NO: 109171

SEQ ID NO: 473327 - RNA, 64 nt, hsa; identical to SEQ ID NO: 109172

SEQ ID NO: 473328 - RNA, 63 nt, hsa; identical to SEQ ID NO: 109173

SEQ ID NO: 473329 - RNA, 64 nt, hsa; identical to SEQ ID NO: 109174

SEQ ID NO: 473330 - RNA, 64 nt, hsa; identical to SEQ ID NO: 109175

SEQ ID NO: 473331 - RNA, 64 nt, hsa; identical to SEQ ID NO: 109176

SEQ ID NO: 473332 - RNA, 64 nt, hsa; identical to SEQ ID NO: 109177

SEQ ID NO: 473333 - RNA, 64 nt, hsa; identical to SEQ ID NO: 109178

SEQ ID NO: 473334 - RNA, 64 nt, hsa; identical to SEQ ID NO: 109179

SEQ ID NO: 473335 - RNA, 64 nt, hsa; identical to SEQ ID NO: 109180

SEQ ID NO: 473336 - RNA, 64 nt, hsa; identical to SEQ ID NO: 109181

SEQ ID NO: 473337 - RNA, 64 nt, hsa; identical to SEQ ID NO: 109182

SEQ ID NO: 473338 - RNA, 64 nt, hsa; identical to SEQ ID NO: 109183

SEQ ID NO: 473339 - RNA, 64 nt, hsa; identical to SEQ ID NO: 109184

SEQ ID NO: 473340 - RNA, 64 nt, hsa; identical to SEQ ID NO: 109185

SEQ ID NO: 473341 - RNA, 64 nt, hsa; identical to SEQ ID NO: 109186

SEQ ID NO: 473342 - RNA, 64 nt, hsa; identical to SEQ ID NO: 109187

SEQ ID NO: 473343 - RNA, 64 nt, hsa; identical to SEQ ID NO: 109188

SEQ ID NO: 473344 - RNA, 64 nt, hsa; identical to SEQ ID NO: 109189

SEQ ID NO: 473345 - RNA, 64 nt, hsa; identical to SEQ ID NO: 109190

SEQ ID NO: 473346 - RNA, 64 nt, hsa; identical to SEQ ID NO: 109191

SEQ ID NO: 473347 - RNA, 64 nt, hsa; identical to SEQ ID NO: 109192

SEQ ID NO: 473348 - RNA, 64 nt, hsa; identical to SEQ ID NO: 109193

SEQ ID NO: 473349 - RNA, 64 nt, hsa; identical to SEQ ID NO: 109194

SEQ ID NO: 473350 - RNA, 64 nt, hsa; identical to SEQ ID NO: 109195

SEQ ID NO: 473351 - RNA, 64 nt, hsa; identical to SEQ ID NO: 109196

SEQ ID NO: 473352 - RNA, 64 nt, hsa; identical to SEQ ID NO: 109197

SEQ ID NO: 473353 - RNA, 64 nt, hsa; identical to SEQ ID NO: 109198

SEQ ID NO: 473354 - RNA, 64 nt, hsa; identical to SEQ ID NO: 109199

SEQ ID NO: 473355 - RNA, 64 nt, hsa; identical to SEQ ID NO: 109200

SEQ ID NO: 473356 - RNA, 64 nt, hsa; identical to SEQ ID NO: 109201

SEQ ID NO: 473357 - RNA, 64 nt, hsa; identical to SEQ ID NO: 109202

SEQ ID NO: 473358 - RNA, 64 nt, hsa; identical to SEQ ID NO: 109203

SEQ ID NO: 473359 - RNA, 64 nt, hsa; identical to SEQ ID NO: 109204

SEQ ID NO: 473360 - RNA, 64 nt, hsa; identical to SEQ ID NO: 109205

SEQ ID NO: 473361 - RNA, 64 nt, hsa; identical to SEQ ID NO: 109206

SEQ ID NO: 473362 - RNA, 64 nt, hsa; identical to SEQ ID NO: 109207

SEQ ID NO: 473363 - RNA, 64 nt, hsa; identical to SEQ ID NO: 109208

SEQ ID NO: 473364 - RNA, 64 nt, hsa; identical to SEQ ID NO: 109209

SEQ ID NO: 473365 - RNA, 64 nt, hsa; identical to SEQ ID NO: 109210

SEQ ID NO: 473366 - RNA, 64 nt, hsa; identical to SEQ ID NO: 109211

SEQ ID NO: 473367 - RNA, 64 nt, hsa; identical to SEQ ID NO: 109212

SEQ ID NO: 473368 - RNA, 64 nt, hsa; identical to SEQ ID NO: 109213

SEQ ID NO: 473369 - RNA, 64 nt, hsa; identical to SEQ ID NO: 109214

SEQ ID NO: 473370 - RNA, 64 nt, hsa; identical to SEQ ID NO: 109215

SEQ ID NO: 473371 - RNA, 64 nt, hsa; identical to SEQ ID NO: 109216

SEQ ID NO: 473372 - RNA, 64 nt, hsa; identical to SEQ ID NO: 109217

SEQ ID NO: 473373 - RNA, 64 nt, hsa; identical to SEQ ID NO: 109218

SEQ ID NO: 473374 - RNA, 64 nt, hsa; identical to SEQ ID NO: 109219

SEQ ID NO: 473375 - RNA, 64 nt, hsa; identical to SEQ ID NO: 109220

SEQ ID NO: 473376 - RNA, 64 nt, hsa; identical to SEQ ID NO: 109221

SEQ ID NO: 473377 - RNA, 64 nt, hsa; identical to SEQ ID NO: 109222

SEQ ID NO: 473378 - RNA, 64 nt, hsa; identical to SEQ ID NO: 109223

SEQ ID NO: 473379 - RNA, 64 nt, hsa; identical to SEQ ID NO: 109224

SEQ ID NO: 473380 - RNA, 64 nt, hsa; identical to SEQ ID NO: 109225

SEQ ID NO: 473381 - RNA, 64 nt, hsa; identical to SEQ ID NO: 109226

SEQ ID NO: 473382 - RNA, 64 nt, hsa; identical to SEQ ID NO: 109227

SEQ ID NO: 473383 - RNA, 64 nt, hsa; identical to SEQ ID NO: 109228

SEQ ID NO: 473384 - RNA, 64 nt, hsa; identical to SEQ ID NO: 109229

SEQ ID NO: 473385 - RNA, 64 nt, hsa; identical to SEQ ID NO: 109230

SEQ ID NO: 473386 - RNA, 64 nt, hsa; identical to SEQ ID NO: 109231

SEQ ID NO: 473387 - RNA, 64 nt, hsa; identical to SEQ ID NO: 109232

SEQ ID NO: 473388 - RNA, 64 nt, hsa; identical to SEQ ID NO: 109233

SEQ ID NO: 473389 - RNA, 64 nt, hsa; identical to SEQ ID NO: 109234

SEQ ID NO: 473390 - RNA, 64 nt, hsa; identical to SEQ ID NO: 311703

SEQ ID NO: 473391 - RNA, 64 nt, hsa; identical to SEQ ID NO: 311704

SEQ ID NO: 473392 - RNA, 64 nt, hsa; identical to SEQ ID NO: 311705

SEQ ID NO: 473393 - RNA, 64 nt, hsa; identical to SEQ ID NO: 311706

SEQ ID NO: 473394 - RNA, 64 nt, hsa; identical to SEQ ID NO: 311707

SEQ ID NO: 473395 - RNA, 64 nt, hsa; identical to SEQ ID NO: 311708

SEQ ID NO: 473396 - RNA, 64 nt, hsa; identical to SEQ ID NO: 311709

SEQ ID NO: 473397 - RNA, 64 nt, hsa; identical to SEQ ID NO: 311710

SEQ ID NO: 473398 - RNA, 64 nt, hsa; identical to SEQ ID NO: 311711

SEQ ID NO: 473399 - RNA, 64 nt, hsa; identical to SEQ ID NO: 311712

SEQ ID NO: 473400 - RNA, 64 nt, hsa; identical to SEQ ID NO: 311713

SEQ ID NO: 473401 - RNA, 64 nt, hsa; identical to SEQ ID NO: 311714

SEQ ID NO: 473402 - RNA, 64 nt, hsa; identical to SEQ ID NO: 311713

SEQ ID NO: 473403 - RNA, 64 nt, hsa; identical to SEQ ID NO: 311714

SEQ ID NO: 473404 - RNA, 64 nt, hsa; identical to SEQ ID NO: 51753

SEQ ID NO: 473405 - RNA, 64 nt, hsa; identical to SEQ ID NO: 51754

SEQ ID NO: 473406 - RNA, 64 nt, hsa; identical to SEQ ID NO: 51755

SEQ ID NO: 473407 - RNA, 64 nt, hsa; identical to SEQ ID NO: 51756

SEQ ID NO: 473408 - RNA, 64 nt, hsa; identical to SEQ ID NO: 51757

SEQ ID NO: 473409 - RNA, 64 nt, hsa; identical to SEQ ID NO: 51758

SEQ ID NO: 473410 - RNA, 64 nt, hsa; identical to SEQ ID NO: 51759

SEQ ID NO: 473411 - RNA, 64 nt, hsa; identical to SEQ ID NO: 51760

SEQ ID NO: 473412 - RNA, 64 nt, hsa; identical to SEQ ID NO: 51761

SEQ ID NO: 473413 - RNA, 64 nt, hsa; identical to SEQ ID NO: 51762

SEQ ID NO: 473414 - RNA, 64 nt, hsa; identical to SEQ ID NO: 51763

SEQ ID NO: 473415 - RNA, 64 nt, hsa; identical to SEQ ID NO: 51764

SEQ ID NO: 473416 - RNA, 63 nt, hsa
uuuguucaguucguauacuucguaagaaggaaugcgaguaaggauuggcuugaauuccaugga

SEQ ID NO: 473417 - RNA, 63 nt, hsa
gggaccacguugcugccugugaaugcugagugagcgaguaagggaggaggggcgauugagggu

SEQ ID NO: 473418 - RNA, 63 nt, hsa
acauuuguggcagugcugaagggggcauugccggcgaguaaaguauuauguuucuucuuguca

SEQ ID NO: 473419 - RNA, 63 nt, hsa
gcaggucacugagugacuuccccagggugcacagcgaguaacagaucaggacccaaacuuggg

SEQ ID NO: 473420 - RNA, 63 nt, hsa
cgaugcugcacgggcccgcccugguggggcucggcgaguaauguguuuuguccccaguuaacc

SEQ ID NO: 473421 - RNA, 63 nt, hsa
agcagguguaaugauguguuuugaccuuugcaggcgaguaaccaggcaauggaguggaguguc

SEQ ID NO: 473422 - RNA, 63 nt, hsa
accugacucugugugucugcaacugaauguugugcgaguaauuuauuaacugucuuucuaaag

SEQ ID NO: 473423 - RNA, 63 nt, hsa
gagggcgaugaauuaagaguagugggguggguggcgaguaaguaaaauuucaaauagcauuuu

SEQ ID NO: 473424 - RNA, 63 nt, hsa
augcuucucauuuuauauuuccaaaccaccugagcgaguaaugucaacuucgggagggucugg

SEQ ID NO: 473425 - RNA, 63 nt, hsa
uuugauguuugcuuauuucaguugcagaaacuggcgaguaaaaaagauuuugcauuuacuuaa

SEQ ID NO: 473426 - RNA, 63 nt, hsa
gcggcaguguuccuugugcccguggggccgggagcgaguaaagucugggccaggcugugugug

SEQ ID NO: 473427 - RNA, 63 nt, hsa
gggcagacagaugguggauggucuggacaagaagcgaguaagccacugcgguuggucauacug

SEQ ID NO: 473428 - RNA, 63 nt, hsa
auguuuuagaucaguaacagcuaauaggaauaugcgaguaaauucagaauugaaacaauuucu

SEQ ID NO: 473429 - RNA, 63 nt, hsa
uuuggaggggcuggggugggcagagagcaagaggcgaguaaagagaauggugguuucagagau

SEQ ID NO: 473430 - RNA, 64 nt, hsa; identical to SEQ ID NO: 133159

SEQ ID NO: 473431 - RNA, 64 nt, hsa; identical to SEQ ID NO: 133160

SEQ ID NO: 473432 - RNA, 64 nt, hsa; identical to SEQ ID NO: 133161

SEQ ID NO: 473433 - RNA, 64 nt, hsa; identical to SEQ ID NO: 133162

SEQ ID NO: 473434 - RNA, 64 nt, hsa; identical to SEQ ID NO: 133163

SEQ ID NO: 473435 - RNA, 64 nt, hsa; identical to SEQ ID NO: 133164

SEQ ID NO: 473436 - RNA, 64 nt, hsa; identical to SEQ ID NO: 133165

SEQ ID NO: 473437 - RNA, 64 nt, hsa; identical to SEQ ID NO: 133166

SEQ ID NO: 473438 - RNA, 64 nt, hsa; identical to SEQ ID NO: 133167

SEQ ID NO: 473439 - RNA, 64 nt, hsa; identical to SEQ ID NO: 133168

SEQ ID NO: 473440 - RNA, 64 nt, hsa; identical to SEQ ID NO: 133169

SEQ ID NO: 473441 - RNA, 64 nt, hsa; identical to SEQ ID NO: 133170

SEQ ID NO: 473442 - RNA, 64 nt, hsa; identical to SEQ ID NO: 133171

SEQ ID NO: 473443 - RNA, 64 nt, hsa; identical to SEQ ID NO: 133172

SEQ ID NO: 473444 - RNA, 64 nt, hsa; identical to SEQ ID NO: 133173

SEQ ID NO: 473445 - RNA, 64 nt, hsa; identical to SEQ ID NO: 133174

SEQ ID NO: 473446 - RNA, 64 nt, hsa; identical to SEQ ID NO: 133175

SEQ ID NO: 473447 - RNA, 64 nt, hsa; identical to SEQ ID NO: 133176

SEQ ID NO: 473448 - RNA, 64 nt, hsa; identical to SEQ ID NO: 133177

SEQ ID NO: 473449 - RNA, 64 nt, hsa; identical to SEQ ID NO: 133178

SEQ ID NO: 473450 - RNA, 64 nt, hsa; identical to SEQ ID NO: 133179

SEQ ID NO: 473451 - RNA, 64 nt, hsa; identical to SEQ ID NO: 133180

SEQ ID NO: 473452 - RNA, 64 nt, hsa; identical to SEQ ID NO: 133181

SEQ ID NO: 473453 - RNA, 64 nt, hsa; identical to SEQ ID NO: 133182

SEQ ID NO: 473454 - RNA, 64 nt, hsa; identical to SEQ ID NO: 133183

SEQ ID NO: 473455 - RNA, 64 nt, hsa; identical to SEQ ID NO: 133184

SEQ ID NO: 473456 - RNA, 64 nt, hsa; identical to SEQ ID NO: 133185

SEQ ID NO: 473457 - RNA, 64 nt, hsa; identical to SEQ ID NO: 133186

SEQ ID NO: 473458 - RNA, 64 nt, hsa; identical to SEQ ID NO: 133187

SEQ ID NO: 473459 - RNA, 64 nt, hsa; identical to SEQ ID NO: 133188

SEQ ID NO: 473460 - RNA, 64 nt, hsa; identical to SEQ ID NO: 133189

SEQ ID NO: 473461 - RNA, 64 nt, hsa; identical to SEQ ID NO: 133190

SEQ ID NO: 473462 - RNA, 64 nt, hsa; identical to SEQ ID NO: 133191

SEQ ID NO: 473463 - RNA, 64 nt, hsa; identical to SEQ ID NO: 133192

SEQ ID NO: 473464 - RNA, 64 nt, hsa; identical to SEQ ID NO: 133193

SEQ ID NO: 473465 - RNA, 64 nt, hsa; identical to SEQ ID NO: 133194

SEQ ID NO: 473466 - RNA, 64 nt, hsa; identical to SEQ ID NO: 133195

SEQ ID NO: 473467 - RNA, 64 nt, hsa; identical to SEQ ID NO: 133196

SEQ ID NO: 473468 - RNA, 64 nt, hsa; identical to SEQ ID NO: 133197

SEQ ID NO: 473469 - RNA, 64 nt, hsa; identical to SEQ ID NO: 133198

SEQ ID NO: 473470 - RNA, 64 nt, hsa; identical to SEQ ID NO: 133199

SEQ ID NO: 473471 - RNA, 64 nt, hsa; identical to SEQ ID NO: 133200

SEQ ID NO: 473472 - RNA, 64 nt, hsa; identical to SEQ ID NO: 133201

SEQ ID NO: 473473 - RNA, 64 nt, hsa; identical to SEQ ID NO: 133202

SEQ ID NO: 473474 - RNA, 64 nt, hsa; identical to SEQ ID NO: 133203

SEQ ID NO: 473475 - RNA, 64 nt, hsa; identical to SEQ ID NO: 137832

SEQ ID NO: 473476 - RNA, 64 nt, hsa; identical to SEQ ID NO: 137833

SEQ ID NO: 473477 - RNA, 64 nt, hsa; identical to SEQ ID NO: 137834

SEQ ID NO: 473478 - RNA, 64 nt, hsa; identical to SEQ ID NO: 137835

SEQ ID NO: 473479 - RNA, 64 nt, hsa; identical to SEQ ID NO: 137836

SEQ ID NO: 473480 - RNA, 64 nt, hsa; identical to SEQ ID NO: 137837

SEQ ID NO: 473481 - RNA, 64 nt, hsa; identical to SEQ ID NO: 137838

SEQ ID NO: 473482 - RNA, 64 nt, hsa; identical to SEQ ID NO: 137839

SEQ ID NO: 473483 - RNA, 64 nt, hsa; identical to SEQ ID NO: 137840

SEQ ID NO: 473484 - RNA, 64 nt, hsa; identical to SEQ ID NO: 137841

SEQ ID NO: 473485 - RNA, 64 nt, hsa; identical to SEQ ID NO: 137842

SEQ ID NO: 473486 - RNA, 64 nt, hsa; identical to SEQ ID NO: 137843

SEQ ID NO: 473487 - RNA, 64 nt, hsa; identical to SEQ ID NO: 137844

SEQ ID NO: 473488 - RNA, 64 nt, hsa; identical to SEQ ID NO: 137845

SEQ ID NO: 473489 - RNA, 64 nt, hsa; identical to SEQ ID NO: 137846

SEQ ID NO: 473490 - RNA, 64 nt, hsa; identical to SEQ ID NO: 137847

SEQ ID NO: 473491 - RNA, 64 nt, hsa; identical to SEQ ID NO: 137848

SEQ ID NO: 473492 - RNA, 64 nt, hsa; identical to SEQ ID NO: 137849

SEQ ID NO: 473493 - RNA, 64 nt, hsa; identical to SEQ ID NO: 137850

SEQ ID NO: 473494 - RNA, 64 nt, hsa; identical to SEQ ID NO: 137851

SEQ ID NO: 473495 - RNA, 64 nt, hsa; identical to SEQ ID NO: 137852

SEQ ID NO: 473496 - RNA, 64 nt, hsa; identical to SEQ ID NO: 137853

SEQ ID NO: 473497 - RNA, 64 nt, hsa; identical to SEQ ID NO: 137854

SEQ ID NO: 473498 - RNA, 64 nt, hsa; identical to SEQ ID NO: 137855

SEQ ID NO: 473499 - RNA, 64 nt, hsa; identical to SEQ ID NO: 137856

SEQ ID NO: 473500 - RNA, 64 nt, hsa; identical to SEQ ID NO: 137857

SEQ ID NO: 473501 - RNA, 64 nt, hsa; identical to SEQ ID NO: 137858

SEQ ID NO: 473502 - RNA, 64 nt, hsa; identical to SEQ ID NO: 137859

SEQ ID NO: 473503 - RNA, 64 nt, hsa; identical to SEQ ID NO: 137860

SEQ ID NO: 473504 - RNA, 64 nt, hsa; identical to SEQ ID NO: 137861

SEQ ID NO: 473505 - RNA, 64 nt, hsa; identical to SEQ ID NO: 137862

SEQ ID NO: 473506 - RNA, 64 nt, hsa; identical to SEQ ID NO: 137863

SEQ ID NO: 473507 - RNA, 64 nt, hsa; identical to SEQ ID NO: 137864

SEQ ID NO: 473508 - RNA, 64 nt, hsa; identical to SEQ ID NO: 137865

SEQ ID NO: 473509 - RNA, 64 nt, hsa; identical to SEQ ID NO: 137866

SEQ ID NO: 473510 - RNA, 64 nt, hsa; identical to SEQ ID NO: 137867

SEQ ID NO: 473511 - RNA, 64 nt, hsa; identical to SEQ ID NO: 137868

SEQ ID NO: 473512 - RNA, 64 nt, hsa; identical to SEQ ID NO: 137869

SEQ ID NO: 473513 - RNA, 64 nt, hsa; identical to SEQ ID NO: 137870

SEQ ID NO: 473514 - RNA, 64 nt, hsa; identical to SEQ ID NO: 137871

SEQ ID NO: 473515 - RNA, 64 nt, hsa; identical to SEQ ID NO: 137872

SEQ ID NO: 473516 - RNA, 64 nt, hsa; identical to SEQ ID NO: 137873

SEQ ID NO: 473517 - RNA, 64 nt, hsa; identical to SEQ ID NO: 137874

SEQ ID NO: 473518 - RNA, 64 nt, hsa; identical to SEQ ID NO: 137875

SEQ ID NO: 473519 - RNA, 64 nt, hsa; identical to SEQ ID NO: 137876

SEQ ID NO: 473520 - RNA, 64 nt, hsa; identical to SEQ ID NO: 137877

SEQ ID NO: 473521 - RNA, 64 nt, hsa; identical to SEQ ID NO: 137878

SEQ ID NO: 473522 - RNA, 64 nt, hsa; identical to SEQ ID NO: 137879

SEQ ID NO: 473523 - RNA, 64 nt, hsa; identical to SEQ ID NO: 137880

SEQ ID NO: 473524 - RNA, 64 nt, hsa; identical to SEQ ID NO: 137881

SEQ ID NO: 473525 - RNA, 64 nt, hsa; identical to SEQ ID NO: 137882

SEQ ID NO: 473526 - RNA, 64 nt, hsa; identical to SEQ ID NO: 137883

SEQ ID NO: 473527 - RNA, 64 nt, hsa; identical to SEQ ID NO: 137884

SEQ ID NO: 473528 - RNA, 64 nt, hsa; identical to SEQ ID NO: 137885

SEQ ID NO: 473529 - RNA, 64 nt, hsa; identical to SEQ ID NO: 137886

SEQ ID NO: 473530 - RNA, 64 nt, hsa; identical to SEQ ID NO: 137887

SEQ ID NO: 473531 - RNA, 64 nt, hsa; identical to SEQ ID NO: 137888

SEQ ID NO: 473532 - RNA, 64 nt, hsa; identical to SEQ ID NO: 137889

SEQ ID NO: 473533 - RNA, 64 nt, hsa; identical to SEQ ID NO: 137890

SEQ ID NO: 473534 - RNA, 64 nt, hsa; identical to SEQ ID NO: 137891

SEQ ID NO: 473535 - RNA, 64 nt, hsa; identical to SEQ ID NO: 137892

SEQ ID NO: 473536 - RNA, 64 nt, hsa; identical to SEQ ID NO: 137893

SEQ ID NO: 473537 - RNA, 64 nt, hsa; identical to SEQ ID NO: 137894

SEQ ID NO: 473538 - RNA, 64 nt, hsa; identical to SEQ ID NO: 137895

SEQ ID NO: 473539 - RNA, 64 nt, hsa; identical to SEQ ID NO: 137896

SEQ ID NO: 473540 - RNA, 64 nt, hsa; identical to SEQ ID NO: 115977

SEQ ID NO: 473541 - RNA, 64 nt, hsa; identical to SEQ ID NO: 115978

SEQ ID NO: 473542 - RNA, 64 nt, hsa; identical to SEQ ID NO: 115979

SEQ ID NO: 473543 - RNA, 64 nt, hsa; identical to SEQ ID NO: 115980

SEQ ID NO: 473544 - RNA, 64 nt, hsa; identical to SEQ ID NO: 115981

SEQ ID NO: 473545 - RNA, 64 nt, hsa; identical to SEQ ID NO: 115982

SEQ ID NO: 473546 - RNA, 64 nt, hsa; identical to SEQ ID NO: 115983

SEQ ID NO: 473547 - RNA, 64 nt, hsa; identical to SEQ ID NO: 115984

SEQ ID NO: 473548 - RNA, 64 nt, hsa; identical to SEQ ID NO: 115985

SEQ ID NO: 473549 - RNA, 64 nt, hsa; identical to SEQ ID NO: 115986

SEQ ID NO: 473550 - RNA, 64 nt, hsa; identical to SEQ ID NO: 115987

SEQ ID NO: 473551 - RNA, 64 nt, hsa; identical to SEQ ID NO: 115988

SEQ ID NO: 473552 - RNA, 64 nt, hsa; identical to SEQ ID NO: 115989

SEQ ID NO: 473553 - RNA, 64 nt, hsa; identical to SEQ ID NO: 115990

SEQ ID NO: 473554 - RNA, 64 nt, hsa; identical to SEQ ID NO: 115991

SEQ ID NO: 473555 - RNA, 64 nt, hsa; identical to SEQ ID NO: 115992

SEQ ID NO: 473556 - RNA, 64 nt, hsa; identical to SEQ ID NO: 115993

SEQ ID NO: 473557 - RNA, 64 nt, hsa; identical to SEQ ID NO: 115994

SEQ ID NO: 473558 - RNA, 64 nt, hsa; identical to SEQ ID NO: 115995

SEQ ID NO: 473559 - RNA, 64 nt, hsa; identical to SEQ ID NO: 115996

SEQ ID NO: 473560 - RNA, 64 nt, hsa; identical to SEQ ID NO: 115997

SEQ ID NO: 473561 - RNA, 64 nt, hsa; identical to SEQ ID NO: 115998

SEQ ID NO: 473562 - RNA, 64 nt, hsa; identical to SEQ ID NO: 115999

SEQ ID NO: 473563 - RNA, 64 nt, hsa; identical to SEQ ID NO: 116000

SEQ ID NO: 473564 - RNA, 64 nt, hsa; identical to SEQ ID NO: 116001

SEQ ID NO: 473565 - RNA, 64 nt, hsa; identical to SEQ ID NO: 116002

SEQ ID NO: 473566 - RNA, 64 nt, hsa; identical to SEQ ID NO: 116003

SEQ ID NO: 473567 - RNA, 64 nt, hsa; identical to SEQ ID NO: 116004

SEQ ID NO: 473568 - RNA, 64 nt, hsa; identical to SEQ ID NO: 116005

SEQ ID NO: 473569 - RNA, 64 nt, hsa; identical to SEQ ID NO: 116006

SEQ ID NO: 473570 - RNA, 64 nt, hsa; identical to SEQ ID NO: 116007

SEQ ID NO: 473571 - RNA, 64 nt, hsa; identical to SEQ ID NO: 116008

SEQ ID NO: 473572 - RNA, 64 nt, hsa; identical to SEQ ID NO: 116009

SEQ ID NO: 473573 - RNA, 64 nt, hsa; identical to SEQ ID NO: 116010

SEQ ID NO: 473574 - RNA, 64 nt, hsa; identical to SEQ ID NO: 116011

SEQ ID NO: 473575 - RNA, 64 nt, hsa; identical to SEQ ID NO: 116012

SEQ ID NO: 473576 - RNA, 64 nt, hsa; identical to SEQ ID NO: 116013

SEQ ID NO: 473577 - RNA, 64 nt, hsa; identical to SEQ ID NO: 116014

SEQ ID NO: 473578 - RNA, 64 nt, hsa; identical to SEQ ID NO: 116015

SEQ ID NO: 473579 - RNA, 64 nt, hsa; identical to SEQ ID NO: 116016

SEQ ID NO: 473580 - RNA, 64 nt, hsa; identical to SEQ ID NO: 116017

SEQ ID NO: 473581 - RNA, 64 nt, hsa; identical to SEQ ID NO: 116018

SEQ ID NO: 473582 - RNA, 64 nt, hsa; identical to SEQ ID NO: 116019

SEQ ID NO: 473583 - RNA, 64 nt, hsa; identical to SEQ ID NO: 116020

SEQ ID NO: 473584 - RNA, 64 nt, hsa; identical to SEQ ID NO: 116021

SEQ ID NO: 473585 - RNA, 64 nt, hsa; identical to SEQ ID NO: 116022

SEQ ID NO: 473586 - RNA, 64 nt, hsa; identical to SEQ ID NO: 116023

SEQ ID NO: 473587 - RNA, 64 nt, hsa; identical to SEQ ID NO: 116024

SEQ ID NO: 473588 - RNA, 64 nt, hsa; identical to SEQ ID NO: 116025

SEQ ID NO: 473589 - RNA, 64 nt, hsa; identical to SEQ ID NO: 116026

SEQ ID NO: 473590 - RNA, 64 nt, hsa; identical to SEQ ID NO: 116027

SEQ ID NO: 473591 - RNA, 64 nt, hsa; identical to SEQ ID NO: 116028

SEQ ID NO: 473592 - RNA, 64 nt, hsa; identical to SEQ ID NO: 116029

SEQ ID NO: 473593 - RNA, 64 nt, hsa; identical to SEQ ID NO: 116030

SEQ ID NO: 473594 - RNA, 64 nt, hsa; identical to SEQ ID NO: 116031

SEQ ID NO: 473595 - RNA, 64 nt, hsa; identical to SEQ ID NO: 116032

SEQ ID NO: 473596 - RNA, 64 nt, hsa; identical to SEQ ID NO: 116033

SEQ ID NO: 473597 - RNA, 64 nt, hsa; identical to SEQ ID NO: 116034

SEQ ID NO: 473598 - RNA, 64 nt, hsa; identical to SEQ ID NO: 116035

SEQ ID NO: 473599 - RNA, 64 nt, hsa; identical to SEQ ID NO: 116036

SEQ ID NO: 473600 - RNA, 64 nt, hsa; identical to SEQ ID NO: 116037

SEQ ID NO: 473601 - RNA, 64 nt, hsa; identical to SEQ ID NO: 116038

SEQ ID NO: 473602 - RNA, 64 nt, hsa; identical to SEQ ID NO: 116039

SEQ ID NO: 473603 - RNA, 64 nt, hsa; identical to SEQ ID NO: 116040

SEQ ID NO: 473604 - RNA, 64 nt, hsa; identical to SEQ ID NO: 116041

SEQ ID NO: 473605 - RNA, 64 nt, hsa; identical to SEQ ID NO: 116042

SEQ ID NO: 473606 - RNA, 64 nt, hsa; identical to SEQ ID NO: 116043

SEQ ID NO: 473607 - RNA, 64 nt, hsa; identical to SEQ ID NO: 116044

SEQ ID NO: 473608 - RNA, 64 nt, hsa; identical to SEQ ID NO: 116045

SEQ ID NO: 473609 - RNA, 64 nt, hsa; identical to SEQ ID NO: 116046

SEQ ID NO: 473610 - RNA, 64 nt, hsa; identical to SEQ ID NO: 116047

SEQ ID NO: 473611 - RNA, 64 nt, hsa; identical to SEQ ID NO: 116048

SEQ ID NO: 473612 - RNA, 64 nt, hsa; identical to SEQ ID NO: 116049

SEQ ID NO: 473613 - RNA, 64 nt, hsa; identical to SEQ ID NO: 116050

SEQ ID NO: 473614 - RNA, 64 nt, hsa; identical to SEQ ID NO: 116051

SEQ ID NO: 473615 - RNA, 64 nt, hsa; identical to SEQ ID NO: 116052

SEQ ID NO: 473616 - RNA, 64 nt, hsa; identical to SEQ ID NO: 116053

SEQ ID NO: 473617 - RNA, 64 nt, hsa; identical to SEQ ID NO: 116054

SEQ ID NO: 473618 - RNA, 64 nt, hsa; identical to SEQ ID NO: 116055

SEQ ID NO: 473619 - RNA, 64 nt, hsa; identical to SEQ ID NO: 116056

SEQ ID NO: 473620 - RNA, 64 nt, hsa; identical to SEQ ID NO: 116057

SEQ ID NO: 473621 - RNA, 64 nt, hsa; identical to SEQ ID NO: 116058

SEQ ID NO: 473622 - RNA, 64 nt, hsa; identical to SEQ ID NO: 116059

SEQ ID NO: 473623 - RNA, 64 nt, hsa; identical to SEQ ID NO: 116060

SEQ ID NO: 473624 - RNA, 64 nt, hsa; identical to SEQ ID NO: 116061

SEQ ID NO: 473625 - RNA, 64 nt, hsa; identical to SEQ ID NO: 116062

SEQ ID NO: 473626 - RNA, 64 nt, hsa; identical to SEQ ID NO: 116063

SEQ ID NO: 473627 - RNA, 64 nt, hsa; identical to SEQ ID NO: 116064

SEQ ID NO: 473628 - RNA, 64 nt, hsa; identical to SEQ ID NO: 116065

SEQ ID NO: 473629 - RNA, 64 nt, hsa; identical to SEQ ID NO: 116066

SEQ ID NO: 473630 - RNA, 64 nt, hsa; identical to SEQ ID NO: 116067

SEQ ID NO: 473631 - RNA, 64 nt, hsa; identical to SEQ ID NO: 116068

SEQ ID NO: 473632 - RNA, 64 nt, hsa; identical to SEQ ID NO: 116069

SEQ ID NO: 473633 - RNA, 64 nt, hsa; identical to SEQ ID NO: 116070

SEQ ID NO: 473634 - RNA, 64 nt, hsa; identical to SEQ ID NO: 116071

SEQ ID NO: 473635 - RNA, 64 nt, hsa; identical to SEQ ID NO: 116072

SEQ ID NO: 473636 - RNA, 64 nt, hsa; identical to SEQ ID NO: 116073

SEQ ID NO: 473637 - RNA, 64 nt, hsa; identical to SEQ ID NO: 116074

SEQ ID NO: 473638 - RNA, 64 nt, hsa; identical to SEQ ID NO: 116075

SEQ ID NO: 473639 - RNA, 64 nt, hsa; identical to SEQ ID NO: 116076

SEQ ID NO: 473640 - RNA, 64 nt, hsa; identical to SEQ ID NO: 116077

SEQ ID NO: 473641 - RNA, 64 nt, hsa; identical to SEQ ID NO: 116078

SEQ ID NO: 473642 - RNA, 64 nt, hsa; identical to SEQ ID NO: 116079

SEQ ID NO: 473643 - RNA, 64 nt, hsa; identical to SEQ ID NO: 116080

SEQ ID NO: 473644 - RNA, 64 nt, hsa; identical to SEQ ID NO: 116081

SEQ ID NO: 473645 - RNA, 64 nt, hsa; identical to SEQ ID NO: 116082

SEQ ID NO: 473646 - RNA, 64 nt, hsa; identical to SEQ ID NO: 116083

SEQ ID NO: 473647 - RNA, 64 nt, hsa; identical to SEQ ID NO: 116084

SEQ ID NO: 473648 - RNA, 64 nt, hsa; identical to SEQ ID NO: 116085

SEQ ID NO: 473649 - RNA, 64 nt, hsa; identical to SEQ ID NO: 116086

SEQ ID NO: 473650 - RNA, 64 nt, hsa; identical to SEQ ID NO: 116087

SEQ ID NO: 473651 - RNA, 64 nt, hsa; identical to SEQ ID NO: 116088

SEQ ID NO: 473652 - RNA, 64 nt, hsa; identical to SEQ ID NO: 116089

SEQ ID NO: 473653 - RNA, 64 nt, hsa; identical to SEQ ID NO: 116090

SEQ ID NO: 473654 - RNA, 64 nt, hsa; identical to SEQ ID NO: 116091

SEQ ID NO: 473655 - RNA, 64 nt, hsa; identical to SEQ ID NO: 116092

SEQ ID NO: 473656 - RNA, 64 nt, hsa; identical to SEQ ID NO: 116093

SEQ ID NO: 473657 - RNA, 64 nt, hsa; identical to SEQ ID NO: 116094

SEQ ID NO: 473658 - RNA, 64 nt, hsa; identical to SEQ ID NO: 116095

SEQ ID NO: 473659 - RNA, 64 nt, hsa; identical to SEQ ID NO: 116096

SEQ ID NO: 473660 - RNA, 64 nt, hsa; identical to SEQ ID NO: 116097

SEQ ID NO: 473661 - RNA, 64 nt, hsa; identical to SEQ ID NO: 116098

SEQ ID NO: 473662 - RNA, 64 nt, hsa; identical to SEQ ID NO: 116099

SEQ ID NO: 473663 - RNA, 64 nt, hsa; identical to SEQ ID NO: 116100

SEQ ID NO: 473664 - RNA, 64 nt, hsa; identical to SEQ ID NO: 116101

SEQ ID NO: 473665 - RNA, 64 nt, hsa; identical to SEQ ID NO: 116102

SEQ ID NO: 473666 - RNA, 64 nt, hsa; identical to SEQ ID NO: 116103

SEQ ID NO: 473667 - RNA, 64 nt, hsa; identical to SEQ ID NO: 116104

SEQ ID NO: 473668 - RNA, 64 nt, hsa; identical to SEQ ID NO: 116105

SEQ ID NO: 473669 - RNA, 64 nt, hsa; identical to SEQ ID NO: 116106

SEQ ID NO: 473670 - RNA, 64 nt, hsa; identical to SEQ ID NO: 116107

SEQ ID NO: 473671 - RNA, 64 nt, hsa; identical to SEQ ID NO: 116108

SEQ ID NO: 473672 - RNA, 64 nt, hsa; identical to SEQ ID NO: 116109

SEQ ID NO: 473673 - RNA, 64 nt, hsa; identical to SEQ ID NO: 116110

SEQ ID NO: 473674 - RNA, 64 nt, hsa; identical to SEQ ID NO: 116111

SEQ ID NO: 473675 - RNA, 64 nt, hsa; identical to SEQ ID NO: 116112

SEQ ID NO: 473676 - RNA, 64 nt, hsa; identical to SEQ ID NO: 116113

SEQ ID NO: 473677 - RNA, 64 nt, hsa; identical to SEQ ID NO: 116114

SEQ ID NO: 473678 - RNA, 64 nt, hsa; identical to SEQ ID NO: 116115

SEQ ID NO: 473679 - RNA, 64 nt, hsa; identical to SEQ ID NO: 116116

SEQ ID NO: 473680 - RNA, 64 nt, hsa; identical to SEQ ID NO: 116117

SEQ ID NO: 473681 - RNA, 64 nt, hsa; identical to SEQ ID NO: 116118

SEQ ID NO: 473682 - RNA, 64 nt, hsa; identical to SEQ ID NO: 116119

SEQ ID NO: 473683 - RNA, 64 nt, hsa; identical to SEQ ID NO: 116120

SEQ ID NO: 473684 - RNA, 64 nt, hsa; identical to SEQ ID NO: 116121

SEQ ID NO: 473685 - RNA, 64 nt, hsa; identical to SEQ ID NO: 116122

SEQ ID NO: 473686 - RNA, 64 nt, hsa; identical to SEQ ID NO: 116123

SEQ ID NO: 473687 - RNA, 64 nt, hsa; identical to SEQ ID NO: 116124

SEQ ID NO: 473688 - RNA, 64 nt, hsa; identical to SEQ ID NO: 116125

SEQ ID NO: 473689 - RNA, 64 nt, hsa; identical to SEQ ID NO: 116126

SEQ ID NO: 473690 - RNA, 64 nt, hsa; identical to SEQ ID NO: 116127

SEQ ID NO: 473691 - RNA, 64 nt, hsa; identical to SEQ ID NO: 116128

SEQ ID NO: 473692 - RNA, 64 nt, hsa; identical to SEQ ID NO: 116129

SEQ ID NO: 473693 - RNA, 64 nt, hsa; identical to SEQ ID NO: 116130

SEQ ID NO: 473694 - RNA, 64 nt, hsa; identical to SEQ ID NO: 116131

SEQ ID NO: 473695 - RNA, 64 nt, hsa; identical to SEQ ID NO: 116132

SEQ ID NO: 473696 - RNA, 64 nt, hsa; identical to SEQ ID NO: 116133

SEQ ID NO: 473697 - RNA, 64 nt, hsa; identical to SEQ ID NO: 116134

SEQ ID NO: 473698 - RNA, 64 nt, hsa; identical to SEQ ID NO: 116135

SEQ ID NO: 473699 - RNA, 64 nt, hsa; identical to SEQ ID NO: 116136

SEQ ID NO: 473700 - RNA, 64 nt, hsa; identical to SEQ ID NO: 116137

SEQ ID NO: 473701 - RNA, 64 nt, hsa; identical to SEQ ID NO: 116138

SEQ ID NO: 473702 - RNA, 64 nt, hsa; identical to SEQ ID NO: 116139

SEQ ID NO: 473703 - RNA, 64 nt, hsa; identical to SEQ ID NO: 116140

SEQ ID NO: 473704 - RNA, 64 nt, hsa; identical to SEQ ID NO: 116141

SEQ ID NO: 473705 - RNA, 64 nt, hsa; identical to SEQ ID NO: 116142

SEQ ID NO: 473706 - RNA, 64 nt, hsa; identical to SEQ ID NO: 116143

SEQ ID NO: 473707 - RNA, 64 nt, hsa; identical to SEQ ID NO: 116144

SEQ ID NO: 473708 - RNA, 64 nt, hsa; identical to SEQ ID NO: 116145

SEQ ID NO: 473709 - RNA, 64 nt, hsa; identical to SEQ ID NO: 116146

SEQ ID NO: 473710 - RNA, 64 nt, hsa; identical to SEQ ID NO: 116147

SEQ ID NO: 473711 - RNA, 64 nt, hsa; identical to SEQ ID NO: 116148

SEQ ID NO: 473712 - RNA, 64 nt, hsa; identical to SEQ ID NO: 116149

SEQ ID NO: 473713 - RNA, 64 nt, hsa; identical to SEQ ID NO: 116150

SEQ ID NO: 473714 - RNA, 64 nt, hsa; identical to SEQ ID NO: 116151

SEQ ID NO: 473715 - RNA, 64 nt, hsa; identical to SEQ ID NO: 116152

SEQ ID NO: 473716 - RNA, 64 nt, hsa; identical to SEQ ID NO: 116153

SEQ ID NO: 473717 - RNA, 64 nt, hsa; identical to SEQ ID NO: 116154

SEQ ID NO: 473718 - RNA, 64 nt, hsa; identical to SEQ ID NO: 116155

SEQ ID NO: 473719 - RNA, 64 nt, hsa; identical to SEQ ID NO: 116156

SEQ ID NO: 473720 - RNA, 64 nt, hsa; identical to SEQ ID NO: 116157

SEQ ID NO: 473721 - RNA, 64 nt, hsa; identical to SEQ ID NO: 116158

SEQ ID NO: 473722 - RNA, 64 nt, hsa; identical to SEQ ID NO: 116159

SEQ ID NO: 473723 - RNA, 64 nt, hsa; identical to SEQ ID NO: 116160

SEQ ID NO: 473724 - RNA, 64 nt, hsa; identical to SEQ ID NO: 116161

SEQ ID NO: 473725 - RNA, 64 nt, hsa; identical to SEQ ID NO: 116162

SEQ ID NO: 473726 - RNA, 64 nt, hsa; identical to SEQ ID NO: 116163

SEQ ID NO: 473727 - RNA, 64 nt, hsa; identical to SEQ ID NO: 116164

SEQ ID NO: 473728 - RNA, 64 nt, hsa; identical to SEQ ID NO: 116165

SEQ ID NO: 473729 - RNA, 64 nt, hsa; identical to SEQ ID NO: 116166

SEQ ID NO: 473730 - RNA, 64 nt, hsa; identical to SEQ ID NO: 116167

SEQ ID NO: 473731 - RNA, 64 nt, hsa; identical to SEQ ID NO: 116168

SEQ ID NO: 473732 - RNA, 64 nt, hsa; identical to SEQ ID NO: 116169

SEQ ID NO: 473733 - RNA, 64 nt, hsa; identical to SEQ ID NO: 116170

SEQ ID NO: 473734 - RNA, 64 nt, hsa; identical to SEQ ID NO: 116171

SEQ ID NO: 473735 - RNA, 64 nt, hsa; identical to SEQ ID NO: 116172

SEQ ID NO: 473736 - RNA, 64 nt, hsa; identical to SEQ ID NO: 116173

SEQ ID NO: 473737 - RNA, 64 nt, hsa; identical to SEQ ID NO: 116174

SEQ ID NO: 473738 - RNA, 64 nt, hsa; identical to SEQ ID NO: 116175

SEQ ID NO: 473739 - RNA, 64 nt, hsa; identical to SEQ ID NO: 116176

SEQ ID NO: 473740 - RNA, 64 nt, hsa; identical to SEQ ID NO: 116177

SEQ ID NO: 473741 - RNA, 64 nt, hsa; identical to SEQ ID NO: 116178

SEQ ID NO: 473742 - RNA, 64 nt, hsa; identical to SEQ ID NO: 116179

SEQ ID NO: 473743 - RNA, 64 nt, hsa; identical to SEQ ID NO: 116180

SEQ ID NO: 473744 - RNA, 64 nt, hsa; identical to SEQ ID NO: 116181

SEQ ID NO: 473745 - RNA, 64 nt, hsa; identical to SEQ ID NO: 116182

SEQ ID NO: 473746 - RNA, 64 nt, hsa; identical to SEQ ID NO: 116183

SEQ ID NO: 473747 - RNA, 64 nt, hsa; identical to SEQ ID NO: 116184

SEQ ID NO: 473748 - RNA, 64 nt, hsa; identical to SEQ ID NO: 116185

SEQ ID NO: 473749 - RNA, 64 nt, hsa; identical to SEQ ID NO: 116186

SEQ ID NO: 473750 - RNA, 64 nt, hsa; identical to SEQ ID NO: 116187

SEQ ID NO: 473751 - RNA, 64 nt, hsa; identical to SEQ ID NO: 116188

SEQ ID NO: 473752 - RNA, 64 nt, hsa; identical to SEQ ID NO: 116189

SEQ ID NO: 473753 - RNA, 64 nt, hsa; identical to SEQ ID NO: 116190

SEQ ID NO: 473754 - RNA, 64 nt, hsa; identical to SEQ ID NO: 116191

SEQ ID NO: 473755 - RNA, 64 nt, hsa; identical to SEQ ID NO: 116192

SEQ ID NO: 473756 - RNA, 64 nt, hsa; identical to SEQ ID NO: 116193

SEQ ID NO: 473757 - RNA, 64 nt, hsa; identical to SEQ ID NO: 116194

SEQ ID NO: 473758 - RNA, 64 nt, hsa; identical to SEQ ID NO: 116195

SEQ ID NO: 473759 - RNA, 64 nt, hsa; identical to SEQ ID NO: 116196

SEQ ID NO: 473760 - RNA, 64 nt, hsa; identical to SEQ ID NO: 116197

SEQ ID NO: 473761 - RNA, 64 nt, hsa; identical to SEQ ID NO: 116198

SEQ ID NO: 473762 - RNA, 64 nt, hsa; identical to SEQ ID NO: 116199

SEQ ID NO: 473763 - RNA, 64 nt, hsa; identical to SEQ ID NO: 116200

SEQ ID NO: 473764 - RNA, 64 nt, hsa; identical to SEQ ID NO: 116201

SEQ ID NO: 473765 - RNA, 64 nt, hsa; identical to SEQ ID NO: 116202

SEQ ID NO: 473766 - RNA, 64 nt, hsa; identical to SEQ ID NO: 116203

SEQ ID NO: 473767 - RNA, 64 nt, hsa; identical to SEQ ID NO: 116204

SEQ ID NO: 473768 - RNA, 64 nt, hsa; identical to SEQ ID NO: 116205

SEQ ID NO: 473769 - RNA, 64 nt, hsa; identical to SEQ ID NO: 116206

SEQ ID NO: 473770 - RNA, 64 nt, hsa; identical to SEQ ID NO: 116207

SEQ ID NO: 473771 - RNA, 64 nt, hsa; identical to SEQ ID NO: 116208

SEQ ID NO: 473772 - RNA, 64 nt, hsa; identical to SEQ ID NO: 116209

SEQ ID NO: 473773 - RNA, 64 nt, hsa; identical to SEQ ID NO: 116210

SEQ ID NO: 473774 - RNA, 64 nt, hsa; identical to SEQ ID NO: 116211

SEQ ID NO: 473775 - RNA, 64 nt, hsa; identical to SEQ ID NO: 116212

SEQ ID NO: 473776 - RNA, 64 nt, hsa; identical to SEQ ID NO: 116213

SEQ ID NO: 473777 - RNA, 64 nt, hsa; identical to SEQ ID NO: 116214

SEQ ID NO: 473778 - RNA, 64 nt, hsa; identical to SEQ ID NO: 116215

SEQ ID NO: 473779 - RNA, 64 nt, hsa; identical to SEQ ID NO: 116216

SEQ ID NO: 473780 - RNA, 64 nt, hsa; identical to SEQ ID NO: 116217

SEQ ID NO: 473781 - RNA, 64 nt, hsa; identical to SEQ ID NO: 116218

SEQ ID NO: 473782 - RNA, 64 nt, hsa; identical to SEQ ID NO: 116219

SEQ ID NO: 473783 - RNA, 64 nt, hsa; identical to SEQ ID NO: 116220

SEQ ID NO: 473784 - RNA, 64 nt, hsa; identical to SEQ ID NO: 116221

SEQ ID NO: 473785 - RNA, 64 nt, hsa; identical to SEQ ID NO: 116222

SEQ ID NO: 473786 - RNA, 64 nt, hsa; identical to SEQ ID NO: 116223

SEQ ID NO: 473787 - RNA, 64 nt, hsa; identical to SEQ ID NO: 116224

SEQ ID NO: 473788 - RNA, 64 nt, hsa; identical to SEQ ID NO: 116225

SEQ ID NO: 473789 - RNA, 64 nt, hsa; identical to SEQ ID NO: 116226

SEQ ID NO: 473790 - RNA, 64 nt, hsa; identical to SEQ ID NO: 116227

SEQ ID NO: 473791 - RNA, 64 nt, hsa; identical to SEQ ID NO: 116228

SEQ ID NO: 473792 - RNA, 64 nt, hsa; identical to SEQ ID NO: 116229

SEQ ID NO: 473793 - RNA, 64 nt, hsa; identical to SEQ ID NO: 116230

SEQ ID NO: 473794 - RNA, 64 nt, hsa; identical to SEQ ID NO: 116231

SEQ ID NO: 473795 - RNA, 64 nt, hsa; identical to SEQ ID NO: 116232

SEQ ID NO: 473796 - RNA, 64 nt, hsa; identical to SEQ ID NO: 116233

SEQ ID NO: 473797 - RNA, 64 nt, hsa; identical to SEQ ID NO: 116234

SEQ ID NO: 473798 - RNA, 64 nt, hsa; identical to SEQ ID NO: 116235

SEQ ID NO: 473799 - RNA, 64 nt, hsa; identical to SEQ ID NO: 116236

SEQ ID NO: 473800 - RNA, 64 nt, hsa; identical to SEQ ID NO: 116237

SEQ ID NO: 473801 - RNA, 64 nt, hsa; identical to SEQ ID NO: 116238

SEQ ID NO: 473802 - RNA, 64 nt, hsa; identical to SEQ ID NO: 116239

SEQ ID NO: 473803 - RNA, 64 nt, hsa; identical to SEQ ID NO: 116240

SEQ ID NO: 473804 - RNA, 64 nt, hsa; identical to SEQ ID NO: 116241

SEQ ID NO: 473805 - RNA, 64 nt, hsa; identical to SEQ ID NO: 116242

SEQ ID NO: 473806 - RNA, 64 nt, hsa; identical to SEQ ID NO: 116243

SEQ ID NO: 473807 - RNA, 64 nt, hsa; identical to SEQ ID NO: 116244

SEQ ID NO: 473808 - RNA, 64 nt, hsa; identical to SEQ ID NO: 116245

SEQ ID NO: 473809 - RNA, 64 nt, hsa; identical to SEQ ID NO: 116246

SEQ ID NO: 473810 - RNA, 64 nt, hsa; identical to SEQ ID NO: 116247

SEQ ID NO: 473811 - RNA, 64 nt, hsa; identical to SEQ ID NO: 116248

SEQ ID NO: 473812 - RNA, 64 nt, hsa; identical to SEQ ID NO: 116249

SEQ ID NO: 473813 - RNA, 64 nt, hsa; identical to SEQ ID NO: 116250

SEQ ID NO: 473814 - RNA, 64 nt, hsa; identical to SEQ ID NO: 116251

SEQ ID NO: 473815 - RNA, 64 nt, hsa; identical to SEQ ID NO: 116252

SEQ ID NO: 473816 - RNA, 64 nt, hsa; identical to SEQ ID NO: 116253

SEQ ID NO: 473817 - RNA, 64 nt, hsa; identical to SEQ ID NO: 116254

SEQ ID NO: 473818 - RNA, 64 nt, hsa; identical to SEQ ID NO: 116255

SEQ ID NO: 473819 - RNA, 64 nt, hsa; identical to SEQ ID NO: 116256

SEQ ID NO: 473820 - RNA, 64 nt, hsa; identical to SEQ ID NO: 116257

SEQ ID NO: 473821 - RNA, 64 nt, hsa; identical to SEQ ID NO: 116258

SEQ ID NO: 473822 - RNA, 64 nt, hsa; identical to SEQ ID NO: 116259

SEQ ID NO: 473823 - RNA, 64 nt, hsa; identical to SEQ ID NO: 116260

SEQ ID NO: 473824 - RNA, 64 nt, hsa; identical to SEQ ID NO: 116261

SEQ ID NO: 473825 - RNA, 64 nt, hsa; identical to SEQ ID NO: 116262

SEQ ID NO: 473826 - RNA, 64 nt, hsa; identical to SEQ ID NO: 116263

SEQ ID NO: 473827 - RNA, 64 nt, hsa; identical to SEQ ID NO: 116264

SEQ ID NO: 473828 - RNA, 64 nt, hsa; identical to SEQ ID NO: 116265

SEQ ID NO: 473829 - RNA, 64 nt, hsa; identical to SEQ ID NO: 116266

SEQ ID NO: 473830 - RNA, 64 nt, hsa; identical to SEQ ID NO: 116267

SEQ ID NO: 473831 - RNA, 64 nt, hsa; identical to SEQ ID NO: 116268

SEQ ID NO: 473832 - RNA, 64 nt, hsa; identical to SEQ ID NO: 116269

SEQ ID NO: 473833 - RNA, 64 nt, hsa; identical to SEQ ID NO: 116270

SEQ ID NO: 473834 - RNA, 64 nt, hsa; identical to SEQ ID NO: 116271

SEQ ID NO: 473835 - RNA, 64 nt, hsa; identical to SEQ ID NO: 116272

SEQ ID NO: 473836 - RNA, 64 nt, hsa; identical to SEQ ID NO: 116273

SEQ ID NO: 473837 - RNA, 64 nt, hsa; identical to SEQ ID NO: 116274

SEQ ID NO: 473838 - RNA, 64 nt, hsa; identical to SEQ ID NO: 116275

SEQ ID NO: 473839 - RNA, 64 nt, hsa; identical to SEQ ID NO: 116276

SEQ ID NO: 473840 - RNA, 64 nt, hsa; identical to SEQ ID NO: 116277

SEQ ID NO: 473841 - RNA, 64 nt, hsa; identical to SEQ ID NO: 116278

SEQ ID NO: 473842 - RNA, 64 nt, hsa; identical to SEQ ID NO: 116279

SEQ ID NO: 473843 - RNA, 64 nt, hsa; identical to SEQ ID NO: 116280

SEQ ID NO: 473844 - RNA, 64 nt, hsa; identical to SEQ ID NO: 116281

SEQ ID NO: 473845 - RNA, 64 nt, hsa; identical to SEQ ID NO: 116282

SEQ ID NO: 473846 - RNA, 64 nt, hsa; identical to SEQ ID NO: 116283

SEQ ID NO: 473847 - RNA, 64 nt, hsa; identical to SEQ ID NO: 116284

SEQ ID NO: 473848 - RNA, 64 nt, hsa; identical to SEQ ID NO: 116285

SEQ ID NO: 473849 - RNA, 64 nt, hsa; identical to SEQ ID NO: 116286

SEQ ID NO: 473850 - RNA, 64 nt, hsa; identical to SEQ ID NO: 116287

SEQ ID NO: 473851 - RNA, 64 nt, hsa; identical to SEQ ID NO: 116288

SEQ ID NO: 473852 - RNA, 64 nt, hsa; identical to SEQ ID NO: 116289

SEQ ID NO: 473853 - RNA, 64 nt, hsa; identical to SEQ ID NO: 116290

SEQ ID NO: 473854 - RNA, 64 nt, hsa; identical to SEQ ID NO: 116291

SEQ ID NO: 473855 - RNA, 64 nt, hsa; identical to SEQ ID NO: 116292

SEQ ID NO: 473856 - RNA, 64 nt, hsa; identical to SEQ ID NO: 116293

SEQ ID NO: 473857 - RNA, 64 nt, hsa; identical to SEQ ID NO: 116294

SEQ ID NO: 473858 - RNA, 64 nt, hsa; identical to SEQ ID NO: 116295

SEQ ID NO: 473859 - RNA, 64 nt, hsa; identical to SEQ ID NO: 116296

SEQ ID NO: 473860 - RNA, 64 nt, hsa; identical to SEQ ID NO: 116297

SEQ ID NO: 473861 - RNA, 64 nt, hsa; identical to SEQ ID NO: 116298

SEQ ID NO: 473862 - RNA, 64 nt, hsa; identical to SEQ ID NO: 116299

SEQ ID NO: 473863 - RNA, 64 nt, hsa; identical to SEQ ID NO: 116300

SEQ ID NO: 473864 - RNA, 64 nt, hsa; identical to SEQ ID NO: 116301

SEQ ID NO: 473865 - RNA, 64 nt, hsa; identical to SEQ ID NO: 116302

SEQ ID NO: 473866 - RNA, 64 nt, hsa; identical to SEQ ID NO: 116303

SEQ ID NO: 473867 - RNA, 64 nt, hsa; identical to SEQ ID NO: 116304

SEQ ID NO: 473868 - RNA, 64 nt, hsa; identical to SEQ ID NO: 116305

SEQ ID NO: 473869 - RNA, 64 nt, hsa; identical to SEQ ID NO: 116306

SEQ ID NO: 473870 - RNA, 64 nt, hsa; identical to SEQ ID NO: 116307

SEQ ID NO: 473871 - RNA, 64 nt, hsa; identical to SEQ ID NO: 116308

SEQ ID NO: 473872 - RNA, 64 nt, hsa; identical to SEQ ID NO: 116309

SEQ ID NO: 473873 - RNA, 64 nt, hsa; identical to SEQ ID NO: 116310

SEQ ID NO: 473874 - RNA, 64 nt, hsa; identical to SEQ ID NO: 116311

SEQ ID NO: 473875 - RNA, 64 nt, hsa; identical to SEQ ID NO: 116312

SEQ ID NO: 473876 - RNA, 64 nt, hsa; identical to SEQ ID NO: 116313

SEQ ID NO: 473877 - RNA, 64 nt, hsa; identical to SEQ ID NO: 116314

SEQ ID NO: 473878 - RNA, 64 nt, hsa; identical to SEQ ID NO: 116315

SEQ ID NO: 473879 - RNA, 64 nt, hsa; identical to SEQ ID NO: 116316

SEQ ID NO: 473880 - RNA, 64 nt, hsa; identical to SEQ ID NO: 116317

SEQ ID NO: 473881 - RNA, 64 nt, hsa; identical to SEQ ID NO: 116318

SEQ ID NO: 473882 - RNA, 64 nt, hsa; identical to SEQ ID NO: 116319

SEQ ID NO: 473883 - RNA, 64 nt, hsa; identical to SEQ ID NO: 116320

SEQ ID NO: 473884 - RNA, 64 nt, hsa; identical to SEQ ID NO: 116321

SEQ ID NO: 473885 - RNA, 64 nt, hsa; identical to SEQ ID NO: 116322

SEQ ID NO: 473886 - RNA, 64 nt, hsa; identical to SEQ ID NO: 116323

SEQ ID NO: 473887 - RNA, 64 nt, hsa; identical to SEQ ID NO: 116324

SEQ ID NO: 473888 - RNA, 64 nt, hsa; identical to SEQ ID NO: 116325

SEQ ID NO: 473889 - RNA, 64 nt, hsa; identical to SEQ ID NO: 116326

SEQ ID NO: 473890 - RNA, 64 nt, hsa; identical to SEQ ID NO: 116327

SEQ ID NO: 473891 - RNA, 64 nt, hsa; identical to SEQ ID NO: 116328

SEQ ID NO: 473892 - RNA, 64 nt, hsa; identical to SEQ ID NO: 116329

SEQ ID NO: 473893 - RNA, 64 nt, hsa; identical to SEQ ID NO: 116330

SEQ ID NO: 473894 - RNA, 64 nt, hsa; identical to SEQ ID NO: 116331

SEQ ID NO: 473895 - RNA, 64 nt, hsa; identical to SEQ ID NO: 116332

SEQ ID NO: 473896 - RNA, 64 nt, hsa; identical to SEQ ID NO: 116333

SEQ ID NO: 473897 - RNA, 64 nt, hsa; identical to SEQ ID NO: 116334

SEQ ID NO: 473898 - RNA, 64 nt, hsa; identical to SEQ ID NO: 116335

SEQ ID NO: 473899 - RNA, 64 nt, hsa; identical to SEQ ID NO: 116336

SEQ ID NO: 473900 - RNA, 64 nt, hsa; identical to SEQ ID NO: 116337

SEQ ID NO: 473901 - RNA, 64 nt, hsa; identical to SEQ ID NO: 116338

SEQ ID NO: 473902 - RNA, 64 nt, hsa; identical to SEQ ID NO: 116339

SEQ ID NO: 473903 - RNA, 64 nt, hsa; identical to SEQ ID NO: 116340

SEQ ID NO: 473904 - RNA, 64 nt, hsa; identical to SEQ ID NO: 116341

SEQ ID NO: 473905 - RNA, 64 nt, hsa; identical to SEQ ID NO: 116342

SEQ ID NO: 473906 - RNA, 64 nt, hsa; identical to SEQ ID NO: 116343

SEQ ID NO: 473907 - RNA, 64 nt, hsa; identical to SEQ ID NO: 116344

SEQ ID NO: 473908 - RNA, 64 nt, hsa; identical to SEQ ID NO: 116345

SEQ ID NO: 473909 - RNA, 64 nt, hsa; identical to SEQ ID NO: 116346

SEQ ID NO: 473910 - RNA, 64 nt, hsa; identical to SEQ ID NO: 116347

SEQ ID NO: 473911 - RNA, 64 nt, hsa; identical to SEQ ID NO: 116348

SEQ ID NO: 473912 - RNA, 64 nt, hsa; identical to SEQ ID NO: 116349

SEQ ID NO: 473913 - RNA, 64 nt, hsa; identical to SEQ ID NO: 116350

SEQ ID NO: 473914 - RNA, 64 nt, hsa; identical to SEQ ID NO: 116351

SEQ ID NO: 473915 - RNA, 64 nt, hsa; identical to SEQ ID NO: 116352

SEQ ID NO: 473916 - RNA, 64 nt, hsa; identical to SEQ ID NO: 116353

SEQ ID NO: 473917 - RNA, 64 nt, hsa; identical to SEQ ID NO: 116354

SEQ ID NO: 473918 - RNA, 64 nt, hsa; identical to SEQ ID NO: 116355

SEQ ID NO: 473919 - RNA, 64 nt, hsa; identical to SEQ ID NO: 116356

SEQ ID NO: 473920 - RNA, 64 nt, hsa; identical to SEQ ID NO: 116357

SEQ ID NO: 473921 - RNA, 64 nt, hsa; identical to SEQ ID NO: 116358

SEQ ID NO: 473922 - RNA, 64 nt, hsa; identical to SEQ ID NO: 116359

SEQ ID NO: 473923 - RNA, 64 nt, hsa; identical to SEQ ID NO: 116360

SEQ ID NO: 473924 - RNA, 64 nt, hsa; identical to SEQ ID NO: 116361

SEQ ID NO: 473925 - RNA, 64 nt, hsa; identical to SEQ ID NO: 116362

SEQ ID NO: 473926 - RNA, 64 nt, hsa; identical to SEQ ID NO: 116363

SEQ ID NO: 473927 - RNA, 64 nt, hsa; identical to SEQ ID NO: 116364

SEQ ID NO: 473928 - RNA, 64 nt, hsa; identical to SEQ ID NO: 116365

SEQ ID NO: 473929 - RNA, 64 nt, hsa; identical to SEQ ID NO: 116366

SEQ ID NO: 473930 - RNA, 64 nt, hsa; identical to SEQ ID NO: 116367

SEQ ID NO: 473931 - RNA, 64 nt, hsa; identical to SEQ ID NO: 116368

SEQ ID NO: 473932 - RNA, 64 nt, hsa
uuucauuccuuauugaacuuauuuugcacaauaguguuuacaaaucuuauacaucuuacuuuga

SEQ ID NO: 473933 - RNA, 64 nt, hsa
augggggucuugacaaagcagaguaaaaauaugcuguuuacauuguuuacuuacaaguaaggag

SEQ ID NO: 473934 - RNA, 64 nt, hsa
acuuuuauuaauucuucauuuuuuguaaaacuuauguuuacaagaagaaaacaaaucaaaacau

SEQ ID NO: 473935 - RNA, 64 nt, hsa
uugccuaaaagaaaggacugacaagugugcaaaauguuuacaaucuuuugugaaauuguaguuu

SEQ ID NO: 473936 - RNA, 64 nt, hsa
ugaucuuagcucacuuuccaauaacagaaggaguuguuuacagaugaauaguaucacaucauua

SEQ ID NO: 473937 - RNA, 64 nt, hsa
augucuuuuguaaaacaaaaauuacaaaaaaauuuguuuacauuccacugguaccuuaauuuaa

SEQ ID NO: 473938 - RNA, 64 nt, hsa
cuuuccccaacuacaaaaauguuuggcaacuuuguguuuacauuuaaagaucauuugcaccuuu

SEQ ID NO: 473939 - RNA, 64 nt, hsa
cuuuuucaaggaaaaaaaguauugaguaaacaauuguuuacauauaucauuuaugcuuuuuucu

SEQ ID NO: 473940 - RNA, 64 nt, hsa
auuucuucuguuuuauacaagcucuguuaaguuauguuuacaguaucuuguaucgcuguuuaca

SEQ ID NO: 473941 - RNA, 64 nt, hsa
ucuguuaaguuauguuuacaguaucuuguaucgcuguuuacaaaucuugcauggacuccugcca

SEQ ID NO: 473942 - RNA, 64 nt, hsa
auccaaguugauuuuugugucuacagcuaaauuuuguuuacaauuaggcuauuuuuuaauauag

SEQ ID NO: 473943 - RNA, 64 nt, hsa
ucaagacuagccugggcaauguggcaaaaccgcguguuuacaaaaaauacaaaaauuagccagg

SEQ ID NO: 473944 - RNA, 64 nt, hsa
aguucuuucaugguaagcucaauggacuuugaauuguuuacagugcuguauguccaauuguuaa

SEQ ID NO: 473945 - RNA, 64 nt, hsa
agacuccaacggagggagccuguugguguuaaauuguuuacauuucuuuauacaaauaaugugc

SEQ ID NO: 473946 - RNA, 64 nt, hsa
aaaggcucaauaacaaauacaacaaauguaaauauguuuacauuuuaagacauaugcagugguu

SEQ ID NO: 473947 - RNA, 64 nt, hsa
gucugcaaauuucaugaauuugugaugucuuugcuguuuacaugcagucccaagaaauggauug

SEQ ID NO: 473948 - RNA, 64 nt, hsa
auguacaucuaccccagccccucaaaagaaaaacuguuuacauagaaauuccuacacauacguu

SEQ ID NO: 473949 - RNA, 64 nt, hsa
uuuaaaacauaauugccaauugaaacccuaaauauguuuacauaccauuaagauaugauucaug

SEQ ID NO: 473950 - RNA, 64 nt, hsa
ccaacaccagccccugccccagcccaaguccaaauguuuacagggagccuccugcccagucccc

SEQ ID NO: 473951 - RNA, 64 nt, hsa
uuccaagugacuccgugccuugagugugucugcguguuuacacccgucccucugcuggccgccc

SEQ ID NO: 473952 - RNA, 64 nt, hsa
ugauacuuacaauuuuuagcagguagcuuuuuaauguuuacagaaauuuuaauuuuuuucuauu

SEQ ID NO: 473953 - RNA, 64 nt, hsa
auuuuaauuuuuuucuauuuugaaauuugaggcuuguuuacauugcuuagauaauuuagaauuu

SEQ ID NO: 473954 - RNA, 64 nt, hsa
aaaacauaagugucucuggccaucaaagugaucuuguuuacagcagugcuuuugugaaacaauu

SEQ ID NO: 473955 - RNA, 64 nt, hsa
uuguuuacaacucaaaacuuugaguuuuacacuuuguuuacaguagauaauuuuuuuuccuuug

SEQ ID NO: 473956 - RNA, 64 nt, hsa
uuuacaaguccagauucaaaaaauguuuuuacuuuguuuacaacucaaaacuuugaguuuuaca

SEQ ID NO: 473957 - RNA, 64 nt, hsa
cuguccagaacugaagacuuuaaaauuuuguuacuguuuacaaguccagauucaaaaaauguuu

SEQ ID NO: 473958 - RNA, 64 nt, hsa
ucaagacccagaauguaggugccacugccuccuauguuuacaggauccuccguggcccuaggca

SEQ ID NO: 473959 - RNA, 64 nt, hsa
augcuguggggugcugguggagcagcugaugucguguuuacagagcaaggcuucccugucuccc

SEQ ID NO: 473960 - RNA, 64 nt, hsa
uuuaugagaaaguucucauuuaaaaugagaucguuguuuacaguguauguacuaagcaguaagc

SEQ ID NO: 473961 - RNA, 64 nt, hsa
uuuccuaaugucagaguagaagauuuuaugcugcuguuuacaaaagcccaauguaaugcauagg

SEQ ID NO: 473962 - RNA, 64 nt, hsa
aagcaagaugccauuuuccccaugacuuugguuuuguuuacauuuuucccuuucaguuaguaua

SEQ ID NO: 473963 - RNA, 64 nt, hsa
cuacuauuuuuaaaauuccuguugaguuucuuuguguuuacaaggaaaggacugaacuuuuucu

SEQ ID NO: 473964 - RNA, 64 nt, hsa
gugauuuuacaauaacauuaucaucugcaguuacuguuuacaagacugcuuuuaccuuaaacuu

SEQ ID NO: 473965 - RNA, 64 nt, hsa
uuuacaagacugcuuuuaccuuaaacuuuguagauguuuacaucuuuuuguuguguuuuaagau

SEQ ID NO: 473966 - RNA, 64 nt, hsa
agcagcuggucugacacuacgcgcagugcucgguuguuuacaaucaguggggaaaagggcagaa

SEQ ID NO: 473967 - RNA, 64 nt, hsa
auuuuuuggaagugcaaaaaucucaauuugugucuguuuacagcucucucuccucacugcucac

SEQ ID NO: 473968 - RNA, 64 nt, hsa
uauccgcgagccugcuugcugauauugcaguuuuuguuuacaagaauaauuagcaauacugagu

SEQ ID NO: 473969 - RNA, 64 nt, hsa
caaacaacaaagcagaagacuccucucuucugacuguuuacaccuuuccgugccgggagcgcac

SEQ ID NO: 473970 - RNA, 64 nt, hsa
cuucauauccauuucuaauccaucaaacagcuuauguuuacauaaaauuuuaucauucacaagg

SEQ ID NO: 473971 - RNA, 64 nt, hsa
agagguuuugauaggaaguauguuuguuucuuaguguuuacaaauauuaaguacucuugauaca

SEQ ID NO: 473972 - RNA, 64 nt, hsa
ugucuuaaacuuuaauaaauucgcauuuuaaagguguuuacagauuauuuuuuauaucuguagc

SEQ ID NO: 473973 - RNA, 64 nt, hsa
auuaaacauucugcauuggguauaaucuaagaauuguuuacaaaaagauuauuuuguauuuacc

SEQ ID NO: 473974 - RNA, 64 nt, hsa
agauaaccuguauguguuccgagcuuuaauuuuuuguuuacaaauugaacaguguuacaugggc

SEQ ID NO: 473975 - RNA, 64 nt, hsa
auaacaaaccuguuuuaugaaaauucacuggugcuguuuacauuggaauaaaaagcucuauaag

SEQ ID NO: 473976 - RNA, 64 nt, hsa
uuaagaauauuauccugguuuaacaacagugcccuguuuacaacagauugugcccuaucucauc

SEQ ID NO: 473977 - RNA, 64 nt, hsa
agguguuaacaucuguuucaggaacauggcaguauguuuacaugucagaaguuuuguuuaauuc

SEQ ID NO: 473978 - RNA, 64 nt, hsa
ccuuacaaguauaugaguauuauuuauagguaguuguuuacauaugagucgggaccaaagagaa

SEQ ID NO: 473979 - RNA, 64 nt, hsa
uuuaugaacaugaagaaacuuuaguaaauguacuuguuuacauaguuaugugaauagauuagau

SEQ ID NO: 473980 - RNA, 64 nt, hsa
uaaauaaauauuuauuuauuuauuuauaaguagauguuuacauaugcccaggauuuugaagagc

SEQ ID NO: 473981 - RNA, 64 nt, hsa
cauggaaaaacuuuaggaaaugcacuuauuaggcuguuuacauggguugccuggauacaaauca

SEQ ID NO: 473982 - RNA, 64 nt, hsa
aagauaaaauuuaguugaguuuuuaauguuuacauguuuacaucucuaaauaaaauuugcuuau

SEQ ID NO: 473983 - RNA, 64 nt, hsa
ucauaauaaagauaaaauuuaguugaguuuuuaauguuuacauguuuacaucucuaaauaaaau

SEQ ID NO: 473984 - RNA, 64 nt, hsa
gugcaauuugguucuugaaaauuaaauuuaaacuuguuuacaaagguuuaguuuuguaauaagg

SEQ ID NO: 473985 - RNA, 64 nt, hsa
uuccuauguuagcuguuaaagaaacagcaggacuuguuuacaaagaugucuucauucccaaggu

SEQ ID NO: 473986 - RNA, 64 nt, hsa
gaggaagaaugggacauggccccaugcuuauuuuuguuuacaacguaacauggcaugagagagg

SEQ ID NO: 473987 - RNA, 64 nt, hsa
cuauaccaggcacaagauaaaacuccaaaauuucuguuuacauugaccuuuacauuuaaagcug

SEQ ID NO: 473988 - RNA, 64 nt, hsa
gcaccuggcuccuaccuggaggacucaguuguucuguuuacauccugguggcaccucucacccu

SEQ ID NO: 473989 - RNA, 64 nt, hsa
acuuuccccuugcucguuucucccuuguuguaaguguuuacaacuggcaugugcuuuuaaacau

SEQ ID NO: 473990 - RNA, 64 nt, hsa
aucugauuugggguuaaacuaggcggcuggaggauguuuacagcuuugaggcuucaaauaaguu

SEQ ID NO: 473991 - RNA, 64 nt, hsa
ucaauuaccucccauguguggacauccugggacuuguuuacauuuuaucuguaauaagauaacu

SEQ ID NO: 473992 - RNA, 64 nt, hsa
uucaaaggcaucacuauuuuuaaauguuuacauauguuuacauguuugugugcaacugcuucau

SEQ ID NO: 473993 - RNA, 64 nt, hsa
ccccuuacauuucaaaggcaucacuauuuuuaaauguuuacauauguuuacauguuugugugca

SEQ ID NO: 473994 - RNA, 64 nt, hsa
aaagaguauuuauguuggaauaauuuuuaaauaauguuuacauaacuguaaguccuguuugguu

SEQ ID NO: 473995 - RNA, 64 nt, hsa
cuuggcacuuguucuagagaaguguagaggaugauguuuacauaauuuuagcaccucaagguau

SEQ ID NO: 473996 - RNA, 64 nt, hsa
cccaaucagaauacggugguugagaaggaaccaguguuuacaaguaauaucagaaaguugaagg

SEQ ID NO: 473997 - RNA, 64 nt, hsa
uuuacaaguaauaucagaaaguugaaggaaccaguguuuacaaguaauaccagaaaguugccaa

SEQ ID NO: 473998 - RNA, 64 nt, hsa
ucagcauucaaucaggcugagcugaauguagugauguuuacauuguuuacauucuuuguacugu

SEQ ID NO: 473999 - RNA, 64 nt, hsa
aaucaggcugagcugaauguagugauguuuacauuguuuacauucuuuguacugucuuccugcu

SEQ ID NO: 474000 - RNA, 64 nt, hsa
uucuuucuuucuuucugccaacuuuguuuuccaguguuuacaaggugacaaauguuugacuuug

SEQ ID NO: 474001 - RNA, 64 nt, hsa
ugcuuuagcacaggacaacuuuacaaaacaugauuguuuacagcugcucuuccccucuuuucug

SEQ ID NO: 474002 - RNA, 64 nt, hsa
aacccaggacuaaaaauggacaggcugaccucaguguuuacaaauucagaauuuugauaggggu

SEQ ID NO: 474003 - RNA, 64 nt, hsa
ccagugcugggugcagcuccaucacccucuuguguguuuacaugucucuuucuaugauaagagg

SEQ ID NO: 474004 - RNA, 64 nt, hsa
uauaugccugucuagacaucaaauuguugguuauuguuuacaaucuagaaaugaugaagcucuu

SEQ ID NO: 474005 - RNA, 64 nt, hsa
aucuagggugauugugucuggagacccuuaauuauguuuacaaagacccauguuccaaguaagu

SEQ ID NO: 474006 - RNA, 64 nt, hsa
gccucacugcuguucugggccauccccauagccauguuuacaugauuugaugugcaauagggug

SEQ ID NO: 474007 - RNA, 64 nt, hsa
cugggugacugggucuagccccugaucccaaaucuguuuacacaucaaucugccucacugcugu

SEQ ID NO: 474008 - RNA, 64 nt, hsa
cucuuggggggucagggugcuguccccuccccucuguuuacaucuccccucuaccccgcuguau

SEQ ID NO: 474009 - RNA, 64 nt, hsa
acccagaggaagccucuauuuauuuauuagcuuuuguuuacaccguggaauugaccccuuccuc

SEQ ID NO: 474010 - RNA, 64 nt, hsa
aaaacaauugagaugcuaacagggaggauuacaguguuuacagaacaaccuucagcgccgaccu

SEQ ID NO: 474011 - RNA, 64 nt, hsa
cuagguagaauaaccgaguaugacaauucuuaauuguuuacauuuuauaacuuccuguccuuca

SEQ ID NO: 474012 - RNA, 64 nt, hsa
gacccuugcagggcuuugcagcugcucaucuguuuguuuacaguuuguucuuucccuccuuccc

SEQ ID NO: 474013 - RNA, 64 nt, hsa
uuuuguguuuuacuugaccaaaaccaaguguauauguuuacauguuuuuauccuguuuagcuug

SEQ ID NO: 474014 - RNA, 64 nt, hsa
gccuccuuccuugcaguguuuacaacauagccaguguuuacagcauagcagaugcugcugcuga

SEQ ID NO: 474015 - RNA, 64 nt, hsa
cucuggcccuuguuucuagccuccuuccuugcaguguuuacaacauagccaguguuuacagcau

SEQ ID NO: 474016 - RNA, 64 nt, hsa
uuauguaguaaauguauguuuacaggguuuaucauguuuacagauuaagcuaauuucuguaguc

SEQ ID NO: 474017 - RNA, 64 nt, hsa
uucuuuacacuuguacaauuauguaguaaauguauguuuacaggguuuaucauguuuacagauu

SEQ ID NO: 474018 - RNA, 64 nt, hsa
uggggcuugcgcugggccguggugggaggcacaguguuuacaggcucugguggcagagcaguug

SEQ ID NO: 474019 - RNA, 64 nt, hsa
uuauauauauuuuuugcaacuuggauuuccaguuuguuuacagaguagucuuagguaguagcaa

SEQ ID NO: 474020 - RNA, 64 nt, hsa
aucuuugaaaggcauugugggucugucuuuaaaguguuuacaaaaaaaaauuauauaaaaaaaa

SEQ ID NO: 474021 - RNA, 64 nt, hsa
aaagucuagugucgacugguguuuucccucgugauguuuacagcuugcuguuugcugcccagcc

SEQ ID NO: 474022 - RNA, 64 nt, hsa
gcugcucccacggaggggagcaggaaugcugcacuguuuacacccugacugugcuuaaaaacac

SEQ ID NO: 474023 - RNA, 64 nt, hsa
aaacauauccacgguaaccggucccuggcaauucuguuuacaugaaauggggagaaagucaccg

SEQ ID NO: 474024 - RNA, 64 nt, hsa
uugacaauaaaauggcuuuuaauuauuuguuauuuguuuacacccuauuccucaguuauuauua

SEQ ID NO: 474025 - RNA, 64 nt, hsa
uucaaaacuauuuguucaaagaacccguuaguguuguuuacaggguuacaguuucucucacaug

SEQ ID NO: 474026 - RNA, 64 nt, hsa
ugaaccauuugguaccugguguuaacuggaguccuguuuacaagguggagucggggcuugcuga

SEQ ID NO: 474027 - RNA, 64 nt, hsa
aagcuguuagccuuagagugauugcagugaacacuguuuacacaccgugaauccauucccauca

SEQ ID NO: 474028 - RNA, 64 nt, hsa
uuaguucacaagcauaauuuggagguguguucuguguuuacacaguaguuuggauguacaauua

SEQ ID NO: 474029 - RNA, 64 nt, hsa
agcuugguuuccauaacauagagcauugguugacuguuuacagaagacucacucaccaggauaa

SEQ ID NO: 474030 - RNA, 64 nt, hsa
uuaaggaaaauuaauaaaucauuaauaguuaaaauguuuacauugagcacuagaacauguuugg

SEQ ID NO: 474031 - RNA, 64 nt, hsa
uguucuauaguaguuacaacaauuucacaaccuauguuuacagauucuucauaaauacaugcau

SEQ ID NO: 474032 - RNA, 64 nt, hsa
cuuuauaggucuuuaaaaauuacuuuuauuauauuguuuacaaauauauuucaugcaagaaaca

SEQ ID NO: 474033 - RNA, 64 nt, hsa
ugaagaugcuguacccacuugaacaguccucagguguuuacauaaauacuauguuuuacaguuu

SEQ ID NO: 474034 - RNA, 64 nt, hsa; identical to SEQ ID NO: 290000

SEQ ID NO: 474035 - RNA, 64 nt, hsa; identical to SEQ ID NO: 290001

SEQ ID NO: 474036 - RNA, 64 nt, hsa; identical to SEQ ID NO: 290002

SEQ ID NO: 474037 - RNA, 64 nt, hsa; identical to SEQ ID NO: 290003

SEQ ID NO: 474038 - RNA, 64 nt, hsa; identical to SEQ ID NO: 290004

SEQ ID NO: 474039 - RNA, 64 nt, hsa; identical to SEQ ID NO: 290005

SEQ ID NO: 474040 - RNA, 64 nt, hsa; identical to SEQ ID NO: 290006

SEQ ID NO: 474041 - RNA, 64 nt, hsa; identical to SEQ ID NO: 290007

SEQ ID NO: 474042 - RNA, 64 nt, hsa; identical to SEQ ID NO: 290008

SEQ ID NO: 474043 - RNA, 64 nt, hsa; identical to SEQ ID NO: 290009

SEQ ID NO: 474044 - RNA, 64 nt, hsa; identical to SEQ ID NO: 290010

SEQ ID NO: 474045 - RNA, 64 nt, hsa; identical to SEQ ID NO: 290011

SEQ ID NO: 474046 - RNA, 64 nt, hsa; identical to SEQ ID NO: 290012

SEQ ID NO: 474047 - RNA, 64 nt, hsa; identical to SEQ ID NO: 290013

SEQ ID NO: 474048 - RNA, 64 nt, hsa; identical to SEQ ID NO: 290014

SEQ ID NO: 474049 - RNA, 64 nt, hsa; identical to SEQ ID NO: 290015

SEQ ID NO: 474050 - RNA, 64 nt, hsa; identical to SEQ ID NO: 290016

SEQ ID NO: 474051 - RNA, 64 nt, hsa; identical to SEQ ID NO: 290017

SEQ ID NO: 474052 - RNA, 64 nt, hsa; identical to SEQ ID NO: 290018

SEQ ID NO: 474053 - RNA, 64 nt, hsa; identical to SEQ ID NO: 290019

SEQ ID NO: 474054 - RNA, 64 nt, hsa; identical to SEQ ID NO: 290020

SEQ ID NO: 474055 - RNA, 64 nt, hsa; identical to SEQ ID NO: 290021

SEQ ID NO: 474056 - RNA, 64 nt, hsa; identical to SEQ ID NO: 290022

SEQ ID NO: 474057 - RNA, 64 nt, hsa; identical to SEQ ID NO: 290023

SEQ ID NO: 474058 - RNA, 64 nt, hsa; identical to SEQ ID NO: 290024

SEQ ID NO: 474059 - RNA, 64 nt, hsa; identical to SEQ ID NO: 290025

SEQ ID NO: 474060 - RNA, 64 nt, hsa; identical to SEQ ID NO: 290026

SEQ ID NO: 474061 - RNA, 64 nt, hsa; identical to SEQ ID NO: 290027

SEQ ID NO: 474062 - RNA, 64 nt, hsa; identical to SEQ ID NO: 290028

SEQ ID NO: 474063 - RNA, 64 nt, hsa; identical to SEQ ID NO: 290029

SEQ ID NO: 474064 - RNA, 56 nt, hsa; identical to SEQ ID NO: 290030

SEQ ID NO: 474065 - RNA, 64 nt, hsa; identical to SEQ ID NO: 290031

SEQ ID NO: 474066 - RNA, 64 nt, hsa; identical to SEQ ID NO: 290032

SEQ ID NO: 474067 - RNA, 64 nt, hsa; identical to SEQ ID NO: 290033

SEQ ID NO: 474068 - RNA, 64 nt, hsa; identical to SEQ ID NO: 290034

SEQ ID NO: 474069 - RNA, 64 nt, hsa; identical to SEQ ID NO: 290035

SEQ ID NO: 474070 - RNA, 64 nt, hsa; identical to SEQ ID NO: 290036

SEQ ID NO: 474071 - RNA, 64 nt, hsa; identical to SEQ ID NO: 290037

SEQ ID NO: 474072 - RNA, 64 nt, hsa; identical to SEQ ID NO: 290038

SEQ ID NO: 474073 - RNA, 64 nt, hsa; identical to SEQ ID NO: 290039

SEQ ID NO: 474074 - RNA, 64 nt, hsa; identical to SEQ ID NO: 290040

SEQ ID NO: 474075 - RNA, 64 nt, hsa
gaccaauugaagcaugaacguggauuguauuuaagacauaaacaaagacauugacagcaauuca

SEQ ID NO: 474076 - RNA, 64 nt, hsa
cucccaaacugacaauuuuaccuauucugaaaaagacauaaaacagaauuugguagcacuuacc

SEQ ID NO: 474077 - RNA, 64 nt, hsa
cuaauacagggagcacacuccuucaguucagcaagacauaaagccuuuugcuuuaugcuugagg

SEQ ID NO: 474078 - RNA, 64 nt, hsa
uggcauuuaauuucaaccuaaauacugacugcuggacauaaaucacagaaaauuuaacuuaaga

SEQ ID NO: 474079 - RNA, 64 nt, hsa
ugcaaguuaauguacauuauacaugcguguaagggacauaaauggaggggugugaacuuugguu

SEQ ID NO: 474080 - RNA, 64 nt, hsa
aaagcugucaucuuguaauauaugcucuagaaaugacauaaagguuuauggggaagcaaagaga

SEQ ID NO: 474081 - RNA, 64 nt, hsa
uuacaggagaggaccuguggauagacuuaguuuugacauaaaacaaugcccauucaccuccucc

SEQ ID NO: 474082 - RNA, 64 nt, hsa
uguaucugaauuuuaaaauuaaaaaggcagauaagacauaaauaguuaucauuuuaauugcaau

SEQ ID NO: 474083 - RNA, 64 nt, hsa
cuguucuuuuuccuaauuaauguagcuuucggaugacauaaauccaguaucucugcuuaugaca

SEQ ID NO: 474084 - RNA, 64 nt, hsa
uuucggaugacauaaauccaguaucucugcuuaugacauaaauccaguaccucugcuuuucuuu

SEQ ID NO: 474085 - RNA, 64 nt, hsa; identical to SEQ ID NO: 57588

SEQ ID NO: 474086 - RNA, 64 nt, hsa; identical to SEQ ID NO: 57589

SEQ ID NO: 474087 - RNA, 64 nt, hsa
ucuuucuuucuuuuucuuuuuaauuccauuuuuguaugcauaccugccagcucguaugccucug

SEQ ID NO: 474088 - RNA, 64 nt, hsa
cuaaugcaugcaagaaucauuagguuggcagguauaugcauaagugaaaaaucuggaaguguaa

SEQ ID NO: 474089 - RNA, 64 nt, hsa
uucuuuccucugcugcucaauaguuuuauauaucuaugcauacauauauacacacauauguaua

SEQ ID NO: 474090 - RNA, 64 nt, hsa
gcuuauaguuuacaagugagacccgauaugucauuaugcauacuuauauuaucuuaagcaugug

SEQ ID NO: 474091 - RNA, 64 nt, hsa
ugugauuuguaauaaauuuauugugguacaguaauaugcauaaaauaaacccauuuuaaugugc

SEQ ID NO: 474092 - RNA, 64 nt, hsa
ugcuucccaauuguagcaccauguucugugugaauaugcauaaccagagugaccccccccagca

SEQ ID NO: 474093 - RNA, 64 nt, hsa
uauauauguauagauacagcuaguuaugcauauauaugcauauauguguuuguuuguguaugua

SEQ ID NO: 474094 - RNA, 64 nt, hsa
ucucuauaccuauauauguauagauacagcuaguuaugcauauauaugcauauauguguuuguu

SEQ ID NO: 474095 - RNA, 64 nt, hsa
uuaaauacaaacauauuuuucucacauugaguaauaugcauaauguaguuccaaauguauuuca

SEQ ID NO: 474096 - RNA, 64 nt, hsa
uuuaaagauaaaacuuuacaaccugcacauuuguuaugcauacuaaaugguguguuaaaauuag

SEQ ID NO: 474097 - RNA, 64 nt, hsa
agagaauuucuuuauauacacaaacauacaugaauaugcauaucuauaugcauagauguaccua

SEQ ID NO: 474098 - RNA, 64 nt, hsa
uauauacacaaacauacaugaauaugcauaucuauaugcauagauguaccuauccugcacccaa

SEQ ID NO: 474099 - RNA, 64 nt, hsa
gagaaagggcauacauccacagauucacuuuguuuaugcauauguagauacaaggaugcacaua

SEQ ID NO: 474100 - RNA, 64 nt, hsa
uuuugaaaaguauugguuacuggugauguugaaauaugcauacuaauuuuugcuuaacauuaga

SEQ ID NO: 474101 - RNA, 64 nt, hsa
uaaacuguguaugcauauaaguauaugcuuuauguaugcauauguauguagauauguuuauauc

SEQ ID NO: 474102 - RNA, 64 nt, hsa
uuuucugaacacuggcugggaaauguaaacuguguaugcauauaaguauaugcuuuauguaugc

SEQ ID NO: 474103 - RNA, 64 nt, hsa; identical to SEQ ID NO: 288961

SEQ ID NO: 474104 - RNA, 64 nt, hsa; identical to SEQ ID NO: 288962

SEQ ID NO: 474105 - RNA, 64 nt, hsa; identical to SEQ ID NO: 288963

SEQ ID NO: 474106 - RNA, 64 nt, hsa; identical to SEQ ID NO: 288964

SEQ ID NO: 474107 - RNA, 64 nt, hsa; identical to SEQ ID NO: 288965

SEQ ID NO: 474108 - RNA, 64 nt, hsa; identical to SEQ ID NO: 288966

SEQ ID NO: 474109 - RNA, 64 nt, hsa; identical to SEQ ID NO: 288967

SEQ ID NO: 474110 - RNA, 64 nt, hsa; identical to SEQ ID NO: 288968

SEQ ID NO: 474111 - RNA, 64 nt, hsa; identical to SEQ ID NO: 288969

SEQ ID NO: 474112 - RNA, 64 nt, hsa; identical to SEQ ID NO: 288970

SEQ ID NO: 474113 - RNA, 64 nt, hsa; identical to SEQ ID NO: 288971

SEQ ID NO: 474114 - RNA, 64 nt, hsa; identical to SEQ ID NO: 288972

SEQ ID NO: 474115 - RNA, 64 nt, hsa; identical to SEQ ID NO: 288973

SEQ ID NO: 474116 - RNA, 64 nt, hsa; identical to SEQ ID NO: 288974

SEQ ID NO: 474117 - RNA, 64 nt, hsa; identical to SEQ ID NO: 288975

SEQ ID NO: 474118 - RNA, 64 nt, hsa; identical to SEQ ID NO: 288976

SEQ ID NO: 474119 - RNA, 64 nt, hsa; identical to SEQ ID NO: 288977

SEQ ID NO: 474120 - RNA, 64 nt, hsa; identical to SEQ ID NO: 288978

SEQ ID NO: 474121 - RNA, 64 nt, hsa; identical to SEQ ID NO: 288979

SEQ ID NO: 474122 - RNA, 52 nt, hsa; identical to SEQ ID NO: 69449

SEQ ID NO: 474123 - RNA, 64 nt, hsa; identical to SEQ ID NO: 288981

SEQ ID NO: 474124 - RNA, 64 nt, hsa; identical to SEQ ID NO: 288982

SEQ ID NO: 474125 - RNA, 64 nt, hsa; identical to SEQ ID NO: 288983

SEQ ID NO: 474126 - RNA, 64 nt, hsa; identical to SEQ ID NO: 288984

SEQ ID NO: 474127 - RNA, 64 nt, hsa; identical to SEQ ID NO: 288985

SEQ ID NO: 474128 - RNA, 64 nt, hsa; identical to SEQ ID NO: 288986

SEQ ID NO: 474129 - RNA, 64 nt, hsa; identical to SEQ ID NO: 288987

SEQ ID NO: 474130 - RNA, 64 nt, hsa; identical to SEQ ID NO: 288988

SEQ ID NO: 474131 - RNA, 64 nt, hsa; identical to SEQ ID NO: 288989

SEQ ID NO: 474132 - RNA, 64 nt, hsa; identical to SEQ ID NO: 288990

SEQ ID NO: 474133 - RNA, 64 nt, hsa; identical to SEQ ID NO: 288991

SEQ ID NO: 474134 - RNA, 64 nt, hsa; identical to SEQ ID NO: 288992

SEQ ID NO: 474135 - RNA, 64 nt, hsa; identical to SEQ ID NO: 288993

SEQ ID NO: 474136 - RNA, 64 nt, hsa; identical to SEQ ID NO: 288994

SEQ ID NO: 474137 - RNA, 64 nt, hsa; identical to SEQ ID NO: 288995

SEQ ID NO: 474138 - RNA, 64 nt, hsa; identical to SEQ ID NO: 288996

SEQ ID NO: 474139 - RNA, 64 nt, hsa; identical to SEQ ID NO: 288997

SEQ ID NO: 474140 - RNA, 64 nt, hsa; identical to SEQ ID NO: 288998

SEQ ID NO: 474141 - RNA, 64 nt, hsa; identical to SEQ ID NO: 288999

SEQ ID NO: 474142 - RNA, 64 nt, hsa; identical to SEQ ID NO: 289000

SEQ ID NO: 474143 - RNA, 64 nt, hsa; identical to SEQ ID NO: 289001

SEQ ID NO: 474144 - RNA, 64 nt, hsa; identical to SEQ ID NO: 289002

SEQ ID NO: 474145 - RNA, 64 nt, hsa; identical to SEQ ID NO: 289003

SEQ ID NO: 474146 - RNA, 64 nt, hsa; identical to SEQ ID NO: 289004

SEQ ID NO: 474147 - RNA, 64 nt, hsa; identical to SEQ ID NO: 289005

SEQ ID NO: 474148 - RNA, 64 nt, hsa; identical to SEQ ID NO: 289006

SEQ ID NO: 474149 - RNA, 64 nt, hsa; identical to SEQ ID NO: 289007

SEQ ID NO: 474150 - RNA, 64 nt, hsa; identical to SEQ ID NO: 289008

SEQ ID NO: 474151 - RNA, 64 nt, hsa
cccgucccauuugcagagcucuacuacuucauuuccacaguaagcauauauauaaugaucacuu

SEQ ID NO: 474152 - RNA, 64 nt, hsa
cuccuaauugugugguaauuugcuuuuacuguuuccacaguauuucaggucuuugcucauucac

SEQ ID NO: 474153 - RNA, 64 nt, hsa
gggagggggcgcagguacaugcuaguuucaauuaccacaguauucuagagacggguugcaauga

SEQ ID NO: 474154 - RNA, 64 nt, hsa
ugugagccaccacgccuggccggcuuauuuuuauccacaguaaaucuucagcaacucauugucu

SEQ ID NO: 474155 - RNA, 64 nt, hsa
cagcacaacaaauuaaaaacaaaaacaacucaugccacaguaugucgucuucaugugucuugca

SEQ ID NO: 474156 - RNA, 64 nt, hsa
gugucccaguacaaaaaggcuguaagauagucaaccacaguagucaccuaugucugugccuccc

SEQ ID NO: 474157 - RNA, 64 nt, hsa
gccagguaauuaauaaucugcacugauauuacauccacaguaccacaguauuuauguguaugaa

SEQ ID NO: 474158 - RNA, 64 nt, hsa
auuaauaaucugcacugauauuacauccacaguaccacaguauuuauguguaugaauuaaggau

SEQ ID NO: 474159 - RNA, 64 nt, hsa
gcacaccaaacucuugucuauauuuaccuuuguaccacaguauuaaucgcuauuguucauguau

SEQ ID NO: 474160 - RNA, 64 nt, hsa
uaauccaaccaaaaauaaugaaauaaaauuugagccacaguauaccacuccuugggauaaaguu

SEQ ID NO: 474161 - RNA, 64 nt, hsa
ugaaggcaucugcuuucuuuacaguaucagaguccaagaacaggaugucaccauagauaaaagc

SEQ ID NO: 474162 - RNA, 64 nt, hsa
gggucccuuccuuucuccuuuccucucuacugcucaagaacagauuugaggccaggugcggugc

SEQ ID NO: 474163 - RNA, 64 nt, hsa
gcagugagaguugagcacagaguccuucacaaaccaagaacacacguaggccuucaacacaauu

SEQ ID NO: 474164 - RNA, 64 nt, hsa
guaaagagaugaacgcaaugccaauaaaauugaacaagaacaaugaucaucugccuuugccaga

SEQ ID NO: 474165 - RNA, 64 nt, hsa
gaacagcagcaaguuuuucagugcauaugcugcacaagaacaaaauauaaaucuguauggcacc

SEQ ID NO: 474166 - RNA, 64 nt, hsa
uguggaaguggucugaggcauauagaguauaugccaagaacacuaccauauauggcaucagcuu

SEQ ID NO: 474167 - RNA, 64 nt, hsa
uagucacuuguuuucauuaucauaauugaauuuccaagaacaacuugauaucauucagcugucc

SEQ ID NO: 474168 - RNA, 64 nt, hsa
agaaagggcaaaaaauucauuugaaccaguuuuccaagaacaaaucuugcacaagcaaaguaua

SEQ ID NO: 474169 - RNA, 64 nt, hsa
ugcuaaauaauacuguguuuuaaguuuuguguugcaagaacaaauggaauaaacuugaauugug

SEQ ID NO: 474170 - RNA, 64 nt, hsa
aacauagcauucuacagcaggguuaaucuauuaucaagaacagucacccugguuaauaacaagu

SEQ ID NO: 474171 - RNA, 64 nt, hsa
aagcaaacaaauccauaacaaccacaacaagcaacaagaacaagaacaacaacaagaagaaguu

SEQ ID NO: 474172 - RNA, 64 nt, hsa
acaaauccauaacaaccacaacaagcaacaagaacaagaacaacaacaagaagaaguugcagua

SEQ ID NO: 474173 - RNA, 64 nt, hsa
gcgcaucuccgugguuaucccgcugucuccucuccaagaacaagcagagcccgggccacuggcc

SEQ ID NO: 474174 - RNA, 64 nt, hsa
cuggcgggggccucgugcaaggggagacugacaccaagaacagccaguagguucuucuccccug

SEQ ID NO: 474175 - RNA, 64 nt, hsa
ugagaagugccugauguugauguacuuacagacacaagaacaaucuuugcuauaauuguauaaa

SEQ ID NO: 474176 - RNA, 64 nt, hsa
aucuucauuggcuugguauuuccuaaauguuuaacaagaacacaaguguuccugauaagauuuc

SEQ ID NO: 474177 - RNA, 64 nt, hsa
ugugaucaacuguucagggucucucucuuacaaccaagaacauuaucuuaguggaagaugguac

SEQ ID NO: 474178 - RNA, 64 nt, hsa
aggaaacaucuccacccaagacgucuuuggaauccaagaacaggaagccaagagagugagcagg

SEQ ID NO: 474179 - RNA, 64 nt, hsa
auuuuauauuuccaauuguuaaagaaaaauauuucaagaacaaaucuucucucaggaaaauugc

SEQ ID NO: 474180 - RNA, 64 nt, hsa
aauugccuuucucuauuuguuaagaauuuuuauacaagaacaccaauauacccccuuuauuuua

SEQ ID NO: 474181 - RNA, 64 nt, hsa
gaaauuggauuuuuauuuagaaucaaaauuaggacaagaacagauaacuucuucagauacauuu

SEQ ID NO: 474182 - RNA, 64 nt, hsa
ucagauagacgcagaaaauuggugagugguugaccaagaacacugcacaaauauaaaaaaaguu

SEQ ID NO: 474183 - RNA, 64 nt, hsa
acaauagcaguacaccacuaggcucuuaaacgaucaagaacaauuuuuuucauggugaaaucaa

SEQ ID NO: 474184 - RNA, 64 nt, hsa
ccaagaucaugccacugcacuccagccugggcaacaagaacaaaacuccaucuaaagaagaaaa

SEQ ID NO: 474185 - RNA, 64 nt, hsa
gagaaacaccucacugcaguuucaacaugcuuuccaagaacaauauauacgacauauacauuuu

SEQ ID NO: 474186 - RNA, 64 nt, hsa
uacagcuuuuaaaauauugugguucuggaccuuacaagaacaagaugguuugauuucauuaaug

SEQ ID NO: 474187 - RNA, 64 nt, hsa; identical to SEQ ID NO: 80674

SEQ ID NO: 474188 - RNA, 64 nt, hsa; identical to SEQ ID NO: 80675

SEQ ID NO: 474189 - RNA, 64 nt, hsa; identical to SEQ ID NO: 80676

SEQ ID NO: 474190 - RNA, 64 nt, hsa; identical to SEQ ID NO: 80677

SEQ ID NO: 474191 - RNA, 64 nt, hsa; identical to SEQ ID NO: 80678

SEQ ID NO: 474192 - RNA, 64 nt, hsa; identical to SEQ ID NO: 80679

SEQ ID NO: 474193 - RNA, 64 nt, hsa; identical to SEQ ID NO: 80680

SEQ ID NO: 474194 - RNA, 64 nt, hsa; identical to SEQ ID NO: 80681

SEQ ID NO: 474195 - RNA, 64 nt, hsa; identical to SEQ ID NO: 80682

SEQ ID NO: 474196 - RNA, 64 nt, hsa; identical to SEQ ID NO: 80683

SEQ ID NO: 474197 - RNA, 64 nt, hsa; identical to SEQ ID NO: 80684

SEQ ID NO: 474198 - RNA, 64 nt, hsa; identical to SEQ ID NO: 80685

SEQ ID NO: 474199 - RNA, 64 nt, hsa
agaaucaggguccucgggcaugaacgcgagcccaaagugccagucugcgauuggaaauuuccag

SEQ ID NO: 474200 - RNA, 64 nt, hsa
ggacgaggcccagcucagcugggccagagcccagaagugccaccucaucauaauucaaguguuc

SEQ ID NO: 474201 - RNA, 64 nt, hsa
guucauguauguucagaagaaauucugucauagaaagugccagaaaguguuuaacuugucaaaa

SEQ ID NO: 474202 - RNA, 64 nt, hsa
ugugacuggucagguauuucaguucuuaggaaggaagugccaaguuuguuuuuggguuccugga

SEQ ID NO: 474203 - RNA, 64 nt, hsa
cugccauggaugcaguagaggaaaguggugguacaagugccaugauugauuagcaaugucugca

SEQ ID NO: 474204 - RNA, 64 nt, hsa
aggagucugagacauguaugauugaaugggugccaagugccagggggcggaguccccagcagau

SEQ ID NO: 474205 - RNA, 64 nt, hsa
ugucucuggaagugcaaccacccaaugucucuggaagugccaccuggaagugccaccuggaagu

SEQ ID NO: 474206 - RNA, 64 nt, hsa
gcaaccacccaaugucucuggaagugccaccuggaagugccaccuggaagugucucuggaagag

SEQ ID NO: 474207 - RNA, 64 nt, hsa
cuggcacagcugcagagugcacagggagggucagaagugccaagucacuggccguuaacucagc

SEQ ID NO: 474208 - RNA, 64 nt, hsa
gggugcugggccuuggaccuucucccuugcuuagaagugccagccucuuuuaggcugugguuag

SEQ ID NO: 474209 - RNA, 64 nt, hsa; identical to SEQ ID NO: 274737

SEQ ID NO: 474210 - RNA, 64 nt, hsa; identical to SEQ ID NO: 274738

SEQ ID NO: 474211 - RNA, 64 nt, hsa; identical to SEQ ID NO: 274739

SEQ ID NO: 474212 - RNA, 64 nt, hsa; identical to SEQ ID NO: 274740

SEQ ID NO: 474213 - RNA, 64 nt, hsa; identical to SEQ ID NO: 274741

SEQ ID NO: 474214 - RNA, 64 nt, hsa; identical to SEQ ID NO: 274742

SEQ ID NO: 474215 - RNA, 64 nt, hsa; identical to SEQ ID NO: 274743

SEQ ID NO: 474216 - RNA, 64 nt, hsa; identical to SEQ ID NO: 182067

SEQ ID NO: 474217 - RNA, 64 nt, hsa; identical to SEQ ID NO: 182068

SEQ ID NO: 474218 - RNA, 64 nt, hsa; identical to SEQ ID NO: 182069

SEQ ID NO: 474219 - RNA, 64 nt, hsa; identical to SEQ ID NO: 182070

SEQ ID NO: 474220 - RNA, 64 nt, hsa; identical to SEQ ID NO: 182071

SEQ ID NO: 474221 - RNA, 64 nt, hsa; identical to SEQ ID NO: 182072

SEQ ID NO: 474222 - RNA, 64 nt, hsa; identical to SEQ ID NO: 182073

SEQ ID NO: 474223 - RNA, 64 nt, hsa; identical to SEQ ID NO: 182074

SEQ ID NO: 474224 - RNA, 64 nt, hsa; identical to SEQ ID NO: 182075

SEQ ID NO: 474225 - RNA, 64 nt, hsa; identical to SEQ ID NO: 182076

SEQ ID NO: 474226 - RNA, 64 nt, hsa; identical to SEQ ID NO: 182077

SEQ ID NO: 474227 - RNA, 64 nt, hsa; identical to SEQ ID NO: 182078

SEQ ID NO: 474228 - RNA, 64 nt, hsa; identical to SEQ ID NO: 182079

SEQ ID NO: 474229 - RNA, 64 nt, hsa; identical to SEQ ID NO: 182080

SEQ ID NO: 474230 - RNA, 64 nt, hsa; identical to SEQ ID NO: 182081

SEQ ID NO: 474231 - RNA, 64 nt, hsa; identical to SEQ ID NO: 182082

SEQ ID NO: 474232 - RNA, 64 nt, hsa; identical to SEQ ID NO: 182083

SEQ ID NO: 474233 - RNA, 64 nt, hsa; identical to SEQ ID NO: 182084

SEQ ID NO: 474234 - RNA, 64 nt, hsa; identical to SEQ ID NO: 182085

SEQ ID NO: 474235 - RNA, 64 nt, hsa; identical to SEQ ID NO: 182086

SEQ ID NO: 474236 - RNA, 64 nt, hsa; identical to SEQ ID NO: 182087

SEQ ID NO: 474237 - RNA, 64 nt, hsa; identical to SEQ ID NO: 182088

SEQ ID NO: 474238 - RNA, 64 nt, hsa; identical to SEQ ID NO: 182089

SEQ ID NO: 474239 - RNA, 64 nt, hsa; identical to SEQ ID NO: 182090

SEQ ID NO: 474240 - RNA, 64 nt, hsa; identical to SEQ ID NO: 182091

SEQ ID NO: 474241 - RNA, 64 nt, hsa; identical to SEQ ID NO: 182092

SEQ ID NO: 474242 - RNA, 64 nt, hsa; identical to SEQ ID NO: 182093

SEQ ID NO: 474243 - RNA, 64 nt, hsa; identical to SEQ ID NO: 182094

SEQ ID NO: 474244 - RNA, 64 nt, hsa; identical to SEQ ID NO: 182095

SEQ ID NO: 474245 - RNA, 64 nt, hsa; identical to SEQ ID NO: 182096

SEQ ID NO: 474246 - RNA, 64 nt, hsa; identical to SEQ ID NO: 182097

SEQ ID NO: 474247 - RNA, 64 nt, hsa; identical to SEQ ID NO: 182098

SEQ ID NO: 474248 - RNA, 61 nt, hsa
cccuuagggcaggaagggacgaugagcaagucugccacaccaccuggugacugggaagggc

SEQ ID NO: 474249 - RNA, 61 nt, hsa
uguggguuucccagcuaacggacaagcuccccugccacacccagugcccacgcaugcucac

SEQ ID NO: 474250 - RNA, 61 nt, hsa
ucauaccacaucaguguuuccgucugcucaccugccacagagcccacacccaugcccacca

SEQ ID NO: 474251 - RNA, 61 nt, hsa
ccagggcagccccaaccaggucuccucccaccugccacacagcgcuccggggccugagggc

SEQ ID NO: 474252 - RNA, 61 nt, hsa
cccggcucuuccuguguggaggugaugguaccugccacaccacagcugcgcacacagcugc

SEQ ID NO: 474253 - RNA, 61 nt, hsa
ggcacugugccagggcuggggccuucugcugcugccacacccagcucaggccugggccagc

SEQ ID NO: 474254 - RNA, 61 nt, hsa
ccacuacaaacugaccccucagcagggcuggcugccacagggcugcccugccucauaggua

SEQ ID NO: 474255 - RNA, 61 nt, hsa
cucaguugagcugccucuggccuuguugcugcugccacauccuaggucuaagaguugaacg

SEQ ID NO: 474256 - RNA, 61 nt, hsa
ccuggacauuggacauugcuaaguugggucacugccacauggagucuugccaugccugugu

SEQ ID NO: 474257 - RNA, 61 nt, hsa
cugccacaucugggcauacagugucuggacacugccacauggagccacugucaugcagguc

SEQ ID NO: 474258 - RNA, 61 nt, hsa
cugccacaucugggcauacagugucuggacgcugccacaucugggcauacagugucuggac

SEQ ID NO: 474259 - RNA, 61 nt, hsa
ccuggagggcagccacacagcuggacggaugcugccacaucugggcauacagugucuggac

SEQ ID NO: 474260 - RNA, 61 nt, hsa
aaaaacacaguccugagagggauggaccagacugccacagcagcucauagcacaaaaaaag

SEQ ID NO: 474261 - RNA, 61 nt, hsa
aagauaccauuauauuuauaugagcuauguacugccacaaaaaaagaugaaauguaauuuc

SEQ ID NO: 474262 - RNA, 61 nt, hsa
aaaaaacacaaucuuaaggggauagacuagacugccacagcagcccauggcacaacuaaca

SEQ ID NO: 474263 - RNA, 61 nt, hsa
uuuuagccuuugaugguaagaggaauacgggcugccacauagacuuuguucucauuaauau

SEQ ID NO: 474264 - RNA, 61 nt, hsa
ugcacugauauauauuuuuuuuaaagagcaacugccacaugcgggauuucauuucugcuuu

SEQ ID NO: 474265 - RNA, 61 nt, hsa
gccucgggcaggggucucaggcccguggccccugccacagggcacuggaauggacagcagg

SEQ ID NO: 474266 - RNA, 61 nt, hsa
cacggugaugcucgggucugcccccgacccccugccacaggccggaagccgcagggggcac

SEQ ID NO: 474267 - RNA, 61 nt, hsa
ggccuccccagcugcuggccagacccuggcgcugccacaguccuggcacugcccaaggcca

SEQ ID NO: 474268 - RNA, 61 nt, hsa
gugggaggagcgacugcccugcccaaaugaacugccacagcagggacagcuggaccgcaga

SEQ ID NO: 474269 - RNA, 61 nt, hsa
ucugccucagacguugccugagaagaaguggcugccacacccaggggaaggcccugaggcg

SEQ ID NO: 474270 - RNA, 61 nt, hsa
gagagacaggcagcccagcaguguggagacccugccacagccagaggagggcagagggaga

SEQ ID NO: 474271 - RNA, 61 nt, hsa
cugguacacugugccauggggguaagccgcucugccacacuuguccuggccuuccucauga

SEQ ID NO: 474272 - RNA, 61 nt, hsa
ucgcugcagcgcuugcuguggguccgucaggcugccacacugaaccauaucgaugaggucu

SEQ ID NO: 474273 - RNA, 61 nt, hsa
cugcgggguccucauggggugagcccaggcccugccacaaccuacagggucacucaguaug

SEQ ID NO: 474274 - RNA, 61 nt, hsa
agugcccaucuuccugaaaggauguuaguuucugccacaaugugaagaaggccuucaccuu

SEQ ID NO: 474275 - RNA, 61 nt, hsa
aggagagcaugcccauauuggcuuacuuugucugccacagacacagacagagggaguuggg

SEQ ID NO: 474276 - RNA, 61 nt, hsa
caaacuccaccucuuggauuggcccuggcugcugccacacacauauccaagagcucagggc

SEQ ID NO: 474277 - RNA, 61 nt, hsa
gggcagacacagcuccagggacccaggccagcugccacacccccgacacuccugcugucca

SEQ ID NO: 474278 - RNA, 61 nt, hsa
uuucuugcugucuggaauucaguuuuuccaucugccacauggaaguucauagccaggauag

SEQ ID NO: 474279 - RNA, 61 nt, hsa
ccucucacucacuucuccacccgccaggcagcugccacaggccuaaggcugagugaggugu

SEQ ID NO: 474280 - RNA, 61 nt, hsa
augccagcccgaggcacugcuacgccagcagcugccacaugggaugguggcucaggcgcuc

SEQ ID NO: 474281 - RNA, 61 nt, hsa
cgccgagggcugagcuccagagccgcaccaucugccacaaacagaauucgagacauacuua

SEQ ID NO: 474282 - RNA, 61 nt, hsa
agagacacggucacugauucacacccagucccugccacagaccgucucagacacgcacagu

SEQ ID NO: 474283 - RNA, 61 nt, hsa
gugggccugcugcaugauucacacccagucccugccacagaccgucucagacacgcacagu

SEQ ID NO: 474284 - RNA, 61 nt, hsa; identical to SEQ ID NO: 474283

SEQ ID NO: 474285 - RNA, 61 nt, hsa
ggcgccccgggugggcuuuggggcugcggcacugccacacauccuuucccuccuggccugc

SEQ ID NO: 474286 - RNA, 61 nt, hsa
gccuucagugucacagcguggccuugcuugucugccacagcgggagcuaagccggcccugg

SEQ ID NO: 474287 - RNA, 61 nt, hsa
cuggcaguagccucuuuccagcuacacgucgcugccacaggccccuggaaaugcuaccuac

SEQ ID NO: 474288 - RNA, 61 nt, hsa
ggccaauccagggcagcccagagggaacauccugccacaccgccuggcaguagccucuuuc

SEQ ID NO: 474289 - RNA, 61 nt, hsa
auuauaacauuuacuuuugcucccuaccugacugccacagaacugggcaacuauucaugag

SEQ ID NO: 474290 - RNA, 61 nt, hsa
cagccuccugaguagcugggacuacaggcgccugccacaacgcccggcuaauuuuuuguau

SEQ ID NO: 474291 - RNA, 61 nt, hsa
gaagcucccaucacaagcuuggcauugcucucugccacacgugggcuuccucaggcuuguc

SEQ ID NO: 474292 - RNA, 61 nt, hsa
cucugccacacgugggcuuccucaggcuugucugccacaagcuacuucucugagcucagaa

SEQ ID NO: 474293 - RNA, 57 nt, hsa; identical to SEQ ID NO: 71857

SEQ ID NO: 474294 - RNA, 61 nt, hsa
ggggcaggcgggagcaggcacgggggugaugcugccacagggggcuggugacacccagagc

SEQ ID NO: 474295 - RNA, 64 nt, hsa; identical to SEQ ID NO: 232496

SEQ ID NO: 474296 - RNA, 64 nt, hsa; identical to SEQ ID NO: 232497

SEQ ID NO: 474297 - RNA, 64 nt, hsa; identical to SEQ ID NO: 232498

SEQ ID NO: 474298 - RNA, 64 nt, hsa; identical to SEQ ID NO: 232499

SEQ ID NO: 474299 - RNA, 64 nt, hsa; identical to SEQ ID NO: 232500

SEQ ID NO: 474300 - RNA, 64 nt, hsa; identical to SEQ ID NO: 232501

SEQ ID NO: 474301 - RNA, 64 nt, hsa; identical to SEQ ID NO: 232502

SEQ ID NO: 474302 - RNA, 64 nt, hsa; identical to SEQ ID NO: 232503

SEQ ID NO: 474303 - RNA, 64 nt, hsa; identical to SEQ ID NO: 232504

SEQ ID NO: 474304 - RNA, 64 nt, hsa; identical to SEQ ID NO: 232505

SEQ ID NO: 474305 - RNA, 64 nt, hsa; identical to SEQ ID NO: 232506

SEQ ID NO: 474306 - RNA, 64 nt, hsa; identical to SEQ ID NO: 232507

SEQ ID NO: 474307 - RNA, 64 nt, hsa; identical to SEQ ID NO: 232508

SEQ ID NO: 474308 - RNA, 64 nt, hsa; identical to SEQ ID NO: 232509

SEQ ID NO: 474309 - RNA, 64 nt, hsa; identical to SEQ ID NO: 232510

SEQ ID NO: 474310 - RNA, 64 nt, hsa; identical to SEQ ID NO: 232511

SEQ ID NO: 474311 - RNA, 64 nt, hsa; identical to SEQ ID NO: 232512

SEQ ID NO: 474312 - RNA, 64 nt, hsa; identical to SEQ ID NO: 232513

SEQ ID NO: 474313 - RNA, 64 nt, hsa; identical to SEQ ID NO: 395363

SEQ ID NO: 474314 - RNA, 64 nt, hsa; identical to SEQ ID NO: 395364

SEQ ID NO: 474315 - RNA, 64 nt, hsa; identical to SEQ ID NO: 395365

SEQ ID NO: 474316 - RNA, 64 nt, hsa; identical to SEQ ID NO: 395366

SEQ ID NO: 474317 - RNA, 64 nt, hsa; identical to SEQ ID NO: 395367

SEQ ID NO: 474318 - RNA, 64 nt, hsa; identical to SEQ ID NO: 395368

SEQ ID NO: 474319 - RNA, 64 nt, hsa; identical to SEQ ID NO: 395369

SEQ ID NO: 474320 - RNA, 64 nt, hsa; identical to SEQ ID NO: 395370

SEQ ID NO: 474321 - RNA, 64 nt, hsa; identical to SEQ ID NO: 395371

SEQ ID NO: 474322 - RNA, 64 nt, hsa; identical to SEQ ID NO: 395372

SEQ ID NO: 474323 - RNA, 64 nt, hsa; identical to SEQ ID NO: 395373

SEQ ID NO: 474324 - RNA, 64 nt, hsa; identical to SEQ ID NO: 395374

SEQ ID NO: 474325 - RNA, 64 nt, hsa; identical to SEQ ID NO: 395375

SEQ ID NO: 474326 - RNA, 64 nt, hsa; identical to SEQ ID NO: 395376

SEQ ID NO: 474327 - RNA, 64 nt, hsa; identical to SEQ ID NO: 395377

SEQ ID NO: 474328 - RNA, 64 nt, hsa; identical to SEQ ID NO: 395378

SEQ ID NO: 474329 - RNA, 64 nt, hsa; identical to SEQ ID NO: 395379

SEQ ID NO: 474330 - RNA, 64 nt, hsa; identical to SEQ ID NO: 395380

SEQ ID NO: 474331 - RNA, 64 nt, hsa; identical to SEQ ID NO: 395381

SEQ ID NO: 474332 - RNA, 64 nt, hsa; identical to SEQ ID NO: 395382

SEQ ID NO: 474333 - RNA, 64 nt, hsa; identical to SEQ ID NO: 395383

SEQ ID NO: 474334 - RNA, 64 nt, hsa; identical to SEQ ID NO: 395384

SEQ ID NO: 474335 - RNA, 64 nt, hsa; identical to SEQ ID NO: 395385

SEQ ID NO: 474336 - RNA, 64 nt, hsa; identical to SEQ ID NO: 395386

SEQ ID NO: 474337 - RNA, 64 nt, hsa; identical to SEQ ID NO: 395387

SEQ ID NO: 474338 - RNA, 64 nt, hsa; identical to SEQ ID NO: 395388

SEQ ID NO: 474339 - RNA, 64 nt, hsa; identical to SEQ ID NO: 395389

SEQ ID NO: 474340 - RNA, 64 nt, hsa; identical to SEQ ID NO: 395390

SEQ ID NO: 474341 - RNA, 64 nt, hsa; identical to SEQ ID NO: 395391

SEQ ID NO: 474342 - RNA, 64 nt, hsa; identical to SEQ ID NO: 395392

SEQ ID NO: 474343 - RNA, 64 nt, hsa; identical to SEQ ID NO: 395393

SEQ ID NO: 474344 - RNA, 64 nt, hsa; identical to SEQ ID NO: 395394

SEQ ID NO: 474345 - RNA, 64 nt, hsa; identical to SEQ ID NO: 395395

SEQ ID NO: 474346 - RNA, 64 nt, hsa; identical to SEQ ID NO: 395396

SEQ ID NO: 474347 - RNA, 64 nt, hsa; identical to SEQ ID NO: 395397

SEQ ID NO: 474348 - RNA, 64 nt, hsa; identical to SEQ ID NO: 395398

SEQ ID NO: 474349 - RNA, 64 nt, hsa; identical to SEQ ID NO: 395399

SEQ ID NO: 474350 - RNA, 64 nt, hsa; identical to SEQ ID NO: 395400

SEQ ID NO: 474351 - RNA, 64 nt, hsa; identical to SEQ ID NO: 395401

SEQ ID NO: 474352 - RNA, 64 nt, hsa; identical to SEQ ID NO: 395402

SEQ ID NO: 474353 - RNA, 64 nt, hsa; identical to SEQ ID NO: 395403

SEQ ID NO: 474354 - RNA, 64 nt, hsa; identical to SEQ ID NO: 395404

SEQ ID NO: 474355 - RNA, 64 nt, hsa; identical to SEQ ID NO: 395405

SEQ ID NO: 474356 - RNA, 64 nt, hsa; identical to SEQ ID NO: 395406

SEQ ID NO: 474357 - RNA, 64 nt, hsa; identical to SEQ ID NO: 395407

SEQ ID NO: 474358 - RNA, 64 nt, hsa; identical to SEQ ID NO: 395408

SEQ ID NO: 474359 - RNA, 64 nt, hsa; identical to SEQ ID NO: 395409

SEQ ID NO: 474360 - RNA, 64 nt, hsa; identical to SEQ ID NO: 395410

SEQ ID NO: 474361 - RNA, 64 nt, hsa; identical to SEQ ID NO: 395411

SEQ ID NO: 474362 - RNA, 64 nt, hsa; identical to SEQ ID NO: 395412

SEQ ID NO: 474363 - RNA, 64 nt, hsa; identical to SEQ ID NO: 395413

SEQ ID NO: 474364 - RNA, 64 nt, hsa; identical to SEQ ID NO: 395414

SEQ ID NO: 474365 - RNA, 64 nt, hsa; identical to SEQ ID NO: 395415

SEQ ID NO: 474366 - RNA, 64 nt, hsa; identical to SEQ ID NO: 395416

SEQ ID NO: 474367 - RNA, 64 nt, hsa; identical to SEQ ID NO: 395417

SEQ ID NO: 474368 - RNA, 64 nt, hsa; identical to SEQ ID NO: 395418

SEQ ID NO: 474369 - RNA, 64 nt, hsa; identical to SEQ ID NO: 395419

SEQ ID NO: 474370 - RNA, 64 nt, hsa; identical to SEQ ID NO: 123308

SEQ ID NO: 474371 - RNA, 64 nt, hsa; identical to SEQ ID NO: 123309

SEQ ID NO: 474372 - RNA, 64 nt, hsa; identical to SEQ ID NO: 123310

SEQ ID NO: 474373 - RNA, 64 nt, hsa; identical to SEQ ID NO: 123311

SEQ ID NO: 474374 - RNA, 64 nt, hsa; identical to SEQ ID NO: 123312

SEQ ID NO: 474375 - RNA, 64 nt, hsa; identical to SEQ ID NO: 123313

SEQ ID NO: 474376 - RNA, 64 nt, hsa; identical to SEQ ID NO: 123314

SEQ ID NO: 474377 - RNA, 64 nt, hsa; identical to SEQ ID NO: 123315

SEQ ID NO: 474378 - RNA, 64 nt, hsa; identical to SEQ ID NO: 123316

SEQ ID NO: 474379 - RNA, 64 nt, hsa; identical to SEQ ID NO: 123317

SEQ ID NO: 474380 - RNA, 64 nt, hsa; identical to SEQ ID NO: 123318

SEQ ID NO: 474381 - RNA, 64 nt, hsa; identical to SEQ ID NO: 123319

SEQ ID NO: 474382 - RNA, 64 nt, hsa; identical to SEQ ID NO: 123320

SEQ ID NO: 474383 - RNA, 64 nt, hsa; identical to SEQ ID NO: 123321

SEQ ID NO: 474384 - RNA, 64 nt, hsa; identical to SEQ ID NO: 123322

SEQ ID NO: 474385 - RNA, 64 nt, hsa; identical to SEQ ID NO: 123323

SEQ ID NO: 474386 - RNA, 64 nt, hsa; identical to SEQ ID NO: 123324

SEQ ID NO: 474387 - RNA, 64 nt, hsa; identical to SEQ ID NO: 123325

SEQ ID NO: 474388 - RNA, 64 nt, hsa; identical to SEQ ID NO: 123326

SEQ ID NO: 474389 - RNA, 64 nt, hsa; identical to SEQ ID NO: 123327

SEQ ID NO: 474390 - RNA, 64 nt, hsa; identical to SEQ ID NO: 123328

SEQ ID NO: 474391 - RNA, 64 nt, hsa; identical to SEQ ID NO: 123329

SEQ ID NO: 474392 - RNA, 64 nt, hsa; identical to SEQ ID NO: 123330

SEQ ID NO: 474393 - RNA, 64 nt, hsa; identical to SEQ ID NO: 123331

SEQ ID NO: 474394 - RNA, 64 nt, hsa; identical to SEQ ID NO: 123332

SEQ ID NO: 474395 - RNA, 64 nt, hsa; identical to SEQ ID NO: 123333

SEQ ID NO: 474396 - RNA, 64 nt, hsa; identical to SEQ ID NO: 123334

SEQ ID NO: 474397 - RNA, 64 nt, hsa; identical to SEQ ID NO: 123335

SEQ ID NO: 474398 - RNA, 64 nt, hsa; identical to SEQ ID NO: 123336

SEQ ID NO: 474399 - RNA, 64 nt, hsa; identical to SEQ ID NO: 123337

SEQ ID NO: 474400 - RNA, 64 nt, hsa; identical to SEQ ID NO: 123338

SEQ ID NO: 474401 - RNA, 64 nt, hsa; identical to SEQ ID NO: 123339

SEQ ID NO: 474402 - RNA, 64 nt, hsa; identical to SEQ ID NO: 123340

SEQ ID NO: 474403 - RNA, 64 nt, hsa; identical to SEQ ID NO: 123341

SEQ ID NO: 474404 - RNA, 61 nt, hsa; identical to SEQ ID NO: 123342

SEQ ID NO: 474405 - RNA, 64 nt, hsa; identical to SEQ ID NO: 123343

SEQ ID NO: 474406 - RNA, 64 nt, hsa; identical to SEQ ID NO: 123344

SEQ ID NO: 474407 - RNA, 64 nt, hsa; identical to SEQ ID NO: 123345

SEQ ID NO: 474408 - RNA, 64 nt, hsa; identical to SEQ ID NO: 123346

SEQ ID NO: 474409 - RNA, 64 nt, hsa; identical to SEQ ID NO: 123347

SEQ ID NO: 474410 - RNA, 64 nt, hsa; identical to SEQ ID NO: 123348

SEQ ID NO: 474411 - RNA, 64 nt, hsa; identical to SEQ ID NO: 123349

SEQ ID NO: 474412 - RNA, 64 nt, hsa; identical to SEQ ID NO: 123350

SEQ ID NO: 474413 - RNA, 64 nt, hsa; identical to SEQ ID NO: 123351

SEQ ID NO: 474414 - RNA, 64 nt, hsa; identical to SEQ ID NO: 123352

SEQ ID NO: 474415 - RNA, 64 nt, hsa; identical to SEQ ID NO: 123353

SEQ ID NO: 474416 - RNA, 64 nt, hsa; identical to SEQ ID NO: 123354

SEQ ID NO: 474417 - RNA, 64 nt, hsa; identical to SEQ ID NO: 123355

SEQ ID NO: 474418 - RNA, 64 nt, hsa; identical to SEQ ID NO: 123356

SEQ ID NO: 474419 - RNA, 64 nt, hsa; identical to SEQ ID NO: 123357

SEQ ID NO: 474420 - RNA, 64 nt, hsa; identical to SEQ ID NO: 123358

SEQ ID NO: 474421 - RNA, 64 nt, hsa; identical to SEQ ID NO: 123359

SEQ ID NO: 474422 - RNA, 64 nt, hsa; identical to SEQ ID NO: 123360

SEQ ID NO: 474423 - RNA, 64 nt, hsa; identical to SEQ ID NO: 123361

SEQ ID NO: 474424 - RNA, 64 nt, hsa; identical to SEQ ID NO: 123362

SEQ ID NO: 474425 - RNA, 64 nt, hsa; identical to SEQ ID NO: 123363

SEQ ID NO: 474426 - RNA, 64 nt, hsa; identical to SEQ ID NO: 123364

SEQ ID NO: 474427 - RNA, 64 nt, hsa; identical to SEQ ID NO: 123365

SEQ ID NO: 474428 - RNA, 64 nt, hsa; identical to SEQ ID NO: 123366

SEQ ID NO: 474429 - RNA, 64 nt, hsa; identical to SEQ ID NO: 123367

SEQ ID NO: 474430 - RNA, 64 nt, hsa; identical to SEQ ID NO: 123368

SEQ ID NO: 474431 - RNA, 64 nt, hsa; identical to SEQ ID NO: 123369

SEQ ID NO: 474432 - RNA, 63 nt, hsa
uuuucuuuccacacaggauuccguuggugaaccuguaaaaacaaaacaaacaaaacaaaacaa

SEQ ID NO: 474433 - RNA, 63 nt, hsa
acagagcaggacgcucuaggccaaaucuauuuuuguaaaaaugcucaugccuaugggugacug

SEQ ID NO: 474434 - RNA, 63 nt, hsa
auuuauugagauugaauuaugccaccacguuuauguaaaaaugaagguggcaccguggugaga

SEQ ID NO: 474435 - RNA, 63 nt, hsa
guggugagaccuaaugagaaauaguuacucaguuguaaaaauuuugauuuauucucuuucuuc

SEQ ID NO: 474436 - RNA, 63 nt, hsa
cuuugucaucuguuagacucuguaugugugauuuguaaaaagcaggcugaaacuauggacaug

SEQ ID NO: 474437 - RNA, 63 nt, hsa
uugaaccccuaggcuucaggaaaacugcucuuuuguaaaaagaauagcgaugacauuuucuaa

SEQ ID NO: 474438 - RNA, 63 nt, hsa
cauuugcacuguucagacauauauauguauguauguaaaaauuauauauacacaaauuagcug

SEQ ID NO: 474439 - RNA, 63 nt, hsa
gcuaaagagacuuggcaccagcuuuguucaaacuguaaaaauagcaauuugccccuacucgcu

SEQ ID NO: 474440 - RNA, 63 nt, hsa
gccuuuuaaguuacugacaucagcuuccaccaguguaaaaauugaguaaaaccugaaguuuug

SEQ ID NO: 474441 - RNA, 63 nt, hsa
auagauauauuccaagccgccugacgaucuaauuguaaaaaguaaagcauacaaauacuagaa

SEQ ID NO: 474442 - RNA, 63 nt, hsa
ggcaagacagaaauaagagaaucaagacuugauuguaaaaauugacaacuuuagauucugagg

SEQ ID NO: 474443 - RNA, 63 nt, hsa
cagcguccuauaauccuagaccuuuucaugacguguaaaaaaugauguuucauccucugauug

SEQ ID NO: 474444 - RNA, 63 nt, hsa
guuguaaaaaggggagauuucgguaggcacagguguaaaaaggggagauuucagaagacgggc

SEQ ID NO: 474445 - RNA, 63 nt, hsa
gacuuggaauaucagcagaguaguaggcacaguuguaaaaaggggagauuucgguaggcacag

SEQ ID NO: 474446 - RNA, 63 nt, hsa
ucacuguaaaaauguauuaucuuguaaaacuuauguaaaaaaaaaaaaaaaaaaaaggcaaag

SEQ ID NO: 474447 - RNA, 63 nt, hsa
ccaaguugcaaaguuguauccacaucaggucacuguaaaaauguauuaucuuguaaaacuuau

SEQ ID NO: 474448 - RNA, 63 nt, hsa
ugaaaaaaugaagaaaaauguauuuucccuuuauguaaaaauuagugaauaucuuaugaauua

SEQ ID NO: 474449 - RNA, 63 nt, hsa
gggaacuugagagcuuuuacugugauucuucaauguaaaaaauaaacaacaaugucaaacugu

SEQ ID NO: 474450 - RNA, 63 nt, hsa
uugauuuuuuuauaauaagccuuuuuaccucuguguaaaaaauauauauacaaguguaugaug

SEQ ID NO: 474451 - RNA, 63 nt, hsa
cucauuuauacuuggggaaaaaacaaggccauauguaaaaacccuuccaaugccuaagugucu

SEQ ID NO: 474452 - RNA, 63 nt, hsa
aauagcuggcgagugcuuucuguauuuaaauauuguaaaaagaaaauaaguuauaacuguuau

SEQ ID NO: 474453 - RNA, 63 nt, hsa
uucauuaucuuuaaugaagacaaaggaaucuaguguaaaaaacaacagcaaacaaaaagguga

SEQ ID NO: 474454 - RNA, 63 nt, hsa
accaacaacaauguguuguaaaaaugucuuucauguaaaaagugcaguaaauauuuacuauuu

SEQ ID NO: 474455 - RNA, 63 nt, hsa
uuuguguugcagccucaaccaacaacaauguguuguaaaaaugucuuucauguaaaaagugca

SEQ ID NO: 474456 - RNA, 63 nt, hsa
aguuuaaguuuacgucauugucucaaguguggcuguaaaaaucagaucuagaguuuagagaca

SEQ ID NO: 474457 - RNA, 63 nt, hsa
agcucagauugucgaguuaguaaacaugagcgauguaaaaacuuuauuugaaaucuccuaagu

SEQ ID NO: 474458 - RNA, 63 nt, hsa
uuaaaagaccauaagcaaacugguuauuuaaaauguaaaaaggaauaugaaagucuuauuaaa

SEQ ID NO: 474459 - RNA, 63 nt, hsa
uaaaggcauugauauuuuagaugcacccguguuuguaaaaauguagagcacaauggaauuaug

SEQ ID NO: 474460 - RNA, 63 nt, hsa
cauuucuuccauuaacugcuuccagagaugucauguaaaaaaguuaguguauuagagaaguuu

SEQ ID NO: 474461 - RNA, 63 nt, hsa
ggcuauuuuugagggauguauuuuuuuuaaaauuguaaaaauuguugaguucuguuuaaagaa

SEQ ID NO: 474462 - RNA, 63 nt, hsa
augaguccuugugauuaggcccaccugaucaaauguaaaaacaugcaugggauauuugauuac

SEQ ID NO: 474463 - RNA, 63 nt, hsa
ucagcaagacuuuauaauuccuucugccuaacuuguaaaaagggggcugcauucuuguuggua

SEQ ID NO: 474464 - RNA, 63 nt, hsa
aaggggaaauacuuuaauuuuuuuucuuaauaguguaaaaauucccugagcuaagcuaaaacc

SEQ ID NO: 474465 - RNA, 63 nt, hsa
uucuucaaacacucuuaaauuuuucuuaaguaauguaaaaauggaacugccaauuuuauuucu

SEQ ID NO: 474466 - RNA, 63 nt, hsa
uucuuauucauuaaaugaauucaacauuuucucuguaaaaacaauagaguuucaguacaugaa

SEQ ID NO: 474467 - RNA, 63 nt, hsa
uaauguacauaaauguuacauuuguaaagaaaauguaaaaauguaacuauagcauaugaauug

SEQ ID NO: 474468 - RNA, 63 nt, hsa
accaguaccuauuuuuacucuuacaaaauuuccuguaaaaaaauacuacauuugaaauuauuu

SEQ ID NO: 474469 - RNA, 63 nt, hsa
aaggauaccuggagcacaaggaauaagaucauuuguaaaaauguuuguuuauauagaccuauc

SEQ ID NO: 474470 - RNA, 63 nt, hsa
gcaugugaagaugugaucauuugugauguuacuuguaaaaaaaaguauauauacauaucuuuu

SEQ ID NO: 474471 - RNA, 63 nt, hsa
aauuaacacaguauucauucaucuguguuauuuuguaaaaauaacuguagcuuauauucuuua

SEQ ID NO: 474472 - RNA, 63 nt, hsa
uucuucuucugagaaugugacuuuuucugguguuguaaaaaagaaaaaaaaaagaaugcucau

SEQ ID NO: 474473 - RNA, 63 nt, hsa
uguuguaaaaaagaaaaaaaaaagaaugcucauuguaaaaauaaaaaaauaauaauaagcaag

SEQ ID NO: 474474 - RNA, 63 nt, hsa
ugggaauuucuuuuccuacgggguacgugauuuuguaaaaaggaaguauuucucccaaaauug

SEQ ID NO: 474475 - RNA, 63 nt, hsa
augcuaguuuaaaaaagaaaauauguaauauaauguaaaaaaaaacaaaaaaaagcuuuuaug

SEQ ID NO: 474476 - RNA, 63 nt, hsa
ugaaaacguuugauuauuuucucaguguauuuuuguaaaaaauauauaaaggggguguuaauc

SEQ ID NO: 474477 - RNA, 63 nt, hsa
cugccaccaguguccacccuccggcccccgucuuguaaaaaggggaggagaauuagccaaaca

SEQ ID NO: 474478 - RNA, 63 nt, hsa
uacgucucacuugaaauugcuuuguauacauuuuguaaaaauauuuauaaaauguuuuguaaa

SEQ ID NO: 474479 - RNA, 63 nt, hsa
uauacauuuuguaaaaauauuuauaaaauguuuuguaaaaaaaaaaaaacuauaacaaauugc

SEQ ID NO: 474480 - RNA, 63 nt, hsa
ucugauaaaacucagaauuucuuuuuaagcaguuguaaaaauugucauguuguaauucauuac

SEQ ID NO: 474481 - RNA, 63 nt, hsa
gugaaccucaugcaugaaagcagcacauuaaauuguaaaaauacaaacagaucgugugaucau

SEQ ID NO: 474482 - RNA, 63 nt, hsa
acccaugaagcaagaauagaugugagaaaucuauguaaaaaaauaauuaaagaaaugcaugug

SEQ ID NO: 474483 - RNA, 63 nt, hsa
agagugaauagauccuaagucccaaauggccaguguaaaaauguccuuaugucugaugcuguc

SEQ ID NO: 474484 - RNA, 63 nt, hsa
ugacuuuuugagcaccuuucaguauuauguauuuguaaaaaccauuguuuuuggauauaaagc

SEQ ID NO: 474485 - RNA, 63 nt, hsa
uuuaaaaguaguaagccacauuacauuuaucuuuguaaaaagauuuaugguaacugguuucuu

SEQ ID NO: 474486 - RNA, 63 nt, hsa
gaggacguugaguggauuccuggguacagcuuuuguaaaaaugucaccauggcuuucauccaa

SEQ ID NO: 474487 - RNA, 63 nt, hsa
ucugcaaaucccaaaucuuucuuuauuauuuauuguaaaaaaaguuuccuuagaagucauaaa

SEQ ID NO: 474488 - RNA, 63 nt, hsa
aagaguauuuauacuggaaagaaacccuacaaauguaaaaaacguggcaaugccuuuaacugg

SEQ ID NO: 474489 - RNA, 63 nt, hsa
guaagaauccauacugaagaaaacuccuggaaguguaaaaaauguggcaacacuuuuaauaaa

SEQ ID NO: 474490 - RNA, 63 nt, hsa
cagcccuauggaauuugcaaucugugauugccuuguaaaaaggagagugcauauggcacugca

SEQ ID NO: 474491 - RNA, 63 nt, hsa
auagaaaauauaugaaccaaagugauuugaguuuguaaaaauguaaaauaguaugaacaaaau

SEQ ID NO: 474492 - RNA, 63 nt, hsa
caaaaguuugcuuguuuaaaaugacaguugugauguaaaaaguuuaagaaauaugaaugugag

SEQ ID NO: 474493 - RNA, 63 nt, hsa
uacuuuuuuaaagcugaguaguuaagaauucccuguaaaaacaaaacccuguaaauugagccu

SEQ ID NO: 474494 - RNA, 63 nt, hsa
uauuagagaacugugauuuaaaaguacuguuaauguaaaaaauaaagcaaguguaauuaauuc

SEQ ID NO: 474495 - RNA, 63 nt, hsa
cacuuccaaaaacaagggaacaaggugguuuauuguaaaaacaggaaauggugcaugucauug

SEQ ID NO: 474496 - RNA, 63 nt, hsa
gaugugccuguaaaccaaggaguuuuccccguuuguaaaaagacauuguagauaauugaaugu

SEQ ID NO: 474497 - RNA, 63 nt, hsa
accuggucaacuuagcuuuuaagcagacgaugcuguaaaaacuaacggcuucucugauauuua

SEQ ID NO: 474498 - RNA, 63 nt, hsa
uaaaaguugugcaugggcuuauacaauuucaaauguaaaaacagccuauuuauauauguugaa

SEQ ID NO: 474499 - RNA, 63 nt, hsa
caauguaaauagaacacuaauuaaaaaacaacuuguaaaaaugcaauuuaaauuuuaauacag

SEQ ID NO: 474500 - RNA, 63 nt, hsa
aaaauauuuuuuaauuuaauggucaguauauuuuguaaaaaucauguuaauuuauuucauagu

SEQ ID NO: 474501 - RNA, 63 nt, hsa
uucugagcagcauuuugguauuuaaacauuucuuguaaaaagcugagacaguuuguaagaaaa

SEQ ID NO: 474502 - RNA, 63 nt, hsa
uauauauccaaagauauaguguguacauuuuuuuguaaaaaguuuagaggcuuaccccuguaa

SEQ ID NO: 474503 - RNA, 63 nt, hsa
uagaggauguauuuauauaauuauuuguuaaauuguaaaaaaaaaaguguaaaauauguauau

SEQ ID NO: 474504 - RNA, 63 nt, hsa
caagacucccucucaaaagaaaaagaaaaaagauguaaaaaccauucuuaguuugugggccuu

SEQ ID NO: 474505 - RNA, 63 nt, hsa
gguauuuauaugaccuuuguaaccauuuaaaaauguaaaaacgaccugacuuaguaaugcgaa

SEQ ID NO: 474506 - RNA, 63 nt, hsa
uccuuaaaucucuuguauggcaaccaaaauuacuguaaaaaaauaaauauacuauugcacuaa

SEQ ID NO: 474507 - RNA, 63 nt, hsa
uggccugcugaggcugccccauauuuuagaaaauguaaaaauggugguuuggccauuaauuug

SEQ ID NO: 474508 - RNA, 63 nt, hsa
cccugugaaugccaaaguaaacuuuauguacaguguaaaaaaaaaaaaucucaguuauguuuu

SEQ ID NO: 474509 - RNA, 63 nt, hsa
aaaauuaaguucugaaaauugaaaaaauuaaaauguaaaaaaauuaaagaauaaaaauacuuc

SEQ ID NO: 474510 - RNA, 63 nt, hsa
uguaaaaaaaagucuuaacaacagcuucuugcuuguaaaaauauguauuauacaucuguauuu

SEQ ID NO: 474511 - RNA, 63 nt, hsa
cuuccuuccugccccaaaauuauaaacucuaaguguaaaaaaaagucuuaacaacagcuucuu

SEQ ID NO: 474512 - RNA, 63 nt, hsa
auuucuaagaauguuuuucuauaaauuacuaauuguaaaaagucuugcuuuuuaaaacaaguu

SEQ ID NO: 474513 - RNA, 63 nt, hsa
ucuccuugaggauagggauagguaagguaaacuuguaaaaaggaugucacagaagucacuuuu

SEQ ID NO: 474514 - RNA, 63 nt, hsa
uguaaagaggaugcugccuuaagaauugcauguuguaaaaaaucuuuuuggaaaauacagacu

SEQ ID NO: 474515 - RNA, 63 nt, hsa
uuauuuaucaaaauuaugugagguuccaaaauauguaaaaaugauaauaauaaaaaaagauua

SEQ ID NO: 474516 - RNA, 63 nt, hsa
ggacuuauugagguaaauuaaaagaacaaaaacuguaaaaaggaaguaguucagcaucuaucg

SEQ ID NO: 474517 - RNA, 63 nt, hsa
uuugucucagggaaaaucuucccccaccgagcuuguaaaaaacuuuaauaauuggguggagaa

SEQ ID NO: 474518 - RNA, 63 nt, hsa
uauacacaaaaaucagauuuaguaacuaaagguuguaaaaaauuguaaaacugguuguacaau

SEQ ID NO: 474519 - RNA, 63 nt, hsa
acaauagaugucucacacagaacaauacaaauauguaaaaaaucuuucaccacauauucuugc

SEQ ID NO: 474520 - RNA, 63 nt, hsa
cuugcugguuuauaccuauguucauuuauaugcuguaaaaaaguaguagcuucuucuacaaug

SEQ ID NO: 474521 - RNA, 63 nt, hsa
uaugcuguaaaaaaguaguagcuucuucuacaauguaaaaauaaauguacauacaaaaaaaug

SEQ ID NO: 474522 - RNA, 63 nt, hsa
gaagcucuaauuauugcagacauauuuuugagauguaaaaaaaaaaauuuaaaguuaaaugau

SEQ ID NO: 474523 - RNA, 63 nt, hsa
cauuuucauuaugccccaucacaucuucuuuacuguaaaaauauuaaaaagcuguuuccaagu

SEQ ID NO: 474524 - RNA, 63 nt, hsa
ugggaggaggcaaggucugcuaucaggaguuacuguaaaaacaagaacuggaagcucguguuu

SEQ ID NO: 474525 - RNA, 63 nt, hsa
cuuguugcuuggcuuuuaaagaugguguauguuuguaaaaauauucuucugggcucaaaagcu

SEQ ID NO: 474526 - RNA, 63 nt, hsa
cucgggcuuuaauuugcuaaagcugugcacauauguaaaaaaaaaaaaaaaaagauuauuuua

SEQ ID NO: 474527 - RNA, 63 nt, hsa
uaagaugauaaagcauuugaaugguacaguagauguaaaaaaaauucaguuuaaaagaacauu

SEQ ID NO: 474528 - RNA, 63 nt, hsa
uuuuucuccuauacuugggcuacauuuuuugauuguaaaaauauuugauggccuuuugaugaa

SEQ ID NO: 474529 - RNA, 63 nt, hsa
acaccuaugcaauauggcuuaucuauauuuauuuguaaaaauccaagcauaguuuaaaauaug

SEQ ID NO: 474530 - RNA, 63 nt, hsa
aaaaaaugaaaguuaugacauuagcuuuaaagguguaaaaaagauguuucacuaauguaacgg

SEQ ID NO: 474531 - RNA, 63 nt, hsa
uuaauaaaaauguuaauuuuggaagugcaguuuuguaaaaaccuuuuucagucaaacaguaaa

SEQ ID NO: 474532 - RNA, 63 nt, hsa
acgacagaguccauguuggaggugauaaaaaacuguaaaaaaaaaaaaaaaaaaaaagacaaa

SEQ ID NO: 474533 - RNA, 63 nt, hsa
aggggggugggaggggaagaaaaacucuauuuuuguaaaaagggaaaaagaccucguggagaa

SEQ ID NO: 474534 - RNA, 63 nt, hsa
gaaaggaugcacacugcaaagaaacaguaugaauguaaaaaaugugggaaaacauacauuacu

SEQ ID NO: 474535 - RNA, 63 nt, hsa
gaaaguacucacacuggagauaaacccuuugaguguaaaaaauguggaaaagcauuuagauac

SEQ ID NO: 474536 - RNA, 63 nt, hsa
gaaagaacucacacuggagaaaaacccuaugaauguaaaaaaugugggaaaguguucguauau

SEQ ID NO: 474537 - RNA, 63 nt, hsa
cagagaauucacacuagugagaaaccguaucaguguaaaaaauguagaaaauccuuuauugau

SEQ ID NO: 474538 - RNA, 63 nt, hsa
cacacuggugacaaacccuaugaauguaaagauuguaaaaaagcuuuucuuuguuauucaaca

SEQ ID NO: 474539 - RNA, 63 nt, hsa
aauguuguaaauauuuggcaauuuaagacauuguguaaaaagcaaucuguaaaaacaucucca

SEQ ID NO: 474540 - RNA, 63 nt, hsa
uuggcaauuuaagacauuguguaaaaagcaaucuguaaaaacaucuccaggcuuugauuuuug

SEQ ID NO: 474541 - RNA, 63 nt, hsa
guuuacucuaccaauguuaugucgaaacugcauuguaaaaagagaagaaaguggcagguuuuc

SEQ ID NO: 474542 - RNA, 63 nt, hsa
uguuuuuaaaaauuauauuccaguuuuaaucauuguaaaaaaagcaccuggaguuucaaaaca

SEQ ID NO: 474543 - RNA, 63 nt, hsa
gguaggucuucagcauaagcugaaauauaugcauguaaaaacuuugacaucuuuuuuuuuaau

SEQ ID NO: 474544 - RNA, 63 nt, hsa
aauuuacuaaccaguuuuuauauugaccugcaguguaaaaagcacauuuaauuauaaacaaua

SEQ ID NO: 474545 - RNA, 63 nt, hsa
cccaccaaaaugauccagucuggaauaacauuuuguaaaaaaaaaaaaaauauauauauauau

SEQ ID NO: 474546 - RNA, 63 nt, hsa
cagaauugucaaccaauuucuuuaauugaacauuguaaaaaacaggaauaaguacuuuugugu

SEQ ID NO: 474547 - RNA, 63 nt, hsa
uaaugcacaguaaauaugugaauuuuuccuagauguaaaaaaaaaaaucuuucauauaaagac

SEQ ID NO: 474548 - RNA, 63 nt, hsa
uaucacuaguguggcuaaauaaccaaacauuuguguaaaaaaaaaaaaaagccaagauuucau

SEQ ID NO: 474549 - RNA, 63 nt, hsa
gauauauauauaaauuuuaauuucauagcaacuuguaaaaaauaaaauacuuguugaaaagcc

SEQ ID NO: 474550 - RNA, 63 nt, hsa
uauaaaaacauugcuuuuguugaauuguauagguguaaaaagggaauaacuguaugcagguuu

SEQ ID NO: 474551 - RNA, 63 nt, hsa
acuguaaagcuacuuguguucucuucauuugucuguaaaaauuucccuaauugauuauauagu

SEQ ID NO: 474552 - RNA, 64 nt, hsa
aucuacuugaccaagcaaaggggcugaaaaacugaauaaggaaacaacuuuauaagagaaacag

SEQ ID NO: 474553 - RNA, 64 nt, hsa
uucauuuugaggaacuccaaagucaauucaaggaaauaaggaaugaccuggaacaggccuuaga

SEQ ID NO: 474554 - RNA, 64 nt, hsa
agaacuugcccacaugauaacucauguuugcuuuaauaaggaaaauauguuauuugagguuaau

SEQ ID NO: 474555 - RNA, 64 nt, hsa
caccuguuuacaaaaagaaucaaauaccacuaugaauaaggauucagggguuuuuaaucuacuu

SEQ ID NO: 474556 - RNA, 64 nt, hsa
acuccagagauuuuagaaauuugaguaaagaaacaauaaggaccuauacaaucauaugagaaca

SEQ ID NO: 474557 - RNA, 64 nt, hsa
acaaacaagcaccuaccauagaccuggcagaauaaauaaggaaauccuuaaagaucuacaaguu

SEQ ID NO: 474558 - RNA, 64 nt, hsa
ugacuuucugacuaaugcugccacccacacagagaauaaggaguagggccugcuggguguuuag

SEQ ID NO: 474559 - RNA, 64 nt, hsa
agauugcaaagcaaugaacucaagaaggaauugaaauaaggagggacaugauggggaaggagua

SEQ ID NO: 474560 - RNA, 64 nt, hsa
cuuaaacagaagcagcaaaugaaagaaccggacaaauaaggaagggcacaagccuacccgacuc

SEQ ID NO: 474561 - RNA, 64 nt, hsa
acacaaacuucacaguaaggagugacaaguuuauaauaaggaagacaaaguuuaacaccuucac

SEQ ID NO: 474562 - RNA, 64 nt, hsa
ucuuuaaauguauugaagcauugugcugucugaaaauaaggaauugcuuauaaaccagccacuu

SEQ ID NO: 474563 - RNA, 64 nt, hsa
uuugaacauccccacuagguucuuuuccauugucaauaaggagcaucagccagugaaucuguuu

SEQ ID NO: 474564 - RNA, 64 nt, hsa
cagaucaagaguuuuggagaucagguaccaaggaaauaaggacagucuagcugccucaagugag

SEQ ID NO: 474565 - RNA, 64 nt, hsa
aucaauaacuaaugcuauguacuuggaaaauccaaauaaggaaguuuuagguuggugcauaacu

SEQ ID NO: 474566 - RNA, 64 nt, hsa
gucuggauuaucuuccuuuucucauggccuaagaaauaaggaucaauaaggaaugauuugaaug

SEQ ID NO: 474567 - RNA, 64 nt, hsa
ucuuccuuuucucauggccuaagaaauaaggaucaauaaggaaugauuugaauguaauuuugug

SEQ ID NO: 474568 - RNA, 64 nt, hsa
acauuauggagagcucugauuccuacauaauaugaauaaggauggauaggccgggcgugguggc

SEQ ID NO: 474569 - RNA, 64 nt, hsa
uggguaacagagcgagaccccgacucaauaaauaaauaaggauggauaaauuguagcguaugca

SEQ ID NO: 474570 - RNA, 64 nt, hsa
cuuuauauuuauccacuacuccgugaaggcuucucuguucuacccguuccaaaagccaauggcu

SEQ ID NO: 474571 - RNA, 64 nt, hsa
ccuucuggcagauucaaaucguuuauuucacacgcuguucuaauggcacuuaucauuagaaucu

SEQ ID NO: 474572 - RNA, 64 nt, hsa
caacauggcaaagcaaaugguaaaagcuucccgacuguucuacuuuggguccgcgcgaagccca

SEQ ID NO: 474573 - RNA, 64 nt, hsa
gauaaccucgaugauguaaauccacccaaagauacuguucuacaaaaaguaggguguggacgca

SEQ ID NO: 474574 - RNA, 64 nt, hsa
aaagaagacugacuagaugcaucuuucuuugaagcuguucuaguccuccucuaguuaacuuagc

SEQ ID NO: 474575 - RNA, 64 nt, hsa
gaaaaaugagaaauucuaccuuuaccagggauaucuguucuacuguuuuaaaaguuccucucua

SEQ ID NO: 474576 - RNA, 64 nt, hsa
agaggaguacaggguccugugagcuguuugaccacuguucuaagacuaugugugcccaaaagca

SEQ ID NO: 474577 - RNA, 64 nt, hsa
uuuugaagucuuucuuuguacuuuaauguucucucuguucuaauaguugaaguaugagauguaa

SEQ ID NO: 474578 - RNA, 64 nt, hsa
auuaaagggaucauuaucaguaauuucauagcaacuguucuaguguuuuguguuuuuaaaacag

SEQ ID NO: 474579 - RNA, 64 nt, hsa
uggcucacugcaaucucugccucucggguucaagcuguucuacugccucagccuccugaguagc

SEQ ID NO: 474580 - RNA, 64 nt, hsa
guaucuguuugugaguugauccuggcuucucucucuguucuaguuuuggcugaaaacaaaacaa

SEQ ID NO: 474581 - RNA, 64 nt, hsa
aggaguuuguuacauuuaaucaacacugugaagucuguucuacagcaauucagccauuacacag

SEQ ID NO: 474582 - RNA, 64 nt, hsa
ccuccuggaccugaaggcaucugagugugagacccuguucuaacucuuagaagugacauuguaa

SEQ ID NO: 474583 - RNA, 64 nt, hsa
ccuccaaacacugggcucugaggaguggaguucucuguucuagagugacaggcaccagauggga

SEQ ID NO: 474584 - RNA, 64 nt, hsa
cacguguauuguccgggcucagaaugggaggacuccagaagaugagagaaaccucuuuauccaa

SEQ ID NO: 474585 - RNA, 64 nt, hsa
ucaccacgugcaguaucucaagauauucagguggccagaagagcuugucagcaagaggaggaca

SEQ ID NO: 474586 - RNA, 64 nt, hsa
ugcugggauuacaggcauaagccacugcgcccagccagaagaugcaugauuucuuaggaucaua

SEQ ID NO: 474587 - RNA, 64 nt, hsa
uauuagauuucugacuugcaaauauguuuguacuccagaagaauuagaggaaaagcagauacua

SEQ ID NO: 474588 - RNA, 64 nt, hsa
uuugccaucauuuuuuuaauuaaagaaaaaauuuccagaagaggaaaaaaaaacuacaaaaaac

SEQ ID NO: 474589 - RNA, 64 nt, hsa
uuauaccaaagaugaagugacacccuauuacaguccagaagauagagguuguuuucguuucuuu

SEQ ID NO: 474590 - RNA, 64 nt, hsa
uccagaaacuuccagaccagcccucucaccacacccagaagaggccuuucccaucuggagagaa

SEQ ID NO: 474591 - RNA, 64 nt, hsa
gagagaaacuuccagaccagcccucucacuacagccagaagaggccuuucccaccgggagagga

SEQ ID NO: 474592 - RNA, 64 nt, hsa
accauucuuaguggcacuggggaaaucuuggcacccagaagaauucaacugcgcucacugcaaa

SEQ ID NO: 474593 - RNA, 64 nt, hsa
caguuaauccugugaaauaaauauugaacauaauccagaagaaucucucuguuucccuugggga

SEQ ID NO: 474594 - RNA, 64 nt, hsa
gucuacccagcccuuguuagauucagaggagcggccagaagaucuacaauuaguagaucaugua

SEQ ID NO: 474595 - RNA, 64 nt, hsa
uguggaaauagaagcaaaugacaaaaagccuuuuccagaagaucugaaaucauuggaccuguuc

SEQ ID NO: 474596 - RNA, 64 nt, hsa
ugcacucaaguuuggccaagggacuccacagcacccagaagacugcaugccucaagguuuaugu

SEQ ID NO: 474597 - RNA, 64 nt, hsa
augcauguuuagugagcacuaauacaaucuuauuccagaagacuguuuuuaguagcuuauugug

SEQ ID NO: 474598 - RNA, 64 nt, hsa
acuuccuucuuucauccuuuccaauuuuucuauuccagaagacagucagaauaaugcauucugu

SEQ ID NO: 474599 - RNA, 64 nt, hsa
ugucucuucaguggaagauauucuuuccuguuucccagaagagagaaauaaaaguccuaaauaa

SEQ ID NO: 474600 - RNA, 64 nt, hsa
aaggggacccacaaacaagagugcucuuguauguccagaagaaagagaaagaccaucaaucagg

SEQ ID NO: 474601 - RNA, 64 nt, hsa
gggggucaggggaaggcaugggggggaccagaaaccagaagaacaaucaagacugcaaugaaaa

SEQ ID NO: 474602 - RNA, 64 nt, hsa
auggggaccugucugcauauacacacggggaaugccagaagaaggcccagucugcaccaggcgu

SEQ ID NO: 474603 - RNA, 64 nt, hsa
aaacaacccauaguaucucauucugucaucagauccagaagaaauauccugguuuuccagcaug

SEQ ID NO: 474604 - RNA, 64 nt, hsa
ucugaauaccaaaaacagggcuucacagccaggcccagaagaggucuggugauaauggcuggcc

SEQ ID NO: 474605 - RNA, 64 nt, hsa
acaaacuauuuugauggacugugcugcaguaucaccagaagacauuagggggcaguaggccccc

SEQ ID NO: 474606 - RNA, 64 nt, hsa
gcugauauccucggcgaacaugucucuccugaguccagaagaccagcacccucaaccugguagc

SEQ ID NO: 474607 - RNA, 64 nt, hsa
gcuuccugugcccucucaagccaguucuucucuuccagaagaauucagaguaugugucucagaa

SEQ ID NO: 474608 - RNA, 64 nt, hsa
uuauucgcuccaagaaagaugcuaagucugagcuccagaagagacugugcuggguguggcuugg

SEQ ID NO: 474609 - RNA, 64 nt, hsa
uauagggcauuguucuggugggugugucacgcucccagaagacugaauucaugguaggaucacu

SEQ ID NO: 474610 - RNA, 64 nt, hsa
auguguguggggggcgugccucucagaaacgcggccagaagacaagcagggaagugaaaggucc

SEQ ID NO: 474611 - RNA, 64 nt, hsa
uaauugccagcugucuacacaaagaauaugcaggccagaagaaaaguugcuuuucaaagaggaa

SEQ ID NO: 474612 - RNA, 64 nt, hsa
aauuuccccccaaaguagagaugcuaagccaaauccagaagaacccauagaugaagaugaagau

SEQ ID NO: 474613 - RNA, 64 nt, hsa
gggucucuuucuguagaguuggagaggaaaugaaccagaagaguggaucccucggacauaccaa

SEQ ID NO: 474614 - RNA, 64 nt, hsa
uccuauccaaagcggccuacagucuccugggcucccagaagaguggcaagcugccauccuccuc

SEQ ID NO: 474615 - RNA, 64 nt, hsa; identical to SEQ ID NO: 179148

SEQ ID NO: 474616 - RNA, 64 nt, hsa; identical to SEQ ID NO: 179149

SEQ ID NO: 474617 - RNA, 64 nt, hsa; identical to SEQ ID NO: 179150

SEQ ID NO: 474618 - RNA, 64 nt, hsa; identical to SEQ ID NO: 179151

SEQ ID NO: 474619 - RNA, 64 nt, hsa; identical to SEQ ID NO: 179152

SEQ ID NO: 474620 - RNA, 64 nt, hsa; identical to SEQ ID NO: 179153

SEQ ID NO: 474621 - RNA, 64 nt, hsa; identical to SEQ ID NO: 153912

SEQ ID NO: 474622 - RNA, 64 nt, hsa; identical to SEQ ID NO: 153913

SEQ ID NO: 474623 - RNA, 64 nt, hsa; identical to SEQ ID NO: 153914

SEQ ID NO: 474624 - RNA, 64 nt, hsa; identical to SEQ ID NO: 153915

SEQ ID NO: 474625 - RNA, 64 nt, hsa; identical to SEQ ID NO: 153916

SEQ ID NO: 474626 - RNA, 64 nt, hsa; identical to SEQ ID NO: 153917

SEQ ID NO: 474627 - RNA, 64 nt, hsa; identical to SEQ ID NO: 153918

SEQ ID NO: 474628 - RNA, 64 nt, hsa; identical to SEQ ID NO: 153919

SEQ ID NO: 474629 - RNA, 64 nt, hsa; identical to SEQ ID NO: 153920

SEQ ID NO: 474630 - RNA, 64 nt, hsa; identical to SEQ ID NO: 153921

SEQ ID NO: 474631 - RNA, 64 nt, hsa; identical to SEQ ID NO: 153922

SEQ ID NO: 474632 - RNA, 64 nt, hsa; identical to SEQ ID NO: 153923

SEQ ID NO: 474633 - RNA, 64 nt, hsa; identical to SEQ ID NO: 153924

SEQ ID NO: 474634 - RNA, 64 nt, hsa; identical to SEQ ID NO: 153925

SEQ ID NO: 474635 - RNA, 64 nt, hsa; identical to SEQ ID NO: 153926

SEQ ID NO: 474636 - RNA, 64 nt, hsa; identical to SEQ ID NO: 153927

SEQ ID NO: 474637 - RNA, 64 nt, hsa; identical to SEQ ID NO: 153928

SEQ ID NO: 474638 - RNA, 64 nt, hsa; identical to SEQ ID NO: 153929

SEQ ID NO: 474639 - RNA, 64 nt, hsa; identical to SEQ ID NO: 153930

SEQ ID NO: 474640 - RNA, 64 nt, hsa; identical to SEQ ID NO: 153931

SEQ ID NO: 474641 - RNA, 64 nt, hsa; identical to SEQ ID NO: 153932

SEQ ID NO: 474642 - RNA, 64 nt, hsa; identical to SEQ ID NO: 153933

SEQ ID NO: 474643 - RNA, 64 nt, hsa
auaccaguaucaucagugaagaauuguauuucaagauucaaacaauaaccagcaauuaaacuuu

SEQ ID NO: 474644 - RNA, 64 nt, hsa
cacagauuuguuuauguguucagauuuuaauagagauucaaaaaugacucauuuuuaccaauaa

SEQ ID NO: 474645 - RNA, 64 nt, hsa
uacacucagagccuggucgccccccguuagcccagauucaaaaggugaacaucuguuugcagaa

SEQ ID NO: 474646 - RNA, 64 nt, hsa
uccacugaacaaggcuaguuccugcaccacccaggauucaaaggaaagacgaagggagcagaac

SEQ ID NO: 474647 - RNA, 64 nt, hsa
aauuaaagaggauccaccccaggguuauuuugaggauucaaaaaggcaugcaacacaccuggag

SEQ ID NO: 474648 - RNA, 64 nt, hsa
aaauggcuuuuauaaacaucuuuuacuuuguuuugauucaaagaccaaacuagaacuuuaaaag

SEQ ID NO: 474649 - RNA, 64 nt, hsa
uagauaauagcagccuaguucuuuaggauuugacgauucaaauuuuuuuuuuguuuuuuguuuu

SEQ ID NO: 474650 - RNA, 64 nt, hsa
aauuguuggauuuaaagaggcaacuuuuguuuaugauucaaauaugggaauuugagaaauauuu

SEQ ID NO: 474651 - RNA, 64 nt, hsa
ggaagggaaacauuuggguugaugaggcagaggggauucaaaugugugagaggcuagauucaaa

SEQ ID NO: 474652 - RNA, 64 nt, hsa
ugaggcagaggggauucaaaugugugagaggcuagauucaaagacccucaguguucuauguuau

SEQ ID NO: 474653 - RNA, 64 nt, hsa
uuuuaaaguaauaagggucaaagacuacaucagagauucaaauagguuuuuaaagaaaagcuaa

SEQ ID NO: 474654 - RNA, 64 nt, hsa
aggaagugaauaagaagaugacagugauucaaaugauucaaaugccaugacauuggaagaaggu

SEQ ID NO: 474655 - RNA, 64 nt, hsa
guuuguuucaggaagugaauaagaagaugacagugauucaaaugauucaaaugccaugacauug

SEQ ID NO: 474656 - RNA, 64 nt, hsa
aggaagugaauaagaagaugagagugauucaaaugauucaaauuccaugacauuggaaaaaggu

SEQ ID NO: 474657 - RNA, 64 nt, hsa
guuuguuucaggaagugaauaagaagaugagagugauucaaaugauucaaauuccaugacauug

SEQ ID NO: 474658 - RNA, 64 nt, hsa; identical to SEQ ID NO: 60066

SEQ ID NO: 474659 - RNA, 64 nt, hsa; identical to SEQ ID NO: 60067

SEQ ID NO: 474660 - RNA, 64 nt, hsa; identical to SEQ ID NO: 60068

SEQ ID NO: 474661 - RNA, 64 nt, hsa; identical to SEQ ID NO: 60069

SEQ ID NO: 474662 - RNA, 64 nt, hsa; identical to SEQ ID NO: 60070

SEQ ID NO: 474663 - RNA, 64 nt, hsa; identical to SEQ ID NO: 60071

SEQ ID NO: 474664 - RNA, 64 nt, hsa; identical to SEQ ID NO: 60072

SEQ ID NO: 474665 - RNA, 64 nt, hsa; identical to SEQ ID NO: 60073

SEQ ID NO: 474666 - RNA, 64 nt, hsa; identical to SEQ ID NO: 60074

SEQ ID NO: 474667 - RNA, 64 nt, hsa; identical to SEQ ID NO: 60075

SEQ ID NO: 474668 - RNA, 64 nt, hsa; identical to SEQ ID NO: 60076

SEQ ID NO: 474669 - RNA, 64 nt, hsa; identical to SEQ ID NO: 89720

SEQ ID NO: 474670 - RNA, 64 nt, hsa; identical to SEQ ID NO: 89721

SEQ ID NO: 474671 - RNA, 64 nt, hsa; identical to SEQ ID NO: 89722

SEQ ID NO: 474672 - RNA, 64 nt, hsa; identical to SEQ ID NO: 89723

SEQ ID NO: 474673 - RNA, 64 nt, hsa; identical to SEQ ID NO: 89724

SEQ ID NO: 474674 - RNA, 64 nt, hsa; identical to SEQ ID NO: 89725

SEQ ID NO: 474675 - RNA, 64 nt, hsa; identical to SEQ ID NO: 89726

SEQ ID NO: 474676 - RNA, 64 nt, hsa; identical to SEQ ID NO: 89727

SEQ ID NO: 474677 - RNA, 64 nt, hsa; identical to SEQ ID NO: 89728

SEQ ID NO: 474678 - RNA, 64 nt, hsa; identical to SEQ ID NO: 89729

SEQ ID NO: 474679 - RNA, 64 nt, hsa; identical to SEQ ID NO: 89730

SEQ ID NO: 474680 - RNA, 64 nt, hsa; identical to SEQ ID NO: 89731

SEQ ID NO: 474681 - RNA, 64 nt, hsa; identical to SEQ ID NO: 424201

SEQ ID NO: 474682 - RNA, 64 nt, hsa; identical to SEQ ID NO: 424202

SEQ ID NO: 474683 - RNA, 64 nt, hsa; identical to SEQ ID NO: 424203

SEQ ID NO: 474684 - RNA, 61 nt, hsa; identical to SEQ ID NO: 424204

SEQ ID NO: 474685 - RNA, 64 nt, hsa; identical to SEQ ID NO: 424205

SEQ ID NO: 474686 - RNA, 64 nt, hsa; identical to SEQ ID NO: 424206

SEQ ID NO: 474687 - RNA, 64 nt, hsa; identical to SEQ ID NO: 424207

SEQ ID NO: 474688 - RNA, 64 nt, hsa; identical to SEQ ID NO: 424208

SEQ ID NO: 474689 - RNA, 64 nt, hsa; identical to SEQ ID NO: 424209

SEQ ID NO: 474690 - RNA, 64 nt, hsa; identical to SEQ ID NO: 424210

SEQ ID NO: 474691 - RNA, 64 nt, hsa; identical to SEQ ID NO: 424211

SEQ ID NO: 474692 - RNA, 64 nt, hsa; identical to SEQ ID NO: 424212

SEQ ID NO: 474693 - RNA, 64 nt, hsa; identical to SEQ ID NO: 424213

SEQ ID NO: 474694 - RNA, 64 nt, hsa; identical to SEQ ID NO: 424214

SEQ ID NO: 474695 - RNA, 64 nt, hsa
gggcugggcuugggaaggggagguggaggccagguguccccagaccucuaacccuugccccuag

SEQ ID NO: 474696 - RNA, 64 nt, hsa
gcacacaguuggugcgugauaugguuaagcuuuguguccccacccacaucucaucuugaauggu

SEQ ID NO: 474697 - RNA, 64 nt, hsa
uggcaccaucuuggaucugagccggucgagccccuguccccacccuuccugaccuguccuuuuc

SEQ ID NO: 474698 - RNA, 64 nt, hsa
uucaggucuccccccagcugucucacccccacuuuguccccacucuagagcagggaggcagugg

SEQ ID NO: 474699 - RNA, 64 nt, hsa
cuggccauaccccggacugcccuccugugccugauguccccagcuggggucagucucaacagga

SEQ ID NO: 474700 - RNA, 64 nt, hsa
agcucagccaggcucccuguguccugggaggaaguguccccaucccccaugccccuuaugggga

SEQ ID NO: 474701 - RNA, 64 nt, hsa
gcugcccugucacuccucuaacacuucccuccccuguccccaacaugcccuguaauaaaauuag

SEQ ID NO: 474702 - RNA, 64 nt, hsa
ucagcagugugcauagaccauuuccaggagggucuguccccagaugcucugccucccguuccaa

SEQ ID NO: 474703 - RNA, 64 nt, hsa
uggcaugcuucugcugggugagcaggacagcuccuguccccagcgaagaauccggcugccccug

SEQ ID NO: 474704 - RNA, 64 nt, hsa
agcuuguaagauggugcagcaugcagaccagacuuguccccaaggucucagcgcugcggucuca

SEQ ID NO: 474705 - RNA, 64 nt, hsa
aguugacuuguuuugcacacuuuucuuuacuucauguccccaucaacaaccguccugcucccca

SEQ ID NO: 474706 - RNA, 64 nt, hsa
ugucucaaagcgguacccauccucccccagaagcuguccccagcgagccucccuucuuuguuug

SEQ ID NO: 474707 - RNA, 64 nt, hsa
ccauaaggccagccaguucuagcucucuauuaccuguccccacucaacugacucauaccuguuu

SEQ ID NO: 474708 - RNA, 64 nt, hsa
cucaggaagaagauagucacauguuuuucuuccuuguccccacggcccccagaacaacauucuc

SEQ ID NO: 474709 - RNA, 64 nt, hsa
cccgcccugguggggcucggcgaguaauguguuuuguccccaguuaaccaccauucugcggccu

SEQ ID NO: 474710 - RNA, 64 nt, hsa
guugcuauuuaaaaaucagggagaggagggcacauguccccauuugcuacauuacaaacuuugg

SEQ ID NO: 474711 - RNA, 64 nt, hsa
caccuucccuucugacucagguuggcagauaaacuguccccagacccugccacacauggaagag

SEQ ID NO: 474712 - RNA, 64 nt, hsa
gcaucagccacugugucuuucauuuauucugaauuguccccagcgugcguuuucuuccauguag

SEQ ID NO: 474713 - RNA, 64 nt, hsa
ggauaccaguucagucuccacauuucugguuuucuguccccauaguacaguucuucaguggaca

SEQ ID NO: 474714 - RNA, 64 nt, hsa
ugggugaacccuggcucugagcucuccucccaucuguccccaucuuccuccccacaccuaccca

SEQ ID NO: 474715 - RNA, 64 nt, hsa
gaccaggggccccgaggccugagggccccuccccuguccccaccucagugccugcggggcccug

SEQ ID NO: 474716 - RNA, 64 nt, hsa
gcccagccagcacucugcagggucacacgcaccguguccccacccaggacagcagacacccgcc

SEQ ID NO: 474717 - RNA, 64 nt, hsa
gcccugagcagcuucacuuccccugcgccuuuuauguccccaccuugaggccuugcagaggcgc

SEQ ID NO: 474718 - RNA, 64 nt, hsa
aacacuaaauguggaccaguaucaagaacccuccuguccccacgcaguguaaacccaguggcuu

SEQ ID NO: 474719 - RNA, 64 nt, hsa
agaugcugccacccucuucugacccugcugcuguuguccccauccgccuucaccccucugcucu

SEQ ID NO: 474720 - RNA, 64 nt, hsa
ggcugugggugagccaggccaacauuggugucccuguccccagagggaggagcaggcaggagag

SEQ ID NO: 474721 - RNA, 64 nt, hsa
gcuggcuggaaccagaggccagaaagccuggccuuguccccaugugggagcccuguccucagcc

SEQ ID NO: 474722 - RNA, 64 nt, hsa
gagaugccuguggcugagggggccucucuaccuguguccccacucacuccaggagcacuggcuu

SEQ ID NO: 474723 - RNA, 64 nt, hsa
aaggccaagaagugaaggccggcggggaggauacuguccccaggagcacccucccugcccgucu

SEQ ID NO: 474724 - RNA, 64 nt, hsa
ccaugaccagugaggagaagcaacagagccugucuguccccaugagcggagucuguccucugcu

SEQ ID NO: 474725 - RNA, 64 nt, hsa
acccagacucgggcaaccucaccguggccaggaguguccccagccccaugaccuuccuucugcu

SEQ ID NO: 474726 - RNA, 64 nt, hsa
gcuacgucugcauucaagcucaguaccacggggcuguccccacggggcacauacugguaauggg

SEQ ID NO: 474727 - RNA, 64 nt, hsa
agccacccaaccuaaauguacuuaucuguccccauguccccacaccagccuguuuucauaauaa

SEQ ID NO: 474728 - RNA, 64 nt, hsa
uucaccugagccacccaaccuaaauguacuuaucuguccccauguccccacaccagccuguuuu

SEQ ID NO: 474729 - RNA, 64 nt, hsa
cucuuugcccugaggcucagucucucucguauuuuguccccacccccaauuccuugagugguuu

SEQ ID NO: 474730 - RNA, 64 nt, hsa
cucaaaucacugcauucauucugagcccccuuccuguccccaggggagguguauuguguaugua

SEQ ID NO: 474731 - RNA, 64 nt, hsa
aagacuuguuuuccagacagaaaaucuacuccccuguccccagccauaucccuggauaggaagg

SEQ ID NO: 474732 - RNA, 64 nt, hsa
auguuuccaugugccaaaucuuagucccaugaucuguccccaaaggggaacaaagggaccucug

SEQ ID NO: 474733 - RNA, 64 nt, hsa
auccugccuaggcuggacuuaaccccuuccucccuguccccacgaccaacuguccccaguuacu

SEQ ID NO: 474734 - RNA, 64 nt, hsa
acuuaaccccuuccucccuguccccacgaccaacuguccccaguuacucuaaccguuauuucau

SEQ ID NO: 474735 - RNA, 64 nt, hsa
aggccccccaccagaagccaucucccccgcuguguguccccaggcgcaucauugcuccacucuc

SEQ ID NO: 474736 - RNA, 64 nt, hsa
uccagaguauguagagagccaaaauguguggcccuguccccaagcucagcaccaccggccauga

SEQ ID NO: 474737 - RNA, 64 nt, hsa
ggagcuccugucccugucagccuuugcuguccccuguccccaacggagacucugucaccccugg

SEQ ID NO: 474738 - RNA, 64 nt, hsa
ccacaugugaccacugcaacgaagacacuccuucuguccccaccugcuccgaagacaaaccaac

SEQ ID NO: 474739 - RNA, 64 nt, hsa
ccacgcccgagaaagccugggggacccagacaccuguccccacagucaaagccuggggacccag

SEQ ID NO: 474740 - RNA, 64 nt, hsa
uccccacagucaaagccuggggacccagacauccuguccccacagucagccuccugucccugcu

SEQ ID NO: 474741 - RNA, 64 nt, hsa
guccguggcuguccaccucccagccauacuugacuguccccaaacucucccugcagccacaugu

SEQ ID NO: 474742 - RNA, 64 nt, hsa
uuuaaugaagagcccggucacuguggccaucuuguguccccaacugcaggagacgcccugaugu

SEQ ID NO: 474743 - RNA, 64 nt, hsa
agcuaaaucaaggaccucagccuuauauaaucauuguccccaccacuaccauggacuggacacc

SEQ ID NO: 474744 - RNA, 64 nt, hsa
cucuggagagagagccauuggcuggaguugagacuguccccagaacccuuggucuugccacucc

SEQ ID NO: 474745 - RNA, 64 nt, hsa
gggugagagcacccacugaauugacaugacccucuguccccaggccuggcuccccgagggcuca

SEQ ID NO: 474746 - RNA, 64 nt, hsa
guuucguggcagcacggcccggccccucacccucuguccccacgaggggacccaugggggcugu

SEQ ID NO: 474747 - RNA, 64 nt, hsa
aggcgcuggggcuccuacgggucccuggggcagcuguccccaucaggccaagagcgagcgagag

SEQ ID NO: 474748 - RNA, 64 nt, hsa
gcacacacaugcaggcggcguggucucccugcucuguccccacacguuccucacauacaggcaa

SEQ ID NO: 474749 - RNA, 64 nt, hsa
guaaaaacccagcggcuuagccaagcccuaagccuguccccagaccaacccugggaccuauaca

SEQ ID NO: 474750 - RNA, 64 nt, hsa
cugggucuggaugggaggagagccacugggccccuguccccaguccccaguccccagcccuggg

SEQ ID NO: 474751 - RNA, 64 nt, hsa
ccccucuagugcuguccugguacccgucccagccuguccccauucucauggcccuuuggucacu

SEQ ID NO: 474752 - RNA, 64 nt, hsa
agcucccaucagccucauuccguggcaggugauguguccccauugguuaggugaggagggugag

SEQ ID NO: 474753 - RNA, 64 nt, hsa
ugcacugggcaagcuagaaguguugggggguuaauguccccaggagcagcaacccugagucaau

SEQ ID NO: 474754 - RNA, 64 nt, hsa
uccgggguuagcagaugccagcagugccugcccguguccccaugucccggcaugaaggacacug

SEQ ID NO: 474755 - RNA, 64 nt, hsa
gcuggggucccagcagcugccaggagcacggcucuguccccagccugggaaagccccugccccu

SEQ ID NO: 474756 - RNA, 64 nt, hsa
gacaacgugcucuuuguuuugugucucuuauggauguccccagcagagagguuugcagucccaa

SEQ ID NO: 474757 - RNA, 64 nt, hsa
gcaccaggaggggccagguggcgucggcagcaucuguccccagaaucaggcagaauccacuucc

SEQ ID NO: 474758 - RNA, 64 nt, hsa
uuggugacaagguccugagaacacaguggccagguguccccaggcuccuggccccuccgacgac

SEQ ID NO: 474759 - RNA, 64 nt, hsa
acuuggaugucaccacugucagccccugccuugauguccccauuuagccaucuccauggagcuc

SEQ ID NO: 474760 - RNA, 64 nt, hsa
uugaauauaccccaccuggugguggccccuccgauguccccacugauggcucugacaccguguu

SEQ ID NO: 474761 - RNA, 64 nt, hsa
agcaucuggcugggaugugaagggcagcacucccuguccccaugucccgggcuccacugggcac

SEQ ID NO: 474762 - RNA, 64 nt, hsa
uauggagcuugcaguccagugagguggacagaccuguccccagacagugauggcccaaaauggu

SEQ ID NO: 474763 - RNA, 64 nt, hsa
uaguccuccaccgucccgaagccaacuucacccauguccccauccccaaucuuguccccauucc

SEQ ID NO: 474764 - RNA, 64 nt, hsa
aagccaacuucacccauguccccauccccaaucuuguccccauuccugacuccaaauccaaccc

SEQ ID NO: 474765 - RNA, 64 nt, hsa
cugugaccuccuguccccaugguacgucccacccuguccccagauccccuauucccuccacaau

SEQ ID NO: 474766 - RNA, 64 nt, hsa
guguguguguguguguguguguucugugaccuccuguccccaugguacgucccacccugucccc

SEQ ID NO: 474767 - RNA, 64 nt, hsa
aggguuacuccucaaaacccccaguucucacucauguccccaacucaaggcuagaaaacagcaa

SEQ ID NO: 474768 - RNA, 64 nt, hsa
ccaggggccaggcaggcugucugucugcuucacauguccccaucagccugcugggacacacggg

SEQ ID NO: 474769 - RNA, 64 nt, hsa
gagcaggggaguggcuucccaaggucucacagcuuguccccaggggccaggcaggcugucuguc

SEQ ID NO: 474770 - RNA, 64 nt, hsa
auugcagggaccagagaagaccaaagaugccagauguccccagaguuucuugagggcuggguuu

SEQ ID NO: 474771 - RNA, 64 nt, hsa
gagggcuggguuucacgucuuugcuuguccuuuuuguccccacuugccugcaccgugccugacu

SEQ ID NO: 474772 - RNA, 64 nt, hsa
ggcacauacacgugucugcaggccacaccgugcauguccccagaccugccgccuggcuucugga

SEQ ID NO: 474773 - RNA, 64 nt, hsa
uugagcauccugaaggagccacugcagccgucacuguccccagagccuguggagauagagccug

SEQ ID NO: 474774 - RNA, 64 nt, hsa
ucuggcaucaucucagguucccuguccccagcacuguccccauggagcugguggcugacaaaga

SEQ ID NO: 474775 - RNA, 64 nt, hsa
cucaggcugaaaucuggcaucaucucagguucccuguccccagcacuguccccauggagcuggu

SEQ ID NO: 474776 - RNA, 64 nt, hsa; identical to SEQ ID NO: 47288

SEQ ID NO: 474777 - RNA, 64 nt, hsa; identical to SEQ ID NO: 47289

SEQ ID NO: 474778 - RNA, 64 nt, hsa; identical to SEQ ID NO: 47290

SEQ ID NO: 474779 - RNA, 64 nt, hsa; identical to SEQ ID NO: 47291

SEQ ID NO: 474780 - RNA, 64 nt, hsa; identical to SEQ ID NO: 47292

SEQ ID NO: 474781 - RNA, 64 nt, hsa; identical to SEQ ID NO: 47293

SEQ ID NO: 474782 - RNA, 64 nt, hsa; identical to SEQ ID NO: 47294

SEQ ID NO: 474783 - RNA, 64 nt, hsa; identical to SEQ ID NO: 47295

SEQ ID NO: 474784 - RNA, 64 nt, hsa; identical to SEQ ID NO: 47296

SEQ ID NO: 474785 - RNA, 64 nt, hsa; identical to SEQ ID NO: 47297

SEQ ID NO: 474786 - RNA, 64 nt, hsa; identical to SEQ ID NO: 47298

SEQ ID NO: 474787 - RNA, 64 nt, hsa; identical to SEQ ID NO: 47299

SEQ ID NO: 474788 - RNA, 64 nt, hsa; identical to SEQ ID NO: 47300

SEQ ID NO: 474789 - RNA, 64 nt, hsa; identical to SEQ ID NO: 47301

SEQ ID NO: 474790 - RNA, 64 nt, hsa; identical to SEQ ID NO: 47302

SEQ ID NO: 474791 - RNA, 64 nt, hsa; identical to SEQ ID NO: 47303

SEQ ID NO: 474792 - RNA, 64 nt, hsa; identical to SEQ ID NO: 138555

SEQ ID NO: 474793 - RNA, 64 nt, hsa; identical to SEQ ID NO: 138556

SEQ ID NO: 474794 - RNA, 64 nt, hsa; identical to SEQ ID NO: 138557

SEQ ID NO: 474795 - RNA, 64 nt, hsa; identical to SEQ ID NO: 138558

SEQ ID NO: 474796 - RNA, 64 nt, hsa; identical to SEQ ID NO: 138559

SEQ ID NO: 474797 - RNA, 64 nt, hsa; identical to SEQ ID NO: 138560

SEQ ID NO: 474798 - RNA, 64 nt, hsa; identical to SEQ ID NO: 138561

SEQ ID NO: 474799 - RNA, 64 nt, hsa; identical to SEQ ID NO: 138562

SEQ ID NO: 474800 - RNA, 64 nt, hsa; identical to SEQ ID NO: 138563

SEQ ID NO: 474801 - RNA, 64 nt, hsa; identical to SEQ ID NO: 138564

SEQ ID NO: 474802 - RNA, 64 nt, hsa; identical to SEQ ID NO: 138565

SEQ ID NO: 474803 - RNA, 64 nt, hsa; identical to SEQ ID NO: 138566

SEQ ID NO: 474804 - RNA, 64 nt, hsa; identical to SEQ ID NO: 138567

SEQ ID NO: 474805 - RNA, 64 nt, hsa; identical to SEQ ID NO: 138568

SEQ ID NO: 474806 - RNA, 64 nt, hsa; identical to SEQ ID NO: 138569

SEQ ID NO: 474807 - RNA, 64 nt, hsa; identical to SEQ ID NO: 138570

SEQ ID NO: 474808 - RNA, 64 nt, hsa; identical to SEQ ID NO: 138571

SEQ ID NO: 474809 - RNA, 64 nt, hsa; identical to SEQ ID NO: 138572

SEQ ID NO: 474810 - RNA, 55 nt, hsa; identical to SEQ ID NO: 138573

SEQ ID NO: 474811 - RNA, 64 nt, hsa; identical to SEQ ID NO: 138574

SEQ ID NO: 474812 - RNA, 64 nt, hsa; identical to SEQ ID NO: 138575

SEQ ID NO: 474813 - RNA, 64 nt, hsa; identical to SEQ ID NO: 138576

SEQ ID NO: 474814 - RNA, 64 nt, hsa; identical to SEQ ID NO: 138577

SEQ ID NO: 474815 - RNA, 64 nt, hsa; identical to SEQ ID NO: 138578

SEQ ID NO: 474816 - RNA, 64 nt, hsa; identical to SEQ ID NO: 138579

SEQ ID NO: 474817 - RNA, 64 nt, hsa; identical to SEQ ID NO: 138580

SEQ ID NO: 474818 - RNA, 64 nt, hsa; identical to SEQ ID NO: 138581

SEQ ID NO: 474819 - RNA, 64 nt, hsa; identical to SEQ ID NO: 138582

SEQ ID NO: 474820 - RNA, 64 nt, hsa; identical to SEQ ID NO: 138583

SEQ ID NO: 474821 - RNA, 64 nt, hsa; identical to SEQ ID NO: 138584

SEQ ID NO: 474822 - RNA, 64 nt, hsa
cuaccaccagaggccugcagccucccacaugccuuaaggggaccguggcccccaccagggacgu

SEQ ID NO: 474823 - RNA, 64 nt, hsa
uguuuuuuuaauucauuaaccagugguuagcccuuaaggggaggaggacggauugauuccacau

SEQ ID NO: 474824 - RNA, 64 nt, hsa
agggauacuggacuuucugacgcagaugaacaauuaaggggaaaagcuucccuuuucccucugu

SEQ ID NO: 474825 - RNA, 64 nt, hsa
cauuguuuucuagguaaacuucacuacugguaauuaaggggaaggauaugaggaagcaguuuaa

SEQ ID NO: 474826 - RNA, 64 nt, hsa
ugucuauaugucuagcucaucuaguuccucuucuuaaggggaugggggucaggggcuaggggag

SEQ ID NO: 474827 - RNA, 64 nt, hsa
gaauucuugaguuuacaucaauaauauuguauauuaaggggaucagaaguaggaaggaaaaaau

SEQ ID NO: 474828 - RNA, 64 nt, hsa
uuucuguuagucauuuccuggaaaaguaauauuuuaaggggaaauuauggaaacaaucuaauug

SEQ ID NO: 474829 - RNA, 64 nt, hsa
uuauacuaaagaauccagaguugcuacaauaaaauaaggggaauaauaaacuugagagugaaua

SEQ ID NO: 474830 - RNA, 64 nt, hsa
gagugucuuaagccuaauauuaaaucaguuuuguuaaggggaaaacucaauaguucuguuacuu

SEQ ID NO: 474831 - RNA, 64 nt, hsa
cugggagucccaguggugaggcucagagaacugcuaaggggaaagaacagcuggaguuucuguu

SEQ ID NO: 474832 - RNA, 64 nt, hsa
ucuugaguacaauggggagccacugauagcuuuuuaaggggaugaauggugggauuugguuuac

SEQ ID NO: 474833 - RNA, 64 nt, hsa
agaacugcugccuaggaaacuauaaacccuugguuaaggggaaaucauggcuuguucucuuugu

SEQ ID NO: 474834 - RNA, 64 nt, hsa
cuucauuaucccugugaaguaggugggacaaguauaaggggaagaggggugcugaauuuuuagg

SEQ ID NO: 474835 - RNA, 64 nt, hsa
gggaaaguuguuuuugguacuacuuggugggaaguaaggggaagguuggaucuuggguuugguc

SEQ ID NO: 474836 - RNA, 64 nt, hsa
uagggaaaagaaaauggggugggggugggggugguaaggggagaccggggagucaguuucagac

SEQ ID NO: 474837 - RNA, 64 nt, hsa
gaguuggggggguugggggugggauuguguccucuaaggggacggguucaucugaguaaacaua

SEQ ID NO: 474838 - RNA, 64 nt, hsa
uaaaacaugcugagguugagauaaagacgggacauaaggggaaaauucauuccauagagcugaa

SEQ ID NO: 474839 - RNA, 64 nt, hsa
uccucugcuuccucuguuggccccagauggacaguaaggggaaccuccaaugucucucugaacu

SEQ ID NO: 474840 - RNA, 64 nt, hsa
aacaaauuacuauagaacauuuaaaugaucaguuuaaggggaaauaggcuaguuuauagaaaaa

SEQ ID NO: 474841 - RNA, 64 nt, hsa
ucuaauuuauuuugucuuuuggcuucucaguagcuaaggggaaggcugaugucaggagagggag

SEQ ID NO: 474842 - RNA, 64 nt, hsa
gcuugugcuuuauacaaagagaaagagguggucuuaaggggaugcuuccaggggggugaguuca

SEQ ID NO: 474843 - RNA, 64 nt, hsa
ggacgaggccgggacuuggccgagcggauccuaauaaggggaaaaugguaaaugcaaacguccc

SEQ ID NO: 474844 - RNA, 64 nt, hsa
uaccaucuuuucagacaagaauguacagcaaaaauaaggggaacaguaguauacugagagugug

SEQ ID NO: 474845 - RNA, 64 nt, hsa
ucaaggccuugggcucuccccagggucuaacgguuaaggggacccacauaccagugccaagggg

SEQ ID NO: 474846 - RNA, 64 nt, hsa
acaaaaaaaaagaugaaccuaggucuguguaaaguaaggggaguguuaggagcagccaggacug

SEQ ID NO: 474847 - RNA, 64 nt, hsa
gucugugcucugauaugcuccuugacugaaacuuuaaggggaucucucccagagacuugacauu

SEQ ID NO: 474848 - RNA, 53 nt, hsa
gaaugccaggaaggauguagaaauaaggggaggaagauucccaucucuacaau

SEQ ID NO: 474849 - RNA, 64 nt, hsa
auacacacacacacacacacacagagacacaucuuaaggggacccacaaguauugcccuuuaac

SEQ ID NO: 474850 - RNA, 64 nt, hsa
acaagagaauaaaaaugggccaucccagcacuuauaaggggagcacaucuuguaaugaaagucu

SEQ ID NO: 474851 - RNA, 64 nt, hsa
guggcaguccuuugccaguggaaggaguuccugcuaaggggaggugcaggaggugagcugauac

SEQ ID NO: 474852 - RNA, 64 nt, hsa
cuggguuuucagaagguccuucugauggcuaggcuaaggggaggaagaauuccugccaugcccc

SEQ ID NO: 474853 - RNA, 64 nt, hsa
gcccuucuuccuggucugggugucucccugagucuaaggggaagauucucaaguccccugguga

SEQ ID NO: 474854 - RNA, 64 nt, hsa
aaaauagucucuuuaaaaggaaagaaaacaucuuuaaggggaggaaccagagugcugaaggaau

SEQ ID NO: 474855 - RNA, 64 nt, hsa
aauacagaugauuuguguaaccugaggccaggauuaaggggaggcaaucaaugcaccuagggaa

SEQ ID NO: 474856 - RNA, 64 nt, hsa
uuaagucuaugugagcaagugagagaagguuagguaaggggagaggauggaaugcuugccucca

SEQ ID NO: 474857 - RNA, 64 nt, hsa
gagcauuuccucaaaauugagauggaucaauauguaaggggaggugggagcguguguggaaggg

SEQ ID NO: 474858 - RNA, 64 nt, hsa
aaaauauaauuauuacugaaauauguuuaauauuuaaggggaaaagagacuaauuucaguuaua

SEQ ID NO: 474859 - RNA, 64 nt, hsa
cuucugcaacaagcaugcagcuuugcaaacccauuaaggggaagaaugaaagcuguuccuuggu

SEQ ID NO: 474860 - RNA, 64 nt, hsa
uggauccuugguaauccucaagcaucagaugccauaaggggaaacuuaauucugcuaaauuaau

SEQ ID NO: 474861 - RNA, 64 nt, hsa
cugucuuaauuacucauggcagguucuagagacuuaaggggaaaagcugcuuucaaggccacca

SEQ ID NO: 474862 - RNA, 64 nt, hsa
cauucuaccucuuugugcccugcuguuuauucuguaaggggaagguggcaaugggacccagcuc

SEQ ID NO: 474863 - RNA, 64 nt, hsa
gguggagagaggggccucuucagugucuacugaguaaggggacagcuccaggccggggccuguc

SEQ ID NO: 474864 - RNA, 64 nt, hsa
uuuuacguuuuagaaaauuuuauguauuuuaaaauaaggggaagagucauuuucacuuuuaaac

SEQ ID NO: 474865 - RNA, 64 nt, hsa
gguuuuuuugggaguuuuuuuaagguuuaauaacuaaggggaauauuuuaaaauuaagagagca

SEQ ID NO: 474866 - RNA, 64 nt, hsa
uuguauuauuuugugcauuuaaaaaacacaaucuuaaggggauagacuagacugccacagcagc

SEQ ID NO: 474867 - RNA, 64 nt, hsa
cuuccccauuuugccaucugucucuuaugauuuauaaggggaaaaaaacuuguuuuguuagagg

SEQ ID NO: 474868 - RNA, 64 nt, hsa
acuuuugagucugguuucauuguuuuaaauaaauuaaggggacacuaaaguccuaucauucauu

SEQ ID NO: 474869 - RNA, 64 nt, hsa
uaauucauguuaagauuauguaugguuugcauuuuaaggggauuuauguuagguuaauuaguug

SEQ ID NO: 474870 - RNA, 64 nt, hsa
uccugacaguccaggcaacacauuuugccuuuuuuaaggggaguuuaccucauuguugguuguu

SEQ ID NO: 474871 - RNA, 64 nt, hsa
uaagugaggaugaaaaaauaacacuguacugcaauaaggggagaguaacccugucuaaugaaac

SEQ ID NO: 474872 - RNA, 64 nt, hsa
ucuucuaaaacuugaguggcugucuuaaaagauauaaggggaaagauaauauugucugucucua

SEQ ID NO: 474873 - RNA, 64 nt, hsa
ugggauuucaugggguuugguugugcugauaggguaaggggaggcugcuuucugcccuucuccc

SEQ ID NO: 474874 - RNA, 64 nt, hsa
gguuguaaggguggcuaagucccaccauaacagcuaaggggaccugggagaugauggcucauuu

SEQ ID NO: 474875 - RNA, 64 nt, hsa
ggugcuaauuacauggcaggaagaauggggccucuaaggggaguguggggucugucucucccuu

SEQ ID NO: 474876 - RNA, 64 nt, hsa
aaaaucucuugauuauaaauguuuggaaagguucuaaggggaccuacagacagacauacauaga

SEQ ID NO: 474877 - RNA, 64 nt, hsa
augacuuuugcuggcagaacugaaauauaaacuguaaggggauuucgucaguugcucccaguau

SEQ ID NO: 474878 - RNA, 64 nt, hsa
cauuguggaagaucuccagccuccuuguaggggauaaggggaugugcagcaucuguguggauuu

SEQ ID NO: 474879 - RNA, 64 nt, hsa
uuuaagaauggugcucuuucaugccuauuaucaguaaggggacuuguauuagagucagagucuu

SEQ ID NO: 474880 - RNA, 64 nt, hsa
agucuggauauaaacguauuuucugucuuccuuauaaggggauucucccagcugcuaaauuuaa

SEQ ID NO: 474881 - RNA, 64 nt, hsa
gaauuaaguuuuuuuuuaaaaaagaaacauuugguaaggggaauugaggacacugauauggguc

SEQ ID NO: 474882 - RNA, 64 nt, hsa
uaacgaggauuuuauuuuaacuuauauuuuaguuuaaggggaacacgugcagguuuguucuaua

SEQ ID NO: 474883 - RNA, 64 nt, hsa
cucuuccaggugggggaggggggagagucaggaauaaggggauccccagaagugcagagcugag

SEQ ID NO: 474884 - RNA, 64 nt, hsa
aaugauaguggcaauaauauuuuucuucagaggcuaaggggaagauagaccuguacauguauuu

SEQ ID NO: 474885 - RNA, 64 nt, hsa
caucgugaaagaugggaaaaaucgugaugauggguaaggggaaaacuucccggaaggcaauggg

SEQ ID NO: 474886 - RNA, 64 nt, hsa
cacaggacacagccuuauuacugcuggggugggauaaggggaaggagaagagggagaauggagc

SEQ ID NO: 474887 - RNA, 64 nt, hsa
aggccaggagugaggggcucuuucuuaccguaaauaaggggaaaaggcaguuagcucaaggacu

SEQ ID NO: 474888 - RNA, 64 nt, hsa
uuuaaaucucuaccacagccucacaagcaaaugcuaaggggaacauacauguaaaaagccagca

SEQ ID NO: 474889 - RNA, 64 nt, hsa
caucugauauaccagaauuauuuccaugcaauuauaaggggaggguaauaugaucaaaguuaag

SEQ ID NO: 474890 - RNA, 64 nt, hsa
caacagaauuugccaaaauucagacaugcacuucuaaggggaaggugauuuuccaguucaaaaa

SEQ ID NO: 474891 - RNA, 64 nt, hsa
agguuauaaguauuacaaaaaauccaccuuucucuaaggggaaguuuguaccccauugauucuu

SEQ ID NO: 474892 - RNA, 64 nt, hsa
gagugggagggcuuauauugguuuuuccagcuauuaaggggacauauugugucguugugcuuuu

SEQ ID NO: 474893 - RNA, 64 nt, hsa
uuuuguuuguguuuuguuuggcuuguuuguuuuuuaaggggaaaaaaguuuguaauuauuucau

SEQ ID NO: 474894 - RNA, 64 nt, hsa
uuuguuuauaaauguguacaguuuuguuuucucguaaggggagcaucauaggguuacuuuauac

SEQ ID NO: 474895 - RNA, 64 nt, hsa
cgaaccucgugggcuguaggaaagcaaauguagguaaggggagagcaaggaugcacagaaaaca

SEQ ID NO: 474896 - RNA, 64 nt, hsa
gcacuaucacuuaguaccuguuugaccaagguguuaaggggauaguaccucccaauucaagcag

SEQ ID NO: 474897 - RNA, 64 nt, hsa
caaaugaaaaagaaugaaagggaaagugaaaaauuaaggggacaaaagaugggaugugaaaaga

SEQ ID NO: 474898 - RNA, 64 nt, hsa
acaaggcauuucugacauuuuauaaaccuacauuuaaggggaauuuuuaaaggaaauguuuuuu

SEQ ID NO: 474899 - RNA, 64 nt, hsa
auacauguauuuuaguaaauccagaaaagaagacuaaggggacaggugaauaccugcuccucgc

SEQ ID NO: 474900 - RNA, 64 nt, hsa
guuuagaccuugguuugguaguucuuguuuuuaauaaggggaaaaagauaaaauaaccccuauu

SEQ ID NO: 474901 - RNA, 64 nt, hsa
caaagugacaggggaaaaggaauuagucuaagaguaaggggaugauuauuauauugaggcuaaa

SEQ ID NO: 474902 - RNA, 64 nt, hsa
gagcagaaacucuuaagaaauccuuucuucucccuaaggggaugaggggaugaucuuuuguggu

SEQ ID NO: 474903 - RNA, 64 nt, hsa
cccugaugguuacuugcuauggaauuuuuuuaaauaaggggaggguuguuccagcuuugauccu

SEQ ID NO: 474904 - RNA, 64 nt, hsa
gucuguagccuccucguucccuacccuaaaauucuaaggggaagggacccauagaggcuugccu

SEQ ID NO: 474905 - RNA, 64 nt, hsa
gcucgugccauguuaugaucauauaccuuuuaaauaaggggaaauaguaucuuuaaaguuaaug

SEQ ID NO: 474906 - RNA, 64 nt, hsa
caccaguuugacugugcuagcuaaaagacaaauuuaaggggagcucuucaacauuaaggcagua

SEQ ID NO: 474907 - RNA, 64 nt, hsa
cuacagagagggaagggaaagccugaggccggcauaaggggaggccuuggaaccugagcugcca

SEQ ID NO: 474908 - RNA, 64 nt, hsa
uauauauuuuuuuuuggaugaagguugcugggauuaaggggauuagagugauuaugggagcagc

SEQ ID NO: 474909 - RNA, 64 nt, hsa
cccuucacaccccccuucacaggggucguaugaguaaggggauuuggaaacugucaacuuacaa

SEQ ID NO: 474910 - RNA, 64 nt, hsa
aaguuaugaaaaaauagacgucaacaaaaauguguaaggggauauuagguuugcuaaauucuuu

SEQ ID NO: 474911 - RNA, 64 nt, hsa
auggaugucacucaacuaagaucaaaucaccauuuaaggggauggcauucuuuauaccuaaaca

SEQ ID NO: 474912 - RNA, 64 nt, hsa
ggggaugguauauggcccuuuccccaccaggcgcuaaggggaacacccccuuccccaggucuuu

SEQ ID NO: 474913 - RNA, 64 nt, hsa
gugcacauuuguuuggggaugggggagaagaagcuaaggggagaagucaacauuuaugaaauau

SEQ ID NO: 474914 - RNA, 64 nt, hsa
aagggaccagggauugcaggccccaucuccaggcuaaggggaggagagcaucaucacuuuccau

SEQ ID NO: 474915 - RNA, 64 nt, hsa
ggguucagcugcugcucccaauaccucagcaugguaaggggacagagcccagcagaucccagcu

SEQ ID NO: 474916 - RNA, 64 nt, hsa
cauccucuuggguggguuuuggguguuggcuggguaaggggagccggggacuucugaaauagag

SEQ ID NO: 474917 - RNA, 64 nt, hsa
ggaauccucaaacuucccuccaagggagauauuguaaggggaaaacaaaguguuuauuucccca

SEQ ID NO: 474918 - RNA, 64 nt, hsa
cagagguagcaugugcccuaguuacagaaucuauuaaggggaugacugucucaaauauguagga

SEQ ID NO: 474919 - RNA, 64 nt, hsa
aaccccugcucccccuguccccaccccaggagaguaaggggacgagggccagcucucuggcauc

SEQ ID NO: 474920 - RNA, 64 nt, hsa
uuuuuuuuuuuuuuggcaaauguuuacauucaauuaaggggaaaaaguagaaccagcacaaaug

SEQ ID NO: 474921 - RNA, 64 nt, hsa
auuucucucaauuugauuagcuuugagucacaauuaaggggaagcaaaaacaucuugaaaagac

SEQ ID NO: 474922 - RNA, 64 nt, hsa
uaaugaaacacuggacauauaauugguuuaaacauaaggggaauuaagucuuuguagucuguca

SEQ ID NO: 474923 - RNA, 64 nt, hsa
cugagccuuuuuuuuuuucuaaugcauccaagguuaaggggaagacgcaaauaacaggacuauu

SEQ ID NO: 474924 - RNA, 64 nt, hsa
cagauugcuucucuguauuaaauagucuagaaguuaaggggauggucacauuuaccauguauug

SEQ ID NO: 474925 - RNA, 64 nt, hsa
ggagauugaggcugugccacaucuucugccauccuaaggggacaugaugguucugugauuccca

SEQ ID NO: 474926 - RNA, 64 nt, hsa
cuuccuuggagaccugcauuugccaacaccuuuuuaaggggaggagagagcacuuaguuucuga

SEQ ID NO: 474927 - RNA, 64 nt, hsa
ucuaaauuccuuaagaaagauauccaaaacaaauuaaggggaaaagggaggguugcauaacagc

SEQ ID NO: 474928 - RNA, 64 nt, hsa
uaaaauucaaaacaagaaacaaaacaaaaaaaauuaaggggaaaauuauuuaaaucggaaagga

SEQ ID NO: 474929 - RNA, 64 nt, hsa
auauuaaaaagucuguauggcaugacaacuacuuuaaggggaagauaagauuucugucuacuaa

SEQ ID NO: 474930 - RNA, 64 nt, hsa
ccuucaggaacacggggagcagaggccaaagcacuaaggggagggcgcauacccgagacgauug

SEQ ID NO: 474931 - RNA, 64 nt, hsa
uguguguguguguguguguguguguguguguguguaaggggaggaaagccaccuugacagccca

SEQ ID NO: 474932 - RNA, 64 nt, hsa
aaccgaaggcucggucuuaauucccccaccugucuaaggggaacagaaaaccccugccaaaacu

SEQ ID NO: 474933 - RNA, 64 nt, hsa
caucaguuagagcugacacaaaccugccuggguuuaaggggagaggaaauauugcuggggucau

SEQ ID NO: 474934 - RNA, 64 nt, hsa
cugcccuuaacuguuuucacuaaacagcuuuuucuaaggggagagcaagggggagagaucuaga

SEQ ID NO: 474935 - RNA, 64 nt, hsa
cuuaagccaccuccccaggacuuacggagagaaauaaggggauguaaccagcaauggccagggu

SEQ ID NO: 474936 - RNA, 64 nt, hsa
aagauauuaagacuuaauucacuaaaauuuauucuaaggggauauuuauacuuuuauacuuuuu

SEQ ID NO: 474937 - RNA, 64 nt, hsa
ucuuucugagcuggcgaguuagaagaauggaagguaaggggaaggucugucaucuacccaggac

SEQ ID NO: 474938 - RNA, 64 nt, hsa
ugaugacucuuuugguaaccagacaccaaucaaauaaggggaggagacgaaaauggaaugauuu

SEQ ID NO: 474939 - RNA, 64 nt, hsa
uugcuuaaaggaaaaugaaauacaauuagcagaauaaggggaaacgaguggucugcucugcucg

SEQ ID NO: 474940 - RNA, 64 nt, hsa
gaggcagaaucccggcugucaagggguguucaguuaaggggagcaacagaggacaugaaaaauu

SEQ ID NO: 474941 - RNA, 64 nt, hsa
auugcuuuuuaaaaugcagugcuuuacuuuaaacuaaggggaacuuugcggaggugaaaaccuu

SEQ ID NO: 474942 - RNA, 64 nt, hsa
cuguauuacugaaagcuaaauccucaaaaccuaguaaggggacuaaugauucauuaaaguaaau

SEQ ID NO: 474943 - RNA, 64 nt, hsa
aaacaaccugagauggagaggccaggagagaguauaaggggauagcagcaaaccaccuaucugg

SEQ ID NO: 474944 - RNA, 64 nt, hsa
cugugauauuuccaacgacuguaggaggaaaaauuaaggggagagaggaaaacaaaaccaacca

SEQ ID NO: 474945 - RNA, 64 nt, hsa
ucuccuuccauaaugcuccuguacccaguuuauuuaaggggacaugcacuggaauaggaaaugu

SEQ ID NO: 474946 - RNA, 64 nt, hsa
aaagaacgcauuugagauuuuaagaugucacuuauaaggggagaaguguucuuaaaaagucaac

SEQ ID NO: 474947 - RNA, 64 nt, hsa
guuugggggcgggguguugggaguagagacaggguaaggggacgugagaaaggaaaaggcauga

SEQ ID NO: 474948 - RNA, 64 nt, hsa
cuuuuuaaauuuggugccgauguugaacuuuuuuuaaggggagaaaauuaaaagaaauauacag

SEQ ID NO: 474949 - RNA, 64 nt, hsa
cccagauagcuaggccagagcuggaagcagacaguaaggggaagagcugcucccacaggagagg

SEQ ID NO: 474950 - RNA, 64 nt, hsa
uacccccucccucuuguccacccuacccccaggguaaggggagccucucuccuuccccaucaga

SEQ ID NO: 474951 - RNA, 64 nt, hsa
ucuaacaugugguccccuuugucccuagcaccuuuaaggggaggggaagaauuggagggcagcu

SEQ ID NO: 474952 - RNA, 64 nt, hsa
gucaggcucuccucuugaccacuguguuaugggauaaggggagggggugggcauauucuggaga

SEQ ID NO: 474953 - RNA, 64 nt, hsa
uggguguuuuucaguguguauguguguguauauguaaggggaaagagagauugaucuggauggc

SEQ ID NO: 474954 - RNA, 64 nt, hsa
gugccaccaagacagccuuuuccaguggccauccuaaggggaacucccaaauggguguugcugg

SEQ ID NO: 474955 - RNA, 64 nt, hsa
ggaaaggggugguagucagaggagggaggaggaauaaggggaaggaagagagagggagcaggcg

SEQ ID NO: 474956 - RNA, 64 nt, hsa
aaguauaaauuaagacacccuauugacuuccggguaaggggagucaauugauuacccagcagca

SEQ ID NO: 474957 - RNA, 64 nt, hsa
agugcuucugcaccccagcccccuguccugccuguaaggggauacagagaagcuccccgucucu

SEQ ID NO: 474958 - RNA, 64 nt, hsa
uuguaguaugcuuaagcuuuggggaauuuuuuuuuaaggggaucuaaaaaaauguuuuuagaac

SEQ ID NO: 474959 - RNA, 64 nt, hsa
aaguacaguaaacacuauuaucuuaucuugacuuuaaggggaaauaauuucucagaggauuaua

SEQ ID NO: 474960 - RNA, 64 nt, hsa
aagggaauuuaauacuuuuccacagauuuuuuuguaaggggaagagggaaauguacacuuuuua

SEQ ID NO: 474961 - RNA, 64 nt, hsa
gugccugagaccccugccuuagaaacagaauuccuaaggggauugacucucccagcauguuccc

SEQ ID NO: 474962 - RNA, 64 nt, hsa
ccauccucagcuaccccgagagguagccccacucuaaggggagcagggggaccugacagcacac

SEQ ID NO: 474963 - RNA, 64 nt, hsa
uagcccugggcuugccccauuuggggcagcuauuuaaggggaggggaugucucaccgggcuggg

SEQ ID NO: 474964 - RNA, 64 nt, hsa
ggugauaggacuuacgcauccccaccuuuugggguaaggggagugcugcccugccauaaucccc

SEQ ID NO: 474965 - RNA, 64 nt, hsa
gggauuuguaagacuuagaugagauagcgcauaauaaggggaagacuuuaaaguauaaaguaaa

SEQ ID NO: 474966 - RNA, 64 nt, hsa
ccugucugagaccacccccggcucugacugagaguaaggggacugucagggccucgacuugcca

SEQ ID NO: 474967 - RNA, 64 nt, hsa
uguguuuauguuaggaucugaaucauguucuggguaaggggacgaggagcgaacacugcacuaa

SEQ ID NO: 474968 - RNA, 64 nt, hsa
aucaacuguugcaaaucccguuucucucucccgguaaggggacaaauuauacuuuauucaggug

SEQ ID NO: 474969 - RNA, 64 nt, hsa
agagaugugaaauguggccaaagagaugugaggguaaggggaaagccaaagcuacacuggagga

SEQ ID NO: 474970 - RNA, 64 nt, hsa
ccuuggaggaaauuccuugagcagucugagccuuuaaggggaauuccuucccuuuucugacuga

SEQ ID NO: 474971 - RNA, 64 nt, hsa
gugcauaauuguagaaauacagauuuuguuguuauaaggggagggucugggugcccaggaguag

SEQ ID NO: 474972 - RNA, 64 nt, hsa
guguuugauuaaaaaaaacacaucuaguaagacguaaggggaaaaucacauccucuuuggagau

SEQ ID NO: 474973 - RNA, 64 nt, hsa
aguagcuggucagggcugaguacaguccuggggguaaggggaugacaugcccaggugucagcuc

SEQ ID NO: 474974 - RNA, 64 nt, hsa
cugugguuguuuucuugugcguacucauucauucuaaggggagucggugcaggaugccgcuucu

SEQ ID NO: 474975 - RNA, 64 nt, hsa
cuugacucugaagggacuuuugaguuaaucagcguaaggggauuucuaaagcaggcaaucccug

SEQ ID NO: 474976 - RNA, 64 nt, hsa
gauacaaaagaagaugaaaauggaaguggcaauauaaggggaugaggaaggcaugccuggacaa

SEQ ID NO: 474977 - RNA, 64 nt, hsa
ggccaucuggaaauccagcugguuauccaaauccuaaggggagcuacagccagcggcauauacu

SEQ ID NO: 474978 - RNA, 64 nt, hsa
uuguuuuguaguguauauuacuuguccauuccuuuaaggggagcagccugcacucuuuuguaga

SEQ ID NO: 474979 - RNA, 64 nt, hsa
agcccuucauggguggugacgugguagucacuuguaaggggaacagaaacauuuuuguucuuau

SEQ ID NO: 474980 - RNA, 64 nt, hsa
gaaaguguuguaguugauugaccaaaccaguucauaaggggaauuuuuuuuaaaaaacaacaaa

SEQ ID NO: 474981 - RNA, 64 nt, hsa
cugcuccccucagaucagucaggaggaagaugacuaaggggagggauccucugggugauggccu

SEQ ID NO: 474982 - RNA, 64 nt, hsa
ggacagaggugcccacgagggcagaggccggugcuaaggggauggggaagaagggacaagauuc

SEQ ID NO: 474983 - RNA, 64 nt, hsa
gcaagcguucccccaacugcugagucugugggauuaaggggauuagggagugucaguggccuag

SEQ ID NO: 474984 - RNA, 64 nt, hsa
aaguuugcuuaacugggcuugaguguguuugugguaaggggagaggagccggaauggagggcag

SEQ ID NO: 474985 - RNA, 64 nt, hsa
acuucuuuuuacaauguaucaacauauuuuuauuuaaggggaauuaacaauugccagggaaacc

SEQ ID NO: 474986 - RNA, 64 nt, hsa
ucugcuccaaccuucuauuuuaauuauuauuuuguaaggggaagaauaacauuugauaaauauu

SEQ ID NO: 474987 - RNA, 64 nt, hsa
uccucuggguuuaagugauuuuauuuaagucaacuaaggggauuuaacaguggacuagagguaa

SEQ ID NO: 474988 - RNA, 64 nt, hsa
ccccucucuguuuacccucccuguccccugagguuaaggggaucuaaaaggaggacagggaggg

SEQ ID NO: 474989 - RNA, 64 nt, hsa
aguguacuauguuaugcacacauuacaaauaauauaaggggaaguuuuauuagcuuaguaggaa

SEQ ID NO: 474990 - RNA, 64 nt, hsa
uuagucaguaagacgauauaaccuacuuacuccguaaggggaaaugaaggcccagagaagggaa

SEQ ID NO: 474991 - RNA, 62 nt, hsa
gcucagggguuggucugagaggccugccauccaccccucagggagcuagguuuucucagagg

SEQ ID NO: 474992 - RNA, 62 nt, hsa
guuauugaaggggaugguucauuaaggacuccaccccucagagcucacucagaccccaagga

SEQ ID NO: 474993 - RNA, 62 nt, hsa
cugcccaccucguuccccagcccucaccccucaccccucaccauccuuccucaggacuuggc

SEQ ID NO: 474994 - RNA, 62 nt, hsa
ccaucagcugcccaccucguuccccagcccucaccccucaccccucaccauccuuccucagg

SEQ ID NO: 474995 - RNA, 62 nt, hsa
uugucuggcgucaacuggcuuucagagugcugaccccucaucacuguggggaucauucucuc

SEQ ID NO: 474996 - RNA, 62 nt, hsa
uuccugcugaggugggacugggcccuggacacaccccucagccccucuguccucauuguuug

SEQ ID NO: 474997 - RNA, 62 nt, hsa
gcaucauggagacccgcaggcggggcuuagccaccccucaaacccagggcccccuggcaccu

SEQ ID NO: 474998 - RNA, 62 nt, hsa
ccuuggauauuucccaagaaccccccacauacaccccucacaagccaccccuccugagaggc

SEQ ID NO: 474999 - RNA, 62 nt, hsa
ugacuuccgcaggaauugagagggaauagcucaccccucauucuguccuccggacuuaggaa

SEQ ID NO: 475000 - RNA, 62 nt, hsa
aguggggugcagcccuggcggucuucagcugcaccccucaccgcuuccguucuuacugccuu

SEQ ID NO: 475001 - RNA, 62 nt, hsa
cauuuucucccugagcuguaggguggaccuggaccccucagagaugcucgacugcagggucc

SEQ ID NO: 475002 - RNA, 62 nt, hsa
ccguccagugucacccacacauugguccggggaccccucagugcagagccugaaguuggggg

SEQ ID NO: 475003 - RNA, 62 nt, hsa
ugguguuucucucuguaauuugugugggguuuaccccucacagguuuaagagaccaggucuu

SEQ ID NO: 475004 - RNA, 62 nt, hsa
gggguucagcggggccucugucuuuuguggugaccccucagggguuucauuguuuccuucug

SEQ ID NO: 475005 - RNA, 62 nt, hsa
cacugucuuaagugagccagggcaaaauuuacaccccucacguuucccucucccuucuuccc

SEQ ID NO: 475006 - RNA, 62 nt, hsa
cagaccucagggaggguugaguuucucuaaggaccccucaaacaugucgcaaaaugaaccaa

SEQ ID NO: 475007 - RNA, 62 nt, hsa
cuucugcccauagacggggaugacucagcacuaccccucaacagagaugacuuugaugacuc

SEQ ID NO: 475008 - RNA, 62 nt, hsa
cagggaugacucagcagggaugacucagcaccaccccucaacagggaugacucagcagggau

SEQ ID NO: 475009 - RNA, 62 nt, hsa
uugucuauucagacgcugguaugggggcucggaccccucacuggggacagggccaguguugg

SEQ ID NO: 475010 - RNA, 62 nt, hsa
gcagcacacucaucccgcgccuccagaggcccaccccucaugcaacagccgcccccgcaggc

SEQ ID NO: 475011 - RNA, 62 nt, hsa
ccccauggucacccugaagcccuuagauuccaaccccucaaucagagacuuccuucauuaac

SEQ ID NO: 475012 - RNA, 62 nt, hsa
gaguagcaccuucaggcuagucccuauccccaaccccucagagcagauucccagauuaacag

SEQ ID NO: 475013 - RNA, 64 nt, hsa
aacuuauguagauuauuauaaauugauguaaaccacgugagaggaaaauguuaauaaaaaaugc

SEQ ID NO: 475014 - RNA, 64 nt, hsa
cagggagccccacagccccaagcucgcugaggcaacgugagaacaggcuaugggaaggcugcaa

SEQ ID NO: 475015 - RNA, 64 nt, hsa; identical to SEQ ID NO: 170734

SEQ ID NO: 475016 - RNA, 64 nt, hsa; identical to SEQ ID NO: 170735

SEQ ID NO: 475017 - RNA, 64 nt, hsa; identical to SEQ ID NO: 170736

SEQ ID NO: 475018 - RNA, 64 nt, hsa; identical to SEQ ID NO: 170737

SEQ ID NO: 475019 - RNA, 64 nt, hsa; identical to SEQ ID NO: 170738

SEQ ID NO: 475020 - RNA, 64 nt, hsa; identical to SEQ ID NO: 170739

SEQ ID NO: 475021 - RNA, 64 nt, hsa; identical to SEQ ID NO: 170740

SEQ ID NO: 475022 - RNA, 64 nt, hsa; identical to SEQ ID NO: 170741

SEQ ID NO: 475023 - RNA, 64 nt, hsa; identical to SEQ ID NO: 170742

SEQ ID NO: 475024 - RNA, 64 nt, hsa; identical to SEQ ID NO: 170743

SEQ ID NO: 475025 - RNA, 64 nt, hsa; identical to SEQ ID NO: 170744

SEQ ID NO: 475026 - RNA, 64 nt, hsa; identical to SEQ ID NO: 170745

SEQ ID NO: 475027 - RNA, 64 nt, hsa; identical to SEQ ID NO: 170746

SEQ ID NO: 475028 - RNA, 64 nt, hsa; identical to SEQ ID NO: 170747

SEQ ID NO: 475029 - RNA, 64 nt, hsa; identical to SEQ ID NO: 170748

SEQ ID NO: 475030 - RNA, 64 nt, hsa; identical to SEQ ID NO: 170749

SEQ ID NO: 475031 - RNA, 64 nt, hsa; identical to SEQ ID NO: 170750

SEQ ID NO: 475032 - RNA, 64 nt, hsa; identical to SEQ ID NO: 170751

SEQ ID NO: 475033 - RNA, 64 nt, hsa; identical to SEQ ID NO: 170752

SEQ ID NO: 475034 - RNA, 64 nt, hsa; identical to SEQ ID NO: 170753

SEQ ID NO: 475035 - RNA, 64 nt, hsa; identical to SEQ ID NO: 170754

SEQ ID NO: 475036 - RNA, 64 nt, hsa; identical to SEQ ID NO: 170755

SEQ ID NO: 475037 - RNA, 64 nt, hsa; identical to SEQ ID NO: 170756

SEQ ID NO: 475038 - RNA, 64 nt, hsa; identical to SEQ ID NO: 170757

SEQ ID NO: 475039 - RNA, 64 nt, hsa; identical to SEQ ID NO: 170758

SEQ ID NO: 475040 - RNA, 64 nt, hsa; identical to SEQ ID NO: 80183

SEQ ID NO: 475041 - RNA, 64 nt, hsa; identical to SEQ ID NO: 80184

SEQ ID NO: 475042 - RNA, 64 nt, hsa; identical to SEQ ID NO: 80185

SEQ ID NO: 475043 - RNA, 64 nt, hsa; identical to SEQ ID NO: 80186

SEQ ID NO: 475044 - RNA, 64 nt, hsa; identical to SEQ ID NO: 80187

SEQ ID NO: 475045 - RNA, 64 nt, hsa; identical to SEQ ID NO: 80188

SEQ ID NO: 475046 - RNA, 64 nt, hsa; identical to SEQ ID NO: 80189

SEQ ID NO: 475047 - RNA, 64 nt, hsa; identical to SEQ ID NO: 80190

SEQ ID NO: 475048 - RNA, 64 nt, hsa; identical to SEQ ID NO: 80191

SEQ ID NO: 475049 - RNA, 64 nt, hsa; identical to SEQ ID NO: 80192

SEQ ID NO: 475050 - RNA, 64 nt, hsa; identical to SEQ ID NO: 80193

SEQ ID NO: 475051 - RNA, 64 nt, hsa; identical to SEQ ID NO: 80194

SEQ ID NO: 475052 - RNA, 64 nt, hsa; identical to SEQ ID NO: 80195

SEQ ID NO: 475053 - RNA, 64 nt, hsa; identical to SEQ ID NO: 80196

SEQ ID NO: 475054 - RNA, 64 nt, hsa; identical to SEQ ID NO: 80197

SEQ ID NO: 475055 - RNA, 64 nt, hsa; identical to SEQ ID NO: 80198

SEQ ID NO: 475056 - RNA, 63 nt, hsa
cuaguuuugaauaagucugggugaccgcaccuaaaaugguaagcaguacccuccggcuuuuuc

SEQ ID NO: 475057 - RNA, 63 nt, hsa
uauuacucagcagcaguaacaugguaacacuuaaaaugguacucggggaccuccaaagacuaa

SEQ ID NO: 475058 - RNA, 63 nt, hsa
uaaaacuuugaauaucccagcgaagaaauggauaaaugguacagugccuguggauaguacagu

SEQ ID NO: 475059 - RNA, 63 nt, hsa
caucuacucaagguauuuuacagauuaccauggaaaugguagauacaguuuaaaagugcuuac

SEQ ID NO: 475060 - RNA, 63 nt, hsa
uuccuagaaaagauuuaaguaaagcaaaaggacaaaugguaauauaaagaaauuauuuucaau

SEQ ID NO: 475061 - RNA, 63 nt, hsa
uaagaaaauuauaagcugagguuucuuuuguuaaaaugguauaacgcuguugcucauuuuaaa

SEQ ID NO: 475062 - RNA, 63 nt, hsa
cccuuagaaagucuucugcaaacccauuucugaaaaugguacauuauaggguggguauagaug

SEQ ID NO: 475063 - RNA, 63 nt, hsa
aaugccacuaaauuguacccauaaaaaugguuaaaaugguaaauuuuguuauguauauuuuau

SEQ ID NO: 475064 - RNA, 63 nt, hsa
aauagucaguuuucuagaaccuacuuuuaggguaaaugguacauuauuuaauauuauauuaaa

SEQ ID NO: 475065 - RNA, 63 nt, hsa
aaaccuccuauagcguggauuguagaccaaaggaaaugguacaauuucugagaauauauguug

SEQ ID NO: 475066 - RNA, 63 nt, hsa
aucgccaaugcaggaugcuccuuagaaaagaaaaaaugguaaagaauggcauuuaacgauuca

SEQ ID NO: 475067 - RNA, 63 nt, hsa
ucccaacaacugcacuuuagaauaccagcagugaaaugguauuacuguuucccucugagugaa

SEQ ID NO: 475068 - RNA, 63 nt, hsa
aaaaaaacaaagauauucaaacugcuuggguucaaaugguauacaauuugccagcuguuacug

SEQ ID NO: 475069 - RNA, 63 nt, hsa
auauuguuggugagauaauauuuaauagguauaaaaugguaaaauaccuaguuuucuauuuag

SEQ ID NO: 475070 - RNA, 63 nt, hsa
aaaacaaagauggacuuguucugggaaaagguaaaaugguaaucaaauagauuguguuccagg

SEQ ID NO: 475071 - RNA, 63 nt, hsa
augggcuguccaguccugauuauagagaggaagaaaugguaacaguauggcagauaagaauua

SEQ ID NO: 475072 - RNA, 63 nt, hsa
aaguuuuucauauuucauggacaacaaaagagaaaaugguaugaacacuguacaaacuuugau

SEQ ID NO: 475073 - RNA, 63 nt, hsa
agugguuuauggugggcaauauugcaauauuugaaaugguaaaaauggaaagaagaacaaaau

SEQ ID NO: 475074 - RNA, 63 nt, hsa
aaacacugaugguuuuuaaagacucaccuuuuuaaaugguacuuggagcuccugauucaaauu

SEQ ID NO: 475075 - RNA, 63 nt, hsa
ggcacagaaagguuaaaugauuacucagcuaaaaaaugguagagauuuuuuuuucaaacacag

SEQ ID NO: 475076 - RNA, 63 nt, hsa
aacaaaguaaaugauucuauuuuagaaggauaaaaaugguaaugaugauaacuaacauuuuuu

SEQ ID NO: 475077 - RNA, 63 nt, hsa
cuacagugcuguguacccuggggcaauaggguuaaaugguaguuagcaacuagggcuagucuu

SEQ ID NO: 475078 - RNA, 63 nt, hsa
uuagauuguguuccugaagaaaagaguccagguaaaugguaugaucaauaaaggacaggcugg

SEQ ID NO: 475079 - RNA, 63 nt, hsa
uugaaaaagaguuucauuguggagagaaaaagcaaaugguaugccacaagaucacucugauuu

SEQ ID NO: 475080 - RNA, 63 nt, hsa
caauggaaaugcuauacguuuuugacauuuauuaaaugguaccaauaaaguauuuuauuacca

SEQ ID NO: 475081 - RNA, 63 nt, hsa
gucaacgcaacgucuaacuggacuucccaagauaaaugguaccagcguccucuuaaaagaugc

SEQ ID NO: 475082 - RNA, 63 nt, hsa
gcagagguggaaaaauacuuuugcuuucagggaaaaugguauaacguuaauuuauuaauaaau

SEQ ID NO: 475083 - RNA, 63 nt, hsa
uucccugcaguccaaagaugauuuuuucaccacaaaugguaagggaugcccaccuacuuuuau

SEQ ID NO: 475084 - RNA, 63 nt, hsa
ccaggugccaacugcuaagcagauauauuccaaaaaugguaacugucaugugcacacuguugg

SEQ ID NO: 475085 - RNA, 63 nt, hsa
ugugauuagugccuaggggucuccauuuagcagaaaugguaaugacagugauauaaugccugg

SEQ ID NO: 475086 - RNA, 63 nt, hsa
guuguuguuuuuuuaagcuucccuugagagaauaaaugguaauggagagaacuauuuaacaag

SEQ ID NO: 475087 - RNA, 63 nt, hsa
aauauugccauuaugcuugacaugguuuccaaaaaaugguacuccacauauuucagugagggu

SEQ ID NO: 475088 - RNA, 63 nt, hsa
cccccuguuucagaggcucagauuguaauauguaaaugguaugucauucgcuacuaugauuua

SEQ ID NO: 475089 - RNA, 63 nt, hsa
gugggucaaauauuauaaaauaggcaaacaccaaaaugguauuaaauauugaacuccugaccu

SEQ ID NO: 475090 - RNA, 63 nt, hsa
cagaaauggaacacuguaucuuuauauuccuaaaaaugguacuuuuggcauaauuaagaaauu

SEQ ID NO: 475091 - RNA, 63 nt, hsa
cccuuuuaaaccuguuaacuugaaggagaacagaaaugguauuacuucaauagugguagauuu

SEQ ID NO: 475092 - RNA, 63 nt, hsa
cuaacuauaaauguaaugaauuauaauaauuauaaaugguauaaaugcauucuacaaugugau

SEQ ID NO: 475093 - RNA, 63 nt, hsa
auaaauacaccuuuuuuucccucuucccccuaaaaaugguaaaucugaucauaucuacaugua

SEQ ID NO: 475094 - RNA, 63 nt, hsa
guaaauuuguauauguuauuuaccuucagaucuaaaugguaaucugaacccaaauuuguauaa

SEQ ID NO: 475095 - RNA, 52 nt, hsa
aaggagcgguguccucuuaagaaaaugguaaugucugggaauccgagacaca

SEQ ID NO: 475096 - RNA, 63 nt, hsa
aucugcuaaacaggacuucagguaagugaggugaaaugguagccagugacccguuaggagcuc

SEQ ID NO: 475097 - RNA, 63 nt, hsa
gguguuucauacagaaugucuucauaucaucugaaaugguauggcugaaguucauuuguuuac

SEQ ID NO: 475098 - RNA, 64 nt, hsa
ucuaaaagaacaacauugucuuucuuuucuagcacagaguuaugcauucaaagaugcauaccua

SEQ ID NO: 475099 - RNA, 64 nt, hsa
gacagacugagcaaaauugcuugcaaaaguggcacagaguuagcacuccauaccccuucaaaca

SEQ ID NO: 475100 - RNA, 64 nt, hsa
cccugugguccggcagugcuaccaugguaauggacagaguuaucaaggcacauucuccaccacu

SEQ ID NO: 475101 - RNA, 64 nt, hsa
gccuugggagcagcagugcuaccacgguaauggacagaguuaucgaggcacauacuucaccacu

SEQ ID NO: 475102 - RNA, 64 nt, hsa
gccuucaauguaggagugcuaccauggaaauggacagaguuaucgaggcacauacuucaccacc

SEQ ID NO: 475103 - RNA, 64 nt, hsa
uuguacacagggaauguaaauaaggauaacugaucagaguuauccacuguauuuauaaggaaga

SEQ ID NO: 475104 - RNA, 64 nt, hsa
cagaaaaauagaaaaugcacagcuuuaaaaugggcagaguuaaaaucuauucccagcuuuauca

SEQ ID NO: 475105 - RNA, 64 nt, hsa
cugcccggagucgcccgggagcaggugcugcagccagaguuacgcgggggccacgcgggccggc

SEQ ID NO: 475106 - RNA, 64 nt, hsa
acucuuuugcaaauuaacaauuuuaucacugauucagaguuaaaaagaagacuaacuuuucaag

SEQ ID NO: 475107 - RNA, 64 nt, hsa; identical to SEQ ID NO: 443317

SEQ ID NO: 475108 - RNA, 64 nt, hsa; identical to SEQ ID NO: 443318

SEQ ID NO: 475109 - RNA, 64 nt, hsa; identical to SEQ ID NO: 443319

SEQ ID NO: 475110 - RNA, 64 nt, hsa; identical to SEQ ID NO: 443320

SEQ ID NO: 475111 - RNA, 64 nt, hsa; identical to SEQ ID NO: 443321

SEQ ID NO: 475112 - RNA, 64 nt, hsa; identical to SEQ ID NO: 443322

SEQ ID NO: 475113 - RNA, 64 nt, hsa; identical to SEQ ID NO: 443323

SEQ ID NO: 475114 - RNA, 64 nt, hsa; identical to SEQ ID NO: 443324

SEQ ID NO: 475115 - RNA, 64 nt, hsa; identical to SEQ ID NO: 443325

SEQ ID NO: 475116 - RNA, 64 nt, hsa; identical to SEQ ID NO: 443326

SEQ ID NO: 475117 - RNA, 64 nt, hsa; identical to SEQ ID NO: 443327

SEQ ID NO: 475118 - RNA, 64 nt, hsa; identical to SEQ ID NO: 443328

SEQ ID NO: 475119 - RNA, 64 nt, hsa; identical to SEQ ID NO: 443329

SEQ ID NO: 475120 - RNA, 64 nt, hsa; identical to SEQ ID NO: 443330

SEQ ID NO: 475121 - RNA, 64 nt, hsa; identical to SEQ ID NO: 443331

SEQ ID NO: 475122 - RNA, 64 nt, hsa; identical to SEQ ID NO: 443332

SEQ ID NO: 475123 - RNA, 64 nt, hsa; identical to SEQ ID NO: 443333

SEQ ID NO: 475124 - RNA, 64 nt, hsa; identical to SEQ ID NO: 443334

SEQ ID NO: 475125 - RNA, 64 nt, hsa; identical to SEQ ID NO: 443335

SEQ ID NO: 475126 - RNA, 64 nt, hsa; identical to SEQ ID NO: 443336

SEQ ID NO: 475127 - RNA, 64 nt, hsa; identical to SEQ ID NO: 443337

SEQ ID NO: 475128 - RNA, 64 nt, hsa; identical to SEQ ID NO: 443338

SEQ ID NO: 475129 - RNA, 64 nt, hsa; identical to SEQ ID NO: 443339

SEQ ID NO: 475130 - RNA, 64 nt, hsa; identical to SEQ ID NO: 443340

SEQ ID NO: 475131 - RNA, 64 nt, hsa; identical to SEQ ID NO: 443341

SEQ ID NO: 475132 - RNA, 64 nt, hsa; identical to SEQ ID NO: 443342

SEQ ID NO: 475133 - RNA, 64 nt, hsa; identical to SEQ ID NO: 443343

SEQ ID NO: 475134 - RNA, 64 nt, hsa; identical to SEQ ID NO: 443344

SEQ ID NO: 475135 - RNA, 64 nt, hsa
uugguccacuaaaacaagaugaaaaauacaagagugacucuauaacucuggucuuuaagaaagc

SEQ ID NO: 475136 - RNA, 64 nt, hsa
uucucuagauauuuaauacagagaguguauagacugacucuaaguuaauaaugugcaaaauauc

SEQ ID NO: 475137 - RNA, 64 nt, hsa
auguauuaugaaaaaauaaaguuguaauuucugaugacucuaagucccuuucuuugguuaauaa

SEQ ID NO: 475138 - RNA, 64 nt, hsa
uuuccaaaacuugcacgugucccugaauuccaucugacucuaauuuuaugagaauugcagaacu

SEQ ID NO: 475139 - RNA, 64 nt, hsa
aaaacucuguaucuguuucuagcaugugcugcauugacucuauuaaucacauuucaaauucacc

SEQ ID NO: 475140 - RNA, 64 nt, hsa
uuuuuaaauaucuuuuuccuucuacuccucccucugacucuaagaauucucucuucuggaaucg

SEQ ID NO: 475141 - RNA, 64 nt, hsa
agaaaaacccauaaccaccucagauggaucugacguggcuaagggacaaacagcaaauauuuca

SEQ ID NO: 475142 - RNA, 64 nt, hsa
gugugugugugugugugugugugugcacguguguguggcuaaauuaagucauacugucaaccac

SEQ ID NO: 475143 - RNA, 64 nt, hsa
uaauuaguugcuuucacuauuuccgaauauaccuguggcuaaguuuuuauugaaacacucaaaa

SEQ ID NO: 475144 - RNA, 64 nt, hsa
uuuugccaaggcugcuugugcuaccaguuugcugguggcuaacggcuugugcuugaaagucuuc

SEQ ID NO: 475145 - RNA, 64 nt, hsa; identical to SEQ ID NO: 223145

SEQ ID NO: 475146 - RNA, 64 nt, hsa; identical to SEQ ID NO: 223146

SEQ ID NO: 475147 - RNA, 64 nt, hsa; identical to SEQ ID NO: 223147

SEQ ID NO: 475148 - RNA, 64 nt, hsa; identical to SEQ ID NO: 223148

SEQ ID NO: 475149 - RNA, 64 nt, hsa; identical to SEQ ID NO: 223149

SEQ ID NO: 475150 - RNA, 64 nt, hsa; identical to SEQ ID NO: 223150

SEQ ID NO: 475151 - RNA, 64 nt, hsa; identical to SEQ ID NO: 223151

SEQ ID NO: 475152 - RNA, 64 nt, hsa; identical to SEQ ID NO: 223152

SEQ ID NO: 475153 - RNA, 64 nt, hsa; identical to SEQ ID NO: 223153

SEQ ID NO: 475154 - RNA, 64 nt, hsa; identical to SEQ ID NO: 223154

SEQ ID NO: 475155 - RNA, 64 nt, hsa; identical to SEQ ID NO: 223155

SEQ ID NO: 475156 - RNA, 64 nt, hsa; identical to SEQ ID NO: 223156

SEQ ID NO: 475157 - RNA, 64 nt, hsa; identical to SEQ ID NO: 223157

SEQ ID NO: 475158 - RNA, 64 nt, hsa; identical to SEQ ID NO: 223158

SEQ ID NO: 475159 - RNA, 64 nt, hsa; identical to SEQ ID NO: 223159

SEQ ID NO: 475160 - RNA, 64 nt, hsa; identical to SEQ ID NO: 223160

SEQ ID NO: 475161 - RNA, 64 nt, hsa; identical to SEQ ID NO: 223161

SEQ ID NO: 475162 - RNA, 64 nt, hsa; identical to SEQ ID NO: 223162

SEQ ID NO: 475163 - RNA, 64 nt, hsa; identical to SEQ ID NO: 223163

SEQ ID NO: 475164 - RNA, 64 nt, hsa; identical to SEQ ID NO: 223164

SEQ ID NO: 475165 - RNA, 64 nt, hsa; identical to SEQ ID NO: 223165

SEQ ID NO: 475166 - RNA, 64 nt, hsa; identical to SEQ ID NO: 223166

SEQ ID NO: 475167 - RNA, 64 nt, hsa; identical to SEQ ID NO: 223167

SEQ ID NO: 475168 - RNA, 64 nt, hsa; identical to SEQ ID NO: 223168

SEQ ID NO: 475169 - RNA, 64 nt, hsa; identical to SEQ ID NO: 223169

SEQ ID NO: 475170 - RNA, 64 nt, hsa; identical to SEQ ID NO: 223170

SEQ ID NO: 475171 - RNA, 64 nt, hsa; identical to SEQ ID NO: 223171

SEQ ID NO: 475172 - RNA, 64 nt, hsa; identical to SEQ ID NO: 223172

SEQ ID NO: 475173 - RNA, 64 nt, hsa; identical to SEQ ID NO: 223173

SEQ ID NO: 475174 - RNA, 64 nt, hsa; identical to SEQ ID NO: 223174

SEQ ID NO: 475175 - RNA, 64 nt, hsa; identical to SEQ ID NO: 223175

SEQ ID NO: 475176 - RNA, 64 nt, hsa; identical to SEQ ID NO: 223176

SEQ ID NO: 475177 - RNA, 64 nt, hsa; identical to SEQ ID NO: 223177

SEQ ID NO: 475178 - RNA, 64 nt, hsa; identical to SEQ ID NO: 223178

SEQ ID NO: 475179 - RNA, 64 nt, hsa; identical to SEQ ID NO: 223179

SEQ ID NO: 475180 - RNA, 64 nt, hsa; identical to SEQ ID NO: 223180

SEQ ID NO: 475181 - RNA, 64 nt, hsa; identical to SEQ ID NO: 223181

SEQ ID NO: 475182 - RNA, 64 nt, hsa; identical to SEQ ID NO: 223182

SEQ ID NO: 475183 - RNA, 64 nt, hsa; identical to SEQ ID NO: 223183

SEQ ID NO: 475184 - RNA, 64 nt, hsa; identical to SEQ ID NO: 223184

SEQ ID NO: 475185 - RNA, 64 nt, hsa; identical to SEQ ID NO: 223185

SEQ ID NO: 475186 - RNA, 64 nt, hsa; identical to SEQ ID NO: 223186

SEQ ID NO: 475187 - RNA, 64 nt, hsa; identical to SEQ ID NO: 223187

SEQ ID NO: 475188 - RNA, 64 nt, hsa; identical to SEQ ID NO: 223188

SEQ ID NO: 475189 - RNA, 64 nt, hsa; identical to SEQ ID NO: 223189

SEQ ID NO: 475190 - RNA, 64 nt, hsa; identical to SEQ ID NO: 223190

SEQ ID NO: 475191 - RNA, 64 nt, hsa; identical to SEQ ID NO: 223191

SEQ ID NO: 475192 - RNA, 64 nt, hsa; identical to SEQ ID NO: 223192

SEQ ID NO: 475193 - RNA, 64 nt, hsa; identical to SEQ ID NO: 223193

SEQ ID NO: 475194 - RNA, 64 nt, hsa; identical to SEQ ID NO: 223194

SEQ ID NO: 475195 - RNA, 64 nt, hsa; identical to SEQ ID NO: 223195

SEQ ID NO: 475196 - RNA, 57 nt, hsa; identical to SEQ ID NO: 223196

SEQ ID NO: 475197 - RNA, 64 nt, hsa; identical to SEQ ID NO: 223197

SEQ ID NO: 475198 - RNA, 54 nt, hsa; identical to SEQ ID NO: 223198

SEQ ID NO: 475199 - RNA, 64 nt, hsa; identical to SEQ ID NO: 426665

SEQ ID NO: 475200 - RNA, 64 nt, hsa; identical to SEQ ID NO: 426666

SEQ ID NO: 475201 - RNA, 64 nt, hsa; identical to SEQ ID NO: 426667

SEQ ID NO: 475202 - RNA, 64 nt, hsa; identical to SEQ ID NO: 426668

SEQ ID NO: 475203 - RNA, 64 nt, hsa; identical to SEQ ID NO: 426669

SEQ ID NO: 475204 - RNA, 64 nt, hsa; identical to SEQ ID NO: 426670

SEQ ID NO: 475205 - RNA, 64 nt, hsa; identical to SEQ ID NO: 426671

SEQ ID NO: 475206 - RNA, 64 nt, hsa; identical to SEQ ID NO: 426672

SEQ ID NO: 475207 - RNA, 64 nt, hsa; identical to SEQ ID NO: 426673

SEQ ID NO: 475208 - RNA, 64 nt, hsa; identical to SEQ ID NO: 426674

SEQ ID NO: 475209 - RNA, 64 nt, hsa; identical to SEQ ID NO: 426675

SEQ ID NO: 475210 - RNA, 64 nt, hsa; identical to SEQ ID NO: 426676

SEQ ID NO: 475211 - RNA, 64 nt, hsa; identical to SEQ ID NO: 426677

SEQ ID NO: 475212 - RNA, 64 nt, hsa; identical to SEQ ID NO: 426678

SEQ ID NO: 475213 - RNA, 64 nt, hsa; identical to SEQ ID NO: 426679

SEQ ID NO: 475214 - RNA, 64 nt, hsa; identical to SEQ ID NO: 426680

SEQ ID NO: 475215 - RNA, 64 nt, hsa; identical to SEQ ID NO: 426681

SEQ ID NO: 475216 - RNA, 64 nt, hsa; identical to SEQ ID NO: 426682

SEQ ID NO: 475217 - RNA, 64 nt, hsa
uaauauucucuccgccauugagaaugugcuuuguaagauccacccccugcccacaaaaaauugc

SEQ ID NO: 475218 - RNA, 64 nt, hsa
ugcacguauacacccagauggccugaagcaacugaagauccacaaaagaagugaaaauagccag

SEQ ID NO: 475219 - RNA, 64 nt, hsa
uguguguaguuuuguaaacacuauagcaucuguuaagauccaguguccauggaaacauucccac

SEQ ID NO: 475220 - RNA, 64 nt, hsa
gccaggggaagaagcaucuucauaaaaaacuuucaagauccaaacauuaauuuguuuuuauuua

SEQ ID NO: 475221 - RNA, 64 nt, hsa
uaaacugagcaaaacugcagcuggcugacaauggaagauccaggugccaauccacagccccacc

SEQ ID NO: 475222 - RNA, 64 nt, hsa
aauuguuugguaaccccuaaucaagagaggccccaagauccacaacucgagugguuaaagcuua

SEQ ID NO: 475223 - RNA, 64 nt, hsa
aauaccacccauguaacauuccuucaaccacuugaagauccaaauucccaacuaguauucucuu

SEQ ID NO: 475224 - RNA, 64 nt, hsa
aucuaugaaggcaaaaggugacaguaaaaacaguaagauccauaugcauaagauuguacaaggc

SEQ ID NO: 475225 - RNA, 64 nt, hsa; identical to SEQ ID NO: 77572

SEQ ID NO: 475226 - RNA, 64 nt, hsa; identical to SEQ ID NO: 77573

SEQ ID NO: 475227 - RNA, 64 nt, hsa; identical to SEQ ID NO: 77574

SEQ ID NO: 475228 - RNA, 64 nt, hsa; identical to SEQ ID NO: 77575

SEQ ID NO: 475229 - RNA, 64 nt, hsa; identical to SEQ ID NO: 77576

SEQ ID NO: 475230 - RNA, 64 nt, hsa; identical to SEQ ID NO: 77577

SEQ ID NO: 475231 - RNA, 64 nt, hsa; identical to SEQ ID NO: 77578

SEQ ID NO: 475232 - RNA, 64 nt, hsa; identical to SEQ ID NO: 77579

SEQ ID NO: 475233 - RNA, 64 nt, hsa; identical to SEQ ID NO: 77580

SEQ ID NO: 475234 - RNA, 64 nt, hsa; identical to SEQ ID NO: 77581

SEQ ID NO: 475235 - RNA, 64 nt, hsa; identical to SEQ ID NO: 77582

SEQ ID NO: 475236 - RNA, 64 nt, hsa; identical to SEQ ID NO: 77583

SEQ ID NO: 475237 - RNA, 64 nt, hsa; identical to SEQ ID NO: 77584

SEQ ID NO: 475238 - RNA, 64 nt, hsa; identical to SEQ ID NO: 77585

SEQ ID NO: 475239 - RNA, 64 nt, hsa; identical to SEQ ID NO: 77586

SEQ ID NO: 475240 - RNA, 64 nt, hsa; identical to SEQ ID NO: 77587

SEQ ID NO: 475241 - RNA, 64 nt, hsa; identical to SEQ ID NO: 77588

SEQ ID NO: 475242 - RNA, 64 nt, hsa; identical to SEQ ID NO: 77589

SEQ ID NO: 475243 - RNA, 56 nt, hsa; identical to SEQ ID NO: 77590

SEQ ID NO: 475244 - RNA, 64 nt, hsa; identical to SEQ ID NO: 77591

SEQ ID NO: 475245 - RNA, 64 nt, hsa; identical to SEQ ID NO: 77592

SEQ ID NO: 475246 - RNA, 64 nt, hsa; identical to SEQ ID NO: 77593

SEQ ID NO: 475247 - RNA, 64 nt, hsa; identical to SEQ ID NO: 77594

SEQ ID NO: 475248 - RNA, 64 nt, hsa; identical to SEQ ID NO: 77595

SEQ ID NO: 475249 - RNA, 64 nt, hsa; identical to SEQ ID NO: 77596

SEQ ID NO: 475250 - RNA, 64 nt, hsa; identical to SEQ ID NO: 77597

SEQ ID NO: 475251 - RNA, 64 nt, hsa; identical to SEQ ID NO: 77598

SEQ ID NO: 475252 - RNA, 64 nt, hsa; identical to SEQ ID NO: 77599

SEQ ID NO: 475253 - RNA, 64 nt, hsa; identical to SEQ ID NO: 77600

SEQ ID NO: 475254 - RNA, 64 nt, hsa; identical to SEQ ID NO: 77601

SEQ ID NO: 475255 - RNA, 64 nt, hsa; identical to SEQ ID NO: 77602

SEQ ID NO: 475256 - RNA, 64 nt, hsa; identical to SEQ ID NO: 77603

SEQ ID NO: 475257 - RNA, 64 nt, hsa; identical to SEQ ID NO: 77604

SEQ ID NO: 475258 - RNA, 64 nt, hsa; identical to SEQ ID NO: 77605

SEQ ID NO: 475259 - RNA, 64 nt, hsa; identical to SEQ ID NO: 77606

SEQ ID NO: 475260 - RNA, 64 nt, hsa; identical to SEQ ID NO: 77607

SEQ ID NO: 475261 - RNA, 64 nt, hsa; identical to SEQ ID NO: 77608

SEQ ID NO: 475262 - RNA, 64 nt, hsa; identical to SEQ ID NO: 77609

SEQ ID NO: 475263 - RNA, 64 nt, hsa; identical to SEQ ID NO: 77610

SEQ ID NO: 475264 - RNA, 64 nt, hsa; identical to SEQ ID NO: 77611

SEQ ID NO: 475265 - RNA, 64 nt, hsa; identical to SEQ ID NO: 77612

SEQ ID NO: 475266 - RNA, 64 nt, hsa; identical to SEQ ID NO: 77613

SEQ ID NO: 475267 - RNA, 64 nt, hsa; identical to SEQ ID NO: 77614

SEQ ID NO: 475268 - RNA, 64 nt, hsa; identical to SEQ ID NO: 77615

SEQ ID NO: 475269 - RNA, 64 nt, hsa; identical to SEQ ID NO: 77616

SEQ ID NO: 475270 - RNA, 64 nt, hsa; identical to SEQ ID NO: 77617

SEQ ID NO: 475271 - RNA, 64 nt, hsa; identical to SEQ ID NO: 77618

SEQ ID NO: 475272 - RNA, 64 nt, hsa; identical to SEQ ID NO: 77619

SEQ ID NO: 475273 - RNA, 64 nt, hsa; identical to SEQ ID NO: 77620

SEQ ID NO: 475274 - RNA, 64 nt, hsa; identical to SEQ ID NO: 77621

SEQ ID NO: 475275 - RNA, 64 nt, hsa; identical to SEQ ID NO: 77622

SEQ ID NO: 475276 - RNA, 64 nt, hsa; identical to SEQ ID NO: 77623

SEQ ID NO: 475277 - RNA, 64 nt, hsa; identical to SEQ ID NO: 77624

SEQ ID NO: 475278 - RNA, 64 nt, hsa; identical to SEQ ID NO: 77625

SEQ ID NO: 475279 - RNA, 64 nt, hsa; identical to SEQ ID NO: 77626

SEQ ID NO: 475280 - RNA, 64 nt, hsa; identical to SEQ ID NO: 77627

SEQ ID NO: 475281 - RNA, 64 nt, hsa; identical to SEQ ID NO: 77628

SEQ ID NO: 475282 - RNA, 64 nt, hsa; identical to SEQ ID NO: 77629

SEQ ID NO: 475283 - RNA, 64 nt, hsa; identical to SEQ ID NO: 77630

SEQ ID NO: 475284 - RNA, 64 nt, hsa; identical to SEQ ID NO: 77631

SEQ ID NO: 475285 - RNA, 64 nt, hsa; identical to SEQ ID NO: 77632

SEQ ID NO: 475286 - RNA, 64 nt, hsa; identical to SEQ ID NO: 77633

SEQ ID NO: 475287 - RNA, 64 nt, hsa; identical to SEQ ID NO: 77634

SEQ ID NO: 475288 - RNA, 64 nt, hsa; identical to SEQ ID NO: 77635

SEQ ID NO: 475289 - RNA, 64 nt, hsa; identical to SEQ ID NO: 77636

SEQ ID NO: 475290 - RNA, 64 nt, hsa; identical to SEQ ID NO: 77637

SEQ ID NO: 475291 - RNA, 64 nt, hsa; identical to SEQ ID NO: 77638

SEQ ID NO: 475292 - RNA, 64 nt, hsa; identical to SEQ ID NO: 77639

SEQ ID NO: 475293 - RNA, 64 nt, hsa; identical to SEQ ID NO: 77640

SEQ ID NO: 475294 - RNA, 64 nt, hsa; identical to SEQ ID NO: 77641

SEQ ID NO: 475295 - RNA, 64 nt, hsa; identical to SEQ ID NO: 77642

SEQ ID NO: 475296 - RNA, 64 nt, hsa; identical to SEQ ID NO: 77643

SEQ ID NO: 475297 - RNA, 64 nt, hsa; identical to SEQ ID NO: 77644

SEQ ID NO: 475298 - RNA, 64 nt, hsa; identical to SEQ ID NO: 77645

SEQ ID NO: 475299 - RNA, 64 nt, hsa; identical to SEQ ID NO: 77646

SEQ ID NO: 475300 - RNA, 64 nt, hsa; identical to SEQ ID NO: 77647

SEQ ID NO: 475301 - RNA, 64 nt, hsa; identical to SEQ ID NO: 77648

SEQ ID NO: 475302 - RNA, 64 nt, hsa; identical to SEQ ID NO: 77649

SEQ ID NO: 475303 - RNA, 64 nt, hsa; identical to SEQ ID NO: 77650

SEQ ID NO: 475304 - RNA, 64 nt, hsa; identical to SEQ ID NO: 77651

SEQ ID NO: 475305 - RNA, 64 nt, hsa; identical to SEQ ID NO: 77652

SEQ ID NO: 475306 - RNA, 64 nt, hsa; identical to SEQ ID NO: 77653

SEQ ID NO: 475307 - RNA, 64 nt, hsa; identical to SEQ ID NO: 77654

SEQ ID NO: 475308 - RNA, 64 nt, hsa; identical to SEQ ID NO: 77655

SEQ ID NO: 475309 - RNA, 64 nt, hsa; identical to SEQ ID NO: 77656

SEQ ID NO: 475310 - RNA, 64 nt, hsa; identical to SEQ ID NO: 77657

SEQ ID NO: 475311 - RNA, 64 nt, hsa; identical to SEQ ID NO: 77658

SEQ ID NO: 475312 - RNA, 64 nt, hsa; identical to SEQ ID NO: 77659

SEQ ID NO: 475313 - RNA, 64 nt, hsa; identical to SEQ ID NO: 77660

SEQ ID NO: 475314 - RNA, 63 nt, hsa; identical to SEQ ID NO: 77661

SEQ ID NO: 475315 - RNA, 64 nt, hsa; identical to SEQ ID NO: 77662

SEQ ID NO: 475316 - RNA, 64 nt, hsa; identical to SEQ ID NO: 77663

SEQ ID NO: 475317 - RNA, 64 nt, hsa; identical to SEQ ID NO: 77664

SEQ ID NO: 475318 - RNA, 64 nt, hsa; identical to SEQ ID NO: 77665

SEQ ID NO: 475319 - RNA, 64 nt, hsa; identical to SEQ ID NO: 77666

SEQ ID NO: 475320 - RNA, 64 nt, hsa; identical to SEQ ID NO: 77667

SEQ ID NO: 475321 - RNA, 64 nt, hsa; identical to SEQ ID NO: 77668

SEQ ID NO: 475322 - RNA, 64 nt, hsa; identical to SEQ ID NO: 77669

SEQ ID NO: 475323 - RNA, 64 nt, hsa; identical to SEQ ID NO: 77670

SEQ ID NO: 475324 - RNA, 64 nt, hsa; identical to SEQ ID NO: 77671

SEQ ID NO: 475325 - RNA, 64 nt, hsa; identical to SEQ ID NO: 77672

SEQ ID NO: 475326 - RNA, 64 nt, hsa; identical to SEQ ID NO: 77673

SEQ ID NO: 475327 - RNA, 64 nt, hsa; identical to SEQ ID NO: 77674

SEQ ID NO: 475328 - RNA, 64 nt, hsa; identical to SEQ ID NO: 77675

SEQ ID NO: 475329 - RNA, 64 nt, hsa; identical to SEQ ID NO: 77676

SEQ ID NO: 475330 - RNA, 64 nt, hsa; identical to SEQ ID NO: 77677

SEQ ID NO: 475331 - RNA, 64 nt, hsa; identical to SEQ ID NO: 77678

SEQ ID NO: 475332 - RNA, 64 nt, hsa; identical to SEQ ID NO: 77679

SEQ ID NO: 475333 - RNA, 64 nt, hsa; identical to SEQ ID NO: 77680

SEQ ID NO: 475334 - RNA, 64 nt, hsa; identical to SEQ ID NO: 77681

SEQ ID NO: 475335 - RNA, 64 nt, hsa; identical to SEQ ID NO: 77682

SEQ ID NO: 475336 - RNA, 64 nt, hsa; identical to SEQ ID NO: 77683

SEQ ID NO: 475337 - RNA, 57 nt, hsa; identical to SEQ ID NO: 77684

SEQ ID NO: 475338 - RNA, 64 nt, hsa; identical to SEQ ID NO: 77685

SEQ ID NO: 475339 - RNA, 64 nt, hsa; identical to SEQ ID NO: 77686

SEQ ID NO: 475340 - RNA, 64 nt, hsa; identical to SEQ ID NO: 77687

SEQ ID NO: 475341 - RNA, 64 nt, hsa; identical to SEQ ID NO: 77688

SEQ ID NO: 475342 - RNA, 64 nt, hsa; identical to SEQ ID NO: 77689

SEQ ID NO: 475343 - RNA, 64 nt, hsa; identical to SEQ ID NO: 77690

SEQ ID NO: 475344 - RNA, 64 nt, hsa; identical to SEQ ID NO: 77691

SEQ ID NO: 475345 - RNA, 64 nt, hsa; identical to SEQ ID NO: 77692

SEQ ID NO: 475346 - RNA, 64 nt, hsa; identical to SEQ ID NO: 77693

SEQ ID NO: 475347 - RNA, 64 nt, hsa; identical to SEQ ID NO: 77694

SEQ ID NO: 475348 - RNA, 64 nt, hsa; identical to SEQ ID NO: 77695

SEQ ID NO: 475349 - RNA, 64 nt, hsa; identical to SEQ ID NO: 77696

SEQ ID NO: 475350 - RNA, 64 nt, hsa; identical to SEQ ID NO: 77697

SEQ ID NO: 475351 - RNA, 64 nt, hsa; identical to SEQ ID NO: 77698

SEQ ID NO: 475352 - RNA, 64 nt, hsa; identical to SEQ ID NO: 77699

SEQ ID NO: 475353 - RNA, 64 nt, hsa; identical to SEQ ID NO: 77700

SEQ ID NO: 475354 - RNA, 64 nt, hsa; identical to SEQ ID NO: 77701

SEQ ID NO: 475355 - RNA, 64 nt, hsa; identical to SEQ ID NO: 77702

SEQ ID NO: 475356 - RNA, 63 nt, hsa; identical to SEQ ID NO: 77703

SEQ ID NO: 475357 - RNA, 64 nt, hsa; identical to SEQ ID NO: 77704

SEQ ID NO: 475358 - RNA, 64 nt, hsa; identical to SEQ ID NO: 77705

SEQ ID NO: 475359 - RNA, 64 nt, hsa; identical to SEQ ID NO: 77706

SEQ ID NO: 475360 - RNA, 64 nt, hsa; identical to SEQ ID NO: 77707

SEQ ID NO: 475361 - RNA, 64 nt, hsa; identical to SEQ ID NO: 77708

SEQ ID NO: 475362 - RNA, 64 nt, hsa; identical to SEQ ID NO: 77709

SEQ ID NO: 475363 - RNA, 64 nt, hsa; identical to SEQ ID NO: 77710

SEQ ID NO: 475364 - RNA, 64 nt, hsa; identical to SEQ ID NO: 77711

SEQ ID NO: 475365 - RNA, 64 nt, hsa; identical to SEQ ID NO: 77712

SEQ ID NO: 475366 - RNA, 64 nt, hsa; identical to SEQ ID NO: 77713

SEQ ID NO: 475367 - RNA, 64 nt, hsa; identical to SEQ ID NO: 77714

SEQ ID NO: 475368 - RNA, 64 nt, hsa; identical to SEQ ID NO: 77715

SEQ ID NO: 475369 - RNA, 64 nt, hsa; identical to SEQ ID NO: 77716

SEQ ID NO: 475370 - RNA, 64 nt, hsa; identical to SEQ ID NO: 77717

SEQ ID NO: 475371 - RNA, 64 nt, hsa; identical to SEQ ID NO: 77718

SEQ ID NO: 475372 - RNA, 64 nt, hsa; identical to SEQ ID NO: 77719

SEQ ID NO: 475373 - RNA, 64 nt, hsa; identical to SEQ ID NO: 77720

SEQ ID NO: 475374 - RNA, 64 nt, hsa; identical to SEQ ID NO: 77721

SEQ ID NO: 475375 - RNA, 64 nt, hsa; identical to SEQ ID NO: 77722

SEQ ID NO: 475376 - RNA, 64 nt, hsa; identical to SEQ ID NO: 77723

SEQ ID NO: 475377 - RNA, 64 nt, hsa; identical to SEQ ID NO: 77724

SEQ ID NO: 475378 - RNA, 64 nt, hsa; identical to SEQ ID NO: 77725

SEQ ID NO: 475379 - RNA, 64 nt, hsa; identical to SEQ ID NO: 77726

SEQ ID NO: 475380 - RNA, 64 nt, hsa; identical to SEQ ID NO: 77727

SEQ ID NO: 475381 - RNA, 64 nt, hsa; identical to SEQ ID NO: 77728

SEQ ID NO: 475382 - RNA, 64 nt, hsa; identical to SEQ ID NO: 77729

SEQ ID NO: 475383 - RNA, 64 nt, hsa; identical to SEQ ID NO: 77730

SEQ ID NO: 475384 - RNA, 64 nt, hsa; identical to SEQ ID NO: 77731

SEQ ID NO: 475385 - RNA, 64 nt, hsa; identical to SEQ ID NO: 77732

SEQ ID NO: 475386 - RNA, 64 nt, hsa; identical to SEQ ID NO: 77733

SEQ ID NO: 475387 - RNA, 64 nt, hsa; identical to SEQ ID NO: 77734

SEQ ID NO: 475388 - RNA, 64 nt, hsa; identical to SEQ ID NO: 77735

SEQ ID NO: 475389 - RNA, 50 nt, hsa; identical to SEQ ID NO: 77736

SEQ ID NO: 475390 - RNA, 64 nt, hsa; identical to SEQ ID NO: 77737

SEQ ID NO: 475391 - RNA, 64 nt, hsa; identical to SEQ ID NO: 77738

SEQ ID NO: 475392 - RNA, 64 nt, hsa; identical to SEQ ID NO: 77739

SEQ ID NO: 475393 - RNA, 64 nt, hsa; identical to SEQ ID NO: 77740

SEQ ID NO: 475394 - RNA, 64 nt, hsa; identical to SEQ ID NO: 77741

SEQ ID NO: 475395 - RNA, 64 nt, hsa; identical to SEQ ID NO: 77742

SEQ ID NO: 475396 - RNA, 64 nt, hsa; identical to SEQ ID NO: 77743

SEQ ID NO: 475397 - RNA, 64 nt, hsa; identical to SEQ ID NO: 77744

SEQ ID NO: 475398 - RNA, 64 nt, hsa
gggauauuuuuguugcuuuuacuuucaugguuagagcuacaaagaacagugauuuuuuuuuuuu

SEQ ID NO: 475399 - RNA, 53 nt, hsa
accaaaguacugaugaauagaggagcuacaaugauagcuguuuccuggauucc

SEQ ID NO: 475400 - RNA, 64 nt, hsa
auaauaaauaacgggcuuuauuguuuauuuuaaaagcuacaauuuguuuuagcugguuucucug

SEQ ID NO: 475401 - RNA, 64 nt, hsa
cuuaauucucuuuucccuaggugccaucuccucaagcuacaaaauguccacaucuuauaucccc

SEQ ID NO: 475402 - RNA, 64 nt, hsa
gagcccccagcagggcccuccgagguggagcagcagcuacaagcagaggcugaacaccugcgga

SEQ ID NO: 475403 - RNA, 64 nt, hsa
gagcccccagcagggcccuccgagguggaacagcagcuacaagcagaggcugaacaccugcgga

SEQ ID NO: 475404 - RNA, 64 nt, hsa
ccccaccuucuccuuuuuggcaugucuggugaaaagcuacaagguucacagggccaaauauucu

SEQ ID NO: 475405 - RNA, 64 nt, hsa
ggggagaacauuucugaaaaagaacuuauaaugaagcuacaaauccauccuuauuucuuauuca

SEQ ID NO: 475406 - RNA, 64 nt, hsa; identical to SEQ ID NO: 418163

SEQ ID NO: 475407 - RNA, 64 nt, hsa; identical to SEQ ID NO: 418164

SEQ ID NO: 475408 - RNA, 64 nt, hsa
ucaagauccuaugucuguuguauuuucucuuugccuggaguaaauagcauuauaagucauucca

SEQ ID NO: 475409 - RNA, 57 nt, hsa
aggacagcaagaagaacugaggccugucuggaguacguagaccagugucgucgugag

SEQ ID NO: 475410 - RNA, 65 nt, hsa
gucauuuuguaauauuugaauuuuuacauuuguuguacaaucaggaaaagcaauaaagauuuuuc

SEQ ID NO: 475411 - RNA, 65 nt, hsa
ugauuuuuagcagguuuagaggcugcagcuugagcuacaaucaggagggaaauuggaaggauuag

SEQ ID NO: 475412 - RNA, 65 nt, hsa
caacuacuuuuaaaguagaaaagcuauccauuuuauacaaucacugauacagucuaugucaaaaa

SEQ ID NO: 475413 - RNA, 65 nt, hsa
uuaucuuaaagucacugucuauuuaagauuaaacauacaaucacauaaccuuaaagaauaccguu

SEQ ID NO: 475414 - RNA, 65 nt, hsa
uuuaagaaacaaaacauaguaucuuauggauuguuuacaaucacaaggacauagauaccuaucag

SEQ ID NO: 475415 - RNA, 65 nt, hsa
aauaacuugaauuuauagacaaaugcuacucacaguacaaucaauuguauuauaccaugagaaaa

SEQ ID NO: 475416 - RNA, 65 nt, hsa
uagaauauugauugguaauaguaaaucguucuccuuacaaucaaguucuugacccuauucggccu

SEQ ID NO: 475417 - RNA, 65 nt, hsa
gacgugcaaaagucuagccuugcccgagcuuuccuuacaaucagagccccucucaccuuguaaag

SEQ ID NO: 475418 - RNA, 65 nt, hsa
agaugauuacgaagaucacaucccacucucugaacuacaaucacugugcucccugggggagaucc

SEQ ID NO: 475419 - RNA, 65 nt, hsa
uauguccaugcuguguccaaggaggaguagguacauacaaucagcacagauuaauauauguaaag

SEQ ID NO: 475420 - RNA, 65 nt, hsa
auguaacagaugauuguuugcuagauuuuguuuucuacaaucaaaauguugaccugcaaagcagu

SEQ ID NO: 475421 - RNA, 65 nt, hsa
auuaucacucaggaaccagcggaucugcaaagaccuacaaucaaaagcaaauccccauuuuccuu

SEQ ID NO: 475422 - RNA, 65 nt, hsa
cugguuaugggguaggacacccagauuuucagacuuacaaucagugguccugguuucaacaugga

SEQ ID NO: 475423 - RNA, 65 nt, hsa
ucaucaagcaguccagagcuaggccagaucaaugcuacaaucaugaaguucucauugcaugcaau

SEQ ID NO: 475424 - RNA, 65 nt, hsa
auuaggacacuaugguuauaaacuguguuuaagccuacaaucauugauuuuuuuuuguuauguca

SEQ ID NO: 475425 - RNA, 65 nt, hsa
uagauuuaugcauguggacauuuuuauaauguaauuacaaucaccacaagguuagcuuuuuuaau

SEQ ID NO: 475426 - RNA, 65 nt, hsa
uguguauggccugaagcucuucucuccaguguuucuacaaucagcuagggacuacuuaauaggug

SEQ ID NO: 475427 - RNA, 65 nt, hsa
agcccuccccaucccaaucccaggcagcuuguguguacaaucagcuucucuagcaacucuguauc

SEQ ID NO: 475428 - RNA, 65 nt, hsa
guacaaucucucagggguuucauaguuuaaaaagcuacaaucacaucauguuguaacuacguaaa

SEQ ID NO: 475429 - RNA, 65 nt, hsa
guaucauugccaauuaucaucauauuuacauuuucuacaaucaugugcuuauuaacauauuggaa

SEQ ID NO: 475430 - RNA, 65 nt, hsa
guaggguaugcugauccucuuuuaaaaacccaagauacaaucaaaaucccagaugcuggucucua

SEQ ID NO: 475431 - RNA, 65 nt, hsa
agucuccuaacauuugucucuagccuuugccuuuguacaaucacagauauccuauggagauuuaa

SEQ ID NO: 475432 - RNA, 65 nt, hsa
cuggggucugcuuccauuuauucacuagccaucacuacaaucaccagcuuuuaaaacaacagcua

SEQ ID NO: 475433 - RNA, 65 nt, hsa
gaaaagugaagagugguuaccuauaccuagcauaguacaaucagaaccucguggagaccaccggg

SEQ ID NO: 475434 - RNA, 65 nt, hsa
acuaucaguaucccacaccagagugguacauuuguuacaaucaauaaaccuccauugacacauca

SEQ ID NO: 475435 - RNA, 65 nt, hsa
ucacucgcccagucuucagucuccugacuuagagauacaaucacgucacaggucucuuggccuca

SEQ ID NO: 475436 - RNA, 65 nt, hsa
gcccagucaguacaaggaggcccacaaauauuuauuacaaucaguauuuuggucccuuccagcuu

SEQ ID NO: 475437 - RNA, 65 nt, hsa
uaaaacuccauauguuaaugauuagaugguuauauuacaaucauuuuauauuuuuuuacaugauu

SEQ ID NO: 475438 - RNA, 65 nt, hsa
uaggacuuuauuuucaugauaucuguaaucacugcuacaaucagcucaccugaucaucugugaau

SEQ ID NO: 475439 - RNA, 65 nt, hsa
aagaaaaaagaucccuauuagauacacuucuuaaauacaaucacauuaacauuuugagcuauuuc

SEQ ID NO: 475440 - RNA, 65 nt, hsa
gaaggucguuucacauucuguaguaaaaauaccccuacaaucauuuugguagggucuucugucuu

SEQ ID NO: 475441 - RNA, 65 nt, hsa
gcaugaacagcuaauuguaccauaguguucauugauacaaucauagcauugucuauuuuucucuu

SEQ ID NO: 475442 - RNA, 65 nt, hsa
gaaaugcaagucaaaaucacaaugagauuccaguuuacaaucacuaggauggcuacaauaaaaag

SEQ ID NO: 475443 - RNA, 65 nt, hsa
ccauugcacccagccauguucuuuuacuuucuaaauacaaucauauuaggggaaaaauaaccaaa

SEQ ID NO: 475444 - RNA, 65 nt, hsa
aauaauugauguuugcaaugugucuuccuuugguuuacaaucaauuuuaaagcuacaucuguaua

SEQ ID NO: 475445 - RNA, 65 nt, hsa
caaaucccuuaagccucucaaauauugagcuuuaguacaaucauggauagacauucuggugauga

SEQ ID NO: 475446 - RNA, 65 nt, hsa
guaggaaagacguuuuuccaguucaaaaugccuuauacaaucaagaggaaaaaaaauuacacaau

SEQ ID NO: 475447 - RNA, 65 nt, hsa
guacgaagauacaauacuguuauucauuuauccuguacaaucaucugugaagugguggugucagg

SEQ ID NO: 475448 - RNA, 65 nt, hsa
aauaguaugauaaagauuucagaguacaggucugguacaaucacaguucauugcagccucaaccu

SEQ ID NO: 475449 - RNA, 65 nt, hsa
ucucccguagagaagcaggucgugccggaccuuccuacaaucaggaagauagauccaacuggcca

SEQ ID NO: 475450 - RNA, 65 nt, hsa
ugugucagaaccaguccugcccugugaauuacugcuacaaucaaggccacugcuacaucucccag

SEQ ID NO: 475451 - RNA, 65 nt, hsa
uggucugccauugcaaugcagagagccaguguuuguacaaucagaccagcagggugggcaacucc

SEQ ID NO: 475452 - RNA, 65 nt, hsa
guauuuuaaaacugacaguagccugaucaaagugauacaaucaauuucaaaacaaucuuccagag

SEQ ID NO: 475453 - RNA, 65 nt, hsa
guuauuaaacucuuuaaauaugucauagaaaauaauacaaucauguaaugagucuugucuuacaa

SEQ ID NO: 475454 - RNA, 65 nt, hsa
augagcaugaagcccaguggcaccaaauggcuggguacaaucaagugauauuuuguagcaccuca

SEQ ID NO: 475455 - RNA, 65 nt, hsa
aaaaaaaaaaauacuugucaauauuuaaacaugguuacaaucauugcugaaaaugguauuuuccc

SEQ ID NO: 475456 - RNA, 65 nt, hsa
uugccgaagaccuuuuacugauugaacaguugugcuacaaucaacuuuucauaguacaugaccug

SEQ ID NO: 475457 - RNA, 65 nt, hsa
aauuuguacuguucauggcacuauuaacaaaacuauacaaucauauuuucucuucuaucuuugaa

SEQ ID NO: 475458 - RNA, 65 nt, hsa
auuccacucaacagacaauauuucauauuugauauuacaaucauuuauuuuauguccuauuauaa

SEQ ID NO: 475459 - RNA, 65 nt, hsa
gaacuuggccaaggaacaacugagucgcgagaacauacaaucaaguuugcuggaaacauuguauc

SEQ ID NO: 475460 - RNA, 65 nt, hsa
aacauaaaauggcuugguaaaaguaauaaaaucaguacaaucacuaacuuuccuuuguacauauu

SEQ ID NO: 475461 - RNA, 65 nt, hsa
auaugguguacaguuuuuaacuuagguuuuaauuuuacaaucauuucugaauacagaaguugugg

SEQ ID NO: 475462 - RNA, 65 nt, hsa
uuuuuagccuuaaaguuuauauucucaaguccuuuuacaaucagugugucuccugaacuagcaca

SEQ ID NO: 475463 - RNA, 65 nt, hsa
ggguuacaucagugcuggucauuguagccugaguauacaaucaagcuucagugugcaaccuuuuu

SEQ ID NO: 475464 - RNA, 65 nt, hsa
caaaauucuuaaguauguuauuuucuguugaaguuuacaaucaaaggaaaauaguaauguuuuau

SEQ ID NO: 475465 - RNA, 65 nt, hsa
aaaauguuaucucaauaagauacuuauaugagaacuacaaucaccgaaucuacuguauucaauau

SEQ ID NO: 475466 - RNA, 65 nt, hsa
uuugcggaggucagguucauaccaauggacacuaauacaaucaguguucccaaggcugugcaggg

SEQ ID NO: 475467 - RNA, 65 nt, hsa
uaaaaguuaaguauaauuauuuuaaugcaaucuaauacaaucagauuacucaguugccuuaccuc

SEQ ID NO: 475468 - RNA, 65 nt, hsa
aaaauggaggggaaaaaggccacagcaaucuguacuacaaucaacuuuauuuugaaaucauguaa

SEQ ID NO: 475469 - RNA, 65 nt, hsa
guaauuacaugaauaaaauuaagaaaauagccauauacaaucaaauacacuauggcauuuuuauu

SEQ ID NO: 475470 - RNA, 65 nt, hsa
agcuggucugacacuacgcgcagugcucgguuguuuacaaucaguggggaaaagggcagaaccag

SEQ ID NO: 475471 - RNA, 65 nt, hsa
uuuaccaaaguggccauuggcacuguuugcuuuuuuacaaucauguggacacaagcauaaguaaa

SEQ ID NO: 475472 - RNA, 65 nt, hsa
ggugggaaaaggggaaaaacuguuucuucagugauuacaaucauacucuucauuacuauaaauau

SEQ ID NO: 475473 - RNA, 65 nt, hsa
uuuagaaauuugaguaaagaaacaauaaggaccuauacaaucauaugagaacaaaaauaugaaau

SEQ ID NO: 475474 - RNA, 65 nt, hsa
cgaucucacucugucaccagguuggaguacagugguacaaucacaacucaccguagccucaaacu

SEQ ID NO: 475475 - RNA, 65 nt, hsa
agucaucaaauaagagcaagaguugauagagcuuuuacaaucaauacucaccuaauucugauaaa

SEQ ID NO: 475476 - RNA, 65 nt, hsa
aaccaagugugcucuuuuuuuaaaagguagagucuuacaaucaaaucuccugcugauuucacuuu

SEQ ID NO: 475477 - RNA, 65 nt, hsa
uggcuuuggaagaauuauauuagguagaauacacauacaaucaaaauuuuaaaaaaaaaagcuaa

SEQ ID NO: 475478 - RNA, 65 nt, hsa
gaaaauacuuguuuuuccaaauuccgguguuuuauuacaaucaaagaagaggaaagcaagguauu

SEQ ID NO: 475479 - RNA, 65 nt, hsa
uuuugauguggugucauagaauagcauguuguagauacaaucagcugcuuuguuaccuuaaaacu

SEQ ID NO: 475480 - RNA, 65 nt, hsa
aucaaccuguagguaccacagaagagcuguagucauacaaucacauaacuuuuacaaauauagug

SEQ ID NO: 475481 - RNA, 65 nt, hsa
auuuaauuuuagaugcaaaagaaaaaggucuaacguacaaucagccaauuagaauuugccugaaa

SEQ ID NO: 475482 - RNA, 65 nt, hsa
cacugugucaucuucuggaguuaucaaaaauuguauacaaucaagacaacacaagaauuauuuua

SEQ ID NO: 475483 - RNA, 65 nt, hsa
acugcagcuuuacugccuuccuccuuauccuacaguacaaucagcagucuaguucuuuucauuug

SEQ ID NO: 475484 - RNA, 65 nt, hsa
uucuguccauagcacagaaacagagcagaaaguaguacaaucauguuggaccuucuuucuguucu

SEQ ID NO: 475485 - RNA, 65 nt, hsa
ucuucaguuuaaugcaagagaacauuuuacuguuguacaaucauguucuggugguuugauuguuu

SEQ ID NO: 475486 - RNA, 65 nt, hsa
ucugauaauaguaacaagguauauuauacuuucauuacaaucaaauuauagaaauuacuugugua

SEQ ID NO: 475487 - RNA, 65 nt, hsa
aauacauuggcaauacagcugcuuuugcucugagcuacaaucauggcuuuucauguuacuuacca

SEQ ID NO: 475488 - RNA, 65 nt, hsa
aguaaguguucccuucacauuuuaaaauuugaguauacaaucauguuugacaauauagaaauuua

SEQ ID NO: 475489 - RNA, 65 nt, hsa
auccuuugugagccuaugauauuccccauuuccuguacaaucaugaacagcucugagauccugga

SEQ ID NO: 475490 - RNA, 65 nt, hsa
ugucuuauauuucucagauuauaauauuaaaaaauuacaaucaauuuauuuucauuaaagaacgu

SEQ ID NO: 475491 - RNA, 65 nt, hsa
accgcaaaaauucacuccuggagaucuccguagacuacaaucaaucaaaucaauagucagucuug

SEQ ID NO: 475492 - RNA, 65 nt, hsa
gcauucuucuguagacauuugcucauguugguaaauacaaucacccauaugaaaaaauuguuuuc

SEQ ID NO: 475493 - RNA, 65 nt, hsa
acaucuugauuguuuuaaccauuaacuugucaaauuacaaucacaguuaagaaaaugauguaaaa

SEQ ID NO: 475494 - RNA, 65 nt, hsa
acuugguuuugauuaccagugaaaagaaaacacaauacaaucaggaguuuucaaauuuuugauuc

SEQ ID NO: 475495 - RNA, 65 nt, hsa
gagcaggaaaaggcacauacucaguuuuuuaaauguacaaucaacaaguaaaaauaaccucaugu

SEQ ID NO: 475496 - RNA, 65 nt, hsa
cuucaacggagaguuugcuucugaguggggaugaauacaaucaggacuuugauucaaccaauuuu

SEQ ID NO: 475497 - RNA, 65 nt, hsa
ccacagauugcaaagcauagcauuuuagcaucaacuacaaucaaaagagcgauuugcugaaggaa

SEQ ID NO: 475498 - RNA, 65 nt, hsa
uccuacugucacacaggucacgaggguggacucccuacaaucaacaaagcaaacagagagccugu

SEQ ID NO: 475499 - RNA, 65 nt, hsa
gcagggguuugccaaacagcccaaacuguauacauuacaaucauuaaaaguucuuauuuuuuuua

SEQ ID NO: 475500 - RNA, 65 nt, hsa
gcugcagaugggcuaaauaaaagccaaauuaauccuacaaucagguauuauguuuuuaaaccaag

SEQ ID NO: 475501 - RNA, 65 nt, hsa
caaacugucuaaaaauuuuucucuuacguuuaacauacaaucaugugaaauuuaggcagaguucg

SEQ ID NO: 475502 - RNA, 65 nt, hsa
uaaaagugucaagggcuggguuugccucugaugaguacaaucaguuccagaagacuggguaaguc

SEQ ID NO: 475503 - RNA, 65 nt, hsa
auucucaaguuaucacaaaauuucccacaaaaauuuacaaucagcaaaauaguuuccuuauuucu

SEQ ID NO: 475504 - RNA, 65 nt, hsa
aacaaaacuaugcuguuuauauugucauuaaauuauacaaucaaacaaaugccaaaugaauugcc

SEQ ID NO: 475505 - RNA, 65 nt, hsa
uugggagauguggcuggaaaguacuuuggaaaauauacaaucaagauaucucauggcauauuaaa

SEQ ID NO: 475506 - RNA, 65 nt, hsa
ggcugugaagguauuuuguagaugugauuaacaucuacaaucaguugacuuuaagugaaagagau

SEQ ID NO: 475507 - RNA, 65 nt, hsa
aagaaagaagauaauagaccagcaauugcagcacuuacaaucacuaauucccuuaagguugaaac

SEQ ID NO: 475508 - RNA, 65 nt, hsa
caugauucuucauagagugguaauacaauuuauaguacaaucacauugcuuugauuuuguguaua

SEQ ID NO: 475509 - RNA, 65 nt, hsa
uucccgaugagggaaggagcccagccagaaagcacuacaaucauggucaaguucccaacugaguc

SEQ ID NO: 475510 - RNA, 65 nt, hsa
auugaguaggaacugaggcugugcuucagguaugguacaaucaagugggggauuuucaugcugaa

SEQ ID NO: 475511 - RNA, 65 nt, hsa
uccggcgacaccgguucucuaucaacggccacuucuacaaucauaaggugaugccccagccuggc

SEQ ID NO: 475512 - RNA, 65 nt, hsa
aaaaauauuuuauuuguauuguuguauaaaauauuuacaaucauauagaauauauagaguuacau

SEQ ID NO: 475513 - RNA, 65 nt, hsa
auugccuuaauucuaauuuuauuuuguucucuacauacaaucaauguaaagccauaucacaauga

SEQ ID NO: 475514 - RNA, 65 nt, hsa
uuucuacuaaaauguccaaguagaauguuuccuuuuacaaucaaauuacuguauuuauuaauuug

SEQ ID NO: 475515 - RNA, 65 nt, hsa
cucacugaguuuuuguuuaaaaaccaggaaauuucuacaaucauggagacagauuuuaauuugca

SEQ ID NO: 475516 - RNA, 65 nt, hsa
uaguguaauguauaauugcucuuguuuauugcuuuuacaaucauauuuauuaaacagauaauguc

SEQ ID NO: 475517 - RNA, 65 nt, hsa
uuugcuaucuguguagaaaauaauuucaugacauuuacaaucaggacugaaguaaguucuucaca

SEQ ID NO: 475518 - RNA, 65 nt, hsa
cauuugggaugccagggaacagagagugagacaccuacaaucaccagucucaaaugcgcuauugu

SEQ ID NO: 475519 - RNA, 65 nt, hsa
ucaccccauuuucuuuuuaaccucgcccccuuuucuacaaucaaauccauucauuauugcgcccu

SEQ ID NO: 475520 - RNA, 65 nt, hsa
uuccuacuagaacauuuuauuuuccuuguucaccauacaaucauguacucuuuaacagaaauugc

SEQ ID NO: 475521 - RNA, 65 nt, hsa
auauuuuucaguauucagacucugaaaucugucauuacaaucaagugcuugucacagcugaaaga

SEQ ID NO: 475522 - RNA, 65 nt, hsa
uucacguuuucccauuucccuguggcucacugucuuacaaucacugcuguggaaucaugauacca

SEQ ID NO: 475523 - RNA, 65 nt, hsa
cuggugugaugaugggcuugcccauccauuacugcuacaaucaaggccaggcuuggaguuuggcc

SEQ ID NO: 475524 - RNA, 65 nt, hsa
gauauaucuuaauuacuaaugccacacagaaauuauacaaucaaacuagaucugaagcauaauuu

SEQ ID NO: 475525 - RNA, 65 nt, hsa
cacagccgccaucugcaaggaaggccuaaucauguuacaaucacugcccacugacccucucccag

SEQ ID NO: 475526 - RNA, 65 nt, hsa
ugaccuuuuuuguaaacuaagugccguuucaacguuacaaucauuuuuaggguuauuguaaucaa

SEQ ID NO: 475527 - RNA, 65 nt, hsa
guuauucguuucuaaacuuggauggaauuagagaauacaaucaaacuuuaccacuuggaggacac

SEQ ID NO: 475528 - RNA, 65 nt, hsa
aaagaaaucuuuuuggucaagaugguaguuggaacuacaaucaucugaaggccugacaagaguug

SEQ ID NO: 475529 - RNA, 65 nt, hsa
ucugguaaaguuacacuuuuauuuccuguauguuguacaaucaaaacacacuacuaccucuuaag

SEQ ID NO: 475530 - RNA, 65 nt, hsa
guguuccauuugcuucuuuguauuguugcauuuaguacaaucaguguuuaaacuuacuguauauu

SEQ ID NO: 475531 - RNA, 65 nt, hsa
auuuagggauugugaaauuuuuuuuucaaauuucauacaaucauauuucccaguacuuuucacaa

SEQ ID NO: 475532 - RNA, 65 nt, hsa
uuuuguacuguuuauaagccuucaaacaguaguuuuacaaucaugcuauucuuacacuugcuauu

SEQ ID NO: 475533 - RNA, 65 nt, hsa
uaaaucuuuggauuugaucacuacaaguauuauuuuacaaucaacaaaauggucauccaaacuca

SEQ ID NO: 475534 - RNA, 65 nt, hsa
gacuaauggcacaggaaaaaccuauucauaaguuuuacaaucaaguauagaggggucuucagcua

SEQ ID NO: 475535 - RNA, 65 nt, hsa
guuuuaauguuccaguugcugugaaauagaacuccuacaaucaaaagacaguuuuaggaagucuu

SEQ ID NO: 475536 - RNA, 65 nt, hsa
ggggaauauuuuaaaaauaaaccagaucaaauuaauacaaucagaagguuucgaaauguaaauau

SEQ ID NO: 475537 - RNA, 65 nt, hsa
ccucuuguacuuggaugcguaguacaucauauguauacaaucagauaaaagcauagaaguaaauc

SEQ ID NO: 475538 - RNA, 65 nt, hsa
ucaagguugcagugaaugaugcucacuuguugcaguacaaucaucggguuaaaaaacucaaugaa

SEQ ID NO: 475539 - RNA, 65 nt, hsa
cauagguguuauuuuuaguugcauaggguauuugauacaaucauuaauggaucauacacaauagg

SEQ ID NO: 475540 - RNA, 65 nt, hsa
agauuaauuuggcauuugaaaugaucauuuuauuuuacaaucauuuauaaugaaucaauguucca

SEQ ID NO: 475541 - RNA, 65 nt, hsa
aguaaguacaguaauguaaaggaagacuuggaguuuacaaucagaaccuggacccuaaagaacag

SEQ ID NO: 475542 - RNA, 65 nt, hsa
acuuggggucaggaccucgucagaccagguucggauacaaucaucugcucaucccaggaauaguu

SEQ ID NO: 475543 - RNA, 65 nt, hsa
gagcucaucucauuuuuacuuuugaacguuggccuuacaaucaaauguaaguuauauauauuugu

SEQ ID NO: 475544 - RNA, 65 nt, hsa
auuaugaaaucauaguauaugauuguauuuaaagguacaaucaaaggaucuuuuguccauuccau

SEQ ID NO: 475545 - RNA, 65 nt, hsa
uuguaaguggaacucuggauugacuggucaguugcuacaaucagaauaugcuuucuuggaccaug

SEQ ID NO: 475546 - RNA, 65 nt, hsa
gcuaucaguauccugcaccacaaugguacauuuguuacaaucaaugaaccuacucugaaacauca

SEQ ID NO: 475547 - RNA, 65 nt, hsa
ggugaaugucaguguauuaucaggaaacaugucuauacaaucacagaguuauauuuccucacaaa

SEQ ID NO: 475548 - RNA, 65 nt, hsa
gcacaacuuccuuuccuuucaguucugccaaaugcuacaaucagaagugcaguaucuuuugugcu

SEQ ID NO: 475549 - RNA, 65 nt, hsa
uaacuaaagguuguaaaaaauuguaaaacugguuguacaaucaugauguuaguaacaguaauuuu

SEQ ID NO: 475550 - RNA, 65 nt, hsa
aaauuacaaaaauguuucuguuuugaaacuugaucuacaaucaguaaaaguuugauaaucaguau

SEQ ID NO: 475551 - RNA, 65 nt, hsa
gucaacuuuaaaguaaacauuaaagauucuugugauacaaucauuuuuggaaaaguguacuuuau

SEQ ID NO: 475552 - RNA, 65 nt, hsa; identical to SEQ ID NO: 475547

SEQ ID NO: 475553 - RNA, 65 nt, hsa
agaugagaaagcaaaaaguacuuuguaaaguguuauacaaucagaaggugcuuugugcugaccgu

SEQ ID NO: 475554 - RNA, 65 nt, hsa
uaauaagcucuuugaauguguauauuauuauuuuuuacaaucauuucauuuuguauuuaauauca

SEQ ID NO: 475555 - RNA, 64 nt, hsa
aauuuuaguggaauuguuauugagaauaaaauuuuuacaaucauaacuggcuuuuuccaaguaa

SEQ ID NO: 475556 - RNA, 65 nt, hsa
auggcacugcgugauuuuauuuuaaugaaguguuauacaaucaagaaaugggggcaagggccugc

SEQ ID NO: 475557 - RNA, 65 nt, hsa
uacuuucucgcucccagaagguugaucagauauucuacaaucacagaguagcaaggacguuugag

SEQ ID NO: 475558 - RNA, 65 nt, hsa
ugccaauuucacacuuguaucuucagcagggacauuacaaucaaacaccaauuccugguuaauga

SEQ ID NO: 475559 - RNA, 65 nt, hsa
ggaaggucuuugacggcaccaucuggaaggacaucuacaaucaggagugguggaaccucaggugg

SEQ ID NO: 475560 - RNA, 65 nt, hsa
gauguaagaaauguucuugcaguuaaggguuaguuuacaaucagccacauucuagguaggggccc

SEQ ID NO: 475561 - RNA, 65 nt, hsa
augcacaucauguagauuaagcugaagauguuuauuacaaucacucucugugggggguggcccug

SEQ ID NO: 475562 - RNA, 65 nt, hsa
uaagcuauguuguugcacuuuaaacauuuaaauuauacaaucaucaacccccaacccucuggguc

SEQ ID NO: 475563 - RNA, 65 nt, hsa
aucgcuaauuguccuuucaguugaaaucuaauuuauacaaucauucuauacuuaaagguuaaaua

SEQ ID NO: 475564 - RNA, 65 nt, hsa
gcaugagggaaauacacuguugcuaauacugaaauuacaaucaaguaacuaaggccuugaguuca

SEQ ID NO: 475565 - RNA, 65 nt, hsa
uaggagauuuuucaguucuccauauaauaauuuucuacaaucagaucuaugcuguggcauauuuu

SEQ ID NO: 475566 - RNA, 65 nt, hsa
auaacucaagguuguaaaaauggcauggugacucuuacaaucauaucacagugggccucuccaac

SEQ ID NO: 475567 - RNA, 65 nt, hsa
ggcccugccguuuccccuccuuggcuuuaugcaaauacaaucagcccagugcaaacggcucgucu

SEQ ID NO: 475568 - RNA, 65 nt, hsa
uguaguuacacugcaggaucucucaugccuuuacuuacaaucaagaugucagccaaagcuauagu

SEQ ID NO: 475569 - RNA, 65 nt, hsa
gaaacaguuucuggagaucuccucauuaccucuuuuacaaucaccucacuccagcauggugucug

SEQ ID NO: 475570 - RNA, 65 nt, hsa
cccagacaguugcuuugauucuuccucaaacuacuuacaaucaccuacaguccaaaauugcuuuu

SEQ ID NO: 475571 - RNA, 65 nt, hsa
uuuuccaucuuguacacgagauacaccaacauagcuacaaucaaacaggccuggguaucugaggc

SEQ ID NO: 475572 - RNA, 65 nt, hsa
cuacguugguugugaccacaaccucaggcaagugcuacaaucacgauuguugcuaugcugcuuug

SEQ ID NO: 475573 - RNA, 65 nt, hsa
auguaaagaaguaacuugugucucaugaaaaucaguacaaucacacaaggaggaugaaacgccgg

SEQ ID NO: 475574 - RNA, 65 nt, hsa
ccuugagcaauaguuguuucuuugucaguuucaguuacaaucaucuuuacccauuaagacuuaca

SEQ ID NO: 475575 - RNA, 65 nt, hsa
ugccucacagaguuuagacaugacuagccagcuccuacaaucacugaagucaauuccuugcaaua

SEQ ID NO: 475576 - RNA, 65 nt, hsa
gaguuacaagccccuggaaaagggagcaggucccauacaaucagccuuucuccucuucucuucuu

SEQ ID NO: 475577 - RNA, 65 nt, hsa
caaugaaauccacccucaaagaggacuacuucggauacaaucacagcaacccuggccucggcccu

SEQ ID NO: 475578 - RNA, 65 nt, hsa
agggucaugaacuuuuuucuuuagugaaggaggaauacaaucaaggguuuuguauucagaauguu

SEQ ID NO: 475579 - RNA, 51 nt, hsa; identical to SEQ ID NO: 147092

SEQ ID NO: 475580 - RNA, 65 nt, hsa
agaggaagccuuugguccuaacgagaagagauaauuacaaucaggcuaccaaaggaagcacuaac

SEQ ID NO: 475581 - RNA, 65 nt, hsa
gaagaaaugcucaauacauacuuugaaagcaaaaauacaaucaaacacauugacacguauauaaa

SEQ ID NO: 475582 - RNA, 65 nt, hsa
gugaaucuccuaauuuuagcaucuuuuuuuuuuuuuacaaucauucagauugugaauucaggcuc

SEQ ID NO: 475583 - RNA, 65 nt, hsa
aguguuuuuacauauagcuuugcaaccuuguacuuuacaaucaugccuacauuagugagauuuag

SEQ ID NO: 475584 - RNA, 65 nt, hsa
ucaggaacuaggcauaucaugccuuuguuuaaaaguacaaucagaggugguaagaugccuuuggc

SEQ ID NO: 475585 - RNA, 65 nt, hsa
guauaauuuguaccugcagaucugauguugcauaauacaaucaaauuacuagauuuuuuaaagag

SEQ ID NO: 475586 - RNA, 65 nt, hsa
uucagggaugacacaagcacacaaugauuuuugcuuacaaucacuuaacuuagcaaauucuguaa

SEQ ID NO: 475587 - RNA, 64 nt, hsa; identical to SEQ ID NO: 270569

SEQ ID NO: 475588 - RNA, 64 nt, hsa; identical to SEQ ID NO: 270570

SEQ ID NO: 475589 - RNA, 64 nt, hsa; identical to SEQ ID NO: 270571

SEQ ID NO: 475590 - RNA, 64 nt, hsa; identical to SEQ ID NO: 270572

SEQ ID NO: 475591 - RNA, 64 nt, hsa; identical to SEQ ID NO: 270573

SEQ ID NO: 475592 - RNA, 64 nt, hsa; identical to SEQ ID NO: 270574

SEQ ID NO: 475593 - RNA, 64 nt, hsa; identical to SEQ ID NO: 270575

SEQ ID NO: 475594 - RNA, 64 nt, hsa; identical to SEQ ID NO: 270576

SEQ ID NO: 475595 - RNA, 64 nt, hsa; identical to SEQ ID NO: 270577

SEQ ID NO: 475596 - RNA, 64 nt, hsa; identical to SEQ ID NO: 270578

SEQ ID NO: 475597 - RNA, 64 nt, hsa; identical to SEQ ID NO: 270579

SEQ ID NO: 475598 - RNA, 55 nt, hsa; identical to SEQ ID NO: 270580

SEQ ID NO: 475599 - RNA, 64 nt, hsa; identical to SEQ ID NO: 270581

SEQ ID NO: 475600 - RNA, 64 nt, hsa; identical to SEQ ID NO: 270582

SEQ ID NO: 475601 - RNA, 64 nt, hsa; identical to SEQ ID NO: 270583

SEQ ID NO: 475602 - RNA, 64 nt, hsa; identical to SEQ ID NO: 270584

SEQ ID NO: 475603 - RNA, 64 nt, hsa; identical to SEQ ID NO: 270585

SEQ ID NO: 475604 - RNA, 64 nt, hsa; identical to SEQ ID NO: 270586

SEQ ID NO: 475605 - RNA, 64 nt, hsa; identical to SEQ ID NO: 270587

SEQ ID NO: 475606 - RNA, 64 nt, hsa; identical to SEQ ID NO: 270588

SEQ ID NO: 475607 - RNA, 64 nt, hsa; identical to SEQ ID NO: 270589

SEQ ID NO: 475608 - RNA, 64 nt, hsa; identical to SEQ ID NO: 270590

SEQ ID NO: 475609 - RNA, 64 nt, hsa; identical to SEQ ID NO: 270591

SEQ ID NO: 475610 - RNA, 64 nt, hsa; identical to SEQ ID NO: 270592

SEQ ID NO: 475611 - RNA, 64 nt, hsa; identical to SEQ ID NO: 270593

SEQ ID NO: 475612 - RNA, 64 nt, hsa; identical to SEQ ID NO: 270594

SEQ ID NO: 475613 - RNA, 64 nt, hsa; identical to SEQ ID NO: 165107

SEQ ID NO: 475614 - RNA, 64 nt, hsa; identical to SEQ ID NO: 165108

SEQ ID NO: 475615 - RNA, 64 nt, hsa; identical to SEQ ID NO: 165109

SEQ ID NO: 475616 - RNA, 64 nt, hsa; identical to SEQ ID NO: 165110

SEQ ID NO: 475617 - RNA, 64 nt, hsa; identical to SEQ ID NO: 165111

SEQ ID NO: 475618 - RNA, 64 nt, hsa; identical to SEQ ID NO: 165112

SEQ ID NO: 475619 - RNA, 64 nt, hsa; identical to SEQ ID NO: 165113

SEQ ID NO: 475620 - RNA, 64 nt, hsa; identical to SEQ ID NO: 165114

SEQ ID NO: 475621 - RNA, 64 nt, hsa; identical to SEQ ID NO: 165115

SEQ ID NO: 475622 - RNA, 64 nt, hsa; identical to SEQ ID NO: 165116

SEQ ID NO: 475623 - RNA, 64 nt, hsa; identical to SEQ ID NO: 165117

SEQ ID NO: 475624 - RNA, 64 nt, hsa; identical to SEQ ID NO: 165118

SEQ ID NO: 475625 - RNA, 64 nt, hsa; identical to SEQ ID NO: 165119

SEQ ID NO: 475626 - RNA, 64 nt, hsa; identical to SEQ ID NO: 165120

SEQ ID NO: 475627 - RNA, 64 nt, hsa; identical to SEQ ID NO: 165121

SEQ ID NO: 475628 - RNA, 64 nt, hsa; identical to SEQ ID NO: 165122

SEQ ID NO: 475629 - RNA, 64 nt, hsa; identical to SEQ ID NO: 165123

SEQ ID NO: 475630 - RNA, 64 nt, hsa; identical to SEQ ID NO: 165124

SEQ ID NO: 475631 - RNA, 64 nt, hsa; identical to SEQ ID NO: 165125

SEQ ID NO: 475632 - RNA, 64 nt, hsa; identical to SEQ ID NO: 165126

SEQ ID NO: 475633 - RNA, 64 nt, hsa; identical to SEQ ID NO: 165127

SEQ ID NO: 475634 - RNA, 64 nt, hsa; identical to SEQ ID NO: 165128

SEQ ID NO: 475635 - RNA, 64 nt, hsa; identical to SEQ ID NO: 165129

SEQ ID NO: 475636 - RNA, 64 nt, hsa; identical to SEQ ID NO: 165130

SEQ ID NO: 475637 - RNA, 64 nt, hsa; identical to SEQ ID NO: 165131

SEQ ID NO: 475638 - RNA, 64 nt, hsa; identical to SEQ ID NO: 165132

SEQ ID NO: 475639 - RNA, 64 nt, hsa; identical to SEQ ID NO: 165133

SEQ ID NO: 475640 - RNA, 64 nt, hsa; identical to SEQ ID NO: 165134

SEQ ID NO: 475641 - RNA, 64 nt, hsa; identical to SEQ ID NO: 165135

SEQ ID NO: 475642 - RNA, 64 nt, hsa; identical to SEQ ID NO: 165136

SEQ ID NO: 475643 - RNA, 64 nt, hsa; identical to SEQ ID NO: 165137

SEQ ID NO: 475644 - RNA, 64 nt, hsa; identical to SEQ ID NO: 165138

SEQ ID NO: 475645 - RNA, 64 nt, hsa; identical to SEQ ID NO: 165139

SEQ ID NO: 475646 - RNA, 64 nt, hsa; identical to SEQ ID NO: 165140

SEQ ID NO: 475647 - RNA, 64 nt, hsa; identical to SEQ ID NO: 165141

SEQ ID NO: 475648 - RNA, 64 nt, hsa; identical to SEQ ID NO: 165142

SEQ ID NO: 475649 - RNA, 64 nt, hsa; identical to SEQ ID NO: 165143

SEQ ID NO: 475650 - RNA, 64 nt, hsa; identical to SEQ ID NO: 165144

SEQ ID NO: 475651 - RNA, 64 nt, hsa; identical to SEQ ID NO: 165145

SEQ ID NO: 475652 - RNA, 64 nt, hsa; identical to SEQ ID NO: 165146

SEQ ID NO: 475653 - RNA, 64 nt, hsa; identical to SEQ ID NO: 165147

SEQ ID NO: 475654 - RNA, 64 nt, hsa; identical to SEQ ID NO: 165148

SEQ ID NO: 475655 - RNA, 64 nt, hsa; identical to SEQ ID NO: 165149

SEQ ID NO: 475656 - RNA, 64 nt, hsa; identical to SEQ ID NO: 165150

SEQ ID NO: 475657 - RNA, 64 nt, hsa; identical to SEQ ID NO: 165151

SEQ ID NO: 475658 - RNA, 64 nt, hsa; identical to SEQ ID NO: 165152

SEQ ID NO: 475659 - RNA, 64 nt, hsa; identical to SEQ ID NO: 165153

SEQ ID NO: 475660 - RNA, 64 nt, hsa; identical to SEQ ID NO: 165154

SEQ ID NO: 475661 - RNA, 64 nt, hsa; identical to SEQ ID NO: 165155

SEQ ID NO: 475662 - RNA, 64 nt, hsa; identical to SEQ ID NO: 165156

SEQ ID NO: 475663 - RNA, 64 nt, hsa; identical to SEQ ID NO: 462980

SEQ ID NO: 475664 - RNA, 64 nt, hsa; identical to SEQ ID NO: 462981

SEQ ID NO: 475665 - RNA, 64 nt, hsa; identical to SEQ ID NO: 462982

SEQ ID NO: 475666 - RNA, 64 nt, hsa; identical to SEQ ID NO: 462983

SEQ ID NO: 475667 - RNA, 64 nt, hsa; identical to SEQ ID NO: 462984

SEQ ID NO: 475668 - RNA, 64 nt, hsa; identical to SEQ ID NO: 462985

SEQ ID NO: 475669 - RNA, 64 nt, hsa; identical to SEQ ID NO: 462986

SEQ ID NO: 475670 - RNA, 64 nt, hsa; identical to SEQ ID NO: 462987

SEQ ID NO: 475671 - RNA, 64 nt, hsa; identical to SEQ ID NO: 462988

SEQ ID NO: 475672 - RNA, 64 nt, hsa; identical to SEQ ID NO: 462989

SEQ ID NO: 475673 - RNA, 64 nt, hsa; identical to SEQ ID NO: 462990

SEQ ID NO: 475674 - RNA, 64 nt, hsa; identical to SEQ ID NO: 462991

SEQ ID NO: 475675 - RNA, 64 nt, hsa; identical to SEQ ID NO: 462992

SEQ ID NO: 475676 - RNA, 64 nt, hsa; identical to SEQ ID NO: 462993

SEQ ID NO: 475677 - RNA, 64 nt, hsa; identical to SEQ ID NO: 462994

SEQ ID NO: 475678 - RNA, 64 nt, hsa; identical to SEQ ID NO: 133159

SEQ ID NO: 475679 - RNA, 64 nt, hsa; identical to SEQ ID NO: 133160

SEQ ID NO: 475680 - RNA, 64 nt, hsa; identical to SEQ ID NO: 133161

SEQ ID NO: 475681 - RNA, 64 nt, hsa; identical to SEQ ID NO: 133162

SEQ ID NO: 475682 - RNA, 64 nt, hsa; identical to SEQ ID NO: 133163

SEQ ID NO: 475683 - RNA, 64 nt, hsa; identical to SEQ ID NO: 133164

SEQ ID NO: 475684 - RNA, 64 nt, hsa; identical to SEQ ID NO: 133165

SEQ ID NO: 475685 - RNA, 64 nt, hsa; identical to SEQ ID NO: 133166

SEQ ID NO: 475686 - RNA, 64 nt, hsa; identical to SEQ ID NO: 133167

SEQ ID NO: 475687 - RNA, 64 nt, hsa; identical to SEQ ID NO: 133168

SEQ ID NO: 475688 - RNA, 64 nt, hsa; identical to SEQ ID NO: 133169

SEQ ID NO: 475689 - RNA, 64 nt, hsa; identical to SEQ ID NO: 133170

SEQ ID NO: 475690 - RNA, 64 nt, hsa; identical to SEQ ID NO: 133171

SEQ ID NO: 475691 - RNA, 64 nt, hsa; identical to SEQ ID NO: 133172

SEQ ID NO: 475692 - RNA, 64 nt, hsa; identical to SEQ ID NO: 133173

SEQ ID NO: 475693 - RNA, 64 nt, hsa; identical to SEQ ID NO: 133174

SEQ ID NO: 475694 - RNA, 64 nt, hsa; identical to SEQ ID NO: 133175

SEQ ID NO: 475695 - RNA, 64 nt, hsa; identical to SEQ ID NO: 133176

SEQ ID NO: 475696 - RNA, 64 nt, hsa; identical to SEQ ID NO: 133177

SEQ ID NO: 475697 - RNA, 64 nt, hsa; identical to SEQ ID NO: 133178

SEQ ID NO: 475698 - RNA, 64 nt, hsa; identical to SEQ ID NO: 133179

SEQ ID NO: 475699 - RNA, 64 nt, hsa; identical to SEQ ID NO: 133180

SEQ ID NO: 475700 - RNA, 64 nt, hsa; identical to SEQ ID NO: 133181

SEQ ID NO: 475701 - RNA, 64 nt, hsa; identical to SEQ ID NO: 133182

SEQ ID NO: 475702 - RNA, 64 nt, hsa; identical to SEQ ID NO: 133183

SEQ ID NO: 475703 - RNA, 64 nt, hsa; identical to SEQ ID NO: 133184

SEQ ID NO: 475704 - RNA, 64 nt, hsa; identical to SEQ ID NO: 133185

SEQ ID NO: 475705 - RNA, 64 nt, hsa; identical to SEQ ID NO: 133186

SEQ ID NO: 475706 - RNA, 64 nt, hsa; identical to SEQ ID NO: 133187

SEQ ID NO: 475707 - RNA, 64 nt, hsa; identical to SEQ ID NO: 133188

SEQ ID NO: 475708 - RNA, 64 nt, hsa; identical to SEQ ID NO: 133189

SEQ ID NO: 475709 - RNA, 64 nt, hsa; identical to SEQ ID NO: 133190

SEQ ID NO: 475710 - RNA, 64 nt, hsa; identical to SEQ ID NO: 133191

SEQ ID NO: 475711 - RNA, 64 nt, hsa; identical to SEQ ID NO: 133192

SEQ ID NO: 475712 - RNA, 64 nt, hsa; identical to SEQ ID NO: 133193

SEQ ID NO: 475713 - RNA, 64 nt, hsa; identical to SEQ ID NO: 133194

SEQ ID NO: 475714 - RNA, 64 nt, hsa; identical to SEQ ID NO: 133195

SEQ ID NO: 475715 - RNA, 64 nt, hsa; identical to SEQ ID NO: 133196

SEQ ID NO: 475716 - RNA, 64 nt, hsa; identical to SEQ ID NO: 133197

SEQ ID NO: 475717 - RNA, 64 nt, hsa; identical to SEQ ID NO: 133198

SEQ ID NO: 475718 - RNA, 64 nt, hsa; identical to SEQ ID NO: 133199

SEQ ID NO: 475719 - RNA, 64 nt, hsa; identical to SEQ ID NO: 133200

SEQ ID NO: 475720 - RNA, 64 nt, hsa; identical to SEQ ID NO: 133201

SEQ ID NO: 475721 - RNA, 64 nt, hsa; identical to SEQ ID NO: 133202

SEQ ID NO: 475722 - RNA, 64 nt, hsa; identical to SEQ ID NO: 133203

SEQ ID NO: 475723 - RNA, 64 nt, hsa
aaaaaaaaaaaaaaaaaaaaagaaauugaauugggggagucauggucaggggugagaccugaag

SEQ ID NO: 475724 - RNA, 64 nt, hsa
ucugaaaagggcaucucaauggcauggguggguggggagucagucaugucacugaaauugaaug

SEQ ID NO: 475725 - RNA, 64 nt, hsa
cggaacggagaaagguggacuggaaggggcccgugggagucaucucaaccauccccuccguggc

SEQ ID NO: 475726 - RNA, 64 nt, hsa
gcucccuaccaccuccccagccuuugaucagguggggagucagggaccccugcccuugucccac

SEQ ID NO: 475727 - RNA, 64 nt, hsa
uccaccaagccagcaccccaccaucccuuugcaggggagucaaagggccagaacuccuuggggg

SEQ ID NO: 475728 - RNA, 64 nt, hsa
ccuggugugggccagcugguguuggguggccccagggagucacacagucuguacccggccccga

SEQ ID NO: 475729 - RNA, 64 nt, hsa
aguguggcuccccuucugauucaguauuuugcauggggguuagagaagguuugagguagacucu

SEQ ID NO: 475730 - RNA, 64 nt, hsa
agggcugucccaagucaauggaaagggaaaggguggggguuaggggaagguuggggggacccag

SEQ ID NO: 475731 - RNA, 64 nt, hsa
gugucguguugcagcagagugacgauggggguugggggguuauuuauuuugccuguccuuaucc

SEQ ID NO: 475732 - RNA, 64 nt, hsa
uaggacugaugaugcauuuuagcuuugagcuuuuggggguuauucuaccaacaaacaguccauu

SEQ ID NO: 475733 - RNA, 64 nt, hsa
uucaguccuucaggucauuuuaagguccacugcaggggguuagugagaaaggguauacuuugug

SEQ ID NO: 475734 - RNA, 64 nt, hsa
ugcugucuucgugcucugugugaaggggaagcugggggguuagcaugaagucuggccuugugug

SEQ ID NO: 475735 - RNA, 64 nt, hsa
aagauuucuaaaauuuaccagaacaguuuagccuggggguuaauaguuaagucuugaggcuaag

SEQ ID NO: 475736 - RNA, 64 nt, hsa
auuuuuuuuuuccuuggggaaacuggcaggcaauggggguuagggagguuggggcggugggggc

SEQ ID NO: 475737 - RNA, 64 nt, hsa
aaaaaaaccuuguaaauucuagaagaguggcuagggggguuauucauuuguauucaacuaagga

SEQ ID NO: 475738 - RNA, 64 nt, hsa
gaaaggacuggacugccuugauugacauggggaaggggguuaguagacuauguggauugcggca

SEQ ID NO: 475739 - RNA, 64 nt, hsa
cccucuccgcacagcguggagacggggcaaggagggggguuauuaggauuggugguuuuguuuu

SEQ ID NO: 475740 - RNA, 64 nt, hsa
ucgaucucauucaguauuaaaggggggagggggaggggguuacaaacugcaauagagacuguag

SEQ ID NO: 475741 - RNA, 64 nt, hsa
ugguaccccugacuguaaguggugggagagggagggggguuaauggaacugggucugggauuau

SEQ ID NO: 475742 - RNA, 64 nt, hsa
aagaaauagcgguuagcgggccgggcgggggaucggggguuagggguggaguccgccaaaggcc

SEQ ID NO: 475743 - RNA, 64 nt, hsa
ugguggggcucucuguggggcaaaaaggugguauggggguuagcacuggcucucguucucaccg

SEQ ID NO: 475744 - RNA, 64 nt, hsa
cccacaagucucugggcugggcagccgggggcggggggguuagcuucguuccaggugggugacc

SEQ ID NO: 475745 - RNA, 64 nt, hsa
cacugcuggcagugggugggccacugggacugacggggguuaaagggcauuuuacuaaggcagc

SEQ ID NO: 475746 - RNA, 64 nt, hsa
aaccaugcaaaauugagcuuugguggggcugggaggggguuauguauucaugggaccuuuaauu

SEQ ID NO: 475747 - RNA, 64 nt, hsa
ugaggggagguggcaggagagaauucuacauuuaggggguuaggcugaaaaguguucaauuagc

SEQ ID NO: 475748 - RNA, 64 nt, hsa
aaggcccucugagaaaggaagcugcuuagagccaggggguuagugggugaggggagcgagugcu

SEQ ID NO: 475749 - RNA, 64 nt, hsa
gccacacaccgguauuccaaaccuuaacaaugaaggggguuagucucuuuuauuugauucuuaa

SEQ ID NO: 475750 - RNA, 64 nt, hsa
ucaucuucaugagggaacugaggucuugggggguggggguuacccaaauagguucacagaagaa

SEQ ID NO: 475751 - RNA, 64 nt, hsa
ucauggaaauuuggaauuacaaaauaaacguccuggggguuacccagaauacagauuuaaaagu

SEQ ID NO: 475752 - RNA, 64 nt, hsa
aaauaaccaagucaaaaccauguacuaucuccuuggggguuagggaugcuaagaagagcccaca

SEQ ID NO: 475753 - RNA, 64 nt, hsa
cagauaaagccaaacuugcuggguuacauuccuuggggguuagacacccuucaucacaagaugu

SEQ ID NO: 475754 - RNA, 64 nt, hsa
ucugccugaaauggggggugugggaggugguggcggggguuauucucuuuccuucaggaaauga

SEQ ID NO: 475755 - RNA, 64 nt, hsa
cacucaugaaauuuacuucaguuaauaugagacuggggguuaaguuguaacuaauaugcaaaau

SEQ ID NO: 475756 - RNA, 64 nt, hsa
aucuuggauuuucuaaaaguaggacagugguuuuggggguuauccacuuuuauuuuuuugaaac

SEQ ID NO: 475757 - RNA, 64 nt, hsa
uuuucccugcauuuuuucccaacaaaauuuuguuggggguuauguuacugaagaaugaacagau

SEQ ID NO: 475758 - RNA, 64 nt, hsa
uaaaagcuuugacauuuuauguuuuauucauaaaggggguuaauuauuugcuacaaagaagcac

SEQ ID NO: 475759 - RNA, 64 nt, hsa
ucagccuuccuggcuggcuuuuggauaucugcuaggggguuagaguggucucagcggcaggugg

SEQ ID NO: 475760 - RNA, 64 nt, hsa
ccuuucccauuucguguaauauucucugauguuuggggguuaccaaaaauaucccuuuuucaca

SEQ ID NO: 475761 - RNA, 64 nt, hsa
cuaugauuuuuacaauucugauucuguauccccuggggguuaucccaguugcuucuuuaggaug

SEQ ID NO: 475762 - RNA, 64 nt, hsa
uacauagccucugugagccucaucgguaaacaguggggguuaugaaacccaccucacaggguug

SEQ ID NO: 475763 - RNA, 64 nt, hsa
caaauagaauauauaauauugaauuuaagauuugggggguuaaaaaagaaaacuuaacuuuaua

SEQ ID NO: 475764 - RNA, 64 nt, hsa
ucagacuaaagcuacccaaggacuuagcagauauggggguuacaucagugcuggucauuguagc

SEQ ID NO: 475765 - RNA, 64 nt, hsa
guguuugggucacaguuccuacaaauacggaaaaggggguuaaaaagcagugcuuucaugaaug

SEQ ID NO: 475766 - RNA, 64 nt, hsa
gggcucuaccacugcauuuucacauguaccuucaggggguuaucuuuuuuuuuuuccccuccua

SEQ ID NO: 475767 - RNA, 64 nt, hsa
aaacaaggaaaacccaauaauuccgaggaacauuggggguuaaauaccaagaauaaaaauuggu

SEQ ID NO: 475768 - RNA, 64 nt, hsa
ccaucuauuacaucuacagcugacccuugaacauggggguuaggggagcugacaauucgugggu

SEQ ID NO: 475769 - RNA, 64 nt, hsa
cucccaaaggacccccuccuaauaccaucacauuggggguuaggguuucaacauaugaauugcg

SEQ ID NO: 475770 - RNA, 64 nt, hsa
gcuuggggcaauugguaaaggaaagagcagguguggggguuaagcacuuauuugaggugggggu

SEQ ID NO: 475771 - RNA, 64 nt, hsa
gaaaaauuaacaaaagacagaaggccugacuuugggggguuagggcaagggguuccucuggauu

SEQ ID NO: 475772 - RNA, 64 nt, hsa
cuaaaauacccaugcugcuuuucugaguguugauggggguuaccagcuugauccacuguugcuc

SEQ ID NO: 475773 - RNA, 64 nt, hsa
caugggguggggagcuucucccagaguggccccaggggguuagaggaggggugaagauuggggc

SEQ ID NO: 475774 - RNA, 64 nt, hsa
gaaugagccugcgguugggagggaauggggcgugggggguuagagcaggaccacagccugguga

SEQ ID NO: 475775 - RNA, 64 nt, hsa
uaucuuuauauuucugucucaaaaaugaagagaaggggguuauggguuaaguugcugccuuuua

SEQ ID NO: 475776 - RNA, 64 nt, hsa
aggguguguuuuuuuuaaccuguugugugcguguggggguuaggauuaguaaggugaacuguuc

SEQ ID NO: 475777 - RNA, 64 nt, hsa
uuaagagcuuuaaauaugaggguuguguuucuggggggguuauuuuuuuggugugugugugugu

SEQ ID NO: 475778 - RNA, 64 nt, hsa
cccccacugcaaauagagaacagcggugggggauggggguuaaaaaguagagaaccuccuuucu

SEQ ID NO: 475779 - RNA, 64 nt, hsa
uucgaaagcuguguucuuuuugaauaccgugcauggggguuaagcugauguuaaaacaguuugc

SEQ ID NO: 475780 - RNA, 64 nt, hsa
caaaguucuguagcugauggucauuuaauugcauggggguuauuuuaucuuucaugauuguggu

SEQ ID NO: 475781 - RNA, 64 nt, hsa
gcucccagagccuuuggugccagguuugugggauggggguuagcgucuauguguggaaggccac

SEQ ID NO: 475782 - RNA, 64 nt, hsa
ugcucuacacuacuguuugacuugaucuucuucuggggguuagggagaaaucugucuccauauu

SEQ ID NO: 475783 - RNA, 64 nt, hsa
ggaaagagaaggggcagcuuccggauuuucuuuuggggguuagaaggucagguguggagacugc

SEQ ID NO: 475784 - RNA, 64 nt, hsa
guuuuauauuuaggcauugggggauggggugggaggggguuauaguucaugaggguuuucuaag

SEQ ID NO: 475785 - RNA, 64 nt, hsa
gaagauuacuuaagaauguguugacacauuuggaggggguuaauuuaccaguuaucauuuacua

SEQ ID NO: 475786 - RNA, 64 nt, hsa
caugacaagcauuuugugaacuagggaagcucagggggguuacuggcuucucuugagucacacu

SEQ ID NO: 475787 - RNA, 64 nt, hsa
acugcguccugggcuuuacgagaccaugcaagacggggguuagugaggaaggaggauuuggggu

SEQ ID NO: 475788 - RNA, 64 nt, hsa
uuagcuuuuuuaaaaaaaaaaaaaaaaaaauuggggggguuaauuuaucauucagaaaucuugc

SEQ ID NO: 475789 - RNA, 64 nt, hsa
cuacaagggcauggcucacaaaagguuaauggauggggguuaccuagcccuggcuaauuccccu

SEQ ID NO: 475790 - RNA, 64 nt, hsa
uuaagccauguguuccaaggcauuuuagcggggaggggguuaucaaaaaaaaaaaaaugugacu

SEQ ID NO: 475791 - RNA, 64 nt, hsa
gaguggcaggccuaggccccuccgauugucccuuggggguuaccccucagcccaccucacuaug

SEQ ID NO: 475792 - RNA, 64 nt, hsa
gcuuuugaauuuuugguuauuuuuguguuucuuuggggguuagaccacuuucugauuagccgcc

SEQ ID NO: 475793 - RNA, 64 nt, hsa
gaaaccauaugauaacacaaauucacauauaauuggggguuagucccauacucuauaacagacu

SEQ ID NO: 475794 - RNA, 64 nt, hsa
uuuucuuucauccaccccuuuccuuuuuuuggaaggggguuauauaugagaguucauugaagaa

SEQ ID NO: 475795 - RNA, 64 nt, hsa
augugacuaccaaucaguuugauacucaaggaaaggggguuauucaagaaauugaaaauuucau

SEQ ID NO: 475796 - RNA, 64 nt, hsa
ccugcuggguguuuuuuuuuaaaaggccauuuugggggguuauuuauuuuuuaagaaaaaaagc

SEQ ID NO: 475797 - RNA, 64 nt, hsa
cuaucaguguucuuguuauaacccccuauuuucaggggguuaaaaaucagcuuuaaaaaaauac

SEQ ID NO: 475798 - RNA, 64 nt, hsa
uaguauggaauugauugugauucuuuugggggaaggggguuacuaucccuuuggcuuaaagcca

SEQ ID NO: 475799 - RNA, 64 nt, hsa
aauuaauuauaaagccuaaagcaaaguuagauuuggggguuauucagccaaaauuaccguuuua

SEQ ID NO: 475800 - RNA, 64 nt, hsa
cugccauccucacucacuucucauaaauggaucuggggguuagaguggaggaaauaaaauccug

SEQ ID NO: 475801 - RNA, 64 nt, hsa
uuggguuccuguguuugugcauaugaagggagauggggguuagguggaggaggagagcagcgug

SEQ ID NO: 475802 - RNA, 64 nt, hsa
uaguauggaauugguugugauucuuuuuggggaaggggguuauuguuccuuuggcuuaaagcca

SEQ ID NO: 475803 - RNA, 64 nt, hsa
guaaauuuuauuuaaucuguuuuuuuguuuguuuggggguuauuuggggggagguugguuuugu

SEQ ID NO: 475804 - RNA, 64 nt, hsa
acagugugccugucccacuguuacacgcaugaauggggguuaugggguggggguggggacucag

SEQ ID NO: 475805 - RNA, 64 nt, hsa
cacuagagcugcagguaccagccacucggccccaggggguuauggccacagagggauaggcaca

SEQ ID NO: 475806 - RNA, 64 nt, hsa
agaagauguggaugaauucaggcacuggggguggggggguuauuuauaaacacaaggugguugg

SEQ ID NO: 475807 - RNA, 50 nt, hsa
ugggccacucccgggggugaggggguuaccccuucccaguguuuuuuauu

SEQ ID NO: 475808 - RNA, 64 nt, hsa
uucuuaccuagcugucacuuuuuuaaaugccucuggggguuauuuuugcuuuccuuggccccca

SEQ ID NO: 475809 - RNA, 64 nt, hsa
gcagcccagccccaucggcagguggccccugccuggggguuauucgggaugguucagccagggc

SEQ ID NO: 475810 - RNA, 64 nt, hsa
caccccccugcagcaacuaagauggugggggagaggggguuagaauaaagcaucugaauacagu

SEQ ID NO: 475811 - RNA, 64 nt, hsa
gauguccugaaauuccaccacgggggucacccugggggguuagggaccuauuuuuaacacuagg

SEQ ID NO: 475812 - RNA, 64 nt, hsa
caccacgcccagccuucccuugcacuuuuaaugaggggguuaaguucacuguuuucucuuucua

SEQ ID NO: 475813 - RNA, 64 nt, hsa
acuggagggugcugagccgaagggacggugggagggggguuauggugcaaguguugggggggag

SEQ ID NO: 475814 - RNA, 64 nt, hsa
guaaaauuacaacaaaaggcauuauaauuuuguuggggguuaauuuuaugaaaauuaugcucaa

SEQ ID NO: 475815 - RNA, 64 nt, hsa
uuucuuaggagcaagaagaaaauguggcccuaaaggggguuaguugagggguaggggguaguga

SEQ ID NO: 475816 - RNA, 64 nt, hsa
uggggucuggucgugggcaggauggugcccagaaggggguuagguugucccagugaaaauucug

SEQ ID NO: 475817 - RNA, 64 nt, hsa
uuuaaaaacagaauuguguuaugugaucaguuuuggggguuaacuuugcuuaauuccucaggcu

SEQ ID NO: 475818 - RNA, 64 nt, hsa
uuauuuuuagcuuuguuuuuuuauaagccuuuuuggggguuaaaauagaguuucuuacauuuuu

SEQ ID NO: 475819 - RNA, 64 nt, hsa
aacaaauucuucaaccuuucuuugucuuucuuauggggguuaccaaauauuuuggccucagaau

SEQ ID NO: 475820 - RNA, 64 nt, hsa
gaucuccauccacuuuucuccugggggcugggcuggggguuagggcugggacugugcccccaca

SEQ ID NO: 475821 - RNA, 64 nt, hsa
cucagucagugcacugggcaagcuagaaguguugggggguuaauguccccaggagcagcaaccc

SEQ ID NO: 475822 - RNA, 64 nt, hsa
ccauccccccuucccuucccgucacguccuguuuggggguuaauucgguuuuuucucuguugca

SEQ ID NO: 475823 - RNA, 64 nt, hsa
acucucagaacacugggagggucuggcacuugauggggguuaguugcuuggcagccugccugcc

SEQ ID NO: 475824 - RNA, 64 nt, hsa
uucccucagugugguuuccugaagccagugauauggggguuaggauaggaagaacuuucucggu

SEQ ID NO: 475825 - RNA, 64 nt, hsa
uguuuauuucugaguaaggggcuuuguugaaagaggggguuagagagagcaagacagcacuuga

SEQ ID NO: 475826 - RNA, 64 nt, hsa
accugacaaaaaaaaaguuccagguguggaauauggggguuaucuguacauccuggggcauuaa

SEQ ID NO: 475827 - RNA, 64 nt, hsa
ucuuauguccacaaaagucacagucugaggugcuggggguuaggacuucaauauauaaauuuug

SEQ ID NO: 475828 - RNA, 64 nt, hsa
uccucuuggguccccucaagcagacggggcucaaggggguuacauuuaauaaaaggaugaagau

SEQ ID NO: 475829 - RNA, 64 nt, hsa
auuuguucagugacuauucucggggcccuguguaggggguuauugccucugaaaugccucuucu

SEQ ID NO: 475830 - RNA, 64 nt, hsa
uuauuuuuguucaucugcugcuguuuacauucugggggguuagggggagucccccucccucccu

SEQ ID NO: 475831 - RNA, 64 nt, hsa
caauuaaggguggggggcggggguugggggguugggggguuagggcagggaggggacuggggaa

SEQ ID NO: 475832 - RNA, 64 nt, hsa
cgcugcauccggaagucgcugugcccugguugagggggguuagggaggagugagugggacucaa

SEQ ID NO: 475833 - RNA, 64 nt, hsa
gaguaauauauacccagaguaugucuauagcagaggggguuaugggggcgggaggguagacuga

SEQ ID NO: 475834 - RNA, 64 nt, hsa
gaaccagaguucaaaguccuaugcaaccuuaggaggggguuagagagucuguuuugauugaugu

SEQ ID NO: 475835 - RNA, 64 nt, hsa
ugugggaggauguucagcagcgcggcagagucauggggguuaaucccuauauccugaagaagaa

SEQ ID NO: 475836 - RNA, 64 nt, hsa
uaaauauauuuaauuuaaugaucauuauauauguggggguuaauauguuguuuuucugucccuu

SEQ ID NO: 475837 - RNA, 64 nt, hsa
ucagagcugccaucaucacuuuuugaauuucuuuggggguuauuuaaugaaaaacaugcuaugu

SEQ ID NO: 475838 - RNA, 64 nt, hsa
cugucucgggugucagcuuaacauuccacagaugggggguuaguuuuuauauccuauaauacaa

SEQ ID NO: 475839 - RNA, 64 nt, hsa
gggcgggggacaucucgggguuucagggugggcaggggguuaguuuggggaggggggggugcgu

SEQ ID NO: 475840 - RNA, 64 nt, hsa
cuagcaagugauggagcccagauuucaaaccaaaggggguuacguccaggggcugaguucccac

SEQ ID NO: 475841 - RNA, 64 nt, hsa; identical to SEQ ID NO: 475723

SEQ ID NO: 475842 - RNA, 64 nt, hsa; identical to SEQ ID NO: 475724

SEQ ID NO: 475843 - RNA, 64 nt, hsa; identical to SEQ ID NO: 475725

SEQ ID NO: 475844 - RNA, 64 nt, hsa; identical to SEQ ID NO: 475726

SEQ ID NO: 475845 - RNA, 64 nt, hsa; identical to SEQ ID NO: 475727

SEQ ID NO: 475846 - RNA, 64 nt, hsa; identical to SEQ ID NO: 475728

SEQ ID NO: 475847 - RNA, 64 nt, hsa; identical to SEQ ID NO: 475729

SEQ ID NO: 475848 - RNA, 64 nt, hsa; identical to SEQ ID NO: 475730

SEQ ID NO: 475849 - RNA, 64 nt, hsa; identical to SEQ ID NO: 475731

SEQ ID NO: 475850 - RNA, 64 nt, hsa; identical to SEQ ID NO: 475732

SEQ ID NO: 475851 - RNA, 64 nt, hsa; identical to SEQ ID NO: 475733

SEQ ID NO: 475852 - RNA, 64 nt, hsa; identical to SEQ ID NO: 475734

SEQ ID NO: 475853 - RNA, 64 nt, hsa; identical to SEQ ID NO: 475735

SEQ ID NO: 475854 - RNA, 64 nt, hsa; identical to SEQ ID NO: 475736

SEQ ID NO: 475855 - RNA, 64 nt, hsa; identical to SEQ ID NO: 475737

SEQ ID NO: 475856 - RNA, 64 nt, hsa; identical to SEQ ID NO: 475738

SEQ ID NO: 475857 - RNA, 64 nt, hsa; identical to SEQ ID NO: 475739

SEQ ID NO: 475858 - RNA, 64 nt, hsa; identical to SEQ ID NO: 475740

SEQ ID NO: 475859 - RNA, 64 nt, hsa; identical to SEQ ID NO: 475741

SEQ ID NO: 475860 - RNA, 64 nt, hsa; identical to SEQ ID NO: 475742

SEQ ID NO: 475861 - RNA, 64 nt, hsa; identical to SEQ ID NO: 475743

SEQ ID NO: 475862 - RNA, 64 nt, hsa; identical to SEQ ID NO: 475744

SEQ ID NO: 475863 - RNA, 64 nt, hsa; identical to SEQ ID NO: 475745

SEQ ID NO: 475864 - RNA, 64 nt, hsa; identical to SEQ ID NO: 475746

SEQ ID NO: 475865 - RNA, 64 nt, hsa; identical to SEQ ID NO: 475747

SEQ ID NO: 475866 - RNA, 64 nt, hsa; identical to SEQ ID NO: 475748

SEQ ID NO: 475867 - RNA, 64 nt, hsa; identical to SEQ ID NO: 475749

SEQ ID NO: 475868 - RNA, 64 nt, hsa; identical to SEQ ID NO: 475750

SEQ ID NO: 475869 - RNA, 64 nt, hsa; identical to SEQ ID NO: 475751

SEQ ID NO: 475870 - RNA, 64 nt, hsa; identical to SEQ ID NO: 475752

SEQ ID NO: 475871 - RNA, 64 nt, hsa; identical to SEQ ID NO: 475753

SEQ ID NO: 475872 - RNA, 64 nt, hsa; identical to SEQ ID NO: 475754

SEQ ID NO: 475873 - RNA, 64 nt, hsa; identical to SEQ ID NO: 475755

SEQ ID NO: 475874 - RNA, 64 nt, hsa; identical to SEQ ID NO: 475756

SEQ ID NO: 475875 - RNA, 64 nt, hsa; identical to SEQ ID NO: 475757

SEQ ID NO: 475876 - RNA, 64 nt, hsa; identical to SEQ ID NO: 475758

SEQ ID NO: 475877 - RNA, 64 nt, hsa; identical to SEQ ID NO: 475759

SEQ ID NO: 475878 - RNA, 64 nt, hsa; identical to SEQ ID NO: 475760

SEQ ID NO: 475879 - RNA, 64 nt, hsa; identical to SEQ ID NO: 475761

SEQ ID NO: 475880 - RNA, 64 nt, hsa; identical to SEQ ID NO: 475762

SEQ ID NO: 475881 - RNA, 64 nt, hsa; identical to SEQ ID NO: 475763

SEQ ID NO: 475882 - RNA, 64 nt, hsa; identical to SEQ ID NO: 475764

SEQ ID NO: 475883 - RNA, 64 nt, hsa; identical to SEQ ID NO: 475765

SEQ ID NO: 475884 - RNA, 64 nt, hsa; identical to SEQ ID NO: 475766

SEQ ID NO: 475885 - RNA, 64 nt, hsa; identical to SEQ ID NO: 475767

SEQ ID NO: 475886 - RNA, 64 nt, hsa; identical to SEQ ID NO: 475768

SEQ ID NO: 475887 - RNA, 64 nt, hsa; identical to SEQ ID NO: 475769

SEQ ID NO: 475888 - RNA, 64 nt, hsa; identical to SEQ ID NO: 475770

SEQ ID NO: 475889 - RNA, 64 nt, hsa; identical to SEQ ID NO: 475771

SEQ ID NO: 475890 - RNA, 64 nt, hsa; identical to SEQ ID NO: 475772

SEQ ID NO: 475891 - RNA, 64 nt, hsa; identical to SEQ ID NO: 475773

SEQ ID NO: 475892 - RNA, 64 nt, hsa; identical to SEQ ID NO: 475774

SEQ ID NO: 475893 - RNA, 64 nt, hsa; identical to SEQ ID NO: 475775

SEQ ID NO: 475894 - RNA, 64 nt, hsa; identical to SEQ ID NO: 475776

SEQ ID NO: 475895 - RNA, 64 nt, hsa; identical to SEQ ID NO: 475777

SEQ ID NO: 475896 - RNA, 64 nt, hsa; identical to SEQ ID NO: 475778

SEQ ID NO: 475897 - RNA, 64 nt, hsa; identical to SEQ ID NO: 475779

SEQ ID NO: 475898 - RNA, 64 nt, hsa; identical to SEQ ID NO: 475780

SEQ ID NO: 475899 - RNA, 64 nt, hsa; identical to SEQ ID NO: 475781

SEQ ID NO: 475900 - RNA, 64 nt, hsa; identical to SEQ ID NO: 475782

SEQ ID NO: 475901 - RNA, 64 nt, hsa; identical to SEQ ID NO: 475783

SEQ ID NO: 475902 - RNA, 64 nt, hsa; identical to SEQ ID NO: 475784

SEQ ID NO: 475903 - RNA, 64 nt, hsa; identical to SEQ ID NO: 475785

SEQ ID NO: 475904 - RNA, 64 nt, hsa; identical to SEQ ID NO: 475786

SEQ ID NO: 475905 - RNA, 64 nt, hsa; identical to SEQ ID NO: 475787

SEQ ID NO: 475906 - RNA, 64 nt, hsa; identical to SEQ ID NO: 475788

SEQ ID NO: 475907 - RNA, 64 nt, hsa; identical to SEQ ID NO: 475789

SEQ ID NO: 475908 - RNA, 64 nt, hsa; identical to SEQ ID NO: 475790

SEQ ID NO: 475909 - RNA, 64 nt, hsa; identical to SEQ ID NO: 475791

SEQ ID NO: 475910 - RNA, 64 nt, hsa; identical to SEQ ID NO: 475792

SEQ ID NO: 475911 - RNA, 64 nt, hsa; identical to SEQ ID NO: 475793

SEQ ID NO: 475912 - RNA, 64 nt, hsa; identical to SEQ ID NO: 475794

SEQ ID NO: 475913 - RNA, 64 nt, hsa; identical to SEQ ID NO: 475795

SEQ ID NO: 475914 - RNA, 64 nt, hsa; identical to SEQ ID NO: 475796

SEQ ID NO: 475915 - RNA, 64 nt, hsa; identical to SEQ ID NO: 475797

SEQ ID NO: 475916 - RNA, 64 nt, hsa; identical to SEQ ID NO: 475798

SEQ ID NO: 475917 - RNA, 64 nt, hsa; identical to SEQ ID NO: 475799

SEQ ID NO: 475918 - RNA, 64 nt, hsa; identical to SEQ ID NO: 475800

SEQ ID NO: 475919 - RNA, 64 nt, hsa; identical to SEQ ID NO: 475801

SEQ ID NO: 475920 - RNA, 64 nt, hsa; identical to SEQ ID NO: 475802

SEQ ID NO: 475921 - RNA, 64 nt, hsa; identical to SEQ ID NO: 475803

SEQ ID NO: 475922 - RNA, 64 nt, hsa; identical to SEQ ID NO: 475804

SEQ ID NO: 475923 - RNA, 64 nt, hsa; identical to SEQ ID NO: 475805

SEQ ID NO: 475924 - RNA, 64 nt, hsa; identical to SEQ ID NO: 475806

SEQ ID NO: 475925 - RNA, 50 nt, hsa; identical to SEQ ID NO: 475807

SEQ ID NO: 475926 - RNA, 64 nt, hsa; identical to SEQ ID NO: 475808

SEQ ID NO: 475927 - RNA, 64 nt, hsa; identical to SEQ ID NO: 475809

SEQ ID NO: 475928 - RNA, 64 nt, hsa; identical to SEQ ID NO: 475810

SEQ ID NO: 475929 - RNA, 64 nt, hsa; identical to SEQ ID NO: 475811

SEQ ID NO: 475930 - RNA, 64 nt, hsa; identical to SEQ ID NO: 475812

SEQ ID NO: 475931 - RNA, 64 nt, hsa; identical to SEQ ID NO: 475813

SEQ ID NO: 475932 - RNA, 64 nt, hsa; identical to SEQ ID NO: 475814

SEQ ID NO: 475933 - RNA, 64 nt, hsa; identical to SEQ ID NO: 475815

SEQ ID NO: 475934 - RNA, 64 nt, hsa; identical to SEQ ID NO: 475816

SEQ ID NO: 475935 - RNA, 64 nt, hsa; identical to SEQ ID NO: 475817

SEQ ID NO: 475936 - RNA, 64 nt, hsa; identical to SEQ ID NO: 475818

SEQ ID NO: 475937 - RNA, 64 nt, hsa; identical to SEQ ID NO: 475819

SEQ ID NO: 475938 - RNA, 64 nt, hsa; identical to SEQ ID NO: 475820

SEQ ID NO: 475939 - RNA, 64 nt, hsa; identical to SEQ ID NO: 475821

SEQ ID NO: 475940 - RNA, 64 nt, hsa; identical to SEQ ID NO: 475822

SEQ ID NO: 475941 - RNA, 64 nt, hsa; identical to SEQ ID NO: 475823

SEQ ID NO: 475942 - RNA, 64 nt, hsa; identical to SEQ ID NO: 475824

SEQ ID NO: 475943 - RNA, 64 nt, hsa; identical to SEQ ID NO: 475825

SEQ ID NO: 475944 - RNA, 64 nt, hsa; identical to SEQ ID NO: 475826

SEQ ID NO: 475945 - RNA, 64 nt, hsa; identical to SEQ ID NO: 475827

SEQ ID NO: 475946 - RNA, 64 nt, hsa; identical to SEQ ID NO: 475828

SEQ ID NO: 475947 - RNA, 64 nt, hsa; identical to SEQ ID NO: 475829

SEQ ID NO: 475948 - RNA, 64 nt, hsa; identical to SEQ ID NO: 475830

SEQ ID NO: 475949 - RNA, 64 nt, hsa; identical to SEQ ID NO: 475831

SEQ ID NO: 475950 - RNA, 64 nt, hsa; identical to SEQ ID NO: 475832

SEQ ID NO: 475951 - RNA, 64 nt, hsa; identical to SEQ ID NO: 475833

SEQ ID NO: 475952 - RNA, 64 nt, hsa; identical to SEQ ID NO: 475834

SEQ ID NO: 475953 - RNA, 64 nt, hsa; identical to SEQ ID NO: 475835

SEQ ID NO: 475954 - RNA, 64 nt, hsa; identical to SEQ ID NO: 475836

SEQ ID NO: 475955 - RNA, 64 nt, hsa; identical to SEQ ID NO: 475837

SEQ ID NO: 475956 - RNA, 64 nt, hsa; identical to SEQ ID NO: 475838

SEQ ID NO: 475957 - RNA, 64 nt, hsa; identical to SEQ ID NO: 475839

SEQ ID NO: 475958 - RNA, 64 nt, hsa; identical to SEQ ID NO: 475840

SEQ ID NO: 475959 - RNA, 64 nt, hsa
uuucuguuuuuagcagagacaugcaacaacaacacacacgcacacacgcacacacacacacgua

SEQ ID NO: 475960 - RNA, 64 nt, hsa
uuuagcagagacaugcaacaacaacacacacgcacacacgcacacacacacacguacacacaca

SEQ ID NO: 475961 - RNA, 64 nt, hsa
cacuucuucagcaccacacacacgcacacacacacacacgcacacaugcgugugcacccgcgca

SEQ ID NO: 475962 - RNA, 64 nt, hsa
aaggccaagcaaccuccacuucuucagcaccacacacacgcacacacacacacacgcacacaug

SEQ ID NO: 475963 - RNA, 64 nt, hsa
gaaacuggacucacauucgacauaccccacugggcacacgcacaaacacacacacuauggggug

SEQ ID NO: 475964 - RNA, 64 nt, hsa
cugggcuccccccagugggaugggacagggaggccacacgcacuggugccaaaaccaggccucu

SEQ ID NO: 475965 - RNA, 64 nt, hsa
gcgcacacgugcucccugaaggcacacguacgcacacacgcacaugcacagauaugccgccugg

SEQ ID NO: 475966 - RNA, 64 nt, hsa
gccugggcacacagauaagcugcccaaaugcacgcacacgcacagagacaugccagaacauaca

SEQ ID NO: 475967 - RNA, 64 nt, hsa
gccagaacauacaaggacaugcugccugaacauacacacgcacacccaugcgcagaugugcugc

SEQ ID NO: 475968 - RNA, 64 nt, hsa
acacacgugcacaggcgcagauaugcugccuggacacacgcagauaugcugucuagucacacac

SEQ ID NO: 475969 - RNA, 64 nt, hsa
cuggacacacgcagauaugcugucuagucacacacacacgcagacaugcuguccggacacacac

SEQ ID NO: 475970 - RNA, 64 nt, hsa
ucacacacacacgcagacaugcuguccggacacacacacgcaugcacagauaugcuguccggac

SEQ ID NO: 475971 - RNA, 64 nt, hsa
acacacgcaugcacagauaugcuguccggacacacacacgcacgcagauaugcugccuggacac

SEQ ID NO: 475972 - RNA, 64 nt, hsa
acaugcacacacgugcagauaugcuguccggauacacacgcacgcacacaugcagauaugcugc

SEQ ID NO: 475973 - RNA, 64 nt, hsa
acaugcacacacaggugcagauaugcugccuggacacacgcagacugacgugcuuuugggaggg

SEQ ID NO: 475974 - RNA, 64 nt, hsa
gccugugcaaauucugaugauggccccacccccgcacacgcacacgcacaucaugcuuuuccag

SEQ ID NO: 475975 - RNA, 64 nt, hsa
gcaaauucugaugauggccccacccccgcacacgcacacgcacaucaugcuuuuccagcucauc

SEQ ID NO: 475976 - RNA, 64 nt, hsa
gcaaauucugaugaugaccccacccccgcacacgcacacgcacaucaugcuuuuccagcucauc

SEQ ID NO: 475977 - RNA, 64 nt, hsa
gccugugcaaauucugaugaugaccccacccccgcacacgcacacgcacaucaugcuuuuccag

SEQ ID NO: 475978 - RNA, 64 nt, hsa
aaaugggagcuagaggguugugacccuucauacacacacgcacgcacgcacacaaacaugcaca

SEQ ID NO: 475979 - RNA, 64 nt, hsa
cauacacacacgcacgcacgcacacaaacaugcacacacgcaugcacacacacaaagccuuaag

SEQ ID NO: 475980 - RNA, 64 nt, hsa
uggucuccaugccugugcccucacacagguguagcacacgcaugugcagauggcaccacggccg

SEQ ID NO: 475981 - RNA, 64 nt, hsa
acaccagaaucuuccagaagcccagcuccacccgcacacgcagcuucccauccaguccuucaac

SEQ ID NO: 475982 - RNA, 64 nt, hsa
cacacacacacacacacacacacacacacgcacgcacacgcacacaucuuaccucucaugcgug

SEQ ID NO: 475983 - RNA, 64 nt, hsa
cagccugggacacacacacacacacacacacacacacacgcacgcacacgcacacaucuuaccu

SEQ ID NO: 475984 - RNA, 64 nt, hsa
caggaaugaaccgaggccgucgccccugcacacgcacacgcacacagccugguuuuguccucau

SEQ ID NO: 475985 - RNA, 64 nt, hsa
uuuccccaggaaugaaccgaggccgucgccccugcacacgcacacgcacacagccugguuuugu

SEQ ID NO: 475986 - RNA, 64 nt, hsa
gucccucuaacaagaacuugucucagcacaugcgcacacgcacacucggacucacacgaaguca

SEQ ID NO: 475987 - RNA, 64 nt, hsa
caugcgcacacgcacacucggacucacacgaagucacacgcacacaugcacgcacacacacaua

SEQ ID NO: 475988 - RNA, 64 nt, hsa
uaugcucaugugugggcacacacgcacaaacacacacacgcacgcacacaguggcagaagggau

SEQ ID NO: 475989 - RNA, 64 nt, hsa
uuucugugaauuaaaauaugcucaugugugggcacacacgcacaaacacacacacgcacgcaca

SEQ ID NO: 475990 - RNA, 64 nt, hsa
aggagcgaaccggucagcaccaaguaacaccacacacacgcagcacccaggaugaugguuucac

SEQ ID NO: 475991 - RNA, 64 nt, hsa
gccucuuuuuccccuagugaaauacuccacguugcacacgcagucugcagagccgccgccgccg

SEQ ID NO: 475992 - RNA, 64 nt, hsa
gcccccaugauucaauuaccucccccugggucugucccacaacacgugggaauucugggagaua

SEQ ID NO: 475993 - RNA, 64 nt, hsa
gcccccaugauucaauuaccuccccuugggucucucccacaacacgugggaauucugguagaua

SEQ ID NO: 475994 - RNA, 64 nt, hsa
gcauuuugggguuauguuuaaaaaaacauuauugucccacaauauuaccuuaagauuuuucuuu

SEQ ID NO: 475995 - RNA, 64 nt, hsa
uuggacugagauuucuuaaaucuuucuucaaaucucccacaaguauauacuuuuaaauuaugga

SEQ ID NO: 475996 - RNA, 64 nt, hsa
ggcccccaugauucaauuaccucccccgggucccucccacaacacaugggaauucugagagaua

SEQ ID NO: 475997 - RNA, 64 nt, hsa
gccccccugauucgaugaccucccccugggucccucccacaacaugugggaauuccagaagaua

SEQ ID NO: 475998 - RNA, 64 nt, hsa
gugcccuccaagcaucuaauggcuuauuaaauuaucccacaaguggguuuuaggcuccuuuuuu

SEQ ID NO: 475999 - RNA, 64 nt, hsa
agucccuuacugcaaauguguuagcucuaacaucucccacaagcuagaggaacuugcgaguaua

SEQ ID NO: 476000 - RNA, 64 nt, hsa
cuucagcuguagcacuuggcagaaacgugaugugucccacaaacugcugguggaggaagaagau

SEQ ID NO: 476001 - RNA, 64 nt, hsa
gcagaugggacugucaaaguugugcugcccucccucccacaaacaaaugaauccagcguggagg

SEQ ID NO: 476002 - RNA, 64 nt, hsa; identical to SEQ ID NO: 106200

SEQ ID NO: 476003 - RNA, 64 nt, hsa; identical to SEQ ID NO: 106201

SEQ ID NO: 476004 - RNA, 64 nt, hsa; identical to SEQ ID NO: 106202

SEQ ID NO: 476005 - RNA, 64 nt, hsa; identical to SEQ ID NO: 106203

SEQ ID NO: 476006 - RNA, 64 nt, hsa; identical to SEQ ID NO: 106204

SEQ ID NO: 476007 - RNA, 64 nt, hsa; identical to SEQ ID NO: 106205

SEQ ID NO: 476008 - RNA, 64 nt, hsa; identical to SEQ ID NO: 106206

SEQ ID NO: 476009 - RNA, 64 nt, hsa; identical to SEQ ID NO: 106207

SEQ ID NO: 476010 - RNA, 64 nt, hsa; identical to SEQ ID NO: 211358

SEQ ID NO: 476011 - RNA, 64 nt, hsa; identical to SEQ ID NO: 211359

SEQ ID NO: 476012 - RNA, 64 nt, hsa; identical to SEQ ID NO: 211360

SEQ ID NO: 476013 - RNA, 64 nt, hsa; identical to SEQ ID NO: 211361

SEQ ID NO: 476014 - RNA, 64 nt, hsa; identical to SEQ ID NO: 211362

SEQ ID NO: 476015 - RNA, 64 nt, hsa; identical to SEQ ID NO: 211363

SEQ ID NO: 476016 - RNA, 64 nt, hsa; identical to SEQ ID NO: 211364

SEQ ID NO: 476017 - RNA, 64 nt, hsa; identical to SEQ ID NO: 211365

SEQ ID NO: 476018 - RNA, 64 nt, hsa; identical to SEQ ID NO: 211366

SEQ ID NO: 476019 - RNA, 64 nt, hsa; identical to SEQ ID NO: 211367

SEQ ID NO: 476020 - RNA, 64 nt, hsa; identical to SEQ ID NO: 211368

SEQ ID NO: 476021 - RNA, 64 nt, hsa; identical to SEQ ID NO: 211369

SEQ ID NO: 476022 - RNA, 64 nt, hsa; identical to SEQ ID NO: 211370

SEQ ID NO: 476023 - RNA, 64 nt, hsa; identical to SEQ ID NO: 211371

SEQ ID NO: 476024 - RNA, 64 nt, hsa; identical to SEQ ID NO: 211372

SEQ ID NO: 476025 - RNA, 64 nt, hsa; identical to SEQ ID NO: 211373

SEQ ID NO: 476026 - RNA, 64 nt, hsa; identical to SEQ ID NO: 211374

SEQ ID NO: 476027 - RNA, 64 nt, hsa; identical to SEQ ID NO: 211375

SEQ ID NO: 476028 - RNA, 50 nt, hsa; identical to SEQ ID NO: 178066

SEQ ID NO: 476029 - RNA, 64 nt, hsa; identical to SEQ ID NO: 211377

SEQ ID NO: 476030 - RNA, 64 nt, hsa; identical to SEQ ID NO: 211378

SEQ ID NO: 476031 - RNA, 64 nt, hsa; identical to SEQ ID NO: 211379

SEQ ID NO: 476032 - RNA, 64 nt, hsa; identical to SEQ ID NO: 211380

SEQ ID NO: 476033 - RNA, 64 nt, hsa; identical to SEQ ID NO: 211381

SEQ ID NO: 476034 - RNA, 64 nt, hsa; identical to SEQ ID NO: 211382

SEQ ID NO: 476035 - RNA, 64 nt, hsa; identical to SEQ ID NO: 211383

SEQ ID NO: 476036 - RNA, 64 nt, hsa; identical to SEQ ID NO: 211384

SEQ ID NO: 476037 - RNA, 64 nt, hsa; identical to SEQ ID NO: 211385

SEQ ID NO: 476038 - RNA, 64 nt, hsa; identical to SEQ ID NO: 211386

SEQ ID NO: 476039 - RNA, 64 nt, hsa; identical to SEQ ID NO: 211387

SEQ ID NO: 476040 - RNA, 64 nt, hsa; identical to SEQ ID NO: 211388

SEQ ID NO: 476041 - RNA, 64 nt, hsa; identical to SEQ ID NO: 211389

SEQ ID NO: 476042 - RNA, 64 nt, hsa; identical to SEQ ID NO: 211390

SEQ ID NO: 476043 - RNA, 64 nt, hsa; identical to SEQ ID NO: 211391

SEQ ID NO: 476044 - RNA, 64 nt, hsa; identical to SEQ ID NO: 211392

SEQ ID NO: 476045 - RNA, 64 nt, hsa; identical to SEQ ID NO: 211393

SEQ ID NO: 476046 - RNA, 64 nt, hsa; identical to SEQ ID NO: 211394

SEQ ID NO: 476047 - RNA, 64 nt, hsa; identical to SEQ ID NO: 211395

SEQ ID NO: 476048 - RNA, 64 nt, hsa; identical to SEQ ID NO: 211396

SEQ ID NO: 476049 - RNA, 64 nt, hsa; identical to SEQ ID NO: 211397

SEQ ID NO: 476050 - RNA, 64 nt, hsa; identical to SEQ ID NO: 211398

SEQ ID NO: 476051 - RNA, 64 nt, hsa; identical to SEQ ID NO: 211399

SEQ ID NO: 476052 - RNA, 64 nt, hsa; identical to SEQ ID NO: 211400

SEQ ID NO: 476053 - RNA, 64 nt, hsa; identical to SEQ ID NO: 211401

SEQ ID NO: 476054 - RNA, 64 nt, hsa; identical to SEQ ID NO: 211402

SEQ ID NO: 476055 - RNA, 64 nt, hsa; identical to SEQ ID NO: 211403

SEQ ID NO: 476056 - RNA, 64 nt, hsa; identical to SEQ ID NO: 211404

SEQ ID NO: 476057 - RNA, 64 nt, hsa; identical to SEQ ID NO: 211405

SEQ ID NO: 476058 - RNA, 64 nt, hsa; identical to SEQ ID NO: 211406

SEQ ID NO: 476059 - RNA, 64 nt, hsa; identical to SEQ ID NO: 211407

SEQ ID NO: 476060 - RNA, 64 nt, hsa; identical to SEQ ID NO: 211408

SEQ ID NO: 476061 - RNA, 64 nt, hsa; identical to SEQ ID NO: 211409

SEQ ID NO: 476062 - RNA, 64 nt, hsa; identical to SEQ ID NO: 211410

SEQ ID NO: 476063 - RNA, 64 nt, hsa; identical to SEQ ID NO: 211411

SEQ ID NO: 476064 - RNA, 64 nt, hsa; identical to SEQ ID NO: 211412

SEQ ID NO: 476065 - RNA, 64 nt, hsa; identical to SEQ ID NO: 211413

SEQ ID NO: 476066 - RNA, 64 nt, hsa; identical to SEQ ID NO: 211414

SEQ ID NO: 476067 - RNA, 64 nt, hsa; identical to SEQ ID NO: 211415

SEQ ID NO: 476068 - RNA, 64 nt, hsa; identical to SEQ ID NO: 211416

SEQ ID NO: 476069 - RNA, 64 nt, hsa; identical to SEQ ID NO: 211417

SEQ ID NO: 476070 - RNA, 64 nt, hsa; identical to SEQ ID NO: 211418

SEQ ID NO: 476071 - RNA, 64 nt, hsa; identical to SEQ ID NO: 211419

SEQ ID NO: 476072 - RNA, 64 nt, hsa; identical to SEQ ID NO: 211420

SEQ ID NO: 476073 - RNA, 64 nt, hsa; identical to SEQ ID NO: 211421

SEQ ID NO: 476074 - RNA, 64 nt, hsa; identical to SEQ ID NO: 211422

SEQ ID NO: 476075 - RNA, 64 nt, hsa; identical to SEQ ID NO: 211423

SEQ ID NO: 476076 - RNA, 64 nt, hsa; identical to SEQ ID NO: 211424

SEQ ID NO: 476077 - RNA, 64 nt, hsa; identical to SEQ ID NO: 211425

SEQ ID NO: 476078 - RNA, 64 nt, hsa; identical to SEQ ID NO: 211426

SEQ ID NO: 476079 - RNA, 64 nt, hsa; identical to SEQ ID NO: 211427

SEQ ID NO: 476080 - RNA, 64 nt, hsa; identical to SEQ ID NO: 211428

SEQ ID NO: 476081 - RNA, 64 nt, hsa; identical to SEQ ID NO: 211429

SEQ ID NO: 476082 - RNA, 64 nt, hsa; identical to SEQ ID NO: 211430

SEQ ID NO: 476083 - RNA, 64 nt, hsa; identical to SEQ ID NO: 211424

SEQ ID NO: 476084 - RNA, 64 nt, hsa; identical to SEQ ID NO: 211423

SEQ ID NO: 476085 - RNA, 64 nt, hsa; identical to SEQ ID NO: 211433

SEQ ID NO: 476086 - RNA, 64 nt, hsa; identical to SEQ ID NO: 211434

SEQ ID NO: 476087 - RNA, 64 nt, hsa; identical to SEQ ID NO: 211435

SEQ ID NO: 476088 - RNA, 64 nt, hsa; identical to SEQ ID NO: 211436

SEQ ID NO: 476089 - RNA, 64 nt, hsa; identical to SEQ ID NO: 211437

SEQ ID NO: 476090 - RNA, 64 nt, hsa; identical to SEQ ID NO: 211438

SEQ ID NO: 476091 - RNA, 64 nt, hsa; identical to SEQ ID NO: 211439

SEQ ID NO: 476092 - RNA, 64 nt, hsa; identical to SEQ ID NO: 211440

SEQ ID NO: 476093 - RNA, 64 nt, hsa; identical to SEQ ID NO: 211441

SEQ ID NO: 476094 - RNA, 64 nt, hsa; identical to SEQ ID NO: 211442

SEQ ID NO: 476095 - RNA, 64 nt, hsa; identical to SEQ ID NO: 211443

SEQ ID NO: 476096 - RNA, 64 nt, hsa; identical to SEQ ID NO: 211444

SEQ ID NO: 476097 - RNA, 64 nt, hsa; identical to SEQ ID NO: 211445

SEQ ID NO: 476098 - RNA, 64 nt, hsa; identical to SEQ ID NO: 211446

SEQ ID NO: 476099 - RNA, 64 nt, hsa; identical to SEQ ID NO: 211447

SEQ ID NO: 476100 - RNA, 64 nt, hsa; identical to SEQ ID NO: 211448

SEQ ID NO: 476101 - RNA, 64 nt, hsa; identical to SEQ ID NO: 211449

SEQ ID NO: 476102 - RNA, 64 nt, hsa; identical to SEQ ID NO: 211450

SEQ ID NO: 476103 - RNA, 64 nt, hsa; identical to SEQ ID NO: 211451

SEQ ID NO: 476104 - RNA, 64 nt, hsa; identical to SEQ ID NO: 211452

SEQ ID NO: 476105 - RNA, 64 nt, hsa; identical to SEQ ID NO: 211453

SEQ ID NO: 476106 - RNA, 64 nt, hsa; identical to SEQ ID NO: 211454

SEQ ID NO: 476107 - RNA, 64 nt, hsa; identical to SEQ ID NO: 211455

SEQ ID NO: 476108 - RNA, 64 nt, hsa; identical to SEQ ID NO: 211456

SEQ ID NO: 476109 - RNA, 64 nt, hsa; identical to SEQ ID NO: 211457

SEQ ID NO: 476110 - RNA, 64 nt, hsa; identical to SEQ ID NO: 211458

SEQ ID NO: 476111 - RNA, 64 nt, hsa; identical to SEQ ID NO: 211459

SEQ ID NO: 476112 - RNA, 64 nt, hsa; identical to SEQ ID NO: 211460

SEQ ID NO: 476113 - RNA, 64 nt, hsa; identical to SEQ ID NO: 211461

SEQ ID NO: 476114 - RNA, 64 nt, hsa; identical to SEQ ID NO: 211462

SEQ ID NO: 476115 - RNA, 64 nt, hsa; identical to SEQ ID NO: 211463

SEQ ID NO: 476116 - RNA, 64 nt, hsa; identical to SEQ ID NO: 211464

SEQ ID NO: 476117 - RNA, 64 nt, hsa; identical to SEQ ID NO: 211465

SEQ ID NO: 476118 - RNA, 64 nt, hsa; identical to SEQ ID NO: 211466

SEQ ID NO: 476119 - RNA, 64 nt, hsa; identical to SEQ ID NO: 211467

SEQ ID NO: 476120 - RNA, 64 nt, hsa; identical to SEQ ID NO: 211468

SEQ ID NO: 476121 - RNA, 64 nt, hsa; identical to SEQ ID NO: 211469

SEQ ID NO: 476122 - RNA, 64 nt, hsa; identical to SEQ ID NO: 211470

SEQ ID NO: 476123 - RNA, 64 nt, hsa; identical to SEQ ID NO: 211471

SEQ ID NO: 476124 - RNA, 64 nt, hsa; identical to SEQ ID NO: 211472

SEQ ID NO: 476125 - RNA, 64 nt, hsa; identical to SEQ ID NO: 211473

SEQ ID NO: 476126 - RNA, 64 nt, hsa; identical to SEQ ID NO: 211474

SEQ ID NO: 476127 - RNA, 64 nt, hsa; identical to SEQ ID NO: 211475

SEQ ID NO: 476128 - RNA, 64 nt, hsa; identical to SEQ ID NO: 211476

SEQ ID NO: 476129 - RNA, 64 nt, hsa; identical to SEQ ID NO: 211477

SEQ ID NO: 476130 - RNA, 64 nt, hsa; identical to SEQ ID NO: 211478

SEQ ID NO: 476131 - RNA, 64 nt, hsa; identical to SEQ ID NO: 211479

SEQ ID NO: 476132 - RNA, 64 nt, hsa; identical to SEQ ID NO: 211480

SEQ ID NO: 476133 - RNA, 64 nt, hsa; identical to SEQ ID NO: 211481

SEQ ID NO: 476134 - RNA, 64 nt, hsa; identical to SEQ ID NO: 211482

SEQ ID NO: 476135 - RNA, 64 nt, hsa; identical to SEQ ID NO: 211483

SEQ ID NO: 476136 - RNA, 64 nt, hsa; identical to SEQ ID NO: 211484

SEQ ID NO: 476137 - RNA, 64 nt, hsa; identical to SEQ ID NO: 211485

SEQ ID NO: 476138 - RNA, 64 nt, hsa; identical to SEQ ID NO: 211486

SEQ ID NO: 476139 - RNA, 64 nt, hsa; identical to SEQ ID NO: 211487

SEQ ID NO: 476140 - RNA, 64 nt, hsa; identical to SEQ ID NO: 211488

SEQ ID NO: 476141 - RNA, 64 nt, hsa; identical to SEQ ID NO: 211489

SEQ ID NO: 476142 - RNA, 64 nt, hsa; identical to SEQ ID NO: 211490

SEQ ID NO: 476143 - RNA, 64 nt, hsa; identical to SEQ ID NO: 211491

SEQ ID NO: 476144 - RNA, 64 nt, hsa; identical to SEQ ID NO: 211492

SEQ ID NO: 476145 - RNA, 64 nt, hsa; identical to SEQ ID NO: 211493

SEQ ID NO: 476146 - RNA, 64 nt, hsa; identical to SEQ ID NO: 211494

SEQ ID NO: 476147 - RNA, 64 nt, hsa; identical to SEQ ID NO: 211495

SEQ ID NO: 476148 - RNA, 64 nt, hsa; identical to SEQ ID NO: 211496

SEQ ID NO: 476149 - RNA, 64 nt, hsa; identical to SEQ ID NO: 211497

SEQ ID NO: 476150 - RNA, 64 nt, hsa; identical to SEQ ID NO: 211498

SEQ ID NO: 476151 - RNA, 64 nt, hsa; identical to SEQ ID NO: 211499

SEQ ID NO: 476152 - RNA, 64 nt, hsa; identical to SEQ ID NO: 211500

SEQ ID NO: 476153 - RNA, 64 nt, hsa; identical to SEQ ID NO: 211501

SEQ ID NO: 476154 - RNA, 64 nt, hsa; identical to SEQ ID NO: 211502

SEQ ID NO: 476155 - RNA, 64 nt, hsa; identical to SEQ ID NO: 211503

SEQ ID NO: 476156 - RNA, 64 nt, hsa; identical to SEQ ID NO: 211504

SEQ ID NO: 476157 - RNA, 64 nt, hsa; identical to SEQ ID NO: 211505

SEQ ID NO: 476158 - RNA, 64 nt, hsa; identical to SEQ ID NO: 211506

SEQ ID NO: 476159 - RNA, 64 nt, hsa; identical to SEQ ID NO: 211507

SEQ ID NO: 476160 - RNA, 64 nt, hsa; identical to SEQ ID NO: 211508

SEQ ID NO: 476161 - RNA, 64 nt, hsa; identical to SEQ ID NO: 211509

SEQ ID NO: 476162 - RNA, 64 nt, hsa; identical to SEQ ID NO: 211510

SEQ ID NO: 476163 - RNA, 64 nt, hsa; identical to SEQ ID NO: 211511

SEQ ID NO: 476164 - RNA, 64 nt, hsa; identical to SEQ ID NO: 211512

SEQ ID NO: 476165 - RNA, 64 nt, hsa; identical to SEQ ID NO: 211513

SEQ ID NO: 476166 - RNA, 64 nt, hsa; identical to SEQ ID NO: 211514

SEQ ID NO: 476167 - RNA, 64 nt, hsa; identical to SEQ ID NO: 211515

SEQ ID NO: 476168 - RNA, 64 nt, hsa; identical to SEQ ID NO: 211516

SEQ ID NO: 476169 - RNA, 64 nt, hsa; identical to SEQ ID NO: 211517

SEQ ID NO: 476170 - RNA, 64 nt, hsa; identical to SEQ ID NO: 211518

SEQ ID NO: 476171 - RNA, 64 nt, hsa; identical to SEQ ID NO: 211519

SEQ ID NO: 476172 - RNA, 64 nt, hsa; identical to SEQ ID NO: 211520

SEQ ID NO: 476173 - RNA, 64 nt, hsa; identical to SEQ ID NO: 211521

SEQ ID NO: 476174 - RNA, 64 nt, hsa; identical to SEQ ID NO: 211522

SEQ ID NO: 476175 - RNA, 64 nt, hsa; identical to SEQ ID NO: 211523

SEQ ID NO: 476176 - RNA, 64 nt, hsa; identical to SEQ ID NO: 211524

SEQ ID NO: 476177 - RNA, 64 nt, hsa; identical to SEQ ID NO: 211525

SEQ ID NO: 476178 - RNA, 64 nt, hsa; identical to SEQ ID NO: 211526

SEQ ID NO: 476179 - RNA, 64 nt, hsa; identical to SEQ ID NO: 211527

SEQ ID NO: 476180 - RNA, 64 nt, hsa; identical to SEQ ID NO: 211528

SEQ ID NO: 476181 - RNA, 64 nt, hsa; identical to SEQ ID NO: 211529

SEQ ID NO: 476182 - RNA, 64 nt, hsa; identical to SEQ ID NO: 211530

SEQ ID NO: 476183 - RNA, 64 nt, hsa; identical to SEQ ID NO: 211531

SEQ ID NO: 476184 - RNA, 64 nt, hsa; identical to SEQ ID NO: 211532

SEQ ID NO: 476185 - RNA, 64 nt, hsa; identical to SEQ ID NO: 211533

SEQ ID NO: 476186 - RNA, 64 nt, hsa; identical to SEQ ID NO: 211534

SEQ ID NO: 476187 - RNA, 64 nt, hsa; identical to SEQ ID NO: 211535

SEQ ID NO: 476188 - RNA, 64 nt, hsa; identical to SEQ ID NO: 211536

SEQ ID NO: 476189 - RNA, 64 nt, hsa; identical to SEQ ID NO: 211537

SEQ ID NO: 476190 - RNA, 64 nt, hsa; identical to SEQ ID NO: 211538

SEQ ID NO: 476191 - RNA, 64 nt, hsa; identical to SEQ ID NO: 211539

SEQ ID NO: 476192 - RNA, 64 nt, hsa; identical to SEQ ID NO: 211540

SEQ ID NO: 476193 - RNA, 64 nt, hsa; identical to SEQ ID NO: 211541

SEQ ID NO: 476194 - RNA, 64 nt, hsa; identical to SEQ ID NO: 211542

SEQ ID NO: 476195 - RNA, 64 nt, hsa; identical to SEQ ID NO: 211543

SEQ ID NO: 476196 - RNA, 64 nt, hsa; identical to SEQ ID NO: 211544

SEQ ID NO: 476197 - RNA, 64 nt, hsa; identical to SEQ ID NO: 211545

SEQ ID NO: 476198 - RNA, 64 nt, hsa; identical to SEQ ID NO: 211546

SEQ ID NO: 476199 - RNA, 64 nt, hsa; identical to SEQ ID NO: 211547

SEQ ID NO: 476200 - RNA, 64 nt, hsa; identical to SEQ ID NO: 211548

SEQ ID NO: 476201 - RNA, 64 nt, hsa; identical to SEQ ID NO: 211549

SEQ ID NO: 476202 - RNA, 64 nt, hsa; identical to SEQ ID NO: 211550

SEQ ID NO: 476203 - RNA, 64 nt, hsa; identical to SEQ ID NO: 211551

SEQ ID NO: 476204 - RNA, 64 nt, hsa; identical to SEQ ID NO: 211552

SEQ ID NO: 476205 - RNA, 64 nt, hsa; identical to SEQ ID NO: 211553

SEQ ID NO: 476206 - RNA, 64 nt, hsa; identical to SEQ ID NO: 211554

SEQ ID NO: 476207 - RNA, 64 nt, hsa; identical to SEQ ID NO: 211555

SEQ ID NO: 476208 - RNA, 64 nt, hsa; identical to SEQ ID NO: 211556

SEQ ID NO: 476209 - RNA, 64 nt, hsa; identical to SEQ ID NO: 211557

SEQ ID NO: 476210 - RNA, 64 nt, hsa; identical to SEQ ID NO: 211558

SEQ ID NO: 476211 - RNA, 64 nt, hsa; identical to SEQ ID NO: 211559

SEQ ID NO: 476212 - RNA, 64 nt, hsa; identical to SEQ ID NO: 211560

SEQ ID NO: 476213 - RNA, 64 nt, hsa; identical to SEQ ID NO: 126810

SEQ ID NO: 476214 - RNA, 64 nt, hsa; identical to SEQ ID NO: 126811

SEQ ID NO: 476215 - RNA, 64 nt, hsa; identical to SEQ ID NO: 126812

SEQ ID NO: 476216 - RNA, 64 nt, hsa; identical to SEQ ID NO: 126813

SEQ ID NO: 476217 - RNA, 64 nt, hsa; identical to SEQ ID NO: 126814

SEQ ID NO: 476218 - RNA, 64 nt, hsa; identical to SEQ ID NO: 126815

SEQ ID NO: 476219 - RNA, 64 nt, hsa; identical to SEQ ID NO: 126816

SEQ ID NO: 476220 - RNA, 64 nt, hsa; identical to SEQ ID NO: 126817

SEQ ID NO: 476221 - RNA, 64 nt, hsa; identical to SEQ ID NO: 126818

SEQ ID NO: 476222 - RNA, 64 nt, hsa; identical to SEQ ID NO: 126819

SEQ ID NO: 476223 - RNA, 64 nt, hsa; identical to SEQ ID NO: 126820

SEQ ID NO: 476224 - RNA, 64 nt, hsa; identical to SEQ ID NO: 126821

SEQ ID NO: 476225 - RNA, 64 nt, hsa; identical to SEQ ID NO: 126822

SEQ ID NO: 476226 - RNA, 64 nt, hsa; identical to SEQ ID NO: 126823

SEQ ID NO: 476227 - RNA, 64 nt, hsa; identical to SEQ ID NO: 126824

SEQ ID NO: 476228 - RNA, 64 nt, hsa; identical to SEQ ID NO: 126825

SEQ ID NO: 476229 - RNA, 64 nt, hsa; identical to SEQ ID NO: 126826

SEQ ID NO: 476230 - RNA, 64 nt, hsa; identical to SEQ ID NO: 126827

SEQ ID NO: 476231 - RNA, 64 nt, hsa; identical to SEQ ID NO: 126828

SEQ ID NO: 476232 - RNA, 64 nt, hsa
aaagucauuuaaaauagaaccucauauaguaugaacaaacuauaaaaauauuuuacauuucaug

SEQ ID NO: 476233 - RNA, 64 nt, hsa
caaaguaacauguaauuguuucuaaaagaaauguacaaacuagaauuuuaauauaaagaaaugu

SEQ ID NO: 476234 - RNA, 63 nt, hsa
auucaacaaccaggguauagccagauaagagaaacaaacuauuuuuuuugauggauugcagua

SEQ ID NO: 476235 - RNA, 64 nt, hsa
auaguuuauaagauaaugcaaagaacuuucucugacaaacuaacugcaguaacagaaaccuuuc

SEQ ID NO: 476236 - RNA, 64 nt, hsa
accugagacuugccgucuggcauuuuaguuuaauacaaacuaaugauugcauuugaaagagauu

SEQ ID NO: 476237 - RNA, 64 nt, hsa
uuuuccaacagugauggcuuccacauaagguuaaacaaacuaggugcuuguaaauaauuuauua

SEQ ID NO: 476238 - RNA, 64 nt, hsa
ugcuaagagugguuuguguaaaacuauuuuauaaacaaacuacagagccuaaaugugcaaauua

SEQ ID NO: 476239 - RNA, 64 nt, hsa
gaagaaagagucuuuguaaauggacauugaacaaacaaacuaccaaagauuccuccacugacua

SEQ ID NO: 476240 - RNA, 64 nt, hsa
agguaauacaaacuauauauaaucaucaaguaauacaaacuaauuuaguaauagccuggguuaa

SEQ ID NO: 476241 - RNA, 64 nt, hsa
acaauucauuguguuaccuguagauucagguaauacaaacuauauauaaucaucaaguaauaca

SEQ ID NO: 476242 - RNA, 64 nt, hsa
ugggcaacagagcaagaccuugucucaaaaauaaacaaacuaaaauuaaaaaaagaagacgaga

SEQ ID NO: 476243 - RNA, 64 nt, hsa
ggcagaggcagagaugggagugaugcggacggacacaaacuaagggaugccacgaugccaagca

SEQ ID NO: 476244 - RNA, 64 nt, hsa
uuacucuggauguuugguauuuuuuuacauuaaaacaaacuaaagcaaaauuuagaagaaagaa

SEQ ID NO: 476245 - RNA, 64 nt, hsa
aucuaaucauuuuuaugacaaauugcagcaccaaacaaacuaauagcaacccauggcugugauu

SEQ ID NO: 476246 - RNA, 64 nt, hsa; identical to SEQ ID NO: 155381

SEQ ID NO: 476247 - RNA, 64 nt, hsa; identical to SEQ ID NO: 155382

SEQ ID NO: 476248 - RNA, 64 nt, hsa; identical to SEQ ID NO: 104346

SEQ ID NO: 476249 - RNA, 64 nt, hsa; identical to SEQ ID NO: 104347

SEQ ID NO: 476250 - RNA, 64 nt, hsa; identical to SEQ ID NO: 104348

SEQ ID NO: 476251 - RNA, 64 nt, hsa; identical to SEQ ID NO: 104349

SEQ ID NO: 476252 - RNA, 64 nt, hsa; identical to SEQ ID NO: 104350

SEQ ID NO: 476253 - RNA, 64 nt, hsa; identical to SEQ ID NO: 104351

SEQ ID NO: 476254 - RNA, 64 nt, hsa; identical to SEQ ID NO: 104352

SEQ ID NO: 476255 - RNA, 64 nt, hsa; identical to SEQ ID NO: 104353

SEQ ID NO: 476256 - RNA, 64 nt, hsa; identical to SEQ ID NO: 104354

SEQ ID NO: 476257 - RNA, 64 nt, hsa; identical to SEQ ID NO: 104355

SEQ ID NO: 476258 - RNA, 64 nt, hsa; identical to SEQ ID NO: 104356

SEQ ID NO: 476259 - RNA, 64 nt, hsa; identical to SEQ ID NO: 104357

SEQ ID NO: 476260 - RNA, 64 nt, hsa; identical to SEQ ID NO: 104358

SEQ ID NO: 476261 - RNA, 64 nt, hsa; identical to SEQ ID NO: 104359

SEQ ID NO: 476262 - RNA, 64 nt, hsa; identical to SEQ ID NO: 104360

SEQ ID NO: 476263 - RNA, 64 nt, hsa; identical to SEQ ID NO: 104361

SEQ ID NO: 476264 - RNA, 64 nt, hsa; identical to SEQ ID NO: 104362

SEQ ID NO: 476265 - RNA, 64 nt, hsa; identical to SEQ ID NO: 104363

SEQ ID NO: 476266 - RNA, 64 nt, hsa; identical to SEQ ID NO: 104364

SEQ ID NO: 476267 - RNA, 64 nt, hsa; identical to SEQ ID NO: 104365

SEQ ID NO: 476268 - RNA, 64 nt, hsa; identical to SEQ ID NO: 104366

SEQ ID NO: 476269 - RNA, 64 nt, hsa; identical to SEQ ID NO: 104367

SEQ ID NO: 476270 - RNA, 64 nt, hsa; identical to SEQ ID NO: 104368

SEQ ID NO: 476271 - RNA, 64 nt, hsa; identical to SEQ ID NO: 104369

SEQ ID NO: 476272 - RNA, 64 nt, hsa; identical to SEQ ID NO: 104370

SEQ ID NO: 476273 - RNA, 64 nt, hsa; identical to SEQ ID NO: 104371

SEQ ID NO: 476274 - RNA, 64 nt, hsa; identical to SEQ ID NO: 104372

SEQ ID NO: 476275 - RNA, 64 nt, hsa; identical to SEQ ID NO: 104373

SEQ ID NO: 476276 - RNA, 64 nt, hsa; identical to SEQ ID NO: 104374

SEQ ID NO: 476277 - RNA, 64 nt, hsa; identical to SEQ ID NO: 104375

SEQ ID NO: 476278 - RNA, 64 nt, hsa; identical to SEQ ID NO: 104376

SEQ ID NO: 476279 - RNA, 64 nt, hsa; identical to SEQ ID NO: 104377

SEQ ID NO: 476280 - RNA, 64 nt, hsa; identical to SEQ ID NO: 104378

SEQ ID NO: 476281 - RNA, 64 nt, hsa; identical to SEQ ID NO: 104379

SEQ ID NO: 476282 - RNA, 64 nt, hsa; identical to SEQ ID NO: 104380

SEQ ID NO: 476283 - RNA, 64 nt, hsa; identical to SEQ ID NO: 104381

SEQ ID NO: 476284 - RNA, 64 nt, hsa; identical to SEQ ID NO: 104382

SEQ ID NO: 476285 - RNA, 64 nt, hsa; identical to SEQ ID NO: 104383

SEQ ID NO: 476286 - RNA, 64 nt, hsa; identical to SEQ ID NO: 104384

SEQ ID NO: 476287 - RNA, 64 nt, hsa; identical to SEQ ID NO: 104385

SEQ ID NO: 476288 - RNA, 64 nt, hsa; identical to SEQ ID NO: 104386

SEQ ID NO: 476289 - RNA, 64 nt, hsa; identical to SEQ ID NO: 104387

SEQ ID NO: 476290 - RNA, 64 nt, hsa; identical to SEQ ID NO: 104388

SEQ ID NO: 476291 - RNA, 64 nt, hsa; identical to SEQ ID NO: 104389

SEQ ID NO: 476292 - RNA, 64 nt, hsa; identical to SEQ ID NO: 104390

SEQ ID NO: 476293 - RNA, 64 nt, hsa; identical to SEQ ID NO: 104391

SEQ ID NO: 476294 - RNA, 64 nt, hsa; identical to SEQ ID NO: 104392

SEQ ID NO: 476295 - RNA, 64 nt, hsa; identical to SEQ ID NO: 104393

SEQ ID NO: 476296 - RNA, 64 nt, hsa; identical to SEQ ID NO: 104394

SEQ ID NO: 476297 - RNA, 64 nt, hsa; identical to SEQ ID NO: 104395

SEQ ID NO: 476298 - RNA, 64 nt, hsa; identical to SEQ ID NO: 104396

SEQ ID NO: 476299 - RNA, 64 nt, hsa; identical to SEQ ID NO: 104397

SEQ ID NO: 476300 - RNA, 64 nt, hsa; identical to SEQ ID NO: 104398

SEQ ID NO: 476301 - RNA, 64 nt, hsa; identical to SEQ ID NO: 104399

SEQ ID NO: 476302 - RNA, 64 nt, hsa; identical to SEQ ID NO: 104400

SEQ ID NO: 476303 - RNA, 64 nt, hsa; identical to SEQ ID NO: 104401

SEQ ID NO: 476304 - RNA, 64 nt, hsa; identical to SEQ ID NO: 104402

SEQ ID NO: 476305 - RNA, 64 nt, hsa; identical to SEQ ID NO: 104403

SEQ ID NO: 476306 - RNA, 64 nt, hsa; identical to SEQ ID NO: 104404

SEQ ID NO: 476307 - RNA, 64 nt, hsa; identical to SEQ ID NO: 104405

SEQ ID NO: 476308 - RNA, 64 nt, hsa; identical to SEQ ID NO: 104406

SEQ ID NO: 476309 - RNA, 64 nt, hsa; identical to SEQ ID NO: 104407

SEQ ID NO: 476310 - RNA, 64 nt, hsa; identical to SEQ ID NO: 104408

SEQ ID NO: 476311 - RNA, 64 nt, hsa; identical to SEQ ID NO: 104409

SEQ ID NO: 476312 - RNA, 64 nt, hsa; identical to SEQ ID NO: 104410

SEQ ID NO: 476313 - RNA, 64 nt, hsa; identical to SEQ ID NO: 104411

SEQ ID NO: 476314 - RNA, 64 nt, hsa; identical to SEQ ID NO: 104412

SEQ ID NO: 476315 - RNA, 64 nt, hsa; identical to SEQ ID NO: 104413

SEQ ID NO: 476316 - RNA, 64 nt, hsa; identical to SEQ ID NO: 104414

SEQ ID NO: 476317 - RNA, 64 nt, hsa; identical to SEQ ID NO: 104415

SEQ ID NO: 476318 - RNA, 64 nt, hsa; identical to SEQ ID NO: 104416

SEQ ID NO: 476319 - RNA, 64 nt, hsa; identical to SEQ ID NO: 104417

SEQ ID NO: 476320 - RNA, 64 nt, hsa; identical to SEQ ID NO: 104418

SEQ ID NO: 476321 - RNA, 64 nt, hsa; identical to SEQ ID NO: 104419

SEQ ID NO: 476322 - RNA, 64 nt, hsa; identical to SEQ ID NO: 104420

SEQ ID NO: 476323 - RNA, 64 nt, hsa; identical to SEQ ID NO: 104421

SEQ ID NO: 476324 - RNA, 64 nt, hsa; identical to SEQ ID NO: 104422

SEQ ID NO: 476325 - RNA, 64 nt, hsa; identical to SEQ ID NO: 104423

SEQ ID NO: 476326 - RNA, 64 nt, hsa; identical to SEQ ID NO: 104424

SEQ ID NO: 476327 - RNA, 64 nt, hsa; identical to SEQ ID NO: 104425

SEQ ID NO: 476328 - RNA, 64 nt, hsa
gccuugaaacaguuccauuuaugcugguuaagagaucccuuaagaaguuagaaggcuuaagaac

SEQ ID NO: 476329 - RNA, 64 nt, hsa
aaguuagaaggcuuaagaacugcuucaugugaacaucccuuauuaguuacaaaguuauauucac

SEQ ID NO: 476330 - RNA, 64 nt, hsa
gugcaacaguaguaggauauauuucuccuagaacaucccuuauuggcuuacaugauuuuauugc

SEQ ID NO: 476331 - RNA, 64 nt, hsa
ucuuauucuuuggucuuucauaugcauuaguuaaaucccuuaaaguagacauucauaaaaacuu

SEQ ID NO: 476332 - RNA, 64 nt, hsa
uuugaguccagcaugggcaacauaacaagaccccaucccuuauuaaaagaaaaaaaaauaauuc

SEQ ID NO: 476333 - RNA, 64 nt, hsa
caccuuaccaauauaugacauuaagugagagugaaucccuuaggacuggaacacuucaagcuca

SEQ ID NO: 476334 - RNA, 64 nt, hsa
uaaaguaaagcacccuuuuguaaugcaauuaauuaucccuuaauguaucuguuuuguaagucug

SEQ ID NO: 476335 - RNA, 64 nt, hsa
aagcaagguuguggccuuagguuggaccuggaauaucccuuauugccuauaauggaauauguga

SEQ ID NO: 476336 - RNA, 64 nt, hsa
gucaauaaaugugggaaagccuuugucaguauuaaucccuuaauugaccuaaguauacucacac

SEQ ID NO: 476337 - RNA, 64 nt, hsa
uuagaaauugaaggaauuuuucaguuccaagugcaucccuuauucuauaggaaauaaacuggag

SEQ ID NO: 476338 - RNA, 64 nt, hsa
aguauauaaaguuuugccccaugauaaaauaaguaacauauaaauuaauacauaaguuaauauu

SEQ ID NO: 476339 - RNA, 64 nt, hsa
gaaggcaacaccuguggauaaaacauuagaagaaaacauauauuuuauuuucauacuuuugaua

SEQ ID NO: 476340 - RNA, 64 nt, hsa
auauauuuaguguuuuauagaauuuuuuaaaguuaacauauaauguagauauuaauuuuuuccu

SEQ ID NO: 476341 - RNA, 64 nt, hsa
gugguagcauuaucuuagacauuaaauuugaaguaacauauauccuguaguaacauagacccaa

SEQ ID NO: 476342 - RNA, 64 nt, hsa
caguuguauauugaccaguguucuuuauugcaaaaacauauacccgauuuagcagugucagcgu

SEQ ID NO: 476343 - RNA, 64 nt, hsa
aagaaugcauuauuccacaaaaaaacagcagaccaacauauagaguguuuaaaauagcauuucu

SEQ ID NO: 476344 - RNA, 64 nt, hsa
aauggugccugauaucucaaagucuuuuguacauaacauauauauauauauacauauauauaaa

SEQ ID NO: 476345 - RNA, 64 nt, hsa
gaaacaaaagacauagaugguagacuuuuauuaaaacauauauggauguggaaagcacauauau

SEQ ID NO: 476346 - RNA, 64 nt, hsa
cagaauuuguccuuuuugguuuuauacauucacaaacauauacauuuuucuugagucucaaggu

SEQ ID NO: 476347 - RNA, 64 nt, hsa
cuaaugaagaucauauacgugaaaauuauuugaaaacauauaaagcacuauacagauucgaaac

SEQ ID NO: 476348 - RNA, 64 nt, hsa
acccaugaacuuaaaaugaaaguuaaaaauaaaaaacauauacaaauaaaaaaaucccgacuuu

SEQ ID NO: 476349 - RNA, 64 nt, hsa
ugaugggacaagaagaauaguauuuauuuaauaaaacauauauuauauugaacuauguguuaau

SEQ ID NO: 476350 - RNA, 64 nt, hsa
auuccuuuuauuuggaggguuuuacuuccuuguuaacauauaaaguuauaaaugaaggacaagg

SEQ ID NO: 476351 - RNA, 64 nt, hsa
uuauuuccuagcuuuucugaauuaaugcacucuuaacauauaauuauauuaauccuauuugugc

SEQ ID NO: 476352 - RNA, 64 nt, hsa
aaaauuauuuuuauuuuuaaaaaauuaugguaaaaacauauaaaauuuaccaucuuaaucacuu

SEQ ID NO: 476353 - RNA, 64 nt, hsa
cuuuuucaaauaucccugccuuuucccaccuggaaacauauacuguaugcgaaagaguugauau

SEQ ID NO: 476354 - RNA, 64 nt, hsa
uuuuucugaucggucguguuuguagaaaauucauaacauauauaggccaaggaaaucugcaugu

SEQ ID NO: 476355 - RNA, 64 nt, hsa
acccaccaugcugcuugaaagccacuugauccucaacauauacuauaauugcaaaggaaacaug

SEQ ID NO: 476356 - RNA, 64 nt, hsa
uauuguguagucguuagcaagaucaucauaggcaaacauauauccguuccaaggcuaaaaguga

SEQ ID NO: 476357 - RNA, 64 nt, hsa
ccugggcaacagagcgaggucccguuucuuaaaaaacauauauguguguggcguguguauauau

SEQ ID NO: 476358 - RNA, 64 nt, hsa
auauuuuuucauuguauuauuacggagacuuucaaacauauauagaaagagcauaaugaagccu

SEQ ID NO: 476359 - RNA, 64 nt, hsa
acuacaucguuggcuuuugaccuugcugaaaaggaacauauaauuguauggaugguaggauuaa

SEQ ID NO: 476360 - RNA, 64 nt, hsa
ucuguuaccacuguuagagggaguuguaucauuuaacauauaguaggauaguuuaaguguaggg

SEQ ID NO: 476361 - RNA, 64 nt, hsa
caaacauacacucacacacacaauuacuauguauaacauauaugaacauauauuauuauuaccu

SEQ ID NO: 476362 - RNA, 64 nt, hsa
cucacacacacaauuacuauguauaacauauaugaacauauauuauuauuaccuaauauaugua

SEQ ID NO: 476363 - RNA, 64 nt, hsa
uauaccuagcugucauaugaaggaaaugcaaagaaacauauauuuuauuaacuggugauuauau

SEQ ID NO: 476364 - RNA, 64 nt, hsa
gccuuuuauuaacauguuuaugguacugcauagauacggguauuuauuuuacccuaagaagauu

SEQ ID NO: 476365 - RNA, 64 nt, hsa
ucuucuuacuucacccggcugggcuccucauuuuuacggguaacagugaggcugggaaggggaa

SEQ ID NO: 476366 - RNA, 64 nt, hsa
caaaaggguaugucauggaccaaagcacuguuaguacggguauguuugcauuuggucacugaua

SEQ ID NO: 476367 - RNA, 64 nt, hsa
acgaauguuugggguuuauguuuuuuaagguaaauacggguauuguuuuuaauuauuaccaugu

SEQ ID NO: 476368 - RNA, 64 nt, hsa
ucuaaacuuguuugaugugacuuuuaauuuuaaauacggguaacaaucugaggcaauaucacua

SEQ ID NO: 476369 - RNA, 64 nt, hsa
cccacuucccacccugccccucagagacugaaauuacggguaccugaagaugggagccuuuacc

SEQ ID NO: 476370 - RNA, 64 nt, hsa
gagguuucugcauagagucuuuauguccauaagcuacggguaggucuauuuucagagcaugaua

SEQ ID NO: 476371 - RNA, 64 nt, hsa
guggcuguggucuacagaauuguuucauauaaaauacggguagagugguagaguuucaaaacuu

SEQ ID NO: 476372 - RNA, 64 nt, hsa
cuuaaauguguacauguaguugaauuucaguccuuacggguaaacagauugagcauggcucucu

SEQ ID NO: 476373 - RNA, 64 nt, hsa
uaucacaaaucuuuuacgcagaagaaauaaaaacuacggguagaaaacauaagaacuaucauaa

SEQ ID NO: 476374 - RNA, 64 nt, hsa
cucgguggagggacgcgugcggcgggacggugccuacggguacuugcagcugugucccaugugg

SEQ ID NO: 476375 - RNA, 64 nt, hsa
acucauccauuaucuuggcugugagcuccuuggguacggguaccuuguauguuuacuuuuauau

SEQ ID NO: 476376 - RNA, 64 nt, hsa
uggaguugugacugccggggccguaucaggaacguacggguaaacguguguuuucuggaugcug

SEQ ID NO: 476377 - RNA, 64 nt, hsa
auuuuauuuuauuuuuauauuuaagaaaugaaaauacggguauuuuuaaagauucuccaaaaag

SEQ ID NO: 476378 - RNA, 64 nt, hsa
uuuccugcucagcagagccccucccuucagagauuacggguacuugcacuggggagguggcugc

SEQ ID NO: 476379 - RNA, 64 nt, hsa
gcucccuguggacaaaagcacauaauucugcuguuacggguacuuugcucauacgagcuuucau

SEQ ID NO: 476380 - RNA, 64 nt, hsa
aacaaagaaaagcacaacuugagauuuuuguuguuacggguauucagccuucagucaccgucug

SEQ ID NO: 476381 - RNA, 64 nt, hsa
gaagaggggggugagcagguguauuaaaauagcuuacggguaaggccuaaaaggucaccccucg

SEQ ID NO: 476382 - RNA, 64 nt, hsa
cuuugaaagugcuuguuugggggagggaaggacauacggguaacuagaacuacccagcgagucg

SEQ ID NO: 476383 - RNA, 64 nt, hsa
aauaccuugaacgcuuauguggaaaguguuaacuuacggguauuuuugugggaauagaaaaaaa

SEQ ID NO: 476384 - RNA, 64 nt, hsa; identical to SEQ ID NO: 95461

SEQ ID NO: 476385 - RNA, 64 nt, hsa; identical to SEQ ID NO: 95462

SEQ ID NO: 476386 - RNA, 64 nt, hsa; identical to SEQ ID NO: 95463

SEQ ID NO: 476387 - RNA, 64 nt, hsa; identical to SEQ ID NO: 95464

SEQ ID NO: 476388 - RNA, 64 nt, hsa; identical to SEQ ID NO: 119429

SEQ ID NO: 476389 - RNA, 64 nt, hsa; identical to SEQ ID NO: 119430

SEQ ID NO: 476390 - RNA, 64 nt, hsa; identical to SEQ ID NO: 119431

SEQ ID NO: 476391 - RNA, 64 nt, hsa; identical to SEQ ID NO: 119432

SEQ ID NO: 476392 - RNA, 64 nt, hsa; identical to SEQ ID NO: 119433

SEQ ID NO: 476393 - RNA, 64 nt, hsa; identical to SEQ ID NO: 119434

SEQ ID NO: 476394 - RNA, 64 nt, hsa; identical to SEQ ID NO: 119435

SEQ ID NO: 476395 - RNA, 64 nt, hsa; identical to SEQ ID NO: 119436

SEQ ID NO: 476396 - RNA, 64 nt, hsa; identical to SEQ ID NO: 155596

SEQ ID NO: 476397 - RNA, 64 nt, hsa; identical to SEQ ID NO: 155597

SEQ ID NO: 476398 - RNA, 64 nt, hsa; identical to SEQ ID NO: 155598

SEQ ID NO: 476399 - RNA, 64 nt, hsa; identical to SEQ ID NO: 155599

SEQ ID NO: 476400 - RNA, 64 nt, hsa; identical to SEQ ID NO: 155600

SEQ ID NO: 476401 - RNA, 64 nt, hsa; identical to SEQ ID NO: 155601

SEQ ID NO: 476402 - RNA, 64 nt, hsa; identical to SEQ ID NO: 155602

SEQ ID NO: 476403 - RNA, 64 nt, hsa; identical to SEQ ID NO: 155603

SEQ ID NO: 476404 - RNA, 64 nt, hsa; identical to SEQ ID NO: 155604

SEQ ID NO: 476405 - RNA, 64 nt, hsa; identical to SEQ ID NO: 155605

SEQ ID NO: 476406 - RNA, 64 nt, hsa; identical to SEQ ID NO: 155606

SEQ ID NO: 476407 - RNA, 64 nt, hsa; identical to SEQ ID NO: 155607

SEQ ID NO: 476408 - RNA, 64 nt, hsa; identical to SEQ ID NO: 155608

SEQ ID NO: 476409 - RNA, 64 nt, hsa; identical to SEQ ID NO: 155609

SEQ ID NO: 476410 - RNA, 64 nt, hsa; identical to SEQ ID NO: 155610

SEQ ID NO: 476411 - RNA, 64 nt, hsa; identical to SEQ ID NO: 155611

SEQ ID NO: 476412 - RNA, 64 nt, hsa; identical to SEQ ID NO: 155612

SEQ ID NO: 476413 - RNA, 64 nt, hsa; identical to SEQ ID NO: 155613

SEQ ID NO: 476414 - RNA, 64 nt, hsa; identical to SEQ ID NO: 155614

SEQ ID NO: 476415 - RNA, 64 nt, hsa; identical to SEQ ID NO: 155615

SEQ ID NO: 476416 - RNA, 64 nt, hsa; identical to SEQ ID NO: 155616

SEQ ID NO: 476417 - RNA, 64 nt, hsa; identical to SEQ ID NO: 155617

SEQ ID NO: 476418 - RNA, 64 nt, hsa; identical to SEQ ID NO: 155618

SEQ ID NO: 476419 - RNA, 64 nt, hsa; identical to SEQ ID NO: 155619

SEQ ID NO: 476420 - RNA, 64 nt, hsa; identical to SEQ ID NO: 155620

SEQ ID NO: 476421 - RNA, 64 nt, hsa; identical to SEQ ID NO: 155621

SEQ ID NO: 476422 - RNA, 64 nt, hsa; identical to SEQ ID NO: 155622

SEQ ID NO: 476423 - RNA, 64 nt, hsa; identical to SEQ ID NO: 155623

SEQ ID NO: 476424 - RNA, 64 nt, hsa; identical to SEQ ID NO: 155624

SEQ ID NO: 476425 - RNA, 64 nt, hsa; identical to SEQ ID NO: 155625

SEQ ID NO: 476426 - RNA, 64 nt, hsa; identical to SEQ ID NO: 155626

SEQ ID NO: 476427 - RNA, 64 nt, hsa
aaugacagcuucacagccccuugaggagugaccaagccacaaaguaaauccuaaagccacaacc

SEQ ID NO: 476428 - RNA, 64 nt, hsa
uugaggagugaccaagccacaaaguaaauccuaaagccacaaccccuucuaccacugagcugcu

SEQ ID NO: 476429 - RNA, 64 nt, hsa
aguagucuuaaaaucaaaguauccaauauuuuaaagccacaaaguagauuacauaauuagcaga

SEQ ID NO: 476430 - RNA, 64 nt, hsa
uagauaaauguguguugaaugaaugugccuaugaagccacaaagaugccacauguuaguauauc

SEQ ID NO: 476431 - RNA, 64 nt, hsa
cgguagucuguggaaaccaggaagauaaaacaacagccacaaaagagaaaaucaagaguguugc

SEQ ID NO: 476432 - RNA, 64 nt, hsa
uugugucuuacagucaaguuuguagauuuucauaagccacaauuuuaaaagaugcaguaaucuu

SEQ ID NO: 476433 - RNA, 64 nt, hsa
uaacaaaauggacaugguggcuuuguuuagguagagccacaaaagaaaagacuuguaauauuuu

SEQ ID NO: 476434 - RNA, 64 nt, hsa
guacaggaacugcauugacuuucaguaaacauaaagccacaacuccuacaugauguuauguacc

SEQ ID NO: 476435 - RNA, 64 nt, hsa
guagccuggcccagcuucuaaagaggaccuucguagccacaaggcaugcuaaaccucuaggguc

SEQ ID NO: 476436 - RNA, 64 nt, hsa
guuuacauuggccuuugguuuuuuuuuuucuuucagccacaacuauaugcugauauaacucagc

SEQ ID NO: 476437 - RNA, 64 nt, hsa
agcuuuuaacuggugccuucccuguacccgcagcagccacaagugggcccagacuauugcagcc

SEQ ID NO: 476438 - RNA, 64 nt, hsa
agaaucaaucagaccuucucccugaacuuaagauagccacaaucagaaaaaggacaaggacaug

SEQ ID NO: 476439 - RNA, 64 nt, hsa
accuuucucugacauaguucuuggcaugggagccagccacaaaugagauucugacguguccagg

SEQ ID NO: 476440 - RNA, 64 nt, hsa
uauuuucccucuuccccuuuauaaauuaugcuaaagccacaaagcacauuuuuggggaucauag

SEQ ID NO: 476441 - RNA, 64 nt, hsa
cacucuugacccuacacugaaggcugaaggcagaagccacaagaggccuugagugccaccccca

SEQ ID NO: 476442 - RNA, 64 nt, hsa
caagccccugcccauggcccaauggggagccuccagccacaaguucccuguccuuaucagccac

SEQ ID NO: 476443 - RNA, 64 nt, hsa
uuccucuuucuucauucagaucuauauggcaaauagccacaauuauauaaaucauuucaagacu

SEQ ID NO: 476444 - RNA, 64 nt, hsa
gccacccuuugguuauuucagcccccaucacccaagccacaagcugaccccuucgugguuauag

SEQ ID NO: 476445 - RNA, 64 nt, hsa
ugaaccaaaucaagaauggaaucccauucacaguagccacaaaaaguauaaaauaccuaggaau

SEQ ID NO: 476446 - RNA, 64 nt, hsa
uuaauaucgcuaaucauuaaggaaaugcaaucaaagccacaaugagauaccaucucagaccugu

SEQ ID NO: 476447 - RNA, 64 nt, hsa
aagaaaaacaguguuaaucuguaguugaaagaaagcuuaguagaugagagaguucuaggcuacu

SEQ ID NO: 476448 - RNA, 64 nt, hsa
gcuuuaagcagugaaguuauccuaaugcaaaagagcuuaguagaaaaugagugguuuaccuuuu

SEQ ID NO: 476449 - RNA, 64 nt, hsa
guugagggaagguucuucaugauccacacuuugggcuuaguauuucucaggaagagcuauggcc

SEQ ID NO: 476450 - RNA, 64 nt, hsa
ucuuaaaugcaagugccuagauuagguagacuuugcuuaguauugacaacugcacaugaaaguu

SEQ ID NO: 476451 - RNA, 64 nt, hsa
cuuucuuuguacaguggggguaaaagucacagcugcuuaguacaaccaucuggguugcucaagu

SEQ ID NO: 476452 - RNA, 64 nt, hsa
uaucaccucuuuccagaacgaagcaaaguugcuggcuuaguagagcccucaauucauagagguu

SEQ ID NO: 476453 - RNA, 64 nt, hsa
agcacugccgcucaacagacaugacucagggauggcuuaguacugccccucagcagggaugacu

SEQ ID NO: 476454 - RNA, 64 nt, hsa
agcacugccgcucaacagggaugacucagggauggcuuaguacugccccucaacagggaugacu

SEQ ID NO: 476455 - RNA, 64 nt, hsa; identical to SEQ ID NO: 476453

SEQ ID NO: 476456 - RNA, 64 nt, hsa; identical to SEQ ID NO: 476453

SEQ ID NO: 476457 - RNA, 64 nt, hsa; identical to SEQ ID NO: 238476

SEQ ID NO: 476458 - RNA, 64 nt, hsa; identical to SEQ ID NO: 238477

SEQ ID NO: 476459 - RNA, 53 nt, hsa; identical to SEQ ID NO: 238478

SEQ ID NO: 476460 - RNA, 64 nt, hsa; identical to SEQ ID NO: 238479

SEQ ID NO: 476461 - RNA, 64 nt, hsa; identical to SEQ ID NO: 238480

SEQ ID NO: 476462 - RNA, 64 nt, hsa; identical to SEQ ID NO: 238481

SEQ ID NO: 476463 - RNA, 64 nt, hsa; identical to SEQ ID NO: 238482

SEQ ID NO: 476464 - RNA, 64 nt, hsa; identical to SEQ ID NO: 238483

SEQ ID NO: 476465 - RNA, 64 nt, hsa; identical to SEQ ID NO: 238484

SEQ ID NO: 476466 - RNA, 64 nt, hsa; identical to SEQ ID NO: 238485

SEQ ID NO: 476467 - RNA, 64 nt, hsa; identical to SEQ ID NO: 238486

SEQ ID NO: 476468 - RNA, 64 nt, hsa; identical to SEQ ID NO: 238487

SEQ ID NO: 476469 - RNA, 64 nt, hsa; identical to SEQ ID NO: 238488

SEQ ID NO: 476470 - RNA, 64 nt, hsa; identical to SEQ ID NO: 238489

SEQ ID NO: 476471 - RNA, 64 nt, hsa; identical to SEQ ID NO: 360046

SEQ ID NO: 476472 - RNA, 64 nt, hsa; identical to SEQ ID NO: 360047

SEQ ID NO: 476473 - RNA, 64 nt, hsa
ugcugaugaugcuaauggagaugaugguaaugauaaagacaacaacaaugauuaucaaguuccu

SEQ ID NO: 476474 - RNA, 64 nt, hsa
ugagaauucaaaaacauccuugcagaaugauucaaaagacaaaagccaggcucaacuuauagaa

SEQ ID NO: 476475 - RNA, 64 nt, hsa
uaaauaugaaagaacaaagguuauuuccuggagaaaagacaauuuauucaacaccaacgaggga

SEQ ID NO: 476476 - RNA, 63 nt, hsa
auaggaacugaccccaacaauaaacuuugauaauaaagacaauaggcuauggugauuuuauuu

SEQ ID NO: 476477 - RNA, 64 nt, hsa
uuagagcaauaaccacuuuuuaaauguaaaauaaaaagacaaaugaaaaggcacauccuugucu

SEQ ID NO: 476478 - RNA, 64 nt, hsa
ugagugaggcugaaggcuggguuugaaaaggcaaaaagacaagacauccaggcagggcuucucu

SEQ ID NO: 476479 - RNA, 64 nt, hsa
ccuuaaacauguggacccauaggugcaguuagaaaaagacaaccuauuuuuauuuauguuagaa

SEQ ID NO: 476480 - RNA, 64 nt, hsa
auccaaauaaacccugaauauuuaguaaguuuaaaaagacaaauugagaacaaguagacacacu

SEQ ID NO: 476481 - RNA, 64 nt, hsa
aggagcuaauuguucaagaaguguugaacuuuaaaaagacaagaccacuuguugaaauccagcg

SEQ ID NO: 476482 - RNA, 64 nt, hsa
ucauuguuaaugugagaacauuucugaagaugggaaagacaaauuauguagcucacaaacuggu

SEQ ID NO: 476483 - RNA, 64 nt, hsa
ggaucuuggguccuaucccuucccggaugauccgaaagacaagaaagcagaaauauuuuuaccg

SEQ ID NO: 476484 - RNA, 64 nt, hsa
ugagcuucugggccuuagcaccuucgauuuccucaaagacaacaacuaccugcccuaccccauc

SEQ ID NO: 476485 - RNA, 64 nt, hsa
uggugaugcuuucuuaguauucuacacaauaagaaaagacaaaguccucgagauucuuaugagu

SEQ ID NO: 476486 - RNA, 64 nt, hsa
aggugggggccucucuggaagcacauuuggagggaaagacaagagagccaugaggagagggcug

SEQ ID NO: 476487 - RNA, 64 nt, hsa
auauaaucaaagaauuuucuguacauauuucacuaaagacaaguuuuugggcuggaugugguag

SEQ ID NO: 476488 - RNA, 64 nt, hsa
ggcacaaaaugaaugaauaaauaaauaaaugaauaaagacaaaagccaagguguaugcucucaa

SEQ ID NO: 476489 - RNA, 64 nt, hsa
ugaauuuuugcuuuaguauuuuaauaagaauuacaaagacaauggcauacuuggggugagaggg

SEQ ID NO: 476490 - RNA, 64 nt, hsa
uuguuucuaauuuuuuuuuuguugucgugugagcaaagacaaacauaaauugaaaaacauccug

SEQ ID NO: 476491 - RNA, 64 nt, hsa
guagagaauacaacaaagaguucuaagacuuagaaaagacaauuuuguggugucauuucaucca

SEQ ID NO: 476492 - RNA, 64 nt, hsa
ggggcuucucuccuugaugcuucuuucuuuuuuuaaagacaaccugccauuaccacaugacuca

SEQ ID NO: 476493 - RNA, 64 nt, hsa
gagucccagggaaagagaaccaugccaugcugaaaaagacaaaauugaagaagaaauguagccc

SEQ ID NO: 476494 - RNA, 64 nt, hsa
uauuuuaaagucaaguugugagcaaauagaaauaaaagacaaaaggacaucacucuuaucaaau

SEQ ID NO: 476495 - RNA, 64 nt, hsa
ucuuuuuuauaaaaaaagagagaugggggagaaaaaagacaagagggaaaguauuucucuugau

SEQ ID NO: 476496 - RNA, 64 nt, hsa
ugaugguuggccauuugagucuuuguaaccuaggaaagacaaaggucugauucagauugcaugg

SEQ ID NO: 476497 - RNA, 64 nt, hsa
cacagauaaagauuuuguuuugcccugcaaauaaaaagacaauuccuuauugucugaauguaau

SEQ ID NO: 476498 - RNA, 64 nt, hsa
uuuauuacaucuuucacauuggcuauuuaaagacaaagacaaauucuguuucuugagaagagaa

SEQ ID NO: 476499 - RNA, 64 nt, hsa
guguauuuuauuacaucuuucacauuggcuauuuaaagacaaagacaaauucuguuucuugaga

SEQ ID NO: 476500 - RNA, 64 nt, hsa
guuuacaauuaauguuuucuacaugucugucuucaaagacaacaugcuuuggaaacauaugucc

SEQ ID NO: 476501 - RNA, 64 nt, hsa
gguugagugcaacaucauguauuaauaucaaaugaaagacaagggugcuguaucuuugauuauu

SEQ ID NO: 476502 - RNA, 64 nt, hsa
ccaaagagacucccacucagauucuaaagcauuuaaagacaauucuagcagaauuuaucaaaac

SEQ ID NO: 476503 - RNA, 64 nt, hsa
uugaaagcaauguucauaaauauuuaagcaaauuaaagacaauguuaacaaauuuucuauuaaa

SEQ ID NO: 476504 - RNA, 64 nt, hsa
caucaaagacaccagggcagauuuuuaaguaaagaaagacaauuggacccuuaagaauuuaugc

SEQ ID NO: 476505 - RNA, 64 nt, hsa
gcaucugagaguuucuuguuucaguaaaaaaagaaaagacaaaaaaaucagcuuuggaaaguaa

SEQ ID NO: 476506 - RNA, 64 nt, hsa
caacccagaaagguuuaaaaaacauaaggaaaaaaaagacaaauuaaaggaggggcuaggggag

SEQ ID NO: 476507 - RNA, 64 nt, hsa
ggccucaaccaacuuagugacuuguuuagaaaaaaaagacaaaaaaguaaaaauaaaaacaaaa

SEQ ID NO: 476508 - RNA, 64 nt, hsa
cuuucuguagcuuuacaauuaauuuaaguacuaaaaagacaaggauuucuuuuaagaaauuuau

SEQ ID NO: 476509 - RNA, 64 nt, hsa
aguuuggacugaaucacaucuguaguacuuagccaaagacaauuuggaggagaauaucagccuu

SEQ ID NO: 476510 - RNA, 64 nt, hsa
guguugcugguuacuaaacuuuauggugucacaaaaagacaaaugauuguaggauccauggaag

SEQ ID NO: 476511 - RNA, 64 nt, hsa
cagccuaagcguacgagugaaaacaaugaugucaaaagacaauagcaaguauaggcuacuauuu

SEQ ID NO: 476512 - RNA, 64 nt, hsa
agaugguugucuugugugcuucucugcauuuuuaaaagacaagacauucuuguacauauuauca

SEQ ID NO: 476513 - RNA, 64 nt, hsa
auaccagaauugaauauaccauaugggauuggagaaagacaaauguggaagaaaucauagagcu

SEQ ID NO: 476514 - RNA, 64 nt, hsa
uuuuuuaagggauguugcaaagggauuacuagagaaagacaaaaugugaccaaaaaaaagcaug

SEQ ID NO: 476515 - RNA, 64 nt, hsa
aacagaagcaaaggagagcuuggggguggggagaaaagacaaaugugcucuauguccuaguaac

SEQ ID NO: 476516 - RNA, 64 nt, hsa
cuucuuagcaaucaauauuuuucugcauucuuuaaaagacaagagaauuugguuauaaaagaaa

SEQ ID NO: 476517 - RNA, 64 nt, hsa
accaucauuuugaaaagauuuauuaaaacuagcuaaagacaacagacuggauagcuuuucuaau

SEQ ID NO: 476518 - RNA, 59 nt, hsa
acucuucgaagagggauuaaaaggugcaaaaagacaacuaaaauacccauuuggaccaa

SEQ ID NO: 476519 - RNA, 64 nt, hsa
acuucucgucuugugagcuaaggcuugugucaugaaagacaagaggccucucuuaacagcccag

SEQ ID NO: 476520 - RNA, 64 nt, hsa
ucaugcccuugccuaucaaagaguauguuguaagaaagacaagacauuguguguauuagagacu

SEQ ID NO: 476521 - RNA, 64 nt, hsa
ucgggaucccaaagaaugaggggaauuucuucagaaagacaaucucggcaugcauuauuucuuu

SEQ ID NO: 476522 - RNA, 64 nt, hsa
cgcuccaagcuuggaaagagcuguguuuugguucaaagacaagggaaauggcaaacaaaagacu

SEQ ID NO: 476523 - RNA, 64 nt, hsa
ggaaggccaaaguauccaucauuagucagccacaaaagacaaucaaaguggcagaacugccuca

SEQ ID NO: 476524 - RNA, 64 nt, hsa
uucugaacuccccugugaaugcaguucuuggcacaaagacaaaagcugcagugaaaauuuugga

SEQ ID NO: 476525 - RNA, 64 nt, hsa
gaaaugugacccccaaguccuauccuaaauaaaaaaagacaaauucggauguaugaucucucua

SEQ ID NO: 476526 - RNA, 64 nt, hsa
gcaucuccuuacagucacuaauauaguagauuuuaaagacaaaauuuuucuuuucuugauuuuu

SEQ ID NO: 476527 - RNA, 64 nt, hsa
gguccuaaaagcaaaauaaaaacuauucgaaugaaaagacaagaaaaucagguauuaaucuugg

SEQ ID NO: 476528 - RNA, 64 nt, hsa
uguuuagauagggcugggcaaggaaaaagaaaauaaagacaaccauauuuagcagugcaguuga

SEQ ID NO: 476529 - RNA, 64 nt, hsa
guagauuguaugaguaagaaguauuaauuuuuuaaaagacaaaucaacuuugaagacacaaaag

SEQ ID NO: 476530 - RNA, 64 nt, hsa
caaggcauguuacuacuuuuaucaucuaaggaaaaaagacaagggaauuccagucaggcauuau

SEQ ID NO: 476531 - RNA, 64 nt, hsa
gagaccccaguugugccuuugcuacagaucuggaaaagacaaggucaugggggccuccaguguc

SEQ ID NO: 476532 - RNA, 64 nt, hsa
aaauugcaaaauaaagaaaaaugccaaccuuagaaaagacaauaaaugcacaaaagauauaaac

SEQ ID NO: 476533 - RNA, 64 nt, hsa
guaauuccaaaucuaucugaguuguauacccaucaaagacaauacaguuauuaacauagaugaa

SEQ ID NO: 476534 - RNA, 64 nt, hsa
aaaagcugggaugcuugaggguauccaaguugaaaaagacaaaaucugaccaucagccagugac

SEQ ID NO: 476535 - RNA, 64 nt, hsa
uuucuguugggaaggcccucuugguuuuggagagaaagacaaguuaugaguagcugcuacccug

SEQ ID NO: 476536 - RNA, 64 nt, hsa
cuagaaauaaauguuaccuaauuauuacagccuuaaagacaaaaauccuuguugaaguuuuuuu

SEQ ID NO: 476537 - RNA, 64 nt, hsa
ugagcaaagaugguaaaaagaagaaaaagaagucaaagacaaaguguguaauuauguaaauaca

SEQ ID NO: 476538 - RNA, 64 nt, hsa
aacaaguauacacuagaggcucuuaaaaguauugaaagacaauacugcuguuauauagcaagac

SEQ ID NO: 476539 - RNA, 64 nt, hsa
uauuguauucaaaauucauuguguauauuacuacaaagacaaccccaaaccaauuuuuuuccug

SEQ ID NO: 476540 - RNA, 64 nt, hsa
gacuuuuccugcacuggacaguaaaaaaauaauaaaagacaaaaacaaauuuaaaaaaaaauuu

SEQ ID NO: 476541 - RNA, 64 nt, hsa
ugaaugucccuuccaacuuuuauauuaaaaauaaaaagacaagaaaauugaagaucauuuuuca

SEQ ID NO: 476542 - RNA, 64 nt, hsa
uuuuuccuccucugaacuggauuuuauaggcauuaaagacaagucggguggcuagagggcuccu

SEQ ID NO: 476543 - RNA, 64 nt, hsa
ugucagccccuuccuuucccccgaccuaaacauaaaagacaaggcaaagcccgcauaauuuuaa

SEQ ID NO: 476544 - RNA, 64 nt, hsa
cuguaaaaaaaaaaaaaaaaaaaaagacaaaacaaaagacaaaaaaaaaaaaaaaacccaacaa

SEQ ID NO: 476545 - RNA, 64 nt, hsa
ggugauaaaaaacuguaaaaaaaaaaaaaaaaaaaaagacaaaacaaaagacaaaaaaaaaaaa

SEQ ID NO: 476546 - RNA, 64 nt, hsa
gggauucuugaacuugaaaaaaaaaaacacaaaaaaagacaaaaaaaaaaaaagaaaauauuuu

SEQ ID NO: 476547 - RNA, 64 nt, hsa
auggggguggguuuccuggcaccuacaugaaaaaaaagacaaguuauaugggugaugaagaaaa

SEQ ID NO: 476548 - RNA, 64 nt, hsa
gaaaaaaaaagacguauuuuugcuuacucagauaaaagacaaccuguaaaaauauaauaauuaa

SEQ ID NO: 476549 - RNA, 64 nt, hsa
cuuugaguauaacaucaagcuuuaacaaauauuuaaagacaaaaaaaucacgucaguaaaauac

SEQ ID NO: 476550 - RNA, 64 nt, hsa
ggggcagguguguauuuacuuuagaaaaaaugaaaaagacaagauuuaugagaaauauuugaag

SEQ ID NO: 476551 - RNA, 64 nt, hsa
ggagaacauaagagaaaaggaaaccuguuacagaaaagacaagaaucuguguuuuggaaugagu

SEQ ID NO: 476552 - RNA, 64 nt, hsa
aaggaaaaagaguuaugaagauacagauuuagacaaagacaagagcaucagacaaaggaaaaga

SEQ ID NO: 476553 - RNA, 64 nt, hsa
cuaaggcucagugccacucaccccucccuccccaaaagacaagagaaauuuggccagaugggga

SEQ ID NO: 476554 - RNA, 64 nt, hsa
ggcaaaucuuccagacuauggcuugaguaggaugaaagacaaacacaucugcccaaugauccag

SEQ ID NO: 476555 - RNA, 62 nt, hsa
cugguggcagggcguuuucccaccgggauacgggaagccaccugugucagggcuaggcccug

SEQ ID NO: 476556 - RNA, 62 nt, hsa
caguaauauuucagcaagaggagguggucaugggaagccagcacagcagaggcucccugacc

SEQ ID NO: 476557 - RNA, 62 nt, hsa
cuuguuucucuagucacaucauguguauacaaggaagccaggaauacagguuuucuugauga

SEQ ID NO: 476558 - RNA, 62 nt, hsa
cuucuuuucuaucccuuugggcccugggagaaggaagccauuugcagugcugguguguccug

SEQ ID NO: 476559 - RNA, 62 nt, hsa
uuuuuaaggggcuguggggugaaauguugacuggaagccacccacaaacacacaccugcugg

SEQ ID NO: 476560 - RNA, 62 nt, hsa
augcccaucuccauagccagaccaagcacucuggaagccaggguugggugcuuauuuaucug

SEQ ID NO: 476561 - RNA, 62 nt, hsa
cugagaaggugaaaugugagcaaagacgugaaggaagccagggagguagcagguagcucucu

SEQ ID NO: 476562 - RNA, 62 nt, hsa
cguuguugggaagccagcaguggccuugggaaggaagccauggcugugguucagagagggug

SEQ ID NO: 476563 - RNA, 62 nt, hsa
aucccacagucagaacugaaucugcguuguugggaagccagcaguggccuugggaaggaagc

SEQ ID NO: 476564 - RNA, 62 nt, hsa
ucuugggcuuucgucauuaaaccaaaggaaauggaagccauuccccuguugcucuccuuagu

SEQ ID NO: 476565 - RNA, 62 nt, hsa
cccaccccuccccacccaccaccgcucccgcgggaagccagcccgugcaacggaagccaggc

SEQ ID NO: 476566 - RNA, 62 nt, hsa
caccgcucccgcgggaagccagcccgugcaacggaagccaggccaacugccccgcgucuuca

SEQ ID NO: 476567 - RNA, 62 nt, hsa
ugugccucuccccaggaagcauccagggcagaggaagccacaucucccggugcccccaaccc

SEQ ID NO: 476568 - RNA, 62 nt, hsa
ggggagcagggaguugcccuuccccucccucgggaagccaccuaagaauguuuacaugccaa

SEQ ID NO: 476569 - RNA, 62 nt, hsa
uccugcaccuguccaccccaccccaacacccuggaagccacugucaaugauuagaucggguc

SEQ ID NO: 476570 - RNA, 62 nt, hsa
gacagcccuggcuaacuaacuuacauuuguggggaagccaacagacacagcaggaggagagg

SEQ ID NO: 476571 - RNA, 62 nt, hsa
cucgagcuccuaccaguggcuggccgcggauuggaagccagccugcugucgcucuguggggg

SEQ ID NO: 476572 - RNA, 62 nt, hsa
uguuauauaauuuauugugaggaccuucucauggaagccauuaggaaaacaaacuagaggua

SEQ ID NO: 476573 - RNA, 62 nt, hsa
uucguuuguuuaccagcaagcaacuucccuggggaagccaaacacauauucauaaaaaaaau

SEQ ID NO: 476574 - RNA, 62 nt, hsa
agaccucugagugggccccagagcccagcugaggaagccacacagccuccaggacguggcac

SEQ ID NO: 476575 - RNA, 62 nt, hsa
gcgaccgugccucugugccagcgucccaggaaggaagccaacccugagcgagccuguccucu

SEQ ID NO: 476576 - RNA, 62 nt, hsa
ccacuuuuucagacaaggaaacugaggcucagggaagccaagugacaaguccaaggucacga

SEQ ID NO: 476577 - RNA, 62 nt, hsa
gaccagcuggcccaggauuucacagucgaaaaggaagccaccacugaugccucccacuguga

SEQ ID NO: 476578 - RNA, 62 nt, hsa
accucucugcgguucccucucacuuuuagaucggaagccaguuucuacacacuugccucucg

SEQ ID NO: 476579 - RNA, 62 nt, hsa
acgccauccgaagacagcacuugaccucggguggaagccaggcucuuugcuuggcuucucuu

SEQ ID NO: 476580 - RNA, 62 nt, hsa
ccugaggacccccgccuaccaccucgagaacuggaagccaaccucuaaccuccugaccucau

SEQ ID NO: 476581 - RNA, 62 nt, hsa
cagugcccaagucucuauggagaaugagaacuggaagccacugcuaccgucuacccagcacc

SEQ ID NO: 476582 - RNA, 62 nt, hsa
gacucuguuccugcccuaggcccagucucaaaggaagccacaaggcgcgggggccacugagg

SEQ ID NO: 476583 - RNA, 62 nt, hsa
aaggccacaaggggaccccggccuaggaggcaggaagccaaggugcagagagcagccuggcc

SEQ ID NO: 476584 - RNA, 62 nt, hsa
ccuuugagaagauauuuucccacaaaggggugggaagccaggagugagaaggaauucaggga

SEQ ID NO: 476585 - RNA, 62 nt, hsa
guggcugcguuuccuggggcccuggguuuuggggaagccaguuagcugcugcuuuggcacug

SEQ ID NO: 476586 - RNA, 62 nt, hsa
ucagguguggacgggacagugaguggcugggaggaagccagaaucaacagcuccagcccucu

SEQ ID NO: 476587 - RNA, 62 nt, hsa
ucaggcacuaagaggggcuggaccuggcggcaggaagccaaagagacugggccuaggccagg

SEQ ID NO: 476588 - RNA, 62 nt, hsa
cgccauuuugguagcuuccagaaaggccaggcggaagccaaggucaagagggccaucccuaa

SEQ ID NO: 476589 - RNA, 62 nt, hsa
ccacuugguggccggacaguggcugagcacguggaagccauugagggcagcguccaggagag

SEQ ID NO: 476590 - RNA, 64 nt, hsa; identical to SEQ ID NO: 147473

SEQ ID NO: 476591 - RNA, 64 nt, hsa; identical to SEQ ID NO: 147474

SEQ ID NO: 476592 - RNA, 64 nt, hsa; identical to SEQ ID NO: 147475

SEQ ID NO: 476593 - RNA, 64 nt, hsa; identical to SEQ ID NO: 147476

SEQ ID NO: 476594 - RNA, 64 nt, hsa; identical to SEQ ID NO: 147477

SEQ ID NO: 476595 - RNA, 64 nt, hsa; identical to SEQ ID NO: 147478

SEQ ID NO: 476596 - RNA, 64 nt, hsa; identical to SEQ ID NO: 147479

SEQ ID NO: 476597 - RNA, 64 nt, hsa; identical to SEQ ID NO: 147480

SEQ ID NO: 476598 - RNA, 64 nt, hsa; identical to SEQ ID NO: 147481

SEQ ID NO: 476599 - RNA, 64 nt, hsa; identical to SEQ ID NO: 147482

SEQ ID NO: 476600 - RNA, 64 nt, hsa; identical to SEQ ID NO: 366491

SEQ ID NO: 476601 - RNA, 64 nt, hsa; identical to SEQ ID NO: 366492

SEQ ID NO: 476602 - RNA, 64 nt, hsa; identical to SEQ ID NO: 366493

SEQ ID NO: 476603 - RNA, 64 nt, hsa; identical to SEQ ID NO: 366494

SEQ ID NO: 476604 - RNA, 64 nt, hsa; identical to SEQ ID NO: 366495

SEQ ID NO: 476605 - RNA, 64 nt, hsa; identical to SEQ ID NO: 366496

SEQ ID NO: 476606 - RNA, 64 nt, hsa; identical to SEQ ID NO: 366497

SEQ ID NO: 476607 - RNA, 64 nt, hsa; identical to SEQ ID NO: 366498

SEQ ID NO: 476608 - RNA, 64 nt, hsa; identical to SEQ ID NO: 366499

SEQ ID NO: 476609 - RNA, 64 nt, hsa; identical to SEQ ID NO: 366500

SEQ ID NO: 476610 - RNA, 64 nt, hsa; identical to SEQ ID NO: 366501

SEQ ID NO: 476611 - RNA, 64 nt, hsa; identical to SEQ ID NO: 366502

SEQ ID NO: 476612 - RNA, 64 nt, hsa; identical to SEQ ID NO: 366503

SEQ ID NO: 476613 - RNA, 64 nt, hsa; identical to SEQ ID NO: 366504

SEQ ID NO: 476614 - RNA, 64 nt, hsa; identical to SEQ ID NO: 366505

SEQ ID NO: 476615 - RNA, 64 nt, hsa; identical to SEQ ID NO: 366506

SEQ ID NO: 476616 - RNA, 64 nt, hsa; identical to SEQ ID NO: 366507

SEQ ID NO: 476617 - RNA, 64 nt, hsa; identical to SEQ ID NO: 366508

SEQ ID NO: 476618 - RNA, 64 nt, hsa; identical to SEQ ID NO: 366509

SEQ ID NO: 476619 - RNA, 64 nt, hsa; identical to SEQ ID NO: 366510

SEQ ID NO: 476620 - RNA, 64 nt, hsa; identical to SEQ ID NO: 366511

SEQ ID NO: 476621 - RNA, 64 nt, hsa; identical to SEQ ID NO: 366512

SEQ ID NO: 476622 - RNA, 64 nt, hsa; identical to SEQ ID NO: 366513

SEQ ID NO: 476623 - RNA, 64 nt, hsa; identical to SEQ ID NO: 366514

SEQ ID NO: 476624 - RNA, 64 nt, hsa; identical to SEQ ID NO: 366515

SEQ ID NO: 476625 - RNA, 64 nt, hsa; identical to SEQ ID NO: 366516

SEQ ID NO: 476626 - RNA, 64 nt, hsa; identical to SEQ ID NO: 366517

SEQ ID NO: 476627 - RNA, 64 nt, hsa; identical to SEQ ID NO: 366518

SEQ ID NO: 476628 - RNA, 64 nt, hsa; identical to SEQ ID NO: 366519

SEQ ID NO: 476629 - RNA, 64 nt, hsa; identical to SEQ ID NO: 366520

SEQ ID NO: 476630 - RNA, 64 nt, hsa; identical to SEQ ID NO: 366521

SEQ ID NO: 476631 - RNA, 64 nt, hsa; identical to SEQ ID NO: 366522

SEQ ID NO: 476632 - RNA, 64 nt, hsa; identical to SEQ ID NO: 366523

SEQ ID NO: 476633 - RNA, 64 nt, hsa; identical to SEQ ID NO: 366524

SEQ ID NO: 476634 - RNA, 64 nt, hsa; identical to SEQ ID NO: 366525

SEQ ID NO: 476635 - RNA, 64 nt, hsa; identical to SEQ ID NO: 366526

SEQ ID NO: 476636 - RNA, 64 nt, hsa; identical to SEQ ID NO: 366527

SEQ ID NO: 476637 - RNA, 64 nt, hsa; identical to SEQ ID NO: 366528

SEQ ID NO: 476638 - RNA, 64 nt, hsa; identical to SEQ ID NO: 366529

SEQ ID NO: 476639 - RNA, 64 nt, hsa; identical to SEQ ID NO: 366530

SEQ ID NO: 476640 - RNA, 64 nt, hsa; identical to SEQ ID NO: 366531

SEQ ID NO: 476641 - RNA, 64 nt, hsa; identical to SEQ ID NO: 366532

SEQ ID NO: 476642 - RNA, 64 nt, hsa; identical to SEQ ID NO: 366533

SEQ ID NO: 476643 - RNA, 64 nt, hsa; identical to SEQ ID NO: 366534

SEQ ID NO: 476644 - RNA, 64 nt, hsa; identical to SEQ ID NO: 225654

SEQ ID NO: 476645 - RNA, 64 nt, hsa; identical to SEQ ID NO: 225655

SEQ ID NO: 476646 - RNA, 64 nt, hsa; identical to SEQ ID NO: 225656

SEQ ID NO: 476647 - RNA, 64 nt, hsa; identical to SEQ ID NO: 225657

SEQ ID NO: 476648 - RNA, 64 nt, hsa; identical to SEQ ID NO: 225658

SEQ ID NO: 476649 - RNA, 64 nt, hsa; identical to SEQ ID NO: 225659

SEQ ID NO: 476650 - RNA, 64 nt, hsa
agaccuugggccggcacgcgugacacggcacuucaggcuccacgcacagaaucucgcagauagu

SEQ ID NO: 476651 - RNA, 64 nt, hsa
cucggggaacacauuccgggagagaugccuggccaggcuccacggaucccgccagaaacaccaa

SEQ ID NO: 476652 - RNA, 64 nt, hsa
cuacgugguggccgguagaauucuccaucuauccaggcuccaggagaccccugggcaucuccca

SEQ ID NO: 476653 - RNA, 64 nt, hsa
auugaaccaccuucuuuccuggggcaagagcaccaggcuccagggcacucggaggcuggugggg

SEQ ID NO: 476654 - RNA, 64 nt, hsa
cagcagguuggguucuagggcugaaccaggcgccaggcuccagaggacgaagggacucuguugc

SEQ ID NO: 476655 - RNA, 64 nt, hsa
gcuggcccugggacccccaggaacgcuaagacacaggcuccaguaggggcuguugccuccaaua

SEQ ID NO: 476656 - RNA, 64 nt, hsa
gcuggccccguggugaggccauguucucauaaucaggcuccagccagaaaaauaagaaacaccg

SEQ ID NO: 476657 - RNA, 64 nt, hsa
ucccgccagcuccucagccugcucccugggaggcaggcuccagaagcaccccgacggggggccu

SEQ ID NO: 476658 - RNA, 64 nt, hsa
ucugagagcucuccagccugagggcauugagcugaggcuccacccugagcucuccugcagggug

SEQ ID NO: 476659 - RNA, 64 nt, hsa
cggggcuauucccauuuugcagacaggacagcagaggcuccagacaaugccuuuccuuucuuuu

SEQ ID NO: 476660 - RNA, 64 nt, hsa
accugcugcuccacgaggaagcucaggccugcacaggcuccaccaggccuuggaugcccucuag

SEQ ID NO: 476661 - RNA, 64 nt, hsa
ugggagcccaagagccaguggcugagcucugagaaggcuccaucucccaccugcccuugagcgc

SEQ ID NO: 476662 - RNA, 64 nt, hsa
augagaaugugccaugcaugaagcaaaggauuccaggcuccagaaaaaaugaaugaacucaccu

SEQ ID NO: 476663 - RNA, 64 nt, hsa
uccucucccacauuauuucuuaaucugaacaugaaggcuccauuagcaacacuaaaacuugauc

SEQ ID NO: 476664 - RNA, 64 nt, hsa
aggguuggauuagagggguuaaacaacuugucuuaggcuccacagcugggaacaaguggggcug

SEQ ID NO: 476665 - RNA, 64 nt, hsa
gcuuugcagaucacagugcuggaagcaggaacccaggcuccagaagguguugccaggggcccag

SEQ ID NO: 476666 - RNA, 64 nt, hsa
guuccagaggaauccaugaagaauucccaugcccaggcuccaugugucauguggaaaccuccac

SEQ ID NO: 476667 - RNA, 64 nt, hsa
cuuuccaauagcaaauucaaagcaagcaacuugcaggcuccauggaacuuuuaaugaaggacag

SEQ ID NO: 476668 - RNA, 64 nt, hsa
gggggcagcccccagaguccugugcauucugccaaggcuccauagcuuugccaaaugcacggag

SEQ ID NO: 476669 - RNA, 64 nt, hsa
uaucaccugguggucugauucauacccuagccugaggcuccacuggaagaucucgcagccucag

SEQ ID NO: 476670 - RNA, 50 nt, hsa
uccuuggcuggagugucuagaggcuccagacucuccuguuaacccuccau

SEQ ID NO: 476671 - RNA, 64 nt, hsa
ccacaugugaacccaucauuccuaaacccuggguaggcuccaugccaaguaacagcagagggag

SEQ ID NO: 476672 - RNA, 64 nt, hsa; identical to SEQ ID NO: 233025

SEQ ID NO: 476673 - RNA, 64 nt, hsa; identical to SEQ ID NO: 233026

SEQ ID NO: 476674 - RNA, 64 nt, hsa; identical to SEQ ID NO: 233027

SEQ ID NO: 476675 - RNA, 64 nt, hsa; identical to SEQ ID NO: 233028

SEQ ID NO: 476676 - RNA, 64 nt, hsa; identical to SEQ ID NO: 233029

SEQ ID NO: 476677 - RNA, 64 nt, hsa; identical to SEQ ID NO: 233030

SEQ ID NO: 476678 - RNA, 64 nt, hsa; identical to SEQ ID NO: 233031

SEQ ID NO: 476679 - RNA, 64 nt, hsa; identical to SEQ ID NO: 233032

SEQ ID NO: 476680 - RNA, 64 nt, hsa; identical to SEQ ID NO: 233033

SEQ ID NO: 476681 - RNA, 64 nt, hsa; identical to SEQ ID NO: 233034

SEQ ID NO: 476682 - RNA, 64 nt, hsa; identical to SEQ ID NO: 233035

SEQ ID NO: 476683 - RNA, 64 nt, hsa; identical to SEQ ID NO: 233036

SEQ ID NO: 476684 - RNA, 64 nt, hsa; identical to SEQ ID NO: 233037

SEQ ID NO: 476685 - RNA, 64 nt, hsa; identical to SEQ ID NO: 233038

SEQ ID NO: 476686 - RNA, 64 nt, hsa; identical to SEQ ID NO: 233039

SEQ ID NO: 476687 - RNA, 64 nt, hsa; identical to SEQ ID NO: 233040

SEQ ID NO: 476688 - RNA, 64 nt, hsa; identical to SEQ ID NO: 233041

SEQ ID NO: 476689 - RNA, 64 nt, hsa; identical to SEQ ID NO: 233042

SEQ ID NO: 476690 - RNA, 64 nt, hsa; identical to SEQ ID NO: 233043

SEQ ID NO: 476691 - RNA, 64 nt, hsa; identical to SEQ ID NO: 233044

SEQ ID NO: 476692 - RNA, 64 nt, hsa; identical to SEQ ID NO: 233045

SEQ ID NO: 476693 - RNA, 64 nt, hsa; identical to SEQ ID NO: 233046

SEQ ID NO: 476694 - RNA, 64 nt, hsa; identical to SEQ ID NO: 233047

SEQ ID NO: 476695 - RNA, 64 nt, hsa; identical to SEQ ID NO: 233048

SEQ ID NO: 476696 - RNA, 64 nt, hsa; identical to SEQ ID NO: 233049

SEQ ID NO: 476697 - RNA, 64 nt, hsa; identical to SEQ ID NO: 233050

SEQ ID NO: 476698 - RNA, 64 nt, hsa; identical to SEQ ID NO: 434003

SEQ ID NO: 476699 - RNA, 64 nt, hsa; identical to SEQ ID NO: 434004

SEQ ID NO: 476700 - RNA, 64 nt, hsa; identical to SEQ ID NO: 434005

SEQ ID NO: 476701 - RNA, 64 nt, hsa; identical to SEQ ID NO: 434006

SEQ ID NO: 476702 - RNA, 64 nt, hsa; identical to SEQ ID NO: 434007

SEQ ID NO: 476703 - RNA, 64 nt, hsa; identical to SEQ ID NO: 434008

SEQ ID NO: 476704 - RNA, 64 nt, hsa; identical to SEQ ID NO: 434009

SEQ ID NO: 476705 - RNA, 64 nt, hsa; identical to SEQ ID NO: 434010

SEQ ID NO: 476706 - RNA, 64 nt, hsa; identical to SEQ ID NO: 434011

SEQ ID NO: 476707 - RNA, 64 nt, hsa; identical to SEQ ID NO: 434012

SEQ ID NO: 476708 - RNA, 64 nt, hsa; identical to SEQ ID NO: 434013

SEQ ID NO: 476709 - RNA, 64 nt, hsa; identical to SEQ ID NO: 434014

SEQ ID NO: 476710 - RNA, 64 nt, hsa; identical to SEQ ID NO: 434015

SEQ ID NO: 476711 - RNA, 64 nt, hsa; identical to SEQ ID NO: 434016

SEQ ID NO: 476712 - RNA, 64 nt, hsa; identical to SEQ ID NO: 434017

SEQ ID NO: 476713 - RNA, 64 nt, hsa; identical to SEQ ID NO: 434018

SEQ ID NO: 476714 - RNA, 64 nt, hsa; identical to SEQ ID NO: 434019

SEQ ID NO: 476715 - RNA, 64 nt, hsa; identical to SEQ ID NO: 434020

SEQ ID NO: 476716 - RNA, 64 nt, hsa; identical to SEQ ID NO: 434021

SEQ ID NO: 476717 - RNA, 64 nt, hsa; identical to SEQ ID NO: 434022

SEQ ID NO: 476718 - RNA, 64 nt, hsa; identical to SEQ ID NO: 434023

SEQ ID NO: 476719 - RNA, 64 nt, hsa; identical to SEQ ID NO: 434024

SEQ ID NO: 476720 - RNA, 64 nt, hsa; identical to SEQ ID NO: 434025

SEQ ID NO: 476721 - RNA, 64 nt, hsa; identical to SEQ ID NO: 434026

SEQ ID NO: 476722 - RNA, 64 nt, hsa; identical to SEQ ID NO: 434027

SEQ ID NO: 476723 - RNA, 64 nt, hsa; identical to SEQ ID NO: 434028

SEQ ID NO: 476724 - RNA, 64 nt, hsa; identical to SEQ ID NO: 434029

SEQ ID NO: 476725 - RNA, 64 nt, hsa; identical to SEQ ID NO: 434030

SEQ ID NO: 476726 - RNA, 64 nt, hsa; identical to SEQ ID NO: 434031

SEQ ID NO: 476727 - RNA, 64 nt, hsa; identical to SEQ ID NO: 434032

SEQ ID NO: 476728 - RNA, 64 nt, hsa; identical to SEQ ID NO: 434033

SEQ ID NO: 476729 - RNA, 64 nt, hsa; identical to SEQ ID NO: 434034

SEQ ID NO: 476730 - RNA, 64 nt, hsa; identical to SEQ ID NO: 434035

SEQ ID NO: 476731 - RNA, 64 nt, hsa; identical to SEQ ID NO: 434036

SEQ ID NO: 476732 - RNA, 64 nt, hsa; identical to SEQ ID NO: 434037

SEQ ID NO: 476733 - RNA, 64 nt, hsa; identical to SEQ ID NO: 434038

SEQ ID NO: 476734 - RNA, 64 nt, hsa; identical to SEQ ID NO: 434039

SEQ ID NO: 476735 - RNA, 64 nt, hsa; identical to SEQ ID NO: 434040

SEQ ID NO: 476736 - RNA, 64 nt, hsa; identical to SEQ ID NO: 434041

SEQ ID NO: 476737 - RNA, 64 nt, hsa; identical to SEQ ID NO: 434042

SEQ ID NO: 476738 - RNA, 64 nt, hsa; identical to SEQ ID NO: 434043

SEQ ID NO: 476739 - RNA, 64 nt, hsa; identical to SEQ ID NO: 434044

SEQ ID NO: 476740 - RNA, 64 nt, hsa
ccaccauccuauugcaaagguuccaacuguauauauucccaauagcaacguagcuucuaccaug

SEQ ID NO: 476741 - RNA, 64 nt, hsa
aaauauugaaauguagcaauaaugucuuuugaauauucccaagcccaugaguccuugaaaauau

SEQ ID NO: 476742 - RNA, 64 nt, hsa
gaacuuacgcauccaauguggguugucacuuguuauucccaaguacuauuauuccauacuacua

SEQ ID NO: 476743 - RNA, 64 nt, hsa
uggagcaaggugcagugcuagaauauggugguugauucccaaacagagcaguuaacuuuacucu

SEQ ID NO: 476744 - RNA, 64 nt, hsa
uuacauuuaaauaugcuaacaucacugucauagaauucccaaauuucauuuguagauacugaac

SEQ ID NO: 476745 - RNA, 64 nt, hsa
guauucuguauaccccuucaagcaguuguuucccauucccaacaaacuguacuuuauacaauuc

SEQ ID NO: 476746 - RNA, 64 nt, hsa
guucagugguacauaaauuuaucucgcccugcauauucccaacauacuuaacacagauguuuuu

SEQ ID NO: 476747 - RNA, 64 nt, hsa
gaagguuauggucaaucccaaaagucaccacuccauucccaacuagacauuaccaaagugaccu

SEQ ID NO: 476748 - RNA, 64 nt, hsa
gauugcuucucauccccagucccaaugcacauccauucccaagaaaugcuuugucuucagccuc

SEQ ID NO: 476749 - RNA, 64 nt, hsa; identical to SEQ ID NO: 72494

SEQ ID NO: 476750 - RNA, 64 nt, hsa; identical to SEQ ID NO: 72495

SEQ ID NO: 476751 - RNA, 64 nt, hsa; identical to SEQ ID NO: 72496

SEQ ID NO: 476752 - RNA, 64 nt, hsa; identical to SEQ ID NO: 72497

SEQ ID NO: 476753 - RNA, 64 nt, hsa; identical to SEQ ID NO: 72498

SEQ ID NO: 476754 - RNA, 64 nt, hsa; identical to SEQ ID NO: 72499

SEQ ID NO: 476755 - RNA, 64 nt, hsa; identical to SEQ ID NO: 72500

SEQ ID NO: 476756 - RNA, 64 nt, hsa; identical to SEQ ID NO: 72501

SEQ ID NO: 476757 - RNA, 64 nt, hsa; identical to SEQ ID NO: 72502

SEQ ID NO: 476758 - RNA, 64 nt, hsa; identical to SEQ ID NO: 72503

SEQ ID NO: 476759 - RNA, 64 nt, hsa; identical to SEQ ID NO: 72504

SEQ ID NO: 476760 - RNA, 64 nt, hsa; identical to SEQ ID NO: 72505

SEQ ID NO: 476761 - RNA, 64 nt, hsa
auugauaguacaaaauccaacaacaauacugagaugaucuaagaagguuauaacaaaaugcucu

SEQ ID NO: 476762 - RNA, 64 nt, hsa
auggaaguuuaaagaaaggacaucaucauagauaugaucuaacaguauuucuaacuauauuuga

SEQ ID NO: 476763 - RNA, 64 nt, hsa; identical to SEQ ID NO: 301501

SEQ ID NO: 476764 - RNA, 64 nt, hsa; identical to SEQ ID NO: 301502

SEQ ID NO: 476765 - RNA, 64 nt, hsa; identical to SEQ ID NO: 24356

SEQ ID NO: 476766 - RNA, 64 nt, hsa; identical to SEQ ID NO: 24357

SEQ ID NO: 476767 - RNA, 64 nt, hsa; identical to SEQ ID NO: 24358

SEQ ID NO: 476768 - RNA, 64 nt, hsa; identical to SEQ ID NO: 24359

SEQ ID NO: 476769 - RNA, 64 nt, hsa; identical to SEQ ID NO: 24360

SEQ ID NO: 476770 - RNA, 64 nt, hsa; identical to SEQ ID NO: 24361

SEQ ID NO: 476771 - RNA, 64 nt, hsa; identical to SEQ ID NO: 24362

SEQ ID NO: 476772 - RNA, 64 nt, hsa; identical to SEQ ID NO: 24363

SEQ ID NO: 476773 - RNA, 64 nt, hsa; identical to SEQ ID NO: 24364

SEQ ID NO: 476774 - RNA, 64 nt, hsa; identical to SEQ ID NO: 24365

SEQ ID NO: 476775 - RNA, 64 nt, hsa; identical to SEQ ID NO: 24366

SEQ ID NO: 476776 - RNA, 64 nt, hsa; identical to SEQ ID NO: 24367

SEQ ID NO: 476777 - RNA, 64 nt, hsa; identical to SEQ ID NO: 24368

SEQ ID NO: 476778 - RNA, 64 nt, hsa; identical to SEQ ID NO: 24369

SEQ ID NO: 476779 - RNA, 64 nt, hsa; identical to SEQ ID NO: 24370

SEQ ID NO: 476780 - RNA, 64 nt, hsa; identical to SEQ ID NO: 24371

SEQ ID NO: 476781 - RNA, 64 nt, hsa
gcacaucccugugcacagcuggaagggugcauggcccgcucaccuuuguucagauggguggaaa

SEQ ID NO: 476782 - RNA, 64 nt, hsa
aauugugcauacuccaaacuuucgcagccaucuucccgcucagccccagacacccagcaaucaa

SEQ ID NO: 476783 - RNA, 64 nt, hsa
cuuuaaaggagcuacagucauuuuauuauuucaggagguuaaaauauacucuauauuacuuggu

SEQ ID NO: 476784 - RNA, 64 nt, hsa
gggcauaggggaguuggcuuuugccccaggaggugagguuaaggaguugggggccugggguucu

SEQ ID NO: 476785 - RNA, 64 nt, hsa
cuaauucuaaagcugcuucagacugcuucaugaggagguuaaucuacaauuaaacaauauuucc

SEQ ID NO: 476786 - RNA, 64 nt, hsa
augguucaucauuuccugggcuguuaaacaaagcgagguuaagguuagacucuugggaaucagc

SEQ ID NO: 476787 - RNA, 64 nt, hsa
gaaaucugacagacaccagcucagccaggugauugagguuaacaucauccaugauaagcccuuu

SEQ ID NO: 476788 - RNA, 64 nt, hsa
aauaugaaauacaaggaucuggcaagguuaggaagagguuaagaauaucagugacaguacucug

SEQ ID NO: 476789 - RNA, 64 nt, hsa
aucuguaguuauucuacauuuucuugaaauuugggagguuaauaccaaguauucauuucaugau

SEQ ID NO: 476790 - RNA, 64 nt, hsa; identical to SEQ ID NO: 476789

SEQ ID NO: 476791 - RNA, 64 nt, hsa; identical to SEQ ID NO: 388779

SEQ ID NO: 476792 - RNA, 64 nt, hsa; identical to SEQ ID NO: 388780

SEQ ID NO: 476793 - RNA, 64 nt, hsa; identical to SEQ ID NO: 388781

SEQ ID NO: 476794 - RNA, 64 nt, hsa; identical to SEQ ID NO: 388782

SEQ ID NO: 476795 - RNA, 64 nt, hsa; identical to SEQ ID NO: 388783

SEQ ID NO: 476796 - RNA, 64 nt, hsa; identical to SEQ ID NO: 388784

SEQ ID NO: 476797 - RNA, 64 nt, hsa; identical to SEQ ID NO: 388785

SEQ ID NO: 476798 - RNA, 64 nt, hsa; identical to SEQ ID NO: 388786

SEQ ID NO: 476799 - RNA, 64 nt, hsa; identical to SEQ ID NO: 388787

SEQ ID NO: 476800 - RNA, 64 nt, hsa; identical to SEQ ID NO: 388788

SEQ ID NO: 476801 - RNA, 64 nt, hsa
uuuuuacuuaagggauaguguugauagauaaauuagaauguauagauagguuugugaaagucua

SEQ ID NO: 476802 - RNA, 64 nt, hsa
uugauuggcaguuucuucgguuaauuauuccuauagaauguauuuuaagaaaucuauacaaauu

SEQ ID NO: 476803 - RNA, 64 nt, hsa
ccaagcguacaggagaugggccauaccugaggagagaauguaugagaucaaaaaagaacaaaug

SEQ ID NO: 476804 - RNA, 64 nt, hsa
agaaguuauagagcgacaacuuauauacacaccuagaauguaaguuaaacaaaauaccggcuuc

SEQ ID NO: 476805 - RNA, 64 nt, hsa
gauagcuuucaggaaagauaaagagaacaugcuuagaauguaagcuaaacagauuuuuucuguu

SEQ ID NO: 476806 - RNA, 64 nt, hsa
uggggcuaacuucgggaucccugcacuuuauguaagaauguaaaccuggagucucauuuaagaa

SEQ ID NO: 476807 - RNA, 64 nt, hsa
uuggauuacacaggcaggcuuguuuacuacauccagaauguagaaacugcuuucuucaacaucu

SEQ ID NO: 476808 - RNA, 64 nt, hsa
cucaccaucaauaaaccaaaaacaggaaagauaaagaauguauaaauuucacguaaauuaguca

SEQ ID NO: 476809 - RNA, 64 nt, hsa
aaaacuguaagaauaauuuagcagaaauagaaccagaauguagaagaguagucauguaacagca

SEQ ID NO: 476810 - RNA, 64 nt, hsa
aauaauauaaggaaaaagggaaaguaaacuauuuagaauguaguuuuguuauauucccagcauu

SEQ ID NO: 476811 - RNA, 64 nt, hsa
auaaaaaugguuugagcgucagugauauucucccagaauguacuuaucuuaccucggcauguac

SEQ ID NO: 476812 - RNA, 64 nt, hsa
cuuuuuuuuuuaauuauuagugguaguaauauauagaauguauuacauaacugucacugaagug

SEQ ID NO: 476813 - RNA, 64 nt, hsa
accgaggggccuuuguucuggggggacccagugcagaauguaagugggcccacccggugggacc

SEQ ID NO: 476814 - RNA, 64 nt, hsa
gagaagguuuaucccgccgauagagggacggccaagaauguacguccagccugccccggagcug

SEQ ID NO: 476815 - RNA, 64 nt, hsa
ucaagggacuauguauacaugauuaggguaagauagaauguauuauauauauauauauauacac

SEQ ID NO: 476816 - RNA, 64 nt, hsa
augaauuguguggcagugauuggucuguuuguggagaauguaugaaagcuauuaauauucuaga

SEQ ID NO: 476817 - RNA, 64 nt, hsa
cuuauuguccauuuauacccuguaaagccguuuuagaauguaauauuuuagguaauccaaaaug

SEQ ID NO: 476818 - RNA, 64 nt, hsa
uaaacuugagguuaaauaauggguaguaaauuauagaauguauaagaaaaaauauaaaggagaa

SEQ ID NO: 476819 - RNA, 64 nt, hsa
ucaauguuagccucaauuucugaacaccauagguagaauguaaagcuugucugaucguucaaag

SEQ ID NO: 476820 - RNA, 64 nt, hsa
acuugacaguggaacuacauuaguacacagcaccagaauguauauuaagguguggcuuuaggag

SEQ ID NO: 476821 - RNA, 64 nt, hsa
gcuuuaaucggagcacugcuggaaaugauugcagagaauguagugcuucauauauccaugacca

SEQ ID NO: 476822 - RNA, 64 nt, hsa
gcagagaccucauguggccaguuugauugauugaagaauguaucacucuuauucaagcaaagga

SEQ ID NO: 476823 - RNA, 64 nt, hsa
ccugugugaaaauauaguuaacauugcaaacuuuagaauguauuaaaaauuuuaccuugccaua

SEQ ID NO: 476824 - RNA, 64 nt, hsa
guauccuagucagggaaagaaccuguuuucuggaagaauguaaguugcuauauguggaggggca

SEQ ID NO: 476825 - RNA, 64 nt, hsa
aaccagagcuguucacaugaaaauauuccuuaguagaauguauauuuaagaaauaaaacaacaa

SEQ ID NO: 476826 - RNA, 64 nt, hsa
cauagagauuucuuggcgaaaauaucuugagaauagaauguaacgauauaacauuuugcugauu

SEQ ID NO: 476827 - RNA, 64 nt, hsa
uagcaaaauauuugucgguggagggaaguagauaagaauguauuaguguauuuuaaaguaauaa

SEQ ID NO: 476828 - RNA, 64 nt, hsa
gcguaaagcugacaaguuaccaguucaccugaucagaauguauuuuuuauaaccaccaucauuc

SEQ ID NO: 476829 - RNA, 64 nt, hsa
gccaaagauaggaggaagaaagagaacucuccauagaauguaauuuauagaugcguguauaugu

SEQ ID NO: 476830 - RNA, 64 nt, hsa
ucuccuaggauacagaaaccauggcaacgaaaguagaauguaaaacucgcagcagauaucagug

SEQ ID NO: 476831 - RNA, 64 nt, hsa
uuuccagugaaaacugaaagugcauuauuauggaagaauguauuugcagguaguaauagcauua

SEQ ID NO: 476832 - RNA, 64 nt, hsa
uuaauauuuuugucuugaagcauuuucuagugauagaauguauuugucuuuuuuccugguggua

SEQ ID NO: 476833 - RNA, 64 nt, hsa
aagugagacuugaacaaaauuuuguucaucuugaagaauguauaguggcuuagguuauuugagg

SEQ ID NO: 476834 - RNA, 64 nt, hsa
auguguaaaacaucuuuuguuuuauaugcuuuuaagaauguagauuguaauuuaggaaauggca

SEQ ID NO: 476835 - RNA, 64 nt, hsa
uuuaaguugauugacuaguuauuauguacauuucagaauguacacauaaauacugugaugaaaa

SEQ ID NO: 476836 - RNA, 64 nt, hsa
uuaaaagcccugcuaauugcaugacacaccacauagaauguauacuagcagauacuauccagug

SEQ ID NO: 476837 - RNA, 64 nt, hsa
gugggguggcaauagcauugugccauuuugucauagaauguaaaaauugguuaacuuuacaaau

SEQ ID NO: 476838 - RNA, 64 nt, hsa
uuaaacauguauguacuuuuuuuuucuaaguuauagaauguauaauuuuguacuacauuuauuu

SEQ ID NO: 476839 - RNA, 64 nt, hsa
caaguaauaguuaucugaauaaaucaaucauauaagaauguauagacaagcugacauauuuccc

SEQ ID NO: 476840 - RNA, 64 nt, hsa
aaaccuuuagacucugaaaguaauauuuugacuaagaauguaaauauuuccaaacuaaauuacu

SEQ ID NO: 476841 - RNA, 64 nt, hsa
acacaaaacauuuaagugccagacuuaauauuaaagaauguaaagguccaaguaaaaugaggua

SEQ ID NO: 476842 - RNA, 64 nt, hsa
uugaaaaaagaugacaauuuaaaagucagccuaaagaauguaaagguaucuauauacaaaaggc

SEQ ID NO: 476843 - RNA, 64 nt, hsa
cucagagauauuuagaauauuugacaaugguuugagaauguaaaacaaaaaggaacuaguuaga

SEQ ID NO: 476844 - RNA, 64 nt, hsa
cauuucuggacaaaucuuauuuuguauuucuggaagaauguaguaaucuucuagaccgcuuaaa

SEQ ID NO: 476845 - RNA, 64 nt, hsa
cuguuuugcagcaguaagagaaacuagugcugcaagaauguauuuuuuaaugaaguuccuuauu

SEQ ID NO: 476846 - RNA, 64 nt, hsa
guaagccuucuaugcauccacaccaaaauccugcagaauguaaguaagcucugcuuuauaagau

SEQ ID NO: 476847 - RNA, 64 nt, hsa
aaaaacacacuguaauauuucaaguguaugcaguagaauguacuguaacugagcccuuucccac

SEQ ID NO: 476848 - RNA, 64 nt, hsa
gcagucuuugauucguacaauagaaggaacacguagaauguauauuuguacauucaugucaaca

SEQ ID NO: 476849 - RNA, 64 nt, hsa
gacucucagguauagaaugaacugagcaauuuggagaauguauuggacuuuguccucucuuauu

SEQ ID NO: 476850 - RNA, 64 nt, hsa
agauuugaacagagcaaaggcuucaagagagggcagaauguauucggcagaaaagggacucagg

SEQ ID NO: 476851 - RNA, 64 nt, hsa
ugagacucugucucaagaaggaaaaaaaaaaaaaagaauguacucauacagauuuuuguuaguc

SEQ ID NO: 476852 - RNA, 64 nt, hsa
uuuaauguugaacaaaauaaauuggaguuggaguagaauguaguuugaggaaauuugcagcuuc

SEQ ID NO: 476853 - RNA, 64 nt, hsa
aaccucuagaauuuuaagccuuuguugaacuguuagaauguaagguauaucauucuaaagauag

SEQ ID NO: 476854 - RNA, 64 nt, hsa; identical to SEQ ID NO: 160193

SEQ ID NO: 476855 - RNA, 64 nt, hsa; identical to SEQ ID NO: 160194

SEQ ID NO: 476856 - RNA, 64 nt, hsa; identical to SEQ ID NO: 160195

SEQ ID NO: 476857 - RNA, 64 nt, hsa; identical to SEQ ID NO: 160196

SEQ ID NO: 476858 - RNA, 64 nt, hsa; identical to SEQ ID NO: 160197

SEQ ID NO: 476859 - RNA, 64 nt, hsa; identical to SEQ ID NO: 160198

SEQ ID NO: 476860 - RNA, 59 nt, hsa; identical to SEQ ID NO: 160199

SEQ ID NO: 476861 - RNA, 64 nt, hsa; identical to SEQ ID NO: 160200

SEQ ID NO: 476862 - RNA, 64 nt, hsa; identical to SEQ ID NO: 160201

SEQ ID NO: 476863 - RNA, 64 nt, hsa; identical to SEQ ID NO: 160202

SEQ ID NO: 476864 - RNA, 64 nt, hsa; identical to SEQ ID NO: 160203

SEQ ID NO: 476865 - RNA, 64 nt, hsa; identical to SEQ ID NO: 160204

SEQ ID NO: 476866 - RNA, 64 nt, hsa; identical to SEQ ID NO: 160205

SEQ ID NO: 476867 - RNA, 64 nt, hsa; identical to SEQ ID NO: 160206

SEQ ID NO: 476868 - RNA, 64 nt, hsa; identical to SEQ ID NO: 160207

SEQ ID NO: 476869 - RNA, 64 nt, hsa; identical to SEQ ID NO: 160208

SEQ ID NO: 476870 - RNA, 64 nt, hsa; identical to SEQ ID NO: 160209

SEQ ID NO: 476871 - RNA, 64 nt, hsa; identical to SEQ ID NO: 160210

SEQ ID NO: 476872 - RNA, 64 nt, hsa; identical to SEQ ID NO: 160211

SEQ ID NO: 476873 - RNA, 64 nt, hsa; identical to SEQ ID NO: 160212

SEQ ID NO: 476874 - RNA, 64 nt, hsa; identical to SEQ ID NO: 160213

SEQ ID NO: 476875 - RNA, 64 nt, hsa; identical to SEQ ID NO: 160214

SEQ ID NO: 476876 - RNA, 64 nt, hsa; identical to SEQ ID NO: 160215

SEQ ID NO: 476877 - RNA, 64 nt, hsa; identical to SEQ ID NO: 160216

SEQ ID NO: 476878 - RNA, 64 nt, hsa; identical to SEQ ID NO: 160217

SEQ ID NO: 476879 - RNA, 64 nt, hsa; identical to SEQ ID NO: 160218

SEQ ID NO: 476880 - RNA, 64 nt, hsa; identical to SEQ ID NO: 160219

SEQ ID NO: 476881 - RNA, 64 nt, hsa; identical to SEQ ID NO: 160220

SEQ ID NO: 476882 - RNA, 64 nt, hsa; identical to SEQ ID NO: 160221

SEQ ID NO: 476883 - RNA, 64 nt, hsa; identical to SEQ ID NO: 160222

SEQ ID NO: 476884 - RNA, 64 nt, hsa; identical to SEQ ID NO: 160223

SEQ ID NO: 476885 - RNA, 64 nt, hsa; identical to SEQ ID NO: 160224

SEQ ID NO: 476886 - RNA, 64 nt, hsa; identical to SEQ ID NO: 160225

SEQ ID NO: 476887 - RNA, 64 nt, hsa; identical to SEQ ID NO: 160226

SEQ ID NO: 476888 - RNA, 64 nt, hsa; identical to SEQ ID NO: 160227

SEQ ID NO: 476889 - RNA, 64 nt, hsa; identical to SEQ ID NO: 160228

SEQ ID NO: 476890 - RNA, 64 nt, hsa; identical to SEQ ID NO: 160229

SEQ ID NO: 476891 - RNA, 64 nt, hsa; identical to SEQ ID NO: 160230

SEQ ID NO: 476892 - RNA, 64 nt, hsa; identical to SEQ ID NO: 160231

SEQ ID NO: 476893 - RNA, 64 nt, hsa; identical to SEQ ID NO: 160232

SEQ ID NO: 476894 - RNA, 64 nt, hsa; identical to SEQ ID NO: 160233

SEQ ID NO: 476895 - RNA, 64 nt, hsa; identical to SEQ ID NO: 160234

SEQ ID NO: 476896 - RNA, 64 nt, hsa; identical to SEQ ID NO: 160235

SEQ ID NO: 476897 - RNA, 64 nt, hsa; identical to SEQ ID NO: 160236

SEQ ID NO: 476898 - RNA, 64 nt, hsa
ggaccccaagugaagacgaggccaaggcugaaaccauccgcaaccugaggaagucuuuugccag

SEQ ID NO: 476899 - RNA, 64 nt, hsa
gcagggugaagaguccaagaagccagcaccaccccauccgcaucucaaguaagugcuuugggaa

SEQ ID NO: 476900 - RNA, 64 nt, hsa; identical to SEQ ID NO: 24913

SEQ ID NO: 476901 - RNA, 64 nt, hsa; identical to SEQ ID NO: 24914

SEQ ID NO: 476902 - RNA, 64 nt, hsa; identical to SEQ ID NO: 24915

SEQ ID NO: 476903 - RNA, 64 nt, hsa; identical to SEQ ID NO: 24916

SEQ ID NO: 476904 - RNA, 64 nt, hsa; identical to SEQ ID NO: 24917

SEQ ID NO: 476905 - RNA, 64 nt, hsa; identical to SEQ ID NO: 24918

SEQ ID NO: 476906 - RNA, 64 nt, hsa; identical to SEQ ID NO: 24919

SEQ ID NO: 476907 - RNA, 64 nt, hsa; identical to SEQ ID NO: 24920

SEQ ID NO: 476908 - RNA, 64 nt, hsa; identical to SEQ ID NO: 24921

SEQ ID NO: 476909 - RNA, 64 nt, hsa; identical to SEQ ID NO: 24922

SEQ ID NO: 476910 - RNA, 64 nt, hsa; identical to SEQ ID NO: 24923

SEQ ID NO: 476911 - RNA, 64 nt, hsa; identical to SEQ ID NO: 24924

SEQ ID NO: 476912 - RNA, 64 nt, hsa; identical to SEQ ID NO: 24925

SEQ ID NO: 476913 - RNA, 64 nt, hsa; identical to SEQ ID NO: 24926

SEQ ID NO: 476914 - RNA, 64 nt, hsa; identical to SEQ ID NO: 24927

SEQ ID NO: 476915 - RNA, 64 nt, hsa; identical to SEQ ID NO: 24928

SEQ ID NO: 476916 - RNA, 64 nt, hsa; identical to SEQ ID NO: 24929

SEQ ID NO: 476917 - RNA, 64 nt, hsa; identical to SEQ ID NO: 24930

SEQ ID NO: 476918 - RNA, 64 nt, hsa; identical to SEQ ID NO: 24931

SEQ ID NO: 476919 - RNA, 64 nt, hsa; identical to SEQ ID NO: 24932

SEQ ID NO: 476920 - RNA, 64 nt, hsa; identical to SEQ ID NO: 24933

SEQ ID NO: 476921 - RNA, 64 nt, hsa; identical to SEQ ID NO: 24934

SEQ ID NO: 476922 - RNA, 64 nt, hsa; identical to SEQ ID NO: 24935

SEQ ID NO: 476923 - RNA, 64 nt, hsa; identical to SEQ ID NO: 24936

SEQ ID NO: 476924 - RNA, 64 nt, hsa; identical to SEQ ID NO: 112962

SEQ ID NO: 476925 - RNA, 64 nt, hsa; identical to SEQ ID NO: 112963

SEQ ID NO: 476926 - RNA, 64 nt, hsa
cuaagugguacuagggaacuacaagaauacuguaaagcuuaagccauuguuaucacugucauuu

SEQ ID NO: 476927 - RNA, 64 nt, hsa
cgucaaaggcagaaucugucacuugaaugaaggaaagcuuaaagcccaagcagauaaaaauaaa

SEQ ID NO: 476928 - RNA, 64 nt, hsa
caucucagugaagaauacuucucauuuuuuaaaaaagcuuaaaacuuugaaguuagcuuuaacu

SEQ ID NO: 476929 - RNA, 64 nt, hsa
auuucccauuuaucgcagaccuuuuuuaggaagcaagcuuaauggcugauaauuuuaaauucuc

SEQ ID NO: 476930 - RNA, 64 nt, hsa
uuucuguguuuuuuggaggugcaguuaaacuuuuaagcuuaagugugacaggacugauaaauag

SEQ ID NO: 476931 - RNA, 64 nt, hsa
aaaaaaauugcuuauuacucuucauuuuacacuaaagcuuaaugucacuaaguuucaugucugu

SEQ ID NO: 476932 - RNA, 64 nt, hsa
auauagaaguguuugaaauguucaagcucacaauaagcuuaaauuuauagaaaaugcuaagguu

SEQ ID NO: 476933 - RNA, 64 nt, hsa
uaaaucaaucccaguuugggaaaagauuauuuuuaagcuuaaaaggcugacaugugccauuaua

SEQ ID NO: 476934 - RNA, 64 nt, hsa; identical to SEQ ID NO: 217042

SEQ ID NO: 476935 - RNA, 64 nt, hsa; identical to SEQ ID NO: 217043

SEQ ID NO: 476936 - RNA, 64 nt, hsa; identical to SEQ ID NO: 217044

SEQ ID NO: 476937 - RNA, 64 nt, hsa; identical to SEQ ID NO: 217045

SEQ ID NO: 476938 - RNA, 64 nt, hsa; identical to SEQ ID NO: 217046

SEQ ID NO: 476939 - RNA, 64 nt, hsa; identical to SEQ ID NO: 217047

SEQ ID NO: 476940 - RNA, 64 nt, hsa; identical to SEQ ID NO: 217048

SEQ ID NO: 476941 - RNA, 64 nt, hsa; identical to SEQ ID NO: 217049

SEQ ID NO: 476942 - RNA, 64 nt, hsa; identical to SEQ ID NO: 217050

SEQ ID NO: 476943 - RNA, 64 nt, hsa; identical to SEQ ID NO: 217051

SEQ ID NO: 476944 - RNA, 64 nt, hsa; identical to SEQ ID NO: 217052

SEQ ID NO: 476945 - RNA, 64 nt, hsa; identical to SEQ ID NO: 217053

SEQ ID NO: 476946 - RNA, 64 nt, hsa; identical to SEQ ID NO: 217054

SEQ ID NO: 476947 - RNA, 64 nt, hsa; identical to SEQ ID NO: 217055

SEQ ID NO: 476948 - RNA, 64 nt, hsa; identical to SEQ ID NO: 217056

SEQ ID NO: 476949 - RNA, 64 nt, hsa; identical to SEQ ID NO: 217057

SEQ ID NO: 476950 - RNA, 64 nt, hsa; identical to SEQ ID NO: 217058

SEQ ID NO: 476951 - RNA, 64 nt, hsa; identical to SEQ ID NO: 167179

SEQ ID NO: 476952 - RNA, 64 nt, hsa; identical to SEQ ID NO: 167180

SEQ ID NO: 476953 - RNA, 64 nt, hsa; identical to SEQ ID NO: 167181

SEQ ID NO: 476954 - RNA, 64 nt, hsa; identical to SEQ ID NO: 167182

SEQ ID NO: 476955 - RNA, 51 nt, hsa; identical to SEQ ID NO: 167183

SEQ ID NO: 476956 - RNA, 64 nt, hsa; identical to SEQ ID NO: 167184

SEQ ID NO: 476957 - RNA, 64 nt, hsa; identical to SEQ ID NO: 167185

SEQ ID NO: 476958 - RNA, 64 nt, hsa; identical to SEQ ID NO: 167186

SEQ ID NO: 476959 - RNA, 58 nt, hsa; identical to SEQ ID NO: 167187

SEQ ID NO: 476960 - RNA, 64 nt, hsa; identical to SEQ ID NO: 167188

SEQ ID NO: 476961 - RNA, 64 nt, hsa; identical to SEQ ID NO: 167189

SEQ ID NO: 476962 - RNA, 64 nt, hsa; identical to SEQ ID NO: 167190

SEQ ID NO: 476963 - RNA, 64 nt, hsa; identical to SEQ ID NO: 167191

SEQ ID NO: 476964 - RNA, 64 nt, hsa; identical to SEQ ID NO: 167192

SEQ ID NO: 476965 - RNA, 64 nt, hsa; identical to SEQ ID NO: 167193

SEQ ID NO: 476966 - RNA, 64 nt, hsa; identical to SEQ ID NO: 167194

SEQ ID NO: 476967 - RNA, 64 nt, hsa; identical to SEQ ID NO: 167195

SEQ ID NO: 476968 - RNA, 64 nt, hsa; identical to SEQ ID NO: 167196

SEQ ID NO: 476969 - RNA, 64 nt, hsa; identical to SEQ ID NO: 167197

SEQ ID NO: 476970 - RNA, 64 nt, hsa; identical to SEQ ID NO: 167198

SEQ ID NO: 476971 - RNA, 64 nt, hsa; identical to SEQ ID NO: 167199

SEQ ID NO: 476972 - RNA, 64 nt, hsa; identical to SEQ ID NO: 167200

SEQ ID NO: 476973 - RNA, 64 nt, hsa; identical to SEQ ID NO: 167201

SEQ ID NO: 476974 - RNA, 64 nt, hsa; identical to SEQ ID NO: 167202

SEQ ID NO: 476975 - RNA, 64 nt, hsa; identical to SEQ ID NO: 167203

SEQ ID NO: 476976 - RNA, 64 nt, hsa; identical to SEQ ID NO: 167204

SEQ ID NO: 476977 - RNA, 64 nt, hsa; identical to SEQ ID NO: 167205

SEQ ID NO: 476978 - RNA, 64 nt, hsa; identical to SEQ ID NO: 167206

SEQ ID NO: 476979 - RNA, 64 nt, hsa; identical to SEQ ID NO: 167207

SEQ ID NO: 476980 - RNA, 64 nt, hsa; identical to SEQ ID NO: 167208

SEQ ID NO: 476981 - RNA, 64 nt, hsa; identical to SEQ ID NO: 167209

SEQ ID NO: 476982 - RNA, 64 nt, hsa; identical to SEQ ID NO: 167210

SEQ ID NO: 476983 - RNA, 64 nt, hsa; identical to SEQ ID NO: 167211

SEQ ID NO: 476984 - RNA, 64 nt, hsa; identical to SEQ ID NO: 167212

SEQ ID NO: 476985 - RNA, 64 nt, hsa; identical to SEQ ID NO: 167213

SEQ ID NO: 476986 - RNA, 64 nt, hsa; identical to SEQ ID NO: 167214

SEQ ID NO: 476987 - RNA, 64 nt, hsa; identical to SEQ ID NO: 167215

SEQ ID NO: 476988 - RNA, 64 nt, hsa; identical to SEQ ID NO: 167216

SEQ ID NO: 476989 - RNA, 64 nt, hsa; identical to SEQ ID NO: 167217

SEQ ID NO: 476990 - RNA, 64 nt, hsa; identical to SEQ ID NO: 167218

SEQ ID NO: 476991 - RNA, 64 nt, hsa; identical to SEQ ID NO: 167219

SEQ ID NO: 476992 - RNA, 64 nt, hsa; identical to SEQ ID NO: 167220

SEQ ID NO: 476993 - RNA, 64 nt, hsa; identical to SEQ ID NO: 167221

SEQ ID NO: 476994 - RNA, 64 nt, hsa; identical to SEQ ID NO: 167222

SEQ ID NO: 476995 - RNA, 64 nt, hsa; identical to SEQ ID NO: 167223

SEQ ID NO: 476996 - RNA, 64 nt, hsa; identical to SEQ ID NO: 167224

SEQ ID NO: 476997 - RNA, 64 nt, hsa; identical to SEQ ID NO: 167225

SEQ ID NO: 476998 - RNA, 64 nt, hsa; identical to SEQ ID NO: 167226

SEQ ID NO: 476999 - RNA, 64 nt, hsa; identical to SEQ ID NO: 167227

SEQ ID NO: 477000 - RNA, 64 nt, hsa; identical to SEQ ID NO: 167228

SEQ ID NO: 477001 - RNA, 64 nt, hsa; identical to SEQ ID NO: 167229

SEQ ID NO: 477002 - RNA, 64 nt, hsa; identical to SEQ ID NO: 167230

SEQ ID NO: 477003 - RNA, 64 nt, hsa; identical to SEQ ID NO: 167231

SEQ ID NO: 477004 - RNA, 64 nt, hsa; identical to SEQ ID NO: 167232

SEQ ID NO: 477005 - RNA, 64 nt, hsa; identical to SEQ ID NO: 167233

SEQ ID NO: 477006 - RNA, 64 nt, hsa; identical to SEQ ID NO: 167234

SEQ ID NO: 477007 - RNA, 64 nt, hsa; identical to SEQ ID NO: 167235

SEQ ID NO: 477008 - RNA, 64 nt, hsa; identical to SEQ ID NO: 167236

SEQ ID NO: 477009 - RNA, 64 nt, hsa; identical to SEQ ID NO: 167237

SEQ ID NO: 477010 - RNA, 64 nt, hsa; identical to SEQ ID NO: 167238

SEQ ID NO: 477011 - RNA, 64 nt, hsa; identical to SEQ ID NO: 167239

SEQ ID NO: 477012 - RNA, 64 nt, hsa; identical to SEQ ID NO: 167240

SEQ ID NO: 477013 - RNA, 64 nt, hsa; identical to SEQ ID NO: 167241

SEQ ID NO: 477014 - RNA, 64 nt, hsa; identical to SEQ ID NO: 167242

SEQ ID NO: 477015 - RNA, 64 nt, hsa; identical to SEQ ID NO: 167243

SEQ ID NO: 477016 - RNA, 64 nt, hsa; identical to SEQ ID NO: 167244

SEQ ID NO: 477017 - RNA, 64 nt, hsa; identical to SEQ ID NO: 167245

SEQ ID NO: 477018 - RNA, 64 nt, hsa; identical to SEQ ID NO: 167246

SEQ ID NO: 477019 - RNA, 64 nt, hsa; identical to SEQ ID NO: 167247

SEQ ID NO: 477020 - RNA, 64 nt, hsa; identical to SEQ ID NO: 167248

SEQ ID NO: 477021 - RNA, 64 nt, hsa; identical to SEQ ID NO: 167249

SEQ ID NO: 477022 - RNA, 64 nt, hsa; identical to SEQ ID NO: 167250

SEQ ID NO: 477023 - RNA, 64 nt, hsa; identical to SEQ ID NO: 167251

SEQ ID NO: 477024 - RNA, 64 nt, hsa; identical to SEQ ID NO: 167252

SEQ ID NO: 477025 - RNA, 64 nt, hsa; identical to SEQ ID NO: 167253

SEQ ID NO: 477026 - RNA, 64 nt, hsa; identical to SEQ ID NO: 167254

SEQ ID NO: 477027 - RNA, 64 nt, hsa; identical to SEQ ID NO: 167255

SEQ ID NO: 477028 - RNA, 64 nt, hsa; identical to SEQ ID NO: 167256

SEQ ID NO: 477029 - RNA, 64 nt, hsa; identical to SEQ ID NO: 167257

SEQ ID NO: 477030 - RNA, 64 nt, hsa; identical to SEQ ID NO: 167258

SEQ ID NO: 477031 - RNA, 64 nt, hsa; identical to SEQ ID NO: 167259

SEQ ID NO: 477032 - RNA, 64 nt, hsa; identical to SEQ ID NO: 167260

SEQ ID NO: 477033 - RNA, 64 nt, hsa; identical to SEQ ID NO: 167261

SEQ ID NO: 477034 - RNA, 63 nt, hsa; identical to SEQ ID NO: 167262

SEQ ID NO: 477035 - RNA, 64 nt, hsa; identical to SEQ ID NO: 167263

SEQ ID NO: 477036 - RNA, 64 nt, hsa; identical to SEQ ID NO: 167264

SEQ ID NO: 477037 - RNA, 64 nt, hsa; identical to SEQ ID NO: 167265

SEQ ID NO: 477038 - RNA, 64 nt, hsa; identical to SEQ ID NO: 167266

SEQ ID NO: 477039 - RNA, 64 nt, hsa; identical to SEQ ID NO: 167267

SEQ ID NO: 477040 - RNA, 64 nt, hsa; identical to SEQ ID NO: 167268

SEQ ID NO: 477041 - RNA, 64 nt, hsa; identical to SEQ ID NO: 167269

SEQ ID NO: 477042 - RNA, 64 nt, hsa; identical to SEQ ID NO: 167270

SEQ ID NO: 477043 - RNA, 64 nt, hsa; identical to SEQ ID NO: 167271

SEQ ID NO: 477044 - RNA, 64 nt, hsa; identical to SEQ ID NO: 167272

SEQ ID NO: 477045 - RNA, 64 nt, hsa; identical to SEQ ID NO: 167273

SEQ ID NO: 477046 - RNA, 64 nt, hsa; identical to SEQ ID NO: 167274

SEQ ID NO: 477047 - RNA, 64 nt, hsa; identical to SEQ ID NO: 167275

SEQ ID NO: 477048 - RNA, 64 nt, hsa; identical to SEQ ID NO: 167276

SEQ ID NO: 477049 - RNA, 64 nt, hsa; identical to SEQ ID NO: 167277

SEQ ID NO: 477050 - RNA, 64 nt, hsa; identical to SEQ ID NO: 167278

SEQ ID NO: 477051 - RNA, 64 nt, hsa; identical to SEQ ID NO: 167279

SEQ ID NO: 477052 - RNA, 64 nt, hsa; identical to SEQ ID NO: 167280

SEQ ID NO: 477053 - RNA, 64 nt, hsa; identical to SEQ ID NO: 167281

SEQ ID NO: 477054 - RNA, 64 nt, hsa; identical to SEQ ID NO: 167282

SEQ ID NO: 477055 - RNA, 64 nt, hsa; identical to SEQ ID NO: 167283

SEQ ID NO: 477056 - RNA, 64 nt, hsa; identical to SEQ ID NO: 167284

SEQ ID NO: 477057 - RNA, 64 nt, hsa; identical to SEQ ID NO: 167285

SEQ ID NO: 477058 - RNA, 64 nt, hsa; identical to SEQ ID NO: 167286

SEQ ID NO: 477059 - RNA, 64 nt, hsa; identical to SEQ ID NO: 167287

SEQ ID NO: 477060 - RNA, 64 nt, hsa; identical to SEQ ID NO: 167288

SEQ ID NO: 477061 - RNA, 64 nt, hsa; identical to SEQ ID NO: 167289

SEQ ID NO: 477062 - RNA, 64 nt, hsa; identical to SEQ ID NO: 167290

SEQ ID NO: 477063 - RNA, 64 nt, hsa; identical to SEQ ID NO: 167291

SEQ ID NO: 477064 - RNA, 64 nt, hsa; identical to SEQ ID NO: 167292

SEQ ID NO: 477065 - RNA, 64 nt, hsa; identical to SEQ ID NO: 167293

SEQ ID NO: 477066 - RNA, 64 nt, hsa; identical to SEQ ID NO: 167294

SEQ ID NO: 477067 - RNA, 64 nt, hsa; identical to SEQ ID NO: 167295

SEQ ID NO: 477068 - RNA, 64 nt, hsa; identical to SEQ ID NO: 167296

SEQ ID NO: 477069 - RNA, 64 nt, hsa; identical to SEQ ID NO: 167297

SEQ ID NO: 477070 - RNA, 64 nt, hsa; identical to SEQ ID NO: 167298

SEQ ID NO: 477071 - RNA, 64 nt, hsa; identical to SEQ ID NO: 167299

SEQ ID NO: 477072 - RNA, 64 nt, hsa; identical to SEQ ID NO: 167300

SEQ ID NO: 477073 - RNA, 64 nt, hsa; identical to SEQ ID NO: 167301

SEQ ID NO: 477074 - RNA, 64 nt, hsa; identical to SEQ ID NO: 167302

SEQ ID NO: 477075 - RNA, 64 nt, hsa; identical to SEQ ID NO: 167303

SEQ ID NO: 477076 - RNA, 64 nt, hsa; identical to SEQ ID NO: 167304

SEQ ID NO: 477077 - RNA, 64 nt, hsa; identical to SEQ ID NO: 167305

SEQ ID NO: 477078 - RNA, 64 nt, hsa; identical to SEQ ID NO: 167306

SEQ ID NO: 477079 - RNA, 64 nt, hsa
ugcauugugaagaggaggaaaagugaaucacggagagagaaaggaaaggauagaaucacaggcu

SEQ ID NO: 477080 - RNA, 64 nt, hsa
uuuauccagcuauacuuacuugcacaguggauuggagagaaaggauucuccagugugcacacuc

SEQ ID NO: 477081 - RNA, 64 nt, hsa
aaugcccgagugacacaugagagcuguaugaauugagagaaaaggcaacaaguagcauucuuca

SEQ ID NO: 477082 - RNA, 64 nt, hsa
uucugugcucuauuauacccugauagagaugggggagagaaaggaauguuuuugauggugguuu

SEQ ID NO: 477083 - RNA, 64 nt, hsa
guguguguguguguguguguguguguggcagagagagagaaagagagagagagagagaaauucu

SEQ ID NO: 477084 - RNA, 64 nt, hsa
guguguguggcagagagagagaaagagagagagagagagaaauucuguuaaaaucuauucugug

SEQ ID NO: 477085 - RNA, 64 nt, hsa
agccccgcagaccuccccagccccuagcccaggagagagaaagccaggcagguagccaggggga

SEQ ID NO: 477086 - RNA, 64 nt, hsa
aaggugcuggaggugggagcaggagauugagaaggagagaaagugggugagaugcuggagaaga

SEQ ID NO: 477087 - RNA, 64 nt, hsa
ccacgcccuccccuccccugcugcaggggcucuggagagaaacaauaaagagauucacacacaa

SEQ ID NO: 477088 - RNA, 64 nt, hsa
caggugucagcuuuucgucuaguaacuuaagugagagagaaagggcagcgccacagaagccccu

SEQ ID NO: 477089 - RNA, 64 nt, hsa
gcuuuaccggaguagggggugggagagggaagaggagagaaaauacagggacuuugaaccuagg

SEQ ID NO: 477090 - RNA, 64 nt, hsa
gcaaauuauuuguaugcuucaaaaaaaaaaaaaagagagaaacaaaaaagugugacauuacaga

SEQ ID NO: 477091 - RNA, 64 nt, hsa
uuuccaguuccguucugagagaaaaagagagagagagagaaaaagaccaugcugcauacauucu

SEQ ID NO: 477092 - RNA, 64 nt, hsa
ugagcaaacauguugcuguuuccaguuccguucugagagaaaaagagagagagagagaaaaaga

SEQ ID NO: 477093 - RNA, 64 nt, hsa
auaaaaacauagacuggaggagguaauccauggagagagaaaaagaagagggcucaggacaagg

SEQ ID NO: 477094 - RNA, 64 nt, hsa
guguugggguuuugccagggaaguaaaaggaguugagagaaagaugggucaguucagaagacau

SEQ ID NO: 477095 - RNA, 64 nt, hsa
gguugacuuuuugcacuucuguauauagucaaaagagagaaaccuguauaauaguaagaucuua

SEQ ID NO: 477096 - RNA, 64 nt, hsa
aaacuacugcauguuuaaaacuucaacaaaaaaagagagaaagaacuauacuaagaacauauau

SEQ ID NO: 477097 - RNA, 64 nt, hsa
aagagcaagaaaagagaaaauauuaaaacgaggagagagaaaaauaauauuaacacaaaaaaau

SEQ ID NO: 477098 - RNA, 64 nt, hsa
aaaugagcaaacaaaaaaaucgaaagacaaacgggagagaaaaagaggaagggaacuuauuucu

SEQ ID NO: 477099 - RNA, 64 nt, hsa
ucaaaccuugauaaacauaagagaauucauaccggagagaaacuguacaaaugugaagaauaug

SEQ ID NO: 477100 - RNA, 64 nt, hsa
gguccucaaugcuuaauaaauauaauucaugcuggagagaaacuucacaugugaaccguguggc

SEQ ID NO: 477101 - RNA, 64 nt, hsa
ucaaacuuuguuaaacauaagagaauuuauaccagagagaaacccuacacauguaaagaaugug

SEQ ID NO: 477102 - RNA, 64 nt, hsa
acacaccacagccaggaggggccuuucccaccuggagagaaacuuccagaccagccccucauac

SEQ ID NO: 477103 - RNA, 64 nt, hsa
ucauaccacagccaagaggggccuuucucaccuggagagaaauuuccagaccauccccucucac

SEQ ID NO: 477104 - RNA, 64 nt, hsa
ucacaccacagccaagagaagccuuuccagccuggagagaaacuuccagaccagcccucucacu

SEQ ID NO: 477105 - RNA, 64 nt, hsa
ucacaccacagccaggagaggccuuucccaccuggagagaaacuuccagaccagccccucauac

SEQ ID NO: 477106 - RNA, 64 nt, hsa
ucauaccacagccaagaggggccuuucucaccuggagagaaacuuccagaccagccccucacac

SEQ ID NO: 477107 - RNA, 64 nt, hsa
ucacaccaccgccaggagaggccuuucccaccgggagagaaacuuccagaccagccccucacac

SEQ ID NO: 477108 - RNA, 64 nt, hsa
ucacaccacagccaggagaggccuuucccaccgggagagaaacuuccagaccagcccucucacu

SEQ ID NO: 477109 - RNA, 64 nt, hsa
ucacaccacagccaggagagaccuuuucugccuggagagaaacuuucagaccagccccacacac

SEQ ID NO: 477110 - RNA, 64 nt, hsa
ucacaccacagccaggagaggccuuucccaccuggagagaaacuuccagaccagccccucucac

SEQ ID NO: 477111 - RNA, 64 nt, hsa
guuuuuuuaaugaugaaaaguuacacauuuuuuggagagaaaagucuuagcugaagguaaauca

SEQ ID NO: 477112 - RNA, 64 nt, hsa
cuagaaaaugcauaagguuaguacaagaucaguagagagaaagucaaagauuacagaagugcug

SEQ ID NO: 477113 - RNA, 64 nt, hsa
ugcauuuuaagccuucaaauuacauuaucaacaugagagaaaucaccaacaaagaagauguuca

SEQ ID NO: 477114 - RNA, 64 nt, hsa
gaaaaaaagcauacaucaugauuauggcaaagaggagagaaagaaauuuauuuuacauugacau

SEQ ID NO: 477115 - RNA, 64 nt, hsa
agagugagagcacaaagauaacgcaggagagagagagagaaagaaugagaaagaaaaggaaugc

SEQ ID NO: 477116 - RNA, 64 nt, hsa
gauguaaugacagagaguucuggugagauacccagagagaaaaagagagagcagggugggguaa

SEQ ID NO: 477117 - RNA, 64 nt, hsa
cucaccaggaaauucuguuuauguucuugcagcagagagaaauaaaacuccuugaaaccagcuc

SEQ ID NO: 477118 - RNA, 64 nt, hsa
agagacacgaacaaaccaaggaaaucuaaguuucgagagaaaggagggcaacuucuacucuuca

SEQ ID NO: 477119 - RNA, 64 nt, hsa
auccccuucuccaaacgauuagucuaaauuuucagagagaaauagauaaaacacgccacagccu

SEQ ID NO: 477120 - RNA, 64 nt, hsa
cuacaugcaucuagggcggagaggcugcacuugugagagaaaauacuauuucaagucauauucu

SEQ ID NO: 477121 - RNA, 64 nt, hsa
uacaagcuuacuacacauaggaaaauucauacuggagagaaacuacaaaugugaagaauguguu

SEQ ID NO: 477122 - RNA, 64 nt, hsa
auccucauaccuuacuauacagaaauucauacuggagagaaagccuacaauugugaagaaugug

SEQ ID NO: 477123 - RNA, 64 nt, hsa
cacaccuugcuacauauaagacaguuuauacuuugagagaaacccugcaaaugugaauaaugug

SEQ ID NO: 477124 - RNA, 64 nt, hsa
uaacaacuuacugaacauaagaaaauuuacacuagagagaaagccuacaaaugugaagaaugug

SEQ ID NO: 477125 - RNA, 64 nt, hsa
ucaacccuuauuacacauaagauaauucauagcggagagaaaccccacaaaugugaagaaugug

SEQ ID NO: 477126 - RNA, 64 nt, hsa
ucaacucuuacugcacauaagaucauucauacuggagagaaaccuuacaaaugugaggaaugug

SEQ ID NO: 477127 - RNA, 64 nt, hsa
ucaaaccuuacuaaacacaagaagauucauacuagagagaaacccuacaaaugugaagaaugug

SEQ ID NO: 477128 - RNA, 64 nt, hsa
ucgaacuuuacuaugcauaagaaaauucaaacuggagagaaacucuacaaaugugaagaaugug

SEQ ID NO: 477129 - RNA, 64 nt, hsa
uccucaaaacuucuuacaccuaaaauucaugcaggagagaaacaccacaaaugugaaaaauuug

SEQ ID NO: 477130 - RNA, 64 nt, hsa
ucaacccuuucugcacauaauauaauucauacuggagagaaaccccacaaauaugaagaaugug

SEQ ID NO: 477131 - RNA, 64 nt, hsa
ucacaucuuauucagcaucaaagaauucacacaggagagaaagcacaugaauguaaugaaugug

SEQ ID NO: 477132 - RNA, 64 nt, hsa
ucagccauugcucagcaucagauaauucacaccagagagaaacccucugaaugugacgaaugaa

SEQ ID NO: 477133 - RNA, 64 nt, hsa
cacauuucaggcuuuacccaacaucgaaauaauggagagaaaauuguugauuauuuguuuauga

SEQ ID NO: 477134 - RNA, 64 nt, hsa
ucaaaacucauugaacacaagaaaauucauacuggagagaaaccuuacaagugugaagaaugug

SEQ ID NO: 477135 - RNA, 64 nt, hsa
ucaacccuuauuggacauaagagaauucauacuggagagaaacccuacaaaugugaagaaugug

SEQ ID NO: 477136 - RNA, 64 nt, hsa
caaauuuuccccauuuuucucuuucuuguagaaggagagaaaccaugcucucuagcaacauuga

SEQ ID NO: 477137 - RNA, 64 nt, hsa
aaagaagagggagggagagagaaagacgaagggagagagaaagcaguuuccaaggauauguuuc

SEQ ID NO: 477138 - RNA, 64 nt, hsa
guacugaagagaaaugggaaagaagagggagggagagagaaagacgaagggagagagaaagcag

SEQ ID NO: 477139 - RNA, 64 nt, hsa
gcauaagugccauccuuuaaucauagacuuugaggagagaaagcauaaaaauauagcauauaau

SEQ ID NO: 477140 - RNA, 64 nt, hsa
uacuuguaacagcguaauuaaacacaucauggaggagagaaacuuaaaauuaaaauaguauuuu

SEQ ID NO: 477141 - RNA, 64 nt, hsa
aaaggaaacacgaaagaaaagucaggaagguagagagagaaaaagggagggaaggagaaagaau

SEQ ID NO: 477142 - RNA, 64 nt, hsa
ccccuggaggaaagucauuccugccuaauccaucgagagaaagaggcuuacgaaaaacuuugcc

SEQ ID NO: 477143 - RNA, 64 nt, hsa
gagacacagagagaaggagaaagagggagggagagagagaaagagagagaaagagagagagaga

SEQ ID NO: 477144 - RNA, 64 nt, hsa
gagaaggagaaagagggagggagagagagaaagagagagaaagagagagagagagagagagaga

SEQ ID NO: 477145 - RNA, 64 nt, hsa
gagaaagagagagaaagagagagagagagagagagagagaaagcugaacgugcacucugacaag

SEQ ID NO: 477146 - RNA, 64 nt, hsa
agucccucuaucccuucuccuguccaggggcccagagagaaacacaccuaccccuggccuugcc

SEQ ID NO: 477147 - RNA, 64 nt, hsa
uccucuuuccguggcuggggguagacuuaauaaagagagaaauucaagaacugcuugcuuuauu

SEQ ID NO: 477148 - RNA, 64 nt, hsa
aaauuuaacugccuaaaauguucuccuuagaugugagagaaagagaaaucagaaaaauuaauuc

SEQ ID NO: 477149 - RNA, 64 nt, hsa
ucauguaaaauaagaaagcccuaaaauacuauuggagagaaaaaauuaacuagguugcuacuuu

SEQ ID NO: 477150 - RNA, 64 nt, hsa
gcuauagagagguuggaaggggugguuggaaggggagagaaacugagauggcccucugugacuc

SEQ ID NO: 477151 - RNA, 64 nt, hsa
gccaugcucugggacgugugggcccuggggagaggagagaaagggcucccaccugccagucccu

SEQ ID NO: 477152 - RNA, 64 nt, hsa
cugguggguaccuaucccagccacguuucagagggagagaaaugcuacaguugauccucaucug

SEQ ID NO: 477153 - RNA, 64 nt, hsa
accuauggcuggcuuuccuuagcagcaagaacuugagagaaaaacacaucugucucugcaaugc

SEQ ID NO: 477154 - RNA, 64 nt, hsa
guucggggauauauuaagauauuuuuguacauaagagagaaagagagagaaaaauuuauagaag

SEQ ID NO: 477155 - RNA, 64 nt, hsa
auauuaagauauuuuuguacauaagagagaaagagagagaaaaauuuauagaaguuuuguacaa

SEQ ID NO: 477156 - RNA, 64 nt, hsa
agaguaagaauaaaaacuaccaaagugauauacagagagaaaaaaagacuuagagaagaggaag

SEQ ID NO: 477157 - RNA, 64 nt, hsa
ucauacuuucugacacuuuugaggaugcaugugggagagaaacccuauugaggcagugacuguu

SEQ ID NO: 477158 - RNA, 64 nt, hsa
ccccaaaauagcugcccuuaaagaguuguuagcagagagaaaaauaacagugaaugugcuccug

SEQ ID NO: 477159 - RNA, 64 nt, hsa
aaguauacacucagcaauaauuagaaaaaaaggagagagaaaagugauuuaaacaggguggauu

SEQ ID NO: 477160 - RNA, 64 nt, hsa
cgaaugugcuuuuuauuguaauucaacagcuauagagagaaagauaacuuauuguguguuugau

SEQ ID NO: 477161 - RNA, 64 nt, hsa
acgaguguggcagagagugugcaugugagaaagcgagagaaagaggaacugaaggacgcgguua

SEQ ID NO: 477162 - RNA, 64 nt, hsa
uacagaguaagugaaagggugccugcgcugacgugagagaaaggaaucuguaaacaguggaaac

SEQ ID NO: 477163 - RNA, 64 nt, hsa
cuuauuuaccuaggagcauguaagagaaagaagggagagaaaagguugcaucugcaggaugccu

SEQ ID NO: 477164 - RNA, 64 nt, hsa
aaaauagaaucagauuaucucuuuuuuucuaaaggagagaaagacuuagaacauacacagaucc

SEQ ID NO: 477165 - RNA, 64 nt, hsa
ucuucuauagacuugagaauguuuuucucuaaaugagagaaagacuuagaauguacacagaucc

SEQ ID NO: 477166 - RNA, 64 nt, hsa
uuuacugguuuggcaugcgguauggaaauucuaagagagaaaguuuuaaggcaaugaaucacag

SEQ ID NO: 477167 - RNA, 64 nt, hsa
gucauugccuuaagccaccuccccaggacuuacggagagaaauaaggggauguaaccagcaaug

SEQ ID NO: 477168 - RNA, 64 nt, hsa
ccccgacaucaccccaaggacaacggcagaaguagagagaaacuaccuaccucacuucaaauua

SEQ ID NO: 477169 - RNA, 64 nt, hsa
agcagcucggcuacuuuuguaaacuucagauuuggagagaaacacgaaagucugaauccugacc

SEQ ID NO: 477170 - RNA, 64 nt, hsa
cagagagugagagagagaaagagagugagagagagagagaaagagagagagagaugcuguugaa

SEQ ID NO: 477171 - RNA, 64 nt, hsa
gaguaaccaguuuccagagagccagagagugagagagagaaagagagugagagagagagagaaa

SEQ ID NO: 477172 - RNA, 64 nt, hsa
auaugaggagagagagacagaggaggcagagagggagagaaacagaggagacagagagggagag

SEQ ID NO: 477173 - RNA, 64 nt, hsa
gaaaggaggagggagagagauggagaggaggggagagagaaagagagguggggagaggggagag

SEQ ID NO: 477174 - RNA, 64 nt, hsa
aagucauuucaaauacaugaaaaaucuuacacuggagagaaacccuaugaguguaagcaaugug

SEQ ID NO: 477175 - RNA, 64 nt, hsa
aaaaaucuucgauuucauaaaaggacacacacuggagagaaacccugugaauguaagaaaugua

SEQ ID NO: 477176 - RNA, 64 nt, hsa
aagauccuuugaauacaugcaagaacacacaauggagagaaacccuaugaauguaaagaaugca

SEQ ID NO: 477177 - RNA, 64 nt, hsa
acuucuuuucaauaucaugaaaggacucacaugggagagaaacccuaugaguguaugccaagug

SEQ ID NO: 477178 - RNA, 64 nt, hsa
aaguuauuucaaacacaugaaaaaauucacacuggagagaaacccuauaaaugcaagcaaugug

SEQ ID NO: 477179 - RNA, 64 nt, hsa
aagaaccuuucaauuuaugaaaggacacacacuggagagaaacccuaugaauguaagaaaugug

SEQ ID NO: 477180 - RNA, 64 nt, hsa
caagaucguuugaauacaugcaaaacacacacuggagagaaaccuaugaauguaaggaaugcaa

SEQ ID NO: 477181 - RNA, 64 nt, hsa
aagucauuucgaagacaugaaaaaacucacacuggagagaaacccuauaaaugcaugccaugug

SEQ ID NO: 477182 - RNA, 64 nt, hsa
aguuccuuucaguaucaugaaaggacucacacuggagagaaacccuaugaguguaagcaaugug

SEQ ID NO: 477183 - RNA, 64 nt, hsa
ccccacaccuucgaaggcaugguaggacucacuggagagaaacccuaugaguguaaggaaugug

SEQ ID NO: 477184 - RNA, 64 nt, hsa
aguuccuuuugguaccaugaaaggacucacacuggagagaaacccuaugaguguaagcaaugug

SEQ ID NO: 477185 - RNA, 64 nt, hsa
ccacaccuucgaauccaugguagaacucacacuggagagaaacccuaugaguguaaggaaugug

SEQ ID NO: 477186 - RNA, 64 nt, hsa
aagucauuucaaauaccugaaaaaucuuacacuggagagaaacccuaugaguguaagcaaugug

SEQ ID NO: 477187 - RNA, 64 nt, hsa
acuucuuuucgauaacaugaaaggacucacacuggagagaaacccuaugaguguaagcaaugug

SEQ ID NO: 477188 - RNA, 64 nt, hsa
guaugaaaacacaaagcacaggucaggauccucugagagaaaaucaacauugcaccacguaggg

SEQ ID NO: 477189 - RNA, 64 nt, hsa
aaugagggcaacaggagauguggggacguguuaggagagaaaaaaaaaaaaacaaaaauauaua

SEQ ID NO: 477190 - RNA, 64 nt, hsa
aaucaaccaacacaagaucaaaaaggaaaaggacgagagaaaaauuauuuuuaagauaauuaaa

SEQ ID NO: 477191 - RNA, 64 nt, hsa
ccacccugaccgugcugaacagacccccccacacgagagaaaauaaaggagcaauaaagucacg

SEQ ID NO: 477192 - RNA, 64 nt, hsa
uuuacccuuaauacacauaagauaauuaaugcuggagagaaacccuacaaaugugaagaaugug

SEQ ID NO: 477193 - RNA, 64 nt, hsa
ucauaccuuacuaaauauaagauaauucauauuggagagaaauucuacagaugugaagaaugug

SEQ ID NO: 477194 - RNA, 64 nt, hsa
ucauccauuaguaaacauaagauaauucauacuggagagaaaaccuacaaaugugaggaaugug

SEQ ID NO: 477195 - RNA, 64 nt, hsa
ucaacccuuacuacacauuagauaauucaugcuggagagaaacccuacaaaugugaaaaaugug

SEQ ID NO: 477196 - RNA, 64 nt, hsa
aguccucaacuccuaguaaacauaauuaaugauggagagaaaccauacaacugugaagaaugug

SEQ ID NO: 477197 - RNA, 64 nt, hsa
ccucaaacuuuauugaacaaaauaauucauacaggagagaaacccuacaaaugugaagaaugug

SEQ ID NO: 477198 - RNA, 64 nt, hsa
ucaauuuuuacuaaacauaagaaaauucauacuggagagaaacccuaugauugugaaaaauaug

SEQ ID NO: 477199 - RNA, 64 nt, hsa
ucgucccugcuucaacaucacaguauucauacuggagagaaaccuuacgaauguauuaaaugug

SEQ ID NO: 477200 - RNA, 64 nt, hsa
ucgaaucuuacugcccaucaaagaguacauaauggagagaaacccaauagugugguaagugugg

SEQ ID NO: 477201 - RNA, 64 nt, hsa
gaaaaucucauuacacaucagaaaauucacacuggagagaaaccuuaugaaugcagugaaugug

SEQ ID NO: 477202 - RNA, 64 nt, hsa
ucaaaccucacugaacaugagaaaauucauacuggagagaaaccuuaucauuguaaucaaugug

SEQ ID NO: 477203 - RNA, 64 nt, hsa
caaaaucuucuugagcaugaaaaaauucauacuggagagaaaccauucaaauguaaugaaugug

SEQ ID NO: 477204 - RNA, 64 nt, hsa
cugcgggacagagugagacccugucugaaagaaagagagaaagaaagaaagaaagagagagaaa

SEQ ID NO: 477205 - RNA, 64 nt, hsa
gucugaaagaaagagagaaagaaagaaagaaagagagagaaagaaagaaagaaagaaagggaaa

SEQ ID NO: 477206 - RNA, 64 nt, hsa
aggaaggaaggaaaaagaaagagaaagagagagagagagaaagaaaaagaaagaaaaguaagaa

SEQ ID NO: 477207 - RNA, 61 nt, hsa; identical to SEQ ID NO: 216570

SEQ ID NO: 477208 - RNA, 64 nt, hsa
ucacgccuuaaaagacauaggagaauucauacuggagagaaaccuuacaaguguaaugagugug

SEQ ID NO: 477209 - RNA, 64 nt, hsa
ucauaccuugcaguucaucagugaacucauacuggagagaaaccuuacaaaugucaugacugug

SEQ ID NO: 477210 - RNA, 64 nt, hsa
ucauccuaugcaaaacauaggagaauucaugcaggagagaaaugucacaagugugaugaguguu

SEQ ID NO: 477211 - RNA, 64 nt, hsa
ucacaccucauuagacaucagagaaucccuacuggagagaaaucuuacaaaugucaucagugug

SEQ ID NO: 477212 - RNA, 64 nt, hsa
uuuccuuggagcacugagcaccauuuggaagcuugagagaaaccaaaauuaaagagagaaagag

SEQ ID NO: 477213 - RNA, 64 nt, hsa
accauuuggaagcuugagagaaaccaaaauuaaagagagaaagagagagcgugcacgcuccugc

SEQ ID NO: 477214 - RNA, 64 nt, hsa
uucacaccccagugucacagggcgagcuguucuggagagaaaaccaucugucguggcugagcgg

SEQ ID NO: 477215 - RNA, 64 nt, hsa
cccagggucuggugauggcagggauggggggagagagagaaaauccacaaauuccaaugucaca

SEQ ID NO: 477216 - RNA, 64 nt, hsa
gaaaacagaaacccgagaaagagagagacagagagagagaaaaaaaaucacccaccaccccccc

SEQ ID NO: 477217 - RNA, 64 nt, hsa
acaaaccuuaauguguguaugugaacucacauuggagagaaacccugcaauuuaaaugguaugg

SEQ ID NO: 477218 - RNA, 64 nt, hsa
ucaagccuuaccaaacacaucagaaaucucacuggagagaaacuguaugaauguagagaaucug

SEQ ID NO: 477219 - RNA, 64 nt, hsa
gccaacuugagaaauaaagggacagaguacaaaagagagaaauuuuaaagcuggguguccgggg

SEQ ID NO: 477220 - RNA, 64 nt, hsa
cuguauuccucaccccaccugugaacuccuaccagagagaaaccuuuuguauguaaagaauuug

SEQ ID NO: 477221 - RNA, 64 nt, hsa
acaggcuuucgagugcacaugagaaugcacacuggagagaaaccuuauaaauguaaggauugug

SEQ ID NO: 477222 - RNA, 64 nt, hsa
aguuauauucauauacaugaacgaauucauacuggagagaaacccuaugaauguaaagaaugug

SEQ ID NO: 477223 - RNA, 64 nt, hsa
gcagguuuccagauacaugaaagaacccacacuggagagaaaccuuaugaauguaaacagugug

SEQ ID NO: 477224 - RNA, 64 nt, hsa
uacucagcucaaagacaugaaaggacucauacuggagagaaacccuacaaauguaaggaaugug

SEQ ID NO: 477225 - RNA, 64 nt, hsa
aacucugcucaaagacaugaaaagacucauacuggagagaaacccuacaaaugcaaggaaugug

SEQ ID NO: 477226 - RNA, 64 nt, hsa
caaucugcucaaaaacaugaaaaggcucauacuggagagaaacccuacaaauguaaggaaugug

SEQ ID NO: 477227 - RNA, 64 nt, hsa
acuugccuucuacaacaugaaagaauucacacucgagagaaaccuuaugaagguaaacaaugug

SEQ ID NO: 477228 - RNA, 64 nt, hsa
aguucuugucuaagacaugaaaaaacucacacuggagagaaacucuguacauguaaacaaugug

SEQ ID NO: 477229 - RNA, 64 nt, hsa
aguuuauuucguaugcaugaaagaacucacucuggagagaaacuauaugaauguaagcaguguu

SEQ ID NO: 477230 - RNA, 64 nt, hsa
guaaucuuuuaaagacaccugagaauauauacuggagagaaacuauaaagaaaauucuauaucc

SEQ ID NO: 477231 - RNA, 64 nt, hsa
aguuccuuuuggauguaugagaguacuuacgcuggagagaaauucaaggaauguaaacggugug

SEQ ID NO: 477232 - RNA, 64 nt, hsa
cuaaaucuuacuaaacauaaaaaaacuuaaacuggagagaaacuacaaagcuggaagacaucac

SEQ ID NO: 477233 - RNA, 64 nt, hsa
uuaauccuuaugaaacaaaagauaauucauacuagagagaaacccuacaaauguaaagaaugug

SEQ ID NO: 477234 - RNA, 64 nt, hsa
caacuuuuauuaaaacacaagauaauucauacuggagagaaauccuacaaaugugauaaaugug

SEQ ID NO: 477235 - RNA, 64 nt, hsa
uuaaggcuuacuacauauaagacaacucauacuggagagaaaccaugcaugugugaagaaugug

SEQ ID NO: 477236 - RNA, 64 nt, hsa
ucaaaccuuguggaacauaagagaauucauacuggagagaaacccuacaaaugcgaagaaugug

SEQ ID NO: 477237 - RNA, 64 nt, hsa
ucaaucuuuauuacacauaagaaaauucaugcuggagagaaacacuacaaacgugaagaaugug

SEQ ID NO: 477238 - RNA, 64 nt, hsa
ucucagucuaguaaacauaagaaaauucauacuggagagaaaaucuacaaaggugaagaaugug

SEQ ID NO: 477239 - RNA, 64 nt, hsa
ucauccuaugcaaaacauaggagaauuuauacaggagagaaaccucacaagugugaugauugug

SEQ ID NO: 477240 - RNA, 64 nt, hsa
ucacauauugcaggucaucggugaacucauacuggagagaaaccuuacaaaugucaugacugug

SEQ ID NO: 477241 - RNA, 64 nt, hsa
ucacaccuggaacaacauacuggacuucacacuggagagaaaccuuacaaguguaaugagugug

SEQ ID NO: 477242 - RNA, 64 nt, hsa
aucacaccuuaaagacauaggagaauuuauacuggagagaaagcuuacaaauguaagguuucug

SEQ ID NO: 477243 - RNA, 64 nt, hsa
ucauccuaugcaaaacauaggagaauucauacaggagagaaaccucacaugugugaugauugug

SEQ ID NO: 477244 - RNA, 64 nt, hsa
ucauacauugcaguucauugacacacucauacuggagagaaaccuuacaaaugucaugacugug

SEQ ID NO: 477245 - RNA, 64 nt, hsa
ucauccuaugcaaaacauaggaggauucauacaggagagaaacucacaagugugaugauugugg

SEQ ID NO: 477246 - RNA, 64 nt, hsa
ucauauauugcuauucaucaucgaacucaugcuggagagaaaccuuauaaaugucaugauugug

SEQ ID NO: 477247 - RNA, 64 nt, hsa
ucacaccuggcacaccauacuagaauucacacuggagagaaaccuuacaagugcaaugagugug

SEQ ID NO: 477248 - RNA, 64 nt, hsa
ucauaccuuguaauucaaaaggcaauucguauuggagagaaacccuacaaguguaaugaaugug

SEQ ID NO: 477249 - RNA, 64 nt, hsa
ucauaccuggcaaaacauauuagaauucaaacuggagagaaaccuuacaaaugugaugagugug

SEQ ID NO: 477250 - RNA, 64 nt, hsa
ucaacccuuguaagucacaaagccauucauacuggagagaaacuuuacaaguguaaugaaugug

SEQ ID NO: 477251 - RNA, 64 nt, hsa
ucaaaccuuguauaccaucauagacuucauaguggagagaaaccuuaaaaguguaaugagugug

SEQ ID NO: 477252 - RNA, 64 nt, hsa
ucauccuaugcaaaacauaggaggauucauacaggagagaaaccucacaagugugaugauugug

SEQ ID NO: 477253 - RNA, 64 nt, hsa
ucaugccuugcauuucacuggugaacucaugcuggagagaaaccuuauaaaugucaugauugag

SEQ ID NO: 477254 - RNA, 64 nt, hsa
ucacacguggcaccccauacuagaauucacacuggagagaaaccuuacaagugcaaugagugug

SEQ ID NO: 477255 - RNA, 64 nt, hsa
aaaggucaaaauucacaccuuguaauucauaguggagagaaaccuuacaagcacaaugaaugug

SEQ ID NO: 477256 - RNA, 64 nt, hsa
gcauaucuggcaaaacauacuagaauucacacuggagagaaacucauuauaaguguaaugagug

SEQ ID NO: 477257 - RNA, 64 nt, hsa
gcaaccuuugcacaucaccauagacuucauacuggagagaaaccuuacaaaugggaggaaugug

SEQ ID NO: 477258 - RNA, 64 nt, hsa
uucaacccuguaagucauaaggcaauucauacuggagagaaaccuuacaagcauaaugaaugug

SEQ ID NO: 477259 - RNA, 64 nt, hsa
uuuuguuuuuuaaacaaaugaugcugagaauaaggagagaaaugaauguagagagagguagaga

SEQ ID NO: 477260 - RNA, 64 nt, hsa
aauaaggagagaaaugaauguagagagagguagagagagaaauaugaacucuaacaaaggacug

SEQ ID NO: 477261 - RNA, 64 nt, hsa
agaagagaccugccagaagauuaaaaaaaagaaugagagaaaagcccaguuaguggugugcaaa

SEQ ID NO: 477262 - RNA, 64 nt, hsa
cucccucuuagaaucucuuaugaaaaaaugaucagagagaaaagugggguuuuguuuccccacc

SEQ ID NO: 477263 - RNA, 64 nt, hsa
ucacucugagcgagucucuagagggugagaauuugagagaaauaguaauuugauuauuucauuc

SEQ ID NO: 477264 - RNA, 64 nt, hsa
gaaacuuucuuuuacaaaagaauauuacauauuugagagaaaauauuucuauuaaugguuuaau

SEQ ID NO: 477265 - RNA, 64 nt, hsa
aauugucaagugaggacuucaucacauaugacacgagagaaaaguaagagcugguucuaaaauc

SEQ ID NO: 477266 - RNA, 64 nt, hsa
aagcaauccagaggugccuucagggcaaagaauagagagaaagggagccgcugugcuggugggg

SEQ ID NO: 477267 - RNA, 64 nt, hsa
ugcaugauuggcauuaguuaccacagccugcccagagagaaacuaucuucucccaacauuuacu

SEQ ID NO: 477268 - RNA, 64 nt, hsa
aaaauguuacaaccgcuguaaaaugacggagagagagagaaagaaucccagacauuaacgguau

SEQ ID NO: 477269 - RNA, 64 nt, hsa; identical to SEQ ID NO: 225847

SEQ ID NO: 477270 - RNA, 64 nt, hsa; identical to SEQ ID NO: 225848

SEQ ID NO: 477271 - RNA, 64 nt, hsa; identical to SEQ ID NO: 225849

SEQ ID NO: 477272 - RNA, 64 nt, hsa; identical to SEQ ID NO: 225850

SEQ ID NO: 477273 - RNA, 64 nt, hsa; identical to SEQ ID NO: 225851

SEQ ID NO: 477274 - RNA, 64 nt, hsa; identical to SEQ ID NO: 225852

SEQ ID NO: 477275 - RNA, 64 nt, hsa; identical to SEQ ID NO: 225853

SEQ ID NO: 477276 - RNA, 64 nt, hsa; identical to SEQ ID NO: 225854

SEQ ID NO: 477277 - RNA, 64 nt, hsa; identical to SEQ ID NO: 225855

SEQ ID NO: 477278 - RNA, 64 nt, hsa; identical to SEQ ID NO: 225856

SEQ ID NO: 477279 - RNA, 64 nt, hsa; identical to SEQ ID NO: 225857

SEQ ID NO: 477280 - RNA, 64 nt, hsa; identical to SEQ ID NO: 225858

SEQ ID NO: 477281 - RNA, 64 nt, hsa; identical to SEQ ID NO: 225859

SEQ ID NO: 477282 - RNA, 64 nt, hsa; identical to SEQ ID NO: 225860

SEQ ID NO: 477283 - RNA, 64 nt, hsa; identical to SEQ ID NO: 221951

SEQ ID NO: 477284 - RNA, 64 nt, hsa; identical to SEQ ID NO: 221952

SEQ ID NO: 477285 - RNA, 64 nt, hsa; identical to SEQ ID NO: 221953

SEQ ID NO: 477286 - RNA, 64 nt, hsa; identical to SEQ ID NO: 221954

SEQ ID NO: 477287 - RNA, 64 nt, hsa; identical to SEQ ID NO: 221955

SEQ ID NO: 477288 - RNA, 64 nt, hsa; identical to SEQ ID NO: 221956

SEQ ID NO: 477289 - RNA, 64 nt, hsa; identical to SEQ ID NO: 221957

SEQ ID NO: 477290 - RNA, 64 nt, hsa; identical to SEQ ID NO: 221958

SEQ ID NO: 477291 - RNA, 64 nt, hsa; identical to SEQ ID NO: 221959

SEQ ID NO: 477292 - RNA, 64 nt, hsa; identical to SEQ ID NO: 221960

SEQ ID NO: 477293 - RNA, 64 nt, hsa; identical to SEQ ID NO: 221961

SEQ ID NO: 477294 - RNA, 64 nt, hsa; identical to SEQ ID NO: 221962

SEQ ID NO: 477295 - RNA, 64 nt, hsa; identical to SEQ ID NO: 221963

SEQ ID NO: 477296 - RNA, 64 nt, hsa; identical to SEQ ID NO: 221964

SEQ ID NO: 477297 - RNA, 64 nt, hsa; identical to SEQ ID NO: 221965

SEQ ID NO: 477298 - RNA, 64 nt, hsa; identical to SEQ ID NO: 221966

SEQ ID NO: 477299 - RNA, 64 nt, hsa; identical to SEQ ID NO: 221967

SEQ ID NO: 477300 - RNA, 64 nt, hsa; identical to SEQ ID NO: 221968

SEQ ID NO: 477301 - RNA, 64 nt, hsa; identical to SEQ ID NO: 221969

SEQ ID NO: 477302 - RNA, 64 nt, hsa; identical to SEQ ID NO: 221970

SEQ ID NO: 477303 - RNA, 64 nt, hsa; identical to SEQ ID NO: 221971

SEQ ID NO: 477304 - RNA, 64 nt, hsa; identical to SEQ ID NO: 221972

SEQ ID NO: 477305 - RNA, 64 nt, hsa; identical to SEQ ID NO: 221973

SEQ ID NO: 477306 - RNA, 64 nt, hsa; identical to SEQ ID NO: 221974

SEQ ID NO: 477307 - RNA, 64 nt, hsa; identical to SEQ ID NO: 221975

SEQ ID NO: 477308 - RNA, 64 nt, hsa; identical to SEQ ID NO: 221976

SEQ ID NO: 477309 - RNA, 64 nt, hsa; identical to SEQ ID NO: 221977

SEQ ID NO: 477310 - RNA, 64 nt, hsa; identical to SEQ ID NO: 221978

SEQ ID NO: 477311 - RNA, 64 nt, hsa; identical to SEQ ID NO: 221979

SEQ ID NO: 477312 - RNA, 64 nt, hsa; identical to SEQ ID NO: 221980

SEQ ID NO: 477313 - RNA, 64 nt, hsa; identical to SEQ ID NO: 221981

SEQ ID NO: 477314 - RNA, 64 nt, hsa; identical to SEQ ID NO: 221982

SEQ ID NO: 477315 - RNA, 64 nt, hsa; identical to SEQ ID NO: 221983

SEQ ID NO: 477316 - RNA, 64 nt, hsa; identical to SEQ ID NO: 221984

SEQ ID NO: 477317 - RNA, 64 nt, hsa; identical to SEQ ID NO: 221985

SEQ ID NO: 477318 - RNA, 64 nt, hsa; identical to SEQ ID NO: 221986

SEQ ID NO: 477319 - RNA, 64 nt, hsa; identical to SEQ ID NO: 221987

SEQ ID NO: 477320 - RNA, 64 nt, hsa; identical to SEQ ID NO: 221988

SEQ ID NO: 477321 - RNA, 64 nt, hsa; identical to SEQ ID NO: 221989

SEQ ID NO: 477322 - RNA, 64 nt, hsa; identical to SEQ ID NO: 221990

SEQ ID NO: 477323 - RNA, 64 nt, hsa; identical to SEQ ID NO: 221991

SEQ ID NO: 477324 - RNA, 64 nt, hsa; identical to SEQ ID NO: 221992

SEQ ID NO: 477325 - RNA, 64 nt, hsa; identical to SEQ ID NO: 221993

SEQ ID NO: 477326 - RNA, 64 nt, hsa; identical to SEQ ID NO: 221994

SEQ ID NO: 477327 - RNA, 64 nt, hsa; identical to SEQ ID NO: 221995

SEQ ID NO: 477328 - RNA, 64 nt, hsa; identical to SEQ ID NO: 221996

SEQ ID NO: 477329 - RNA, 64 nt, hsa; identical to SEQ ID NO: 221997

SEQ ID NO: 477330 - RNA, 64 nt, hsa; identical to SEQ ID NO: 221998

SEQ ID NO: 477331 - RNA, 64 nt, hsa; identical to SEQ ID NO: 221999

SEQ ID NO: 477332 - RNA, 64 nt, hsa; identical to SEQ ID NO: 222000

SEQ ID NO: 477333 - RNA, 64 nt, hsa; identical to SEQ ID NO: 222001

SEQ ID NO: 477334 - RNA, 64 nt, hsa; identical to SEQ ID NO: 222002

SEQ ID NO: 477335 - RNA, 64 nt, hsa; identical to SEQ ID NO: 222003

SEQ ID NO: 477336 - RNA, 64 nt, hsa; identical to SEQ ID NO: 222004

SEQ ID NO: 477337 - RNA, 64 nt, hsa; identical to SEQ ID NO: 222005

SEQ ID NO: 477338 - RNA, 64 nt, hsa; identical to SEQ ID NO: 222006

SEQ ID NO: 477339 - RNA, 64 nt, hsa; identical to SEQ ID NO: 222007

SEQ ID NO: 477340 - RNA, 64 nt, hsa
uuaaaaacucagguuagaacaaaaaugucauaaagggcacuaaaaguaacauuuggguuucacu

SEQ ID NO: 477341 - RNA, 64 nt, hsa
gagacagaagugcuggcuaggaggucucagccucgggcacuacaauguuuaucuuuuucuuuuu

SEQ ID NO: 477342 - RNA, 64 nt, hsa
cguuucuccugagcccuggggucaccucagggacagcguccaggcuucagccaagggcucccug

SEQ ID NO: 477343 - RNA, 64 nt, hsa
cccucgucugggcaccucagcaucuguggacuugagcguccaaaaacccugagugugauucugg

SEQ ID NO: 477344 - RNA, 64 nt, hsa
ggcagugaaucgaagcccaaggaugagcuaugacagcguccaggucagacggaugggugacuag

SEQ ID NO: 477345 - RNA, 64 nt, hsa
accagaaaccaccaggcacacggggcagaaagccagcguccaugccccagcagcccccuccugc

SEQ ID NO: 477346 - RNA, 64 nt, hsa
gucgguguggagauccaaaguggguuguggaaagagcguccauaggagaagugagaauacugug

SEQ ID NO: 477347 - RNA, 64 nt, hsa
cuuucccaucuccccuggggagccugaggagcccagcguccacucuucaugccuugggccgagc

SEQ ID NO: 477348 - RNA, 64 nt, hsa
aguacacuggagugccgagcccugccuuccacccagcguccauccagccccuguccucaccucu

SEQ ID NO: 477349 - RNA, 64 nt, hsa
uugaaaauuuuuauauaccaaugagcuuuuugguagcguccacaauguuuaaaauauuucauag

SEQ ID NO: 477350 - RNA, 64 nt, hsa
uucggcuuuugcuuugcguuagggugaagacccuagcguccagcuccccucaacgcuauauuuu

SEQ ID NO: 477351 - RNA, 64 nt, hsa
ucuuugaagacacacucggcucuucuccacagcaagcguccagggcagauggcagaggaucugc

SEQ ID NO: 477352 - RNA, 64 nt, hsa
cccuuguccuccuucaaauaaaugcuuugugcgcagcguccaguuugcccaccuuguucaacuc

SEQ ID NO: 477353 - RNA, 64 nt, hsa
gagaagagguuccaaauugggcuucugugcccagagcguccacagcaccauucccaguguagac

SEQ ID NO: 477354 - RNA, 64 nt, hsa
auguacuguuuggauguagcauagucuugagucuagcguccacaaagaauuauucaaaugauau

SEQ ID NO: 477355 - RNA, 64 nt, hsa
cugcagccugcugugcugagcccugcugcaguccagcguccagauggaugcacguucacuacug

SEQ ID NO: 477356 - RNA, 64 nt, hsa
acggucuucugcaucacugguauacacacucguuagcguccauuucuuauuuaauuagaaugga

SEQ ID NO: 477357 - RNA, 64 nt, hsa
uuuacuugcuggaugauaccauaauguaucaaggagcguccauggauacaagauaagaugugua

SEQ ID NO: 477358 - RNA, 64 nt, hsa
ggaucuguuucuuugccugagauccuuccugaggagcguccauuccucuggagucucuccuugu

SEQ ID NO: 477359 - RNA, 64 nt, hsa
gauagaggaaaagacacacauaaacucgcuucugagcguccacuucugcacucucugcucugcu

SEQ ID NO: 477360 - RNA, 64 nt, hsa
gugauuuucauuguaaauauuugacuuuagugaaagcguccaauugacugcccucuuacuguuu

SEQ ID NO: 477361 - RNA, 64 nt, hsa
cccuggggacaaagcagcgucuggcucgaguggaagcguccaaaccugcuuuucccaucucccc

SEQ ID NO: 477362 - RNA, 64 nt, hsa
cagaaaggcauuuccaccaccguccccacucauuagcguccagagugccuuucucucucggcuu

SEQ ID NO: 477363 - RNA, 64 nt, hsa
guauaaccccuuccacuaucucacagauagucacagcguccauuccauagucugucuccucaca

SEQ ID NO: 477364 - RNA, 64 nt, hsa
acaggagguaucaaacuagcugcuaugugcaaacagcguccauuuuuucauauuagagguggaa

SEQ ID NO: 477365 - RNA, 64 nt, hsa
acgauaaggcaguaaacauggagacacgggggacagcguccacacucagagggccugggccaca

SEQ ID NO: 477366 - RNA, 64 nt, hsa
ggcaaaauggcuagaauuauucagacgauuuggcagcguccaggguaagcugguguuauaauac

SEQ ID NO: 477367 - RNA, 64 nt, hsa
cgguugccccccacucuaaagccuccucccucccagcguccacuggcuccaggcuccucacaac

SEQ ID NO: 477368 - RNA, 64 nt, hsa
cuccucccagcuguaccggccacugcaacccaugagcguccaggugaucccccaaacagcaugu

SEQ ID NO: 477369 - RNA, 64 nt, hsa
cuucauuggcuauaaacuuuauuuguuuuauuuuagcguccauuguacaucguuuuaaaugaaa

SEQ ID NO: 477370 - RNA, 64 nt, hsa
ccaaaggucagugacaguuucucagaagaggcccagcguccaccucucucccagggccagacag

SEQ ID NO: 477371 - RNA, 64 nt, hsa
auaaaauccauuuaacugguguucuuaaaaucagagcguccagaggaaauucuuccuaaaacua

SEQ ID NO: 477372 - RNA, 64 nt, hsa
gcagcggaggccaggucugucccggcuggagaacagcguccacgcaguccugccuggggucagg

SEQ ID NO: 477373 - RNA, 64 nt, hsa
gcucagaacguuccaggccuuggugagacacagcagcguccaaugcucacaggcuguccccacu

SEQ ID NO: 477374 - RNA, 64 nt, hsa
gaggaggaaguggaggccgcugcguagacccaacagcguccaguuccuacuaacucugagcuga

SEQ ID NO: 477375 - RNA, 64 nt, hsa
gugcugggccagagaggacggcguggcgaaagucagcguccacugcagcacaggaucagauggc

SEQ ID NO: 477376 - RNA, 64 nt, hsa
gugaagccuucuggaggagaaggugacguggcccagcguccaagggacagacucagcuccaggc

SEQ ID NO: 477377 - RNA, 64 nt, hsa
uauuuuucuuuucuuuuuuuaaugaaucaauagcagcguccagucccccagggcugcuuccugc

SEQ ID NO: 477378 - RNA, 64 nt, hsa
ccuuuuaccauguggguuucuuuagugucuuaaaagcguccauaagccaccauucuguggaacc

SEQ ID NO: 477379 - RNA, 64 nt, hsa
cuuuacaaccauggccucuaguauacuuaaaauaagcguccaguuauaaaaagccuauuugcac

SEQ ID NO: 477380 - RNA, 64 nt, hsa
cuuccucaccaucccauuaaagaccgggcugguuagcguccagcucagggagaagggcgcuagu

SEQ ID NO: 477381 - RNA, 64 nt, hsa
aggcacaucagucccaaaauucaucacuuaacccagcguccaggagggucaggccuguacccca

SEQ ID NO: 477382 - RNA, 64 nt, hsa
uuaguuguaucucugugaaaaacuuguauacacaagcguccaugucucacacaaauauugaugu

SEQ ID NO: 477383 - RNA, 64 nt, hsa
gaaaauggucuuaauggugcucacuuuagcagacagcguccacaaugugaauccuacaguuucc

SEQ ID NO: 477384 - RNA, 64 nt, hsa
cccaguugacagucaguggaaugcucgucuccuuagcguccaggguggggauucugcuggaaua

SEQ ID NO: 477385 - RNA, 64 nt, hsa
acaagucucuuacacuggacgcccacugcuccucagcguccaguccuccugggcggccccaggu

SEQ ID NO: 477386 - RNA, 64 nt, hsa
ugugguggagaugacugaagcccgacacggccugagcguccagaaauggugcucaccaugcuuc

SEQ ID NO: 477387 - RNA, 64 nt, hsa
uguuaguuauuacguucaccuggaacuaaagaagagcguccaggugggacugggauaauuguuc

SEQ ID NO: 477388 - RNA, 64 nt, hsa
ccccaggcccgggcgcaggaccgcuggaggacgcagcguccagggccagcgagcucccccggca

SEQ ID NO: 477389 - RNA, 64 nt, hsa
cagcuucuucuucgagucggagagcuacaaggacagcguccaggguagggugagagggggacca

SEQ ID NO: 477390 - RNA, 64 nt, hsa
cugaugccaacugcagauaauacacaccuccugcagcguccagccacggcuccagggcacugcu

SEQ ID NO: 477391 - RNA, 64 nt, hsa
ccauagggcuggcucacauccagucacucccaacagcguccagcacacaaauaaaagacccuug

SEQ ID NO: 477392 - RNA, 64 nt, hsa
gaagcugcugacugugauuaggugcuggggucuuagcguccagcgcagcccgggggcauccugg

SEQ ID NO: 477393 - RNA, 64 nt, hsa
ucaggugaugagcugagaaagauguucacgucuaagcguccagugugcacccagcgcuccauag

SEQ ID NO: 477394 - RNA, 64 nt, hsa
aggcugugucucugccuugucuuuagaggacuucagcguccaagacuggggcccacccuucuca

SEQ ID NO: 477395 - RNA, 64 nt, hsa
caagaucuacauuucaacccugccuuacacccagagcguccagaucugccacauagaaggucag

SEQ ID NO: 477396 - RNA, 64 nt, hsa
gacaguggcugagcacguggaagccauugagggcagcguccaggagagcucgggcccugugacc

SEQ ID NO: 477397 - RNA, 64 nt, hsa
aacugggcccugagcugugagagaccagcacagcagcguccagguuaaaagccgcugaccaaag

SEQ ID NO: 477398 - RNA, 64 nt, hsa
cccacuugguccuaagaaucccaaggucuuugggagcguccagcauguuaauuagcguaucauu

SEQ ID NO: 477399 - RNA, 64 nt, hsa
cugaacggagccaggaggccacgugucccagcccagcguccaguggugccucucaagaaacccc

SEQ ID NO: 477400 - RNA, 64 nt, hsa
ugacauuaaggaaaguucugcuguuuuuagcaaaagcguccagaaaggagagcuuagcaggagu

SEQ ID NO: 477401 - RNA, 64 nt, hsa
aaccugauucaggguuagcagcaaugaguaucacagcguccaacucaguagcuccaguguauga

SEQ ID NO: 477402 - RNA, 64 nt, hsa
uuaguuauucuaaaauagaaaguuugcuggagaaagcguccacucacagauuguucuguaagga

SEQ ID NO: 477403 - RNA, 64 nt, hsa
cggguggagacuuugggauggacuggaggaggccagcguccagcuggcggugcucccgggaugu

SEQ ID NO: 477404 - RNA, 64 nt, hsa
guggugugacggcucacugcagccugcgccucccagcguccagcaauucuuguuucucggccuc

SEQ ID NO: 477405 - RNA, 64 nt, hsa
uauccacccgcccacccgcccccaccccaccggcagcguccaggugcggggccgggaaccacac

SEQ ID NO: 477406 - RNA, 64 nt, hsa
gcuggacagaaagugauccuuagcccagugugucagcguccauuguuacucaucacugcauugu

SEQ ID NO: 477407 - RNA, 64 nt, hsa
aauauuucacauccauccagagcucggaaucuacagcguccagccauuuccagcaagagcgcuu

SEQ ID NO: 477408 - RNA, 64 nt, hsa
cuggagcagcaccucagaguggacagaaagcauuagcguccacgagcucacccgacgccgagcc

SEQ ID NO: 477409 - RNA, 64 nt, hsa
cacggacaaugccuggaucgagacgguggccgucagcguccacuuccaggaccagaaugacgug

SEQ ID NO: 477410 - RNA, 64 nt, hsa
cccagguguccacacaccuguaggccucugagccagcguccaggguacaggugcgggugguggg

SEQ ID NO: 477411 - RNA, 64 nt, hsa
aucccaguccugagggacucagcacaacaggauaagcguccaggagccacgggcucccaccccg

SEQ ID NO: 477412 - RNA, 64 nt, hsa
aguuauucuccccuaugccuuccuucucuuucuaagcguccacuaggucuggccuuggaaaccu

SEQ ID NO: 477413 - RNA, 64 nt, hsa
cuuuuuuugcaaaugccacucgacugccuucauaagcguccauaggauaucugaggaacauuca

SEQ ID NO: 477414 - RNA, 64 nt, hsa
aaaaaaaaaauagccgugcacucuugaccccgucagcguccaacguggaaaaggcguuaccucu

SEQ ID NO: 477415 - RNA, 64 nt, hsa
gcccaguuauucuccccuaugccuucucuuccuaagcguccacuaggucuggccuuggaaaucu

SEQ ID NO: 477416 - RNA, 64 nt, hsa
acacggccgcaccugccccaaagcgggccgcccgagcguccacuccaagccugagcauccacac

SEQ ID NO: 477417 - RNA, 64 nt, hsa; identical to SEQ ID NO: 477342

SEQ ID NO: 477418 - RNA, 64 nt, hsa; identical to SEQ ID NO: 477343

SEQ ID NO: 477419 - RNA, 64 nt, hsa; identical to SEQ ID NO: 477344

SEQ ID NO: 477420 - RNA, 64 nt, hsa; identical to SEQ ID NO: 477345

SEQ ID NO: 477421 - RNA, 64 nt, hsa; identical to SEQ ID NO: 477346

SEQ ID NO: 477422 - RNA, 64 nt, hsa; identical to SEQ ID NO: 477347

SEQ ID NO: 477423 - RNA, 64 nt, hsa; identical to SEQ ID NO: 477348

SEQ ID NO: 477424 - RNA, 64 nt, hsa; identical to SEQ ID NO: 477349

SEQ ID NO: 477425 - RNA, 64 nt, hsa; identical to SEQ ID NO: 477350

SEQ ID NO: 477426 - RNA, 64 nt, hsa; identical to SEQ ID NO: 477351

SEQ ID NO: 477427 - RNA, 64 nt, hsa; identical to SEQ ID NO: 477352

SEQ ID NO: 477428 - RNA, 64 nt, hsa; identical to SEQ ID NO: 477353

SEQ ID NO: 477429 - RNA, 64 nt, hsa; identical to SEQ ID NO: 477354

SEQ ID NO: 477430 - RNA, 64 nt, hsa; identical to SEQ ID NO: 477355

SEQ ID NO: 477431 - RNA, 64 nt, hsa; identical to SEQ ID NO: 477356

SEQ ID NO: 477432 - RNA, 64 nt, hsa; identical to SEQ ID NO: 477357

SEQ ID NO: 477433 - RNA, 64 nt, hsa; identical to SEQ ID NO: 477358

SEQ ID NO: 477434 - RNA, 64 nt, hsa; identical to SEQ ID NO: 477359

SEQ ID NO: 477435 - RNA, 64 nt, hsa; identical to SEQ ID NO: 477360

SEQ ID NO: 477436 - RNA, 64 nt, hsa; identical to SEQ ID NO: 477361

SEQ ID NO: 477437 - RNA, 64 nt, hsa; identical to SEQ ID NO: 477362

SEQ ID NO: 477438 - RNA, 64 nt, hsa; identical to SEQ ID NO: 477363

SEQ ID NO: 477439 - RNA, 64 nt, hsa; identical to SEQ ID NO: 477364

SEQ ID NO: 477440 - RNA, 64 nt, hsa; identical to SEQ ID NO: 477365

SEQ ID NO: 477441 - RNA, 64 nt, hsa; identical to SEQ ID NO: 477366

SEQ ID NO: 477442 - RNA, 64 nt, hsa; identical to SEQ ID NO: 477367

SEQ ID NO: 477443 - RNA, 64 nt, hsa; identical to SEQ ID NO: 477368

SEQ ID NO: 477444 - RNA, 64 nt, hsa; identical to SEQ ID NO: 477369

SEQ ID NO: 477445 - RNA, 64 nt, hsa; identical to SEQ ID NO: 477370

SEQ ID NO: 477446 - RNA, 64 nt, hsa; identical to SEQ ID NO: 477371

SEQ ID NO: 477447 - RNA, 64 nt, hsa; identical to SEQ ID NO: 477372

SEQ ID NO: 477448 - RNA, 64 nt, hsa; identical to SEQ ID NO: 477373

SEQ ID NO: 477449 - RNA, 64 nt, hsa; identical to SEQ ID NO: 477374

SEQ ID NO: 477450 - RNA, 64 nt, hsa; identical to SEQ ID NO: 477375

SEQ ID NO: 477451 - RNA, 64 nt, hsa; identical to SEQ ID NO: 477376

SEQ ID NO: 477452 - RNA, 64 nt, hsa; identical to SEQ ID NO: 477377

SEQ ID NO: 477453 - RNA, 64 nt, hsa; identical to SEQ ID NO: 477378

SEQ ID NO: 477454 - RNA, 64 nt, hsa; identical to SEQ ID NO: 477379

SEQ ID NO: 477455 - RNA, 64 nt, hsa; identical to SEQ ID NO: 477380

SEQ ID NO: 477456 - RNA, 64 nt, hsa; identical to SEQ ID NO: 477381

SEQ ID NO: 477457 - RNA, 64 nt, hsa; identical to SEQ ID NO: 477382

SEQ ID NO: 477458 - RNA, 64 nt, hsa; identical to SEQ ID NO: 477383

SEQ ID NO: 477459 - RNA, 64 nt, hsa; identical to SEQ ID NO: 477384

SEQ ID NO: 477460 - RNA, 64 nt, hsa; identical to SEQ ID NO: 477385

SEQ ID NO: 477461 - RNA, 64 nt, hsa; identical to SEQ ID NO: 477386

SEQ ID NO: 477462 - RNA, 64 nt, hsa; identical to SEQ ID NO: 477387

SEQ ID NO: 477463 - RNA, 64 nt, hsa; identical to SEQ ID NO: 477388

SEQ ID NO: 477464 - RNA, 64 nt, hsa; identical to SEQ ID NO: 477389

SEQ ID NO: 477465 - RNA, 64 nt, hsa; identical to SEQ ID NO: 477390

SEQ ID NO: 477466 - RNA, 64 nt, hsa; identical to SEQ ID NO: 477391

SEQ ID NO: 477467 - RNA, 64 nt, hsa; identical to SEQ ID NO: 477392

SEQ ID NO: 477468 - RNA, 64 nt, hsa; identical to SEQ ID NO: 477393

SEQ ID NO: 477469 - RNA, 64 nt, hsa; identical to SEQ ID NO: 477394

SEQ ID NO: 477470 - RNA, 64 nt, hsa; identical to SEQ ID NO: 477395

SEQ ID NO: 477471 - RNA, 64 nt, hsa; identical to SEQ ID NO: 477396

SEQ ID NO: 477472 - RNA, 64 nt, hsa; identical to SEQ ID NO: 477397

SEQ ID NO: 477473 - RNA, 64 nt, hsa; identical to SEQ ID NO: 477398

SEQ ID NO: 477474 - RNA, 64 nt, hsa; identical to SEQ ID NO: 477399

SEQ ID NO: 477475 - RNA, 64 nt, hsa; identical to SEQ ID NO: 477400

SEQ ID NO: 477476 - RNA, 64 nt, hsa; identical to SEQ ID NO: 477401

SEQ ID NO: 477477 - RNA, 64 nt, hsa; identical to SEQ ID NO: 477402

SEQ ID NO: 477478 - RNA, 64 nt, hsa; identical to SEQ ID NO: 477403

SEQ ID NO: 477479 - RNA, 64 nt, hsa; identical to SEQ ID NO: 477404

SEQ ID NO: 477480 - RNA, 64 nt, hsa; identical to SEQ ID NO: 477405

SEQ ID NO: 477481 - RNA, 64 nt, hsa; identical to SEQ ID NO: 477406

SEQ ID NO: 477482 - RNA, 64 nt, hsa; identical to SEQ ID NO: 477407

SEQ ID NO: 477483 - RNA, 64 nt, hsa; identical to SEQ ID NO: 477408

SEQ ID NO: 477484 - RNA, 64 nt, hsa; identical to SEQ ID NO: 477409

SEQ ID NO: 477485 - RNA, 64 nt, hsa; identical to SEQ ID NO: 477410

SEQ ID NO: 477486 - RNA, 64 nt, hsa; identical to SEQ ID NO: 477411

SEQ ID NO: 477487 - RNA, 64 nt, hsa; identical to SEQ ID NO: 477412

SEQ ID NO: 477488 - RNA, 64 nt, hsa; identical to SEQ ID NO: 477413

SEQ ID NO: 477489 - RNA, 64 nt, hsa; identical to SEQ ID NO: 477414

SEQ ID NO: 477490 - RNA, 64 nt, hsa; identical to SEQ ID NO: 477415

SEQ ID NO: 477491 - RNA, 64 nt, hsa; identical to SEQ ID NO: 477416

SEQ ID NO: 477492 - RNA, 64 nt, hsa
aggcuuggccaucuagcauuccauacaaaauuguuuccuauaagcauuccuuuuauucucuauu

SEQ ID NO: 477493 - RNA, 64 nt, hsa
acccuuucuuucucugggaucccugcccagcaccuuccuauagagaugacuuuaaaaggaaaaa

SEQ ID NO: 477494 - RNA, 64 nt, hsa
acagaauaauuuggugugcauucuuucagacuuuuuccuauacauuuuauauguagaaauguag

SEQ ID NO: 477495 - RNA, 64 nt, hsa
gaaauguagcaauguauuuguauagaugugaucauuccuauauuguuauugauuuuuuucacuu

SEQ ID NO: 477496 - RNA, 64 nt, hsa
uggggcccaugugguaguccccauaccccuccaguuccuauauuuuugucuucuuccuuucccc

SEQ ID NO: 477497 - RNA, 64 nt, hsa
ucacaaaugacuuguaaugucgugauuaaaaaaauuccuauauucuucugcaaaucaaacguuc

SEQ ID NO: 477498 - RNA, 64 nt, hsa
gaacgcuguaagcuguguacuguuauaagugugcuuccuauauuguugcauuuccuugauaaua

SEQ ID NO: 477499 - RNA, 64 nt, hsa
auuuugaucuagauauaaaauuaaaauuguccauuuccuauauaaauaccagcaagaucacucu

SEQ ID NO: 477500 - RNA, 64 nt, hsa
augaaccuuugaggccuguaaaguggauuguaauuuccuauaagcuguaauaguggagguauug

SEQ ID NO: 477501 - RNA, 64 nt, hsa
uaguuuuuuaauucauuuacuaaugcuauaaaauuuccuauauuaccccaguaauuugcaucag

SEQ ID NO: 477502 - RNA, 64 nt, hsa
acauuuggugguuuucuauuggguacuccccauuuuccuauauuuguguguauauguauguguu

SEQ ID NO: 477503 - RNA, 64 nt, hsa
ggucucaucaauuaaagcaccuuguggaaucuguuuccuauauuugaauauuagaugggaaaau

SEQ ID NO: 477504 - RNA, 64 nt, hsa
uuauacaguacacuucaguuaucuugaucucccuuuccuauaugaugauuugcuuaaauaucca

SEQ ID NO: 477505 - RNA, 64 nt, hsa
gggacuaugcuuuucucaaagccccauuaacugcuuccuauaauuuugauagugggaccacaua

SEQ ID NO: 477506 - RNA, 60 nt, hsa; identical to SEQ ID NO: 193746

SEQ ID NO: 477507 - RNA, 64 nt, hsa; identical to SEQ ID NO: 193747

SEQ ID NO: 477508 - RNA, 64 nt, hsa; identical to SEQ ID NO: 193748

SEQ ID NO: 477509 - RNA, 64 nt, hsa; identical to SEQ ID NO: 193749

SEQ ID NO: 477510 - RNA, 64 nt, hsa; identical to SEQ ID NO: 193750

SEQ ID NO: 477511 - RNA, 64 nt, hsa; identical to SEQ ID NO: 193751

SEQ ID NO: 477512 - RNA, 64 nt, hsa; identical to SEQ ID NO: 193752

SEQ ID NO: 477513 - RNA, 64 nt, hsa; identical to SEQ ID NO: 193753

SEQ ID NO: 477514 - RNA, 64 nt, hsa; identical to SEQ ID NO: 193754

SEQ ID NO: 477515 - RNA, 64 nt, hsa; identical to SEQ ID NO: 193755

SEQ ID NO: 477516 - RNA, 64 nt, hsa; identical to SEQ ID NO: 193756

SEQ ID NO: 477517 - RNA, 64 nt, hsa; identical to SEQ ID NO: 193757

SEQ ID NO: 477518 - RNA, 64 nt, hsa; identical to SEQ ID NO: 193758

SEQ ID NO: 477519 - RNA, 64 nt, hsa; identical to SEQ ID NO: 193759

SEQ ID NO: 477520 - RNA, 64 nt, hsa; identical to SEQ ID NO: 193760

SEQ ID NO: 477521 - RNA, 64 nt, hsa; identical to SEQ ID NO: 193761

SEQ ID NO: 477522 - RNA, 64 nt, hsa; identical to SEQ ID NO: 193762

SEQ ID NO: 477523 - RNA, 64 nt, hsa; identical to SEQ ID NO: 193763

SEQ ID NO: 477524 - RNA, 64 nt, hsa; identical to SEQ ID NO: 193764

SEQ ID NO: 477525 - RNA, 64 nt, hsa; identical to SEQ ID NO: 193764

SEQ ID NO: 477526 - RNA, 64 nt, hsa; identical to SEQ ID NO: 193766

SEQ ID NO: 477527 - RNA, 64 nt, hsa; identical to SEQ ID NO: 193767

SEQ ID NO: 477528 - RNA, 64 nt, hsa; identical to SEQ ID NO: 193768

SEQ ID NO: 477529 - RNA, 64 nt, hsa; identical to SEQ ID NO: 193769

SEQ ID NO: 477530 - RNA, 64 nt, hsa; identical to SEQ ID NO: 193770

SEQ ID NO: 477531 - RNA, 64 nt, hsa; identical to SEQ ID NO: 193771

SEQ ID NO: 477532 - RNA, 64 nt, hsa; identical to SEQ ID NO: 193772

SEQ ID NO: 477533 - RNA, 64 nt, hsa; identical to SEQ ID NO: 193773

SEQ ID NO: 477534 - RNA, 64 nt, hsa; identical to SEQ ID NO: 193774

SEQ ID NO: 477535 - RNA, 64 nt, hsa; identical to SEQ ID NO: 193775

SEQ ID NO: 477536 - RNA, 64 nt, hsa; identical to SEQ ID NO: 141798

SEQ ID NO: 477537 - RNA, 64 nt, hsa; identical to SEQ ID NO: 141799

SEQ ID NO: 477538 - RNA, 64 nt, hsa; identical to SEQ ID NO: 141800

SEQ ID NO: 477539 - RNA, 64 nt, hsa; identical to SEQ ID NO: 141801

SEQ ID NO: 477540 - RNA, 64 nt, hsa; identical to SEQ ID NO: 141802

SEQ ID NO: 477541 - RNA, 64 nt, hsa; identical to SEQ ID NO: 141803

SEQ ID NO: 477542 - RNA, 64 nt, hsa; identical to SEQ ID NO: 141804

SEQ ID NO: 477543 - RNA, 64 nt, hsa; identical to SEQ ID NO: 141805

SEQ ID NO: 477544 - RNA, 64 nt, hsa
guaacauucccaguuucagccacaauuuagccaagaauaagauaaaaacuugaauaagaaguaa

SEQ ID NO: 477545 - RNA, 64 nt, hsa
agccacaauuuagccaagaauaagauaaaaacuugaauaagaaguaaguagcauaaaucaguau

SEQ ID NO: 477546 - RNA, 64 nt, hsa
aagaauaagagugcaccagaauaagagcgcaccagaauaagagcgcaccagcuaacaaugugau

SEQ ID NO: 477547 - RNA, 64 nt, hsa
aucuucucuugaaaggaagaauaagagugcaccagaauaagagcgcaccagaauaagagcgcac

SEQ ID NO: 477548 - RNA, 64 nt, hsa
aucauugcauuuuaaaaucuucucuugaaaggaagaauaagagugcaccagaauaagagcgcac

SEQ ID NO: 477549 - RNA, 64 nt, hsa
cauuccuauugagaaccagcuaccuugugguagggaauaagaggucagacacaaauuaagacaa

SEQ ID NO: 477550 - RNA, 64 nt, hsa
cauggaguuuugcuaaggcacaagacaauaaucugaauaagacaauaugugaugaauauaagaa

SEQ ID NO: 477551 - RNA, 64 nt, hsa
cuuuggaaguacggcuaauagaagcccuagauccgaauaagauccgaauaagaauauguaaugg

SEQ ID NO: 477552 - RNA, 64 nt, hsa
cggcuaauagaagcccuagauccgaauaagauccgaauaagaauauguaauggaccaggcgcag

SEQ ID NO: 477553 - RNA, 64 nt, hsa
ccgauaagcagugaguguaaaauuguuguagcuugaauaagaaaccacuuuuguaguuuuaacc

SEQ ID NO: 477554 - RNA, 64 nt, hsa
auuuuuugaaaauuuacuguagcuucuauuucgugaauaagaauguuuugauuuugaucauaca

SEQ ID NO: 477555 - RNA, 64 nt, hsa
ucacaaacccuugcaacauugccugaaguuuauggaauaagauguauucucacucccuugaucu

SEQ ID NO: 477556 - RNA, 64 nt, hsa
auuugacuuaucuggaaaagcaaaauguacuuaagaauaagaauaacaugguccauucaccuuu

SEQ ID NO: 477557 - RNA, 64 nt, hsa
aagucucgauuucuucucucucugcauaugccuggaauaagagauccuuuuucaauguaacaau

SEQ ID NO: 477558 - RNA, 64 nt, hsa
aaucugaagaugugaagggcacagaagugacuuugaauaagaagaauuuaguguaucuguaauu

SEQ ID NO: 477559 - RNA, 64 nt, hsa
uuuuauaaugauuuuuaaaaaacauaucuauuuggaauaagauacagcaacaaucauugcuacu

SEQ ID NO: 477560 - RNA, 64 nt, hsa
ucaacauacuuauccucugaacacauaaauaagugaauaagauaaaaauaucuuuaccuuauua

SEQ ID NO: 477561 - RNA, 64 nt, hsa
gcucugcagggcuggaauuucaaacagaaagagggaauaagauccugugauuuuucucaccugc

SEQ ID NO: 477562 - RNA, 64 nt, hsa
uuuucagguaucuuuguagcgguuucccuuuacugaauaagaugacacguggugauugugaaga

SEQ ID NO: 477563 - RNA, 64 nt, hsa
gaugcaaaaaaaaaaaaaaaaaaaaaaaaaaaaagaauaagaggugauauuacacccaugaaac

SEQ ID NO: 477564 - RNA, 64 nt, hsa
aagaauaagaggugauauuacacccaugaaacaagaauaagaugcuauuuugagacaagaaaca

SEQ ID NO: 477565 - RNA, 64 nt, hsa
uuuuuacuguuauuuaauugaaaccauagacuaagaauaagaagcaucauacuauaacugaaca

SEQ ID NO: 477566 - RNA, 64 nt, hsa
gaauaguuguuuaaauauuuuuuaaaaaacacuugaauaagaaucaguaggguauaaacuagaa

SEQ ID NO: 477567 - RNA, 64 nt, hsa
gagauuuuucuuuuaagcccugcucuuucucugagaaccaaaagaugccuugaauauuuauuca

SEQ ID NO: 477568 - RNA, 64 nt, hsa
accuccuuuucuucuagcuuuguuguccucccaggaaccaaaaaaccccagcuauuuucugacc

SEQ ID NO: 477569 - RNA, 63 nt, hsa
uucaacuugauuauaaauacaccugucacuaccagaaccaaaaaaaaaaagaaaaaaauccca

SEQ ID NO: 477570 - RNA, 64 nt, hsa
cucaaaaucuuccuuuguguaggacaagaaaauugaaccaaagcuugcuuguugcaauguggua

SEQ ID NO: 477571 - RNA, 64 nt, hsa
gcagaggccaaguuccaggugucuguguucccaggaaccaaauggggagucuggggcccguuuu

SEQ ID NO: 477572 - RNA, 64 nt, hsa
cacccacccccauccaggaaccgugacguccaaggaaccaaacccagacgcagaacaauaaaau

SEQ ID NO: 477573 - RNA, 64 nt, hsa
ccaaauauuaagcccuuaaaaaaauaaaaccucugaaccaaaaucuucccaggaauaguacuua

SEQ ID NO: 477574 - RNA, 64 nt, hsa
gaagaaacaaacagaagucuuaagauuagaaugagaaccaaagagaauuuaacccugccauuuu

SEQ ID NO: 477575 - RNA, 64 nt, hsa
cagcuuucucuggaaaaugaaugcuaauuagugugaaccaaaagaguaaguaagagucugaagu

SEQ ID NO: 477576 - RNA, 64 nt, hsa
ccccuccgcacaggaaagguacccaguagauaaugaaccaaauuaaguucccucccuccagcca

SEQ ID NO: 477577 - RNA, 64 nt, hsa
uguguucauguucccagccagcucugagacccaggaaccaaauauuccauuuuggcuucugcua

SEQ ID NO: 477578 - RNA, 64 nt, hsa
guucccccaaaauaaacguguccccauuuuaccagaaccaaaccucaacacagcgaagcuguac

SEQ ID NO: 477579 - RNA, 64 nt, hsa
guaguugacuccaagucucugugagcagugacuugaaccaaacacaccaggaauaauccauucu

SEQ ID NO: 477580 - RNA, 64 nt, hsa
cacuguccuuagaagaaagggcauuuuuacuuuugaaccaaaaagagaaaaaaaaaucagaagu

SEQ ID NO: 477581 - RNA, 64 nt, hsa
cgcaaaucaauaaauguaauccagcauauaaacagaaccaaagacagaaaccacaugauuaucu

SEQ ID NO: 477582 - RNA, 64 nt, hsa
cagaauugaaaaacacuacuuuaaaguucauauggaaccaaaaaagagcccacauugccaaguc

SEQ ID NO: 477583 - RNA, 62 nt, hsa
ugaaugauuuuuucaguaaaaaauacauauucaagaaccaaaccuugguggucauuucucuu

SEQ ID NO: 477584 - RNA, 64 nt, hsa
uagugugaaauugucauguuaaaaaaaaaaacaggaaccaaaugugaccuugugcauauauugg

SEQ ID NO: 477585 - RNA, 64 nt, hsa
uuuuuaaaaauuccuuuuagagacagucuuuugggaaccaaaguauuuuacuguaaaucuuuaa

SEQ ID NO: 477586 - RNA, 64 nt, hsa
uaagcaaggaauauaagauuucaaauaaaauuuugaaccaaaaacauuuauaaugccguucugg

SEQ ID NO: 477587 - RNA, 64 nt, hsa; identical to SEQ ID NO: 76027

SEQ ID NO: 477588 - RNA, 64 nt, hsa; identical to SEQ ID NO: 76028

SEQ ID NO: 477589 - RNA, 64 nt, hsa; identical to SEQ ID NO: 76029

SEQ ID NO: 477590 - RNA, 64 nt, hsa; identical to SEQ ID NO: 76030

SEQ ID NO: 477591 - RNA, 64 nt, hsa; identical to SEQ ID NO: 76031

SEQ ID NO: 477592 - RNA, 64 nt, hsa; identical to SEQ ID NO: 76032

SEQ ID NO: 477593 - RNA, 64 nt, hsa; identical to SEQ ID NO: 76033

SEQ ID NO: 477594 - RNA, 64 nt, hsa; identical to SEQ ID NO: 76034

SEQ ID NO: 477595 - RNA, 64 nt, hsa; identical to SEQ ID NO: 76035

SEQ ID NO: 477596 - RNA, 64 nt, hsa; identical to SEQ ID NO: 76036

SEQ ID NO: 477597 - RNA, 64 nt, hsa; identical to SEQ ID NO: 76037

SEQ ID NO: 477598 - RNA, 64 nt, hsa; identical to SEQ ID NO: 76038

SEQ ID NO: 477599 - RNA, 64 nt, hsa; identical to SEQ ID NO: 76039

SEQ ID NO: 477600 - RNA, 64 nt, hsa; identical to SEQ ID NO: 76040

SEQ ID NO: 477601 - RNA, 64 nt, hsa; identical to SEQ ID NO: 76041

SEQ ID NO: 477602 - RNA, 64 nt, hsa; identical to SEQ ID NO: 76042

SEQ ID NO: 477603 - RNA, 64 nt, hsa; identical to SEQ ID NO: 76043

SEQ ID NO: 477604 - RNA, 64 nt, hsa; identical to SEQ ID NO: 76044

SEQ ID NO: 477605 - RNA, 64 nt, hsa; identical to SEQ ID NO: 76045

SEQ ID NO: 477606 - RNA, 64 nt, hsa; identical to SEQ ID NO: 76046

SEQ ID NO: 477607 - RNA, 64 nt, hsa; identical to SEQ ID NO: 76047

SEQ ID NO: 477608 - RNA, 64 nt, hsa; identical to SEQ ID NO: 76048

SEQ ID NO: 477609 - RNA, 64 nt, hsa; identical to SEQ ID NO: 76049

SEQ ID NO: 477610 - RNA, 64 nt, hsa; identical to SEQ ID NO: 76050

SEQ ID NO: 477611 - RNA, 64 nt, hsa; identical to SEQ ID NO: 76051

SEQ ID NO: 477612 - RNA, 64 nt, hsa; identical to SEQ ID NO: 76052

SEQ ID NO: 477613 - RNA, 64 nt, hsa; identical to SEQ ID NO: 76053

SEQ ID NO: 477614 - RNA, 64 nt, hsa; identical to SEQ ID NO: 76054

SEQ ID NO: 477615 - RNA, 64 nt, hsa; identical to SEQ ID NO: 76055

SEQ ID NO: 477616 - RNA, 64 nt, hsa; identical to SEQ ID NO: 76056

SEQ ID NO: 477617 - RNA, 64 nt, hsa; identical to SEQ ID NO: 76057

SEQ ID NO: 477618 - RNA, 64 nt, hsa; identical to SEQ ID NO: 76058

SEQ ID NO: 477619 - RNA, 52 nt, hsa; identical to SEQ ID NO: 76059

SEQ ID NO: 477620 - RNA, 64 nt, hsa; identical to SEQ ID NO: 76060

SEQ ID NO: 477621 - RNA, 64 nt, hsa; identical to SEQ ID NO: 76061

SEQ ID NO: 477622 - RNA, 64 nt, hsa; identical to SEQ ID NO: 76062

SEQ ID NO: 477623 - RNA, 64 nt, hsa; identical to SEQ ID NO: 76062

SEQ ID NO: 477624 - RNA, 64 nt, hsa; identical to SEQ ID NO: 76064

SEQ ID NO: 477625 - RNA, 64 nt, hsa; identical to SEQ ID NO: 76065

SEQ ID NO: 477626 - RNA, 64 nt, hsa; identical to SEQ ID NO: 76066

SEQ ID NO: 477627 - RNA, 64 nt, hsa; identical to SEQ ID NO: 76067

SEQ ID NO: 477628 - RNA, 64 nt, hsa; identical to SEQ ID NO: 76068

SEQ ID NO: 477629 - RNA, 64 nt, hsa; identical to SEQ ID NO: 76069

SEQ ID NO: 477630 - RNA, 64 nt, hsa; identical to SEQ ID NO: 76070

SEQ ID NO: 477631 - RNA, 64 nt, hsa; identical to SEQ ID NO: 76071

SEQ ID NO: 477632 - RNA, 64 nt, hsa; identical to SEQ ID NO: 76072

SEQ ID NO: 477633 - RNA, 64 nt, hsa; identical to SEQ ID NO: 76073

SEQ ID NO: 477634 - RNA, 64 nt, hsa; identical to SEQ ID NO: 76074

SEQ ID NO: 477635 - RNA, 64 nt, hsa; identical to SEQ ID NO: 76075

SEQ ID NO: 477636 - RNA, 64 nt, hsa; identical to SEQ ID NO: 76076

SEQ ID NO: 477637 - RNA, 64 nt, hsa; identical to SEQ ID NO: 76077

SEQ ID NO: 477638 - RNA, 64 nt, hsa; identical to SEQ ID NO: 76078

SEQ ID NO: 477639 - RNA, 64 nt, hsa; identical to SEQ ID NO: 76079

SEQ ID NO: 477640 - RNA, 64 nt, hsa; identical to SEQ ID NO: 76080

SEQ ID NO: 477641 - RNA, 64 nt, hsa; identical to SEQ ID NO: 76081

SEQ ID NO: 477642 - RNA, 64 nt, hsa; identical to SEQ ID NO: 76082

SEQ ID NO: 477643 - RNA, 64 nt, hsa; identical to SEQ ID NO: 76083

SEQ ID NO: 477644 - RNA, 64 nt, hsa; identical to SEQ ID NO: 76084

SEQ ID NO: 477645 - RNA, 64 nt, hsa; identical to SEQ ID NO: 76085

SEQ ID NO: 477646 - RNA, 64 nt, hsa; identical to SEQ ID NO: 76086

SEQ ID NO: 477647 - RNA, 64 nt, hsa; identical to SEQ ID NO: 76087

SEQ ID NO: 477648 - RNA, 64 nt, hsa; identical to SEQ ID NO: 76088

SEQ ID NO: 477649 - RNA, 64 nt, hsa; identical to SEQ ID NO: 76089

SEQ ID NO: 477650 - RNA, 64 nt, hsa; identical to SEQ ID NO: 76090

SEQ ID NO: 477651 - RNA, 64 nt, hsa; identical to SEQ ID NO: 76090

SEQ ID NO: 477652 - RNA, 64 nt, hsa; identical to SEQ ID NO: 50680

SEQ ID NO: 477653 - RNA, 64 nt, hsa; identical to SEQ ID NO: 50681

SEQ ID NO: 477654 - RNA, 64 nt, hsa; identical to SEQ ID NO: 50682

SEQ ID NO: 477655 - RNA, 64 nt, hsa; identical to SEQ ID NO: 50683

SEQ ID NO: 477656 - RNA, 64 nt, hsa; identical to SEQ ID NO: 50684

SEQ ID NO: 477657 - RNA, 64 nt, hsa; identical to SEQ ID NO: 50685

SEQ ID NO: 477658 - RNA, 64 nt, hsa; identical to SEQ ID NO: 50686

SEQ ID NO: 477659 - RNA, 64 nt, hsa; identical to SEQ ID NO: 50687

SEQ ID NO: 477660 - RNA, 64 nt, hsa; identical to SEQ ID NO: 50688

SEQ ID NO: 477661 - RNA, 64 nt, hsa; identical to SEQ ID NO: 50689

SEQ ID NO: 477662 - RNA, 64 nt, hsa; identical to SEQ ID NO: 50690

SEQ ID NO: 477663 - RNA, 64 nt, hsa; identical to SEQ ID NO: 50691

SEQ ID NO: 477664 - RNA, 64 nt, hsa; identical to SEQ ID NO: 50692

SEQ ID NO: 477665 - RNA, 64 nt, hsa; identical to SEQ ID NO: 50693

SEQ ID NO: 477666 - RNA, 64 nt, hsa; identical to SEQ ID NO: 153237

SEQ ID NO: 477667 - RNA, 64 nt, hsa; identical to SEQ ID NO: 153238

SEQ ID NO: 477668 - RNA, 64 nt, hsa; identical to SEQ ID NO: 153239

SEQ ID NO: 477669 - RNA, 64 nt, hsa; identical to SEQ ID NO: 153240

SEQ ID NO: 477670 - RNA, 64 nt, hsa; identical to SEQ ID NO: 153241

SEQ ID NO: 477671 - RNA, 64 nt, hsa; identical to SEQ ID NO: 153242

SEQ ID NO: 477672 - RNA, 64 nt, hsa; identical to SEQ ID NO: 153243

SEQ ID NO: 477673 - RNA, 64 nt, hsa; identical to SEQ ID NO: 153244

SEQ ID NO: 477674 - RNA, 64 nt, hsa; identical to SEQ ID NO: 153245

SEQ ID NO: 477675 - RNA, 64 nt, hsa; identical to SEQ ID NO: 153246

SEQ ID NO: 477676 - RNA, 64 nt, hsa; identical to SEQ ID NO: 50680

SEQ ID NO: 477677 - RNA, 64 nt, hsa; identical to SEQ ID NO: 50681

SEQ ID NO: 477678 - RNA, 64 nt, hsa; identical to SEQ ID NO: 50682

SEQ ID NO: 477679 - RNA, 64 nt, hsa; identical to SEQ ID NO: 50683

SEQ ID NO: 477680 - RNA, 64 nt, hsa; identical to SEQ ID NO: 50684

SEQ ID NO: 477681 - RNA, 64 nt, hsa; identical to SEQ ID NO: 50685

SEQ ID NO: 477682 - RNA, 64 nt, hsa; identical to SEQ ID NO: 50686

SEQ ID NO: 477683 - RNA, 64 nt, hsa; identical to SEQ ID NO: 50687

SEQ ID NO: 477684 - RNA, 64 nt, hsa; identical to SEQ ID NO: 50688

SEQ ID NO: 477685 - RNA, 64 nt, hsa; identical to SEQ ID NO: 50689

SEQ ID NO: 477686 - RNA, 64 nt, hsa; identical to SEQ ID NO: 50690

SEQ ID NO: 477687 - RNA, 64 nt, hsa; identical to SEQ ID NO: 50691

SEQ ID NO: 477688 - RNA, 64 nt, hsa; identical to SEQ ID NO: 50692

SEQ ID NO: 477689 - RNA, 64 nt, hsa; identical to SEQ ID NO: 50693

SEQ ID NO: 477690 - RNA, 64 nt, hsa; identical to SEQ ID NO: 153237

SEQ ID NO: 477691 - RNA, 64 nt, hsa; identical to SEQ ID NO: 153238

SEQ ID NO: 477692 - RNA, 64 nt, hsa; identical to SEQ ID NO: 153239

SEQ ID NO: 477693 - RNA, 64 nt, hsa; identical to SEQ ID NO: 153240

SEQ ID NO: 477694 - RNA, 64 nt, hsa; identical to SEQ ID NO: 153241

SEQ ID NO: 477695 - RNA, 64 nt, hsa; identical to SEQ ID NO: 153242

SEQ ID NO: 477696 - RNA, 64 nt, hsa; identical to SEQ ID NO: 153243

SEQ ID NO: 477697 - RNA, 64 nt, hsa; identical to SEQ ID NO: 153244

SEQ ID NO: 477698 - RNA, 64 nt, hsa; identical to SEQ ID NO: 153245

SEQ ID NO: 477699 - RNA, 64 nt, hsa; identical to SEQ ID NO: 153246

SEQ ID NO: 477700 - RNA, 64 nt, hsa; identical to SEQ ID NO: 50680

SEQ ID NO: 477701 - RNA, 64 nt, hsa; identical to SEQ ID NO: 50681

SEQ ID NO: 477702 - RNA, 64 nt, hsa; identical to SEQ ID NO: 50682

SEQ ID NO: 477703 - RNA, 64 nt, hsa; identical to SEQ ID NO: 50683

SEQ ID NO: 477704 - RNA, 64 nt, hsa; identical to SEQ ID NO: 50684

SEQ ID NO: 477705 - RNA, 64 nt, hsa; identical to SEQ ID NO: 50685

SEQ ID NO: 477706 - RNA, 64 nt, hsa; identical to SEQ ID NO: 50686

SEQ ID NO: 477707 - RNA, 64 nt, hsa; identical to SEQ ID NO: 50687

SEQ ID NO: 477708 - RNA, 64 nt, hsa; identical to SEQ ID NO: 50688

SEQ ID NO: 477709 - RNA, 64 nt, hsa; identical to SEQ ID NO: 50689

SEQ ID NO: 477710 - RNA, 64 nt, hsa; identical to SEQ ID NO: 50690

SEQ ID NO: 477711 - RNA, 64 nt, hsa; identical to SEQ ID NO: 50691

SEQ ID NO: 477712 - RNA, 64 nt, hsa; identical to SEQ ID NO: 50692

SEQ ID NO: 477713 - RNA, 64 nt, hsa; identical to SEQ ID NO: 50693

SEQ ID NO: 477714 - RNA, 64 nt, hsa; identical to SEQ ID NO: 153237

SEQ ID NO: 477715 - RNA, 64 nt, hsa; identical to SEQ ID NO: 153238

SEQ ID NO: 477716 - RNA, 64 nt, hsa; identical to SEQ ID NO: 153239

SEQ ID NO: 477717 - RNA, 64 nt, hsa; identical to SEQ ID NO: 153240

SEQ ID NO: 477718 - RNA, 64 nt, hsa; identical to SEQ ID NO: 153241

SEQ ID NO: 477719 - RNA, 64 nt, hsa; identical to SEQ ID NO: 153242

SEQ ID NO: 477720 - RNA, 64 nt, hsa; identical to SEQ ID NO: 153243

SEQ ID NO: 477721 - RNA, 64 nt, hsa; identical to SEQ ID NO: 153244

SEQ ID NO: 477722 - RNA, 64 nt, hsa; identical to SEQ ID NO: 153245

SEQ ID NO: 477723 - RNA, 64 nt, hsa; identical to SEQ ID NO: 153246

SEQ ID NO: 477724 - RNA, 64 nt, hsa; identical to SEQ ID NO: 50680

SEQ ID NO: 477725 - RNA, 64 nt, hsa; identical to SEQ ID NO: 50681

SEQ ID NO: 477726 - RNA, 64 nt, hsa; identical to SEQ ID NO: 50682

SEQ ID NO: 477727 - RNA, 64 nt, hsa; identical to SEQ ID NO: 50683

SEQ ID NO: 477728 - RNA, 64 nt, hsa; identical to SEQ ID NO: 50684

SEQ ID NO: 477729 - RNA, 64 nt, hsa; identical to SEQ ID NO: 50685

SEQ ID NO: 477730 - RNA, 64 nt, hsa; identical to SEQ ID NO: 50686

SEQ ID NO: 477731 - RNA, 64 nt, hsa; identical to SEQ ID NO: 50687

SEQ ID NO: 477732 - RNA, 64 nt, hsa; identical to SEQ ID NO: 50688

SEQ ID NO: 477733 - RNA, 64 nt, hsa; identical to SEQ ID NO: 50689

SEQ ID NO: 477734 - RNA, 64 nt, hsa; identical to SEQ ID NO: 50690

SEQ ID NO: 477735 - RNA, 64 nt, hsa; identical to SEQ ID NO: 50691

SEQ ID NO: 477736 - RNA, 64 nt, hsa; identical to SEQ ID NO: 50692

SEQ ID NO: 477737 - RNA, 64 nt, hsa; identical to SEQ ID NO: 50693

SEQ ID NO: 477738 - RNA, 64 nt, hsa; identical to SEQ ID NO: 153237

SEQ ID NO: 477739 - RNA, 64 nt, hsa; identical to SEQ ID NO: 153238

SEQ ID NO: 477740 - RNA, 64 nt, hsa; identical to SEQ ID NO: 153239

SEQ ID NO: 477741 - RNA, 64 nt, hsa; identical to SEQ ID NO: 153240

SEQ ID NO: 477742 - RNA, 64 nt, hsa; identical to SEQ ID NO: 153241

SEQ ID NO: 477743 - RNA, 64 nt, hsa; identical to SEQ ID NO: 153242

SEQ ID NO: 477744 - RNA, 64 nt, hsa; identical to SEQ ID NO: 153243

SEQ ID NO: 477745 - RNA, 64 nt, hsa; identical to SEQ ID NO: 153244

SEQ ID NO: 477746 - RNA, 64 nt, hsa; identical to SEQ ID NO: 153245

SEQ ID NO: 477747 - RNA, 64 nt, hsa; identical to SEQ ID NO: 153246

SEQ ID NO: 477748 - RNA, 64 nt, hsa; identical to SEQ ID NO: 50680

SEQ ID NO: 477749 - RNA, 64 nt, hsa; identical to SEQ ID NO: 50681

SEQ ID NO: 477750 - RNA, 64 nt, hsa; identical to SEQ ID NO: 50682

SEQ ID NO: 477751 - RNA, 64 nt, hsa; identical to SEQ ID NO: 50683

SEQ ID NO: 477752 - RNA, 64 nt, hsa; identical to SEQ ID NO: 50684

SEQ ID NO: 477753 - RNA, 64 nt, hsa; identical to SEQ ID NO: 50685

SEQ ID NO: 477754 - RNA, 64 nt, hsa; identical to SEQ ID NO: 50686

SEQ ID NO: 477755 - RNA, 64 nt, hsa; identical to SEQ ID NO: 50687

SEQ ID NO: 477756 - RNA, 64 nt, hsa; identical to SEQ ID NO: 50688

SEQ ID NO: 477757 - RNA, 64 nt, hsa; identical to SEQ ID NO: 50689

SEQ ID NO: 477758 - RNA, 64 nt, hsa; identical to SEQ ID NO: 50690

SEQ ID NO: 477759 - RNA, 64 nt, hsa; identical to SEQ ID NO: 50691

SEQ ID NO: 477760 - RNA, 64 nt, hsa; identical to SEQ ID NO: 50692

SEQ ID NO: 477761 - RNA, 64 nt, hsa; identical to SEQ ID NO: 50693

SEQ ID NO: 477762 - RNA, 64 nt, hsa; identical to SEQ ID NO: 153237

SEQ ID NO: 477763 - RNA, 64 nt, hsa; identical to SEQ ID NO: 153238

SEQ ID NO: 477764 - RNA, 64 nt, hsa; identical to SEQ ID NO: 153239

SEQ ID NO: 477765 - RNA, 64 nt, hsa; identical to SEQ ID NO: 153240

SEQ ID NO: 477766 - RNA, 64 nt, hsa; identical to SEQ ID NO: 153241

SEQ ID NO: 477767 - RNA, 64 nt, hsa; identical to SEQ ID NO: 153242

SEQ ID NO: 477768 - RNA, 64 nt, hsa; identical to SEQ ID NO: 153243

SEQ ID NO: 477769 - RNA, 64 nt, hsa; identical to SEQ ID NO: 153244

SEQ ID NO: 477770 - RNA, 64 nt, hsa; identical to SEQ ID NO: 153245

SEQ ID NO: 477771 - RNA, 64 nt, hsa; identical to SEQ ID NO: 153246

SEQ ID NO: 477772 - RNA, 64 nt, hsa; identical to SEQ ID NO: 50680

SEQ ID NO: 477773 - RNA, 64 nt, hsa; identical to SEQ ID NO: 50681

SEQ ID NO: 477774 - RNA, 64 nt, hsa; identical to SEQ ID NO: 50682

SEQ ID NO: 477775 - RNA, 64 nt, hsa; identical to SEQ ID NO: 50683

SEQ ID NO: 477776 - RNA, 64 nt, hsa; identical to SEQ ID NO: 50684

SEQ ID NO: 477777 - RNA, 64 nt, hsa; identical to SEQ ID NO: 50685

SEQ ID NO: 477778 - RNA, 64 nt, hsa; identical to SEQ ID NO: 50686

SEQ ID NO: 477779 - RNA, 64 nt, hsa; identical to SEQ ID NO: 50687

SEQ ID NO: 477780 - RNA, 64 nt, hsa; identical to SEQ ID NO: 50688

SEQ ID NO: 477781 - RNA, 64 nt, hsa; identical to SEQ ID NO: 50689

SEQ ID NO: 477782 - RNA, 64 nt, hsa; identical to SEQ ID NO: 50690

SEQ ID NO: 477783 - RNA, 64 nt, hsa; identical to SEQ ID NO: 50691

SEQ ID NO: 477784 - RNA, 64 nt, hsa; identical to SEQ ID NO: 50692

SEQ ID NO: 477785 - RNA, 64 nt, hsa; identical to SEQ ID NO: 50693

SEQ ID NO: 477786 - RNA, 64 nt, hsa; identical to SEQ ID NO: 153237

SEQ ID NO: 477787 - RNA, 64 nt, hsa; identical to SEQ ID NO: 153238

SEQ ID NO: 477788 - RNA, 64 nt, hsa; identical to SEQ ID NO: 153239

SEQ ID NO: 477789 - RNA, 64 nt, hsa; identical to SEQ ID NO: 153240

SEQ ID NO: 477790 - RNA, 64 nt, hsa; identical to SEQ ID NO: 153241

SEQ ID NO: 477791 - RNA, 64 nt, hsa; identical to SEQ ID NO: 153242

SEQ ID NO: 477792 - RNA, 64 nt, hsa; identical to SEQ ID NO: 153243

SEQ ID NO: 477793 - RNA, 64 nt, hsa; identical to SEQ ID NO: 153244

SEQ ID NO: 477794 - RNA, 64 nt, hsa; identical to SEQ ID NO: 153245

SEQ ID NO: 477795 - RNA, 64 nt, hsa; identical to SEQ ID NO: 153246

SEQ ID NO: 477796 - RNA, 64 nt, hsa; identical to SEQ ID NO: 50680

SEQ ID NO: 477797 - RNA, 64 nt, hsa; identical to SEQ ID NO: 50681

SEQ ID NO: 477798 - RNA, 64 nt, hsa; identical to SEQ ID NO: 50682

SEQ ID NO: 477799 - RNA, 64 nt, hsa; identical to SEQ ID NO: 50683

SEQ ID NO: 477800 - RNA, 64 nt, hsa; identical to SEQ ID NO: 50684

SEQ ID NO: 477801 - RNA, 64 nt, hsa; identical to SEQ ID NO: 50685

SEQ ID NO: 477802 - RNA, 64 nt, hsa; identical to SEQ ID NO: 50686

SEQ ID NO: 477803 - RNA, 64 nt, hsa; identical to SEQ ID NO: 50687

SEQ ID NO: 477804 - RNA, 64 nt, hsa; identical to SEQ ID NO: 50688

SEQ ID NO: 477805 - RNA, 64 nt, hsa; identical to SEQ ID NO: 50689

SEQ ID NO: 477806 - RNA, 64 nt, hsa; identical to SEQ ID NO: 50690

SEQ ID NO: 477807 - RNA, 64 nt, hsa; identical to SEQ ID NO: 50691

SEQ ID NO: 477808 - RNA, 64 nt, hsa; identical to SEQ ID NO: 50692

SEQ ID NO: 477809 - RNA, 64 nt, hsa; identical to SEQ ID NO: 50693

SEQ ID NO: 477810 - RNA, 64 nt, hsa; identical to SEQ ID NO: 153237

SEQ ID NO: 477811 - RNA, 64 nt, hsa; identical to SEQ ID NO: 153238

SEQ ID NO: 477812 - RNA, 64 nt, hsa; identical to SEQ ID NO: 153239

SEQ ID NO: 477813 - RNA, 64 nt, hsa; identical to SEQ ID NO: 153240

SEQ ID NO: 477814 - RNA, 64 nt, hsa; identical to SEQ ID NO: 153241

SEQ ID NO: 477815 - RNA, 64 nt, hsa; identical to SEQ ID NO: 153242

SEQ ID NO: 477816 - RNA, 64 nt, hsa; identical to SEQ ID NO: 153243

SEQ ID NO: 477817 - RNA, 64 nt, hsa; identical to SEQ ID NO: 153244

SEQ ID NO: 477818 - RNA, 64 nt, hsa; identical to SEQ ID NO: 153245

SEQ ID NO: 477819 - RNA, 64 nt, hsa; identical to SEQ ID NO: 153246

SEQ ID NO: 477820 - RNA, 64 nt, hsa; identical to SEQ ID NO: 102097

SEQ ID NO: 477821 - RNA, 64 nt, hsa; identical to SEQ ID NO: 102098

SEQ ID NO: 477822 - RNA, 64 nt, hsa; identical to SEQ ID NO: 102099

SEQ ID NO: 477823 - RNA, 64 nt, hsa; identical to SEQ ID NO: 102100

SEQ ID NO: 477824 - RNA, 64 nt, hsa; identical to SEQ ID NO: 102101

SEQ ID NO: 477825 - RNA, 64 nt, hsa; identical to SEQ ID NO: 102102

SEQ ID NO: 477826 - RNA, 64 nt, hsa; identical to SEQ ID NO: 102103

SEQ ID NO: 477827 - RNA, 64 nt, hsa; identical to SEQ ID NO: 102104

SEQ ID NO: 477828 - RNA, 64 nt, hsa; identical to SEQ ID NO: 102105

SEQ ID NO: 477829 - RNA, 64 nt, hsa; identical to SEQ ID NO: 102106

SEQ ID NO: 477830 - RNA, 64 nt, hsa; identical to SEQ ID NO: 102107

SEQ ID NO: 477831 - RNA, 64 nt, hsa; identical to SEQ ID NO: 102108

SEQ ID NO: 477832 - RNA, 64 nt, hsa; identical to SEQ ID NO: 102109

SEQ ID NO: 477833 - RNA, 64 nt, hsa; identical to SEQ ID NO: 102110

SEQ ID NO: 477834 - RNA, 64 nt, hsa; identical to SEQ ID NO: 102111

SEQ ID NO: 477835 - RNA, 64 nt, hsa; identical to SEQ ID NO: 102112

SEQ ID NO: 477836 - RNA, 64 nt, hsa; identical to SEQ ID NO: 102113

SEQ ID NO: 477837 - RNA, 64 nt, hsa; identical to SEQ ID NO: 102114

SEQ ID NO: 477838 - RNA, 64 nt, hsa; identical to SEQ ID NO: 102115

SEQ ID NO: 477839 - RNA, 64 nt, hsa; identical to SEQ ID NO: 102116

SEQ ID NO: 477840 - RNA, 64 nt, hsa
auaggagacaaaguuaggaaacauugauacaagcuuuguacagagauuuguacauuuguguaau

SEQ ID NO: 477841 - RNA, 64 nt, hsa
guuaggaaacauugauacaagcuuuguacagagauuuguacauuuguguaauaggccuuuucau

SEQ ID NO: 477842 - RNA, 64 nt, hsa
uggaaaaauauuuaagauaguuuugccagaacaguuuguacagacguaugcuuauuuuaaaauu

SEQ ID NO: 477843 - RNA, 64 nt, hsa
uuuauugcuugauacuuuugacaacaaauuagguuuuguacaauugaacuuaaauaaaugucau

SEQ ID NO: 477844 - RNA, 64 nt, hsa
cuuuuguacagagauauauuuuuauuauacaaaguuuguacaguaccaaaaaagaaaaaaaaaa

SEQ ID NO: 477845 - RNA, 64 nt, hsa
aaaaaaaaaaguaaaacaaagacaaaaaaaaucuuuuguacagagauauauuuuuauuauacaa

SEQ ID NO: 477846 - RNA, 64 nt, hsa
uaauuuuguugaaaaugguuucaaguuauucaaauuuguacaggacuguaaagauuuguugaca

SEQ ID NO: 477847 - RNA, 64 nt, hsa
cauuuauuuaugaaaaaauaugaaccuauuuucauuuguacaagguaauuguuuuuuaaagcaa

SEQ ID NO: 477848 - RNA, 64 nt, hsa
cuuuuuuaaaaauuaauauauuuucaggcguauuuuuguacagugaaaagggaacauucuugcu

SEQ ID NO: 477849 - RNA, 64 nt, hsa
gccuugugguuuaaaaaaaaaaagcaaacuuuuuuuuguacagcuauaguagagauuuguucaa

SEQ ID NO: 477850 - RNA, 64 nt, hsa
gaguggcaaaguggcacuaaugaagcuuuugccuuuuguacauuugagauuuuuguauauagug

SEQ ID NO: 477851 - RNA, 64 nt, hsa
uuaggauuuuuuuuuuuuguauugugaugcuuuauuuguacauuuuuuuccuuucuggauguaa

SEQ ID NO: 477852 - RNA, 64 nt, hsa
uuuucguuguaggagcacuugauuucuaguguguuuuguacaguauauaacuacaagauaguac

SEQ ID NO: 477853 - RNA, 64 nt, hsa
uuaauuacugagcagaaguaaauacuguuggcauuuuguacauaaucuaauuuuuauaugcaug

SEQ ID NO: 477854 - RNA, 64 nt, hsa
ugucauguuggagauugguaauggcuuuccugucuuuguacaguugaauuccuagucuuccuuc

SEQ ID NO: 477855 - RNA, 64 nt, hsa
uuuucaucuuauuaaaugugaugugacuuuuuucuuuguacagaagaguacuguauuuuugaau

SEQ ID NO: 477856 - RNA, 64 nt, hsa
cuggucuguacuccuuggauuugcauuuuuguauuuuguacaaaguaaaaauaaacuguuauga

SEQ ID NO: 477857 - RNA, 64 nt, hsa
cuuuccugcaucuuucauaguucuguuaaauauuuuuguacaucgcuucuuuuucaaaacuagu

SEQ ID NO: 477858 - RNA, 64 nt, hsa
uuuugaagugagaaaaugaacauuaacaggcauguuuguacagcuagaauauauuaguaagaua

SEQ ID NO: 477859 - RNA, 64 nt, hsa
aaauccaaauucucuuccugguuccagcacugauuuuguacauaaacauuaggcagguugcuua

SEQ ID NO: 477860 - RNA, 64 nt, hsa
auaaaauaaaucuacuguuuagugagcaguaugauuuguacaugccauugaaaauuauuaauca

SEQ ID NO: 477861 - RNA, 64 nt, hsa
aaaaugauuuaccccugguuaaguuucugaagacuuuguacauacagaaguauggcucuguucu

SEQ ID NO: 477862 - RNA, 64 nt, hsa
uuagcaagucugugauguacuuucacuggcucuguuuguacauugagauuguuuguuuaacaau

SEQ ID NO: 477863 - RNA, 64 nt, hsa
uuuauuuuuaaauuauguuuuacuguucauuugauuuguacagauucuuuauuaucauuguucu

SEQ ID NO: 477864 - RNA, 64 nt, hsa
uauuuuuacaacucacuggugguuuuccgcauucuuuguacacccaugaaagaaaacuuuuaug

SEQ ID NO: 477865 - RNA, 64 nt, hsa
agagagauccuggacuucuuuuugggggacuauuuuuguacagagaaaaccuggggaggguggg

SEQ ID NO: 477866 - RNA, 64 nt, hsa
gacgaaaaaaauguuuuaauauuugcaagcaacuuuuguacaguauuuaucgagauaaacaugg

SEQ ID NO: 477867 - RNA, 64 nt, hsa
gagugcuuuguagcaggcauuacaauuaaucuguuuuguacauaaaugugccaacagcuugaug

SEQ ID NO: 477868 - RNA, 64 nt, hsa
cauuucuaauaaaaauuuauugagugaaacaaucuuuguacaaugacuagucaugcaucaucag

SEQ ID NO: 477869 - RNA, 64 nt, hsa
cugcucuucuuaaaaucguuuagauuuuuuuugguuuguacagcuccaccuuuuagaggucuua

SEQ ID NO: 477870 - RNA, 64 nt, hsa
ucacaguacagcuaauuuuuccuaguuaacauauuuuguacaauauuaaaaaaaugcacagaaa

SEQ ID NO: 477871 - RNA, 64 nt, hsa
uuguguccagugauaaaugugauugaucuugccuuuuguacauggaggucaccucugaagugau

SEQ ID NO: 477872 - RNA, 64 nt, hsa
aaacauucuaauauuuuuguaaacauuaaauuauuuuguacaguuaaguguaaauauuguaugu

SEQ ID NO: 477873 - RNA, 64 nt, hsa
aggauuuauuuaagcuauuauuuuaauaaagaacuuuguacauuuuuauuuuuauauuuuuuuc

SEQ ID NO: 477874 - RNA, 64 nt, hsa
cagaggcacucaugggaaaauugguuuugcuuucuuuguacacaccagagacccaucugagguc

SEQ ID NO: 477875 - RNA, 64 nt, hsa
gaguaauuuauccuagugguaaugguuauauguauuuguacaguuuaaauuaaugucucaaagc

SEQ ID NO: 477876 - RNA, 64 nt, hsa
ugcugugguuggcuuaagagguuugucuuuuguuuuuguacagcaguugggccaaccuuugcug

SEQ ID NO: 477877 - RNA, 64 nt, hsa
uuucggaaauaacaccucacagcagcuucgugcuuuuguacagaccuuuguaacaaguguacag

SEQ ID NO: 477878 - RNA, 64 nt, hsa
uauaaaucugagcauugauaauguucuaucuaaauuuguacagugugauuuuuuuuuuuagaau

SEQ ID NO: 477879 - RNA, 64 nt, hsa
gacuuacuagucauuuuaguguuauaaauggcauuuuguacaaaauagucuauucaguucguuc

SEQ ID NO: 477880 - RNA, 64 nt, hsa
uuuuggaaugauguaucuuuguagaguuaaugauuuuguacauuugcacauguaaucaucauac

SEQ ID NO: 477881 - RNA, 64 nt, hsa
uuguuuuuaaucuguauagaugacauuuuguagcuuuguacauguuguuaauuaagggcauaua

SEQ ID NO: 477882 - RNA, 64 nt, hsa
uuaaauugcugcaguccauaauuugggcuuguuauuuguacauuaaagauuuuuuccaaguaag

SEQ ID NO: 477883 - RNA, 64 nt, hsa
aguauguugaaauaaacuaugguaucuucaucauuuuguacauuuccuuuuugaggaagguuuc

SEQ ID NO: 477884 - RNA, 64 nt, hsa
agugaagauggaaggcuggagagaaugauugcuuuuuguacaguuaaauaaggucacaauauuc

SEQ ID NO: 477885 - RNA, 64 nt, hsa
ugcuguaauuuauuaauguuuguagcuuuuuauauuuguacauuucuuaugagcuuuguuuaua

SEQ ID NO: 477886 - RNA, 62 nt, hsa
aucaaaguuuuaaaaaaguaaaaauauuucagguuuuguacagaaccaugucugugucauuu

SEQ ID NO: 477887 - RNA, 64 nt, hsa
caaauauuacguuuaucuaguuagaagcuaauguuuuguacauuuuuuguaugaggaagugaug

SEQ ID NO: 477888 - RNA, 64 nt, hsa
acauuuauucaaugguugacguuguuuugugauauuuguacacaaauuuucuuuucucaguuuu

SEQ ID NO: 477889 - RNA, 64 nt, hsa
cuugacacuuccauguuggcucuucucagcuuuuuuuguacauauuuuuuuuuucuaaagagaa

SEQ ID NO: 477890 - RNA, 64 nt, hsa
uaaguucguaucuaaaccuaagacauuaccaagguuuguacaaauucuacuaccugacauuuau

SEQ ID NO: 477891 - RNA, 64 nt, hsa
ggaucggggcuggaaccuagaucgccgauguagauuuguacaggagucuccguuggccggaggu

SEQ ID NO: 477892 - RNA, 64 nt, hsa
ugaaauuauaaaagaggauucugacaguagguauuuuguacauauguauauauguuguccaaau

SEQ ID NO: 477893 - RNA, 64 nt, hsa
uacugaucuuuacaacuguuuaaucaguuuuauuuuuguacaguauuagugaccuaaguuauuu

SEQ ID NO: 477894 - RNA, 64 nt, hsa
uuugaauguucaguuucuauuuugcuugagguauuuuguacauaugugccuugugauugcugcu

SEQ ID NO: 477895 - RNA, 64 nt, hsa
uauaaacuuugcauuguauuugaaucuuagaacuuuuguacacacuaaauauugaugucacacc

SEQ ID NO: 477896 - RNA, 64 nt, hsa
gaugccucuaaccuuggauuggccuguguguguguuuguacauagaauauuuauuuuuauacag

SEQ ID NO: 477897 - RNA, 64 nt, hsa
cagauuauuaaaaaagaaagaaaaaccugcauauuuuguacagaaaauaucaaccucuucccuu

SEQ ID NO: 477898 - RNA, 64 nt, hsa
uuuuaaacaaaaacaaaaaaagcaaccagggcuauuuguacaguugaaggggugaacagaaugg

SEQ ID NO: 477899 - RNA, 64 nt, hsa
gccugaaguaacucccacagaaaccaucaucgucuuuguacaucguauguacaaugcaaucauu

SEQ ID NO: 477900 - RNA, 64 nt, hsa
uugguugccaccgguccuacuucaaaagaauuauuuuguacaaaaucaucauauuaauauuuga

SEQ ID NO: 477901 - RNA, 64 nt, hsa
cagaggauuacuguuucauauugaagcucucucuuuuguacauucagaguuugaugcauuucua

SEQ ID NO: 477902 - RNA, 64 nt, hsa
uauccuaaccaguucggggauauauuaagauauuuuuguacauaagagagaaagagagagaaaa

SEQ ID NO: 477903 - RNA, 64 nt, hsa
uaagagagaaagagagagaaaaauuuauagaaguuuuguacaaaugguuuaaaauguguauauc

SEQ ID NO: 477904 - RNA, 64 nt, hsa
aaaucuauuggguuaauuucucccuauguuuauuuuuguacauuugagccaugucacacaaacu

SEQ ID NO: 477905 - RNA, 64 nt, hsa
ucaaaaucugugaccugucagaauaaaaaugugguuuguacauaucaaauagauauuuuaaggg

SEQ ID NO: 477906 - RNA, 64 nt, hsa
cccucuuuuuuccugggaauauuuuguacaauauuuuguacaaagacaggcaugaggagugccu

SEQ ID NO: 477907 - RNA, 64 nt, hsa
agcccuucuuuucccucuuuuuuccugggaauauuuuguacaauauuuuguacaaagacaggca

SEQ ID NO: 477908 - RNA, 64 nt, hsa
ucugguggaaaaaacucgucuacaucgaccuccguuuguacauuccaucacacccagcaauagc

SEQ ID NO: 477909 - RNA, 64 nt, hsa
agcugagaaaaaaaaaaaaaaacacguuugauacuuuguacaucagaugcaucuuauuuaaaag

SEQ ID NO: 477910 - RNA, 64 nt, hsa
cccggcucccgccccgccccggcgcggcguggcuuuuguacagacguucccacauucuugucaa

SEQ ID NO: 477911 - RNA, 64 nt, hsa
uuuuagacugaacuucgguguuuucuugagacuuuuuguacaguauuuaucaccuacggaggaa

SEQ ID NO: 477912 - RNA, 64 nt, hsa
uggauuaguacuaauuuuauacaugcuuaacugguuuguacacuuugggaugcuacuuagugau

SEQ ID NO: 477913 - RNA, 64 nt, hsa
ucuauuuuuuuuuguuuauuuuguuauuugcaaauuuguacaaacauuuaaaugguucuaauuu

SEQ ID NO: 477914 - RNA, 64 nt, hsa
uaaacuuuuggaaaaaaaaagauuaaaugccagcuuuguacaggucuuuucuauuuuuuuuugu

SEQ ID NO: 477915 - RNA, 64 nt, hsa
caguuuguaauuguaauuuuuguaaauaaauuuguuuguacauuguaugcuuuuuuuuuaguuu

SEQ ID NO: 477916 - RNA, 64 nt, hsa
uggcuucuguuggaggcaugggaaauugucucaauuuguacaguuuguaauuguaauuuuugua

SEQ ID NO: 477917 - RNA, 64 nt, hsa
cuuucuuacccuguucuguuccaguuuugcuggauuuguacauagccauucuagaaauagaguu

SEQ ID NO: 477918 - RNA, 64 nt, hsa
auguauaugaagcaaauauuuuuaaaaauuucuguuuguacauauucugcauguuuuauaauuu

SEQ ID NO: 477919 - RNA, 64 nt, hsa
cucuguaugaagagaagauuucucccaggaaaucuuuguacagcuuuaaguugugucagauucu

SEQ ID NO: 477920 - RNA, 64 nt, hsa
gccuuucuuauuuauauagagaacacuucacuuuuuuguacauuuuuaaggggccuucagggaa

SEQ ID NO: 477921 - RNA, 64 nt, hsa
cacuccgccauuccugguucucuccgaaccguucuuuguacaguaaauguaauucagcuguggu

SEQ ID NO: 477922 - RNA, 64 nt, hsa
aaaagugaauaaauaagucacagagaauguaaauuuuguacaguauuagaauguguaaaugaag

SEQ ID NO: 477923 - RNA, 64 nt, hsa
ugucaacugucacuguuucuuccaaaagucacaauuuguacaagaaccuuugcuuuccuuagac

SEQ ID NO: 477924 - RNA, 64 nt, hsa
uuccugauauuuucuuaaaagaucuaguguccuuuuuguacacuaaacaggugaaugcugacuu

SEQ ID NO: 477925 - RNA, 64 nt, hsa
cuuuuagcuacugcuaaugagacuugagucuauuuuuguacaaaagagaagcaaaaucuuuuuu

SEQ ID NO: 477926 - RNA, 64 nt, hsa
auugucaugcaauaauuauucauauuugguaaguuuuguacauauauuauguacacucagggaa

SEQ ID NO: 477927 - RNA, 64 nt, hsa
cuguaagacauaccaggcccagcugggaccauaauuuguacagaaacacuggaugugauuaaua

SEQ ID NO: 477928 - RNA, 64 nt, hsa
ugaggagcagcagagucccuuguaaaagacugcuuuuguacagaaugcgcuauaaauuauaccu

SEQ ID NO: 477929 - RNA, 64 nt, hsa
augaugcuucccccuucuccauggucuagucaauuuuguacaauuagguaucugacuuuacaag

SEQ ID NO: 477930 - RNA, 64 nt, hsa
gaucuaaaguuggccuuuguugucucaaauuggguuuguacacacaugcaugcauguguguaua

SEQ ID NO: 477931 - RNA, 64 nt, hsa
uugaaccagacauuuuuauaaaauacugauugacuuuguacauuauggauauuauauaugaaau

SEQ ID NO: 477932 - RNA, 64 nt, hsa; identical to SEQ ID NO: 180624

SEQ ID NO: 477933 - RNA, 64 nt, hsa; identical to SEQ ID NO: 180625

SEQ ID NO: 477934 - RNA, 64 nt, hsa; identical to SEQ ID NO: 180626

SEQ ID NO: 477935 - RNA, 64 nt, hsa; identical to SEQ ID NO: 180627

SEQ ID NO: 477936 - RNA, 64 nt, hsa; identical to SEQ ID NO: 180628

SEQ ID NO: 477937 - RNA, 64 nt, hsa; identical to SEQ ID NO: 180629

SEQ ID NO: 477938 - RNA, 64 nt, hsa; identical to SEQ ID NO: 180630

SEQ ID NO: 477939 - RNA, 64 nt, hsa; identical to SEQ ID NO: 180631

SEQ ID NO: 477940 - RNA, 59 nt, hsa
gaagagucuugagaggggcugucaucuguagcugccaucacagugaguuggcagaagug

SEQ ID NO: 477941 - RNA, 59 nt, hsa
gccccugugccaggcuaagcugguacaagagcugccaaccucacagaguguuugcuagg

SEQ ID NO: 477942 - RNA, 59 nt, hsa
uccuccucagaucuucuguggguuucuaaagcugccagccgagauagccaaggccaaag

SEQ ID NO: 477943 - RNA, 59 nt, hsa
ccuguccccgcacugggcuuggggaccagagcugccaccugccuguugggccaggagcc

SEQ ID NO: 477944 - RNA, 59 nt, hsa
guacacccaccugccucucuggcuccagaagcugccagagugcacuggggggaauguuc

SEQ ID NO: 477945 - RNA, 59 nt, hsa
cgagcauugcagauugcaguaggggucccagcugccaaguaggacaugacuaggagugu

SEQ ID NO: 477946 - RNA, 59 nt, hsa
cauugauuaaaauggaauaaagaaagagcagcugccacuuuuaaacaacauaaaggaau

SEQ ID NO: 477947 - RNA, 59 nt, hsa
uaaaagauagucaagaaauucugcaauauagcugccaaaauagacagcuacauuuuuau

SEQ ID NO: 477948 - RNA, 59 nt, hsa
caacuggacugaggggagugugcccaggcagcugccaagcacucccucccuggcuucag

SEQ ID NO: 477949 - RNA, 59 nt, hsa
uuagaccucaaacuuuagcaucucuguggagcugccauccacuguauaauuucgccugg

SEQ ID NO: 477950 - RNA, 59 nt, hsa
ccuggaggccagcucugccccaggggcugagcugccaccagagguccugggacccucac

SEQ ID NO: 477951 - RNA, 59 nt, hsa
guggcugucggccagagggaauguucuggagcugccaaggagggaggagacucggguug

SEQ ID NO: 477952 - RNA, 59 nt, hsa
gcucucucaggaccauccgaucaagcugcagcugccacccucaccuagaaacaugccuu

SEQ ID NO: 477953 - RNA, 59 nt, hsa
uuggaauguccuggucacagggucaugucagcugccaguucucgucucccguccuggag

SEQ ID NO: 477954 - RNA, 59 nt, hsa
ccccacgauuuaggguaacuguuaucaucagcugccauuucugauagggucuaccacau

SEQ ID NO: 477955 - RNA, 59 nt, hsa
ccugugucaucacugcagcgguccucaggagcugccagggccaauugcuacagaguguc

SEQ ID NO: 477956 - RNA, 59 nt, hsa
gggcagacacagcuccagggacccaggccagcugccacacccccgacacuccugcuguc

SEQ ID NO: 477957 - RNA, 59 nt, hsa
gauguucugggggaggaggcaaucgcuguagcugccaggccagccccaucuggaaggag

SEQ ID NO: 477958 - RNA, 59 nt, hsa
ccucucacucacuucuccacccgccaggcagcugccacaggccuaaggcugagugaggu

SEQ ID NO: 477959 - RNA, 59 nt, hsa
ugcgcuccugcgagaccagauauaaaacuagcugccaacccagccuguggccaggucac

SEQ ID NO: 477960 - RNA, 59 nt, hsa
cuccuuugugcuggaaccugggcuccuccagcugccaggcaggagucgguaggacugug

SEQ ID NO: 477961 - RNA, 59 nt, hsa
augccagcccgaggcacugcuacgccagcagcugccacaugggaugguggcucaggcgc

SEQ ID NO: 477962 - RNA, 59 nt, hsa
ccuuuuccaccucccccuuccaucccaccagcugccaguggcucccagaaagccuuauu

SEQ ID NO: 477963 - RNA, 59 nt, hsa
ccaagauggcuguaaacacagagcauuugagcugccacucuuggagcacauugauuuuu

SEQ ID NO: 477964 - RNA, 59 nt, hsa
agagauggccccuccucaccugggacggaagcugccagcucgcuucccccaagcugccu

SEQ ID NO: 477965 - RNA, 59 nt, hsa
ucugugucucagauggcgauuuugcugacagcugccaagaaaaugcuucacucaacagu

SEQ ID NO: 477966 - RNA, 59 nt, hsa
uuuggugugguguuugccauugcagagcaagcugccacgaagaccccugggcaugauuu

SEQ ID NO: 477967 - RNA, 59 nt, hsa
gaagaaggcaugggauggagcccuggcauagcugccaccaugccuaugugcccaagagc

SEQ ID NO: 477968 - RNA, 59 nt, hsa
aaacagcaaagucagcauuugcuguauagagcugccacccaacucuaagcaggagaaac

SEQ ID NO: 477969 - RNA, 59 nt, hsa
aauuugaccucccagagccaguuuccauuagcugccaugcucugcugccucuaauucac

SEQ ID NO: 477970 - RNA, 59 nt, hsa
cuggcccccucagccaucucagggugaggagcugccagucauguccagauggaaugacu

SEQ ID NO: 477971 - RNA, 59 nt, hsa
gggaagaugugcauccguggucaaaagucagcugccagcccugcggaaccagagccuca

SEQ ID NO: 477972 - RNA, 59 nt, hsa
caguuaugucccauuuuuaugaugccaaaagcugccacugugugguauucgaggauuau

SEQ ID NO: 477973 - RNA, 59 nt, hsa
uccacccgaccccagcaguggugcaggacagcugccagcacccaccuggcccuccuccu

SEQ ID NO: 477974 - RNA, 59 nt, hsa
aaggugugugaaagauguuauacaccaggagcugccacugcaugucccaaccagacugu

SEQ ID NO: 477975 - RNA, 59 nt, hsa
ucuucaguucauuccacuuuaggaaacagagcugccaauugaaacagaagaagaaaaaa

SEQ ID NO: 477976 - RNA, 59 nt, hsa
cacccugaaauugugacccccugggggacagcugccagacacagcuggcggcagcacca

SEQ ID NO: 477977 - RNA, 59 nt, hsa
agaggucaugaagggaccucuguggcuccagcugccaacccuggagcccagaccgaggu

SEQ ID NO: 477978 - RNA, 59 nt, hsa
aguuuccuuuuuuauucucucaagccaccagcugccagccaccagcagccagcugccag

SEQ ID NO: 477979 - RNA, 59 nt, hsa
aagccaccagcugccagccaccagcagccagcugccagccuagcuuuuuuuuuuuuuuu

SEQ ID NO: 477980 - RNA, 64 nt, hsa; identical to SEQ ID NO: 249371

SEQ ID NO: 477981 - RNA, 64 nt, hsa; identical to SEQ ID NO: 249372

SEQ ID NO: 477982 - RNA, 64 nt, hsa; identical to SEQ ID NO: 249373

SEQ ID NO: 477983 - RNA, 64 nt, hsa; identical to SEQ ID NO: 249374

SEQ ID NO: 477984 - RNA, 64 nt, hsa; identical to SEQ ID NO: 249375

SEQ ID NO: 477985 - RNA, 64 nt, hsa; identical to SEQ ID NO: 249376

SEQ ID NO: 477986 - RNA, 64 nt, hsa; identical to SEQ ID NO: 249377

SEQ ID NO: 477987 - RNA, 64 nt, hsa; identical to SEQ ID NO: 249378

SEQ ID NO: 477988 - RNA, 64 nt, hsa; identical to SEQ ID NO: 249379

SEQ ID NO: 477989 - RNA, 64 nt, hsa; identical to SEQ ID NO: 249380

SEQ ID NO: 477990 - RNA, 64 nt, hsa; identical to SEQ ID NO: 249381

SEQ ID NO: 477991 - RNA, 64 nt, hsa; identical to SEQ ID NO: 249382

SEQ ID NO: 477992 - RNA, 64 nt, hsa; identical to SEQ ID NO: 249383

SEQ ID NO: 477993 - RNA, 64 nt, hsa; identical to SEQ ID NO: 249384

SEQ ID NO: 477994 - RNA, 64 nt, hsa; identical to SEQ ID NO: 249385

SEQ ID NO: 477995 - RNA, 64 nt, hsa; identical to SEQ ID NO: 249386

SEQ ID NO: 477996 - RNA, 64 nt, hsa; identical to SEQ ID NO: 249387

SEQ ID NO: 477997 - RNA, 64 nt, hsa; identical to SEQ ID NO: 249388

SEQ ID NO: 477998 - RNA, 64 nt, hsa; identical to SEQ ID NO: 249389

SEQ ID NO: 477999 - RNA, 64 nt, hsa; identical to SEQ ID NO: 249390

SEQ ID NO: 478000 - RNA, 63 nt, hsa; identical to SEQ ID NO: 249391

SEQ ID NO: 478001 - RNA, 64 nt, hsa; identical to SEQ ID NO: 249392

SEQ ID NO: 478002 - RNA, 64 nt, hsa; identical to SEQ ID NO: 249393

SEQ ID NO: 478003 - RNA, 64 nt, hsa; identical to SEQ ID NO: 249394

SEQ ID NO: 478004 - RNA, 64 nt, hsa; identical to SEQ ID NO: 249395

SEQ ID NO: 478005 - RNA, 64 nt, hsa; identical to SEQ ID NO: 249396

SEQ ID NO: 478006 - RNA, 64 nt, hsa; identical to SEQ ID NO: 249397

SEQ ID NO: 478007 - RNA, 64 nt, hsa; identical to SEQ ID NO: 249398

SEQ ID NO: 478008 - RNA, 64 nt, hsa; identical to SEQ ID NO: 249399

SEQ ID NO: 478009 - RNA, 64 nt, hsa; identical to SEQ ID NO: 249400

SEQ ID NO: 478010 - RNA, 64 nt, hsa; identical to SEQ ID NO: 249401

SEQ ID NO: 478011 - RNA, 64 nt, hsa; identical to SEQ ID NO: 249402

SEQ ID NO: 478012 - RNA, 64 nt, hsa; identical to SEQ ID NO: 249403

SEQ ID NO: 478013 - RNA, 64 nt, hsa; identical to SEQ ID NO: 249404

SEQ ID NO: 478014 - RNA, 64 nt, hsa; identical to SEQ ID NO: 249405

SEQ ID NO: 478015 - RNA, 64 nt, hsa; identical to SEQ ID NO: 249406

SEQ ID NO: 478016 - RNA, 64 nt, hsa; identical to SEQ ID NO: 249407

SEQ ID NO: 478017 - RNA, 64 nt, hsa; identical to SEQ ID NO: 249408

SEQ ID NO: 478018 - RNA, 64 nt, hsa; identical to SEQ ID NO: 249409

SEQ ID NO: 478019 - RNA, 64 nt, hsa; identical to SEQ ID NO: 249410

SEQ ID NO: 478020 - RNA, 64 nt, hsa; identical to SEQ ID NO: 249411

SEQ ID NO: 478021 - RNA, 64 nt, hsa; identical to SEQ ID NO: 249412

SEQ ID NO: 478022 - RNA, 64 nt, hsa; identical to SEQ ID NO: 249413

SEQ ID NO: 478023 - RNA, 64 nt, hsa; identical to SEQ ID NO: 249414

SEQ ID NO: 478024 - RNA, 64 nt, hsa; identical to SEQ ID NO: 249415

SEQ ID NO: 478025 - RNA, 64 nt, hsa; identical to SEQ ID NO: 249416

SEQ ID NO: 478026 - RNA, 64 nt, hsa; identical to SEQ ID NO: 249417

SEQ ID NO: 478027 - RNA, 64 nt, hsa; identical to SEQ ID NO: 249418

SEQ ID NO: 478028 - RNA, 64 nt, hsa; identical to SEQ ID NO: 249419

SEQ ID NO: 478029 - RNA, 64 nt, hsa; identical to SEQ ID NO: 249420

SEQ ID NO: 478030 - RNA, 64 nt, hsa; identical to SEQ ID NO: 249421

SEQ ID NO: 478031 - RNA, 64 nt, hsa; identical to SEQ ID NO: 249422

SEQ ID NO: 478032 - RNA, 64 nt, hsa; identical to SEQ ID NO: 249423

SEQ ID NO: 478033 - RNA, 59 nt, hsa; identical to SEQ ID NO: 249424

SEQ ID NO: 478034 - RNA, 62 nt, hsa
gcccugcugucugucugugcccaagcccuuccaccagaaaagcuagucuaggugugagagcc

SEQ ID NO: 478035 - RNA, 62 nt, hsa
caaaacucucaaaaauguauuucaagucagugaccagaaaaaucccaccccuugcccuuucc

SEQ ID NO: 478036 - RNA, 62 nt, hsa
gguaucucccugggauaaaaaagaagaagcuaaccagaaaaagcuggaauuugcauucgcaa

SEQ ID NO: 478037 - RNA, 62 nt, hsa
cacuacaaucaccagcuuuuaaaacaacagcuaccagaaauacaaagagugccauuggaaca

SEQ ID NO: 478038 - RNA, 62 nt, hsa
ccagguggugggaauaauuuacaaucuguccaaccagaaaagaauguguguguuugagcagc

SEQ ID NO: 478039 - RNA, 62 nt, hsa
gcagggcacugagacacccguccguguuccuaaccagaaauccuaaagaagaggaauuauac

SEQ ID NO: 478040 - RNA, 62 nt, hsa
ccaggucuucagcuaagcucaaccaauugucaaccagaaaauguuuaaauuuaccuacagcc

SEQ ID NO: 478041 - RNA, 62 nt, hsa
gagaaaaaaaggaugugacagaagcagagaugaccagaaagcacaggggcaggguucugacu

SEQ ID NO: 478042 - RNA, 62 nt, hsa
aauaaguacuccuaaagugaccauuauuagggaccagaaaauuauaucuuggcuaaguaaua

SEQ ID NO: 478043 - RNA, 62 nt, hsa
accaugguaauauuugcaaaaggucuggccauaccagaaaaguacaguugagauaguuaaga

SEQ ID NO: 478044 - RNA, 62 nt, hsa
aggaauaggaacuacaacuucauaaaugaggaaccagaaaagguaaaaaaaaaaaaaaaaac

SEQ ID NO: 478045 - RNA, 62 nt, hsa
guggauaccuaguagucucugccauacccuugaccagaaauuuuucuucuaaagaauuuaau

SEQ ID NO: 478046 - RNA, 62 nt, hsa
ccuuuaaauaugcuuuuugcuuucaaaaauaaaccagaaaaccuauauccuaugauacaacu

SEQ ID NO: 478047 - RNA, 62 nt, hsa
gccuguacuaucauauaauuuaauguauauacaccagaaacuauuuuucaaacuuuuuuuac

SEQ ID NO: 478048 - RNA, 62 nt, hsa
uaacgaauucuugaguuuguuuucuaaaggagaccagaaauccacuauuacaaauguauuug

SEQ ID NO: 478049 - RNA, 62 nt, hsa
auuaucuuuguguauaugcuucauguuauuuaaccagaaaugucuuaucucuaaaaauuuuu

SEQ ID NO: 478050 - RNA, 62 nt, hsa
ucaagccuacaaugcccuagaggaagaguaaaaccagaaauucaugcuggcuuaaauaaucu

SEQ ID NO: 478051 - RNA, 62 nt, hsa
uugcuucaaucagguuugguggaggcaaccugaccagaaacacuucgcugcugcaagccaga

SEQ ID NO: 478052 - RNA, 62 nt, hsa
gucccuuuguaauuggcuucuaacagaauucaaccagaaauaauugauaaugugaauuuuug

SEQ ID NO: 478053 - RNA, 62 nt, hsa
auacugacuagcaaccauggaaugaaugugugaccagaaaguggcuuugacaccaagugcua

SEQ ID NO: 478054 - RNA, 62 nt, hsa
auauuuacacuaauuuuuuuaucuuuauugcuaccagaaaaaaaugcgaacgaaugcauugc

SEQ ID NO: 478055 - RNA, 62 nt, hsa
uugcccagcaggaaaaucauguaaguuauaccaccagaaagcaaaaggagcaugguuuggug

SEQ ID NO: 478056 - RNA, 62 nt, hsa
ucauccucagaaaagccuugcccugguguucuaccagaaaaacgucucccaaucacccagga

SEQ ID NO: 478057 - RNA, 62 nt, hsa
agacagagagcagaucaauguguacuucagacaccagaaagucugguggcuuuggucccaag

SEQ ID NO: 478058 - RNA, 53 nt, hsa
acgaagggaauuucugcugaagaaccagaaaaaagaaagcacaacaccuuucc

SEQ ID NO: 478059 - RNA, 62 nt, hsa
guuugcauucacaugaaggaauugcuuuucacaccagaaauucagacuuagucaauguuggc

SEQ ID NO: 478060 - RNA, 62 nt, hsa
auccuuuagccagcguuucaaccucauucaacaccagaaaguucacaguggaaaaaaucuug

SEQ ID NO: 478061 - RNA, 62 nt, hsa
agguuucagccaaaggccuaacccuauucaacaccagaaaguuuacacuggagaaaggccuu

SEQ ID NO: 478062 - RNA, 62 nt, hsa
uaucuaugucucgacuuuucugaugaaguuauaccagaaaaguuaauuauuugaugggccug

SEQ ID NO: 478063 - RNA, 62 nt, hsa
aguuaauuauuugaugggccugccaugugaaaaccagaaaauaaccucguacucacaagcca

SEQ ID NO: 478064 - RNA, 64 nt, hsa; identical to SEQ ID NO: 93499

SEQ ID NO: 478065 - RNA, 64 nt, hsa; identical to SEQ ID NO: 93500

SEQ ID NO: 478066 - RNA, 64 nt, hsa; identical to SEQ ID NO: 93501

SEQ ID NO: 478067 - RNA, 64 nt, hsa; identical to SEQ ID NO: 93502

SEQ ID NO: 478068 - RNA, 64 nt, hsa; identical to SEQ ID NO: 93503

SEQ ID NO: 478069 - RNA, 64 nt, hsa; identical to SEQ ID NO: 93504

SEQ ID NO: 478070 - RNA, 64 nt, hsa; identical to SEQ ID NO: 93505

SEQ ID NO: 478071 - RNA, 64 nt, hsa; identical to SEQ ID NO: 93506

SEQ ID NO: 478072 - RNA, 64 nt, hsa; identical to SEQ ID NO: 93507

SEQ ID NO: 478073 - RNA, 64 nt, hsa; identical to SEQ ID NO: 93508

SEQ ID NO: 478074 - RNA, 64 nt, hsa; identical to SEQ ID NO: 93509

SEQ ID NO: 478075 - RNA, 64 nt, hsa; identical to SEQ ID NO: 93510

SEQ ID NO: 478076 - RNA, 64 nt, hsa; identical to SEQ ID NO: 93511

SEQ ID NO: 478077 - RNA, 64 nt, hsa; identical to SEQ ID NO: 93512

SEQ ID NO: 478078 - RNA, 64 nt, hsa; identical to SEQ ID NO: 93513

SEQ ID NO: 478079 - RNA, 64 nt, hsa; identical to SEQ ID NO: 93514

SEQ ID NO: 478080 - RNA, 64 nt, hsa; identical to SEQ ID NO: 93515

SEQ ID NO: 478081 - RNA, 64 nt, hsa; identical to SEQ ID NO: 93516

SEQ ID NO: 478082 - RNA, 64 nt, hsa; identical to SEQ ID NO: 93517

SEQ ID NO: 478083 - RNA, 64 nt, hsa; identical to SEQ ID NO: 93518

SEQ ID NO: 478084 - RNA, 64 nt, hsa; identical to SEQ ID NO: 93519

SEQ ID NO: 478085 - RNA, 64 nt, hsa; identical to SEQ ID NO: 93520

SEQ ID NO: 478086 - RNA, 64 nt, hsa; identical to SEQ ID NO: 93521

SEQ ID NO: 478087 - RNA, 64 nt, hsa; identical to SEQ ID NO: 93522

SEQ ID NO: 478088 - RNA, 64 nt, hsa; identical to SEQ ID NO: 93523

SEQ ID NO: 478089 - RNA, 64 nt, hsa; identical to SEQ ID NO: 93524

SEQ ID NO: 478090 - RNA, 64 nt, hsa; identical to SEQ ID NO: 93525

SEQ ID NO: 478091 - RNA, 64 nt, hsa; identical to SEQ ID NO: 93526

SEQ ID NO: 478092 - RNA, 64 nt, hsa; identical to SEQ ID NO: 93527

SEQ ID NO: 478093 - RNA, 64 nt, hsa; identical to SEQ ID NO: 93528

SEQ ID NO: 478094 - RNA, 64 nt, hsa; identical to SEQ ID NO: 93529

SEQ ID NO: 478095 - RNA, 64 nt, hsa; identical to SEQ ID NO: 93530

SEQ ID NO: 478096 - RNA, 64 nt, hsa; identical to SEQ ID NO: 93531

SEQ ID NO: 478097 - RNA, 64 nt, hsa; identical to SEQ ID NO: 93532

SEQ ID NO: 478098 - RNA, 64 nt, hsa; identical to SEQ ID NO: 93533

SEQ ID NO: 478099 - RNA, 64 nt, hsa; identical to SEQ ID NO: 93534

SEQ ID NO: 478100 - RNA, 64 nt, hsa; identical to SEQ ID NO: 93535

SEQ ID NO: 478101 - RNA, 64 nt, hsa; identical to SEQ ID NO: 93536

SEQ ID NO: 478102 - RNA, 64 nt, hsa; identical to SEQ ID NO: 93537

SEQ ID NO: 478103 - RNA, 64 nt, hsa; identical to SEQ ID NO: 93538

SEQ ID NO: 478104 - RNA, 64 nt, hsa; identical to SEQ ID NO: 93539

SEQ ID NO: 478105 - RNA, 64 nt, hsa; identical to SEQ ID NO: 93540

SEQ ID NO: 478106 - RNA, 64 nt, hsa; identical to SEQ ID NO: 93541

SEQ ID NO: 478107 - RNA, 64 nt, hsa; identical to SEQ ID NO: 93542

SEQ ID NO: 478108 - RNA, 64 nt, hsa; identical to SEQ ID NO: 93543

SEQ ID NO: 478109 - RNA, 64 nt, hsa; identical to SEQ ID NO: 93544

SEQ ID NO: 478110 - RNA, 64 nt, hsa; identical to SEQ ID NO: 93545

SEQ ID NO: 478111 - RNA, 64 nt, hsa; identical to SEQ ID NO: 93546

SEQ ID NO: 478112 - RNA, 64 nt, hsa; identical to SEQ ID NO: 93547

SEQ ID NO: 478113 - RNA, 64 nt, hsa; identical to SEQ ID NO: 93548

SEQ ID NO: 478114 - RNA, 64 nt, hsa; identical to SEQ ID NO: 93549

SEQ ID NO: 478115 - RNA, 64 nt, hsa; identical to SEQ ID NO: 93550

SEQ ID NO: 478116 - RNA, 64 nt, hsa; identical to SEQ ID NO: 93551

SEQ ID NO: 478117 - RNA, 64 nt, hsa; identical to SEQ ID NO: 93552

SEQ ID NO: 478118 - RNA, 64 nt, hsa; identical to SEQ ID NO: 93553

SEQ ID NO: 478119 - RNA, 64 nt, hsa; identical to SEQ ID NO: 93554

SEQ ID NO: 478120 - RNA, 64 nt, hsa; identical to SEQ ID NO: 93555

SEQ ID NO: 478121 - RNA, 64 nt, hsa; identical to SEQ ID NO: 93556

SEQ ID NO: 478122 - RNA, 64 nt, hsa; identical to SEQ ID NO: 93557

SEQ ID NO: 478123 - RNA, 64 nt, hsa; identical to SEQ ID NO: 93558

SEQ ID NO: 478124 - RNA, 64 nt, hsa; identical to SEQ ID NO: 93559

SEQ ID NO: 478125 - RNA, 64 nt, hsa; identical to SEQ ID NO: 93560

SEQ ID NO: 478126 - RNA, 64 nt, hsa; identical to SEQ ID NO: 93561

SEQ ID NO: 478127 - RNA, 64 nt, hsa; identical to SEQ ID NO: 93562

SEQ ID NO: 478128 - RNA, 64 nt, hsa; identical to SEQ ID NO: 93563

SEQ ID NO: 478129 - RNA, 64 nt, hsa; identical to SEQ ID NO: 93564

SEQ ID NO: 478130 - RNA, 64 nt, hsa; identical to SEQ ID NO: 93565

SEQ ID NO: 478131 - RNA, 64 nt, hsa; identical to SEQ ID NO: 93566

SEQ ID NO: 478132 - RNA, 64 nt, hsa; identical to SEQ ID NO: 93567

SEQ ID NO: 478133 - RNA, 64 nt, hsa; identical to SEQ ID NO: 93568

SEQ ID NO: 478134 - RNA, 64 nt, hsa; identical to SEQ ID NO: 93569

SEQ ID NO: 478135 - RNA, 64 nt, hsa; identical to SEQ ID NO: 93570

SEQ ID NO: 478136 - RNA, 64 nt, hsa; identical to SEQ ID NO: 93571

SEQ ID NO: 478137 - RNA, 64 nt, hsa; identical to SEQ ID NO: 93572

SEQ ID NO: 478138 - RNA, 64 nt, hsa; identical to SEQ ID NO: 93573

SEQ ID NO: 478139 - RNA, 64 nt, hsa; identical to SEQ ID NO: 93574

SEQ ID NO: 478140 - RNA, 64 nt, hsa; identical to SEQ ID NO: 93575

SEQ ID NO: 478141 - RNA, 64 nt, hsa; identical to SEQ ID NO: 93576

SEQ ID NO: 478142 - RNA, 64 nt, hsa; identical to SEQ ID NO: 93577

SEQ ID NO: 478143 - RNA, 64 nt, hsa; identical to SEQ ID NO: 93578

SEQ ID NO: 478144 - RNA, 64 nt, hsa; identical to SEQ ID NO: 93579

SEQ ID NO: 478145 - RNA, 64 nt, hsa; identical to SEQ ID NO: 93580

SEQ ID NO: 478146 - RNA, 64 nt, hsa; identical to SEQ ID NO: 93581

SEQ ID NO: 478147 - RNA, 64 nt, hsa; identical to SEQ ID NO: 93582

SEQ ID NO: 478148 - RNA, 64 nt, hsa; identical to SEQ ID NO: 90702

SEQ ID NO: 478149 - RNA, 64 nt, hsa; identical to SEQ ID NO: 90703

SEQ ID NO: 478150 - RNA, 64 nt, hsa; identical to SEQ ID NO: 90704

SEQ ID NO: 478151 - RNA, 64 nt, hsa; identical to SEQ ID NO: 90705

SEQ ID NO: 478152 - RNA, 64 nt, hsa; identical to SEQ ID NO: 90706

SEQ ID NO: 478153 - RNA, 64 nt, hsa; identical to SEQ ID NO: 90707

SEQ ID NO: 478154 - RNA, 64 nt, hsa; identical to SEQ ID NO: 90708

SEQ ID NO: 478155 - RNA, 64 nt, hsa; identical to SEQ ID NO: 90709

SEQ ID NO: 478156 - RNA, 64 nt, hsa; identical to SEQ ID NO: 90710

SEQ ID NO: 478157 - RNA, 64 nt, hsa; identical to SEQ ID NO: 90711

SEQ ID NO: 478158 - RNA, 64 nt, hsa; identical to SEQ ID NO: 90712

SEQ ID NO: 478159 - RNA, 64 nt, hsa; identical to SEQ ID NO: 90713

SEQ ID NO: 478160 - RNA, 64 nt, hsa; identical to SEQ ID NO: 90714

SEQ ID NO: 478161 - RNA, 64 nt, hsa; identical to SEQ ID NO: 90715

SEQ ID NO: 478162 - RNA, 64 nt, hsa; identical to SEQ ID NO: 90716

SEQ ID NO: 478163 - RNA, 64 nt, hsa; identical to SEQ ID NO: 90717

SEQ ID NO: 478164 - RNA, 64 nt, hsa; identical to SEQ ID NO: 90718

SEQ ID NO: 478165 - RNA, 64 nt, hsa; identical to SEQ ID NO: 90719

SEQ ID NO: 478166 - RNA, 64 nt, hsa; identical to SEQ ID NO: 90720

SEQ ID NO: 478167 - RNA, 64 nt, hsa; identical to SEQ ID NO: 90721

SEQ ID NO: 478168 - RNA, 64 nt, hsa; identical to SEQ ID NO: 90722

SEQ ID NO: 478169 - RNA, 64 nt, hsa; identical to SEQ ID NO: 90723

SEQ ID NO: 478170 - RNA, 64 nt, hsa; identical to SEQ ID NO: 90724

SEQ ID NO: 478171 - RNA, 64 nt, hsa; identical to SEQ ID NO: 90725

SEQ ID NO: 478172 - RNA, 64 nt, hsa; identical to SEQ ID NO: 90726

SEQ ID NO: 478173 - RNA, 64 nt, hsa; identical to SEQ ID NO: 90727

SEQ ID NO: 478174 - RNA, 64 nt, hsa; identical to SEQ ID NO: 90728

SEQ ID NO: 478175 - RNA, 64 nt, hsa; identical to SEQ ID NO: 90729

SEQ ID NO: 478176 - RNA, 64 nt, hsa; identical to SEQ ID NO: 90730

SEQ ID NO: 478177 - RNA, 64 nt, hsa; identical to SEQ ID NO: 90731

SEQ ID NO: 478178 - RNA, 64 nt, hsa; identical to SEQ ID NO: 90732

SEQ ID NO: 478179 - RNA, 64 nt, hsa; identical to SEQ ID NO: 90733

SEQ ID NO: 478180 - RNA, 64 nt, hsa; identical to SEQ ID NO: 90734

SEQ ID NO: 478181 - RNA, 64 nt, hsa; identical to SEQ ID NO: 50680

SEQ ID NO: 478182 - RNA, 64 nt, hsa; identical to SEQ ID NO: 50681

SEQ ID NO: 478183 - RNA, 64 nt, hsa; identical to SEQ ID NO: 50682

SEQ ID NO: 478184 - RNA, 64 nt, hsa; identical to SEQ ID NO: 50683

SEQ ID NO: 478185 - RNA, 64 nt, hsa; identical to SEQ ID NO: 50684

SEQ ID NO: 478186 - RNA, 64 nt, hsa; identical to SEQ ID NO: 50685

SEQ ID NO: 478187 - RNA, 64 nt, hsa; identical to SEQ ID NO: 50686

SEQ ID NO: 478188 - RNA, 64 nt, hsa; identical to SEQ ID NO: 50687

SEQ ID NO: 478189 - RNA, 64 nt, hsa; identical to SEQ ID NO: 50688

SEQ ID NO: 478190 - RNA, 64 nt, hsa; identical to SEQ ID NO: 50689

SEQ ID NO: 478191 - RNA, 64 nt, hsa; identical to SEQ ID NO: 50690

SEQ ID NO: 478192 - RNA, 64 nt, hsa; identical to SEQ ID NO: 50691

SEQ ID NO: 478193 - RNA, 64 nt, hsa; identical to SEQ ID NO: 50692

SEQ ID NO: 478194 - RNA, 64 nt, hsa; identical to SEQ ID NO: 50693

SEQ ID NO: 478195 - RNA, 64 nt, hsa; identical to SEQ ID NO: 153237

SEQ ID NO: 478196 - RNA, 64 nt, hsa; identical to SEQ ID NO: 153238

SEQ ID NO: 478197 - RNA, 64 nt, hsa; identical to SEQ ID NO: 153239

SEQ ID NO: 478198 - RNA, 64 nt, hsa; identical to SEQ ID NO: 153240

SEQ ID NO: 478199 - RNA, 64 nt, hsa; identical to SEQ ID NO: 153241

SEQ ID NO: 478200 - RNA, 64 nt, hsa; identical to SEQ ID NO: 153242

SEQ ID NO: 478201 - RNA, 64 nt, hsa; identical to SEQ ID NO: 153243

SEQ ID NO: 478202 - RNA, 64 nt, hsa; identical to SEQ ID NO: 153244

SEQ ID NO: 478203 - RNA, 64 nt, hsa; identical to SEQ ID NO: 153245

SEQ ID NO: 478204 - RNA, 64 nt, hsa; identical to SEQ ID NO: 153246

SEQ ID NO: 478205 - RNA, 64 nt, hsa; identical to SEQ ID NO: 50680

SEQ ID NO: 478206 - RNA, 64 nt, hsa; identical to SEQ ID NO: 50681

SEQ ID NO: 478207 - RNA, 64 nt, hsa; identical to SEQ ID NO: 50682

SEQ ID NO: 478208 - RNA, 64 nt, hsa; identical to SEQ ID NO: 50683

SEQ ID NO: 478209 - RNA, 64 nt, hsa; identical to SEQ ID NO: 50684

SEQ ID NO: 478210 - RNA, 64 nt, hsa; identical to SEQ ID NO: 50685

SEQ ID NO: 478211 - RNA, 64 nt, hsa; identical to SEQ ID NO: 50686

SEQ ID NO: 478212 - RNA, 64 nt, hsa; identical to SEQ ID NO: 50687

SEQ ID NO: 478213 - RNA, 64 nt, hsa; identical to SEQ ID NO: 50688

SEQ ID NO: 478214 - RNA, 64 nt, hsa; identical to SEQ ID NO: 50689

SEQ ID NO: 478215 - RNA, 64 nt, hsa; identical to SEQ ID NO: 50690

SEQ ID NO: 478216 - RNA, 64 nt, hsa; identical to SEQ ID NO: 50691

SEQ ID NO: 478217 - RNA, 64 nt, hsa; identical to SEQ ID NO: 50692

SEQ ID NO: 478218 - RNA, 64 nt, hsa; identical to SEQ ID NO: 50693

SEQ ID NO: 478219 - RNA, 64 nt, hsa; identical to SEQ ID NO: 153237

SEQ ID NO: 478220 - RNA, 64 nt, hsa; identical to SEQ ID NO: 153238

SEQ ID NO: 478221 - RNA, 64 nt, hsa; identical to SEQ ID NO: 153239

SEQ ID NO: 478222 - RNA, 64 nt, hsa; identical to SEQ ID NO: 153240

SEQ ID NO: 478223 - RNA, 64 nt, hsa; identical to SEQ ID NO: 153241

SEQ ID NO: 478224 - RNA, 64 nt, hsa; identical to SEQ ID NO: 153242

SEQ ID NO: 478225 - RNA, 64 nt, hsa; identical to SEQ ID NO: 153243

SEQ ID NO: 478226 - RNA, 64 nt, hsa; identical to SEQ ID NO: 153244

SEQ ID NO: 478227 - RNA, 64 nt, hsa; identical to SEQ ID NO: 153245

SEQ ID NO: 478228 - RNA, 64 nt, hsa; identical to SEQ ID NO: 153246

SEQ ID NO: 478229 - RNA, 64 nt, hsa
aaggcucccggcugccuccccgccaccgagcuuguagccugaaugccuggcugucgcauggagc

SEQ ID NO: 478230 - RNA, 64 nt, hsa
gcuagcucuccuucgccuucugccaugcuggaaguagccugaggcccucaccagaagcagacgc

SEQ ID NO: 478231 - RNA, 64 nt, hsa
caaccuagaccuggaccugggugggaggaaacuguagccugaguguccacagggacacacguga

SEQ ID NO: 478232 - RNA, 64 nt, hsa
auuugaccucgaaugcuccuaaaagagaacuugauagccugacagcagagaaguauuauuuggu

SEQ ID NO: 478233 - RNA, 62 nt, hsa
gcaauagagcugcuugguuggaggaagugaagcuggcuuaguaccagcagcugaucucuucc

SEQ ID NO: 478234 - RNA, 62 nt, hsa
gcuauuuccaagaucucuuacugcugcuucuccuggcuuacuggccagaaacuagcucacuc

SEQ ID NO: 478235 - RNA, 62 nt, hsa
acuacccuuuagguugaaguuugaccuggcuccuggcuuaccagucuccuggaagcagagca

SEQ ID NO: 478236 - RNA, 62 nt, hsa
ugaccucuagacacuaauuuuauccuuugaggcuggcuuaauuagggaugcugucauuaagg

SEQ ID NO: 478237 - RNA, 62 nt, hsa
ugcaagcauauuggugcccuccaugaccaccucuggcuuaggacuuggcccuguuaugagcu

SEQ ID NO: 478238 - RNA, 62 nt, hsa
ggacccaaaugggcacuuucuugucugagacucuggcuuauuccagguuggcugauguguug

SEQ ID NO: 478239 - RNA, 62 nt, hsa
agugaugagauuauaggcgugagccaccgcgccuggcuuauacuuucuuaauaaaaaggaga

SEQ ID NO: 478240 - RNA, 62 nt, hsa
caccagacugauuucuccgauguugcacuuggcuggcuuaugccucugagaucggugccacg

SEQ ID NO: 478241 - RNA, 62 nt, hsa
gcugcagauugacaggcgaggcucagaaacuccuggcuuagauugaagugugugugaugggg

SEQ ID NO: 478242 - RNA, 62 nt, hsa
gcacacaggaugcagccuucccccucccaggccuggcuuauuccaagaggcugagccaaugg

SEQ ID NO: 478243 - RNA, 62 nt, hsa
auccugggggagccccuccccccccugaaucccuggcuuagcuaccuuccugccugugcacc

SEQ ID NO: 478244 - RNA, 62 nt, hsa
uuuuuccuccaguuuuuaacaagaucacauaacuggcuuauuuuuaacagcuuugucaaacu

SEQ ID NO: 478245 - RNA, 62 nt, hsa
uuuuauugaguuaaaugaguucuuaauaaucucuggcuuacaaguccuuaauuuaucaaaua

SEQ ID NO: 478246 - RNA, 62 nt, hsa
gaaaaauaaaugaaguaucucuaggaaacagucuggcuuaacuauuuuugaaaauauaacug

SEQ ID NO: 478247 - RNA, 62 nt, hsa
gcagugcugaaggaggagauccagguuuaaaucuggcuuauuaacucaagccaauuuuaagg

SEQ ID NO: 478248 - RNA, 62 nt, hsa
ccuguuucuugcuccuguucucagccuguuaucuggcuuauccaucaguuucugaaccaaca

SEQ ID NO: 478249 - RNA, 62 nt, hsa
auuucuuuuucaccguuuuuaccuuuuguccucuggcuuauugccucagaguugcaagaugg

SEQ ID NO: 478250 - RNA, 64 nt, hsa; identical to SEQ ID NO: 275585

SEQ ID NO: 478251 - RNA, 64 nt, hsa; identical to SEQ ID NO: 275586

SEQ ID NO: 478252 - RNA, 64 nt, hsa; identical to SEQ ID NO: 275587

SEQ ID NO: 478253 - RNA, 64 nt, hsa; identical to SEQ ID NO: 275588

SEQ ID NO: 478254 - RNA, 64 nt, hsa; identical to SEQ ID NO: 275589

SEQ ID NO: 478255 - RNA, 64 nt, hsa; identical to SEQ ID NO: 275590

SEQ ID NO: 478256 - RNA, 64 nt, hsa; identical to SEQ ID NO: 275591

SEQ ID NO: 478257 - RNA, 64 nt, hsa; identical to SEQ ID NO: 275592

SEQ ID NO: 478258 - RNA, 64 nt, hsa; identical to SEQ ID NO: 275593

SEQ ID NO: 478259 - RNA, 64 nt, hsa; identical to SEQ ID NO: 275594

SEQ ID NO: 478260 - RNA, 64 nt, hsa; identical to SEQ ID NO: 287388

SEQ ID NO: 478261 - RNA, 64 nt, hsa; identical to SEQ ID NO: 287389

SEQ ID NO: 478262 - RNA, 64 nt, hsa; identical to SEQ ID NO: 287390

SEQ ID NO: 478263 - RNA, 64 nt, hsa; identical to SEQ ID NO: 287391

SEQ ID NO: 478264 - RNA, 64 nt, hsa; identical to SEQ ID NO: 287392

SEQ ID NO: 478265 - RNA, 64 nt, hsa; identical to SEQ ID NO: 287393

SEQ ID NO: 478266 - RNA, 64 nt, hsa; identical to SEQ ID NO: 287394

SEQ ID NO: 478267 - RNA, 64 nt, hsa; identical to SEQ ID NO: 287395

SEQ ID NO: 478268 - RNA, 64 nt, hsa; identical to SEQ ID NO: 287396

SEQ ID NO: 478269 - RNA, 64 nt, hsa; identical to SEQ ID NO: 287397

SEQ ID NO: 478270 - RNA, 64 nt, hsa; identical to SEQ ID NO: 287398

SEQ ID NO: 478271 - RNA, 64 nt, hsa; identical to SEQ ID NO: 287399

SEQ ID NO: 478272 - RNA, 64 nt, hsa
aucacugagguuggccagccccugccaaguguuguguaggcaaagcacuuguuaguggcuuccu

SEQ ID NO: 478273 - RNA, 64 nt, hsa
gaaugauauacuagaugaaauaguguucaaaaccuguaggcacucucuggcuaaaaacaaacuc

SEQ ID NO: 478274 - RNA, 64 nt, hsa
ugggggccauaccuguuccagcucuguucccaggguggggcagggagguggggguugggggagu

SEQ ID NO: 478275 - RNA, 64 nt, hsa
aggguggggcagggagguggggguugggggaguaguggggcacggcuccuaagauccagccccc

SEQ ID NO: 478276 - RNA, 64 nt, hsa
uccgccuuuccggggcugcuggccuggcccuugaguggggcagccuccuugccuggaacucacu

SEQ ID NO: 478277 - RNA, 64 nt, hsa
cagguggaggugccaggaagcucccucccucacuguggggcauuucaccauucaaacaggucga

SEQ ID NO: 478278 - RNA, 64 nt, hsa
gcggagacugcagaccagugcuucacuguguggaguggggcaggcaggggcuggaccccaggga

SEQ ID NO: 478279 - RNA, 64 nt, hsa
ugggcagugcugguaggguuucaaggugcuauuaguggggcaggggcagggcggcugcucacag

SEQ ID NO: 478280 - RNA, 64 nt, hsa
ucuccucaccaucuaaggcagaggaugggaugugguggggcagggaucugguacagacauaggc

SEQ ID NO: 478281 - RNA, 64 nt, hsa
gaaggcugcacacaggcacauuccuucuuccacaguggggcaccaaggauucuguccucauugc

SEQ ID NO: 478282 - RNA, 64 nt, hsa
uccaucauauuuuucaggacagauaguuuuuacuguggggcaaauagguuaaaauuacacuaug

SEQ ID NO: 478283 - RNA, 64 nt, hsa
uuuaaguaauuauaucuucucuucuugcugguggguggggcaguuugguuuaguguuauacuuu

SEQ ID NO: 478284 - RNA, 64 nt, hsa
aacggucccacggugcggaucucccccuucccuuguggggcacagcuggccugggccuccaauc

SEQ ID NO: 478285 - RNA, 64 nt, hsa
gccgggcccgagugucugccccucggcccucaggguggggcacuuagcacccagaagggaccaa

SEQ ID NO: 478286 - RNA, 64 nt, hsa
agaccucagccgccucggggaugagaggggacucguggggcaagcaagcugcccugugcucuga

SEQ ID NO: 478287 - RNA, 64 nt, hsa
uguuuccugcagggcuggcccuggcucgggcaggguggggcaucaccaccucacuggccuugcu

SEQ ID NO: 478288 - RNA, 64 nt, hsa
agagagaggggcucaggaacugggagccucguggguggggcagaugcuccgcggccuggagugg

SEQ ID NO: 478289 - RNA, 64 nt, hsa
uggcagugcuggagaugaccccgagccccuccccguggggcacccaggagggcccugccggaau

SEQ ID NO: 478290 - RNA, 64 nt, hsa
ccugggcugcgucccacauccacccuccugccccguggggcaauuuaaccuuuuucaugaaagu

SEQ ID NO: 478291 - RNA, 64 nt, hsa
gagagaggagaccaaaaugaggugguggcacaggguggggcaaggagauccucucuaaggccuc

SEQ ID NO: 478292 - RNA, 64 nt, hsa
aaucuuggugcuuuguggcucaccacagccaucuguggggcaggcacacacaccucccgccagc

SEQ ID NO: 478293 - RNA, 64 nt, hsa
cuauugacgggccuugguagccaccaguggguguguggggcaguggcuguggggguguaagaau

SEQ ID NO: 478294 - RNA, 64 nt, hsa
caccccuuucuaccccagggcagggcagggcuggguggggcaagaucccccagcccgacuagac

SEQ ID NO: 478295 - RNA, 64 nt, hsa
gagugccacaggaagucagacaaggaaggagaguguggggcaggugccguuuaaauggggggcg

SEQ ID NO: 478296 - RNA, 64 nt, hsa
gaaaagcuaagggcuugauuccuagccccguucuguggggcacugggugauacucaguuucuug

SEQ ID NO: 478297 - RNA, 64 nt, hsa
uuguucagguagucgcccuucugguuuguucucuguggggcaguuggugggggcugggggaaga

SEQ ID NO: 478298 - RNA, 64 nt, hsa
uugccagcucuuucuuauucuacuacacaagccgccaacucaacugagagcuaaagagacuaga

SEQ ID NO: 478299 - RNA, 64 nt, hsa
ugagagcuaaagagacuagaaaagagauaagcugccaacucaacugagaacaagaaacuagaag

SEQ ID NO: 478300 - RNA, 64 nt, hsa
uuuauucuucaacaaugucuacuccauccccaacccaacucacagcccuaugacuacuaucuuu

SEQ ID NO: 478301 - RNA, 64 nt, hsa
ucaaaacauugcuuugguuggugcauuuaaguauccaacucaaaaagcauaucaaauauuuugg

SEQ ID NO: 478302 - RNA, 64 nt, hsa
guaugagcgcuuggcgcuccuccuccguccuaucccaacucacccccaaacccccaucccuucc

SEQ ID NO: 478303 - RNA, 64 nt, hsa
gaccuugaccccccuguccgcgccuucaaggcucccaacucaggcaccagguccgcaccucucc

SEQ ID NO: 478304 - RNA, 64 nt, hsa; identical to SEQ ID NO: 119503

SEQ ID NO: 478305 - RNA, 64 nt, hsa; identical to SEQ ID NO: 119504

SEQ ID NO: 478306 - RNA, 64 nt, hsa; identical to SEQ ID NO: 119505

SEQ ID NO: 478307 - RNA, 64 nt, hsa; identical to SEQ ID NO: 119506

SEQ ID NO: 478308 - RNA, 64 nt, hsa; identical to SEQ ID NO: 119507

SEQ ID NO: 478309 - RNA, 64 nt, hsa; identical to SEQ ID NO: 119508

SEQ ID NO: 478310 - RNA, 64 nt, hsa; identical to SEQ ID NO: 119509

SEQ ID NO: 478311 - RNA, 64 nt, hsa; identical to SEQ ID NO: 119510

SEQ ID NO: 478312 - RNA, 64 nt, hsa; identical to SEQ ID NO: 119511

SEQ ID NO: 478313 - RNA, 64 nt, hsa; identical to SEQ ID NO: 119512

SEQ ID NO: 478314 - RNA, 64 nt, hsa; identical to SEQ ID NO: 119513

SEQ ID NO: 478315 - RNA, 64 nt, hsa; identical to SEQ ID NO: 119514

SEQ ID NO: 478316 - RNA, 64 nt, hsa; identical to SEQ ID NO: 119515

SEQ ID NO: 478317 - RNA, 64 nt, hsa; identical to SEQ ID NO: 119516

SEQ ID NO: 478318 - RNA, 64 nt, hsa; identical to SEQ ID NO: 119517

SEQ ID NO: 478319 - RNA, 64 nt, hsa; identical to SEQ ID NO: 119518

SEQ ID NO: 478320 - RNA, 64 nt, hsa; identical to SEQ ID NO: 119519

SEQ ID NO: 478321 - RNA, 64 nt, hsa; identical to SEQ ID NO: 119520

SEQ ID NO: 478322 - RNA, 64 nt, hsa; identical to SEQ ID NO: 119521

SEQ ID NO: 478323 - RNA, 64 nt, hsa; identical to SEQ ID NO: 119522

SEQ ID NO: 478324 - RNA, 64 nt, hsa; identical to SEQ ID NO: 119523

SEQ ID NO: 478325 - RNA, 64 nt, hsa; identical to SEQ ID NO: 119524

SEQ ID NO: 478326 - RNA, 64 nt, hsa; identical to SEQ ID NO: 119525

SEQ ID NO: 478327 - RNA, 64 nt, hsa; identical to SEQ ID NO: 119526

SEQ ID NO: 478328 - RNA, 64 nt, hsa; identical to SEQ ID NO: 119527

SEQ ID NO: 478329 - RNA, 64 nt, hsa; identical to SEQ ID NO: 119528

SEQ ID NO: 478330 - RNA, 64 nt, hsa; identical to SEQ ID NO: 119529

SEQ ID NO: 478331 - RNA, 64 nt, hsa; identical to SEQ ID NO: 119530

SEQ ID NO: 478332 - RNA, 64 nt, hsa; identical to SEQ ID NO: 119531

SEQ ID NO: 478333 - RNA, 64 nt, hsa; identical to SEQ ID NO: 119532

SEQ ID NO: 478334 - RNA, 64 nt, hsa; identical to SEQ ID NO: 119533

SEQ ID NO: 478335 - RNA, 64 nt, hsa; identical to SEQ ID NO: 119534

SEQ ID NO: 478336 - RNA, 64 nt, hsa; identical to SEQ ID NO: 119535

SEQ ID NO: 478337 - RNA, 64 nt, hsa; identical to SEQ ID NO: 119536

SEQ ID NO: 478338 - RNA, 64 nt, hsa; identical to SEQ ID NO: 119537

SEQ ID NO: 478339 - RNA, 64 nt, hsa; identical to SEQ ID NO: 119538

SEQ ID NO: 478340 - RNA, 64 nt, hsa; identical to SEQ ID NO: 119539

SEQ ID NO: 478341 - RNA, 64 nt, hsa; identical to SEQ ID NO: 119540

SEQ ID NO: 478342 - RNA, 64 nt, hsa; identical to SEQ ID NO: 119541

SEQ ID NO: 478343 - RNA, 64 nt, hsa; identical to SEQ ID NO: 119542

SEQ ID NO: 478344 - RNA, 64 nt, hsa; identical to SEQ ID NO: 119543

SEQ ID NO: 478345 - RNA, 64 nt, hsa; identical to SEQ ID NO: 119544

SEQ ID NO: 478346 - RNA, 64 nt, hsa; identical to SEQ ID NO: 119545

SEQ ID NO: 478347 - RNA, 64 nt, hsa; identical to SEQ ID NO: 119546

SEQ ID NO: 478348 - RNA, 64 nt, hsa; identical to SEQ ID NO: 119547

SEQ ID NO: 478349 - RNA, 64 nt, hsa; identical to SEQ ID NO: 119548

SEQ ID NO: 478350 - RNA, 64 nt, hsa; identical to SEQ ID NO: 119549

SEQ ID NO: 478351 - RNA, 64 nt, hsa; identical to SEQ ID NO: 119550

SEQ ID NO: 478352 - RNA, 64 nt, hsa; identical to SEQ ID NO: 119551

SEQ ID NO: 478353 - RNA, 64 nt, hsa; identical to SEQ ID NO: 119552

SEQ ID NO: 478354 - RNA, 64 nt, hsa; identical to SEQ ID NO: 119553

SEQ ID NO: 478355 - RNA, 64 nt, hsa; identical to SEQ ID NO: 119554

SEQ ID NO: 478356 - RNA, 64 nt, hsa; identical to SEQ ID NO: 119555

SEQ ID NO: 478357 - RNA, 64 nt, hsa; identical to SEQ ID NO: 119556

SEQ ID NO: 478358 - RNA, 64 nt, hsa; identical to SEQ ID NO: 119557

SEQ ID NO: 478359 - RNA, 64 nt, hsa; identical to SEQ ID NO: 119558

SEQ ID NO: 478360 - RNA, 64 nt, hsa; identical to SEQ ID NO: 119559

SEQ ID NO: 478361 - RNA, 64 nt, hsa; identical to SEQ ID NO: 119560

SEQ ID NO: 478362 - RNA, 64 nt, hsa; identical to SEQ ID NO: 119561

SEQ ID NO: 478363 - RNA, 64 nt, hsa; identical to SEQ ID NO: 119562

SEQ ID NO: 478364 - RNA, 64 nt, hsa; identical to SEQ ID NO: 119563

SEQ ID NO: 478365 - RNA, 64 nt, hsa; identical to SEQ ID NO: 119564

SEQ ID NO: 478366 - RNA, 64 nt, hsa; identical to SEQ ID NO: 119565

SEQ ID NO: 478367 - RNA, 64 nt, hsa; identical to SEQ ID NO: 119566

SEQ ID NO: 478368 - RNA, 64 nt, hsa; identical to SEQ ID NO: 119567

SEQ ID NO: 478369 - RNA, 64 nt, hsa; identical to SEQ ID NO: 119568

SEQ ID NO: 478370 - RNA, 64 nt, hsa; identical to SEQ ID NO: 119569

SEQ ID NO: 478371 - RNA, 64 nt, hsa; identical to SEQ ID NO: 119570

SEQ ID NO: 478372 - RNA, 64 nt, hsa; identical to SEQ ID NO: 119571

SEQ ID NO: 478373 - RNA, 64 nt, hsa; identical to SEQ ID NO: 119572

SEQ ID NO: 478374 - RNA, 64 nt, hsa; identical to SEQ ID NO: 119573

SEQ ID NO: 478375 - RNA, 64 nt, hsa; identical to SEQ ID NO: 119574

SEQ ID NO: 478376 - RNA, 64 nt, hsa; identical to SEQ ID NO: 119575

SEQ ID NO: 478377 - RNA, 64 nt, hsa; identical to SEQ ID NO: 119576

SEQ ID NO: 478378 - RNA, 64 nt, hsa; identical to SEQ ID NO: 119577

SEQ ID NO: 478379 - RNA, 64 nt, hsa; identical to SEQ ID NO: 119578

SEQ ID NO: 478380 - RNA, 64 nt, hsa; identical to SEQ ID NO: 119579

SEQ ID NO: 478381 - RNA, 64 nt, hsa; identical to SEQ ID NO: 119580

SEQ ID NO: 478382 - RNA, 64 nt, hsa; identical to SEQ ID NO: 119581

SEQ ID NO: 478383 - RNA, 64 nt, hsa; identical to SEQ ID NO: 119582

SEQ ID NO: 478384 - RNA, 64 nt, hsa; identical to SEQ ID NO: 119583

SEQ ID NO: 478385 - RNA, 64 nt, hsa; identical to SEQ ID NO: 119584

SEQ ID NO: 478386 - RNA, 64 nt, hsa; identical to SEQ ID NO: 119585

SEQ ID NO: 478387 - RNA, 64 nt, hsa; identical to SEQ ID NO: 119586

SEQ ID NO: 478388 - RNA, 64 nt, hsa; identical to SEQ ID NO: 119587

SEQ ID NO: 478389 - RNA, 64 nt, hsa; identical to SEQ ID NO: 119588

SEQ ID NO: 478390 - RNA, 64 nt, hsa; identical to SEQ ID NO: 119589

SEQ ID NO: 478391 - RNA, 64 nt, hsa; identical to SEQ ID NO: 119590

SEQ ID NO: 478392 - RNA, 64 nt, hsa; identical to SEQ ID NO: 119591

SEQ ID NO: 478393 - RNA, 64 nt, hsa; identical to SEQ ID NO: 119592

SEQ ID NO: 478394 - RNA, 64 nt, hsa; identical to SEQ ID NO: 119593

SEQ ID NO: 478395 - RNA, 64 nt, hsa; identical to SEQ ID NO: 119594

SEQ ID NO: 478396 - RNA, 64 nt, hsa; identical to SEQ ID NO: 119595

SEQ ID NO: 478397 - RNA, 64 nt, hsa; identical to SEQ ID NO: 119596

SEQ ID NO: 478398 - RNA, 64 nt, hsa; identical to SEQ ID NO: 119597

SEQ ID NO: 478399 - RNA, 64 nt, hsa
uaaacacacacacacacacacacacacacacacacauacacagacaaaaacacaaaaacucuga

SEQ ID NO: 478400 - RNA, 64 nt, hsa
gaugguggugguacaguuggaauuagugccaugucauacacaaauguuccacaaggcgggagug

SEQ ID NO: 478401 - RNA, 64 nt, hsa
auguacacacgcagacacagacaccacacacacacauacacacacacacacacacacaccugag

SEQ ID NO: 478402 - RNA, 64 nt, hsa
caagcuuuccugaacuggaacgucgggggcaaagcauacacacacacuccaauccauccaugca

SEQ ID NO: 478403 - RNA, 64 nt, hsa
acgugcacacacacauacauauucauacacaauucauacacaugcaaucauacaugcacacuga

SEQ ID NO: 478404 - RNA, 64 nt, hsa
uaccuauacauacgugcacacacacauacauauucauacacaauucauacacaugcaaucauac

SEQ ID NO: 478405 - RNA, 64 nt, hsa
agaugcuaguguguggcagccaugaaaaguuacacauacacacccacauacagacagaccuacc

SEQ ID NO: 478406 - RNA, 64 nt, hsa
uccuccauguucuucuaaaacauauacauauauacauacacacauacacauauucuucaggucu

SEQ ID NO: 478407 - RNA, 64 nt, hsa
guucuucuaaaacauauacauauauacauacacacauacacauauucuucaggucucuaagccc

SEQ ID NO: 478408 - RNA, 64 nt, hsa
gagagaccuagguucuuacacauaugcacacacgcauacacacaugcacgcacacacacauaca

SEQ ID NO: 478409 - RNA, 64 nt, hsa
ugcacacacgcauacacacaugcacgcacacacacauacacacaugcacgcacgcacgcaugca

SEQ ID NO: 478410 - RNA, 64 nt, hsa
cugcaaguuuaaauauuugagcuuuacaaauaaacauacacaugcucaguuuuuuaaguaaacc

SEQ ID NO: 478411 - RNA, 64 nt, hsa
guaaggcuuauguguauuuuccauauauguaaaacauacacauguaaaauauauguggccauaa

SEQ ID NO: 478412 - RNA, 64 nt, hsa
uuuaaagguauucauggugacucaggaauacacacauacacacacacacacacacacacacaca

SEQ ID NO: 478413 - RNA, 64 nt, hsa
cauacacacacacacacacacacacacacacacacauacacacauauaauuugaaagaggugag

SEQ ID NO: 478414 - RNA, 64 nt, hsa
aauccauaauggacuagaauauaaauuacaaacacauacacacaucuucacuuaaaguuguuuu

SEQ ID NO: 478415 - RNA, 64 nt, hsa
uaaaauguuugccauguauacaccuguaugugcacauacacacauuacacacacacacagaaug

SEQ ID NO: 478416 - RNA, 64 nt, hsa
ggaaagugaugaggaggaagaagagggcuguggucauacacacuguguacguggccaccgcaaa

SEQ ID NO: 478417 - RNA, 64 nt, hsa
cugggauccgguuuucauuuuccgguccuuuugccauacacaguuacagagaucagucaaaucc

SEQ ID NO: 478418 - RNA, 64 nt, hsa
uaggggccuucccucccaggucugugucugauagcauacacacacacauauauauacacacaca

SEQ ID NO: 478419 - RNA, 64 nt, hsa
cacacacacacacacacacacacacacacacauacauacacacacacauauauauacacacaca

SEQ ID NO: 478420 - RNA, 64 nt, hsa
uagcaaucaaccccagaaaauauuaaaaugggaucauacacagaagauagaaaaaucuagcaaa

SEQ ID NO: 478421 - RNA, 64 nt, hsa
uucgccagaagcuguccuuauaacgccuuauacgcauacacagccaggaaacguggagcauugu

SEQ ID NO: 478422 - RNA, 64 nt, hsa
ugaacuuaucuaccugguuaugauacuguggguccauacacaaguaaaauaagauuagacagaa

SEQ ID NO: 478423 - RNA, 64 nt, hsa
caaaaaaaugcaaacuaugaugccauuuaaaacucauacacaugggaggaaaaccuuauauacu

SEQ ID NO: 478424 - RNA, 64 nt, hsa
aaacguauacauauguguauauaugauacauacacauacacacacacgagagacagaaggaaag

SEQ ID NO: 478425 - RNA, 64 nt, hsa
guauguaaacguauacauauguguauauaugauacauacacauacacacacacgagagacagaa

SEQ ID NO: 478426 - RNA, 64 nt, hsa
ugcacacacaugcacacauacacgcacaugcacacauacacaugcaugcacacauacacaggca

SEQ ID NO: 478427 - RNA, 64 nt, hsa
uacacgcacaugcacacauacacaugcaugcacacauacacaggcauacaugcaugcacacaca

SEQ ID NO: 478428 - RNA, 64 nt, hsa
cacgcacacacacaugcacacauacacgugcacacauacacaggcacacaugcaugcacacaua

SEQ ID NO: 478429 - RNA, 64 nt, hsa
cgugcacacauacacaggcacacaugcaugcacacauacacaugcacacacacaugcacacaua

SEQ ID NO: 478430 - RNA, 64 nt, hsa
uauccaugcacacaaacacauauauacacaugcacauacacagauuuuucugcuggccaggugg

SEQ ID NO: 478431 - RNA, 64 nt, hsa
auuagaaauaaguaguaaauuuugauauauuguacauacacacgugugugugugugugugugug

SEQ ID NO: 478432 - RNA, 64 nt, hsa
uguauguaugugaaugugugugaguguguauucacauacacauauauacuggaaccuauaguag

SEQ ID NO: 478433 - RNA, 64 nt, hsa
aggcugugcuccgccauggugucccgguaccuuccauacacagaggagugcagccuucuccaua

SEQ ID NO: 478434 - RNA, 64 nt, hsa
ggaagccagagccccaagcaggacgaaaaagaggcauacacacagcagugugaauagccuggcc

SEQ ID NO: 478435 - RNA, 64 nt, hsa
cgcagccccuccccgccacagagacacaccauuacauacacagacacacacagaaagacacaca

SEQ ID NO: 478436 - RNA, 64 nt, hsa
cccuuccggccacagaaacacaccauuacacacacauacacagaaagacacacacagacacaca

SEQ ID NO: 478437 - RNA, 64 nt, hsa
cacacacccuccccgccacagagacacaccauuacauacacagacacgcaaucgcagauacgcc

SEQ ID NO: 478438 - RNA, 64 nt, hsa
cacacacacccuccccgccacagagacaccauuacauacacagacacacacagaaagacacaga

SEQ ID NO: 478439 - RNA, 64 nt, hsa
cacacacccccuccccaccacagagacaccauuacauacacagacacacacagaaagacacaca

SEQ ID NO: 478440 - RNA, 64 nt, hsa
aucauauauauaauauauuuuuuguaacuaugaacauacacaguuuuccagaaauagauuuuac

SEQ ID NO: 478441 - RNA, 64 nt, hsa
cagguaauaaacauccccaagguuuguggcuggccauacacauaggcaucaguuuaacaaccau

SEQ ID NO: 478442 - RNA, 64 nt, hsa
ggccauauuuguggcccgugcagcuuccaaaucucauacacaacuguucccgauucacguuuuu

SEQ ID NO: 478443 - RNA, 64 nt, hsa
gagccgccgugcccagccauugcauuuuuauucacauacacauuguuaauguggaacaauuuaa

SEQ ID NO: 478444 - RNA, 64 nt, hsa
ucaucaagacaccuuuuuucuaaaauaggcauugcauacacauaugcacacguaugugcaugug

SEQ ID NO: 478445 - RNA, 64 nt, hsa
ugugauuuuguguuuugaauuacugucagaauuacauacacaauuacaacaaacuuuuuuuaaa

SEQ ID NO: 478446 - RNA, 64 nt, hsa
aagcaaaccaauaccuggugaaucuauggacagucauacacauacaucaggggaaaaugugugu

SEQ ID NO: 478447 - RNA, 64 nt, hsa
cuuuuaauguacaucacacacacacucacacucacauacacacacacacacacacucugacugu

SEQ ID NO: 478448 - RNA, 64 nt, hsa
gauuacaggcgugagacagacacacauacacacacauacacacacacagagucuuuauugcaga

SEQ ID NO: 478449 - RNA, 64 nt, hsa
ugagugcuaggauuacaggcgugagacagacacacauacacacacauacacacacacagagucu

SEQ ID NO: 478450 - RNA, 64 nt, hsa
uugcauaggguauuugauacaaucauuaauggaucauacacaauagguuuuuaaaaauuaauaa

SEQ ID NO: 478451 - RNA, 64 nt, hsa
cguuuuacaugaucugauacaaccauuaaugaaucauacacaauagguuuuuuaaaauuaauau

SEQ ID NO: 478452 - RNA, 64 nt, hsa
cucucugaaugcugagcugaagaaauuauacguacauacacacauacauacauacauacaaaua

SEQ ID NO: 478453 - RNA, 64 nt, hsa
ugggucacauuuguuagccacggaaacauagaaacauacacaaggccagaaaaagaagaaggag

SEQ ID NO: 478454 - RNA, 64 nt, hsa
aguguccagauccccagagccacacauacauacacauacacacccuuacccccauccacucuag

SEQ ID NO: 478455 - RNA, 64 nt, hsa
gagggcaguguccagauccccagagccacacauacauacacauacacacccuuacccccaucca

SEQ ID NO: 478456 - RNA, 64 nt, hsa
ccuuuguacaaagcuccucuuuucccuuuuuuuacauacacaagauccucuuggcagguggagc

SEQ ID NO: 478457 - RNA, 64 nt, hsa
cucuggagaggagauugaaauauaauugcacccucauacacauuuaggaaaugguuaagaagug

SEQ ID NO: 478458 - RNA, 64 nt, hsa
ugacucaugcugcuaagaugcacaaccgcacacccauacacaacuacaagggccacaaagcaac

SEQ ID NO: 478459 - RNA, 64 nt, hsa
guggaaagcggccccugcugccccuccacacacacauacacacucacugaucuacagccccugu

SEQ ID NO: 478460 - RNA, 64 nt, hsa
gccauagcucaucccuuucuagauuugacccaaucauacacaugagaaacguacauucauacac

SEQ ID NO: 478461 - RNA, 64 nt, hsa
uuugacccaaucauacacaugagaaacguacauucauacacaagccuuuucacacagcacuccc

SEQ ID NO: 478462 - RNA, 64 nt, hsa
cucuccuucuccaucucacccucccucucucacacauacacacacaaacacauacacacaacac

SEQ ID NO: 478463 - RNA, 64 nt, hsa
cacccucccucucucacacauacacacacaaacacauacacacaacacuaagugccuagacuuu

SEQ ID NO: 478464 - RNA, 64 nt, hsa
caugcacacacguguagcucacacacaguauacacauacacaagugcacagaccacacacagca

SEQ ID NO: 478465 - RNA, 64 nt, hsa
uacacauacgugcauacacaugccugcauacaggcauacacaugcacgcuuacauguacacgug

SEQ ID NO: 478466 - RNA, 64 nt, hsa
caccuguauagaccaugcacaguacacauacgugcauacacaugccugcauacaggcauacaca

SEQ ID NO: 478467 - RNA, 64 nt, hsa
gacacuuguuaccauauuuuaaaaucuggcuucacauacacagagucuuugcuaugcaccaugu

SEQ ID NO: 478468 - RNA, 64 nt, hsa
cacacaggcacauacacucauauacauagacacacauacacaccucaaucuagaaagaacuugc

SEQ ID NO: 478469 - RNA, 64 nt, hsa
auucugcccacacacacacaaacacauacacacacauacacacacacagacacacacacacgaa

SEQ ID NO: 478470 - RNA, 64 nt, hsa
auuaaaagaaauucugcccacacacacacaaacacauacacacacauacacacacacagacaca

SEQ ID NO: 478471 - RNA, 64 nt, hsa
cagucagugggcaagaggaaagauaaguaaguaccauacacaccuaaaagaugagagaauucau

SEQ ID NO: 478472 - RNA, 64 nt, hsa
uggacauggggaggcgacaguccuaucuagacaucauacacauuugccaagaaaggaucucugg

SEQ ID NO: 478473 - RNA, 64 nt, hsa
uuugguguuuuuaaaguguguauacauacauacacauacacacaugcacauaugucaaauauaa

SEQ ID NO: 478474 - RNA, 64 nt, hsa
caaggguuugguguuuuuaaaguguguauacauacauacacauacacacaugcacauaugucaa

SEQ ID NO: 478475 - RNA, 64 nt, hsa
caaaccuuuaguuuucugaugaucuacacacacacauacacacacacacacacacacgugcaca

SEQ ID NO: 478476 - RNA, 64 nt, hsa
guauucaaauacuaaguaucuuauaugcuacgugcauacacauucuuuucuuaaacuuuaccug

SEQ ID NO: 478477 - RNA, 64 nt, hsa
cauaaguuucaagaauaacauggcacacagaacaauggaaaaaaguuuguuuccauuggaaaau

SEQ ID NO: 478478 - RNA, 64 nt, hsa
acuuaaagguauauauucaauuuuuuaccauuuuauggaaaauauuuaaaaucuguuuuuacag

SEQ ID NO: 478479 - RNA, 64 nt, hsa
uggcuguuggaaaccugaaugcuuuuagacccaaauggaaaauuucugaaaugcuggauuaucu

SEQ ID NO: 478480 - RNA, 64 nt, hsa
ucuugcacuuacaaauaaggucuaugggaguagcauggaaaacguuugcuguuuuucccuuuuu

SEQ ID NO: 478481 - RNA, 64 nt, hsa
uaaacauagccuauuuuugugcuuaagauacugaauggaaaacuccauuguguguugcuggacu

SEQ ID NO: 478482 - RNA, 64 nt, hsa
aagcacuacaccuugccuugcuguuuguccugagauggaaaaguguccuucuugcucccccuca

SEQ ID NO: 478483 - RNA, 64 nt, hsa
cagggagggaagaaugaacacuccccauuaacagauggaaaaacugaggcuuagagauagacaa

SEQ ID NO: 478484 - RNA, 64 nt, hsa
uuagccuaugaaaaaaaaaacauuuuguuaaccuauggaaaaagccuuggaagagaaaaguaga

SEQ ID NO: 478485 - RNA, 64 nt, hsa
ucuauaugugggaaccauucugaaguucaaaacuauggaaaauugaauuuucuucagacaaaac

SEQ ID NO: 478486 - RNA, 64 nt, hsa
aaauccuguaaauguaaauauuauggaaaaccuuauggaaaauaauuauaguacaauucucaag

SEQ ID NO: 478487 - RNA, 64 nt, hsa
cccacuggaaauaaauccuguaaauguaaauauuauggaaaaccuuauggaaaauaauuauagu

SEQ ID NO: 478488 - RNA, 64 nt, hsa
cacacgaauaacuuggauagcaaauccugagacaauggaaaaccauuaacuuuacuucauuggc

SEQ ID NO: 478489 - RNA, 64 nt, hsa
aaauuucuuaucauuguuucaaaaaagcaaaaucauggaaaauuuuuguuguccaggcaaauaa

SEQ ID NO: 478490 - RNA, 64 nt, hsa
uuuaucggcauuguccaaaauauuuuauucuuuaauggaaaaagccauuaauauucaaaugaag

SEQ ID NO: 478491 - RNA, 64 nt, hsa
uccuacccugaccuucguaccuaugauuauacggauggaaaagcucagaacucaggugaaacau

SEQ ID NO: 478492 - RNA, 64 nt, hsa
uuccccagugcuuccacacccgggcucugagcaaauggaaaagacuuuucauuuaguagacaau

SEQ ID NO: 478493 - RNA, 64 nt, hsa
aaccaaucacuuuguaugcuaugcuccuacugugauggaaaacaaaaugaguauaacuuauuuu

SEQ ID NO: 478494 - RNA, 64 nt, hsa
uuuuucuuauuuuuaaguguuauuaauuauaucuauggaaaaacuauuccugaaauauauacag

SEQ ID NO: 478495 - RNA, 64 nt, hsa
augcuucuguacuuuuuaaaagcuuauaguugguauggaaaacauuuuucuuauuuuuaagugu

SEQ ID NO: 478496 - RNA, 64 nt, hsa
acaccugaccaccauuuaaggacucuaagccagaauggaaaauucaccaggacuccauucuuaa

SEQ ID NO: 478497 - RNA, 64 nt, hsa
caaaccuccuugggaauccacauuuuuugggggaauggaaaagcucugucucccuaacucaacu

SEQ ID NO: 478498 - RNA, 64 nt, hsa
ccugacuuuuucucauugccauuaguaaugacugauggaaaacccagccaccacugugaugcga

SEQ ID NO: 478499 - RNA, 64 nt, hsa
ggggcauuuguggaacuuacccauggggacuaauauggaaaaggucuguccauagugguucccu

SEQ ID NO: 478500 - RNA, 64 nt, hsa
ucuuaagcuguucuugcauaggcucuuaagcagcauggaaaaaugguugauggaaaauaaacau

SEQ ID NO: 478501 - RNA, 64 nt, hsa
gcauaggcucuuaagcagcauggaaaaaugguugauggaaaauaaacaucaguuucuaaaaguu

SEQ ID NO: 478502 - RNA, 64 nt, hsa
uaauguguccaaaugaaagcuaguagauguaaacauggaaaaauuguguuuacaauuuuauaau

SEQ ID NO: 478503 - RNA, 64 nt, hsa
caggcaggcacucaagaaaugaauuaacuacauaauggaaaaguaugguuuaauguguccaaau

SEQ ID NO: 478504 - RNA, 64 nt, hsa
ucuuccaacccuccauuagcucaauuuugagauaauggaaaauugacuggaaauucaaaacuca

SEQ ID NO: 478505 - RNA, 64 nt, hsa
caguauuuugagaauugccauauuaauuuuuauaauggaaaacuuaauaaauugcuacuguuuu

SEQ ID NO: 478506 - RNA, 64 nt, hsa
uauucagcaaggccaaagacuuuugagaauguguauggaaaauucuuuuugugcauuugagggc

SEQ ID NO: 478507 - RNA, 64 nt, hsa
ucuaugaauguuaaauucagaauaucucuaaaacauggaaaauugauguuucaauaaaaaggga

SEQ ID NO: 478508 - RNA, 64 nt, hsa
aucacacagaagagggcuguggugaaggaccagcauggaaaacgcauugacuuggagcaccugg

SEQ ID NO: 478509 - RNA, 64 nt, hsa
aauugaauauaucuaugagggcauguauuaguuaauggaaaaaaaaauacaacacuaacaauac

SEQ ID NO: 478510 - RNA, 55 nt, hsa
auaaauccguggauuccugaacaguauggaaaagcaaacugugcaacuacuacau

SEQ ID NO: 478511 - RNA, 64 nt, hsa
ccauggauuuugugcuugggacagaccauaaaugauggaaaaugucaacacaaaaauagcugaa

SEQ ID NO: 478512 - RNA, 64 nt, hsa
uuacucagagauaacauagauuauccaggcugagauggaaaacaagcccuuuauugaauuuuca

SEQ ID NO: 478513 - RNA, 64 nt, hsa
cauuuauuuucuucagccugugcaaaacaaagcaauggaaaaggaaacuaaaaaauauacauac

SEQ ID NO: 478514 - RNA, 64 nt, hsa
auucccauaauuucacuuuacuuucuguuuaggcauggaaaaauuuaucagucagaauugcugu

SEQ ID NO: 478515 - RNA, 64 nt, hsa
acaaaagauuccaaagaaagucaaaaaguguaaaauggaaaauaagagaucaaaaugaauauag

SEQ ID NO: 478516 - RNA, 64 nt, hsa
cuuuucuguugguagagcucucccauuuggugacauggaaaauaccuuuccauuaucacaacaa

SEQ ID NO: 478517 - RNA, 64 nt, hsa
aacuugguugcuaauuacaagaaugaaaauuauaauggaaaaggacaaaauaauauaccagcug

SEQ ID NO: 478518 - RNA, 64 nt, hsa
uucagcgguugaggagaauugcggcgagacaagcauggaaaaucagugacaucugauuggcaga

SEQ ID NO: 478519 - RNA, 64 nt, hsa
agauuugaggacuuguuaaagagcacugggucauauggaaaaaauguaugugucucccaggugc

SEQ ID NO: 478520 - RNA, 57 nt, hsa
auaccaauaagucagccugaugcucuaauggaaaaauggcccucuucaagccuggug

SEQ ID NO: 478521 - RNA, 64 nt, hsa
gaugaggcuccaccuuguuaaauaaauuggauguauggaaaaauagacugcagaaaaggggaac

SEQ ID NO: 478522 - RNA, 64 nt, hsa
uuuucauuaccaaaauguacagcuauuauuugccauggaaaagguuagucucauuuagaaaaau

SEQ ID NO: 478523 - RNA, 64 nt, hsa
uuuacaccaucugcaaccauaugcuauuaauaaaauggaaaaaaacaaaauggucauuuugcau

SEQ ID NO: 478524 - RNA, 64 nt, hsa
aauaguaaaucuauuuuuacugaauaaaguaauuauggaaaauauuuuaaacucuagaagcuuc

SEQ ID NO: 478525 - RNA, 64 nt, hsa
gcuuuccagucacacaucaaggcgcuugaucacaauggaaaaggugaagaaauuugagguaaau

SEQ ID NO: 478526 - RNA, 64 nt, hsa
uuuggaaaguacuuaaaaguuaccagaauuuucaauggaaaaugagggguuucuccccacugau

SEQ ID NO: 478527 - RNA, 64 nt, hsa
caaagagaaaaagcacagguuagcuccccauuagauggaaaaguguagggacugagaagggcug

SEQ ID NO: 478528 - RNA, 64 nt, hsa
agcauuuauacuugagaaaaauuguauaaagaauauggaaaagccauuuauaucugcucacaug

SEQ ID NO: 478529 - RNA, 64 nt, hsa
uguauuggagaaaaacccugcaaauguaauaaauauggaaaaacauuuuuucaaaaacuacagc

SEQ ID NO: 478530 - RNA, 64 nt, hsa
auaauguuccaguugaaugcaaaacaaaaaaaauauggaaaacauuuugauaaaauuuuuuccu

SEQ ID NO: 478531 - RNA, 64 nt, hsa
cccauauaaauuaucucuaacgucuuuguuguuuauggaaaagcccagauacuggauauaucac

SEQ ID NO: 478532 - RNA, 64 nt, hsa
aagucaaguuauuauugcuguuacucuggaugauauggaaaacacugccauauuuuaaaucaac

SEQ ID NO: 478533 - RNA, 64 nt, hsa
ccuaacuuauuggagcacaucaguuucuuggguaauggaaaacauuaccuagaguugccagugg

SEQ ID NO: 478534 - RNA, 64 nt, hsa
gguuuuaaucauucuucuauaaaauacauuuaaaauggaaaaauacuuaauaucacuaaauauc

SEQ ID NO: 478535 - RNA, 64 nt, hsa
agaaauaaacguaauaaauaucucauagagacauauggaaaaauaacuuucagauucagcccag

SEQ ID NO: 478536 - RNA, 64 nt, hsa
ggccucagguaaggaugaggaacucugaaaucagauggaaaagagcgguguuaauuuuuauggu

SEQ ID NO: 478537 - RNA, 64 nt, hsa
uuuucaaaagaagacaucuguggccaacaauccuauggaaaaaagcccagcaucacugaucauu

SEQ ID NO: 478538 - RNA, 64 nt, hsa
ucaauaaaucgugcugggauaacuggccagccauauggaaaagauugaaaauggacgccuuccu

SEQ ID NO: 478539 - RNA, 64 nt, hsa
gucuuuggaagauaaucuuccucuuuggaaaugaauggaaaagcaaaaggcccuauuacuuuua

SEQ ID NO: 478540 - RNA, 64 nt, hsa
uuuguguugaacugaaggcuaagucucaguggacauggaaaagacuuuugggugauuuauuuuu

SEQ ID NO: 478541 - RNA, 64 nt, hsa
uguuaguuucuggggaaagaauaguaaccaugcaauggaaaaaaauggacaaccucuugacuag

SEQ ID NO: 478542 - RNA, 64 nt, hsa
cauguugauguugaugggagucaggauguucacuauggaaaaacaaauauacaaauaugaaaug

SEQ ID NO: 478543 - RNA, 64 nt, hsa
caaccucugcuuguccggaaaacgacaacacgaaauggaaaaggcuacagcccucugcauaaac

SEQ ID NO: 478544 - RNA, 64 nt, hsa
guuucucaacucuugcuuugguguuugccgcagcauggaaaacagggcgccuaaggcugggagc

SEQ ID NO: 478545 - RNA, 64 nt, hsa
uagcuagaaauaauuauguggaaaaaaaugaauaauggaaaauagugagucucaaauuguucuc

SEQ ID NO: 478546 - RNA, 64 nt, hsa
cagccauugggaaauugggagaaaugauaaacaaauggaaaaagaagaugucccuaaccuacac

SEQ ID NO: 478547 - RNA, 64 nt, hsa
ugauuaucuucagcccaggcuuuugcuagauggaauggaaaagcaacuucauuugacacaaagc

SEQ ID NO: 478548 - RNA, 64 nt, hsa
uuuuuuggguuaaaagaugguuguagcauuuaaaauggaaaauuuucuccuugguuugcuagua

SEQ ID NO: 478549 - RNA, 64 nt, hsa
cuguaggguacuguaauuugucaaaaugcagagaauggaaaacagugaacggaaaacacagagu

SEQ ID NO: 478550 - RNA, 64 nt, hsa
auuugaguaaccaucaacacaauuaguuuacagaauggaaaaggagucugagaucuguacuguu

SEQ ID NO: 478551 - RNA, 64 nt, hsa
acagccuggauugagaauuuuuauaagauuggcaauggaaaaacauuuauucuuuuaaauaaua

SEQ ID NO: 478552 - RNA, 64 nt, hsa
cuaugcaugcucuaagucugcaugggauaugggaauggaaaagggcaauaagaaauuaauaccc

SEQ ID NO: 478553 - RNA, 64 nt, hsa
uaaacaucaaagaaaacauuuuuauuaguuacuuauggaaaaucaucuauuacaaugauaaccu

SEQ ID NO: 478554 - RNA, 64 nt, hsa
uugucauugccucuggucauuugucuaaauaggaauggaaaauuaaaagaaaagcaacaaucca

SEQ ID NO: 478555 - RNA, 64 nt, hsa
uacaaaauaaguguugugguuuaucuagaaaaauauggaaaauauugcuguuauuuuuggugaa

SEQ ID NO: 478556 - RNA, 64 nt, hsa
ucuugaacuuaaagaaacaaaugacaaaguuugaauggaaaagccugcuguuguuccacaucuc

SEQ ID NO: 478557 - RNA, 64 nt, hsa
auugugcuauccugaauggaaaauagaggauacaauggaaaauagaggauaccaacuguaugcu

SEQ ID NO: 478558 - RNA, 50 nt, hsa
ggacaauugugcuauccugaauggaaaauagaggauacaauggaaaauag

SEQ ID NO: 478559 - RNA, 64 nt, hsa
aaaagguagagaaacuuguaguguucuccacauaauggaaaauguacaaaugccuaguuguguu

SEQ ID NO: 478560 - RNA, 64 nt, hsa
aucccaaaaggaagaacugucuugaacaagaugaauggaaaauugugguuaauucugaauuuca

SEQ ID NO: 478561 - RNA, 64 nt, hsa
uuacucaaaaaguaccucuucaggucuugagaacauggaaaagaauugagugcuuuuaaauacu

SEQ ID NO: 478562 - RNA, 64 nt, hsa
cauaaacuauguagcaaaaguaucuguaaaauccauggaaaauaaaaguuguaucauucuuuuu

SEQ ID NO: 478563 - RNA, 64 nt, hsa
uuugcuuucucuucaagauaaguuguauuuuaccauggaaaaauacaguaucuaacauuaccau

SEQ ID NO: 478564 - RNA, 64 nt, hsa
gaaguuaauuacugggccaacuugagaggaaaaaauggaaaagaaacuaaaauguugggugaau

SEQ ID NO: 478565 - RNA, 64 nt, hsa
uuguaaauagcaguucacauuuuuccacaguauaauggaaaauaauggguaggggugcauugcu

SEQ ID NO: 478566 - RNA, 64 nt, hsa
aaucacuuaauuaguaccauuaagugagagaguaauggaaaacuguuauccaucaaaagugaua

SEQ ID NO: 478567 - RNA, 64 nt, hsa
aauguauccccugccuauuuuccuuguguaacaaauggaaaacauucuccccugugagaaauaa

SEQ ID NO: 478568 - RNA, 64 nt, hsa
gcaugggaaagcaaagcagaaaacagugccccaaauggaaaaaagauacucacacagaacaaaa

SEQ ID NO: 478569 - RNA, 64 nt, hsa
uuuuuauuuuuuuuauuauuaaaugauguggucuauggaaaaaaaaauaaaaaucugacuuagu

SEQ ID NO: 478570 - RNA, 64 nt, hsa
ucuuucacaucaccuaucccuacauacauaccaaauggaaaaguggccauccuuuuccccccaa

SEQ ID NO: 478571 - RNA, 64 nt, hsa
agggcaagagaccuguuuuagugcugcauucgacauggaaaaguccuuuuaaccugugcuugca

SEQ ID NO: 478572 - RNA, 64 nt, hsa
aucuucucagccuccuagccaaguccuauguaauauggaaaacaaacacugcagacuugagauu

SEQ ID NO: 478573 - RNA, 64 nt, hsa
aauaauuugguuuguggacugggcaugguggcuuauggaaaagaggugagccuuugugaagaac

SEQ ID NO: 478574 - RNA, 64 nt, hsa
uauggaaaagaggugagccuuugugaagaacauaauggaaaagugcauguacgggaaauaacag

SEQ ID NO: 478575 - RNA, 64 nt, hsa
uugcacacaauggguuuggagcugacugggaacaauggaaaaaauuacauuagcugugguugua

SEQ ID NO: 478576 - RNA, 64 nt, hsa
agaauuucauagccuguaucuaucauuuagaugcauggaaaaaaaugggcuuugcacacaaugg

SEQ ID NO: 478577 - RNA, 64 nt, hsa
uaugugauuuuuuaaauguccccuuuaguauuuaauggaaaauugguuccugcaaaagacaaag

SEQ ID NO: 478578 - RNA, 64 nt, hsa
uuagcucuucugacuggauuuuucuacaaaaacuauggaaaauaucuuuguucuuguuugcugc

SEQ ID NO: 478579 - RNA, 64 nt, hsa
uucaauguguuccuguugggcguuacuagaaacuauggaaaacuggaaaauaacuuugaaaaaa

SEQ ID NO: 478580 - RNA, 64 nt, hsa
uaaaaugucuuaauguagguuguagucacuuuagauggaaaauuaccucacaucuguuuucuuc

SEQ ID NO: 478581 - RNA, 64 nt, hsa
aucuuggcauaagcucaaaaaagccaggaucuuuauggaaaaauuuuaauacuuuguuaaaagg

SEQ ID NO: 478582 - RNA, 64 nt, hsa
cuggaauaaauggaaagaaauaccauauacauagauggaaaaacccaguauuauaaaaaccuca

SEQ ID NO: 478583 - RNA, 64 nt, hsa
gggacgauucccaaaauaaaucaccaguuuguaaauggaaaacuuauuuuaaguugggacaaga

SEQ ID NO: 478584 - RNA, 64 nt, hsa
caguucgcuaguacaaggggucuucaggaaguucauggaaaaauacauauuaugagaaaauugu

SEQ ID NO: 478585 - RNA, 64 nt, hsa
aaaaaauguauauggguaaggaccugaaagauccauggaaaaguuaacccaguugagauuuuua

SEQ ID NO: 478586 - RNA, 64 nt, hsa
aaauacacuguuuugcaucaagcuggaguacuggauggaaaacucuacaauaacauuuugugca

SEQ ID NO: 478587 - RNA, 64 nt, hsa
gagggcagcaaaugcugacaaggaugaaaagcacauggaaaaaaauggaugaggagggaaaacu

SEQ ID NO: 478588 - RNA, 64 nt, hsa
gaaaaaaauggaugaggagggaaaacucugccaaauggaaaaugaccaaauuuaagaggguggg

SEQ ID NO: 478589 - RNA, 64 nt, hsa
gaaauucucucacucuguguauguauauauaccuauggaaaacuaguuguugggaaaggaguac

SEQ ID NO: 478590 - RNA, 64 nt, hsa
aauugcuucuuagugcuuauuaggagcugaagaaauggaaaagcagucuccaauuucacaucuu

SEQ ID NO: 478591 - RNA, 64 nt, hsa
agucauuaauguucuuuauaaaaagugaaauaagauggaaaaauaaggauccuacagccaguaa

SEQ ID NO: 478592 - RNA, 64 nt, hsa
gauuccacaguggcaagaaacaucauucuacauaauggaaaacauuuacaucaaaucccacuua

SEQ ID NO: 478593 - RNA, 64 nt, hsa; identical to SEQ ID NO: 297911

SEQ ID NO: 478594 - RNA, 64 nt, hsa; identical to SEQ ID NO: 297912

SEQ ID NO: 478595 - RNA, 64 nt, hsa; identical to SEQ ID NO: 297913

SEQ ID NO: 478596 - RNA, 64 nt, hsa; identical to SEQ ID NO: 297914

SEQ ID NO: 478597 - RNA, 64 nt, hsa; identical to SEQ ID NO: 297915

SEQ ID NO: 478598 - RNA, 64 nt, hsa; identical to SEQ ID NO: 297916

SEQ ID NO: 478599 - RNA, 64 nt, hsa; identical to SEQ ID NO: 297917

SEQ ID NO: 478600 - RNA, 64 nt, hsa; identical to SEQ ID NO: 297918

SEQ ID NO: 478601 - RNA, 64 nt, hsa; identical to SEQ ID NO: 297919

SEQ ID NO: 478602 - RNA, 64 nt, hsa; identical to SEQ ID NO: 297920

SEQ ID NO: 478603 - RNA, 64 nt, hsa; identical to SEQ ID NO: 297921

SEQ ID NO: 478604 - RNA, 64 nt, hsa; identical to SEQ ID NO: 297922

SEQ ID NO: 478605 - RNA, 64 nt, hsa; identical to SEQ ID NO: 297923

SEQ ID NO: 478606 - RNA, 64 nt, hsa; identical to SEQ ID NO: 297924

SEQ ID NO: 478607 - RNA, 64 nt, hsa; identical to SEQ ID NO: 297925

SEQ ID NO: 478608 - RNA, 64 nt, hsa; identical to SEQ ID NO: 297926

SEQ ID NO: 478609 - RNA, 64 nt, hsa; identical to SEQ ID NO: 297927

SEQ ID NO: 478610 - RNA, 64 nt, hsa; identical to SEQ ID NO: 297928

SEQ ID NO: 478611 - RNA, 64 nt, hsa; identical to SEQ ID NO: 297929

SEQ ID NO: 478612 - RNA, 64 nt, hsa; identical to SEQ ID NO: 297930

SEQ ID NO: 478613 - RNA, 64 nt, hsa; identical to SEQ ID NO: 297931

SEQ ID NO: 478614 - RNA, 64 nt, hsa; identical to SEQ ID NO: 297932

SEQ ID NO: 478615 - RNA, 64 nt, hsa; identical to SEQ ID NO: 297933

SEQ ID NO: 478616 - RNA, 64 nt, hsa; identical to SEQ ID NO: 297934

SEQ ID NO: 478617 - RNA, 64 nt, hsa; identical to SEQ ID NO: 297935

SEQ ID NO: 478618 - RNA, 64 nt, hsa; identical to SEQ ID NO: 297936

SEQ ID NO: 478619 - RNA, 64 nt, hsa; identical to SEQ ID NO: 297937

SEQ ID NO: 478620 - RNA, 64 nt, hsa; identical to SEQ ID NO: 297938

SEQ ID NO: 478621 - RNA, 64 nt, hsa; identical to SEQ ID NO: 297939

SEQ ID NO: 478622 - RNA, 64 nt, hsa; identical to SEQ ID NO: 297940

SEQ ID NO: 478623 - RNA, 64 nt, hsa; identical to SEQ ID NO: 297941

SEQ ID NO: 478624 - RNA, 64 nt, hsa; identical to SEQ ID NO: 297942

SEQ ID NO: 478625 - RNA, 64 nt, hsa; identical to SEQ ID NO: 297943

SEQ ID NO: 478626 - RNA, 64 nt, hsa; identical to SEQ ID NO: 297944

SEQ ID NO: 478627 - RNA, 64 nt, hsa
uuauuucaagggauggcauaacuguaagaggucagugcuagaauaaaguccuguagguuuauuu

SEQ ID NO: 478628 - RNA, 64 nt, hsa
uggaagggacuguggccaggguaguucucagguugugcuagagcagcacuuuguuauguggaag

SEQ ID NO: 478629 - RNA, 64 nt, hsa
agagaaaaacaauauaacuuucuugagugcaaaggugcuagacaacuaggagcccagcugggau

SEQ ID NO: 478630 - RNA, 64 nt, hsa
agcuagucauggauaacagacuuuaaccaguuaggugcuagauccuaagaggcacucacaaggc

SEQ ID NO: 478631 - RNA, 64 nt, hsa
aggacgucaaaaacucaccauggaccccaaggcagaaaccaagaacugucugcaggcaaauaag

SEQ ID NO: 478632 - RNA, 64 nt, hsa
gaugcuuaauggugcuagaggcucaaguguguuugaaaccaagagccaguugucccccaugcag

SEQ ID NO: 478633 - RNA, 64 nt, hsa
cucagccucugcaacugcaagaaaggggacccaagaaaccaaagucugccgcccaccucgcucc

SEQ ID NO: 478634 - RNA, 64 nt, hsa
uauuaaguguucucaacugaguaacuuuuaaguggaaaccaaguuuagauuuggggagugguaa

SEQ ID NO: 478635 - RNA, 64 nt, hsa
gacuuugucuaagccucauuauacugaaguugaagaaaccaaaugagcuccacccucacuuugc

SEQ ID NO: 478636 - RNA, 64 nt, hsa
aaaaauuuauuaaauauaaauauccccagggacagaaaccaaggccccgagcucagggcagcug

SEQ ID NO: 478637 - RNA, 64 nt, hsa
aagucaauugaguaaggacaccuccagccauacagaaaccaacacugugugggggccaaggucu

SEQ ID NO: 478638 - RNA, 64 nt, hsa
gggagagcgaugcuuggauuuuuguuuccuauuagaaaccaacaguuuuguucuaauuucauuu

SEQ ID NO: 478639 - RNA, 64 nt, hsa
ugaagcucccagugaccuggagggaggauuccuggaaaccaaacaaucaguuuaggugcaggug

SEQ ID NO: 478640 - RNA, 64 nt, hsa
uucaucagguaucuuucuguggcauuugagaacagaaaccaagaaacaugguaauuacuaaauu

SEQ ID NO: 478641 - RNA, 64 nt, hsa
ucccuuuucuauaaaaaauaaguuaaugugucaagaaaccaacucuauuaaggugggguuuaau

SEQ ID NO: 478642 - RNA, 64 nt, hsa
cauugcugauugguguuaaguugcuagacacugcgaaaccaagcugacucacaagaagaccucu

SEQ ID NO: 478643 - RNA, 64 nt, hsa
guuuucgcacuucuuggcugguccagggacugcagaaaccaaagcugcuauuguugaggaauaa

SEQ ID NO: 478644 - RNA, 64 nt, hsa
aauuauguuaauaauuuauuuaaugagugguauggaaaccaauugauuuuuuuagauaaaagaa

SEQ ID NO: 478645 - RNA, 64 nt, hsa
ccccacucccacuuccaggauugugguuuggauugaaaccaaguuuacaaguagacaccccugg

SEQ ID NO: 478646 - RNA, 64 nt, hsa
ucaaaugauugccaucagaaagagacaacuugaagaaaccaacaaugacuaugaaacagcugac

SEQ ID NO: 478647 - RNA, 64 nt, hsa
uuuucacccauucugugguucauuguaguuuaaggaaaccaagcauauagaugcauuagugauu

SEQ ID NO: 478648 - RNA, 64 nt, hsa
uuucaccuuuguauaagauauagccaagacugaagaaaccaaauauauguguuuacuguagcau

SEQ ID NO: 478649 - RNA, 64 nt, hsa
auauauauuauuuuuuuuuaagaaaggaggaaaagaaaccaaaaguuuuuuuuaagaaaaaaaa

SEQ ID NO: 478650 - RNA, 64 nt, hsa
ugcugccuucauccuccccaccuaaugcauuuuugaaaccaaagguaccuagccucagagacag

SEQ ID NO: 478651 - RNA, 64 nt, hsa
gaaaauauuuccugauucaagauucuauaaaaaggaaaccaagcauaagacucugucaucauac

SEQ ID NO: 478652 - RNA, 64 nt, hsa
aaagggcaagaucuuuuuuccuucacuuauugcugaaaccaagagcacaauucccauugagaga

SEQ ID NO: 478653 - RNA, 64 nt, hsa
ucccccaggacuugaugaccacacggggcagagagaaaccaaccaaggccagcaccuccgucgg

SEQ ID NO: 478654 - RNA, 64 nt, hsa
auguuuaaaacaucaacacauugcuuaaaaugaugaaaccaacccucaaaaaacagucuccuaa

SEQ ID NO: 478655 - RNA, 64 nt, hsa
ggacauuagucguuauauuugacuugaaaagaaagaaaccaagugcgcuuugcaauauuuauua

SEQ ID NO: 478656 - RNA, 64 nt, hsa
uccuuagaagucccauucucccuuccaguuaugagaaaccaaugccuucuagauucaggugacu

SEQ ID NO: 478657 - RNA, 64 nt, hsa
uuuacaauuaggcuauuuuuuaauauaggauuuagaaaccaaggguauguguuuuaaaauuaca

SEQ ID NO: 478658 - RNA, 64 nt, hsa
aggcgaguggggcccaggacugguuccagugagagaaaccaaccacaggcacccaagcacuacc

SEQ ID NO: 478659 - RNA, 64 nt, hsa
uccuucgagcuugacucugagagggaaagugacggaaaccaagucagaugagaugacugccaug

SEQ ID NO: 478660 - RNA, 64 nt, hsa
agaagauuuauuccaccagggguauuucagcuuugaaaccaaaucuguguaucuaauacuaacc

SEQ ID NO: 478661 - RNA, 64 nt, hsa
gaaacugacuugcucaccuggaacaccugauggugaaaccaaacaaauacaaaauccuucucca

SEQ ID NO: 478662 - RNA, 64 nt, hsa
cgccgcguggacugaagcucuucaugaugagauggaaaccaaaagggagucucccaugaugggg

SEQ ID NO: 478663 - RNA, 64 nt, hsa
uacaguauacauauauauuuauaucacaauuuacgaaaccaaaaaguugaguuuccaauggaac

SEQ ID NO: 478664 - RNA, 64 nt, hsa
aggcuaaccuuucuaagcucccuaacuugggccagaaaccaaagcugagcuuuuaacuuucucc

SEQ ID NO: 478665 - RNA, 64 nt, hsa
ggaaacuuacauguugagaucuacagagauccaggaaaccaaagcccugcugagcagagccauu

SEQ ID NO: 478666 - RNA, 64 nt, hsa
cgacuugaguguaaacauaacuuauaugcacugggaaaccaaaaaaucugugugacuugcuuua

SEQ ID NO: 478667 - RNA, 64 nt, hsa
gagauagucuuauucugauuuuuuuuuucuucuggaaaccaaguagaauuagggaugggaauac

SEQ ID NO: 478668 - RNA, 64 nt, hsa
guuucuucccuguauuuucuuucucuacuuugaggaaaccaaaguaaccuuuugcaccugcucu

SEQ ID NO: 478669 - RNA, 64 nt, hsa
uucauuauguguucuacagugucggugaauaaaugaaaccaaucucaauuuagagguauggaug

SEQ ID NO: 478670 - RNA, 64 nt, hsa
acugcauccuucaacucucacuagaaaaucuuuugaaaccaaauggauuaauuuauggcuauuu

SEQ ID NO: 478671 - RNA, 64 nt, hsa
acugaagaugauguaugaaggaguuggaguuguugaaaccaagguguccaugaucccuccccac

SEQ ID NO: 478672 - RNA, 64 nt, hsa; identical to SEQ ID NO: 82031

SEQ ID NO: 478673 - RNA, 64 nt, hsa; identical to SEQ ID NO: 82032

SEQ ID NO: 478674 - RNA, 64 nt, hsa; identical to SEQ ID NO: 82033

SEQ ID NO: 478675 - RNA, 64 nt, hsa; identical to SEQ ID NO: 82034

SEQ ID NO: 478676 - RNA, 64 nt, hsa
ccucugaaggccgggacccagucauacauccuuagaaaccaaaguaugguuuuuguuuucucuu

SEQ ID NO: 478677 - RNA, 64 nt, hsa
gaagaaaaauagguguauaaaauguuuuccaugagaaaccaagaaacuuacacugguuugacag

SEQ ID NO: 478678 - RNA, 64 nt, hsa
cucauuaaguguuauuuauuuuacucaagaacuggaaaccaacuaaaugccuucuauagaagua

SEQ ID NO: 478679 - RNA, 64 nt, hsa
acucuuucucaccugaugcucuuaaaagaucuuagaaaccaaccauacagacgagccgaugcgg

SEQ ID NO: 478680 - RNA, 64 nt, hsa
ccauuugcacauaguuaccagucacucuguuucugaaaccaauccagaaauucauguuagaaca

SEQ ID NO: 478681 - RNA, 53 nt, hsa
ucagggaaaguaaaaaguaaaaagaaaccaagaauuuuccauuuugugaucaa

SEQ ID NO: 478682 - RNA, 64 nt, hsa
caguaauguauuugaaggaaaaauacccugauuugaaaccaacagcagauguugcaaacuuuca

SEQ ID NO: 478683 - RNA, 50 nt, hsa
uuauccucuccuacacauaagaaaccaaaaggcugggcguaguggcucac

SEQ ID NO: 478684 - RNA, 64 nt, hsa
augccucuacuaucauuaccucuauugggacccagaaaccaauaccccaaaauauggugcaugg

SEQ ID NO: 478685 - RNA, 64 nt, hsa
ccacgcuuguuccccauguaccucuagagaagcagaaaccaaagucccccugugcccugggagg

SEQ ID NO: 478686 - RNA, 64 nt, hsa
cucugagggcuguuuuuuuuuuuugauguuaacagaaaccaaucuuagcaccuuuucaaggggu

SEQ ID NO: 478687 - RNA, 64 nt, hsa
agcuagcaaucuaugcaaacaccuuucccauaaagaaaccaaaccccauaguacagugccuugu

SEQ ID NO: 478688 - RNA, 64 nt, hsa
aaaacucuguguugcugcaggguuugaacuuuuggaaaccaauuaaaaugugccuuuggugggc

SEQ ID NO: 478689 - RNA, 64 nt, hsa
uuaaagaggagagcaggaagaaagguugguuucagaaaccaagagggucggcaguggacgcgua

SEQ ID NO: 478690 - RNA, 58 nt, hsa
uuaaaaaagccaccaacugaucaucugagaaaccaacacauuuuuuccugugaauuug

SEQ ID NO: 478691 - RNA, 64 nt, hsa
gucuacaauggggagaacuuguuuuauagaugaggaaaccaaggcucagaggggcaaagucacc

SEQ ID NO: 478692 - RNA, 64 nt, hsa
uacuucguuaugaaaaugccuuccacgcaaauaagaaaccaagggauaaaacuguucauggaug

SEQ ID NO: 478693 - RNA, 64 nt, hsa; identical to SEQ ID NO: 82035

SEQ ID NO: 478694 - RNA, 64 nt, hsa; identical to SEQ ID NO: 82036

SEQ ID NO: 478695 - RNA, 64 nt, hsa
auguuauucauguauuacugggagaugcuaccaagaaaccaacccaaagaaaauucugaaaaau

SEQ ID NO: 478696 - RNA, 64 nt, hsa
cuccucaauugggaguguugugacugaaaugcuugaaaccaaagcuucagauaaacuugcaaga

SEQ ID NO: 478697 - RNA, 64 nt, hsa
uagguuuccgcuuucaugggacaugagugaaaaugaaaccaagucaauaugagguaccuuuaca

SEQ ID NO: 478698 - RNA, 64 nt, hsa
gauuuacuuuuaagaggcaaaaugugaguaaauugaaaccaagaaaacuuguuuuuagaauauu

SEQ ID NO: 478699 - RNA, 64 nt, hsa
gcagugaguuaaaauuuaguaagaugaagauguggaaaccaaugaaaaguacauuuagaaaugc

SEQ ID NO: 478700 - RNA, 64 nt, hsa
guagagcugaguuaccaaaauuucuauuucaaaggaaaccaaaccuuaaaaaaaaaaaacaaaa

SEQ ID NO: 478701 - RNA, 64 nt, hsa
aaauggugcuuuguuccugcugguuccaagcucagaaaccaagacuagcuuuguaggagagaau

SEQ ID NO: 478702 - RNA, 64 nt, hsa
caucuauuccuuuucucuugugucccuacucauugaaaccaaacucuggaaaggacccaaugua

SEQ ID NO: 478703 - RNA, 64 nt, hsa; identical to SEQ ID NO: 82037

SEQ ID NO: 478704 - RNA, 64 nt, hsa; identical to SEQ ID NO: 82038

SEQ ID NO: 478705 - RNA, 64 nt, hsa
uaaggacuuuccuuccuccaucuccaagaaugcugaaaccaagggggaugacaugugacuccua

SEQ ID NO: 478706 - RNA, 64 nt, hsa
cuuuuauuuauagaaugcaugucuuuuguguuaagaaaccaaagagaaauaaagagaacacucc

SEQ ID NO: 478707 - RNA, 64 nt, hsa
gauggcucacugggcucuuggaggggaaugugaagaaaccaaggagucacuuuuucaucuagau

SEQ ID NO: 478708 - RNA, 64 nt, hsa
ugguaggcagugucccuucugcuugaaaccuauugaaaccaauuuaaaacuguguacuuuuuaa

SEQ ID NO: 478709 - RNA, 64 nt, hsa
ucaccuuaguggaaagguuaaaaaccagagccuggaaaccaagaugauugauuugacaagguau

SEQ ID NO: 478710 - RNA, 64 nt, hsa
ucucagugacagaagcauguuugagaugccgugggaaaccaaauauauaauaauaaaaauauaa

SEQ ID NO: 478711 - RNA, 64 nt, hsa
gcaaauauuccauuguaaacaaaucaaaggaaaagaaaccaagaacugaauuacugucugccca

SEQ ID NO: 478712 - RNA, 64 nt, hsa
cagucaaagggcaccauucuuuuuuuuuuuuuuugaaaccaaagcugucucagaaauggccaau

SEQ ID NO: 478713 - RNA, 64 nt, hsa
aaauugcacuuuuggaagcccggugucaugaaaugaaaccaaaccucggugccaucgcagagua

SEQ ID NO: 478714 - RNA, 64 nt, hsa
ugcagauggauguuuccaugaagaaaucucugaagaaaccaaaagagcugaaacugaaaaaaga

SEQ ID NO: 478715 - RNA, 64 nt, hsa
gugugcaaaccucuugacuuuaccccacauuacugaaaccaaaauauauuugcuucaucugccc

SEQ ID NO: 478716 - RNA, 64 nt, hsa
cccaacucacccaagcagcaacgagcaacaaucggaaaccaaauacuggagagaaaaccaacgu

SEQ ID NO: 478717 - RNA, 64 nt, hsa; identical to SEQ ID NO: 82039

SEQ ID NO: 478718 - RNA, 64 nt, hsa; identical to SEQ ID NO: 82040

SEQ ID NO: 478719 - RNA, 64 nt, hsa
cguucauggagcuggucauuucuugaaaugagaagaaaccaaccuggaagaugucuuuuucagu

SEQ ID NO: 478720 - RNA, 64 nt, hsa
uuuuaaauugcaaauguaauuuuugccaauuagagaaaccaaccggugucaguaaaauucugug

SEQ ID NO: 478721 - RNA, 63 nt, hsa
uuuguuuagcccaaaaguaaucgcucuggaguagaaaccaaaugugaauagccacaucuuacc

SEQ ID NO: 478722 - RNA, 64 nt, hsa
auauaaauauaaaauuauauauaaaggguuauuugaaaccaauccauggcaacgcuggugcuug

SEQ ID NO: 478723 - RNA, 64 nt, hsa
gaagcuuuacuuuuccacuuuuuuuuaaaaaaaagaaaccaacaauuuaaauuauauugauguu

SEQ ID NO: 478724 - RNA, 64 nt, hsa
auuuuuacaccccuuaagggugcuuaauucuguugaaaccaaaaagauuugucuacaaaugcua

SEQ ID NO: 478725 - RNA, 64 nt, hsa
aaugccaccagagauagugggggaaaugccagaugaaaccaacucuugcucucacuaguuguca

SEQ ID NO: 478726 - RNA, 64 nt, hsa
gggugaggcuuagcccagaaggagaacugagcaggaaaccaaggcucuucucuguccccugccc

SEQ ID NO: 478727 - RNA, 64 nt, hsa
gccuccauuuuccugagaucaaaaagacuguuucgaaaccaacaucugauauguaaacugcucu

SEQ ID NO: 478728 - RNA, 64 nt, hsa
ccuucugagcguuucugacagcucccagcugggagaaaccaacaugacgaaaagacaaagaaua

SEQ ID NO: 478729 - RNA, 64 nt, hsa
ggaaugaugguugcacaacuuugugaauauacuagaaaccaaugaauuaaaaacuuuggaagau

SEQ ID NO: 478730 - RNA, 64 nt, hsa
ucugcaguuccuuauaggcgaagggaaccggguggaaaccaagcugggagaggcugaggauggc

SEQ ID NO: 478731 - RNA, 64 nt, hsa
auuguaccauacaauuucauuaucuuaucagaaugaaaccaauucacagggaaacuagagacua

SEQ ID NO: 478732 - RNA, 64 nt, hsa
aggaaauaucaaagaacacaacgcaggacuugcugaaaccaaauuacuacuucacacucuccuu

SEQ ID NO: 478733 - RNA, 64 nt, hsa
gcaacauuuuggaagcagagggcaacucucacuggaaaccaaaucuccuggcaccuugaucuug

SEQ ID NO: 478734 - RNA, 64 nt, hsa
uauauaagucaagaauguuuuauugucauuaugugaaaccaauauuggcaaauaguacuuuaau

SEQ ID NO: 478735 - RNA, 64 nt, hsa
caguaauagauaugugauuuuacaucauuuuuaagaaaccaaggggaaguaauaaguugaaaaa

SEQ ID NO: 478736 - RNA, 64 nt, hsa
ccauucuuaauuguaauuuuuuucuuuaaauaaggaaaccaauauaaucucauguauaaaaacu

SEQ ID NO: 478737 - RNA, 64 nt, hsa
uugguugacaaaauuggcuguuggcaucaguauagaaaccaacuggcagcuuucccugacaagc

SEQ ID NO: 478738 - RNA, 64 nt, hsa
gcuccaugcucgcuacgucuugaaccuuuuguaugaaaccaagaaacaucugguacagcugcca

SEQ ID NO: 478739 - RNA, 64 nt, hsa
cuucugguaccaugauccucaacuuagagaggaagaaaccaagacagagagcuuaacucacuuc

SEQ ID NO: 478740 - RNA, 64 nt, hsa; identical to SEQ ID NO: 82041

SEQ ID NO: 478741 - RNA, 64 nt, hsa; identical to SEQ ID NO: 82042

SEQ ID NO: 478742 - RNA, 64 nt, hsa
caauggaggggucuggggaccaugguauaaagaggaaaccaagaaaaagaagccaagcaaaaau

SEQ ID NO: 478743 - RNA, 64 nt, hsa
gugccugguauauaguaggugcucaauaaauguugaaaccaacugaacugccaacaaaauaaaa

SEQ ID NO: 478744 - RNA, 64 nt, hsa
aaucccaguucucuaauuugguuuucuucuuugggaaaccaaacauacaaaugaaucaguauca

SEQ ID NO: 478745 - RNA, 64 nt, hsa
uugucuucguaaaaguuagaucugacuucagacagaaaccaauaccagcuuccuuuuccuuuaa

SEQ ID NO: 478746 - RNA, 64 nt, hsa
auaaaccaaaacaaaauuuccaaaaacaaugaaggaaaccaaaauaaauauuucugcauuucag

SEQ ID NO: 478747 - RNA, 64 nt, hsa
ugccugugcuuuuguuugacugucucuagauuuugaaaccaaaaaacugaacugaaaucaucua

SEQ ID NO: 478748 - RNA, 64 nt, hsa
gcugugccggcgcuacgggacccgagccgucccagaaaccaaagggcaggcacggcagcaaacg

SEQ ID NO: 478749 - RNA, 64 nt, hsa
guaaaguaaaaggaaacaguacacuuggagcuaggaaaccaaagcaagcuuugugaaacuggca

SEQ ID NO: 478750 - RNA, 64 nt, hsa
augaucaguccaacugaacgaccuuacaaaugaggaaaccaagauaaaugagcugccagaauca

SEQ ID NO: 478751 - RNA, 64 nt, hsa
gauaccuccagguuccaguaaaauucuucugaccgaaaccaauguggguguuagaaaaauuacc

SEQ ID NO: 478752 - RNA, 64 nt, hsa
caccccagcacugcuguugggaaggugacugcaggaaaccaauucuuacaagauccaggcccag

SEQ ID NO: 478753 - RNA, 64 nt, hsa
auacaaccagcauagaaagacccaaaacuauacagaaaccaaaaccagaaugccauguggugga

SEQ ID NO: 478754 - RNA, 64 nt, hsa
agauauuaagcguguguaaaugggcuuuagucuggaaaccaaaaaaaaaaaaaaaauuuaguca

SEQ ID NO: 478755 - RNA, 64 nt, hsa
cccaccaugcccuucugccaucuucugggagaaggaaaccaaaggaucuaaaacugggguuugg

SEQ ID NO: 478756 - RNA, 64 nt, hsa
gacccuagagcagaggugggcaaacuaugaccuggaaaccaaaucugacuuaccaccuuuuccu

SEQ ID NO: 478757 - RNA, 64 nt, hsa
aucugauuugguauugugauuuacuucagacccugaaaccaaauaucugaucuuccauuagacu

SEQ ID NO: 478758 - RNA, 64 nt, hsa; identical to SEQ ID NO: 82043

SEQ ID NO: 478759 - RNA, 64 nt, hsa; identical to SEQ ID NO: 82044

SEQ ID NO: 478760 - RNA, 64 nt, hsa
gguugcauggaaguuuuauucucuuguuuugcuggaaaccaagaggauccaaacuuccugcaac

SEQ ID NO: 478761 - RNA, 64 nt, hsa
gggugggaggcaccaaaacuuggcagcugugccagaaaccaaagccaggcccagauguaggggg

SEQ ID NO: 478762 - RNA, 64 nt, hsa
acgcaaaacuggcuucuucuggucacuggugucugaaaccaaauccagagcagccuguggccug

SEQ ID NO: 478763 - RNA, 64 nt, hsa
uuaaaguuccuaagacccagugacaguacugggagaaaccaaggcugaagagucagguugaagc

SEQ ID NO: 478764 - RNA, 64 nt, hsa
uaauguaauaauagaaaaauacucauaauagggagaaaccaagagaaguuuuguuuuuguuuuu

SEQ ID NO: 478765 - RNA, 64 nt, hsa
caggauaacacaagcuuaguguuagaucuuguaggaaaccaagauuagaaacauuagaaauuug

SEQ ID NO: 478766 - RNA, 64 nt, hsa
uaaaaauuguuagaaauuggugggaaaauagguagaaaccaaggaagcagacacaacaugcauu

SEQ ID NO: 478767 - RNA, 64 nt, hsa
uuagccugugucaaguucuuugagugauacuagugaaaccaaauagaaaacuauuguuggauca

SEQ ID NO: 478768 - RNA, 64 nt, hsa; identical to SEQ ID NO: 82045

SEQ ID NO: 478769 - RNA, 64 nt, hsa; identical to SEQ ID NO: 82046

SEQ ID NO: 478770 - RNA, 64 nt, hsa
uguacaugcauucauacaggcagcgauggucucagaaaccaaacaguuugcucuaggggaagag

SEQ ID NO: 478771 - RNA, 64 nt, hsa
aucagagcuggaaccucaucccugcacagaugaggaaaccaaggcauggagcaguucccagagu

SEQ ID NO: 478772 - RNA, 64 nt, hsa
cucuuccucaaggcaaccugaggccagacaccaagaaaccaagcguaucugcucuaaaaugacu

SEQ ID NO: 478773 - RNA, 64 nt, hsa
gugauuauuauuaacucuagauaagcagguacuagaaaccaaaacucagaaaauguuuacuguu

SEQ ID NO: 478774 - RNA, 64 nt, hsa
uagucaucucauccuacucaauuuuucaaaggcagaaaccaacccuggagcaauugagaggacu

SEQ ID NO: 478775 - RNA, 64 nt, hsa
cauuuuauauggcugaucaauuuucauacauugagaaaccaagucaaucaagcaggaaucauuu

SEQ ID NO: 478776 - RNA, 64 nt, hsa
uacuagucaaauccgucagugaucccgagucccagaaaccaaaggcucuuuucagagccaccca

SEQ ID NO: 478777 - RNA, 64 nt, hsa
uagcuuuaggggaccaugaagagacucucuuagggaaaccaauaguccccaucagcaccaugga

SEQ ID NO: 478778 - RNA, 64 nt, hsa
cauuuaguaauguaccuugaguuaaaaagccugagaaaccaaacacagcuaaugcuauggggug

SEQ ID NO: 478779 - RNA, 64 nt, hsa
agagggaacgagcuguagguuugcagaaaugugugaaaccaaaaugaucacugccuacuuguga

SEQ ID NO: 478780 - RNA, 64 nt, hsa
ugguuuaaucagucuaauuguuuugacuguuauagaaaccaaauauuuuacuguuucuuuuaag

SEQ ID NO: 478781 - RNA, 64 nt, hsa
gugagguagauugcugucccguuaacauagugcugaaaccaaaggcaguggggguccaaacucg

SEQ ID NO: 478782 - RNA, 64 nt, hsa
cacuuucuagaacauauucuuuacuaauguuauugaaaccaauuucuacuucauacugauguuu

SEQ ID NO: 478783 - RNA, 64 nt, hsa
auuuuaauaccaugccagagaagaguauucugcugaaaccaacagguuuuacuggucaaaauga

SEQ ID NO: 478784 - RNA, 64 nt, hsa
uugggaauuaaacaggucacacgugacagaugaagaaaccaagggggcugcugaggagaccugg

SEQ ID NO: 478785 - RNA, 64 nt, hsa
caauuacuauaauccugagccauggugugcuacugaaaccaauuuuuauccaccaucuaguccu

SEQ ID NO: 478786 - RNA, 64 nt, hsa
aucaucacaaauccuuuaaaacaauuaccuaaaagaaaccaaaaauccugccuucuuugugggg

SEQ ID NO: 478787 - RNA, 64 nt, hsa
cagggcgaaaagaaaaaaauaauacuauuaauaagaaaccaacaaacaagaaccucucuuucua

SEQ ID NO: 478788 - RNA, 64 nt, hsa
uuggaauacuggucaucuuucugacaucacaguagaaaccaaaccuuggauuuagauucaaaag

SEQ ID NO: 478789 - RNA, 64 nt, hsa
cugacacccuuuaaugugguugcagaucucagaugaaaccaagcuuaauuauacuaugccauua

SEQ ID NO: 478790 - RNA, 64 nt, hsa
aauaaaauuguaauauaauaaauuuggcugacaagaaaccaaagugauucuuaauuaguauaca

SEQ ID NO: 478791 - RNA, 64 nt, hsa
acucuuuacaagcuaagaagagagggccucagaagaaaccaacccugccaacaccuugaucuug

SEQ ID NO: 478792 - RNA, 64 nt, hsa
gucaagaguugaggagacauuacaauguguaauggaaaccaaggaaagugaaacuuuggauaag

SEQ ID NO: 478793 - RNA, 64 nt, hsa
uaucuuugugcuauauaguggauuauaauucugugaaaccaaguuuguauauugaauuacauua

SEQ ID NO: 478794 - RNA, 64 nt, hsa
cuugugaaguugcuguuggcacauagcccacuaggaaaccaagaaguuugacugggagcgugug

SEQ ID NO: 478795 - RNA, 64 nt, hsa
aagaauugucauaggagggaagcuucaaagucaugaaaccaaucaacagccaagucagcaagca

SEQ ID NO: 478796 - RNA, 64 nt, hsa
ccagccuccccgcccgcucucuuuucucccaagcgaaaccaaaugcgccccuucaccucgcgug

SEQ ID NO: 478797 - RNA, 64 nt, hsa
uaauuuacuucuuauaaauugaagucuuaaaugugaaaccaagaaauguaaucaagcaguaaaa

SEQ ID NO: 478798 - RNA, 64 nt, hsa
cuccaccacugugcacuuagccaugauggcaacagaaaccaagagacacaauuacgcagguauu

SEQ ID NO: 478799 - RNA, 64 nt, hsa; identical to SEQ ID NO: 82047

SEQ ID NO: 478800 - RNA, 64 nt, hsa; identical to SEQ ID NO: 82048

SEQ ID NO: 478801 - RNA, 64 nt, hsa
guuaaaagccuauuauuguuaaaggccuuuuauggaaaccaacuuggaaaacaaccuuaaaugu

SEQ ID NO: 478802 - RNA, 64 nt, hsa
aaaaaaauaaaacgcaaaaaaagaaacuguaaaggaaaccaagagauuuuguuuaauuuuuuug

SEQ ID NO: 478803 - RNA, 64 nt, hsa
ccaaaggcauaagacccuaagccuccuuuugcuugaaaccaaagauauauacacaggauccuau

SEQ ID NO: 478804 - RNA, 64 nt, hsa
ccuucaagaggguuacaauguggccaucagacaggaaaccaaacgguggauaaaguauuaagua

SEQ ID NO: 478805 - RNA, 64 nt, hsa
gcauggaggagggaggcgugggaugggaauagcagaaaccaaccaugucuucagugauugaaac

SEQ ID NO: 478806 - RNA, 64 nt, hsa
augaaagugguaaaagugggaaccagugugcuuugaaaccaaauuagaaacacauuccuuggga

SEQ ID NO: 478807 - RNA, 64 nt, hsa
gcucaaaacacuacauccacauuauugacuuuuggaaaccaaccaaauuacuuaagaaauggaa

SEQ ID NO: 478808 - RNA, 64 nt, hsa
auauucucauuauuaacuuccucuauuucacacagaaaccaaggacaacaagauacaaauaccu

SEQ ID NO: 478809 - RNA, 64 nt, hsa
ucuucuaucuucuuuccaccuuucucuguuuuaugaaaccaacuguugacauacaaaccaugau

SEQ ID NO: 478810 - RNA, 64 nt, hsa
guuauauaugaacacucaaaucuuuuacuguaacgaaaccaagaaacuuguuuagaaugugaua

SEQ ID NO: 478811 - RNA, 64 nt, hsa; identical to SEQ ID NO: 82049

SEQ ID NO: 478812 - RNA, 64 nt, hsa; identical to SEQ ID NO: 82050

SEQ ID NO: 478813 - RNA, 64 nt, hsa; identical to SEQ ID NO: 82051

SEQ ID NO: 478814 - RNA, 64 nt, hsa
aaucacuuuuuaaaauauaaggaccgaaugcaaggaaaccaaaguuuauuaauaauuuuuauau

SEQ ID NO: 478815 - RNA, 64 nt, hsa
ccgagggaacccugggucuugggaagaacaacaggaaaccaaggucugaccuaggguucccucc

SEQ ID NO: 478816 - RNA, 64 nt, hsa
caauagaaauuuuucucauaauauauaccuaugugaaaccaacuuaucugcauaauuaaaucua

SEQ ID NO: 478817 - RNA, 64 nt, hsa
acuuuuagcuuugaucacaaguggacaaauuucugaaaccaaaggcaacuaaguugcuguguua

SEQ ID NO: 478818 - RNA, 62 nt, hsa
acagacucugcugucgcugagcuuccuagauagaaaccaaagcagugcaagauucaguucaa

SEQ ID NO: 478819 - RNA, 64 nt, hsa
uuacagauugccuccuuaugacgcggcucaaaaggaaaccaaguggucaggaguuguuucugac

SEQ ID NO: 478820 - RNA, 64 nt, hsa
acgcauuggcauccaaggccacggacuaugagaagaaaccaaacguguuuaaacuuaaaacugc

SEQ ID NO: 478821 - RNA, 64 nt, hsa
gaaccccugcaacccucccugaaccccugcaaaugaaaccaaacguccaccuggguguguucau

SEQ ID NO: 478822 - RNA, 64 nt, hsa
uucucauaguauagaguuuacuuuguacacguuugaaaccaacuacuguagaagaugaggaauc

SEQ ID NO: 478823 - RNA, 64 nt, hsa
uuaggggaucauaucaagaaaguuagucugguuggaaaccaagagaauggcugaugucucuuuc

SEQ ID NO: 478824 - RNA, 64 nt, hsa
ucccuaccugugaguuccuuuauuuauaauucuugaaaccaaaauguauaauguacaguuuuca

SEQ ID NO: 478825 - RNA, 64 nt, hsa
cagugaguuggucaaaugcuccugacaguguggagaaaccaacaggcaaaacgugggugcaaaa

SEQ ID NO: 478826 - RNA, 64 nt, hsa
agaacugucggaggaaagacaacacaaccaacgcgaaaccaauuccucauccucagaugcucaa

SEQ ID NO: 478827 - RNA, 64 nt, hsa
acaguuucccuacuguauguagaauccaggugcugaaaccaaguguuucuuuucccaugcucuu

SEQ ID NO: 478828 - RNA, 64 nt, hsa
ugggcuuuauuuggacaaaccaaacuuuuagccugaaaccaacuuuaugccacuaagucauagc

SEQ ID NO: 478829 - RNA, 64 nt, hsa
uguccacagauguacuggccauuacaugaaacaagaaaccaagcaucuuugcuguuguuaauua

SEQ ID NO: 478830 - RNA, 64 nt, hsa
uggcauuuccauguauauauguauauaaaugcaggaaaccaacaugucauugacaccucucuuc

SEQ ID NO: 478831 - RNA, 64 nt, hsa
uaagucuguacaaccuagcauagaauaaaaaacugaaaccaagauucccaacguuuuucauagc

SEQ ID NO: 478832 - RNA, 64 nt, hsa
cacaauuaagagcucaugucuuagcaagaucugggaaaccaacauugcgagaguagcuauuuug

SEQ ID NO: 478833 - RNA, 64 nt, hsa
acccaggaagcgucuuuggugcuugggagaccaagaaaccaagaaauuaacaacugaaagcauu

SEQ ID NO: 478834 - RNA, 64 nt, hsa
ggguucugaacccguucccuacacagaaaucuuggaaaccaaaugcugcugaguaaggaugaag

SEQ ID NO: 478835 - RNA, 64 nt, hsa
ccaucaaaacacauacacccagaaagaaacaacagaaaccaaaacucacaaggcgcaugauuac

SEQ ID NO: 478836 - RNA, 64 nt, hsa
ugggcacuaagcuaugggagagaccauagcugcagaaaccaacccugcccuaggcauaaaaugc

SEQ ID NO: 478837 - RNA, 64 nt, hsa
ggcagcaggcucaggcccacaccuugugauuuuugaaaccaaagcccagaagaugauguuuacu

SEQ ID NO: 478838 - RNA, 64 nt, hsa
acacgauuugucagagagaaaugaaagcaagccugaaaccaagcaauugagagugagaaagagg

SEQ ID NO: 478839 - RNA, 64 nt, hsa
aggacguguaccucuguguguucauggagcuggagaaaccaaaacugggucucucuccacccgg

SEQ ID NO: 478840 - RNA, 64 nt, hsa
uaaugucauuuuuauggauuguagacccaguuuugaaaccaaaaaagaaaccuagaaucuaaug

SEQ ID NO: 478841 - RNA, 64 nt, hsa
cacaccugcaauguaaaauggaagaaaaugcaaagaaaccaaaugugccgagugaauaaaggau

SEQ ID NO: 478842 - RNA, 64 nt, hsa
ggaaccaacauucaaauucugccucaucuggagggaaaccaaaauugggagggggaagaggacc

SEQ ID NO: 478843 - RNA, 64 nt, hsa
uaguacaauaagcguuaagggcagagucuaccuugaaaccaauuaagcagcuugguauucauaa

SEQ ID NO: 478844 - RNA, 64 nt, hsa
uauauauuuuuaaaucacauuaauuuuaccaagugaaaccaagccauacuguuuuugagccaau

SEQ ID NO: 478845 - RNA, 64 nt, hsa
gacaguccuguaagaucgagcaaccagucaugaugaaaccaagugguggccggaucaguaugac

SEQ ID NO: 478846 - RNA, 64 nt, hsa
uuauaugcauuaauuuaagagcaucuacuuagaagaaaccaaauagucuaucgcccucauauca

SEQ ID NO: 478847 - RNA, 64 nt, hsa
uaaagaaugagaauggauucuguacaauacacuagaaaccaacauaauguauuucuuuaaaacc

SEQ ID NO: 478848 - RNA, 64 nt, hsa
cucugaaaaccaaaaguauuuucauaacccauuugaaaccaaaccugaccugaacuuacacuga

SEQ ID NO: 478849 - RNA, 64 nt, hsa
ugggaguagacagaguuguauggccuggacaguggaaaccaagagcaggaucgcaaaguaacag

SEQ ID NO: 478850 - RNA, 64 nt, hsa
ugaagagaaaagccaugcccaccccagccccagagaaaccaauaagaauccucuauuauuuuca

SEQ ID NO: 478851 - RNA, 64 nt, hsa
cccguucgcccccaugugacuuuuaucuguagcagaaaccaagucuacuucacuaaugacgaug

SEQ ID NO: 478852 - RNA, 64 nt, hsa
uuuugcacaagguguuucauuuucguuuuuaugggaaaccaagggaaaagcacauugcgaucca

SEQ ID NO: 478853 - RNA, 64 nt, hsa
cuguggugccaaauugcuggugucucucuuuggagaaaccaaccagauacaucugcuggagagc

SEQ ID NO: 478854 - RNA, 64 nt, hsa
ggccugaagaggaagagaaaaaaaacaaaaaacagaaaccaaucgguaaucugauccaccacuu

SEQ ID NO: 478855 - RNA, 64 nt, hsa
ccuccagagaccgagcagcuguggggccugcugggaaaccaaggucgguuuccgcccucuagcg

SEQ ID NO: 478856 - RNA, 64 nt, hsa; identical to SEQ ID NO: 82052

SEQ ID NO: 478857 - RNA, 64 nt, hsa; identical to SEQ ID NO: 82053

SEQ ID NO: 478858 - RNA, 64 nt, hsa
ucauuccuggggcacuguggccugguuuugcuuugaaaccaagaaagagcaaagggaacccagc

SEQ ID NO: 478859 - RNA, 64 nt, hsa
guucaucaguguuuuauagaaaugguguugcugggaaaccaaguuugcaccuggaaacuuacaa

SEQ ID NO: 478860 - RNA, 64 nt, hsa
uauauauaacuaugcuaauuguucauaaucaacagaaaccaagauagagcuacaaacucagcug

SEQ ID NO: 478861 - RNA, 64 nt, hsa
ucucacucaggccuccagggauccaugggggagugaaaccaauucucagagaacaacccaccag

SEQ ID NO: 478862 - RNA, 64 nt, hsa
cagacauacgaaacacaaaccacaacugacacaggaaaccaacacccaaagcauggacuaaccc

SEQ ID NO: 478863 - RNA, 64 nt, hsa
gccucauccucauugcuucugccuccacguaaaugaaaccaaaggccucagcauauccugggag

SEQ ID NO: 478864 - RNA, 64 nt, hsa
aaacuuaaucuucaucuuuaaaaaaaagaaaaaagaaaccaaaaugagaaucaacacuucauag

SEQ ID NO: 478865 - RNA, 64 nt, hsa
uuauuuuuuaaaugaaaccuuuuuuuuucuuuuugaaaccaaauguuaaacuauagccuuaaga

SEQ ID NO: 478866 - RNA, 64 nt, hsa
gagaaaaaaaaaaagagaacccacaugaagcucugaaaccaaacagcauccugccaugagcuuc

SEQ ID NO: 478867 - RNA, 64 nt, hsa
ccauacacagaaacauaauaaacaaucuucacacgaaaccaaaaauagcauacaccuaauguug

SEQ ID NO: 478868 - RNA, 64 nt, hsa
gaccuuuggcucacagaacugcaggguauggugagaaaccaacuacggauugcugcaaaccaca

SEQ ID NO: 478869 - RNA, 64 nt, hsa
ucagauggcucccacauuuuaagauuuuaaaaaugaaaccaaaaaauaaauugaagaaaacugu

SEQ ID NO: 478870 - RNA, 64 nt, hsa
auuaaauacuuaaugcugauuugaagagauagcugaaaccaaggcugaagacuguuuuacuuuc

SEQ ID NO: 478871 - RNA, 64 nt, hsa
ccccagaucaugcuuuaauucuuucuuuucuguagaaaccaacaguuuccauuuaugucaaugc

SEQ ID NO: 478872 - RNA, 64 nt, hsa
agcaaguguguagcuuaaggccacuacugguaaggaaaccaaguguccucugugccuuuuuucu

SEQ ID NO: 478873 - RNA, 64 nt, hsa
gcuagcugugcagaacccaauugcccuuugcacagaaaccaaccccugacccagcgguaccggc

SEQ ID NO: 478874 - RNA, 64 nt, hsa
ccauggugauagccugaaagagcuuuccucacuagaaaccaaaugguguaaauauuuuauuuga

SEQ ID NO: 478875 - RNA, 64 nt, hsa
ggaugggagccacagugcccuucacucucuccuggaaaccaacuguaagcuggugggcucaacc

SEQ ID NO: 478876 - RNA, 64 nt, hsa
guguuuaguaucugaauuugaaacucaucugguggaaaccaaguuucaggggacaugaguuuuc

SEQ ID NO: 478877 - RNA, 64 nt, hsa
ggcuggucccaugugugaaagggacucucucggggaaaccaaggcccagccccuccccccuccc

SEQ ID NO: 478878 - RNA, 64 nt, hsa
auaacauuaagaaaaacaauaaagauacaugauugaaaccaaguugaaaaauagcauaugccuu

SEQ ID NO: 478879 - RNA, 64 nt, hsa
gagcuucagccucucuucgucgucuuaccccacugaaaccaacagggaucgggccaggcuccca

SEQ ID NO: 478880 - RNA, 64 nt, hsa
auggagcucuggacuccuaaauuccccugaagaagaaaccaauguacuguggucucuugggacu

SEQ ID NO: 478881 - RNA, 64 nt, hsa
cuguccacucuuguucaaguaucuaacucuucuggaaaccaaauaggcuuuagaagagauuauc

SEQ ID NO: 478882 - RNA, 64 nt, hsa
cguuuguagguucuuacuggaccagaggagucaagaaaccaagaugguuugggguauggggugg

SEQ ID NO: 478883 - RNA, 64 nt, hsa
ggcaagaugaccgucacauuacauguuuaaucuggaaaccaaagagacccugaagaauauuuga

SEQ ID NO: 478884 - RNA, 64 nt, hsa
caaaguucaaaaguagaaauaccaaaauagagcagaaaccaagcuaagaguguguuucuguguu

SEQ ID NO: 478885 - RNA, 64 nt, hsa
uuauuuguguuaucuuuauuucucuucauuguuagaaaccaaagucuucucugcuggcuggggc

SEQ ID NO: 478886 - RNA, 64 nt, hsa
ugccuccauuauccauucccaagaugccugaucagaaaccaaccaugaaugaaccccuggcucc

SEQ ID NO: 478887 - RNA, 64 nt, hsa
agaucccgccccuccuguccucuguguucccgcggaaaccaaccaaaccgugcgcugugaccca

SEQ ID NO: 478888 - RNA, 64 nt, hsa
agaaguaagcucugcauguuccccuuccugggaggaaaccaauugucagaaggauguaugauga

SEQ ID NO: 478889 - RNA, 64 nt, hsa
uuccccaaccucuuacacccuggaugucacuuuggaaaccaagcccuuggaagcaaguggggug

SEQ ID NO: 478890 - RNA, 64 nt, hsa
accaccuuucauguuuuugauugcccuacaaagagaaaccaaaugagcugauuacugacuauaa

SEQ ID NO: 478891 - RNA, 64 nt, hsa
uauaguggucacugugauauaauaaaucauaaaggaaaccaaaucacaaaggagaugguguggc

SEQ ID NO: 478892 - RNA, 64 nt, hsa; identical to SEQ ID NO: 82054

SEQ ID NO: 478893 - RNA, 64 nt, hsa; identical to SEQ ID NO: 82055

SEQ ID NO: 478894 - RNA, 64 nt, hsa
uuuuuaaaaagaaacuauuuuuguguuugaaagugaaaccaacauccagaucuauagcagaguc

SEQ ID NO: 478895 - RNA, 64 nt, hsa
aauugaaagcaacacuaauauagagccacuuccugaaaccaagaaucuguaguuuugauccaaa

SEQ ID NO: 478896 - RNA, 64 nt, hsa
uguuccaucauuucuagcuaaaacuccauuuggugaaaccaacauauccauuucuuuuccuagu

SEQ ID NO: 478897 - RNA, 64 nt, hsa
acaaccgugggggaacacaccacuuuuuacuguugaaaccaacacaacguugaaauccaggcuu

SEQ ID NO: 478898 - RNA, 64 nt, hsa
ggcccuucugaaacuuauggucaucucucccacugaaaccaaggucuuuucaaauguggcuaaa

SEQ ID NO: 478899 - RNA, 64 nt, hsa
acccuucagugcuacauuuuguggcuuuuuaauggaaaccaagccaauguuauagacguuugga

SEQ ID NO: 478900 - RNA, 64 nt, hsa
ggccccuggcuccggagaaugcuggauggaacaggaaaccaaucaccuggcaccacuuucaaga

SEQ ID NO: 478901 - RNA, 64 nt, hsa
ugugugugugugugcacaauaaauaggaaauguagaaaccaagcaagaaggcuuaguagcucag

SEQ ID NO: 478902 - RNA, 64 nt, hsa
cgagcuugucagcuuuuuugaaaacacaucaguagaaaccaagauuuuaaaaugaagugucaag

SEQ ID NO: 478903 - RNA, 64 nt, hsa
gcauccuuauauaauaaugcuauuuagaaagacugaaaccaagacuauuuaacugugaacuaug

SEQ ID NO: 478904 - RNA, 64 nt, hsa
cagacugccagcagcacccgucuguuacacaugugaaaccaaagccugcucucuccuaaggcuc

SEQ ID NO: 478905 - RNA, 64 nt, hsa
auuauguuuuuacugaaauuaacugaaaaaauaugaaaccaaaaguacaaacuguguugucuuu

SEQ ID NO: 478906 - RNA, 64 nt, hsa
uauuuaacaauagcaauaguucuagugaaugugugaaaccaagaaacacucuguacugugugcg

SEQ ID NO: 478907 - RNA, 64 nt, hsa
augaaaguugaccauaguuauuuccaaauaaaaagaaaccaacucuuaccaggucuuggacugu

SEQ ID NO: 478908 - RNA, 64 nt, hsa
ggauuccaaaugaaccccugcguuaguuacaaaggaaaccaaugccacuuuuguuuauaagacc

SEQ ID NO: 478909 - RNA, 64 nt, hsa
ccagcucuaguucagcuauaauuccuuuuauagagaaaccaaccugauacacacuuucaugaug

SEQ ID NO: 478910 - RNA, 64 nt, hsa
uuaauugaaaugucaaguuuccuguuacacuauggaaaccaagaaacaucagacaucauugcgu

SEQ ID NO: 478911 - RNA, 64 nt, hsa
uguuuuuuguuguuguuguuguuguuuuacagcugaaaccaaccagcaagcccuugaugaccaa

SEQ ID NO: 478912 - RNA, 64 nt, hsa
ggcccccgggggccccgccccgaagcagccuccugaaaccaaaacgcccgacgcagacgcggug

SEQ ID NO: 478913 - RNA, 64 nt, hsa
cuagcucuagccuguaccaguuaguucaucaaaggaaaccaaccgggaugcuaacuacaacaug

SEQ ID NO: 478914 - RNA, 64 nt, hsa
uccccacagacugccccagccaacgagauugcuggaaaccaagucaggccaggugggcggacaa

SEQ ID NO: 478915 - RNA, 64 nt, hsa
ccaaaccugugaccccaggccagggaacggggaggaaaccaaagaaaaccauuuucagggagcu

SEQ ID NO: 478916 - RNA, 64 nt, hsa
ucaccuaggauuggcuauucugagggauugcauagaaaccaagcuccacuugcuguccuuggga

SEQ ID NO: 478917 - RNA, 64 nt, hsa
cauaaugaauuacagucaugacaggcacauguaagaaaccaaaauuugcuaaauauguacauga

SEQ ID NO: 478918 - RNA, 64 nt, hsa
acaucuguucccaccaacuuacuauauauacacggaaaccaauuucuuacccuugcccuagauu

SEQ ID NO: 478919 - RNA, 64 nt, hsa
cccccguccggcuuccuugguggaggccgucuaggaaaccaaaaacucccaggaugccccggug

SEQ ID NO: 478920 - RNA, 64 nt, hsa
aaaggagaaguggggcagcugcaggacauguagagaaaccaaacugggaaaucuuacaaggagu

SEQ ID NO: 478921 - RNA, 64 nt, hsa
cuccaguuuaaaaaguguuauuuuuaaaacauuugaaaccaaguacuguuuaauuucaaucaga

SEQ ID NO: 478922 - RNA, 64 nt, hsa
ugcuucagccccagguguggugacuuagaccuaggaaaccaauuaugaguggaaagugacccuc

SEQ ID NO: 478923 - RNA, 64 nt, hsa
aacaaaaugccaguauuuucuuaagccaugaugugaaaccaaugacccugugaccacauggcac

SEQ ID NO: 478924 - RNA, 64 nt, hsa
aacguccugaccugugaucacacaugacagugaggaaaccaagugcaacuccuggguuuuuuua

SEQ ID NO: 478925 - RNA, 64 nt, hsa
aaauuucauuuuuuccuuuuuccauuuaucuguggaaaccaacagauauugcucuauauuuuuu

SEQ ID NO: 478926 - RNA, 64 nt, hsa; identical to SEQ ID NO: 82056

SEQ ID NO: 478927 - RNA, 64 nt, hsa; identical to SEQ ID NO: 82057

SEQ ID NO: 478928 - RNA, 64 nt, hsa
caacuaaauuuacccuuuacuuauuaguuaaaaggaaaccaaggcauguaggaaaauauuggua

SEQ ID NO: 478929 - RNA, 64 nt, hsa
aaccuuggagugagagcccagggacaggucccuggaaaccaaagaaaaaucgcauuucaacccu

SEQ ID NO: 478930 - RNA, 64 nt, hsa
acggggaacuauagcaauauuuaaagaugcuuuggaaaccaaccgugaacacaucaacaccacg

SEQ ID NO: 478931 - RNA, 64 nt, hsa
cuccccaccaccccuccugccccacuuuggcccagaaaccaaaugugaacuuccugucucccac

SEQ ID NO: 478932 - RNA, 64 nt, hsa
ggcaauuuaacgagccacuuccaugaucuccaaagaaaccaaaauacaaacacaauauuuaauc

SEQ ID NO: 478933 - RNA, 64 nt, hsa
ucaugugggcuugccuucucugccaaacgacugggaaaccaaaaugagcccaccuuguguucuu

SEQ ID NO: 478934 - RNA, 64 nt, hsa
gagagaaagucaaauaaagucaaagaccaguuuggaaaccaaaguuggaaaagaagaauuguag

SEQ ID NO: 478935 - RNA, 64 nt, hsa
agaaacacccuaaucuagauaaaggucuguuucagaaaccaacagugauggcauucuaaagagu

SEQ ID NO: 478936 - RNA, 64 nt, hsa
gguuggagacuucaaccgggcaaaggagcacaaggaaaccaagcagcagaggccccaucagcac

SEQ ID NO: 478937 - RNA, 64 nt, hsa
aaauauaguuuauaaaucggcaguacgguauuaugaaaccaagaaaggguuucuugaaaagcuu

SEQ ID NO: 478938 - RNA, 64 nt, hsa
gaaaacggcacaccaaucaauaaagaacugagcagaaaccaacagugugcuuuuaauaaaggau

SEQ ID NO: 478939 - RNA, 64 nt, hsa
aucacugcuccuuauaauaaaccuaauaaagcaagaaaccaagccuaucugggucucuuauuuc

SEQ ID NO: 478940 - RNA, 64 nt, hsa
auaaacuauuuaaaucaaaauauucuuacauauagaaaccaaguaagaauaaaugagagauauu

SEQ ID NO: 478941 - RNA, 64 nt, hsa
auuuauaaaugcacuguaauauguacacaacuuagaaaccaaauuacaaguauucaguuccaau

SEQ ID NO: 478942 - RNA, 64 nt, hsa
uuuaaauaaaacuucuuuuggauagaaaucauuagaaaccaagcauacugcacucuaauauuuu

SEQ ID NO: 478943 - RNA, 64 nt, hsa
uuugaagaaaaaaaagcguuauuuauaguccaaagaaaccaaagacuuagcucaccugcauucu

SEQ ID NO: 478944 - RNA, 64 nt, hsa
uguagcagcacacuuguucagguuugcaugguaugaaaccaaauagauucaugaaaccuuggcc

SEQ ID NO: 478945 - RNA, 64 nt, hsa
gaauagccaucgacaaacuaagggggccucagaggaaaccaacccugcugacaccucaaucuua

SEQ ID NO: 478946 - RNA, 64 nt, hsa
ugagcuguagcauuugggcuggccugccuuaucagaaaccaagcuuaugaagaucuucucccag

SEQ ID NO: 478947 - RNA, 64 nt, hsa
auuggcaccaaguuaggucucagaggaaagaauggaaaccaaucacuuuacauuuuuauuuuua

SEQ ID NO: 478948 - RNA, 64 nt, hsa
caucaacgcacaccugcuaucguggaacagccuagaaaccaagggacuccaccaccaagucacu

SEQ ID NO: 478949 - RNA, 64 nt, hsa
cgccagcugauuggaugucuaggaaugacugaaagaaaccaaaacagccuguccacugcugcug

SEQ ID NO: 478950 - RNA, 64 nt, hsa
cuugcccuggggccgguucuuacccagguccagagaaaccaacgcgggaugucagacuucacca

SEQ ID NO: 478951 - RNA, 64 nt, hsa
gucaguaccccugguaaaccaagccucccacacugaaaccaaaacauaaaaaccaaacccagac

SEQ ID NO: 478952 - RNA, 64 nt, hsa
uggccgucugcaagccgaggagggggccucaggagaaaccaacccugcaaucaccuugaucuug

SEQ ID NO: 478953 - RNA, 64 nt, hsa; identical to SEQ ID NO: 82058

SEQ ID NO: 478954 - RNA, 64 nt, hsa; identical to SEQ ID NO: 82059

SEQ ID NO: 478955 - RNA, 64 nt, hsa
uuaguggauuuaccuguagaguuuauuggauccugaaaccaaucaauuacuuagaacuaggcaa

SEQ ID NO: 478956 - RNA, 64 nt, hsa
ugugacagucacugcauuugccugcuucuuuccagaaaccaaacuaggagaugaaacugguucc

SEQ ID NO: 478957 - RNA, 64 nt, hsa
caccaagucucgucuucuuuccuuccugugaguugaaaccaaacaggccucucgcucacuccuc

SEQ ID NO: 478958 - RNA, 57 nt, hsa
uagucugcagaugccucuaaggaguccgaaaccaaguccgaagucaacaacaagcaa

SEQ ID NO: 478959 - RNA, 64 nt, hsa
caaccacaaagguguuugugauuccucaccccgggaaaccaaggagcugcaaaguggagucugg

SEQ ID NO: 478960 - RNA, 64 nt, hsa
uuuaacuuaaucaaaugugguaugggagggguuggaaaccaaguugucuccugggggggagaaa

SEQ ID NO: 478961 - RNA, 64 nt, hsa
guuuggccacccucuggccagccaaaagcacucugaaaccaagaccuucccauuuccuccuccc

SEQ ID NO: 478962 - RNA, 63 nt, hsa
aaauuguauauuuugaaaaauaaaacacugaaaagaaaccaacaaaaaugaguuguucaucag

SEQ ID NO: 478963 - RNA, 64 nt, hsa
aaggcagguagccuggcgccuaggaaccagaccugaaaccaaggaaccagacccgaaaccaggc

SEQ ID NO: 478964 - RNA, 64 nt, hsa
cagaaucagaaaaaaaaagcauuaaaauuuauuugaaaccaaaaaagagcccaaaaagccaaag

SEQ ID NO: 478965 - RNA, 64 nt, hsa
uuuccaguuuuauggaauugggagucugacaagugaaaccaauuuaauguaaaguauuuggcuu

SEQ ID NO: 478966 - RNA, 64 nt, hsa
agaaccccuuuuaucccuggaagaggcuguguaugaaaccaaugcccaggguuugaaggguguu

SEQ ID NO: 478967 - RNA, 64 nt, hsa
ucuuuuucagcuuuauuuuuaagaguacagucaggaaaccaacaaggggccuaagaguggcugc

SEQ ID NO: 478968 - RNA, 64 nt, hsa
uccaacuccaaagccauaaauaaucaccauuuuugaaaccaaaccagagccugaguguugccua

SEQ ID NO: 478969 - RNA, 64 nt, hsa
gguuaaaauuuauagucauucuaacugcacuuuggaaaccaagcaaggggagaagacaaaugaa

SEQ ID NO: 478970 - RNA, 64 nt, hsa
ggucaagcaauaggcgccuggcagugucaagccugaaaccaagcaauaccgucauguuucagcc

SEQ ID NO: 478971 - RNA, 64 nt, hsa
uauccagaggccugcugcagauggggaagagcuggaaaccaagaaguuugucaacagaggaccc

SEQ ID NO: 478972 - RNA, 64 nt, hsa
aaaaaaagucauuaggcuuucccuuugugucagugaaaccaaaagugcuucuuacaacguucgc

SEQ ID NO: 478973 - RNA, 64 nt, hsa
gauuugguugccauagucauaagcaaugauacaugaaaccaaugaaagacaguacauguaauaa

SEQ ID NO: 478974 - RNA, 64 nt, hsa
agaacauauuugcauaagauagcuauuuacucuggaaaccaacaacuuuugagauuucccuugc

SEQ ID NO: 478975 - RNA, 64 nt, hsa
aauuagugcaaauacaagcugcguuucuuuaauagaaaccaaaggcaucuggagcccgagaggc

SEQ ID NO: 478976 - RNA, 64 nt, hsa
uuuccuagccagcugggggacacuggaaauucgggaaaccaagagagaggaagaaggagacgcc

SEQ ID NO: 478977 - RNA, 64 nt, hsa
gcaggcugagcaagucuguaaacugauucugggagaaaccaagcugcuggccauaggguguccu

SEQ ID NO: 478978 - RNA, 64 nt, hsa
cacaggacagcagaagauccccuuugucaguggggaaaccaaggcagagcugaggggacaggga

SEQ ID NO: 478979 - RNA, 64 nt, hsa
ccuucccuuauuucuaacguguauguuucugguggaaaccaaguucacccuggcugggagcauc

SEQ ID NO: 478980 - RNA, 64 nt, hsa
cugccgcaagaccacuacaugacuuagggaacuugaaaccaacuggcucauggagaaaacaaau

SEQ ID NO: 478981 - RNA, 64 nt, hsa
cuggcugccucugagucugaaucucccaaagagagaaaccaauuucuaagaggacuggauugca

SEQ ID NO: 478982 - RNA, 64 nt, hsa
cgacgguagaguucuuucaucuaugguugaaucagaaaccaagaaacacuacuauuaaacugca

SEQ ID NO: 478983 - RNA, 64 nt, hsa
acaaggcuuccaggggaugccauccagccuguaggaaaccaaagaugggaaguggcuccuaggg

SEQ ID NO: 478984 - RNA, 64 nt, hsa
cugcacuucuagcccucauuuaagauuugagggugaaaccaaagaaaacccccuaagugaggga

SEQ ID NO: 478985 - RNA, 64 nt, hsa
cuuagcaagauauuuuaucucuguacauaaaguagaaaccaaaagcuagggaaacagauacucu

SEQ ID NO: 478986 - RNA, 64 nt, hsa
agauaaagaccuuuuccaugcacccucauacacagaaaccaauuuucuuuuuuauacucaauca

SEQ ID NO: 478987 - RNA, 64 nt, hsa
ccucucacugccugccagaaaacaaaaacaccaagaaaccaagucaacuuuucaccuccugagu

SEQ ID NO: 478988 - RNA, 64 nt, hsa
uauaguccuagcugacgccaauaauaaaaaacaagaaaccaagugggcugguauucucucuaug

SEQ ID NO: 478989 - RNA, 64 nt, hsa
uuuuuagaagaaauauguuacacucagaaaugaugaaaccaaaucuuauauuaaaaggcaaaga

SEQ ID NO: 478990 - RNA, 64 nt, hsa
ugauuccuuccaacgugcacuucagcuggagaaagaaaccaagaagggaagcggccgcugggcc

SEQ ID NO: 478991 - RNA, 64 nt, hsa
guuuggucagacaucaucuccuuggcugcccuuugaaaccaaaucacuugccuuggggauaaag

SEQ ID NO: 478992 - RNA, 64 nt, hsa
auaugacguacgaaauggacaaaaagcuuuuucugaaaccaacuuuuuacuuccaucauccuuu

SEQ ID NO: 478993 - RNA, 64 nt, hsa
gugauaggcuuaaagauuguauuuucacagaguggaaaccaauuuuuuuaguuauuguucaagg

SEQ ID NO: 478994 - RNA, 64 nt, hsa
gaggccgauuuuuuuuuuuuuaacauggaacaaugaaaccaacaacaaacauuuuuaaaauuaa

SEQ ID NO: 478995 - RNA, 64 nt, hsa
agccgggcaggguggaaggagcuugccucuuugagaaaccaaggagucccagugaucuguuacc

SEQ ID NO: 478996 - RNA, 64 nt, hsa
uugccaggggugaggccgugccccaggccuccccgaaaccaaaggggaaggcagggguggggcc

SEQ ID NO: 478997 - RNA, 64 nt, hsa
gcuaggggcccgccccgcggacugacagcaccaggaaaccaaaugaugucccugcccgccgccc

SEQ ID NO: 478998 - RNA, 64 nt, hsa
accuucgaaaacaugguaggacucacacuggauagaaaccaaagcaggugaaucaccugagguc

SEQ ID NO: 478999 - RNA, 64 nt, hsa
cucccacugccgcucaggggcugacccuauuuaggaaaccaaagaggguggguugaaccuacuc

SEQ ID NO: 479000 - RNA, 64 nt, hsa
cucugggucccccuucucuguccacccacagagugaaaccaauuaaaauguuggaucucauuua

SEQ ID NO: 479001 - RNA, 64 nt, hsa
cuuggagcacugagcaccauuuggaagcuugagagaaaccaaaauuaaagagagaaagagagag

SEQ ID NO: 479002 - RNA, 64 nt, hsa
gcccagcauucagggaggagucguaagaucuuaagaaaccaauccuugccucaagcaaaagcau

SEQ ID NO: 479003 - RNA, 64 nt, hsa
ccuggaacagaugcuuucauuauggccuccagaggaaaccaacccugucuccaccuugauauug

SEQ ID NO: 479004 - RNA, 64 nt, hsa
ugcagagggagccuccugcucccugcuccaggaugaaaccaagagggggaugucagccucaccc

SEQ ID NO: 479005 - RNA, 64 nt, hsa
cucggggcgggcggagcccgcguggccgaagcuggaaaccaaaccuaauaaaguuuucccaucc

SEQ ID NO: 479006 - RNA, 64 nt, hsa
aaauguuugucuuuucuguuuuuuaaaugaucaugaaaccaaaaagagacugaucauccaggcc

SEQ ID NO: 479007 - RNA, 64 nt, hsa
uuuauuauccuguccccagagggugguuuauccagaaaccaagaaaaaaaaucaaucagaauaa

SEQ ID NO: 479008 - RNA, 64 nt, hsa
uucauaaccaggccggaccacgugcaauaggguggaaaccaaacugcuccaugccggguuauuu

SEQ ID NO: 479009 - RNA, 64 nt, hsa
gcaggcggguggggggaugggaagggggugcccugaaaccaaacuggaagcccccucugccucc

SEQ ID NO: 479010 - RNA, 64 nt, hsa
uacuguauguugcuuuucuaaauaaauguauugugaaaccaaaacagcugcuguuaauauggau

SEQ ID NO: 479011 - RNA, 64 nt, hsa
acugauugcugucucgugugucuguaaaaugugugaaaccaaacugcagccucaacaccaugga

SEQ ID NO: 479012 - RNA, 64 nt, hsa
aaggcaggaaggauccugccuugauuuuacuucagaaaccaaaucagucuucuauaaucugggg

SEQ ID NO: 479013 - RNA, 64 nt, hsa
auuaaaacuuaacagcaucaaauuauugggaccagaaaccaaguaauguauaauguggcuuuug

SEQ ID NO: 479014 - RNA, 64 nt, hsa
gcccuuccaacucuggagugucuguaguucuugugaaaccaaaacguugacuaccugccucuuu

SEQ ID NO: 479015 - RNA, 64 nt, hsa
cugaagccuggauuccagcagugaaugcuagacagaaaccaagccauuaaugagauguuauuac

SEQ ID NO: 479016 - RNA, 64 nt, hsa
acuuuauuacgaguaaaguguaaugaguacuguggaaaccaaauuugaauacugcaaauuugua

SEQ ID NO: 479017 - RNA, 64 nt, hsa
uacaaacagggcagaaccacagaagaacguuuuagaaaccaagagaugugcagaaagaaauguu

SEQ ID NO: 479018 - RNA, 64 nt, hsa; identical to SEQ ID NO: 82060

SEQ ID NO: 479019 - RNA, 64 nt, hsa; identical to SEQ ID NO: 82061

SEQ ID NO: 479020 - RNA, 64 nt, hsa
uccucgaguggccacugugagccucgucacagcagaaaccaacuuuucuaacgacugaguucgc

SEQ ID NO: 479021 - RNA, 64 nt, hsa
uuuuacuggcaguucuauaguaguccagacuuuagaaaccaaacacaacaaaauggcuuguugc

SEQ ID NO: 479022 - RNA, 64 nt, hsa
gaugaugccuaggcccaaaggagaggccaaaagggaaaccaaggcugcacaccuagaaccccaa

SEQ ID NO: 479023 - RNA, 64 nt, hsa
gccccuucugccuuccaggagaggucuugcuuuugaaaccaaaaucauguucuucuaaaguguc

SEQ ID NO: 479024 - RNA, 64 nt, hsa
ggagaaagagaauuauccccacuucacagaugaggaaaccaaggcuaagagaugagcgaugccu

SEQ ID NO: 479025 - RNA, 64 nt, hsa
augauaaugauaccaaaggaaagauaauuaucaugaaaccaacuuuuggaucauucccuuuuua

SEQ ID NO: 479026 - RNA, 64 nt, hsa
ccacacaacaucaagaaggccgacaaccagguuggaaaccaagacggagcucagacccaccaca

SEQ ID NO: 479027 - RNA, 64 nt, hsa
cuuggggcagccauuggccucugucucguuuugggaaaccaaggucaggaggccguugcagaca

SEQ ID NO: 479028 - RNA, 64 nt, hsa
aguagagauaauguguagucacuucugauuuagugaaaccaauuguaauaauuguggaaauguu

SEQ ID NO: 479029 - RNA, 64 nt, hsa
aagaacucaaauuccuuucucauuggagccuagugaaaccaaaugaacgggaccugcuggccuc

SEQ ID NO: 479030 - RNA, 64 nt, hsa
uuccagaggaugcaucuggcucaccggguguuccgaaaccaaagaagaaacuucgccuuaucag

SEQ ID NO: 479031 - RNA, 64 nt, hsa
agucugcuguccugaaacccagaagugauggagagaaaccaacaagagaucucgaacccugucu

SEQ ID NO: 479032 - RNA, 64 nt, hsa
gcaccuacugggugcuggguucacuguguccuaggaaaccaagaggguccccaguccuggccuc

SEQ ID NO: 479033 - RNA, 64 nt, hsa
gcugguaccugcuggcccauggcccggguguagagaaaccaagcggcagccaccaccaguguug

SEQ ID NO: 479034 - RNA, 64 nt, hsa
uuaugcuaccuaccccuguacaaguuaugcgaaggaaaccaagccaucugcauguuuauuuccu

SEQ ID NO: 479035 - RNA, 64 nt, hsa
gcucuuucuaccaauguuugcuccugguuggaaagaaaccaaagauuuaagacgggcugcucuu

SEQ ID NO: 479036 - RNA, 64 nt, hsa
cuguaggaacuugacuugcguuagaguguacucugaaaccaacucgucucuggccgcaggaguc

SEQ ID NO: 479037 - RNA, 64 nt, hsa
gaaagaagguuuaucauuacaaauaccuuccaaugaaaccaagaauuucucaaaauauuuaaug

SEQ ID NO: 479038 - RNA, 64 nt, hsa
caaaaucaguuuuuauauuccccaaaagaagaaggaaaccaaggaguagcuauauauuucuacu

SEQ ID NO: 479039 - RNA, 64 nt, hsa
caacuauagguuuaaaccaagacaaaugaagacugaaaccaagaauauuguucuuaugcuggaa

SEQ ID NO: 479040 - RNA, 64 nt, hsa
gaaugggagggcgggccuggagcugcgugagagugaaaccaagaagcggauggggaagggagag

SEQ ID NO: 479041 - RNA, 64 nt, hsa
uauaaagugccucggacaguccgcaguuguagcagaaaccaacaagaaccacuccuucauguuu

SEQ ID NO: 479042 - RNA, 64 nt, hsa
agucauaugccuccagccauuauaugagaacugugaaaccaauaugguuuucuuuaugucuugg

SEQ ID NO: 479043 - RNA, 64 nt, hsa
auuauuucuuaucuuucuucuuuuauauuuuuuggaaaccaaauuuauaguuaguuuagguaaa

SEQ ID NO: 479044 - RNA, 64 nt, hsa
caccaaaaaaaguauauagugacauuuuuaguaugaaaccaaauuacacuaaggucuuuuguug

SEQ ID NO: 479045 - RNA, 64 nt, hsa
ugcauagaaggaggagagggaaaauguuuuguaagaaaccaaucaagauaaaggacagugaagu

SEQ ID NO: 479046 - RNA, 64 nt, hsa
aauaaaauuuccccuaaucuuuucugaaucuucugaaaccaaauguaacuauguuuuaucgucc

SEQ ID NO: 479047 - RNA, 64 nt, hsa
uuaaauuucuuaaccuaggcuucagggagcauaugaaaccaaaauuauauggaacauuuucugu

SEQ ID NO: 479048 - RNA, 64 nt, hsa
uguagaacuguaauaagugaauuacaggucacaugaaaccaaaacgggcccugcuccauaagag

SEQ ID NO: 479049 - RNA, 64 nt, hsa
aacucuuaaauuauaaugugaaaccugguuuuaugaaaccaaagacuagugcagcauuucagca

SEQ ID NO: 479050 - RNA, 64 nt, hsa
agcuaauuaagggcgaugauuauuauuacaagaagaaaccaagacauuacaccaugguuuuuag

SEQ ID NO: 479051 - RNA, 64 nt, hsa
cagaggagggugaggaagacuaauuaaacauggagaaaccaaauuggacaaauccucaccacca

SEQ ID NO: 479052 - RNA, 64 nt, hsa
auuucaacauagagucacauaaaugucccccugagaaaccaaucccacuucuuucuaggagauu

SEQ ID NO: 479053 - RNA, 64 nt, hsa
gugaggccugcagaggcccugaaugcacaaaugggaaaccaaggcacagagaggcucuccucuc

SEQ ID NO: 479054 - RNA, 61 nt, hsa
aggacaguggggaggauuagucacacauggagaaaccaaauuggacaaaucaucaccacug

SEQ ID NO: 479055 - RNA, 61 nt, hsa
aggaggguggggaggacuagucaaacauggagaaaccaaauuggacaaauccucacuacca

SEQ ID NO: 479056 - RNA, 64 nt, hsa
aacugaggaaggugcuuagauggugagggcucuagaaaccaagccccaugagcagcaguggaag

SEQ ID NO: 479057 - RNA, 64 nt, hsa
ugaaacuuugggaauuugcuuuagccagaauaaagaaaccaaaucaugaaaauuauggaagacu

SEQ ID NO: 479058 - RNA, 64 nt, hsa
aauuauuauuucuuaucuucuuuuauauuuuuuggaaaccaaauuuauaguuaguuuagguaaa

SEQ ID NO: 479059 - RNA, 64 nt, hsa
augugugaacuugacuuguguuagaguauauucugaaaccaacuugucccaggccacaggagug

SEQ ID NO: 479060 - RNA, 65 nt, hsa
caggacgucaaaaacucaccauggaccccaaggcagaaaccaagaacugucugcaggcaaauaag

SEQ ID NO: 479061 - RNA, 65 nt, hsa
ggaugcuuaauggugcuagaggcucaaguguguuugaaaccaagagccaguugucccccaugcag

SEQ ID NO: 479062 - RNA, 65 nt, hsa
ccucagccucugcaacugcaagaaaggggacccaagaaaccaaagucugccgcccaccucgcucc

SEQ ID NO: 479063 - RNA, 65 nt, hsa
auauuaaguguucucaacugaguaacuuuuaaguggaaaccaaguuuagauuuggggagugguaa

SEQ ID NO: 479064 - RNA, 65 nt, hsa
agacuuugucuaagccucauuauacugaaguugaagaaaccaaaugagcuccacccucacuuugc

SEQ ID NO: 479065 - RNA, 65 nt, hsa
uaaaaauuuauuaaauauaaauauccccagggacagaaaccaaggccccgagcucagggcagcug

SEQ ID NO: 479066 - RNA, 65 nt, hsa
gaagucaauugaguaaggacaccuccagccauacagaaaccaacacugugugggggccaaggucu

SEQ ID NO: 479067 - RNA, 65 nt, hsa
cgggagagcgaugcuuggauuuuuguuuccuauuagaaaccaacaguuuuguucuaauuucauuu

SEQ ID NO: 479068 - RNA, 65 nt, hsa
uugaagcucccagugaccuggagggaggauuccuggaaaccaaacaaucaguuuaggugcaggug

SEQ ID NO: 479069 - RNA, 65 nt, hsa
uuucaucagguaucuuucuguggcauuugagaacagaaaccaagaaacaugguaauuacuaaauu

SEQ ID NO: 479070 - RNA, 65 nt, hsa
aucccuuuucuauaaaaaauaaguuaaugugucaagaaaccaacucuauuaaggugggguuuaau

SEQ ID NO: 479071 - RNA, 65 nt, hsa
acauugcugauugguguuaaguugcuagacacugcgaaaccaagcugacucacaagaagaccucu

SEQ ID NO: 479072 - RNA, 65 nt, hsa
gguuuucgcacuucuuggcugguccagggacugcagaaaccaaagcugcuauuguugaggaauaa

SEQ ID NO: 479073 - RNA, 65 nt, hsa
caauuauguuaauaauuuauuuaaugagugguauggaaaccaauugauuuuuuuagauaaaagaa

SEQ ID NO: 479074 - RNA, 65 nt, hsa
cccccacucccacuuccaggauugugguuuggauugaaaccaaguuuacaaguagacaccccugg

SEQ ID NO: 479075 - RNA, 65 nt, hsa
gucaaaugauugccaucagaaagagacaacuugaagaaaccaacaaugacuaugaaacagcugac

SEQ ID NO: 479076 - RNA, 65 nt, hsa
auuuucacccauucugugguucauuguaguuuaaggaaaccaagcauauagaugcauuagugauu

SEQ ID NO: 479077 - RNA, 65 nt, hsa
guuucaccuuuguauaagauauagccaagacugaagaaaccaaauauauguguuuacuguagcau

SEQ ID NO: 479078 - RNA, 65 nt, hsa
uauauauauuauuuuuuuuuaagaaaggaggaaaagaaaccaaaaguuuuuuuuaagaaaaaaaa

SEQ ID NO: 479079 - RNA, 65 nt, hsa
gugcugccuucauccuccccaccuaaugcauuuuugaaaccaaagguaccuagccucagagacag

SEQ ID NO: 479080 - RNA, 65 nt, hsa
cgaaaauauuuccugauucaagauucuauaaaaaggaaaccaagcauaagacucugucaucauac

SEQ ID NO: 479081 - RNA, 65 nt, hsa
aaaagggcaagaucuuuuuuccuucacuuauugcugaaaccaagagcacaauucccauugagaga

SEQ ID NO: 479082 - RNA, 65 nt, hsa
aucccccaggacuugaugaccacacggggcagagagaaaccaaccaaggccagcaccuccgucgg

SEQ ID NO: 479083 - RNA, 65 nt, hsa
gauguuuaaaacaucaacacauugcuuaaaaugaugaaaccaacccucaaaaaacagucuccuaa

SEQ ID NO: 479084 - RNA, 65 nt, hsa
gggacauuagucguuauauuugacuugaaaagaaagaaaccaagugcgcuuugcaauauuuauua

SEQ ID NO: 479085 - RNA, 65 nt, hsa
guccuuagaagucccauucucccuuccaguuaugagaaaccaaugccuucuagauucaggugacu

SEQ ID NO: 479086 - RNA, 65 nt, hsa
guuuacaauuaggcuauuuuuuaauauaggauuuagaaaccaaggguauguguuuuaaaauuaca

SEQ ID NO: 479087 - RNA, 65 nt, hsa
caggcgaguggggcccaggacugguuccagugagagaaaccaaccacaggcacccaagcacuacc

SEQ ID NO: 479088 - RNA, 65 nt, hsa
cuccuucgagcuugacucugagagggaaagugacggaaaccaagucagaugagaugacugccaug

SEQ ID NO: 479089 - RNA, 65 nt, hsa
gagaagauuuauuccaccagggguauuucagcuuugaaaccaaaucuguguaucuaauacuaacc

SEQ ID NO: 479090 - RNA, 65 nt, hsa
cgaaacugacuugcucaccuggaacaccugauggugaaaccaaacaaauacaaaauccuucucca

SEQ ID NO: 479091 - RNA, 65 nt, hsa
acgccgcguggacugaagcucuucaugaugagauggaaaccaaaagggagucucccaugaugggg

SEQ ID NO: 479092 - RNA, 65 nt, hsa
uuacaguauacauauauauuuauaucacaauuuacgaaaccaaaaaguugaguuuccaauggaac

SEQ ID NO: 479093 - RNA, 65 nt, hsa
aaggcuaaccuuucuaagcucccuaacuugggccagaaaccaaagcugagcuuuuaacuuucucc

SEQ ID NO: 479094 - RNA, 65 nt, hsa
gggaaacuuacauguugagaucuacagagauccaggaaaccaaagcccugcugagcagagccauu

SEQ ID NO: 479095 - RNA, 65 nt, hsa
ucgacuugaguguaaacauaacuuauaugcacugggaaaccaaaaaaucugugugacuugcuuua

SEQ ID NO: 479096 - RNA, 65 nt, hsa
ugagauagucuuauucugauuuuuuuuuucuucuggaaaccaaguagaauuagggaugggaauac

SEQ ID NO: 479097 - RNA, 65 nt, hsa
cguuucuucccuguauuuucuuucucuacuuugaggaaaccaaaguaaccuuuugcaccugcucu

SEQ ID NO: 479098 - RNA, 65 nt, hsa
uuucauuauguguucuacagugucggugaauaaaugaaaccaaucucaauuuagagguauggaug

SEQ ID NO: 479099 - RNA, 65 nt, hsa
uacugcauccuucaacucucacuagaaaaucuuuugaaaccaaauggauuaauuuauggcuauuu

SEQ ID NO: 479100 - RNA, 65 nt, hsa
aacugaagaugauguaugaaggaguuggaguuguugaaaccaagguguccaugaucccuccccac

SEQ ID NO: 479101 - RNA, 65 nt, hsa
gcagugucuuaaggagacugguaggaggaggcauggaaaccaaaaggccguguguuuagaagccu

SEQ ID NO: 479102 - RNA, 65 nt, hsa
uaaacaaaugcuuguugauagccuuuuucuaucaagaaaccaaggagcuaauuauuaauaacaau

SEQ ID NO: 479103 - RNA, 65 nt, hsa
auuccuggaaucaaggaauccugagucugggcaaugaaaccaaagccaggaguugacgcauccug

SEQ ID NO: 479104 - RNA, 65 nt, hsa
uuucuuggcaguauuccaugggauguuaagcaaaggaaaccaaaggaaucguuucaaauggacuc

SEQ ID NO: 479105 - RNA, 65 nt, hsa
uccucugaaggccgggacccagucauacauccuuagaaaccaaaguaugguuuuuguuuucucuu

SEQ ID NO: 479106 - RNA, 65 nt, hsa
ggaagaaaaauagguguauaaaauguuuuccaugagaaaccaagaaacuuacacugguuugacag

SEQ ID NO: 479107 - RNA, 65 nt, hsa
acucauuaaguguuauuuauuuuacucaagaacuggaaaccaacuaaaugccuucuauagaagua

SEQ ID NO: 479108 - RNA, 65 nt, hsa
uacucuuucucaccugaugcucuuaaaagaucuuagaaaccaaccauacagacgagccgaugcgg

SEQ ID NO: 479109 - RNA, 65 nt, hsa
gccauuugcacauaguuaccagucacucuguuucugaaaccaauccagaaauucauguuagaaca

SEQ ID NO: 479110 - RNA, 53 nt, hsa; identical to SEQ ID NO: 478681

SEQ ID NO: 479111 - RNA, 65 nt, hsa
ucaguaauguauuugaaggaaaaauacccugauuugaaaccaacagcagauguugcaaacuuuca

SEQ ID NO: 479112 - RNA, 50 nt, hsa; identical to SEQ ID NO: 478683

SEQ ID NO: 479113 - RNA, 65 nt, hsa
gaugccucuacuaucauuaccucuauugggacccagaaaccaauaccccaaaauauggugcaugg

SEQ ID NO: 479114 - RNA, 65 nt, hsa
gccacgcuuguuccccauguaccucuagagaagcagaaaccaaagucccccugugcccugggagg

SEQ ID NO: 479115 - RNA, 65 nt, hsa
gcucugagggcuguuuuuuuuuuuugauguuaacagaaaccaaucuuagcaccuuuucaaggggu

SEQ ID NO: 479116 - RNA, 65 nt, hsa
uagcuagcaaucuaugcaaacaccuuucccauaaagaaaccaaaccccauaguacagugccuugu

SEQ ID NO: 479117 - RNA, 65 nt, hsa
caaaacucuguguugcugcaggguuugaacuuuuggaaaccaauuaaaaugugccuuuggugggc

SEQ ID NO: 479118 - RNA, 65 nt, hsa
cuuaaagaggagagcaggaagaaagguugguuucagaaaccaagagggucggcaguggacgcgua

SEQ ID NO: 479119 - RNA, 58 nt, hsa; identical to SEQ ID NO: 478690

SEQ ID NO: 479120 - RNA, 65 nt, hsa
ggucuacaauggggagaacuuguuuuauagaugaggaaaccaaggcucagaggggcaaagucacc

SEQ ID NO: 479121 - RNA, 65 nt, hsa
guacuucguuaugaaaaugccuuccacgcaaauaagaaaccaagggauaaaacuguucauggaug

SEQ ID NO: 479122 - RNA, 65 nt, hsa
aaaaugugaacguuuucuaacugccucguaggguagaaaccaauauuuuucaggaugcuguauuu

SEQ ID NO: 479123 - RNA, 65 nt, hsa
ggauacauucuucagcauuuggcaguuaaucugcugaaaccaaaguaagaacugaaugacaguga

SEQ ID NO: 479124 - RNA, 65 nt, hsa
uauguuauucauguauuacugggagaugcuaccaagaaaccaacccaaagaaaauucugaaaaau

SEQ ID NO: 479125 - RNA, 65 nt, hsa
acuccucaauugggaguguugugacugaaaugcuugaaaccaaagcuucagauaaacuugcaaga

SEQ ID NO: 479126 - RNA, 65 nt, hsa
auagguuuccgcuuucaugggacaugagugaaaaugaaaccaagucaauaugagguaccuuuaca

SEQ ID NO: 479127 - RNA, 65 nt, hsa
ggauuuacuuuuaagaggcaaaaugugaguaaauugaaaccaagaaaacuuguuuuuagaauauu

SEQ ID NO: 479128 - RNA, 65 nt, hsa
cgcagugaguuaaaauuuaguaagaugaagauguggaaaccaaugaaaaguacauuuagaaaugc

SEQ ID NO: 479129 - RNA, 65 nt, hsa
uguagagcugaguuaccaaaauuucuauuucaaaggaaaccaaaccuuaaaaaaaaaaaacaaaa

SEQ ID NO: 479130 - RNA, 65 nt, hsa
uaaauggugcuuuguuccugcugguuccaagcucagaaaccaagacuagcuuuguaggagagaau

SEQ ID NO: 479131 - RNA, 65 nt, hsa
ucaucuauuccuuuucucuugugucccuacucauugaaaccaaacucuggaaaggacccaaugua

SEQ ID NO: 479132 - RNA, 65 nt, hsa
uaauguuucuuaaaaguuuuugagaaaaaaaggaagaaaccaacucauucagaaggcucggauuc

SEQ ID NO: 479133 - RNA, 65 nt, hsa
aguccaggaguccaaguagaucucgaaguaaaucugaaaccaaaucaagacacagaacaaggucu

SEQ ID NO: 479134 - RNA, 65 nt, hsa
uuaaggacuuuccuuccuccaucuccaagaaugcugaaaccaagggggaugacaugugacuccua

SEQ ID NO: 479135 - RNA, 65 nt, hsa
ccuuuuauuuauagaaugcaugucuuuuguguuaagaaaccaaagagaaauaaagagaacacucc

SEQ ID NO: 479136 - RNA, 65 nt, hsa
ugauggcucacugggcucuuggaggggaaugugaagaaaccaaggagucacuuuuucaucuagau

SEQ ID NO: 479137 - RNA, 65 nt, hsa
gugguaggcagugucccuucugcuugaaaccuauugaaaccaauuuaaaacuguguacuuuuuaa

SEQ ID NO: 479138 - RNA, 65 nt, hsa
gucaccuuaguggaaagguuaaaaaccagagccuggaaaccaagaugauugauuugacaagguau

SEQ ID NO: 479139 - RNA, 65 nt, hsa
uucucagugacagaagcauguuugagaugccgugggaaaccaaauauauaauaauaaaaauauaa

SEQ ID NO: 479140 - RNA, 65 nt, hsa
ugcaaauauuccauuguaaacaaaucaaaggaaaagaaaccaagaacugaauuacugucugccca

SEQ ID NO: 479141 - RNA, 65 nt, hsa
ucagucaaagggcaccauucuuuuuuuuuuuuuuugaaaccaaagcugucucagaaauggccaau

SEQ ID NO: 479142 - RNA, 65 nt, hsa
caaauugcacuuuuggaagcccggugucaugaaaugaaaccaaaccucggugccaucgcagagua

SEQ ID NO: 479143 - RNA, 65 nt, hsa
cugcagauggauguuuccaugaagaaaucucugaagaaaccaaaagagcugaaacugaaaaaaga

SEQ ID NO: 479144 - RNA, 65 nt, hsa
cgugugcaaaccucuugacuuuaccccacauuacugaaaccaaaauauauuugcuucaucugccc

SEQ ID NO: 479145 - RNA, 65 nt, hsa
acccaacucacccaagcagcaacgagcaacaaucggaaaccaaauacuggagagaaaaccaacgu

SEQ ID NO: 479146 - RNA, 65 nt, hsa
gugguggugucaccacuacuuaauugggagauaaugaaaccaaucauggaugcuguuuuuauugg

SEQ ID NO: 479147 - RNA, 65 nt, hsa
auuauguucuguuaaugggaauuuaacauauuuaagaaaccaauauuuaaaauguuggucuaggu

SEQ ID NO: 479148 - RNA, 65 nt, hsa
ccguucauggagcuggucauuucuugaaaugagaagaaaccaaccuggaagaugucuuuuucagu

SEQ ID NO: 479149 - RNA, 65 nt, hsa
uuuuuaaauugcaaauguaauuuuugccaauuagagaaaccaaccggugucaguaaaauucugug

SEQ ID NO: 479150 - RNA, 63 nt, hsa; identical to SEQ ID NO: 478721

SEQ ID NO: 479151 - RNA, 65 nt, hsa
uauauaaauauaaaauuauauauaaaggguuauuugaaaccaauccauggcaacgcuggugcuug

SEQ ID NO: 479152 - RNA, 65 nt, hsa
agaagcuuuacuuuuccacuuuuuuuuaaaaaaaagaaaccaacaauuuaaauuauauugauguu

SEQ ID NO: 479153 - RNA, 65 nt, hsa
cauuuuuacaccccuuaagggugcuuaauucuguugaaaccaaaaagauuugucuacaaaugcua

SEQ ID NO: 479154 - RNA, 65 nt, hsa
caaugccaccagagauagugggggaaaugccagaugaaaccaacucuugcucucacuaguuguca

SEQ ID NO: 479155 - RNA, 65 nt, hsa
ggggugaggcuuagcccagaaggagaacugagcaggaaaccaaggcucuucucuguccccugccc

SEQ ID NO: 479156 - RNA, 65 nt, hsa
ugccuccauuuuccugagaucaaaaagacuguuucgaaaccaacaucugauauguaaacugcucu

SEQ ID NO: 479157 - RNA, 65 nt, hsa
cccuucugagcguuucugacagcucccagcugggagaaaccaacaugacgaaaagacaaagaaua

SEQ ID NO: 479158 - RNA, 65 nt, hsa
uggaaugaugguugcacaacuuugugaauauacuagaaaccaaugaauuaaaaacuuuggaagau

SEQ ID NO: 479159 - RNA, 65 nt, hsa
uucugcaguuccuuauaggcgaagggaaccggguggaaaccaagcugggagaggcugaggauggc

SEQ ID NO: 479160 - RNA, 65 nt, hsa
cauuguaccauacaauuucauuaucuuaucagaaugaaaccaauucacagggaaacuagagacua

SEQ ID NO: 479161 - RNA, 65 nt, hsa
aaggaaauaucaaagaacacaacgcaggacuugcugaaaccaaauuacuacuucacacucuccuu

SEQ ID NO: 479162 - RNA, 65 nt, hsa
ggcaacauuuuggaagcagagggcaacucucacuggaaaccaaaucuccuggcaccuugaucuug

SEQ ID NO: 479163 - RNA, 65 nt, hsa
guauauaagucaagaauguuuuauugucauuaugugaaaccaauauuggcaaauaguacuuuaau

SEQ ID NO: 479164 - RNA, 65 nt, hsa
gcaguaauagauaugugauuuuacaucauuuuuaagaaaccaaggggaaguaauaaguugaaaaa

SEQ ID NO: 479165 - RNA, 65 nt, hsa
uccauucuuaauuguaauuuuuuucuuuaaauaaggaaaccaauauaaucucauguauaaaaacu

SEQ ID NO: 479166 - RNA, 65 nt, hsa
guugguugacaaaauuggcuguuggcaucaguauagaaaccaacuggcagcuuucccugacaagc

SEQ ID NO: 479167 - RNA, 65 nt, hsa
agcuccaugcucgcuacgucuugaaccuuuuguaugaaaccaagaaacaucugguacagcugcca

SEQ ID NO: 479168 - RNA, 65 nt, hsa
gcuucugguaccaugauccucaacuuagagaggaagaaaccaagacagagagcuuaacucacuuc

SEQ ID NO: 479169 - RNA, 65 nt, hsa
acuggauugauuguggacuuuuauacuauauugcagaaaccaauaucuguuucuuggugguuaug

SEQ ID NO: 479170 - RNA, 65 nt, hsa
uaacuuucuaacagaacuuccauaacuagaagguggaaaccaaaacccucaugguaguauuuccu

SEQ ID NO: 479171 - RNA, 65 nt, hsa
ucaauggaggggucuggggaccaugguauaaagaggaaaccaagaaaaagaagccaagcaaaaau

SEQ ID NO: 479172 - RNA, 65 nt, hsa
agugccugguauauaguaggugcucaauaaauguugaaaccaacugaacugccaacaaaauaaaa

SEQ ID NO: 479173 - RNA, 65 nt, hsa
aaaucccaguucucuaauuugguuuucuucuuugggaaaccaaacauacaaaugaaucaguauca

SEQ ID NO: 479174 - RNA, 65 nt, hsa
auugucuucguaaaaguuagaucugacuucagacagaaaccaauaccagcuuccuuuuccuuuaa

SEQ ID NO: 479175 - RNA, 65 nt, hsa
uauaaaccaaaacaaaauuuccaaaaacaaugaaggaaaccaaaauaaauauuucugcauuucag

SEQ ID NO: 479176 - RNA, 65 nt, hsa
cugccugugcuuuuguuugacugucucuagauuuugaaaccaaaaaacugaacugaaaucaucua

SEQ ID NO: 479177 - RNA, 65 nt, hsa
agcugugccggcgcuacgggacccgagccgucccagaaaccaaagggcaggcacggcagcaaacg

SEQ ID NO: 479178 - RNA, 65 nt, hsa
gguaaaguaaaaggaaacaguacacuuggagcuaggaaaccaaagcaagcuuugugaaacuggca

SEQ ID NO: 479179 - RNA, 65 nt, hsa
gaugaucaguccaacugaacgaccuuacaaaugaggaaaccaagauaaaugagcugccagaauca

SEQ ID NO: 479180 - RNA, 65 nt, hsa
ggauaccuccagguuccaguaaaauucuucugaccgaaaccaauguggguguuagaaaaauuacc

SEQ ID NO: 479181 - RNA, 65 nt, hsa
ucaccccagcacugcuguugggaaggugacugcaggaaaccaauucuuacaagauccaggcccag

SEQ ID NO: 479182 - RNA, 65 nt, hsa
aauacaaccagcauagaaagacccaaaacuauacagaaaccaaaaccagaaugccauguggugga

SEQ ID NO: 479183 - RNA, 65 nt, hsa
aagauauuaagcguguguaaaugggcuuuagucuggaaaccaaaaaaaaaaaaaaaauuuaguca

SEQ ID NO: 479184 - RNA, 65 nt, hsa
ucccaccaugcccuucugccaucuucugggagaaggaaaccaaaggaucuaaaacugggguuugg

SEQ ID NO: 479185 - RNA, 65 nt, hsa
ugacccuagagcagaggugggcaaacuaugaccuggaaaccaaaucugacuuaccaccuuuuccu

SEQ ID NO: 479186 - RNA, 65 nt, hsa
caucugauuugguauugugauuuacuucagacccugaaaccaaauaucugaucuuccauuagacu

SEQ ID NO: 479187 - RNA, 65 nt, hsa
cucuaaacucguccccagaggaggacuugaaugaggaaaccaacacuuugagaaaccaaaguccu

SEQ ID NO: 479188 - RNA, 65 nt, hsa
agaggaggacuugaaugaggaaaccaacacuuugagaaaccaaaguccuuuuucccaaagguucu

SEQ ID NO: 479189 - RNA, 65 nt, hsa
ggguugcauggaaguuuuauucucuuguuuugcuggaaaccaagaggauccaaacuuccugcaac

SEQ ID NO: 479190 - RNA, 65 nt, hsa
ugggugggaggcaccaaaacuuggcagcugugccagaaaccaaagccaggcccagauguaggggg

SEQ ID NO: 479191 - RNA, 65 nt, hsa
cacgcaaaacuggcuucuucuggucacuggugucugaaaccaaauccagagcagccuguggccug

SEQ ID NO: 479192 - RNA, 65 nt, hsa
auuaaaguuccuaagacccagugacaguacugggagaaaccaaggcugaagagucagguugaagc

SEQ ID NO: 479193 - RNA, 65 nt, hsa
cuaauguaauaauagaaaaauacucauaauagggagaaaccaagagaaguuuuguuuuuguuuuu

SEQ ID NO: 479194 - RNA, 65 nt, hsa
ucaggauaacacaagcuuaguguuagaucuuguaggaaaccaagauuagaaacauuagaaauuug

SEQ ID NO: 479195 - RNA, 65 nt, hsa
cuaaaaauuguuagaaauuggugggaaaauagguagaaaccaaggaagcagacacaacaugcauu

SEQ ID NO: 479196 - RNA, 65 nt, hsa
auuagccugugucaaguucuuugagugauacuagugaaaccaaauagaaaacuauuguuggauca

SEQ ID NO: 479197 - RNA, 65 nt, hsa
aaagcuaaagaagacuaugauaccauacccaucuagaaaccaagaacuaguuugaaaucguuuau

SEQ ID NO: 479198 - RNA, 65 nt, hsa
gaauccaagugacugugaaaaggucucauuacaaugaaaccaauccuaaauaauuacaccaacuu

SEQ ID NO: 479199 - RNA, 65 nt, hsa
uuguacaugcauucauacaggcagcgauggucucagaaaccaaacaguuugcucuaggggaagag

SEQ ID NO: 479200 - RNA, 65 nt, hsa
uaucagagcuggaaccucaucccugcacagaugaggaaaccaaggcauggagcaguucccagagu

SEQ ID NO: 479201 - RNA, 65 nt, hsa
gcucuuccucaaggcaaccugaggccagacaccaagaaaccaagcguaucugcucuaaaaugacu

SEQ ID NO: 479202 - RNA, 65 nt, hsa
ggugauuauuauuaacucuagauaagcagguacuagaaaccaaaacucagaaaauguuuacuguu

SEQ ID NO: 479203 - RNA, 65 nt, hsa
auagucaucucauccuacucaauuuuucaaaggcagaaaccaacccuggagcaauugagaggacu

SEQ ID NO: 479204 - RNA, 65 nt, hsa
acauuuuauauggcugaucaauuuucauacauugagaaaccaagucaaucaagcaggaaucauuu

SEQ ID NO: 479205 - RNA, 65 nt, hsa
uuacuagucaaauccgucagugaucccgagucccagaaaccaaaggcucuuuucagagccaccca

SEQ ID NO: 479206 - RNA, 65 nt, hsa
cuagcuuuaggggaccaugaagagacucucuuagggaaaccaauaguccccaucagcaccaugga

SEQ ID NO: 479207 - RNA, 65 nt, hsa
ucauuuaguaauguaccuugaguuaaaaagccugagaaaccaaacacagcuaaugcuauggggug

SEQ ID NO: 479208 - RNA, 65 nt, hsa
cagagggaacgagcuguagguuugcagaaaugugugaaaccaaaaugaucacugccuacuuguga

SEQ ID NO: 479209 - RNA, 65 nt, hsa
augguuuaaucagucuaauuguuuugacuguuauagaaaccaaauauuuuacuguuucuuuuaag

SEQ ID NO: 479210 - RNA, 65 nt, hsa
agugagguagauugcugucccguuaacauagugcugaaaccaaaggcaguggggguccaaacucg

SEQ ID NO: 479211 - RNA, 65 nt, hsa
ccacuuucuagaacauauucuuuacuaauguuauugaaaccaauuucuacuucauacugauguuu

SEQ ID NO: 479212 - RNA, 65 nt, hsa
cauuuuaauaccaugccagagaagaguauucugcugaaaccaacagguuuuacuggucaaaauga

SEQ ID NO: 479213 - RNA, 65 nt, hsa
uuugggaauuaaacaggucacacgugacagaugaagaaaccaagggggcugcugaggagaccugg

SEQ ID NO: 479214 - RNA, 65 nt, hsa
ucaauuacuauaauccugagccauggugugcuacugaaaccaauuuuuauccaccaucuaguccu

SEQ ID NO: 479215 - RNA, 65 nt, hsa
gaucaucacaaauccuuuaaaacaauuaccuaaaagaaaccaaaaauccugccuucuuugugggg

SEQ ID NO: 479216 - RNA, 65 nt, hsa
ucagggcgaaaagaaaaaaauaauacuauuaauaagaaaccaacaaacaagaaccucucuuucua

SEQ ID NO: 479217 - RNA, 65 nt, hsa
uuuggaauacuggucaucuuucugacaucacaguagaaaccaaaccuuggauuuagauucaaaag

SEQ ID NO: 479218 - RNA, 65 nt, hsa
ucugacacccuuuaaugugguugcagaucucagaugaaaccaagcuuaauuauacuaugccauua

SEQ ID NO: 479219 - RNA, 65 nt, hsa
caauaaaauuguaauauaauaaauuuggcugacaagaaaccaaagugauucuuaauuaguauaca

SEQ ID NO: 479220 - RNA, 65 nt, hsa
aacucuuuacaagcuaagaagagagggccucagaagaaaccaacccugccaacaccuugaucuug

SEQ ID NO: 479221 - RNA, 65 nt, hsa
agucaagaguugaggagacauuacaauguguaauggaaaccaaggaaagugaaacuuuggauaag

SEQ ID NO: 479222 - RNA, 65 nt, hsa
uuaucuuugugcuauauaguggauuauaauucugugaaaccaaguuuguauauugaauuacauua

SEQ ID NO: 479223 - RNA, 65 nt, hsa
ccuugugaaguugcuguuggcacauagcccacuaggaaaccaagaaguuugacugggagcgugug

SEQ ID NO: 479224 - RNA, 65 nt, hsa
gaagaauugucauaggagggaagcuucaaagucaugaaaccaaucaacagccaagucagcaagca

SEQ ID NO: 479225 - RNA, 65 nt, hsa
gccagccuccccgcccgcucucuuuucucccaagcgaaaccaaaugcgccccuucaccucgcgug

SEQ ID NO: 479226 - RNA, 65 nt, hsa
auaauuuacuucuuauaaauugaagucuuaaaugugaaaccaagaaauguaaucaagcaguaaaa

SEQ ID NO: 479227 - RNA, 65 nt, hsa
gcuccaccacugugcacuuagccaugauggcaacagaaaccaagagacacaauuacgcagguauu

SEQ ID NO: 479228 - RNA, 65 nt, hsa
uucuuuuugaaucucucaaacggcaacauuccucagaaaccaaagcuuuauuucaaaucucuucc

SEQ ID NO: 479229 - RNA, 65 nt, hsa
caucucuguugcuaacacacagagcucaccuguuugaaaccaagcuuucaaacauguugaagcuc

SEQ ID NO: 479230 - RNA, 65 nt, hsa
uguuaaaagccuauuauuguuaaaggccuuuuauggaaaccaacuuggaaaacaaccuuaaaugu

SEQ ID NO: 479231 - RNA, 65 nt, hsa
gaaaaaaauaaaacgcaaaaaaagaaacuguaaaggaaaccaagagauuuuguuuaauuuuuuug

SEQ ID NO: 479232 - RNA, 65 nt, hsa
uccaaaggcauaagacccuaagccuccuuuugcuugaaaccaaagauauauacacaggauccuau

SEQ ID NO: 479233 - RNA, 65 nt, hsa
uccuucaagaggguuacaauguggccaucagacaggaaaccaaacgguggauaaaguauuaagua

SEQ ID NO: 479234 - RNA, 65 nt, hsa
ggcauggaggagggaggcgugggaugggaauagcagaaaccaaccaugucuucagugauugaaac

SEQ ID NO: 479235 - RNA, 65 nt, hsa
caugaaagugguaaaagugggaaccagugugcuuugaaaccaaauuagaaacacauuccuuggga

SEQ ID NO: 479236 - RNA, 65 nt, hsa
agcucaaaacacuacauccacauuauugacuuuuggaaaccaaccaaauuacuuaagaaauggaa

SEQ ID NO: 479237 - RNA, 65 nt, hsa
aauauucucauuauuaacuuccucuauuucacacagaaaccaaggacaacaagauacaaauaccu

SEQ ID NO: 479238 - RNA, 65 nt, hsa
aucuucuaucuucuuuccaccuuucucuguuuuaugaaaccaacuguugacauacaaaccaugau

SEQ ID NO: 479239 - RNA, 65 nt, hsa
uguuauauaugaacacucaaaucuuuuacuguaacgaaaccaagaaacuuguuuagaaugugaua

SEQ ID NO: 479240 - RNA, 65 nt, hsa
cuuuggggaauuuuggccaggagacccugaaacaugaaaccaaacaggcuuugauauuuuuuuuu

SEQ ID NO: 479241 - RNA, 65 nt, hsa
gcuguggcuuugagaaguuaacuuuuguggaauaugaaaccaaaggaagaauuuccauguagaua

SEQ ID NO: 479242 - RNA, 65 nt, hsa
ucaugggaauuacauaaggauaaugaggcccaacugaaaccaaguuucagucugccuuaccuuua

SEQ ID NO: 479243 - RNA, 65 nt, hsa
uaaucacuuuuuaaaauauaaggaccgaaugcaaggaaaccaaaguuuauuaauaauuuuuauau

SEQ ID NO: 479244 - RNA, 65 nt, hsa
accgagggaacccugggucuugggaagaacaacaggaaaccaaggucugaccuaggguucccucc

SEQ ID NO: 479245 - RNA, 65 nt, hsa
acaauagaaauuuuucucauaauauauaccuaugugaaaccaacuuaucugcauaauuaaaucua

SEQ ID NO: 479246 - RNA, 65 nt, hsa
aacuuuuagcuuugaucacaaguggacaaauuucugaaaccaaaggcaacuaaguugcuguguua

SEQ ID NO: 479247 - RNA, 62 nt, hsa; identical to SEQ ID NO: 478818

SEQ ID NO: 479248 - RNA, 65 nt, hsa
uuuacagauugccuccuuaugacgcggcucaaaaggaaaccaaguggucaggaguuguuucugac

SEQ ID NO: 479249 - RNA, 65 nt, hsa
cacgcauuggcauccaaggccacggacuaugagaagaaaccaaacguguuuaaacuuaaaacugc

SEQ ID NO: 479250 - RNA, 65 nt, hsa
ugaaccccugcaacccucccugaaccccugcaaaugaaaccaaacguccaccuggguguguucau

SEQ ID NO: 479251 - RNA, 65 nt, hsa
cuucucauaguauagaguuuacuuuguacacguuugaaaccaacuacuguagaagaugaggaauc

SEQ ID NO: 479252 - RNA, 65 nt, hsa
uuuaggggaucauaucaagaaaguuagucugguuggaaaccaagagaauggcugaugucucuuuc

SEQ ID NO: 479253 - RNA, 65 nt, hsa
cucccuaccugugaguuccuuuauuuauaauucuugaaaccaaaauguauaauguacaguuuuca

SEQ ID NO: 479254 - RNA, 65 nt, hsa
acagugaguuggucaaaugcuccugacaguguggagaaaccaacaggcaaaacgugggugcaaaa

SEQ ID NO: 479255 - RNA, 65 nt, hsa
cagaacugucggaggaaagacaacacaaccaacgcgaaaccaauuccucauccucagaugcucaa

SEQ ID NO: 479256 - RNA, 65 nt, hsa
cacaguuucccuacuguauguagaauccaggugcugaaaccaaguguuucuuuucccaugcucuu

SEQ ID NO: 479257 - RNA, 65 nt, hsa
uugggcuuuauuuggacaaaccaaacuuuuagccugaaaccaacuuuaugccacuaagucauagc

SEQ ID NO: 479258 - RNA, 65 nt, hsa
uuguccacagauguacuggccauuacaugaaacaagaaaccaagcaucuuugcuguuguuaauua

SEQ ID NO: 479259 - RNA, 65 nt, hsa
cuggcauuuccauguauauauguauauaaaugcaggaaaccaacaugucauugacaccucucuuc

SEQ ID NO: 479260 - RNA, 65 nt, hsa
auaagucuguacaaccuagcauagaauaaaaaacugaaaccaagauucccaacguuuuucauagc

SEQ ID NO: 479261 - RNA, 65 nt, hsa
acacaauuaagagcucaugucuuagcaagaucugggaaaccaacauugcgagaguagcuauuuug

SEQ ID NO: 479262 - RNA, 65 nt, hsa
aacccaggaagcgucuuuggugcuugggagaccaagaaaccaagaaauuaacaacugaaagcauu

SEQ ID NO: 479263 - RNA, 65 nt, hsa
aggguucugaacccguucccuacacagaaaucuuggaaaccaaaugcugcugaguaaggaugaag

SEQ ID NO: 479264 - RNA, 65 nt, hsa
gccaucaaaacacauacacccagaaagaaacaacagaaaccaaaacucacaaggcgcaugauuac

SEQ ID NO: 479265 - RNA, 65 nt, hsa
gugggcacuaagcuaugggagagaccauagcugcagaaaccaacccugcccuaggcauaaaaugc

SEQ ID NO: 479266 - RNA, 65 nt, hsa
aggcagcaggcucaggcccacaccuugugauuuuugaaaccaaagcccagaagaugauguuuacu

SEQ ID NO: 479267 - RNA, 65 nt, hsa
cacacgauuugucagagagaaaugaaagcaagccugaaaccaagcaauugagagugagaaagagg

SEQ ID NO: 479268 - RNA, 65 nt, hsa
uaggacguguaccucuguguguucauggagcuggagaaaccaaaacugggucucucuccacccgg

SEQ ID NO: 479269 - RNA, 65 nt, hsa
uuaaugucauuuuuauggauuguagacccaguuuugaaaccaaaaaagaaaccuagaaucuaaug

SEQ ID NO: 479270 - RNA, 65 nt, hsa
ccacaccugcaauguaaaauggaagaaaaugcaaagaaaccaaaugugccgagugaauaaaggau

SEQ ID NO: 479271 - RNA, 65 nt, hsa
uggaaccaacauucaaauucugccucaucuggagggaaaccaaaauugggagggggaagaggacc

SEQ ID NO: 479272 - RNA, 65 nt, hsa
uuaguacaauaagcguuaagggcagagucuaccuugaaaccaauuaagcagcuugguauucauaa

SEQ ID NO: 479273 - RNA, 65 nt, hsa
auauauauuuuuaaaucacauuaauuuuaccaagugaaaccaagccauacuguuuuugagccaau

SEQ ID NO: 479274 - RNA, 65 nt, hsa
agacaguccuguaagaucgagcaaccagucaugaugaaaccaagugguggccggaucaguaugac

SEQ ID NO: 479275 - RNA, 65 nt, hsa
uuuauaugcauuaauuuaagagcaucuacuuagaagaaaccaaauagucuaucgcccucauauca

SEQ ID NO: 479276 - RNA, 65 nt, hsa
guaaagaaugagaauggauucuguacaauacacuagaaaccaacauaauguauuucuuuaaaacc

SEQ ID NO: 479277 - RNA, 65 nt, hsa
gcucugaaaaccaaaaguauuuucauaacccauuugaaaccaaaccugaccugaacuuacacuga

SEQ ID NO: 479278 - RNA, 65 nt, hsa
augggaguagacagaguuguauggccuggacaguggaaaccaagagcaggaucgcaaaguaacag

SEQ ID NO: 479279 - RNA, 65 nt, hsa
augaagagaaaagccaugcccaccccagccccagagaaaccaauaagaauccucuauuauuuuca

SEQ ID NO: 479280 - RNA, 65 nt, hsa
acccguucgcccccaugugacuuuuaucuguagcagaaaccaagucuacuucacuaaugacgaug

SEQ ID NO: 479281 - RNA, 65 nt, hsa
uuuuugcacaagguguuucauuuucguuuuuaugggaaaccaagggaaaagcacauugcgaucca

SEQ ID NO: 479282 - RNA, 65 nt, hsa
acuguggugccaaauugcuggugucucucuuuggagaaaccaaccagauacaucugcuggagagc

SEQ ID NO: 479283 - RNA, 65 nt, hsa
uggccugaagaggaagagaaaaaaaacaaaaaacagaaaccaaucgguaaucugauccaccacuu

SEQ ID NO: 479284 - RNA, 65 nt, hsa
gccuccagagaccgagcagcuguggggccugcugggaaaccaaggucgguuuccgcccucuagcg

SEQ ID NO: 479285 - RNA, 65 nt, hsa
uauuuuaguuuuauuuuugaaaccaagcaucuauagaaaccaagaaagucagcauguaagcguca

SEQ ID NO: 479286 - RNA, 65 nt, hsa
ggauuuggaauuuuuguuauuuuaguuuuauuuuugaaaccaagcaucuauagaaaccaagaaag

SEQ ID NO: 479287 - RNA, 65 nt, hsa
uucauuccuggggcacuguggccugguuuugcuuugaaaccaagaaagagcaaagggaacccagc

SEQ ID NO: 479288 - RNA, 65 nt, hsa
uguucaucaguguuuuauagaaaugguguugcugggaaaccaaguuugcaccuggaaacuuacaa

SEQ ID NO: 479289 - RNA, 65 nt, hsa
uuauauauaacuaugcuaauuguucauaaucaacagaaaccaagauagagcuacaaacucagcug

SEQ ID NO: 479290 - RNA, 65 nt, hsa
aucucacucaggccuccagggauccaugggggagugaaaccaauucucagagaacaacccaccag

SEQ ID NO: 479291 - RNA, 65 nt, hsa
ccagacauacgaaacacaaaccacaacugacacaggaaaccaacacccaaagcauggacuaaccc

SEQ ID NO: 479292 - RNA, 65 nt, hsa
cgccucauccucauugcuucugccuccacguaaaugaaaccaaaggccucagcauauccugggag

SEQ ID NO: 479293 - RNA, 65 nt, hsa
caaacuuaaucuucaucuuuaaaaaaaagaaaaaagaaaccaaaaugagaaucaacacuucauag

SEQ ID NO: 479294 - RNA, 65 nt, hsa
auuauuuuuuaaaugaaaccuuuuuuuuucuuuuugaaaccaaauguuaaacuauagccuuaaga

SEQ ID NO: 479295 - RNA, 65 nt, hsa
agagaaaaaaaaaaagagaacccacaugaagcucugaaaccaaacagcauccugccaugagcuuc

SEQ ID NO: 479296 - RNA, 65 nt, hsa
uccauacacagaaacauaauaaacaaucuucacacgaaaccaaaaauagcauacaccuaauguug

SEQ ID NO: 479297 - RNA, 65 nt, hsa
agaccuuuggcucacagaacugcaggguauggugagaaaccaacuacggauugcugcaaaccaca

SEQ ID NO: 479298 - RNA, 65 nt, hsa
cucagauggcucccacauuuuaagauuuuaaaaaugaaaccaaaaaauaaauugaagaaaacugu

SEQ ID NO: 479299 - RNA, 65 nt, hsa
uauuaaauacuuaaugcugauuugaagagauagcugaaaccaaggcugaagacuguuuuacuuuc

SEQ ID NO: 479300 - RNA, 65 nt, hsa
cccccagaucaugcuuuaauucuuucuuuucuguagaaaccaacaguuuccauuuaugucaaugc

SEQ ID NO: 479301 - RNA, 65 nt, hsa
aagcaaguguguagcuuaaggccacuacugguaaggaaaccaaguguccucugugccuuuuuucu

SEQ ID NO: 479302 - RNA, 65 nt, hsa
ugcuagcugugcagaacccaauugcccuuugcacagaaaccaaccccugacccagcgguaccggc

SEQ ID NO: 479303 - RNA, 65 nt, hsa
cccauggugauagccugaaagagcuuuccucacuagaaaccaaaugguguaaauauuuuauuuga

SEQ ID NO: 479304 - RNA, 65 nt, hsa
gggaugggagccacagugcccuucacucucuccuggaaaccaacuguaagcuggugggcucaacc

SEQ ID NO: 479305 - RNA, 65 nt, hsa
uguguuuaguaucugaauuugaaacucaucugguggaaaccaaguuucaggggacaugaguuuuc

SEQ ID NO: 479306 - RNA, 65 nt, hsa
uggcuggucccaugugugaaagggacucucucggggaaaccaaggcccagccccuccccccuccc

SEQ ID NO: 479307 - RNA, 65 nt, hsa
uauaacauuaagaaaaacaauaaagauacaugauugaaaccaaguugaaaaauagcauaugccuu

SEQ ID NO: 479308 - RNA, 65 nt, hsa
agagcuucagccucucuucgucgucuuaccccacugaaaccaacagggaucgggccaggcuccca

SEQ ID NO: 479309 - RNA, 65 nt, hsa
uauggagcucuggacuccuaaauuccccugaagaagaaaccaauguacuguggucucuugggacu

SEQ ID NO: 479310 - RNA, 65 nt, hsa
ucuguccacucuuguucaaguaucuaacucuucuggaaaccaaauaggcuuuagaagagauuauc

SEQ ID NO: 479311 - RNA, 65 nt, hsa
acguuuguagguucuuacuggaccagaggagucaagaaaccaagaugguuugggguauggggugg

SEQ ID NO: 479312 - RNA, 65 nt, hsa
uggcaagaugaccgucacauuacauguuuaaucuggaaaccaaagagacccugaagaauauuuga

SEQ ID NO: 479313 - RNA, 65 nt, hsa
acaaaguucaaaaguagaaauaccaaaauagagcagaaaccaagcuaagaguguguuucuguguu

SEQ ID NO: 479314 - RNA, 65 nt, hsa
auuauuuguguuaucuuuauuucucuucauuguuagaaaccaaagucuucucugcuggcuggggc

SEQ ID NO: 479315 - RNA, 65 nt, hsa
cugccuccauuauccauucccaagaugccugaucagaaaccaaccaugaaugaaccccuggcucc

SEQ ID NO: 479316 - RNA, 65 nt, hsa
cagaucccgccccuccuguccucuguguucccgcggaaaccaaccaaaccgugcgcugugaccca

SEQ ID NO: 479317 - RNA, 65 nt, hsa
cagaaguaagcucugcauguuccccuuccugggaggaaaccaauugucagaaggauguaugauga

SEQ ID NO: 479318 - RNA, 65 nt, hsa
uuuccccaaccucuuacacccuggaugucacuuuggaaaccaagcccuuggaagcaaguggggug

SEQ ID NO: 479319 - RNA, 65 nt, hsa
caccaccuuucauguuuuugauugcccuacaaagagaaaccaaaugagcugauuacugacuauaa

SEQ ID NO: 479320 - RNA, 65 nt, hsa
auauaguggucacugugauauaauaaaucauaaaggaaaccaaaucacaaaggagaugguguggc

SEQ ID NO: 479321 - RNA, 65 nt, hsa
cacuuggccucacuaccagaagaaggguggagucagaaaccaaagugaccuccagagcuguccuc

SEQ ID NO: 479322 - RNA, 65 nt, hsa
agagcaaauauuguucuucccauuuuacagauucagaaaccaaggcuaagggacuggucuaaagu

SEQ ID NO: 479323 - RNA, 65 nt, hsa
uuuuuuaaaaagaaacuauuuuuguguuugaaagugaaaccaacauccagaucuauagcagaguc

SEQ ID NO: 479324 - RNA, 65 nt, hsa
uaauugaaagcaacacuaauauagagccacuuccugaaaccaagaaucuguaguuuugauccaaa

SEQ ID NO: 479325 - RNA, 65 nt, hsa
auguuccaucauuucuagcuaaaacuccauuuggugaaaccaacauauccauuucuuuuccuagu

SEQ ID NO: 479326 - RNA, 65 nt, hsa
gacaaccgugggggaacacaccacuuuuuacuguugaaaccaacacaacguugaaauccaggcuu

SEQ ID NO: 479327 - RNA, 65 nt, hsa
uggcccuucugaaacuuauggucaucucucccacugaaaccaaggucuuuucaaauguggcuaaa

SEQ ID NO: 479328 - RNA, 65 nt, hsa
aacccuucagugcuacauuuuguggcuuuuuaauggaaaccaagccaauguuauagacguuugga

SEQ ID NO: 479329 - RNA, 65 nt, hsa
uggccccuggcuccggagaaugcuggauggaacaggaaaccaaucaccuggcaccacuuucaaga

SEQ ID NO: 479330 - RNA, 65 nt, hsa
gugugugugugugugcacaauaaauaggaaauguagaaaccaagcaagaaggcuuaguagcucag

SEQ ID NO: 479331 - RNA, 65 nt, hsa
ccgagcuugucagcuuuuuugaaaacacaucaguagaaaccaagauuuuaaaaugaagugucaag

SEQ ID NO: 479332 - RNA, 65 nt, hsa
agcauccuuauauaauaaugcuauuuagaaagacugaaaccaagacuauuuaacugugaacuaug

SEQ ID NO: 479333 - RNA, 65 nt, hsa
ccagacugccagcagcacccgucuguuacacaugugaaaccaaagccugcucucuccuaaggcuc

SEQ ID NO: 479334 - RNA, 65 nt, hsa
uauuauguuuuuacugaaauuaacugaaaaaauaugaaaccaaaaguacaaacuguguugucuuu

SEQ ID NO: 479335 - RNA, 65 nt, hsa
uuauuuaacaauagcaauaguucuagugaaugugugaaaccaagaaacacucuguacugugugcg

SEQ ID NO: 479336 - RNA, 65 nt, hsa
aaugaaaguugaccauaguuauuuccaaauaaaaagaaaccaacucuuaccaggucuuggacugu

SEQ ID NO: 479337 - RNA, 65 nt, hsa
uggauuccaaaugaaccccugcguuaguuacaaaggaaaccaaugccacuuuuguuuauaagacc

SEQ ID NO: 479338 - RNA, 65 nt, hsa
uccagcucuaguucagcuauaauuccuuuuauagagaaaccaaccugauacacacuuucaugaug

SEQ ID NO: 479339 - RNA, 65 nt, hsa
uuuaauugaaaugucaaguuuccuguuacacuauggaaaccaagaaacaucagacaucauugcgu

SEQ ID NO: 479340 - RNA, 65 nt, hsa
uuguuuuuuguuguuguuguuguuguuuuacagcugaaaccaaccagcaagcccuugaugaccaa

SEQ ID NO: 479341 - RNA, 65 nt, hsa
cggcccccgggggccccgccccgaagcagccuccugaaaccaaaacgcccgacgcagacgcggug

SEQ ID NO: 479342 - RNA, 65 nt, hsa
ccuagcucuagccuguaccaguuaguucaucaaaggaaaccaaccgggaugcuaacuacaacaug

SEQ ID NO: 479343 - RNA, 65 nt, hsa
guccccacagacugccccagccaacgagauugcuggaaaccaagucaggccaggugggcggacaa

SEQ ID NO: 479344 - RNA, 65 nt, hsa
uccaaaccugugaccccaggccagggaacggggaggaaaccaaagaaaaccauuuucagggagcu

SEQ ID NO: 479345 - RNA, 65 nt, hsa
cucaccuaggauuggcuauucugagggauugcauagaaaccaagcuccacuugcuguccuuggga

SEQ ID NO: 479346 - RNA, 65 nt, hsa
ucauaaugaauuacagucaugacaggcacauguaagaaaccaaaauuugcuaaauauguacauga

SEQ ID NO: 479347 - RNA, 65 nt, hsa
aacaucuguucccaccaacuuacuauauauacacggaaaccaauuucuuacccuugcccuagauu

SEQ ID NO: 479348 - RNA, 65 nt, hsa
gcccccguccggcuuccuugguggaggccgucuaggaaaccaaaaacucccaggaugccccggug

SEQ ID NO: 479349 - RNA, 65 nt, hsa
uaaaggagaaguggggcagcugcaggacauguagagaaaccaaacugggaaaucuuacaaggagu

SEQ ID NO: 479350 - RNA, 65 nt, hsa
acuccaguuuaaaaaguguuauuuuuaaaacauuugaaaccaaguacuguuuaauuucaaucaga

SEQ ID NO: 479351 - RNA, 65 nt, hsa
uugcuucagccccagguguggugacuuagaccuaggaaaccaauuaugaguggaaagugacccuc

SEQ ID NO: 479352 - RNA, 65 nt, hsa
aaacaaaaugccaguauuuucuuaagccaugaugugaaaccaaugacccugugaccacauggcac

SEQ ID NO: 479353 - RNA, 65 nt, hsa
aaacguccugaccugugaucacacaugacagugaggaaaccaagugcaacuccuggguuuuuuua

SEQ ID NO: 479354 - RNA, 65 nt, hsa
caaauuucauuuuuuccuuuuuccauuuaucuguggaaaccaacagauauugcucuauauuuuuu

SEQ ID NO: 479355 - RNA, 65 nt, hsa
agaaaccaaaccaccaucuuuuauaaauugccauggaaaccaagugccuucaaugaaacaagccu

SEQ ID NO: 479356 - RNA, 65 nt, hsa
uugaacacccaaacuacgucaucuguuccaaugaagaaaccaaaccaccaucuuuuauaaauugc

SEQ ID NO: 479357 - RNA, 65 nt, hsa
gcaacuaaauuuacccuuuacuuauuaguuaaaaggaaaccaaggcauguaggaaaauauuggua

SEQ ID NO: 479358 - RNA, 65 nt, hsa
uaaccuuggagugagagcccagggacaggucccuggaaaccaaagaaaaaucgcauuucaacccu

SEQ ID NO: 479359 - RNA, 65 nt, hsa
aacggggaacuauagcaauauuuaaagaugcuuuggaaaccaaccgugaacacaucaacaccacg

SEQ ID NO: 479360 - RNA, 65 nt, hsa
ucuccccaccaccccuccugccccacuuuggcccagaaaccaaaugugaacuuccugucucccac

SEQ ID NO: 479361 - RNA, 65 nt, hsa
uggcaauuuaacgagccacuuccaugaucuccaaagaaaccaaaauacaaacacaauauuuaauc

SEQ ID NO: 479362 - RNA, 65 nt, hsa
gucaugugggcuugccuucucugccaaacgacugggaaaccaaaaugagcccaccuuguguucuu

SEQ ID NO: 479363 - RNA, 65 nt, hsa
agagagaaagucaaauaaagucaaagaccaguuuggaaaccaaaguuggaaaagaagaauuguag

SEQ ID NO: 479364 - RNA, 65 nt, hsa
aagaaacacccuaaucuagauaaaggucuguuucagaaaccaacagugauggcauucuaaagagu

SEQ ID NO: 479365 - RNA, 65 nt, hsa
agguuggagacuucaaccgggcaaaggagcacaaggaaaccaagcagcagaggccccaucagcac

SEQ ID NO: 479366 - RNA, 65 nt, hsa
aaaauauaguuuauaaaucggcaguacgguauuaugaaaccaagaaaggguuucuugaaaagcuu

SEQ ID NO: 479367 - RNA, 65 nt, hsa
agaaaacggcacaccaaucaauaaagaacugagcagaaaccaacagugugcuuuuaauaaaggau

SEQ ID NO: 479368 - RNA, 65 nt, hsa
caucacugcuccuuauaauaaaccuaauaaagcaagaaaccaagccuaucugggucucuuauuuc

SEQ ID NO: 479369 - RNA, 65 nt, hsa
uauaaacuauuuaaaucaaaauauucuuacauauagaaaccaaguaagaauaaaugagagauauu

SEQ ID NO: 479370 - RNA, 65 nt, hsa
gauuuauaaaugcacuguaauauguacacaacuuagaaaccaaauuacaaguauucaguuccaau

SEQ ID NO: 479371 - RNA, 65 nt, hsa
uuuuaaauaaaacuucuuuuggauagaaaucauuagaaaccaagcauacugcacucuaauauuuu

SEQ ID NO: 479372 - RNA, 65 nt, hsa
auuugaagaaaaaaaagcguuauuuauaguccaaagaaaccaaagacuuagcucaccugcauucu

SEQ ID NO: 479373 - RNA, 65 nt, hsa
guguagcagcacacuuguucagguuugcaugguaugaaaccaaauagauucaugaaaccuuggcc

SEQ ID NO: 479374 - RNA, 65 nt, hsa
ggaauagccaucgacaaacuaagggggccucagaggaaaccaacccugcugacaccucaaucuua

SEQ ID NO: 479375 - RNA, 65 nt, hsa
cugagcuguagcauuugggcuggccugccuuaucagaaaccaagcuuaugaagaucuucucccag

SEQ ID NO: 479376 - RNA, 65 nt, hsa
uauuggcaccaaguuaggucucagaggaaagaauggaaaccaaucacuuuacauuuuuauuuuua

SEQ ID NO: 479377 - RNA, 65 nt, hsa
ccaucaacgcacaccugcuaucguggaacagccuagaaaccaagggacuccaccaccaagucacu

SEQ ID NO: 479378 - RNA, 65 nt, hsa
ccgccagcugauuggaugucuaggaaugacugaaagaaaccaaaacagccuguccacugcugcug

SEQ ID NO: 479379 - RNA, 65 nt, hsa
ccuugcccuggggccgguucuuacccagguccagagaaaccaacgcgggaugucagacuucacca

SEQ ID NO: 479380 - RNA, 65 nt, hsa
agucaguaccccugguaaaccaagccucccacacugaaaccaaaacauaaaaaccaaacccagac

SEQ ID NO: 479381 - RNA, 65 nt, hsa
guggccgucugcaagccgaggagggggccucaggagaaaccaacccugcaaucaccuugaucuug

SEQ ID NO: 479382 - RNA, 65 nt, hsa
ugguccuugugaugguauuacuuuuuacaaagaaugaaaccaaauggacucagcccucucccaca

SEQ ID NO: 479383 - RNA, 65 nt, hsa
aguuguccccauugucuacccacacaaauccucaggaaaccaaccaccgcccagguggcccugag

SEQ ID NO: 479384 - RNA, 65 nt, hsa
cuuaguggauuuaccuguagaguuuauuggauccugaaaccaaucaauuacuuagaacuaggcaa

SEQ ID NO: 479385 - RNA, 65 nt, hsa
uugugacagucacugcauuugccugcuucuuuccagaaaccaaacuaggagaugaaacugguucc

SEQ ID NO: 479386 - RNA, 65 nt, hsa
ucaccaagucucgucuucuuuccuuccugugaguugaaaccaaacaggccucucgcucacuccuc

SEQ ID NO: 479387 - RNA, 57 nt, hsa; identical to SEQ ID NO: 478958

SEQ ID NO: 479388 - RNA, 65 nt, hsa
ccaaccacaaagguguuugugauuccucaccccgggaaaccaaggagcugcaaaguggagucugg

SEQ ID NO: 479389 - RNA, 65 nt, hsa
auuuaacuuaaucaaaugugguaugggagggguuggaaaccaaguugucuccugggggggagaaa

SEQ ID NO: 479390 - RNA, 65 nt, hsa
uguuuggccacccucuggccagccaaaagcacucugaaaccaagaccuucccauuuccuccuccc

SEQ ID NO: 479391 - RNA, 64 nt, hsa
uaaauuguauauuuugaaaaauaaaacacugaaaagaaaccaacaaaaaugaguuguucaucag

SEQ ID NO: 479392 - RNA, 65 nt, hsa
aaaggcagguagccuggcgccuaggaaccagaccugaaaccaaggaaccagacccgaaaccaggc

SEQ ID NO: 479393 - RNA, 65 nt, hsa
acagaaucagaaaaaaaaagcauuaaaauuuauuugaaaccaaaaaagagcccaaaaagccaaag

SEQ ID NO: 479394 - RNA, 65 nt, hsa
uuuuccaguuuuauggaauugggagucugacaagugaaaccaauuuaauguaaaguauuuggcuu

SEQ ID NO: 479395 - RNA, 65 nt, hsa
aagaaccccuuuuaucccuggaagaggcuguguaugaaaccaaugcccaggguuugaaggguguu

SEQ ID NO: 479396 - RNA, 65 nt, hsa
cucuuuuucagcuuuauuuuuaagaguacagucaggaaaccaacaaggggccuaagaguggcugc

SEQ ID NO: 479397 - RNA, 65 nt, hsa
cuccaacuccaaagccauaaauaaucaccauuuuugaaaccaaaccagagccugaguguugccua

SEQ ID NO: 479398 - RNA, 65 nt, hsa
agguuaaaauuuauagucauucuaacugcacuuuggaaaccaagcaaggggagaagacaaaugaa

SEQ ID NO: 479399 - RNA, 65 nt, hsa
aggucaagcaauaggcgccuggcagugucaagccugaaaccaagcaauaccgucauguuucagcc

SEQ ID NO: 479400 - RNA, 65 nt, hsa
uuauccagaggccugcugcagauggggaagagcuggaaaccaagaaguuugucaacagaggaccc

SEQ ID NO: 479401 - RNA, 65 nt, hsa
gaaaaaaagucauuaggcuuucccuuugugucagugaaaccaaaagugcuucuuacaacguucgc

SEQ ID NO: 479402 - RNA, 65 nt, hsa
agauuugguugccauagucauaagcaaugauacaugaaaccaaugaaagacaguacauguaauaa

SEQ ID NO: 479403 - RNA, 65 nt, hsa
uagaacauauuugcauaagauagcuauuuacucuggaaaccaacaacuuuugagauuucccuugc

SEQ ID NO: 479404 - RNA, 65 nt, hsa
uaauuagugcaaauacaagcugcguuucuuuaauagaaaccaaaggcaucuggagcccgagaggc

SEQ ID NO: 479405 - RNA, 65 nt, hsa
auuuccuagccagcugggggacacuggaaauucgggaaaccaagagagaggaagaaggagacgcc

SEQ ID NO: 479406 - RNA, 65 nt, hsa
cgcaggcugagcaagucuguaaacugauucugggagaaaccaagcugcuggccauaggguguccu

SEQ ID NO: 479407 - RNA, 65 nt, hsa
acacaggacagcagaagauccccuuugucaguggggaaaccaaggcagagcugaggggacaggga

SEQ ID NO: 479408 - RNA, 65 nt, hsa
uccuucccuuauuucuaacguguauguuucugguggaaaccaaguucacccuggcugggagcauc

SEQ ID NO: 479409 - RNA, 65 nt, hsa
acugccgcaagaccacuacaugacuuagggaacuugaaaccaacuggcucauggagaaaacaaau

SEQ ID NO: 479410 - RNA, 65 nt, hsa
ucuggcugccucugagucugaaucucccaaagagagaaaccaauuucuaagaggacuggauugca

SEQ ID NO: 479411 - RNA, 65 nt, hsa
ccgacgguagaguucuuucaucuaugguugaaucagaaaccaagaaacacuacuauuaaacugca

SEQ ID NO: 479412 - RNA, 65 nt, hsa
uacaaggcuuccaggggaugccauccagccuguaggaaaccaaagaugggaaguggcuccuaggg

SEQ ID NO: 479413 - RNA, 65 nt, hsa
ccugcacuucuagcccucauuuaagauuugagggugaaaccaaagaaaacccccuaagugaggga

SEQ ID NO: 479414 - RNA, 65 nt, hsa
ucuuagcaagauauuuuaucucuguacauaaaguagaaaccaaaagcuagggaaacagauacucu

SEQ ID NO: 479415 - RNA, 65 nt, hsa
gagauaaagaccuuuuccaugcacccucauacacagaaaccaauuuucuuuuuuauacucaauca

SEQ ID NO: 479416 - RNA, 65 nt, hsa
uccucucacugccugccagaaaacaaaaacaccaagaaaccaagucaacuuuucaccuccugagu

SEQ ID NO: 479417 - RNA, 65 nt, hsa
guauaguccuagcugacgccaauaauaaaaaacaagaaaccaagugggcugguauucucucuaug

SEQ ID NO: 479418 - RNA, 65 nt, hsa
auuuuuagaagaaauauguuacacucagaaaugaugaaaccaaaucuuauauuaaaaggcaaaga

SEQ ID NO: 479419 - RNA, 65 nt, hsa
cugauuccuuccaacgugcacuucagcuggagaaagaaaccaagaagggaagcggccgcugggcc

SEQ ID NO: 479420 - RNA, 65 nt, hsa
cguuuggucagacaucaucuccuuggcugcccuuugaaaccaaaucacuugccuuggggauaaag

SEQ ID NO: 479421 - RNA, 65 nt, hsa
aauaugacguacgaaauggacaaaaagcuuuuucugaaaccaacuuuuuacuuccaucauccuuu

SEQ ID NO: 479422 - RNA, 65 nt, hsa
agugauaggcuuaaagauuguauuuucacagaguggaaaccaauuuuuuuaguuauuguucaagg

SEQ ID NO: 479423 - RNA, 65 nt, hsa
cgaggccgauuuuuuuuuuuuuaacauggaacaaugaaaccaacaacaaacauuuuuaaaauuaa

SEQ ID NO: 479424 - RNA, 65 nt, hsa
cagccgggcaggguggaaggagcuugccucuuugagaaaccaaggagucccagugaucuguuacc

SEQ ID NO: 479425 - RNA, 65 nt, hsa
guugccaggggugaggccgugccccaggccuccccgaaaccaaaggggaaggcagggguggggcc

SEQ ID NO: 479426 - RNA, 65 nt, hsa
agcuaggggcccgccccgcggacugacagcaccaggaaaccaaaugaugucccugcccgccgccc

SEQ ID NO: 479427 - RNA, 65 nt, hsa
caccuucgaaaacaugguaggacucacacuggauagaaaccaaagcaggugaaucaccugagguc

SEQ ID NO: 479428 - RNA, 65 nt, hsa
ccucccacugccgcucaggggcugacccuauuuaggaaaccaaagaggguggguugaaccuacuc

SEQ ID NO: 479429 - RNA, 65 nt, hsa
ccucugggucccccuucucuguccacccacagagugaaaccaauuaaaauguuggaucucauuua

SEQ ID NO: 479430 - RNA, 65 nt, hsa
ccuuggagcacugagcaccauuuggaagcuugagagaaaccaaaauuaaagagagaaagagagag

SEQ ID NO: 479431 - RNA, 65 nt, hsa
ggcccagcauucagggaggagucguaagaucuuaagaaaccaauccuugccucaagcaaaagcau

SEQ ID NO: 479432 - RNA, 65 nt, hsa
accuggaacagaugcuuucauuauggccuccagaggaaaccaacccugucuccaccuugauauug

SEQ ID NO: 479433 - RNA, 65 nt, hsa
cugcagagggagccuccugcucccugcuccaggaugaaaccaagagggggaugucagccucaccc

SEQ ID NO: 479434 - RNA, 65 nt, hsa
gcucggggcgggcggagcccgcguggccgaagcuggaaaccaaaccuaauaaaguuuucccaucc

SEQ ID NO: 479435 - RNA, 65 nt, hsa
gaaauguuugucuuuucuguuuuuuaaaugaucaugaaaccaaaaagagacugaucauccaggcc

SEQ ID NO: 479436 - RNA, 65 nt, hsa
uuuuauuauccuguccccagagggugguuuauccagaaaccaagaaaaaaaaucaaucagaauaa

SEQ ID NO: 479437 - RNA, 65 nt, hsa
uuucauaaccaggccggaccacgugcaauaggguggaaaccaaacugcuccaugccggguuauuu

SEQ ID NO: 479438 - RNA, 65 nt, hsa
ggcaggcggguggggggaugggaagggggugcccugaaaccaaacuggaagcccccucugccucc

SEQ ID NO: 479439 - RNA, 65 nt, hsa
uuacuguauguugcuuuucuaaauaaauguauugugaaaccaaaacagcugcuguuaauauggau

SEQ ID NO: 479440 - RNA, 65 nt, hsa
uacugauugcugucucgugugucuguaaaaugugugaaaccaaacugcagccucaacaccaugga

SEQ ID NO: 479441 - RNA, 65 nt, hsa
aaaggcaggaaggauccugccuugauuuuacuucagaaaccaaaucagucuucuauaaucugggg

SEQ ID NO: 479442 - RNA, 65 nt, hsa
aauuaaaacuuaacagcaucaaauuauugggaccagaaaccaaguaauguauaauguggcuuuug

SEQ ID NO: 479443 - RNA, 65 nt, hsa
ggcccuuccaacucuggagugucuguaguucuugugaaaccaaaacguugacuaccugccucuuu

SEQ ID NO: 479444 - RNA, 65 nt, hsa
ccugaagccuggauuccagcagugaaugcuagacagaaaccaagccauuaaugagauguuauuac

SEQ ID NO: 479445 - RNA, 65 nt, hsa
uacuuuauuacgaguaaaguguaaugaguacuguggaaaccaaauuugaauacugcaaauuugua

SEQ ID NO: 479446 - RNA, 65 nt, hsa
auacaaacagggcagaaccacagaagaacguuuuagaaaccaagagaugugcagaaagaaauguu

SEQ ID NO: 479447 - RNA, 65 nt, hsa
aauugaaauaagcucuuugcaggcguccaauccuagaaaccaauggucuccagaacucucacaca

SEQ ID NO: 479448 - RNA, 65 nt, hsa
caauuccucuuauucuuaaauaucuaaagggaaaggaaaccaacuuuaauuucagaacuucucuu

SEQ ID NO: 479449 - RNA, 65 nt, hsa
uuccucgaguggccacugugagccucgucacagcagaaaccaacuuuucuaacgacugaguucgc

SEQ ID NO: 479450 - RNA, 65 nt, hsa
guuuuacuggcaguucuauaguaguccagacuuuagaaaccaaacacaacaaaauggcuuguugc

SEQ ID NO: 479451 - RNA, 65 nt, hsa
ggaugaugccuaggcccaaaggagaggccaaaagggaaaccaaggcugcacaccuagaaccccaa

SEQ ID NO: 479452 - RNA, 65 nt, hsa
ggccccuucugccuuccaggagaggucuugcuuuugaaaccaaaaucauguucuucuaaaguguc

SEQ ID NO: 479453 - RNA, 65 nt, hsa
uggagaaagagaauuauccccacuucacagaugaggaaaccaaggcuaagagaugagcgaugccu

SEQ ID NO: 479454 - RNA, 65 nt, hsa
uaugauaaugauaccaaaggaaagauaauuaucaugaaaccaacuuuuggaucauucccuuuuua

SEQ ID NO: 479455 - RNA, 65 nt, hsa
gccacacaacaucaagaaggccgacaaccagguuggaaaccaagacggagcucagacccaccaca

SEQ ID NO: 479456 - RNA, 65 nt, hsa
gcuuggggcagccauuggccucugucucguuuugggaaaccaaggucaggaggccguugcagaca

SEQ ID NO: 479457 - RNA, 65 nt, hsa
aaguagagauaauguguagucacuucugauuuagugaaaccaauuguaauaauuguggaaauguu

SEQ ID NO: 479458 - RNA, 65 nt, hsa
caagaacucaaauuccuuucucauuggagccuagugaaaccaaaugaacgggaccugcuggccuc

SEQ ID NO: 479459 - RNA, 65 nt, hsa
guuccagaggaugcaucuggcucaccggguguuccgaaaccaaagaagaaacuucgccuuaucag

SEQ ID NO: 479460 - RNA, 65 nt, hsa
cagucugcuguccugaaacccagaagugauggagagaaaccaacaagagaucucgaacccugucu

SEQ ID NO: 479461 - RNA, 65 nt, hsa
agcaccuacugggugcuggguucacuguguccuaggaaaccaagaggguccccaguccuggccuc

SEQ ID NO: 479462 - RNA, 65 nt, hsa
cgcugguaccugcuggcccauggcccggguguagagaaaccaagcggcagccaccaccaguguug

SEQ ID NO: 479463 - RNA, 65 nt, hsa
uuuaugcuaccuaccccuguacaaguuaugcgaaggaaaccaagccaucugcauguuuauuuccu

SEQ ID NO: 479464 - RNA, 65 nt, hsa
ggcucuuucuaccaauguuugcuccugguuggaaagaaaccaaagauuuaagacgggcugcucuu

SEQ ID NO: 479465 - RNA, 65 nt, hsa
acuguaggaacuugacuugcguuagaguguacucugaaaccaacucgucucuggccgcaggaguc

SEQ ID NO: 479466 - RNA, 65 nt, hsa
ugaaagaagguuuaucauuacaaauaccuuccaaugaaaccaagaauuucucaaaauauuuaaug

SEQ ID NO: 479467 - RNA, 65 nt, hsa
ucaaaaucaguuuuuauauuccccaaaagaagaaggaaaccaaggaguagcuauauauuucuacu

SEQ ID NO: 479468 - RNA, 65 nt, hsa
gcaacuauagguuuaaaccaagacaaaugaagacugaaaccaagaauauuguucuuaugcuggaa

SEQ ID NO: 479469 - RNA, 65 nt, hsa
ugaaugggagggcgggccuggagcugcgugagagugaaaccaagaagcggauggggaagggagag

SEQ ID NO: 479470 - RNA, 65 nt, hsa
cuauaaagugccucggacaguccgcaguuguagcagaaaccaacaagaaccacuccuucauguuu

SEQ ID NO: 479471 - RNA, 65 nt, hsa
aagucauaugccuccagccauuauaugagaacugugaaaccaauaugguuuucuuuaugucuugg

SEQ ID NO: 479472 - RNA, 65 nt, hsa
uauuauuucuuaucuuucuucuuuuauauuuuuuggaaaccaaauuuauaguuaguuuagguaaa

SEQ ID NO: 479473 - RNA, 65 nt, hsa
ucaccaaaaaaaguauauagugacauuuuuaguaugaaaccaaauuacacuaaggucuuuuguug

SEQ ID NO: 479474 - RNA, 65 nt, hsa
cugcauagaaggaggagagggaaaauguuuuguaagaaaccaaucaagauaaaggacagugaagu

SEQ ID NO: 479475 - RNA, 65 nt, hsa
uaauaaaauuuccccuaaucuuuucugaaucuucugaaaccaaauguaacuauguuuuaucgucc

SEQ ID NO: 479476 - RNA, 65 nt, hsa
cuuaaauuucuuaaccuaggcuucagggagcauaugaaaccaaaauuauauggaacauuuucugu

SEQ ID NO: 479477 - RNA, 65 nt, hsa
auguagaacuguaauaagugaauuacaggucacaugaaaccaaaacgggcccugcuccauaagag

SEQ ID NO: 479478 - RNA, 65 nt, hsa
aaacucuuaaauuauaaugugaaaccugguuuuaugaaaccaaagacuagugcagcauuucagca

SEQ ID NO: 479479 - RNA, 65 nt, hsa
aagcuaauuaagggcgaugauuauuauuacaagaagaaaccaagacauuacaccaugguuuuuag

SEQ ID NO: 479480 - RNA, 65 nt, hsa
ucagaggagggugaggaagacuaauuaaacauggagaaaccaaauuggacaaauccucaccacca

SEQ ID NO: 479481 - RNA, 65 nt, hsa
cauuucaacauagagucacauaaaugucccccugagaaaccaaucccacuucuuucuaggagauu

SEQ ID NO: 479482 - RNA, 65 nt, hsa
ugugaggccugcagaggcccugaaugcacaaaugggaaaccaaggcacagagaggcucuccucuc

SEQ ID NO: 479483 - RNA, 61 nt, hsa; identical to SEQ ID NO: 479054

SEQ ID NO: 479484 - RNA, 61 nt, hsa; identical to SEQ ID NO: 479055

SEQ ID NO: 479485 - RNA, 65 nt, hsa
gaacugaggaaggugcuuagauggugagggcucuagaaaccaagccccaugagcagcaguggaag

SEQ ID NO: 479486 - RNA, 65 nt, hsa
cugaaacuuugggaauuugcuuuagccagaauaaagaaaccaaaucaugaaaauuauggaagacu

SEQ ID NO: 479487 - RNA, 65 nt, hsa
uaauuauuauuucuuaucuucuuuuauauuuuuuggaaaccaaauuuauaguuaguuuagguaaa

SEQ ID NO: 479488 - RNA, 65 nt, hsa
aaugugugaacuugacuuguguuagaguauauucugaaaccaacuugucccaggccacaggagug

SEQ ID NO: 479489 - RNA, 66 nt, hsa
ucaggacgucaaaaacucaccauggaccccaaggcagaaaccaagaacugucugcaggcaaauaag

SEQ ID NO: 479490 - RNA, 66 nt, hsa
uggaugcuuaauggugcuagaggcucaaguguguuugaaaccaagagccaguugucccccaugcag

SEQ ID NO: 479491 - RNA, 66 nt, hsa
uccucagccucugcaacugcaagaaaggggacccaagaaaccaaagucugccgcccaccucgcucc

SEQ ID NO: 479492 - RNA, 66 nt, hsa
gauauuaaguguucucaacugaguaacuuuuaaguggaaaccaaguuuagauuuggggagugguaa

SEQ ID NO: 479493 - RNA, 66 nt, hsa
aagacuuugucuaagccucauuauacugaaguugaagaaaccaaaugagcuccacccucacuuugc

SEQ ID NO: 479494 - RNA, 66 nt, hsa
auaaaaauuuauuaaauauaaauauccccagggacagaaaccaaggccccgagcucagggcagcug

SEQ ID NO: 479495 - RNA, 66 nt, hsa
ugaagucaauugaguaaggacaccuccagccauacagaaaccaacacugugugggggccaaggucu

SEQ ID NO: 479496 - RNA, 66 nt, hsa
gcgggagagcgaugcuuggauuuuuguuuccuauuagaaaccaacaguuuuguucuaauuucauuu

SEQ ID NO: 479497 - RNA, 66 nt, hsa
auugaagcucccagugaccuggagggaggauuccuggaaaccaaacaaucaguuuaggugcaggug

SEQ ID NO: 479498 - RNA, 66 nt, hsa
cuuucaucagguaucuuucuguggcauuugagaacagaaaccaagaaacaugguaauuacuaaauu

SEQ ID NO: 479499 - RNA, 66 nt, hsa
uaucccuuuucuauaaaaaauaaguuaaugugucaagaaaccaacucuauuaaggugggguuuaau

SEQ ID NO: 479500 - RNA, 65 nt, hsa; identical to SEQ ID NO: 479071

SEQ ID NO: 479501 - RNA, 66 nt, hsa
agguuuucgcacuucuuggcugguccagggacugcagaaaccaaagcugcuauuguugaggaauaa

SEQ ID NO: 479502 - RNA, 66 nt, hsa
ccaauuauguuaauaauuuauuuaaugagugguauggaaaccaauugauuuuuuuagauaaaagaa

SEQ ID NO: 479503 - RNA, 66 nt, hsa
ucccccacucccacuuccaggauugugguuuggauugaaaccaaguuuacaaguagacaccccugg

SEQ ID NO: 479504 - RNA, 66 nt, hsa
cgucaaaugauugccaucagaaagagacaacuugaagaaaccaacaaugacuaugaaacagcugac

SEQ ID NO: 479505 - RNA, 66 nt, hsa
cauuuucacccauucugugguucauuguaguuuaaggaaaccaagcauauagaugcauuagugauu

SEQ ID NO: 479506 - RNA, 66 nt, hsa
gguuucaccuuuguauaagauauagccaagacugaagaaaccaaauauauguguuuacuguagcau

SEQ ID NO: 479507 - RNA, 66 nt, hsa
uuauauauauuauuuuuuuuuaagaaaggaggaaaagaaaccaaaaguuuuuuuuaagaaaaaaaa

SEQ ID NO: 479508 - RNA, 66 nt, hsa
ggugcugccuucauccuccccaccuaaugcauuuuugaaaccaaagguaccuagccucagagacag

SEQ ID NO: 479509 - RNA, 66 nt, hsa
acgaaaauauuuccugauucaagauucuauaaaaaggaaaccaagcauaagacucugucaucauac

SEQ ID NO: 479510 - RNA, 66 nt, hsa
caaaagggcaagaucuuuuuuccuucacuuauugcugaaaccaagagcacaauucccauugagaga

SEQ ID NO: 479511 - RNA, 66 nt, hsa
caucccccaggacuugaugaccacacggggcagagagaaaccaaccaaggccagcaccuccgucgg

SEQ ID NO: 479512 - RNA, 66 nt, hsa
ggauguuuaaaacaucaacacauugcuuaaaaugaugaaaccaacccucaaaaaacagucuccuaa

SEQ ID NO: 479513 - RNA, 66 nt, hsa
ugggacauuagucguuauauuugacuugaaaagaaagaaaccaagugcgcuuugcaauauuuauua

SEQ ID NO: 479514 - RNA, 66 nt, hsa
gguccuuagaagucccauucucccuuccaguuaugagaaaccaaugccuucuagauucaggugacu

SEQ ID NO: 479515 - RNA, 66 nt, hsa
uguuuacaauuaggcuauuuuuuaauauaggauuuagaaaccaaggguauguguuuuaaaauuaca

SEQ ID NO: 479516 - RNA, 66 nt, hsa
ccaggcgaguggggcccaggacugguuccagugagagaaaccaaccacaggcacccaagcacuacc

SEQ ID NO: 479517 - RNA, 66 nt, hsa
ucuccuucgagcuugacucugagagggaaagugacggaaaccaagucagaugagaugacugccaug

SEQ ID NO: 479518 - RNA, 66 nt, hsa
ugagaagauuuauuccaccagggguauuucagcuuugaaaccaaaucuguguaucuaauacuaacc

SEQ ID NO: 479519 - RNA, 66 nt, hsa
ccgaaacugacuugcucaccuggaacaccugauggugaaaccaaacaaauacaaaauccuucucca

SEQ ID NO: 479520 - RNA, 66 nt, hsa
aacgccgcguggacugaagcucuucaugaugagauggaaaccaaaagggagucucccaugaugggg

SEQ ID NO: 479521 - RNA, 66 nt, hsa
cuuacaguauacauauauauuuauaucacaauuuacgaaaccaaaaaguugaguuuccaauggaac

SEQ ID NO: 479522 - RNA, 66 nt, hsa
caaggcuaaccuuucuaagcucccuaacuugggccagaaaccaaagcugagcuuuuaacuuucucc

SEQ ID NO: 479523 - RNA, 66 nt, hsa
ugggaaacuuacauguugagaucuacagagauccaggaaaccaaagcccugcugagcagagccauu

SEQ ID NO: 479524 - RNA, 66 nt, hsa
aucgacuugaguguaaacauaacuuauaugcacugggaaaccaaaaaaucugugugacuugcuuua

SEQ ID NO: 479525 - RNA, 66 nt, hsa
uugagauagucuuauucugauuuuuuuuuucuucuggaaaccaaguagaauuagggaugggaauac

SEQ ID NO: 479526 - RNA, 66 nt, hsa
ccguuucuucccuguauuuucuuucucuacuuugaggaaaccaaaguaaccuuuugcaccugcucu

SEQ ID NO: 479527 - RNA, 66 nt, hsa
auuucauuauguguucuacagugucggugaauaaaugaaaccaaucucaauuuagagguauggaug

SEQ ID NO: 479528 - RNA, 66 nt, hsa
cuacugcauccuucaacucucacuagaaaaucuuuugaaaccaaauggauuaauuuauggcuauuu

SEQ ID NO: 479529 - RNA, 66 nt, hsa
uaacugaagaugauguaugaaggaguuggaguuguugaaaccaagguguccaugaucccuccccac

SEQ ID NO: 479530 - RNA, 66 nt, hsa
ggcagugucuuaaggagacugguaggaggaggcauggaaaccaaaaggccguguguuuagaagccu

SEQ ID NO: 479531 - RNA, 66 nt, hsa
auaaacaaaugcuuguugauagccuuuuucuaucaagaaaccaaggagcuaauuauuaauaacaau

SEQ ID NO: 479532 - RNA, 66 nt, hsa
cauuccuggaaucaaggaauccugagucugggcaaugaaaccaaagccaggaguugacgcauccug

SEQ ID NO: 479533 - RNA, 66 nt, hsa
uuuucuuggcaguauuccaugggauguuaagcaaaggaaaccaaaggaaucguuucaaauggacuc

SEQ ID NO: 479534 - RNA, 66 nt, hsa
auccucugaaggccgggacccagucauacauccuuagaaaccaaaguaugguuuuuguuuucucuu

SEQ ID NO: 479535 - RNA, 66 nt, hsa
aggaagaaaaauagguguauaaaauguuuuccaugagaaaccaagaaacuuacacugguuugacag

SEQ ID NO: 479536 - RNA, 66 nt, hsa
uacucauuaaguguuauuuauuuuacucaagaacuggaaaccaacuaaaugccuucuauagaagua

SEQ ID NO: 479537 - RNA, 66 nt, hsa
uuacucuuucucaccugaugcucuuaaaagaucuuagaaaccaaccauacagacgagccgaugcgg

SEQ ID NO: 479538 - RNA, 66 nt, hsa
agccauuugcacauaguuaccagucacucuguuucugaaaccaauccagaaauucauguuagaaca

SEQ ID NO: 479539 - RNA, 53 nt, hsa; identical to SEQ ID NO: 478681

SEQ ID NO: 479540 - RNA, 66 nt, hsa
cucaguaauguauuugaaggaaaaauacccugauuugaaaccaacagcagauguugcaaacuuuca

SEQ ID NO: 479541 - RNA, 50 nt, hsa; identical to SEQ ID NO: 478683

SEQ ID NO: 479542 - RNA, 66 nt, hsa
ugaugccucuacuaucauuaccucuauugggacccagaaaccaauaccccaaaauauggugcaugg

SEQ ID NO: 479543 - RNA, 66 nt, hsa
agccacgcuuguuccccauguaccucuagagaagcagaaaccaaagucccccugugcccugggagg

SEQ ID NO: 479544 - RNA, 66 nt, hsa
ggcucugagggcuguuuuuuuuuuuugauguuaacagaaaccaaucuuagcaccuuuucaaggggu

SEQ ID NO: 479545 - RNA, 66 nt, hsa
auagcuagcaaucuaugcaaacaccuuucccauaaagaaaccaaaccccauaguacagugccuugu

SEQ ID NO: 479546 - RNA, 66 nt, hsa
ccaaaacucuguguugcugcaggguuugaacuuuuggaaaccaauuaaaaugugccuuuggugggc

SEQ ID NO: 479547 - RNA, 66 nt, hsa
ucuuaaagaggagagcaggaagaaagguugguuucagaaaccaagagggucggcaguggacgcgua

SEQ ID NO: 479548 - RNA, 58 nt, hsa; identical to SEQ ID NO: 478690

SEQ ID NO: 479549 - RNA, 66 nt, hsa
gggucuacaauggggagaacuuguuuuauagaugaggaaaccaaggcucagaggggcaaagucacc

SEQ ID NO: 479550 - RNA, 66 nt, hsa
aguacuucguuaugaaaaugccuuccacgcaaauaagaaaccaagggauaaaacuguucauggaug

SEQ ID NO: 479551 - RNA, 66 nt, hsa
uaaaaugugaacguuuucuaacugccucguaggguagaaaccaauauuuuucaggaugcuguauuu

SEQ ID NO: 479552 - RNA, 66 nt, hsa
uggauacauucuucagcauuuggcaguuaaucugcugaaaccaaaguaagaacugaaugacaguga

SEQ ID NO: 479553 - RNA, 66 nt, hsa
guauguuauucauguauuacugggagaugcuaccaagaaaccaacccaaagaaaauucugaaaaau

SEQ ID NO: 479554 - RNA, 66 nt, hsa
cacuccucaauugggaguguugugacugaaaugcuugaaaccaaagcuucagauaaacuugcaaga

SEQ ID NO: 479555 - RNA, 66 nt, hsa
cauagguuuccgcuuucaugggacaugagugaaaaugaaaccaagucaauaugagguaccuuuaca

SEQ ID NO: 479556 - RNA, 66 nt, hsa
gggauuuacuuuuaagaggcaaaaugugaguaaauugaaaccaagaaaacuuguuuuuagaauauu

SEQ ID NO: 479557 - RNA, 66 nt, hsa
ccgcagugaguuaaaauuuaguaagaugaagauguggaaaccaaugaaaaguacauuuagaaaugc

SEQ ID NO: 479558 - RNA, 66 nt, hsa
cuguagagcugaguuaccaaaauuucuauuucaaaggaaaccaaaccuuaaaaaaaaaaaacaaaa

SEQ ID NO: 479559 - RNA, 66 nt, hsa
guaaauggugcuuuguuccugcugguuccaagcucagaaaccaagacuagcuuuguaggagagaau

SEQ ID NO: 479560 - RNA, 66 nt, hsa
cucaucuauuccuuuucucuugugucccuacucauugaaaccaaacucuggaaaggacccaaugua

SEQ ID NO: 479561 - RNA, 66 nt, hsa
uuaauguuucuuaaaaguuuuugagaaaaaaaggaagaaaccaacucauucagaaggcucggauuc

SEQ ID NO: 479562 - RNA, 66 nt, hsa
caguccaggaguccaaguagaucucgaaguaaaucugaaaccaaaucaagacacagaacaaggucu

SEQ ID NO: 479563 - RNA, 66 nt, hsa
uuuaaggacuuuccuuccuccaucuccaagaaugcugaaaccaagggggaugacaugugacuccua

SEQ ID NO: 479564 - RNA, 66 nt, hsa
uccuuuuauuuauagaaugcaugucuuuuguguuaagaaaccaaagagaaauaaagagaacacucc

SEQ ID NO: 479565 - RNA, 66 nt, hsa
cugauggcucacugggcucuuggaggggaaugugaagaaaccaaggagucacuuuuucaucuagau

SEQ ID NO: 479566 - RNA, 66 nt, hsa
agugguaggcagugucccuucugcuugaaaccuauugaaaccaauuuaaaacuguguacuuuuuaa

SEQ ID NO: 479567 - RNA, 66 nt, hsa
agucaccuuaguggaaagguuaaaaaccagagccuggaaaccaagaugauugauuugacaagguau

SEQ ID NO: 479568 - RNA, 66 nt, hsa
uuucucagugacagaagcauguuugagaugccgugggaaaccaaauauauaauaauaaaaauauaa

SEQ ID NO: 479569 - RNA, 66 nt, hsa
augcaaauauuccauuguaaacaaaucaaaggaaaagaaaccaagaacugaauuacugucugccca

SEQ ID NO: 479570 - RNA, 66 nt, hsa
aucagucaaagggcaccauucuuuuuuuuuuuuuuugaaaccaaagcugucucagaaauggccaau

SEQ ID NO: 479571 - RNA, 66 nt, hsa
ucaaauugcacuuuuggaagcccggugucaugaaaugaaaccaaaccucggugccaucgcagagua

SEQ ID NO: 479572 - RNA, 66 nt, hsa
gcugcagauggauguuuccaugaagaaaucucugaagaaaccaaaagagcugaaacugaaaaaaga

SEQ ID NO: 479573 - RNA, 66 nt, hsa
acgugugcaaaccucuugacuuuaccccacauuacugaaaccaaaauauauuugcuucaucugccc

SEQ ID NO: 479574 - RNA, 66 nt, hsa
cacccaacucacccaagcagcaacgagcaacaaucggaaaccaaauacuggagagaaaaccaacgu

SEQ ID NO: 479575 - RNA, 66 nt, hsa
agugguggugucaccacuacuuaauugggagauaaugaaaccaaucauggaugcuguuuuuauugg

SEQ ID NO: 479576 - RNA, 66 nt, hsa
gauuauguucuguuaaugggaauuuaacauauuuaagaaaccaauauuuaaaauguuggucuaggu

SEQ ID NO: 479577 - RNA, 66 nt, hsa
cccguucauggagcuggucauuucuugaaaugagaagaaaccaaccuggaagaugucuuuuucagu

SEQ ID NO: 479578 - RNA, 66 nt, hsa
uuuuuuaaauugcaaauguaauuuuugccaauuagagaaaccaaccggugucaguaaaauucugug

SEQ ID NO: 479579 - RNA, 63 nt, hsa; identical to SEQ ID NO: 478721

SEQ ID NO: 479580 - RNA, 66 nt, hsa
auauauaaauauaaaauuauauauaaaggguuauuugaaaccaauccauggcaacgcuggugcuug

SEQ ID NO: 479581 - RNA, 66 nt, hsa
cagaagcuuuacuuuuccacuuuuuuuuaaaaaaaagaaaccaacaauuuaaauuauauugauguu

SEQ ID NO: 479582 - RNA, 66 nt, hsa
gcauuuuuacaccccuuaagggugcuuaauucuguugaaaccaaaaagauuugucuacaaaugcua

SEQ ID NO: 479583 - RNA, 66 nt, hsa
acaaugccaccagagauagugggggaaaugccagaugaaaccaacucuugcucucacuaguuguca

SEQ ID NO: 479584 - RNA, 66 nt, hsa
gggggugaggcuuagcccagaaggagaacugagcaggaaaccaaggcucuucucuguccccugccc

SEQ ID NO: 479585 - RNA, 66 nt, hsa
cugccuccauuuuccugagaucaaaaagacuguuucgaaaccaacaucugauauguaaacugcucu

SEQ ID NO: 479586 - RNA, 66 nt, hsa
ccccuucugagcguuucugacagcucccagcugggagaaaccaacaugacgaaaagacaaagaaua

SEQ ID NO: 479587 - RNA, 66 nt, hsa
guggaaugaugguugcacaacuuugugaauauacuagaaaccaaugaauuaaaaacuuuggaagau

SEQ ID NO: 479588 - RNA, 66 nt, hsa
uuucugcaguuccuuauaggcgaagggaaccggguggaaaccaagcugggagaggcugaggauggc

SEQ ID NO: 479589 - RNA, 66 nt, hsa
acauuguaccauacaauuucauuaucuuaucagaaugaaaccaauucacagggaaacuagagacua

SEQ ID NO: 479590 - RNA, 66 nt, hsa
caaggaaauaucaaagaacacaacgcaggacuugcugaaaccaaauuacuacuucacacucuccuu

SEQ ID NO: 479591 - RNA, 66 nt, hsa
aggcaacauuuuggaagcagagggcaacucucacuggaaaccaaaucuccuggcaccuugaucuug

SEQ ID NO: 479592 - RNA, 66 nt, hsa
aguauauaagucaagaauguuuuauugucauuaugugaaaccaauauuggcaaauaguacuuuaau

SEQ ID NO: 479593 - RNA, 66 nt, hsa
ugcaguaauagauaugugauuuuacaucauuuuuaagaaaccaaggggaaguaauaaguugaaaaa

SEQ ID NO: 479594 - RNA, 66 nt, hsa
uuccauucuuaauuguaauuuuuuucuuuaaauaaggaaaccaauauaaucucauguauaaaaacu

SEQ ID NO: 479595 - RNA, 66 nt, hsa
uguugguugacaaaauuggcuguuggcaucaguauagaaaccaacuggcagcuuucccugacaagc

SEQ ID NO: 479596 - RNA, 66 nt, hsa
cagcuccaugcucgcuacgucuugaaccuuuuguaugaaaccaagaaacaucugguacagcugcca

SEQ ID NO: 479597 - RNA, 66 nt, hsa
agcuucugguaccaugauccucaacuuagagaggaagaaaccaagacagagagcuuaacucacuuc

SEQ ID NO: 479598 - RNA, 66 nt, hsa
gacuggauugauuguggacuuuuauacuauauugcagaaaccaauaucuguuucuuggugguuaug

SEQ ID NO: 479599 - RNA, 66 nt, hsa
cuaacuuucuaacagaacuuccauaacuagaagguggaaaccaaaacccucaugguaguauuuccu

SEQ ID NO: 479600 - RNA, 66 nt, hsa
cucaauggaggggucuggggaccaugguauaaagaggaaaccaagaaaaagaagccaagcaaaaau

SEQ ID NO: 479601 - RNA, 66 nt, hsa
cagugccugguauauaguaggugcucaauaaauguugaaaccaacugaacugccaacaaaauaaaa

SEQ ID NO: 479602 - RNA, 66 nt, hsa
gaaaucccaguucucuaauuugguuuucuucuuugggaaaccaaacauacaaaugaaucaguauca

SEQ ID NO: 479603 - RNA, 66 nt, hsa
uauugucuucguaaaaguuagaucugacuucagacagaaaccaauaccagcuuccuuuuccuuuaa

SEQ ID NO: 479604 - RNA, 66 nt, hsa
uuauaaaccaaaacaaaauuuccaaaaacaaugaaggaaaccaaaauaaauauuucugcauuucag

SEQ ID NO: 479605 - RNA, 66 nt, hsa
ucugccugugcuuuuguuugacugucucuagauuuugaaaccaaaaaacugaacugaaaucaucua

SEQ ID NO: 479606 - RNA, 66 nt, hsa
cagcugugccggcgcuacgggacccgagccgucccagaaaccaaagggcaggcacggcagcaaacg

SEQ ID NO: 479607 - RNA, 66 nt, hsa
ugguaaaguaaaaggaaacaguacacuuggagcuaggaaaccaaagcaagcuuugugaaacuggca

SEQ ID NO: 479608 - RNA, 66 nt, hsa
agaugaucaguccaacugaacgaccuuacaaaugaggaaaccaagauaaaugagcugccagaauca

SEQ ID NO: 479609 - RNA, 66 nt, hsa
gggauaccuccagguuccaguaaaauucuucugaccgaaaccaauguggguguuagaaaaauuacc

SEQ ID NO: 479610 - RNA, 66 nt, hsa
cucaccccagcacugcuguugggaaggugacugcaggaaaccaauucuuacaagauccaggcccag

SEQ ID NO: 479611 - RNA, 66 nt, hsa
aaauacaaccagcauagaaagacccaaaacuauacagaaaccaaaaccagaaugccauguggugga

SEQ ID NO: 479612 - RNA, 66 nt, hsa
caagauauuaagcguguguaaaugggcuuuagucuggaaaccaaaaaaaaaaaaaaaauuuaguca

SEQ ID NO: 479613 - RNA, 66 nt, hsa
uucccaccaugcccuucugccaucuucugggagaaggaaaccaaaggaucuaaaacugggguuugg

SEQ ID NO: 479614 - RNA, 66 nt, hsa
uugacccuagagcagaggugggcaaacuaugaccuggaaaccaaaucugacuuaccaccuuuuccu

SEQ ID NO: 479615 - RNA, 66 nt, hsa
gcaucugauuugguauugugauuuacuucagacccugaaaccaaauaucugaucuuccauuagacu

SEQ ID NO: 479616 - RNA, 66 nt, hsa
acucuaaacucguccccagaggaggacuugaaugaggaaaccaacacuuugagaaaccaaaguccu

SEQ ID NO: 479617 - RNA, 66 nt, hsa
cagaggaggacuugaaugaggaaaccaacacuuugagaaaccaaaguccuuuuucccaaagguucu

SEQ ID NO: 479618 - RNA, 66 nt, hsa
cggguugcauggaaguuuuauucucuuguuuugcuggaaaccaagaggauccaaacuuccugcaac

SEQ ID NO: 479619 - RNA, 66 nt, hsa
gugggugggaggcaccaaaacuuggcagcugugccagaaaccaaagccaggcccagauguaggggg

SEQ ID NO: 479620 - RNA, 66 nt, hsa
acacgcaaaacuggcuucuucuggucacuggugucugaaaccaaauccagagcagccuguggccug

SEQ ID NO: 479621 - RNA, 66 nt, hsa
cauuaaaguuccuaagacccagugacaguacugggagaaaccaaggcugaagagucagguugaagc

SEQ ID NO: 479622 - RNA, 66 nt, hsa
ccuaauguaauaauagaaaaauacucauaauagggagaaaccaagagaaguuuuguuuuuguuuuu

SEQ ID NO: 479623 - RNA, 66 nt, hsa
aucaggauaacacaagcuuaguguuagaucuuguaggaaaccaagauuagaaacauuagaaauuug

SEQ ID NO: 479624 - RNA, 66 nt, hsa
ccuaaaaauuguuagaaauuggugggaaaauagguagaaaccaaggaagcagacacaacaugcauu

SEQ ID NO: 479625 - RNA, 66 nt, hsa
cauuagccugugucaaguucuuugagugauacuagugaaaccaaauagaaaacuauuguuggauca

SEQ ID NO: 479626 - RNA, 66 nt, hsa
gaaagcuaaagaagacuaugauaccauacccaucuagaaaccaagaacuaguuugaaaucguuuau

SEQ ID NO: 479627 - RNA, 66 nt, hsa
ugaauccaagugacugugaaaaggucucauuacaaugaaaccaauccuaaauaauuacaccaacuu

SEQ ID NO: 479628 - RNA, 66 nt, hsa
uuuguacaugcauucauacaggcagcgauggucucagaaaccaaacaguuugcucuaggggaagag

SEQ ID NO: 479629 - RNA, 66 nt, hsa
cuaucagagcuggaaccucaucccugcacagaugaggaaaccaaggcauggagcaguucccagagu

SEQ ID NO: 479630 - RNA, 66 nt, hsa
agcucuuccucaaggcaaccugaggccagacaccaagaaaccaagcguaucugcucuaaaaugacu

SEQ ID NO: 479631 - RNA, 66 nt, hsa
gggugauuauuauuaacucuagauaagcagguacuagaaaccaaaacucagaaaauguuuacuguu

SEQ ID NO: 479632 - RNA, 66 nt, hsa
gauagucaucucauccuacucaauuuuucaaaggcagaaaccaacccuggagcaauugagaggacu

SEQ ID NO: 479633 - RNA, 66 nt, hsa
cacauuuuauauggcugaucaauuuucauacauugagaaaccaagucaaucaagcaggaaucauuu

SEQ ID NO: 479634 - RNA, 66 nt, hsa
auuacuagucaaauccgucagugaucccgagucccagaaaccaaaggcucuuuucagagccaccca

SEQ ID NO: 479635 - RNA, 66 nt, hsa
ucuagcuuuaggggaccaugaagagacucucuuagggaaaccaauaguccccaucagcaccaugga

SEQ ID NO: 479636 - RNA, 66 nt, hsa
cucauuuaguaauguaccuugaguuaaaaagccugagaaaccaaacacagcuaaugcuauggggug

SEQ ID NO: 479637 - RNA, 66 nt, hsa
ucagagggaacgagcuguagguuugcagaaaugugugaaaccaaaaugaucacugccuacuuguga

SEQ ID NO: 479638 - RNA, 66 nt, hsa
uaugguuuaaucagucuaauuguuuugacuguuauagaaaccaaauauuuuacuguuucuuuuaag

SEQ ID NO: 479639 - RNA, 66 nt, hsa
gagugagguagauugcugucccguuaacauagugcugaaaccaaaggcaguggggguccaaacucg

SEQ ID NO: 479640 - RNA, 66 nt, hsa
uccacuuucuagaacauauucuuuacuaauguuauugaaaccaauuucuacuucauacugauguuu

SEQ ID NO: 479641 - RNA, 66 nt, hsa
acauuuuaauaccaugccagagaagaguauucugcugaaaccaacagguuuuacuggucaaaauga

SEQ ID NO: 479642 - RNA, 66 nt, hsa
auuugggaauuaaacaggucacacgugacagaugaagaaaccaagggggcugcugaggagaccugg

SEQ ID NO: 479643 - RNA, 66 nt, hsa
aucaauuacuauaauccugagccauggugugcuacugaaaccaauuuuuauccaccaucuaguccu

SEQ ID NO: 479644 - RNA, 66 nt, hsa
ugaucaucacaaauccuuuaaaacaauuaccuaaaagaaaccaaaaauccugccuucuuugugggg

SEQ ID NO: 479645 - RNA, 66 nt, hsa
gucagggcgaaaagaaaaaaauaauacuauuaauaagaaaccaacaaacaagaaccucucuuucua

SEQ ID NO: 479646 - RNA, 66 nt, hsa
auuuggaauacuggucaucuuucugacaucacaguagaaaccaaaccuuggauuuagauucaaaag

SEQ ID NO: 479647 - RNA, 66 nt, hsa
uucugacacccuuuaaugugguugcagaucucagaugaaaccaagcuuaauuauacuaugccauua

SEQ ID NO: 479648 - RNA, 66 nt, hsa
acaauaaaauuguaauauaauaaauuuggcugacaagaaaccaaagugauucuuaauuaguauaca

SEQ ID NO: 479649 - RNA, 66 nt, hsa
caacucuuuacaagcuaagaagagagggccucagaagaaaccaacccugccaacaccuugaucuug

SEQ ID NO: 479650 - RNA, 66 nt, hsa
gagucaagaguugaggagacauuacaauguguaauggaaaccaaggaaagugaaacuuuggauaag

SEQ ID NO: 479651 - RNA, 66 nt, hsa
guuaucuuugugcuauauaguggauuauaauucugugaaaccaaguuuguauauugaauuacauua

SEQ ID NO: 479652 - RNA, 66 nt, hsa
accuugugaaguugcuguuggcacauagcccacuaggaaaccaagaaguuugacugggagcgugug

SEQ ID NO: 479653 - RNA, 66 nt, hsa
ggaagaauugucauaggagggaagcuucaaagucaugaaaccaaucaacagccaagucagcaagca

SEQ ID NO: 479654 - RNA, 66 nt, hsa
cgccagccuccccgcccgcucucuuuucucccaagcgaaaccaaaugcgccccuucaccucgcgug

SEQ ID NO: 479655 - RNA, 66 nt, hsa
uauaauuuacuucuuauaaauugaagucuuaaaugugaaaccaagaaauguaaucaagcaguaaaa

SEQ ID NO: 479656 - RNA, 66 nt, hsa
agcuccaccacugugcacuuagccaugauggcaacagaaaccaagagacacaauuacgcagguauu

SEQ ID NO: 479657 - RNA, 66 nt, hsa
uuucuuuuugaaucucucaaacggcaacauuccucagaaaccaaagcuuuauuucaaaucucuucc

SEQ ID NO: 479658 - RNA, 66 nt, hsa
gcaucucuguugcuaacacacagagcucaccuguuugaaaccaagcuuucaaacauguugaagcuc

SEQ ID NO: 479659 - RNA, 66 nt, hsa
uuguuaaaagccuauuauuguuaaaggccuuuuauggaaaccaacuuggaaaacaaccuuaaaugu

SEQ ID NO: 479660 - RNA, 66 nt, hsa
ugaaaaaaauaaaacgcaaaaaaagaaacuguaaaggaaaccaagagauuuuguuuaauuuuuuug

SEQ ID NO: 479661 - RNA, 66 nt, hsa
uuccaaaggcauaagacccuaagccuccuuuugcuugaaaccaaagauauauacacaggauccuau

SEQ ID NO: 479662 - RNA, 66 nt, hsa
uuccuucaagaggguuacaauguggccaucagacaggaaaccaaacgguggauaaaguauuaagua

SEQ ID NO: 479663 - RNA, 66 nt, hsa
aggcauggaggagggaggcgugggaugggaauagcagaaaccaaccaugucuucagugauugaaac

SEQ ID NO: 479664 - RNA, 66 nt, hsa
ucaugaaagugguaaaagugggaaccagugugcuuugaaaccaaauuagaaacacauuccuuggga

SEQ ID NO: 479665 - RNA, 66 nt, hsa
gagcucaaaacacuacauccacauuauugacuuuuggaaaccaaccaaauuacuuaagaaauggaa

SEQ ID NO: 479666 - RNA, 66 nt, hsa
caauauucucauuauuaacuuccucuauuucacacagaaaccaaggacaacaagauacaaauaccu

SEQ ID NO: 479667 - RNA, 66 nt, hsa
caucuucuaucuucuuuccaccuuucucuguuuuaugaaaccaacuguugacauacaaaccaugau

SEQ ID NO: 479668 - RNA, 66 nt, hsa
uuguuauauaugaacacucaaaucuuuuacuguaacgaaaccaagaaacuuguuuagaaugugaua

SEQ ID NO: 479669 - RNA, 66 nt, hsa
gcuuuggggaauuuuggccaggagacccugaaacaugaaaccaaacaggcuuugauauuuuuuuuu

SEQ ID NO: 479670 - RNA, 66 nt, hsa
ugcuguggcuuugagaaguuaacuuuuguggaauaugaaaccaaaggaagaauuuccauguagaua

SEQ ID NO: 479671 - RNA, 66 nt, hsa
aucaugggaauuacauaaggauaaugaggcccaacugaaaccaaguuucagucugccuuaccuuua

SEQ ID NO: 479672 - RNA, 66 nt, hsa
uuaaucacuuuuuaaaauauaaggaccgaaugcaaggaaaccaaaguuuauuaauaauuuuuauau

SEQ ID NO: 479673 - RNA, 66 nt, hsa
aaccgagggaacccugggucuugggaagaacaacaggaaaccaaggucugaccuaggguucccucc

SEQ ID NO: 479674 - RNA, 66 nt, hsa
aacaauagaaauuuuucucauaauauauaccuaugugaaaccaacuuaucugcauaauuaaaucua

SEQ ID NO: 479675 - RNA, 66 nt, hsa
aaacuuuuagcuuugaucacaaguggacaaauuucugaaaccaaaggcaacuaaguugcuguguua

SEQ ID NO: 479676 - RNA, 62 nt, hsa; identical to SEQ ID NO: 478818

SEQ ID NO: 479677 - RNA, 66 nt, hsa
uuuuacagauugccuccuuaugacgcggcucaaaaggaaaccaaguggucaggaguuguuucugac

SEQ ID NO: 479678 - RNA, 66 nt, hsa
ccacgcauuggcauccaaggccacggacuaugagaagaaaccaaacguguuuaaacuuaaaacugc

SEQ ID NO: 479679 - RNA, 66 nt, hsa
cugaaccccugcaacccucccugaaccccugcaaaugaaaccaaacguccaccuggguguguucau

SEQ ID NO: 479680 - RNA, 66 nt, hsa
ucuucucauaguauagaguuuacuuuguacacguuugaaaccaacuacuguagaagaugaggaauc

SEQ ID NO: 479681 - RNA, 66 nt, hsa
uuuuaggggaucauaucaagaaaguuagucugguuggaaaccaagagaauggcugaugucucuuuc

SEQ ID NO: 479682 - RNA, 66 nt, hsa
acucccuaccugugaguuccuuuauuuauaauucuugaaaccaaaauguauaauguacaguuuuca

SEQ ID NO: 479683 - RNA, 66 nt, hsa
cacagugaguuggucaaaugcuccugacaguguggagaaaccaacaggcaaaacgugggugcaaaa

SEQ ID NO: 479684 - RNA, 66 nt, hsa
ucagaacugucggaggaaagacaacacaaccaacgcgaaaccaauuccucauccucagaugcucaa

SEQ ID NO: 479685 - RNA, 66 nt, hsa
acacaguuucccuacuguauguagaauccaggugcugaaaccaaguguuucuuuucccaugcucuu

SEQ ID NO: 479686 - RNA, 66 nt, hsa
auugggcuuuauuuggacaaaccaaacuuuuagccugaaaccaacuuuaugccacuaagucauagc

SEQ ID NO: 479687 - RNA, 66 nt, hsa
auuguccacagauguacuggccauuacaugaaacaagaaaccaagcaucuuugcuguuguuaauua

SEQ ID NO: 479688 - RNA, 66 nt, hsa
acuggcauuuccauguauauauguauauaaaugcaggaaaccaacaugucauugacaccucucuuc

SEQ ID NO: 479689 - RNA, 66 nt, hsa
aauaagucuguacaaccuagcauagaauaaaaaacugaaaccaagauucccaacguuuuucauagc

SEQ ID NO: 479690 - RNA, 66 nt, hsa
cacacaauuaagagcucaugucuuagcaagaucugggaaaccaacauugcgagaguagcuauuuug

SEQ ID NO: 479691 - RNA, 66 nt, hsa
caacccaggaagcgucuuuggugcuugggagaccaagaaaccaagaaauuaacaacugaaagcauu

SEQ ID NO: 479692 - RNA, 66 nt, hsa
gaggguucugaacccguucccuacacagaaaucuuggaaaccaaaugcugcugaguaaggaugaag

SEQ ID NO: 479693 - RNA, 66 nt, hsa
ugccaucaaaacacauacacccagaaagaaacaacagaaaccaaaacucacaaggcgcaugauuac

SEQ ID NO: 479694 - RNA, 66 nt, hsa
ggugggcacuaagcuaugggagagaccauagcugcagaaaccaacccugcccuaggcauaaaaugc

SEQ ID NO: 479695 - RNA, 66 nt, hsa
caggcagcaggcucaggcccacaccuugugauuuuugaaaccaaagcccagaagaugauguuuacu

SEQ ID NO: 479696 - RNA, 66 nt, hsa
ccacacgauuugucagagagaaaugaaagcaagccugaaaccaagcaauugagagugagaaagagg

SEQ ID NO: 479697 - RNA, 66 nt, hsa
guaggacguguaccucuguguguucauggagcuggagaaaccaaaacugggucucucuccacccgg

SEQ ID NO: 479698 - RNA, 66 nt, hsa
auuaaugucauuuuuauggauuguagacccaguuuugaaaccaaaaaagaaaccuagaaucuaaug

SEQ ID NO: 479699 - RNA, 66 nt, hsa
gccacaccugcaauguaaaauggaagaaaaugcaaagaaaccaaaugugccgagugaauaaaggau

SEQ ID NO: 479700 - RNA, 66 nt, hsa
uuggaaccaacauucaaauucugccucaucuggagggaaaccaaaauugggagggggaagaggacc

SEQ ID NO: 479701 - RNA, 66 nt, hsa
auuaguacaauaagcguuaagggcagagucuaccuugaaaccaauuaagcagcuugguauucauaa

SEQ ID NO: 479702 - RNA, 66 nt, hsa
uauauauauuuuuaaaucacauuaauuuuaccaagugaaaccaagccauacuguuuuugagccaau

SEQ ID NO: 479703 - RNA, 66 nt, hsa
aagacaguccuguaagaucgagcaaccagucaugaugaaaccaagugguggccggaucaguaugac

SEQ ID NO: 479704 - RNA, 66 nt, hsa
auuuauaugcauuaauuuaagagcaucuacuuagaagaaaccaaauagucuaucgcccucauauca

SEQ ID NO: 479705 - RNA, 66 nt, hsa
aguaaagaaugagaauggauucuguacaauacacuagaaaccaacauaauguauuucuuuaaaacc

SEQ ID NO: 479706 - RNA, 66 nt, hsa
ugcucugaaaaccaaaaguauuuucauaacccauuugaaaccaaaccugaccugaacuuacacuga

SEQ ID NO: 479707 - RNA, 66 nt, hsa
aaugggaguagacagaguuguauggccuggacaguggaaaccaagagcaggaucgcaaaguaacag

SEQ ID NO: 479708 - RNA, 66 nt, hsa
aaugaagagaaaagccaugcccaccccagccccagagaaaccaauaagaauccucuauuauuuuca

SEQ ID NO: 479709 - RNA, 66 nt, hsa
gacccguucgcccccaugugacuuuuaucuguagcagaaaccaagucuacuucacuaaugacgaug

SEQ ID NO: 479710 - RNA, 66 nt, hsa
uuuuuugcacaagguguuucauuuucguuuuuaugggaaaccaagggaaaagcacauugcgaucca

SEQ ID NO: 479711 - RNA, 66 nt, hsa
aacuguggugccaaauugcuggugucucucuuuggagaaaccaaccagauacaucugcuggagagc

SEQ ID NO: 479712 - RNA, 66 nt, hsa
guggccugaagaggaagagaaaaaaaacaaaaaacagaaaccaaucgguaaucugauccaccacuu

SEQ ID NO: 479713 - RNA, 66 nt, hsa
agccuccagagaccgagcagcuguggggccugcugggaaaccaaggucgguuuccgcccucuagcg

SEQ ID NO: 479714 - RNA, 66 nt, hsa
uuauuuuaguuuuauuuuugaaaccaagcaucuauagaaaccaagaaagucagcauguaagcguca

SEQ ID NO: 479715 - RNA, 66 nt, hsa
gggauuuggaauuuuuguuauuuuaguuuuauuuuugaaaccaagcaucuauagaaaccaagaaag

SEQ ID NO: 479716 - RNA, 66 nt, hsa
guucauuccuggggcacuguggccugguuuugcuuugaaaccaagaaagagcaaagggaacccagc

SEQ ID NO: 479717 - RNA, 66 nt, hsa
auguucaucaguguuuuauagaaaugguguugcugggaaaccaaguuugcaccuggaaacuuacaa

SEQ ID NO: 479718 - RNA, 66 nt, hsa
auuauauauaacuaugcuaauuguucauaaucaacagaaaccaagauagagcuacaaacucagcug

SEQ ID NO: 479719 - RNA, 66 nt, hsa
aaucucacucaggccuccagggauccaugggggagugaaaccaauucucagagaacaacccaccag

SEQ ID NO: 479720 - RNA, 66 nt, hsa
uccagacauacgaaacacaaaccacaacugacacaggaaaccaacacccaaagcauggacuaaccc

SEQ ID NO: 479721 - RNA, 66 nt, hsa
gcgccucauccucauugcuucugccuccacguaaaugaaaccaaaggccucagcauauccugggag

SEQ ID NO: 479722 - RNA, 66 nt, hsa
acaaacuuaaucuucaucuuuaaaaaaaagaaaaaagaaaccaaaaugagaaucaacacuucauag

SEQ ID NO: 479723 - RNA, 66 nt, hsa
aauuauuuuuuaaaugaaaccuuuuuuuuucuuuuugaaaccaaauguuaaacuauagccuuaaga

SEQ ID NO: 479724 - RNA, 66 nt, hsa
gagagaaaaaaaaaaagagaacccacaugaagcucugaaaccaaacagcauccugccaugagcuuc

SEQ ID NO: 479725 - RNA, 66 nt, hsa
guccauacacagaaacauaauaaacaaucuucacacgaaaccaaaaauagcauacaccuaauguug

SEQ ID NO: 479726 - RNA, 66 nt, hsa
aagaccuuuggcucacagaacugcaggguauggugagaaaccaacuacggauugcugcaaaccaca

SEQ ID NO: 479727 - RNA, 66 nt, hsa
ucucagauggcucccacauuuuaagauuuuaaaaaugaaaccaaaaaauaaauugaagaaaacugu

SEQ ID NO: 479728 - RNA, 66 nt, hsa
auauuaaauacuuaaugcugauuugaagagauagcugaaaccaaggcugaagacuguuuuacuuuc

SEQ ID NO: 479729 - RNA, 66 nt, hsa
ucccccagaucaugcuuuaauucuuucuuuucuguagaaaccaacaguuuccauuuaugucaaugc

SEQ ID NO: 479730 - RNA, 66 nt, hsa
caagcaaguguguagcuuaaggccacuacugguaaggaaaccaaguguccucugugccuuuuuucu

SEQ ID NO: 479731 - RNA, 66 nt, hsa
cugcuagcugugcagaacccaauugcccuuugcacagaaaccaaccccugacccagcgguaccggc

SEQ ID NO: 479732 - RNA, 66 nt, hsa
ccccauggugauagccugaaagagcuuuccucacuagaaaccaaaugguguaaauauuuuauuuga

SEQ ID NO: 479733 - RNA, 66 nt, hsa
agggaugggagccacagugcccuucacucucuccuggaaaccaacuguaagcuggugggcucaacc

SEQ ID NO: 479734 - RNA, 66 nt, hsa
guguguuuaguaucugaauuugaaacucaucugguggaaaccaaguuucaggggacaugaguuuuc

SEQ ID NO: 479735 - RNA, 66 nt, hsa
uuggcuggucccaugugugaaagggacucucucggggaaaccaaggcccagccccuccccccuccc

SEQ ID NO: 479736 - RNA, 66 nt, hsa
uuauaacauuaagaaaaacaauaaagauacaugauugaaaccaaguugaaaaauagcauaugccuu

SEQ ID NO: 479737 - RNA, 66 nt, hsa
cagagcuucagccucucuucgucgucuuaccccacugaaaccaacagggaucgggccaggcuccca

SEQ ID NO: 479738 - RNA, 66 nt, hsa
guauggagcucuggacuccuaaauuccccugaagaagaaaccaauguacuguggucucuugggacu

SEQ ID NO: 479739 - RNA, 66 nt, hsa
cucuguccacucuuguucaaguaucuaacucuucuggaaaccaaauaggcuuuagaagagauuauc

SEQ ID NO: 479740 - RNA, 66 nt, hsa
cacguuuguagguucuuacuggaccagaggagucaagaaaccaagaugguuugggguauggggugg

SEQ ID NO: 479741 - RNA, 66 nt, hsa
guggcaagaugaccgucacauuacauguuuaaucuggaaaccaaagagacccugaagaauauuuga

SEQ ID NO: 479742 - RNA, 66 nt, hsa
aacaaaguucaaaaguagaaauaccaaaauagagcagaaaccaagcuaagaguguguuucuguguu

SEQ ID NO: 479743 - RNA, 66 nt, hsa
uauuauuuguguuaucuuuauuucucuucauuguuagaaaccaaagucuucucugcuggcuggggc

SEQ ID NO: 479744 - RNA, 66 nt, hsa
gcugccuccauuauccauucccaagaugccugaucagaaaccaaccaugaaugaaccccuggcucc

SEQ ID NO: 479745 - RNA, 66 nt, hsa
ccagaucccgccccuccuguccucuguguucccgcggaaaccaaccaaaccgugcgcugugaccca

SEQ ID NO: 479746 - RNA, 66 nt, hsa
ccagaaguaagcucugcauguuccccuuccugggaggaaaccaauugucagaaggauguaugauga

SEQ ID NO: 479747 - RNA, 66 nt, hsa
uuuuccccaaccucuuacacccuggaugucacuuuggaaaccaagcccuuggaagcaaguggggug

SEQ ID NO: 479748 - RNA, 66 nt, hsa
ucaccaccuuucauguuuuugauugcccuacaaagagaaaccaaaugagcugauuacugacuauaa

SEQ ID NO: 479749 - RNA, 66 nt, hsa
uauauaguggucacugugauauaauaaaucauaaaggaaaccaaaucacaaaggagaugguguggc

SEQ ID NO: 479750 - RNA, 66 nt, hsa
ccacuuggccucacuaccagaagaaggguggagucagaaaccaaagugaccuccagagcuguccuc

SEQ ID NO: 479751 - RNA, 66 nt, hsa
uagagcaaauauuguucuucccauuuuacagauucagaaaccaaggcuaagggacuggucuaaagu

SEQ ID NO: 479752 - RNA, 66 nt, hsa
cuuuuuuaaaaagaaacuauuuuuguguuugaaagugaaaccaacauccagaucuauagcagaguc

SEQ ID NO: 479753 - RNA, 66 nt, hsa
uuaauugaaagcaacacuaauauagagccacuuccugaaaccaagaaucuguaguuuugauccaaa

SEQ ID NO: 479754 - RNA, 66 nt, hsa
aauguuccaucauuucuagcuaaaacuccauuuggugaaaccaacauauccauuucuuuuccuagu

SEQ ID NO: 479755 - RNA, 66 nt, hsa
agacaaccgugggggaacacaccacuuuuuacuguugaaaccaacacaacguugaaauccaggcuu

SEQ ID NO: 479756 - RNA, 66 nt, hsa
guggcccuucugaaacuuauggucaucucucccacugaaaccaaggucuuuucaaauguggcuaaa

SEQ ID NO: 479757 - RNA, 66 nt, hsa
aaacccuucagugcuacauuuuguggcuuuuuaauggaaaccaagccaauguuauagacguuugga

SEQ ID NO: 479758 - RNA, 66 nt, hsa
guggccccuggcuccggagaaugcuggauggaacaggaaaccaaucaccuggcaccacuuucaaga

SEQ ID NO: 479759 - RNA, 66 nt, hsa
ugugugugugugugugcacaauaaauaggaaauguagaaaccaagcaagaaggcuuaguagcucag

SEQ ID NO: 479760 - RNA, 66 nt, hsa
accgagcuugucagcuuuuuugaaaacacaucaguagaaaccaagauuuuaaaaugaagugucaag

SEQ ID NO: 479761 - RNA, 66 nt, hsa
uagcauccuuauauaauaaugcuauuuagaaagacugaaaccaagacuauuuaacugugaacuaug

SEQ ID NO: 479762 - RNA, 66 nt, hsa
cccagacugccagcagcacccgucuguuacacaugugaaaccaaagccugcucucuccuaaggcuc

SEQ ID NO: 479763 - RNA, 66 nt, hsa
auauuauguuuuuacugaaauuaacugaaaaaauaugaaaccaaaaguacaaacuguguugucuuu

SEQ ID NO: 479764 - RNA, 66 nt, hsa
guuauuuaacaauagcaauaguucuagugaaugugugaaaccaagaaacacucuguacugugugcg

SEQ ID NO: 479765 - RNA, 66 nt, hsa
uaaugaaaguugaccauaguuauuuccaaauaaaaagaaaccaacucuuaccaggucuuggacugu

SEQ ID NO: 479766 - RNA, 66 nt, hsa
guggauuccaaaugaaccccugcguuaguuacaaaggaaaccaaugccacuuuuguuuauaagacc

SEQ ID NO: 479767 - RNA, 66 nt, hsa
cuccagcucuaguucagcuauaauuccuuuuauagagaaaccaaccugauacacacuuucaugaug

SEQ ID NO: 479768 - RNA, 66 nt, hsa
uuuuaauugaaaugucaaguuuccuguuacacuauggaaaccaagaaacaucagacaucauugcgu

SEQ ID NO: 479769 - RNA, 66 nt, hsa
guuguuuuuuguuguuguuguuguuguuuuacagcugaaaccaaccagcaagcccuugaugaccaa

SEQ ID NO: 479770 - RNA, 66 nt, hsa
ucggcccccgggggccccgccccgaagcagccuccugaaaccaaaacgcccgacgcagacgcggug

SEQ ID NO: 479771 - RNA, 66 nt, hsa
accuagcucuagccuguaccaguuaguucaucaaaggaaaccaaccgggaugcuaacuacaacaug

SEQ ID NO: 479772 - RNA, 66 nt, hsa
gguccccacagacugccccagccaacgagauugcuggaaaccaagucaggccaggugggcggacaa

SEQ ID NO: 479773 - RNA, 66 nt, hsa
guccaaaccugugaccccaggccagggaacggggaggaaaccaaagaaaaccauuuucagggagcu

SEQ ID NO: 479774 - RNA, 66 nt, hsa
gcucaccuaggauuggcuauucugagggauugcauagaaaccaagcuccacuugcuguccuuggga

SEQ ID NO: 479775 - RNA, 66 nt, hsa
gucauaaugaauuacagucaugacaggcacauguaagaaaccaaaauuugcuaaauauguacauga

SEQ ID NO: 479776 - RNA, 66 nt, hsa
gaacaucuguucccaccaacuuacuauauauacacggaaaccaauuucuuacccuugcccuagauu

SEQ ID NO: 479777 - RNA, 66 nt, hsa
cgcccccguccggcuuccuugguggaggccgucuaggaaaccaaaaacucccaggaugccccggug

SEQ ID NO: 479778 - RNA, 66 nt, hsa
guaaaggagaaguggggcagcugcaggacauguagagaaaccaaacugggaaaucuuacaaggagu

SEQ ID NO: 479779 - RNA, 66 nt, hsa
aacuccaguuuaaaaaguguuauuuuuaaaacauuugaaaccaaguacuguuuaauuucaaucaga

SEQ ID NO: 479780 - RNA, 66 nt, hsa
cuugcuucagccccagguguggugacuuagaccuaggaaaccaauuaugaguggaaagugacccuc

SEQ ID NO: 479781 - RNA, 66 nt, hsa
gaaacaaaaugccaguauuuucuuaagccaugaugugaaaccaaugacccugugaccacauggcac

SEQ ID NO: 479782 - RNA, 66 nt, hsa
gaaacguccugaccugugaucacacaugacagugaggaaaccaagugcaacuccuggguuuuuuua

SEQ ID NO: 479783 - RNA, 66 nt, hsa
ucaaauuucauuuuuuccuuuuuccauuuaucuguggaaaccaacagauauugcucuauauuuuuu

SEQ ID NO: 479784 - RNA, 66 nt, hsa
aagaaaccaaaccaccaucuuuuauaaauugccauggaaaccaagugccuucaaugaaacaagccu

SEQ ID NO: 479785 - RNA, 66 nt, hsa
cuugaacacccaaacuacgucaucuguuccaaugaagaaaccaaaccaccaucuuuuauaaauugc

SEQ ID NO: 479786 - RNA, 66 nt, hsa
agcaacuaaauuuacccuuuacuuauuaguuaaaaggaaaccaaggcauguaggaaaauauuggua

SEQ ID NO: 479787 - RNA, 66 nt, hsa
uuaaccuuggagugagagcccagggacaggucccuggaaaccaaagaaaaaucgcauuucaacccu

SEQ ID NO: 479788 - RNA, 66 nt, hsa
aaacggggaacuauagcaauauuuaaagaugcuuuggaaaccaaccgugaacacaucaacaccacg

SEQ ID NO: 479789 - RNA, 66 nt, hsa
uucuccccaccaccccuccugccccacuuuggcccagaaaccaaaugugaacuuccugucucccac

SEQ ID NO: 479790 - RNA, 66 nt, hsa
uuggcaauuuaacgagccacuuccaugaucuccaaagaaaccaaaauacaaacacaauauuuaauc

SEQ ID NO: 479791 - RNA, 66 nt, hsa
agucaugugggcuugccuucucugccaaacgacugggaaaccaaaaugagcccaccuuguguucuu

SEQ ID NO: 479792 - RNA, 66 nt, hsa
gagagagaaagucaaauaaagucaaagaccaguuuggaaaccaaaguuggaaaagaagaauuguag

SEQ ID NO: 479793 - RNA, 66 nt, hsa
aaagaaacacccuaaucuagauaaaggucuguuucagaaaccaacagugauggcauucuaaagagu

SEQ ID NO: 479794 - RNA, 66 nt, hsa
gagguuggagacuucaaccgggcaaaggagcacaaggaaaccaagcagcagaggccccaucagcac

SEQ ID NO: 479795 - RNA, 66 nt, hsa
uaaaauauaguuuauaaaucggcaguacgguauuaugaaaccaagaaaggguuucuugaaaagcuu

SEQ ID NO: 479796 - RNA, 66 nt, hsa
gagaaaacggcacaccaaucaauaaagaacugagcagaaaccaacagugugcuuuuaauaaaggau

SEQ ID NO: 479797 - RNA, 66 nt, hsa
ucaucacugcuccuuauaauaaaccuaauaaagcaagaaaccaagccuaucugggucucuuauuuc

SEQ ID NO: 479798 - RNA, 66 nt, hsa
auauaaacuauuuaaaucaaaauauucuuacauauagaaaccaaguaagaauaaaugagagauauu

SEQ ID NO: 479799 - RNA, 66 nt, hsa
agauuuauaaaugcacuguaauauguacacaacuuagaaaccaaauuacaaguauucaguuccaau

SEQ ID NO: 479800 - RNA, 66 nt, hsa
guuuuaaauaaaacuucuuuuggauagaaaucauuagaaaccaagcauacugcacucuaauauuuu

SEQ ID NO: 479801 - RNA, 66 nt, hsa
uauuugaagaaaaaaaagcguuauuuauaguccaaagaaaccaaagacuuagcucaccugcauucu

SEQ ID NO: 479802 - RNA, 66 nt, hsa
aguguagcagcacacuuguucagguuugcaugguaugaaaccaaauagauucaugaaaccuuggcc

SEQ ID NO: 479803 - RNA, 66 nt, hsa
gggaauagccaucgacaaacuaagggggccucagaggaaaccaacccugcugacaccucaaucuua

SEQ ID NO: 479804 - RNA, 66 nt, hsa
gcugagcuguagcauuugggcuggccugccuuaucagaaaccaagcuuaugaagaucuucucccag

SEQ ID NO: 479805 - RNA, 66 nt, hsa
guauuggcaccaaguuaggucucagaggaaagaauggaaaccaaucacuuuacauuuuuauuuuua

SEQ ID NO: 479806 - RNA, 66 nt, hsa
uccaucaacgcacaccugcuaucguggaacagccuagaaaccaagggacuccaccaccaagucacu

SEQ ID NO: 479807 - RNA, 66 nt, hsa
cccgccagcugauuggaugucuaggaaugacugaaagaaaccaaaacagccuguccacugcugcug

SEQ ID NO: 479808 - RNA, 66 nt, hsa
uccuugcccuggggccgguucuuacccagguccagagaaaccaacgcgggaugucagacuucacca

SEQ ID NO: 479809 - RNA, 66 nt, hsa
gagucaguaccccugguaaaccaagccucccacacugaaaccaaaacauaaaaaccaaacccagac

SEQ ID NO: 479810 - RNA, 66 nt, hsa
gguggccgucugcaagccgaggagggggccucaggagaaaccaacccugcaaucaccuugaucuug

SEQ ID NO: 479811 - RNA, 66 nt, hsa
augguccuugugaugguauuacuuuuuacaaagaaugaaaccaaauggacucagcccucucccaca

SEQ ID NO: 479812 - RNA, 66 nt, hsa
uaguuguccccauugucuacccacacaaauccucaggaaaccaaccaccgcccagguggcccugag

SEQ ID NO: 479813 - RNA, 66 nt, hsa
ccuuaguggauuuaccuguagaguuuauuggauccugaaaccaaucaauuacuuagaacuaggcaa

SEQ ID NO: 479814 - RNA, 66 nt, hsa
guugugacagucacugcauuugccugcuucuuuccagaaaccaaacuaggagaugaaacugguucc

SEQ ID NO: 479815 - RNA, 66 nt, hsa
aucaccaagucucgucuucuuuccuuccugugaguugaaaccaaacaggccucucgcucacuccuc

SEQ ID NO: 479816 - RNA, 57 nt, hsa; identical to SEQ ID NO: 478958

SEQ ID NO: 479817 - RNA, 66 nt, hsa
cccaaccacaaagguguuugugauuccucaccccgggaaaccaaggagcugcaaaguggagucugg

SEQ ID NO: 479818 - RNA, 66 nt, hsa
uauuuaacuuaaucaaaugugguaugggagggguuggaaaccaaguugucuccugggggggagaaa

SEQ ID NO: 479819 - RNA, 66 nt, hsa
cuguuuggccacccucuggccagccaaaagcacucugaaaccaagaccuucccauuuccuccuccc

SEQ ID NO: 479820 - RNA, 65 nt, hsa
uuaaauuguauauuuugaaaaauaaaacacugaaaagaaaccaacaaaaaugaguuguucaucag

SEQ ID NO: 479821 - RNA, 66 nt, hsa
uaaaggcagguagccuggcgccuaggaaccagaccugaaaccaaggaaccagacccgaaaccaggc

SEQ ID NO: 479822 - RNA, 66 nt, hsa
cacagaaucagaaaaaaaaagcauuaaaauuuauuugaaaccaaaaaagagcccaaaaagccaaag

SEQ ID NO: 479823 - RNA, 66 nt, hsa
auuuuccaguuuuauggaauugggagucugacaagugaaaccaauuuaauguaaaguauuuggcuu

SEQ ID NO: 479824 - RNA, 66 nt, hsa
caagaaccccuuuuaucccuggaagaggcuguguaugaaaccaaugcccaggguuugaaggguguu

SEQ ID NO: 479825 - RNA, 66 nt, hsa
gcucuuuuucagcuuuauuuuuaagaguacagucaggaaaccaacaaggggccuaagaguggcugc

SEQ ID NO: 479826 - RNA, 65 nt, hsa; identical to SEQ ID NO: 479397

SEQ ID NO: 479827 - RNA, 66 nt, hsa
gagguuaaaauuuauagucauucuaacugcacuuuggaaaccaagcaaggggagaagacaaaugaa

SEQ ID NO: 479828 - RNA, 66 nt, hsa
gaggucaagcaauaggcgccuggcagugucaagccugaaaccaagcaauaccgucauguuucagcc

SEQ ID NO: 479829 - RNA, 66 nt, hsa
uuuauccagaggccugcugcagauggggaagagcuggaaaccaagaaguuugucaacagaggaccc

SEQ ID NO: 479830 - RNA, 66 nt, hsa
ggaaaaaaagucauuaggcuuucccuuugugucagugaaaccaaaagugcuucuuacaacguucgc

SEQ ID NO: 479831 - RNA, 66 nt, hsa
aagauuugguugccauagucauaagcaaugauacaugaaaccaaugaaagacaguacauguaauaa

SEQ ID NO: 479832 - RNA, 66 nt, hsa
uuagaacauauuugcauaagauagcuauuuacucuggaaaccaacaacuuuugagauuucccuugc

SEQ ID NO: 479833 - RNA, 66 nt, hsa
uuaauuagugcaaauacaagcugcguuucuuuaauagaaaccaaaggcaucuggagcccgagaggc

SEQ ID NO: 479834 - RNA, 66 nt, hsa
cauuuccuagccagcugggggacacuggaaauucgggaaaccaagagagaggaagaaggagacgcc

SEQ ID NO: 479835 - RNA, 66 nt, hsa
ccgcaggcugagcaagucuguaaacugauucugggagaaaccaagcugcuggccauaggguguccu

SEQ ID NO: 479836 - RNA, 66 nt, hsa
cacacaggacagcagaagauccccuuugucaguggggaaaccaaggcagagcugaggggacaggga

SEQ ID NO: 479837 - RNA, 66 nt, hsa
uuccuucccuuauuucuaacguguauguuucugguggaaaccaaguucacccuggcugggagcauc

SEQ ID NO: 479838 - RNA, 66 nt, hsa
aacugccgcaagaccacuacaugacuuagggaacuugaaaccaacuggcucauggagaaaacaaau

SEQ ID NO: 479839 - RNA, 66 nt, hsa
cucuggcugccucugagucugaaucucccaaagagagaaaccaauuucuaagaggacuggauugca

SEQ ID NO: 479840 - RNA, 66 nt, hsa
cccgacgguagaguucuuucaucuaugguugaaucagaaaccaagaaacacuacuauuaaacugca

SEQ ID NO: 479841 - RNA, 66 nt, hsa
cuacaaggcuuccaggggaugccauccagccuguaggaaaccaaagaugggaaguggcuccuaggg

SEQ ID NO: 479842 - RNA, 66 nt, hsa
cccugcacuucuagcccucauuuaagauuugagggugaaaccaaagaaaacccccuaagugaggga

SEQ ID NO: 479843 - RNA, 66 nt, hsa
uucuuagcaagauauuuuaucucuguacauaaaguagaaaccaaaagcuagggaaacagauacucu

SEQ ID NO: 479844 - RNA, 66 nt, hsa
agagauaaagaccuuuuccaugcacccucauacacagaaaccaauuuucuuuuuuauacucaauca

SEQ ID NO: 479845 - RNA, 66 nt, hsa
cuccucucacugccugccagaaaacaaaaacaccaagaaaccaagucaacuuuucaccuccugagu

SEQ ID NO: 479846 - RNA, 66 nt, hsa
cguauaguccuagcugacgccaauaauaaaaaacaagaaaccaagugggcugguauucucucuaug

SEQ ID NO: 479847 - RNA, 66 nt, hsa
uauuuuuagaagaaauauguuacacucagaaaugaugaaaccaaaucuuauauuaaaaggcaaaga

SEQ ID NO: 479848 - RNA, 66 nt, hsa
ucugauuccuuccaacgugcacuucagcuggagaaagaaaccaagaagggaagcggccgcugggcc

SEQ ID NO: 479849 - RNA, 66 nt, hsa
gcguuuggucagacaucaucuccuuggcugcccuuugaaaccaaaucacuugccuuggggauaaag

SEQ ID NO: 479850 - RNA, 66 nt, hsa
aaauaugacguacgaaauggacaaaaagcuuuuucugaaaccaacuuuuuacuuccaucauccuuu

SEQ ID NO: 479851 - RNA, 66 nt, hsa
cagugauaggcuuaaagauuguauuuucacagaguggaaaccaauuuuuuuaguuauuguucaagg

SEQ ID NO: 479852 - RNA, 66 nt, hsa
acgaggccgauuuuuuuuuuuuuaacauggaacaaugaaaccaacaacaaacauuuuuaaaauuaa

SEQ ID NO: 479853 - RNA, 66 nt, hsa
ccagccgggcaggguggaaggagcuugccucuuugagaaaccaaggagucccagugaucuguuacc

SEQ ID NO: 479854 - RNA, 66 nt, hsa
uguugccaggggugaggccgugccccaggccuccccgaaaccaaaggggaaggcagggguggggcc

SEQ ID NO: 479855 - RNA, 66 nt, hsa
gagcuaggggcccgccccgcggacugacagcaccaggaaaccaaaugaugucccugcccgccgccc

SEQ ID NO: 479856 - RNA, 66 nt, hsa
acaccuucgaaaacaugguaggacucacacuggauagaaaccaaagcaggugaaucaccugagguc

SEQ ID NO: 479857 - RNA, 66 nt, hsa
accucccacugccgcucaggggcugacccuauuuaggaaaccaaagaggguggguugaaccuacuc

SEQ ID NO: 479858 - RNA, 66 nt, hsa
gccucugggucccccuucucuguccacccacagagugaaaccaauuaaaauguuggaucucauuua

SEQ ID NO: 479859 - RNA, 66 nt, hsa
uccuuggagcacugagcaccauuuggaagcuugagagaaaccaaaauuaaagagagaaagagagag

SEQ ID NO: 479860 - RNA, 66 nt, hsa
uggcccagcauucagggaggagucguaagaucuuaagaaaccaauccuugccucaagcaaaagcau

SEQ ID NO: 479861 - RNA, 66 nt, hsa
gaccuggaacagaugcuuucauuauggccuccagaggaaaccaacccugucuccaccuugauauug

SEQ ID NO: 479862 - RNA, 66 nt, hsa
gcugcagagggagccuccugcucccugcuccaggaugaaaccaagagggggaugucagccucaccc

SEQ ID NO: 479863 - RNA, 66 nt, hsa
agcucggggcgggcggagcccgcguggccgaagcuggaaaccaaaccuaauaaaguuuucccaucc

SEQ ID NO: 479864 - RNA, 66 nt, hsa
ugaaauguuugucuuuucuguuuuuuaaaugaucaugaaaccaaaaagagacugaucauccaggcc

SEQ ID NO: 479865 - RNA, 66 nt, hsa
guuuuauuauccuguccccagagggugguuuauccagaaaccaagaaaaaaaaucaaucagaauaa

SEQ ID NO: 479866 - RNA, 66 nt, hsa
auuucauaaccaggccggaccacgugcaauaggguggaaaccaaacugcuccaugccggguuauuu

SEQ ID NO: 479867 - RNA, 66 nt, hsa
gggcaggcggguggggggaugggaagggggugcccugaaaccaaacuggaagcccccucugccucc

SEQ ID NO: 479868 - RNA, 66 nt, hsa
auuacuguauguugcuuuucuaaauaaauguauugugaaaccaaaacagcugcuguuaauauggau

SEQ ID NO: 479869 - RNA, 66 nt, hsa
guacugauugcugucucgugugucuguaaaaugugugaaaccaaacugcagccucaacaccaugga

SEQ ID NO: 479870 - RNA, 66 nt, hsa
caaaggcaggaaggauccugccuugauuuuacuucagaaaccaaaucagucuucuauaaucugggg

SEQ ID NO: 479871 - RNA, 66 nt, hsa
aaauuaaaacuuaacagcaucaaauuauugggaccagaaaccaaguaauguauaauguggcuuuug

SEQ ID NO: 479872 - RNA, 66 nt, hsa
gggcccuuccaacucuggagugucuguaguucuugugaaaccaaaacguugacuaccugccucuuu

SEQ ID NO: 479873 - RNA, 66 nt, hsa
gccugaagccuggauuccagcagugaaugcuagacagaaaccaagccauuaaugagauguuauuac

SEQ ID NO: 479874 - RNA, 66 nt, hsa
guacuuuauuacgaguaaaguguaaugaguacuguggaaaccaaauuugaauacugcaaauuugua

SEQ ID NO: 479875 - RNA, 66 nt, hsa
uauacaaacagggcagaaccacagaagaacguuuuagaaaccaagagaugugcagaaagaaauguu

SEQ ID NO: 479876 - RNA, 66 nt, hsa
aaauugaaauaagcucuuugcaggcguccaauccuagaaaccaauggucuccagaacucucacaca

SEQ ID NO: 479877 - RNA, 66 nt, hsa
ucaauuccucuuauucuuaaauaucuaaagggaaaggaaaccaacuuuaauuucagaacuucucuu

SEQ ID NO: 479878 - RNA, 66 nt, hsa
cuuccucgaguggccacugugagccucgucacagcagaaaccaacuuuucuaacgacugaguucgc

SEQ ID NO: 479879 - RNA, 66 nt, hsa
uguuuuacuggcaguucuauaguaguccagacuuuagaaaccaaacacaacaaaauggcuuguugc

SEQ ID NO: 479880 - RNA, 66 nt, hsa
uggaugaugccuaggcccaaaggagaggccaaaagggaaaccaaggcugcacaccuagaaccccaa

SEQ ID NO: 479881 - RNA, 66 nt, hsa
uggccccuucugccuuccaggagaggucuugcuuuugaaaccaaaaucauguucuucuaaaguguc

SEQ ID NO: 479882 - RNA, 66 nt, hsa
uuggagaaagagaauuauccccacuucacagaugaggaaaccaaggcuaagagaugagcgaugccu

SEQ ID NO: 479883 - RNA, 66 nt, hsa
auaugauaaugauaccaaaggaaagauaauuaucaugaaaccaacuuuuggaucauucccuuuuua

SEQ ID NO: 479884 - RNA, 66 nt, hsa
cgccacacaacaucaagaaggccgacaaccagguuggaaaccaagacggagcucagacccaccaca

SEQ ID NO: 479885 - RNA, 66 nt, hsa
agcuuggggcagccauuggccucugucucguuuugggaaaccaaggucaggaggccguugcagaca

SEQ ID NO: 479886 - RNA, 66 nt, hsa
aaaguagagauaauguguagucacuucugauuuagugaaaccaauuguaauaauuguggaaauguu

SEQ ID NO: 479887 - RNA, 66 nt, hsa
ccaagaacucaaauuccuuucucauuggagccuagugaaaccaaaugaacgggaccugcuggccuc

SEQ ID NO: 479888 - RNA, 66 nt, hsa
gguuccagaggaugcaucuggcucaccggguguuccgaaaccaaagaagaaacuucgccuuaucag

SEQ ID NO: 479889 - RNA, 66 nt, hsa
ccagucugcuguccugaaacccagaagugauggagagaaaccaacaagagaucucgaacccugucu

SEQ ID NO: 479890 - RNA, 66 nt, hsa
aagcaccuacugggugcuggguucacuguguccuaggaaaccaagaggguccccaguccuggccuc

SEQ ID NO: 479891 - RNA, 66 nt, hsa
gcgcugguaccugcuggcccauggcccggguguagagaaaccaagcggcagccaccaccaguguug

SEQ ID NO: 479892 - RNA, 66 nt, hsa
uuuuaugcuaccuaccccuguacaaguuaugcgaaggaaaccaagccaucugcauguuuauuuccu

SEQ ID NO: 479893 - RNA, 66 nt, hsa
uggcucuuucuaccaauguuugcuccugguuggaaagaaaccaaagauuuaagacgggcugcucuu

SEQ ID NO: 479894 - RNA, 66 nt, hsa
aacuguaggaacuugacuugcguuagaguguacucugaaaccaacucgucucuggccgcaggaguc

SEQ ID NO: 479895 - RNA, 66 nt, hsa
cugaaagaagguuuaucauuacaaauaccuuccaaugaaaccaagaauuucucaaaauauuuaaug

SEQ ID NO: 479896 - RNA, 66 nt, hsa
cucaaaaucaguuuuuauauuccccaaaagaagaaggaaaccaaggaguagcuauauauuucuacu

SEQ ID NO: 479897 - RNA, 66 nt, hsa
ggcaacuauagguuuaaaccaagacaaaugaagacugaaaccaagaauauuguucuuaugcuggaa

SEQ ID NO: 479898 - RNA, 66 nt, hsa
gugaaugggagggcgggccuggagcugcgugagagugaaaccaagaagcggauggggaagggagag

SEQ ID NO: 479899 - RNA, 66 nt, hsa
ccuauaaagugccucggacaguccgcaguuguagcagaaaccaacaagaaccacuccuucauguuu

SEQ ID NO: 479900 - RNA, 66 nt, hsa
uaagucauaugccuccagccauuauaugagaacugugaaaccaauaugguuuucuuuaugucuugg

SEQ ID NO: 479901 - RNA, 66 nt, hsa
uuauuauuucuuaucuuucuucuuuuauauuuuuuggaaaccaaauuuauaguuaguuuagguaaa

SEQ ID NO: 479902 - RNA, 66 nt, hsa
aucaccaaaaaaaguauauagugacauuuuuaguaugaaaccaaauuacacuaaggucuuuuguug

SEQ ID NO: 479903 - RNA, 66 nt, hsa
gcugcauagaaggaggagagggaaaauguuuuguaagaaaccaaucaagauaaaggacagugaagu

SEQ ID NO: 479904 - RNA, 66 nt, hsa
auaauaaaauuuccccuaaucuuuucugaaucuucugaaaccaaauguaacuauguuuuaucgucc

SEQ ID NO: 479905 - RNA, 66 nt, hsa
ucuuaaauuucuuaaccuaggcuucagggagcauaugaaaccaaaauuauauggaacauuuucugu

SEQ ID NO: 479906 - RNA, 66 nt, hsa
cauguagaacuguaauaagugaauuacaggucacaugaaaccaaaacgggcccugcuccauaagag

SEQ ID NO: 479907 - RNA, 66 nt, hsa
gaaacucuuaaauuauaaugugaaaccugguuuuaugaaaccaaagacuagugcagcauuucagca

SEQ ID NO: 479908 - RNA, 66 nt, hsa
uaagcuaauuaagggcgaugauuauuauuacaagaagaaaccaagacauuacaccaugguuuuuag

SEQ ID NO: 479909 - RNA, 66 nt, hsa
gucagaggagggugaggaagacuaauuaaacauggagaaaccaaauuggacaaauccucaccacca

SEQ ID NO: 479910 - RNA, 66 nt, hsa
gcauuucaacauagagucacauaaaugucccccugagaaaccaaucccacuucuuucuaggagauu

SEQ ID NO: 479911 - RNA, 66 nt, hsa
gugugaggccugcagaggcccugaaugcacaaaugggaaaccaaggcacagagaggcucuccucuc

SEQ ID NO: 479912 - RNA, 61 nt, hsa; identical to SEQ ID NO: 479054

SEQ ID NO: 479913 - RNA, 61 nt, hsa; identical to SEQ ID NO: 479055

SEQ ID NO: 479914 - RNA, 66 nt, hsa
ugaacugaggaaggugcuuagauggugagggcucuagaaaccaagccccaugagcagcaguggaag

SEQ ID NO: 479915 - RNA, 66 nt, hsa
ucugaaacuuugggaauuugcuuuagccagaauaaagaaaccaaaucaugaaaauuauggaagacu

SEQ ID NO: 479916 - RNA, 66 nt, hsa
auaauuauuauuucuuaucuucuuuuauauuuuuuggaaaccaaauuuauaguuaguuuagguaaa

SEQ ID NO: 479917 - RNA, 66 nt, hsa
aaaugugugaacuugacuuguguuagaguauauucugaaaccaacuugucccaggccacaggagug

SEQ ID NO: 479918 - RNA, 64 nt, hsa
aauuugaaugaacuaaagauauaucucuaccuucucauuugaauaucuuuaguucauucagauu

SEQ ID NO: 479919 - RNA, 64 nt, hsa
aaucugaaugaacuaaagauguaucuguaccuucucauuugauguauuaaucauaaaauuucac

SEQ ID NO: 479920 - RNA, 64 nt, hsa
uagguuuauauuuucagaucucucaaaaaucacaucauuugaccaaagaauaauuuaagacaca

SEQ ID NO: 479921 - RNA, 64 nt, hsa
gaaaaccuuagauagagggacaugugaaacaaaaucauuugaaauuuugauucagacauccauu

SEQ ID NO: 479922 - RNA, 64 nt, hsa
aauucauuguuuugugggaucuaagacccaggggucauuugagagguuugacaguaucuuuucu

SEQ ID NO: 479923 - RNA, 64 nt, hsa
gcccccaucaugccccacacccaucagucaacacucauuugacaaauagaguccagcugccucu

SEQ ID NO: 479924 - RNA, 64 nt, hsa
uaaacugaagaaagugucuauauuggaacuagggucauuugaaagcuucagucucggaacauga

SEQ ID NO: 479925 - RNA, 64 nt, hsa
gacuuacaaauaaugggcucugauugggcaauacucauuugaguuccuuccauuugaccuaauu

SEQ ID NO: 479926 - RNA, 64 nt, hsa
uuggaagccuuuugcagcucuguggcuuggaauuucauuugagcaauuucuauaggauauguau

SEQ ID NO: 479927 - RNA, 64 nt, hsa
gagccacacauuuaaauacagacagcuuuccugaucauuugauuuauugugcaccugauuuuug

SEQ ID NO: 479928 - RNA, 64 nt, hsa
uucuuauguauggguuuuuuuuaaugugaucccuucauuugaauauuaauggcuuuuuccauua

SEQ ID NO: 479929 - RNA, 64 nt, hsa
guggccuuuuaaccaagaaguaguacuugauuggucauuugaaaacacugcaacagugaacuuu

SEQ ID NO: 479930 - RNA, 64 nt, hsa
aucuugaaaggcuuuuggugaaaaugaagggauuucauuugaaauuacagcaugaugaauuuug

SEQ ID NO: 479931 - RNA, 64 nt, hsa
cguuaugacuuuggcaacuugcuucauuucuuuuucauuugacuuacaacacacuucucuaaca

SEQ ID NO: 479932 - RNA, 64 nt, hsa
auucucuuagaaauucaaguauuuucaaggggagucauuugagauauauuuauuuuacuaggag

SEQ ID NO: 479933 - RNA, 64 nt, hsa
ucuaugagguucuuagaaaaauuugguuuuaaaaucauuugaggacaggaaugucuauagcaag

SEQ ID NO: 479934 - RNA, 64 nt, hsa
ucucugguugccuccugccaccagcauccauggcucauuugacaccuuuuuaaauaucaggaca

SEQ ID NO: 479935 - RNA, 64 nt, hsa
uucagguuugcugucacauaugcaucaucugaaaucauuugaaauuuuuguacaauaaaauauc

SEQ ID NO: 479936 - RNA, 64 nt, hsa
acuuggcccuugguaaaauuuugacaaucauaagucauuugaaaagaacagacuuacuaaaauc

SEQ ID NO: 479937 - RNA, 64 nt, hsa
cucccacaacaaauaccaagcaucaaaagcacuuucauuugaaaauuauuauguuguaauuuuu

SEQ ID NO: 479938 - RNA, 64 nt, hsa
gagugacuuucuaacauaggaauucacuguguuuucauuugaugucguacugguuuuaaaccuu

SEQ ID NO: 479939 - RNA, 64 nt, hsa
acaaugcuguguaacauaggaauucacuguguuuucauuugaugucguacugguuuuaaaccuu

SEQ ID NO: 479940 - RNA, 64 nt, hsa
uaguaagaguauucuaaacagcacuacauuaauaucauuugauagguauaaaguauacuuuuuc

SEQ ID NO: 479941 - RNA, 64 nt, hsa
uuaaaaugagaaguuauuauucauacuguguugcucauuugacaaaauaagguaaggauuucau

SEQ ID NO: 479942 - RNA, 64 nt, hsa
aaucccagcacuuugggaggccgaggcggguggaucauuugaggucaggaguuugaaaccagcc

SEQ ID NO: 479943 - RNA, 64 nt, hsa
gaauuuuuccauauaaaucucaaugaauucccuuucauuugaauaggcaaacccaaauccaugc

SEQ ID NO: 479944 - RNA, 64 nt, hsa
auuuuguauaaaaaagaacaacagaaauuaucugucauuugagaaguggcuugacaaucauuug

SEQ ID NO: 479945 - RNA, 64 nt, hsa
gaaauuaucugucauuugagaaguggcuugacaaucauuugagcuuugaaagcagucacugugg

SEQ ID NO: 479946 - RNA, 64 nt, hsa
augaagacccaaggcauaagguugggaaaacaccucauuugaccuugccagcugaccuucaaac

SEQ ID NO: 479947 - RNA, 64 nt, hsa
aacuugaauggaauaacgacauuccagaaguuaaucauuugaauucugaacacuggagaaaaac

SEQ ID NO: 479948 - RNA, 64 nt, hsa
gugacugaaggauuuauucagacugcuguacucuucauuugauguaacaaaaugcuauuaaucu

SEQ ID NO: 479949 - RNA, 64 nt, hsa
cuguggcugcuagugaccucuuugcuguggccccucauuugaccuuucaccucugucuguugga

SEQ ID NO: 479950 - RNA, 64 nt, hsa
uuuuguaucuuccauucauacuuuaaccuacaggucauuugagucuucacacaaauaauaaccu

SEQ ID NO: 479951 - RNA, 64 nt, hsa
aggacuuuucaccauccaucacccacuuaucccuucauuugacaccauucauuaagugccuucu

SEQ ID NO: 479952 - RNA, 64 nt, hsa
auuaaagcccuuuuuaaaaagcaccuauuugggaucauuugaggucaagaauucgagaucagcc

SEQ ID NO: 479953 - RNA, 64 nt, hsa
cuaaguuuuuaguaugggugauacuggagucuuaucauuugaaguguuugcuuuucuacuuuua

SEQ ID NO: 479954 - RNA, 64 nt, hsa
auuucuucucugguuguaauucuaaauuacagagucauuugagcuuucuccccucccgcuagua

SEQ ID NO: 479955 - RNA, 64 nt, hsa
uguagcauucuguuuuagcaucuuugaauuaugaucauuugauuuggcuaauuacaaaaaguac

SEQ ID NO: 479956 - RNA, 64 nt, hsa
cucuguauuaauccccaucauuacugguaaagccucauuugaaugugugaauucaauacaggcu

SEQ ID NO: 479957 - RNA, 64 nt, hsa
guaugagucuucuguaauucauugagcaguuagcucauuugagauaaagucaaaugccaaacac

SEQ ID NO: 479958 - RNA, 64 nt, hsa
gaauguggcagguuagaaagagagagaaugucuuucauuugaagaguguuggacuugugugaaa

SEQ ID NO: 479959 - RNA, 64 nt, hsa
gauggagacauuaacaagcuaaugguaauuagaaucauuugaauuuauuuuuuucuaauaugug

SEQ ID NO: 479960 - RNA, 64 nt, hsa
accuucucauuccuuccuuucagagccuaaaaccucauuugauaagcacuccuagucucuggcc

SEQ ID NO: 479961 - RNA, 64 nt, hsa
uuuuaauuuuuaagaguguucaauccgagaugaaucauuugaaguauuuuuauauguauaucua

SEQ ID NO: 479962 - RNA, 64 nt, hsa
acuacaaggaagguuuuccauuauacuuuuaaagucauuugagggcucuggcucuguggcuuug

SEQ ID NO: 479963 - RNA, 64 nt, hsa
auagcaagaccucaucucagaaaaaaaaaaaaagucauuugaaaacuucuaauacagcaaaauc

SEQ ID NO: 479964 - RNA, 64 nt, hsa
cagaagggccacacuccaggaggaguguugagagucauuugagguagucuugccaccuguuuuc

SEQ ID NO: 479965 - RNA, 64 nt, hsa
ggucccagcuacucaggaggcugaggugggaggaucauuugagccuaggaggucaaggcugcag

SEQ ID NO: 479966 - RNA, 64 nt, hsa; identical to SEQ ID NO: 113393

SEQ ID NO: 479967 - RNA, 64 nt, hsa; identical to SEQ ID NO: 113394

SEQ ID NO: 479968 - RNA, 64 nt, hsa; identical to SEQ ID NO: 113395

SEQ ID NO: 479969 - RNA, 64 nt, hsa; identical to SEQ ID NO: 113396

SEQ ID NO: 479970 - RNA, 64 nt, hsa; identical to SEQ ID NO: 113397

SEQ ID NO: 479971 - RNA, 64 nt, hsa; identical to SEQ ID NO: 113398

SEQ ID NO: 479972 - RNA, 64 nt, hsa; identical to SEQ ID NO: 113399

SEQ ID NO: 479973 - RNA, 64 nt, hsa; identical to SEQ ID NO: 113400

SEQ ID NO: 479974 - RNA, 64 nt, hsa; identical to SEQ ID NO: 113401

SEQ ID NO: 479975 - RNA, 64 nt, hsa; identical to SEQ ID NO: 113402

SEQ ID NO: 479976 - RNA, 64 nt, hsa; identical to SEQ ID NO: 113403

SEQ ID NO: 479977 - RNA, 64 nt, hsa; identical to SEQ ID NO: 113404

SEQ ID NO: 479978 - RNA, 64 nt, hsa; identical to SEQ ID NO: 113405

SEQ ID NO: 479979 - RNA, 64 nt, hsa; identical to SEQ ID NO: 113406

SEQ ID NO: 479980 - RNA, 64 nt, hsa; identical to SEQ ID NO: 113407

SEQ ID NO: 479981 - RNA, 64 nt, hsa; identical to SEQ ID NO: 113408

SEQ ID NO: 479982 - RNA, 64 nt, hsa; identical to SEQ ID NO: 113409

SEQ ID NO: 479983 - RNA, 64 nt, hsa; identical to SEQ ID NO: 113410

SEQ ID NO: 479984 - RNA, 64 nt, hsa; identical to SEQ ID NO: 113411

SEQ ID NO: 479985 - RNA, 64 nt, hsa; identical to SEQ ID NO: 113412

SEQ ID NO: 479986 - RNA, 64 nt, hsa; identical to SEQ ID NO: 113413

SEQ ID NO: 479987 - RNA, 64 nt, hsa; identical to SEQ ID NO: 113414

SEQ ID NO: 479988 - RNA, 64 nt, hsa; identical to SEQ ID NO: 113415

SEQ ID NO: 479989 - RNA, 64 nt, hsa; identical to SEQ ID NO: 113416

SEQ ID NO: 479990 - RNA, 64 nt, hsa; identical to SEQ ID NO: 113417

SEQ ID NO: 479991 - RNA, 64 nt, hsa; identical to SEQ ID NO: 113418

SEQ ID NO: 479992 - RNA, 64 nt, hsa; identical to SEQ ID NO: 113419

SEQ ID NO: 479993 - RNA, 64 nt, hsa; identical to SEQ ID NO: 113420

SEQ ID NO: 479994 - RNA, 64 nt, hsa; identical to SEQ ID NO: 113421

SEQ ID NO: 479995 - RNA, 58 nt, hsa; identical to SEQ ID NO: 113422

SEQ ID NO: 479996 - RNA, 64 nt, hsa; identical to SEQ ID NO: 113423

SEQ ID NO: 479997 - RNA, 64 nt, hsa; identical to SEQ ID NO: 113424

SEQ ID NO: 479998 - RNA, 64 nt, hsa; identical to SEQ ID NO: 113425

SEQ ID NO: 479999 - RNA, 64 nt, hsa; identical to SEQ ID NO: 113426

SEQ ID NO: 480000 - RNA, 64 nt, hsa; identical to SEQ ID NO: 113427

SEQ ID NO: 480001 - RNA, 64 nt, hsa; identical to SEQ ID NO: 113428

SEQ ID NO: 480002 - RNA, 64 nt, hsa; identical to SEQ ID NO: 113429

SEQ ID NO: 480003 - RNA, 64 nt, hsa; identical to SEQ ID NO: 113430

SEQ ID NO: 480004 - RNA, 64 nt, hsa; identical to SEQ ID NO: 113431

SEQ ID NO: 480005 - RNA, 64 nt, hsa; identical to SEQ ID NO: 113432

SEQ ID NO: 480006 - RNA, 64 nt, hsa; identical to SEQ ID NO: 113433

SEQ ID NO: 480007 - RNA, 64 nt, hsa; identical to SEQ ID NO: 113434

SEQ ID NO: 480008 - RNA, 64 nt, hsa; identical to SEQ ID NO: 113435

SEQ ID NO: 480009 - RNA, 64 nt, hsa; identical to SEQ ID NO: 113436

SEQ ID NO: 480010 - RNA, 64 nt, hsa; identical to SEQ ID NO: 113437

SEQ ID NO: 480011 - RNA, 64 nt, hsa; identical to SEQ ID NO: 113438

SEQ ID NO: 480012 - RNA, 64 nt, hsa; identical to SEQ ID NO: 113439

SEQ ID NO: 480013 - RNA, 64 nt, hsa; identical to SEQ ID NO: 113440

SEQ ID NO: 480014 - RNA, 64 nt, hsa; identical to SEQ ID NO: 113441

SEQ ID NO: 480015 - RNA, 64 nt, hsa; identical to SEQ ID NO: 113442

SEQ ID NO: 480016 - RNA, 64 nt, hsa; identical to SEQ ID NO: 113443

SEQ ID NO: 480017 - RNA, 64 nt, hsa; identical to SEQ ID NO: 113444

SEQ ID NO: 480018 - RNA, 64 nt, hsa; identical to SEQ ID NO: 113445

SEQ ID NO: 480019 - RNA, 64 nt, hsa; identical to SEQ ID NO: 113446

SEQ ID NO: 480020 - RNA, 64 nt, hsa; identical to SEQ ID NO: 113447

SEQ ID NO: 480021 - RNA, 64 nt, hsa; identical to SEQ ID NO: 113448

SEQ ID NO: 480022 - RNA, 64 nt, hsa; identical to SEQ ID NO: 113449

SEQ ID NO: 480023 - RNA, 64 nt, hsa; identical to SEQ ID NO: 113450

SEQ ID NO: 480024 - RNA, 64 nt, hsa; identical to SEQ ID NO: 113451

SEQ ID NO: 480025 - RNA, 64 nt, hsa; identical to SEQ ID NO: 113452

SEQ ID NO: 480026 - RNA, 64 nt, hsa; identical to SEQ ID NO: 113453

SEQ ID NO: 480027 - RNA, 64 nt, hsa; identical to SEQ ID NO: 113454

SEQ ID NO: 480028 - RNA, 64 nt, hsa; identical to SEQ ID NO: 113455

SEQ ID NO: 480029 - RNA, 64 nt, hsa; identical to SEQ ID NO: 113456

SEQ ID NO: 480030 - RNA, 64 nt, hsa; identical to SEQ ID NO: 113457

SEQ ID NO: 480031 - RNA, 64 nt, hsa; identical to SEQ ID NO: 113458

SEQ ID NO: 480032 - RNA, 64 nt, hsa; identical to SEQ ID NO: 113459

SEQ ID NO: 480033 - RNA, 64 nt, hsa; identical to SEQ ID NO: 113460

SEQ ID NO: 480034 - RNA, 64 nt, hsa; identical to SEQ ID NO: 113461

SEQ ID NO: 480035 - RNA, 64 nt, hsa; identical to SEQ ID NO: 113462

SEQ ID NO: 480036 - RNA, 64 nt, hsa; identical to SEQ ID NO: 113463

SEQ ID NO: 480037 - RNA, 64 nt, hsa; identical to SEQ ID NO: 113464

SEQ ID NO: 480038 - RNA, 64 nt, hsa; identical to SEQ ID NO: 113465

SEQ ID NO: 480039 - RNA, 64 nt, hsa; identical to SEQ ID NO: 113466

SEQ ID NO: 480040 - RNA, 64 nt, hsa; identical to SEQ ID NO: 113467

SEQ ID NO: 480041 - RNA, 64 nt, hsa; identical to SEQ ID NO: 113468

SEQ ID NO: 480042 - RNA, 64 nt, hsa; identical to SEQ ID NO: 113469

SEQ ID NO: 480043 - RNA, 64 nt, hsa; identical to SEQ ID NO: 113470

SEQ ID NO: 480044 - RNA, 64 nt, hsa; identical to SEQ ID NO: 113471

SEQ ID NO: 480045 - RNA, 64 nt, hsa; identical to SEQ ID NO: 113472

SEQ ID NO: 480046 - RNA, 64 nt, hsa; identical to SEQ ID NO: 113473

SEQ ID NO: 480047 - RNA, 64 nt, hsa; identical to SEQ ID NO: 113474

SEQ ID NO: 480048 - RNA, 64 nt, hsa; identical to SEQ ID NO: 113475

SEQ ID NO: 480049 - RNA, 64 nt, hsa; identical to SEQ ID NO: 113476

SEQ ID NO: 480050 - RNA, 64 nt, hsa; identical to SEQ ID NO: 113477

SEQ ID NO: 480051 - RNA, 64 nt, hsa; identical to SEQ ID NO: 113478

SEQ ID NO: 480052 - RNA, 64 nt, hsa; identical to SEQ ID NO: 113479

SEQ ID NO: 480053 - RNA, 64 nt, hsa; identical to SEQ ID NO: 113480

SEQ ID NO: 480054 - RNA, 64 nt, hsa; identical to SEQ ID NO: 113481

SEQ ID NO: 480055 - RNA, 64 nt, hsa
cugcccaaaauuuccccuacccccaacuuuccccuacccccaacuuuccccaccagcuccacaa

SEQ ID NO: 480056 - RNA, 64 nt, hsa
cugggcugaugaaggcacugcccaaaauuuccccuacccccaacuuuccccuacccccaacuuu

SEQ ID NO: 480057 - RNA, 64 nt, hsa
caucuucugggcccuucucuccuuuaggccagcuuacccccaaaccuggcuccuggggacggau

SEQ ID NO: 480058 - RNA, 64 nt, hsa
ucagcugugacaucgugccugggaaggcgaaauauacccccagccccuuccaacacacacacuc

SEQ ID NO: 480059 - RNA, 64 nt, hsa
guacagaaaauguaucucuuggggagggccuguguacccccauucucugauuauaaacagauaa

SEQ ID NO: 480060 - RNA, 64 nt, hsa
aacagauaaacccaaauguggaucauccuuggaauacccccauucuccuugccucuuagcaugu

SEQ ID NO: 480061 - RNA, 64 nt, hsa
ccaaccuguauggcgggucuguacuuauuuuguuuacccccaauuuaaaacguuuuuuuuuauu

SEQ ID NO: 480062 - RNA, 64 nt, hsa
gacucccccaucuugcugacagcauggcagucccuacccccaauuuuucccaggccaggcacug

SEQ ID NO: 480063 - RNA, 64 nt, hsa; identical to SEQ ID NO: 134055

SEQ ID NO: 480064 - RNA, 64 nt, hsa; identical to SEQ ID NO: 134056

SEQ ID NO: 480065 - RNA, 64 nt, hsa; identical to SEQ ID NO: 134057

SEQ ID NO: 480066 - RNA, 64 nt, hsa; identical to SEQ ID NO: 134058

SEQ ID NO: 480067 - RNA, 64 nt, hsa; identical to SEQ ID NO: 134059

SEQ ID NO: 480068 - RNA, 64 nt, hsa; identical to SEQ ID NO: 134060

SEQ ID NO: 480069 - RNA, 64 nt, hsa; identical to SEQ ID NO: 134061

SEQ ID NO: 480070 - RNA, 64 nt, hsa; identical to SEQ ID NO: 134062

SEQ ID NO: 480071 - RNA, 64 nt, hsa; identical to SEQ ID NO: 134063

SEQ ID NO: 480072 - RNA, 64 nt, hsa; identical to SEQ ID NO: 134064

SEQ ID NO: 480073 - RNA, 64 nt, hsa; identical to SEQ ID NO: 134065

SEQ ID NO: 480074 - RNA, 64 nt, hsa; identical to SEQ ID NO: 134066

SEQ ID NO: 480075 - RNA, 64 nt, hsa; identical to SEQ ID NO: 134067

SEQ ID NO: 480076 - RNA, 64 nt, hsa; identical to SEQ ID NO: 134068

SEQ ID NO: 480077 - RNA, 64 nt, hsa; identical to SEQ ID NO: 134069

SEQ ID NO: 480078 - RNA, 64 nt, hsa; identical to SEQ ID NO: 134070

SEQ ID NO: 480079 - RNA, 64 nt, hsa; identical to SEQ ID NO: 134071

SEQ ID NO: 480080 - RNA, 64 nt, hsa; identical to SEQ ID NO: 134072

SEQ ID NO: 480081 - RNA, 64 nt, hsa; identical to SEQ ID NO: 134073

SEQ ID NO: 480082 - RNA, 64 nt, hsa; identical to SEQ ID NO: 134074

SEQ ID NO: 480083 - RNA, 64 nt, hsa; identical to SEQ ID NO: 134075

SEQ ID NO: 480084 - RNA, 64 nt, hsa; identical to SEQ ID NO: 134076

SEQ ID NO: 480085 - RNA, 64 nt, hsa; identical to SEQ ID NO: 134077

SEQ ID NO: 480086 - RNA, 64 nt, hsa; identical to SEQ ID NO: 134078

SEQ ID NO: 480087 - RNA, 64 nt, hsa; identical to SEQ ID NO: 134079

SEQ ID NO: 480088 - RNA, 64 nt, hsa; identical to SEQ ID NO: 134080

SEQ ID NO: 480089 - RNA, 64 nt, hsa; identical to SEQ ID NO: 134081

SEQ ID NO: 480090 - RNA, 64 nt, hsa; identical to SEQ ID NO: 134082

SEQ ID NO: 480091 - RNA, 64 nt, hsa; identical to SEQ ID NO: 134083

SEQ ID NO: 480092 - RNA, 64 nt, hsa; identical to SEQ ID NO: 134084

SEQ ID NO: 480093 - RNA, 64 nt, hsa; identical to SEQ ID NO: 134085

SEQ ID NO: 480094 - RNA, 64 nt, hsa; identical to SEQ ID NO: 134086

SEQ ID NO: 480095 - RNA, 64 nt, hsa; identical to SEQ ID NO: 134087

SEQ ID NO: 480096 - RNA, 64 nt, hsa; identical to SEQ ID NO: 134088

SEQ ID NO: 480097 - RNA, 64 nt, hsa; identical to SEQ ID NO: 134089

SEQ ID NO: 480098 - RNA, 64 nt, hsa; identical to SEQ ID NO: 134090

SEQ ID NO: 480099 - RNA, 64 nt, hsa; identical to SEQ ID NO: 134091

SEQ ID NO: 480100 - RNA, 64 nt, hsa; identical to SEQ ID NO: 134092

SEQ ID NO: 480101 - RNA, 64 nt, hsa; identical to SEQ ID NO: 134093

SEQ ID NO: 480102 - RNA, 64 nt, hsa; identical to SEQ ID NO: 134094

SEQ ID NO: 480103 - RNA, 64 nt, hsa; identical to SEQ ID NO: 134095

SEQ ID NO: 480104 - RNA, 64 nt, hsa; identical to SEQ ID NO: 134096

SEQ ID NO: 480105 - RNA, 64 nt, hsa; identical to SEQ ID NO: 134097

SEQ ID NO: 480106 - RNA, 64 nt, hsa; identical to SEQ ID NO: 134098

SEQ ID NO: 480107 - RNA, 64 nt, hsa; identical to SEQ ID NO: 134099

SEQ ID NO: 480108 - RNA, 64 nt, hsa; identical to SEQ ID NO: 134100

SEQ ID NO: 480109 - RNA, 64 nt, hsa; identical to SEQ ID NO: 134101

SEQ ID NO: 480110 - RNA, 64 nt, hsa; identical to SEQ ID NO: 134102

SEQ ID NO: 480111 - RNA, 64 nt, hsa; identical to SEQ ID NO: 134103

SEQ ID NO: 480112 - RNA, 64 nt, hsa; identical to SEQ ID NO: 134104

SEQ ID NO: 480113 - RNA, 64 nt, hsa; identical to SEQ ID NO: 134105

SEQ ID NO: 480114 - RNA, 64 nt, hsa; identical to SEQ ID NO: 134106

SEQ ID NO: 480115 - RNA, 64 nt, hsa; identical to SEQ ID NO: 134107

SEQ ID NO: 480116 - RNA, 64 nt, hsa; identical to SEQ ID NO: 134108

SEQ ID NO: 480117 - RNA, 64 nt, hsa; identical to SEQ ID NO: 134109

SEQ ID NO: 480118 - RNA, 64 nt, hsa; identical to SEQ ID NO: 134110

SEQ ID NO: 480119 - RNA, 64 nt, hsa; identical to SEQ ID NO: 134111

SEQ ID NO: 480120 - RNA, 64 nt, hsa; identical to SEQ ID NO: 134112

SEQ ID NO: 480121 - RNA, 64 nt, hsa; identical to SEQ ID NO: 134113

SEQ ID NO: 480122 - RNA, 64 nt, hsa; identical to SEQ ID NO: 134114

SEQ ID NO: 480123 - RNA, 64 nt, hsa; identical to SEQ ID NO: 134115

SEQ ID NO: 480124 - RNA, 64 nt, hsa; identical to SEQ ID NO: 134116

SEQ ID NO: 480125 - RNA, 64 nt, hsa; identical to SEQ ID NO: 134117

SEQ ID NO: 480126 - RNA, 64 nt, hsa; identical to SEQ ID NO: 134118

SEQ ID NO: 480127 - RNA, 64 nt, hsa; identical to SEQ ID NO: 134119

SEQ ID NO: 480128 - RNA, 64 nt, hsa; identical to SEQ ID NO: 134120

SEQ ID NO: 480129 - RNA, 64 nt, hsa; identical to SEQ ID NO: 134121

SEQ ID NO: 480130 - RNA, 64 nt, hsa; identical to SEQ ID NO: 134122

SEQ ID NO: 480131 - RNA, 64 nt, hsa; identical to SEQ ID NO: 134123

SEQ ID NO: 480132 - RNA, 64 nt, hsa; identical to SEQ ID NO: 134124

SEQ ID NO: 480133 - RNA, 64 nt, hsa; identical to SEQ ID NO: 134125

SEQ ID NO: 480134 - RNA, 64 nt, hsa; identical to SEQ ID NO: 221220

SEQ ID NO: 480135 - RNA, 64 nt, hsa; identical to SEQ ID NO: 221221

SEQ ID NO: 480136 - RNA, 64 nt, hsa; identical to SEQ ID NO: 221222

SEQ ID NO: 480137 - RNA, 64 nt, hsa; identical to SEQ ID NO: 221223

SEQ ID NO: 480138 - RNA, 64 nt, hsa; identical to SEQ ID NO: 221224

SEQ ID NO: 480139 - RNA, 64 nt, hsa; identical to SEQ ID NO: 221225

SEQ ID NO: 480140 - RNA, 64 nt, hsa; identical to SEQ ID NO: 221226

SEQ ID NO: 480141 - RNA, 64 nt, hsa; identical to SEQ ID NO: 221227

SEQ ID NO: 480142 - RNA, 64 nt, hsa; identical to SEQ ID NO: 221228

SEQ ID NO: 480143 - RNA, 64 nt, hsa; identical to SEQ ID NO: 221229

SEQ ID NO: 480144 - RNA, 64 nt, hsa; identical to SEQ ID NO: 221230

SEQ ID NO: 480145 - RNA, 64 nt, hsa; identical to SEQ ID NO: 221231

SEQ ID NO: 480146 - RNA, 64 nt, hsa; identical to SEQ ID NO: 221232

SEQ ID NO: 480147 - RNA, 64 nt, hsa; identical to SEQ ID NO: 221233

SEQ ID NO: 480148 - RNA, 64 nt, hsa; identical to SEQ ID NO: 221234

SEQ ID NO: 480149 - RNA, 64 nt, hsa; identical to SEQ ID NO: 221235

SEQ ID NO: 480150 - RNA, 64 nt, hsa; identical to SEQ ID NO: 221236

SEQ ID NO: 480151 - RNA, 64 nt, hsa; identical to SEQ ID NO: 221237

SEQ ID NO: 480152 - RNA, 64 nt, hsa; identical to SEQ ID NO: 221238

SEQ ID NO: 480153 - RNA, 64 nt, hsa; identical to SEQ ID NO: 221239

SEQ ID NO: 480154 - RNA, 64 nt, hsa; identical to SEQ ID NO: 221240

SEQ ID NO: 480155 - RNA, 64 nt, hsa; identical to SEQ ID NO: 221241

SEQ ID NO: 480156 - RNA, 64 nt, hsa; identical to SEQ ID NO: 221242

SEQ ID NO: 480157 - RNA, 64 nt, hsa; identical to SEQ ID NO: 221243

SEQ ID NO: 480158 - RNA, 64 nt, hsa; identical to SEQ ID NO: 221244

SEQ ID NO: 480159 - RNA, 64 nt, hsa; identical to SEQ ID NO: 221245

SEQ ID NO: 480160 - RNA, 64 nt, hsa; identical to SEQ ID NO: 221246

SEQ ID NO: 480161 - RNA, 64 nt, hsa; identical to SEQ ID NO: 221247

SEQ ID NO: 480162 - RNA, 64 nt, hsa; identical to SEQ ID NO: 221248

SEQ ID NO: 480163 - RNA, 64 nt, hsa; identical to SEQ ID NO: 221249

SEQ ID NO: 480164 - RNA, 64 nt, hsa; identical to SEQ ID NO: 221250

SEQ ID NO: 480165 - RNA, 64 nt, hsa; identical to SEQ ID NO: 221251

SEQ ID NO: 480166 - RNA, 64 nt, hsa; identical to SEQ ID NO: 221252

SEQ ID NO: 480167 - RNA, 64 nt, hsa; identical to SEQ ID NO: 221253

SEQ ID NO: 480168 - RNA, 64 nt, hsa; identical to SEQ ID NO: 221254

SEQ ID NO: 480169 - RNA, 64 nt, hsa; identical to SEQ ID NO: 221255

SEQ ID NO: 480170 - RNA, 64 nt, hsa; identical to SEQ ID NO: 221256

SEQ ID NO: 480171 - RNA, 64 nt, hsa; identical to SEQ ID NO: 221257

SEQ ID NO: 480172 - RNA, 64 nt, hsa; identical to SEQ ID NO: 221258

SEQ ID NO: 480173 - RNA, 64 nt, hsa; identical to SEQ ID NO: 221259

SEQ ID NO: 480174 - RNA, 64 nt, hsa; identical to SEQ ID NO: 221260

SEQ ID NO: 480175 - RNA, 64 nt, hsa; identical to SEQ ID NO: 221261

SEQ ID NO: 480176 - RNA, 64 nt, hsa; identical to SEQ ID NO: 221262

SEQ ID NO: 480177 - RNA, 64 nt, hsa; identical to SEQ ID NO: 221263

SEQ ID NO: 480178 - RNA, 64 nt, hsa; identical to SEQ ID NO: 221264

SEQ ID NO: 480179 - RNA, 64 nt, hsa; identical to SEQ ID NO: 221265

SEQ ID NO: 480180 - RNA, 64 nt, hsa; identical to SEQ ID NO: 221266

SEQ ID NO: 480181 - RNA, 54 nt, hsa; identical to SEQ ID NO: 221267

SEQ ID NO: 480182 - RNA, 64 nt, hsa; identical to SEQ ID NO: 221268

SEQ ID NO: 480183 - RNA, 64 nt, hsa; identical to SEQ ID NO: 221269

SEQ ID NO: 480184 - RNA, 64 nt, hsa; identical to SEQ ID NO: 221270

SEQ ID NO: 480185 - RNA, 64 nt, hsa; identical to SEQ ID NO: 221271

SEQ ID NO: 480186 - RNA, 64 nt, hsa; identical to SEQ ID NO: 221272

SEQ ID NO: 480187 - RNA, 64 nt, hsa; identical to SEQ ID NO: 221273

SEQ ID NO: 480188 - RNA, 64 nt, hsa; identical to SEQ ID NO: 55178

SEQ ID NO: 480189 - RNA, 64 nt, hsa; identical to SEQ ID NO: 55179

SEQ ID NO: 480190 - RNA, 64 nt, hsa; identical to SEQ ID NO: 55180

SEQ ID NO: 480191 - RNA, 64 nt, hsa; identical to SEQ ID NO: 55181

SEQ ID NO: 480192 - RNA, 64 nt, hsa; identical to SEQ ID NO: 55182

SEQ ID NO: 480193 - RNA, 64 nt, hsa; identical to SEQ ID NO: 55183

SEQ ID NO: 480194 - RNA, 64 nt, hsa; identical to SEQ ID NO: 55184

SEQ ID NO: 480195 - RNA, 64 nt, hsa; identical to SEQ ID NO: 55185

SEQ ID NO: 480196 - RNA, 64 nt, hsa; identical to SEQ ID NO: 55186

SEQ ID NO: 480197 - RNA, 64 nt, hsa; identical to SEQ ID NO: 55187

SEQ ID NO: 480198 - RNA, 64 nt, hsa; identical to SEQ ID NO: 55188

SEQ ID NO: 480199 - RNA, 64 nt, hsa; identical to SEQ ID NO: 55189

SEQ ID NO: 480200 - RNA, 64 nt, hsa; identical to SEQ ID NO: 173467

SEQ ID NO: 480201 - RNA, 64 nt, hsa; identical to SEQ ID NO: 173468

SEQ ID NO: 480202 - RNA, 64 nt, hsa; identical to SEQ ID NO: 173469

SEQ ID NO: 480203 - RNA, 64 nt, hsa; identical to SEQ ID NO: 173470

SEQ ID NO: 480204 - RNA, 64 nt, hsa; identical to SEQ ID NO: 173471

SEQ ID NO: 480205 - RNA, 64 nt, hsa; identical to SEQ ID NO: 173472

SEQ ID NO: 480206 - RNA, 64 nt, hsa; identical to SEQ ID NO: 173473

SEQ ID NO: 480207 - RNA, 64 nt, hsa; identical to SEQ ID NO: 173474

SEQ ID NO: 480208 - RNA, 64 nt, hsa; identical to SEQ ID NO: 173475

SEQ ID NO: 480209 - RNA, 64 nt, hsa; identical to SEQ ID NO: 173476

SEQ ID NO: 480210 - RNA, 64 nt, hsa; identical to SEQ ID NO: 173477

SEQ ID NO: 480211 - RNA, 64 nt, hsa; identical to SEQ ID NO: 173478

SEQ ID NO: 480212 - RNA, 64 nt, hsa; identical to SEQ ID NO: 173479

SEQ ID NO: 480213 - RNA, 64 nt, hsa; identical to SEQ ID NO: 173480

SEQ ID NO: 480214 - RNA, 64 nt, hsa; identical to SEQ ID NO: 173481

SEQ ID NO: 480215 - RNA, 64 nt, hsa; identical to SEQ ID NO: 173482

SEQ ID NO: 480216 - RNA, 64 nt, hsa; identical to SEQ ID NO: 173483

SEQ ID NO: 480217 - RNA, 64 nt, hsa; identical to SEQ ID NO: 173484

SEQ ID NO: 480218 - RNA, 64 nt, hsa; identical to SEQ ID NO: 173485

SEQ ID NO: 480219 - RNA, 64 nt, hsa; identical to SEQ ID NO: 173486

SEQ ID NO: 480220 - RNA, 64 nt, hsa; identical to SEQ ID NO: 173487

SEQ ID NO: 480221 - RNA, 64 nt, hsa; identical to SEQ ID NO: 173488

SEQ ID NO: 480222 - RNA, 64 nt, hsa; identical to SEQ ID NO: 232496

SEQ ID NO: 480223 - RNA, 64 nt, hsa; identical to SEQ ID NO: 232497

SEQ ID NO: 480224 - RNA, 64 nt, hsa; identical to SEQ ID NO: 232498

SEQ ID NO: 480225 - RNA, 64 nt, hsa; identical to SEQ ID NO: 232499

SEQ ID NO: 480226 - RNA, 64 nt, hsa; identical to SEQ ID NO: 232500

SEQ ID NO: 480227 - RNA, 64 nt, hsa; identical to SEQ ID NO: 232501

SEQ ID NO: 480228 - RNA, 64 nt, hsa; identical to SEQ ID NO: 232502

SEQ ID NO: 480229 - RNA, 64 nt, hsa; identical to SEQ ID NO: 232503

SEQ ID NO: 480230 - RNA, 64 nt, hsa; identical to SEQ ID NO: 232504

SEQ ID NO: 480231 - RNA, 64 nt, hsa; identical to SEQ ID NO: 232505

SEQ ID NO: 480232 - RNA, 64 nt, hsa; identical to SEQ ID NO: 232506

SEQ ID NO: 480233 - RNA, 64 nt, hsa; identical to SEQ ID NO: 232507

SEQ ID NO: 480234 - RNA, 64 nt, hsa; identical to SEQ ID NO: 232508

SEQ ID NO: 480235 - RNA, 64 nt, hsa; identical to SEQ ID NO: 232509

SEQ ID NO: 480236 - RNA, 64 nt, hsa; identical to SEQ ID NO: 232510

SEQ ID NO: 480237 - RNA, 64 nt, hsa; identical to SEQ ID NO: 232511

SEQ ID NO: 480238 - RNA, 64 nt, hsa; identical to SEQ ID NO: 232512

SEQ ID NO: 480239 - RNA, 64 nt, hsa; identical to SEQ ID NO: 232513

SEQ ID NO: 480240 - RNA, 64 nt, hsa
ucaucacugaccuggugguggggcugugaccugggcagcucaagacuggugccccuugcugauc

SEQ ID NO: 480241 - RNA, 64 nt, hsa
ggcuaauuagaccccuccccuugugucaacuccggcagcucaagacccccgagcaacauuugua

SEQ ID NO: 480242 - RNA, 64 nt, hsa
ccucaccugguguucagacaccccaugcucuccugcagcucagggcaggugaccccauccccag

SEQ ID NO: 480243 - RNA, 64 nt, hsa
cugccuggucccaguagguaucaggucuuucugugcagcucagggagacccuaaguuaaggggc

SEQ ID NO: 480244 - RNA, 64 nt, hsa
ggauaugcaggcacucaugcuuaccgggacuggggcagcucacuaggauucuauccuuuccaau

SEQ ID NO: 480245 - RNA, 64 nt, hsa
cacuagcccaucuucaaugaccccuuaaucugcagcagcucacaggcugggggugaggaguccc

SEQ ID NO: 480246 - RNA, 64 nt, hsa
ugcauagccucuguccucaggacggaacuugggugcagcucagugggucggaagagaaggcggu

SEQ ID NO: 480247 - RNA, 64 nt, hsa
gggucugucuuugagaugcccaggccagcagaaagcagcucagaaguauuguugcucauggugu

SEQ ID NO: 480248 - RNA, 64 nt, hsa
uugggcaaacccuggcucggagcccagggcagaggcagcucagaguggaggcucuaggcagguu

SEQ ID NO: 480249 - RNA, 64 nt, hsa
ggcaucagcacaggggucccugccccacccuccggcagcucagggaguguuuuccugugaggcc

SEQ ID NO: 480250 - RNA, 64 nt, hsa
cgcgcgcccgcaggguggagaucgcugcaucccugcagcucaacgagacccaagugaagaucug

SEQ ID NO: 480251 - RNA, 64 nt, hsa
aacccaacgcggugcgcaccaacuucacuaccaagcagcucacggaacuggagaaggaguucca

SEQ ID NO: 480252 - RNA, 64 nt, hsa
ugaaagagaaaagaggcucagaaaaguuuagagagcagcucagugucacacugggagcugggca

SEQ ID NO: 480253 - RNA, 64 nt, hsa
cauugaggagaagagacuuacccaggcucacacagcagcucagccuguuccaggcgcuggucag

SEQ ID NO: 480254 - RNA, 64 nt, hsa
cagccgucauggaaaugaugagucagaagauucagcagcucacagcccugggggcagcucaggc

SEQ ID NO: 480255 - RNA, 64 nt, hsa
gagucagaagauucagcagcucacagcccugggggcagcucaggcuacugcuaaggccugagag

SEQ ID NO: 480256 - RNA, 64 nt, hsa
gggccccacggacagucagccugccggccucccugcagcucacggggcagaaccagcacaucug

SEQ ID NO: 480257 - RNA, 64 nt, hsa
cacacuuuauuccuaaaacgugucuuauuuuuaugcagcucauuuuuucuuuaaaggagaaaac

SEQ ID NO: 480258 - RNA, 64 nt, hsa
caccggcuggccuggccccucagggucccugguggcagcucaccucucccuuggauuguccccg

SEQ ID NO: 480259 - RNA, 64 nt, hsa
aagcucagggccuggcucagguggggucacucuggcagcucagagagggugggagugggcccaa

SEQ ID NO: 480260 - RNA, 64 nt, hsa
caugcaagaaguacugccaauacugccaaccagagcagcucacucgagaucuuuguguccagag

SEQ ID NO: 480261 - RNA, 64 nt, hsa
acuucugccuuggccucccaaagugcugaauuaagcagcucaccauccacacggcugaccucau

SEQ ID NO: 480262 - RNA, 64 nt, hsa
gagacuuacaugagugaaaggguugccucaucaagcagcucaguguaaauggggaggcuaggcu

SEQ ID NO: 480263 - RNA, 64 nt, hsa
guuucaucaaauggagugguuuaaaacugaucaagcagcucauaauaaugaauuccugcucugu

SEQ ID NO: 480264 - RNA, 64 nt, hsa
gggugguccugaagacuccggccaagaggcacaagcagcucaagaacaagcuggagaagaacga

SEQ ID NO: 480265 - RNA, 64 nt, hsa
agaguccacucccuuccuggcugugucaccccgagcagcucauccaccauggaggucauuggcc

SEQ ID NO: 480266 - RNA, 64 nt, hsa
uggaauacauggaaaagagcaagcaucugcaggagcagcucaaugaacucaagacagaaaucga

SEQ ID NO: 480267 - RNA, 64 nt, hsa
ucucuggcaauuccaucugguuuugagaaacuuagcagcucacagagcacagagauccugccuu

SEQ ID NO: 480268 - RNA, 64 nt, hsa
auccacacugccggacccuaggcuguucagggaggcagcucauuuccaccccggccccaggaca

SEQ ID NO: 480269 - RNA, 64 nt, hsa
accucccccugccucccugccuguguccgcuuuugcagcucaaugcagccaugacaaggaaaga

SEQ ID NO: 480270 - RNA, 64 nt, hsa; identical to SEQ ID NO: 219214

SEQ ID NO: 480271 - RNA, 64 nt, hsa; identical to SEQ ID NO: 219215

SEQ ID NO: 480272 - RNA, 64 nt, hsa; identical to SEQ ID NO: 219216

SEQ ID NO: 480273 - RNA, 64 nt, hsa; identical to SEQ ID NO: 219217

SEQ ID NO: 480274 - RNA, 64 nt, hsa; identical to SEQ ID NO: 219218

SEQ ID NO: 480275 - RNA, 64 nt, hsa; identical to SEQ ID NO: 219219

SEQ ID NO: 480276 - RNA, 64 nt, hsa; identical to SEQ ID NO: 219220

SEQ ID NO: 480277 - RNA, 64 nt, hsa; identical to SEQ ID NO: 219221

SEQ ID NO: 480278 - RNA, 64 nt, hsa; identical to SEQ ID NO: 219222

SEQ ID NO: 480279 - RNA, 64 nt, hsa; identical to SEQ ID NO: 219223

SEQ ID NO: 480280 - RNA, 64 nt, hsa; identical to SEQ ID NO: 219224

SEQ ID NO: 480281 - RNA, 64 nt, hsa; identical to SEQ ID NO: 219225

SEQ ID NO: 480282 - RNA, 64 nt, hsa; identical to SEQ ID NO: 219226

SEQ ID NO: 480283 - RNA, 64 nt, hsa; identical to SEQ ID NO: 219227

SEQ ID NO: 480284 - RNA, 64 nt, hsa
ucaaacuaugaagaaacagaagucccauuaccagaaagaccaaaauuaaacuccuggaucuuca

SEQ ID NO: 480285 - RNA, 64 nt, hsa
uuguguccuuguuuuuccuuguuuuucucuuuuuaaagaccaacuucccuuugauggcugugug

SEQ ID NO: 480286 - RNA, 64 nt, hsa
augaaguugucauucagggccccucauguagccaaaagaccaagaaaaaucuggcccacagaua

SEQ ID NO: 480287 - RNA, 64 nt, hsa
uauuuuauucagguugaucuguugaauauuugcuaaagaccaguucuuuaagcuaagacaugua

SEQ ID NO: 480288 - RNA, 64 nt, hsa
uuaguaaaaccaugcuguagaauuuuugucuuaaaaagaccacauacccagcacccaugaaaua

SEQ ID NO: 480289 - RNA, 64 nt, hsa
gagaaagaaccucuuuccugaauauugacauguaaaagaccaaaguaauuuuucugaacuucug

SEQ ID NO: 480290 - RNA, 64 nt, hsa
cuuauguaaccauuuuaaacgugguuucuauaggaaagaccaacauuuguuuagcuugcuuggc

SEQ ID NO: 480291 - RNA, 64 nt, hsa
acauggaaaccccaguggaaucagauuuucccucaaagaccaugaugguaucggacuaguuuuc

SEQ ID NO: 480292 - RNA, 64 nt, hsa
ggucaaagccaaggacgucgaugaguacaaacugaaagaccacuaucuggaguuugaggugugu

SEQ ID NO: 480293 - RNA, 64 nt, hsa
aaaguacugaggagaaagcuaacggaacacauccaaagaccaucagucguauuggaaguacuac

SEQ ID NO: 480294 - RNA, 64 nt, hsa
ucccaugccuucaagucagcaucaggcuuagggcaaagaccaggccucugaagcugccucuugu

SEQ ID NO: 480295 - RNA, 64 nt, hsa
ucagcuucuugggacuucaaccaucuucuuucugaaagaccaaaucuaauguaaccaguaacgu

SEQ ID NO: 480296 - RNA, 64 nt, hsa
gaauuuuuuaucuagagaccagcauguucuccccaaagaccaagauauucugccaaaauaucag

SEQ ID NO: 480297 - RNA, 64 nt, hsa
gaauuuuuugucuagagaccagcauguucuccccaaagaccagaauauucuaccuaaauaucaa

SEQ ID NO: 480298 - RNA, 64 nt, hsa
ucuaccuaaauaucaaggccaggauuuucuaccuaaagaccaggacuuuuuaucuagagaccag

SEQ ID NO: 480299 - RNA, 64 nt, hsa
ggauuuucuacccagagaccaagguguucuucccaaagaccaaaauauucuacccauaugucag

SEQ ID NO: 480300 - RNA, 64 nt, hsa
ggauuuucuacccagagaccaagguuaucuuccuaaagaccaaaauauucuacccauaugucag

SEQ ID NO: 480301 - RNA, 64 nt, hsa
gaaaccauguauauucaccacuaggacagguuaaaaagaccauuguauguuuuucuauuucuga

SEQ ID NO: 480302 - RNA, 64 nt, hsa
auauggcuauuagaaauccacauucuuacacaagaaagaccauauuagaaucuaaggaaaacau

SEQ ID NO: 480303 - RNA, 64 nt, hsa
aaacaaagucuccaagaaauaugggacuaugugaaaagaccaaaucuaccucugauugguguac

SEQ ID NO: 480304 - RNA, 64 nt, hsa
ugauaccagccgcugcaaaaucaugccaaaauguaaagaccaucgagacuaggaagaaacugca

SEQ ID NO: 480305 - RNA, 64 nt, hsa
cuuggucauuucugcccucuagccacaucccucuguuccucacuguggggauuacuacagaaag

SEQ ID NO: 480306 - RNA, 64 nt, hsa
guggggauuacuacagaaaggugcucugugccaaguuccucacucauucgcgcuccuguaggcc

SEQ ID NO: 480307 - RNA, 64 nt, hsa
cucuuuguauggcaguauguauauauuguguuaaguuccucaagaaucuccuuaaaaacuuuga

SEQ ID NO: 480308 - RNA, 64 nt, hsa
gaaaagcaggggugcuuuuggaagcaguguuaguguuccucaaaagucggaacaauugccuguu

SEQ ID NO: 480309 - RNA, 64 nt, hsa
aaaggugggaggcggguggguggucuuuuggaggguuccucaugaagugugcuugaggaaagaa

SEQ ID NO: 480310 - RNA, 64 nt, hsa
agucccagugagggagcuagaaacagagcuaucuguuccucauagugccaguguguuuacauuu

SEQ ID NO: 480311 - RNA, 64 nt, hsa
uuuuagguuugguauguguuguuuuauuuccaugguuccucaaguuuccuuuuuaaacauuugc

SEQ ID NO: 480312 - RNA, 64 nt, hsa
aaguuugguuccagccaacgucaucugcucuucaguuccucacugccuucuugggauacuaaga

SEQ ID NO: 480313 - RNA, 64 nt, hsa
aaauguaacaauaaaguuccucaaaauaagaucuguuccucauagcuauacuguguacacauaa

SEQ ID NO: 480314 - RNA, 64 nt, hsa
ugugccucaauuauugcaaaaauguaacaauaaaguuccucaaaauaagaucuguuccucauag

SEQ ID NO: 480315 - RNA, 64 nt, hsa
ucagauauauuggcaguuuuccuuaagcuauuuaguuccucaucuguugcuuuuucauuuugua

SEQ ID NO: 480316 - RNA, 64 nt, hsa
uaccaguuugugauguuuucucuaaaaacuugaaguuccucaggccuguaacuucuggaaaaga

SEQ ID NO: 480317 - RNA, 64 nt, hsa
aguagaacauaaaauugaauaguacccaauuaaaguuccucaguaagaaaaaaaauguguuuuu

SEQ ID NO: 480318 - RNA, 64 nt, hsa
cuccuuguuguuugcaauggcagagcauccuagaguuccucagcuaaccucucauuaugugucu

SEQ ID NO: 480319 - RNA, 64 nt, hsa
uguaugaagaucugagguauaagcucuugcuggaguuccucaaugacuacccaccuuuacgaug

SEQ ID NO: 480320 - RNA, 64 nt, hsa
ugacuacccaccuuuacgaugcacccacagugaaguuccucacacccugcuaccacccuaacgu

SEQ ID NO: 480321 - RNA, 64 nt, hsa
ccugaucaacgucugucucuugggaguagcuagaguuccucaugagcuuguccucaagcgaggc

SEQ ID NO: 480322 - RNA, 64 nt, hsa
gccucuaagcucaugugguuguaagccagguucaguuccucauugguugucagaccgaaggugu

SEQ ID NO: 480323 - RNA, 64 nt, hsa
uacaaaugugaagaauguggcaagccuuuuagcuguuccucaauccuuacuaaacauucaugua

SEQ ID NO: 480324 - RNA, 64 nt, hsa
uacaaaugcgaagaaugugauaaagacuucaacuguuccucacaccuuacuacucauaaaagaa

SEQ ID NO: 480325 - RNA, 64 nt, hsa
cccaccacuuagaccacgcccaccuccugaccgcguuccucagccuccucuccuaggucccucc

SEQ ID NO: 480326 - RNA, 64 nt, hsa
uccaccuagaaccaggcugcccucuacugugcucguuccucaagcauuuauuaagcaccuacug

SEQ ID NO: 480327 - RNA, 64 nt, hsa
gcuuuucccuggagaguggggagaugagaccaguguuccucacacuggagggugauagacccca

SEQ ID NO: 480328 - RNA, 64 nt, hsa
ggagcucaguuuccucucuucucacccuccaccuguuccucauuugccauuauucaccuugucc

SEQ ID NO: 480329 - RNA, 64 nt, hsa; identical to SEQ ID NO: 132195

SEQ ID NO: 480330 - RNA, 64 nt, hsa; identical to SEQ ID NO: 132196

SEQ ID NO: 480331 - RNA, 64 nt, hsa; identical to SEQ ID NO: 132197

SEQ ID NO: 480332 - RNA, 64 nt, hsa; identical to SEQ ID NO: 132198

SEQ ID NO: 480333 - RNA, 64 nt, hsa; identical to SEQ ID NO: 132199

SEQ ID NO: 480334 - RNA, 64 nt, hsa; identical to SEQ ID NO: 132200

SEQ ID NO: 480335 - RNA, 64 nt, hsa; identical to SEQ ID NO: 132201

SEQ ID NO: 480336 - RNA, 64 nt, hsa; identical to SEQ ID NO: 132202

SEQ ID NO: 480337 - RNA, 64 nt, hsa; identical to SEQ ID NO: 132203

SEQ ID NO: 480338 - RNA, 64 nt, hsa; identical to SEQ ID NO: 132204

SEQ ID NO: 480339 - RNA, 64 nt, hsa; identical to SEQ ID NO: 132205

SEQ ID NO: 480340 - RNA, 64 nt, hsa; identical to SEQ ID NO: 132206

SEQ ID NO: 480341 - RNA, 64 nt, hsa; identical to SEQ ID NO: 132207

SEQ ID NO: 480342 - RNA, 64 nt, hsa; identical to SEQ ID NO: 132208

SEQ ID NO: 480343 - RNA, 64 nt, hsa; identical to SEQ ID NO: 132209

SEQ ID NO: 480344 - RNA, 64 nt, hsa; identical to SEQ ID NO: 132210

SEQ ID NO: 480345 - RNA, 64 nt, hsa; identical to SEQ ID NO: 132211

SEQ ID NO: 480346 - RNA, 64 nt, hsa; identical to SEQ ID NO: 132212

SEQ ID NO: 480347 - RNA, 64 nt, hsa; identical to SEQ ID NO: 132213

SEQ ID NO: 480348 - RNA, 64 nt, hsa; identical to SEQ ID NO: 132214

SEQ ID NO: 480349 - RNA, 64 nt, hsa; identical to SEQ ID NO: 72787

SEQ ID NO: 480350 - RNA, 64 nt, hsa; identical to SEQ ID NO: 72788

SEQ ID NO: 480351 - RNA, 64 nt, hsa; identical to SEQ ID NO: 72789

SEQ ID NO: 480352 - RNA, 64 nt, hsa; identical to SEQ ID NO: 72790

SEQ ID NO: 480353 - RNA, 64 nt, hsa; identical to SEQ ID NO: 72791

SEQ ID NO: 480354 - RNA, 64 nt, hsa; identical to SEQ ID NO: 72792

SEQ ID NO: 480355 - RNA, 64 nt, hsa; identical to SEQ ID NO: 72793

SEQ ID NO: 480356 - RNA, 64 nt, hsa; identical to SEQ ID NO: 72794

SEQ ID NO: 480357 - RNA, 64 nt, hsa; identical to SEQ ID NO: 72795

SEQ ID NO: 480358 - RNA, 64 nt, hsa; identical to SEQ ID NO: 72796

SEQ ID NO: 480359 - RNA, 64 nt, hsa; identical to SEQ ID NO: 72797

SEQ ID NO: 480360 - RNA, 64 nt, hsa; identical to SEQ ID NO: 72798

SEQ ID NO: 480361 - RNA, 64 nt, hsa; identical to SEQ ID NO: 72799

SEQ ID NO: 480362 - RNA, 64 nt, hsa; identical to SEQ ID NO: 72800

SEQ ID NO: 480363 - RNA, 64 nt, hsa; identical to SEQ ID NO: 72801

SEQ ID NO: 480364 - RNA, 64 nt, hsa; identical to SEQ ID NO: 72802

SEQ ID NO: 480365 - RNA, 64 nt, hsa; identical to SEQ ID NO: 72803

SEQ ID NO: 480366 - RNA, 64 nt, hsa; identical to SEQ ID NO: 72804

SEQ ID NO: 480367 - RNA, 64 nt, hsa; identical to SEQ ID NO: 72805

SEQ ID NO: 480368 - RNA, 64 nt, hsa; identical to SEQ ID NO: 72806

SEQ ID NO: 480369 - RNA, 64 nt, hsa; identical to SEQ ID NO: 72807

SEQ ID NO: 480370 - RNA, 64 nt, hsa; identical to SEQ ID NO: 72808

SEQ ID NO: 480371 - RNA, 64 nt, hsa; identical to SEQ ID NO: 72809

SEQ ID NO: 480372 - RNA, 64 nt, hsa; identical to SEQ ID NO: 72810

SEQ ID NO: 480373 - RNA, 64 nt, hsa; identical to SEQ ID NO: 72811

SEQ ID NO: 480374 - RNA, 64 nt, hsa; identical to SEQ ID NO: 72812

SEQ ID NO: 480375 - RNA, 64 nt, hsa; identical to SEQ ID NO: 72813

SEQ ID NO: 480376 - RNA, 64 nt, hsa; identical to SEQ ID NO: 72814

SEQ ID NO: 480377 - RNA, 64 nt, hsa; identical to SEQ ID NO: 72815

SEQ ID NO: 480378 - RNA, 64 nt, hsa; identical to SEQ ID NO: 72816

SEQ ID NO: 480379 - RNA, 64 nt, hsa; identical to SEQ ID NO: 72817

SEQ ID NO: 480380 - RNA, 64 nt, hsa; identical to SEQ ID NO: 72818

SEQ ID NO: 480381 - RNA, 64 nt, hsa; identical to SEQ ID NO: 72819

SEQ ID NO: 480382 - RNA, 64 nt, hsa; identical to SEQ ID NO: 72820

SEQ ID NO: 480383 - RNA, 64 nt, hsa; identical to SEQ ID NO: 72821

SEQ ID NO: 480384 - RNA, 64 nt, hsa; identical to SEQ ID NO: 72822

SEQ ID NO: 480385 - RNA, 64 nt, hsa; identical to SEQ ID NO: 72823

SEQ ID NO: 480386 - RNA, 64 nt, hsa; identical to SEQ ID NO: 72824

SEQ ID NO: 480387 - RNA, 64 nt, hsa; identical to SEQ ID NO: 72825

SEQ ID NO: 480388 - RNA, 64 nt, hsa; identical to SEQ ID NO: 72826

SEQ ID NO: 480389 - RNA, 64 nt, hsa; identical to SEQ ID NO: 72827

SEQ ID NO: 480390 - RNA, 64 nt, hsa; identical to SEQ ID NO: 72828

SEQ ID NO: 480391 - RNA, 64 nt, hsa; identical to SEQ ID NO: 72829

SEQ ID NO: 480392 - RNA, 64 nt, hsa; identical to SEQ ID NO: 72830

SEQ ID NO: 480393 - RNA, 64 nt, hsa; identical to SEQ ID NO: 72831

SEQ ID NO: 480394 - RNA, 64 nt, hsa; identical to SEQ ID NO: 72832

SEQ ID NO: 480395 - RNA, 64 nt, hsa; identical to SEQ ID NO: 72833

SEQ ID NO: 480396 - RNA, 64 nt, hsa; identical to SEQ ID NO: 72834

SEQ ID NO: 480397 - RNA, 64 nt, hsa; identical to SEQ ID NO: 72835

SEQ ID NO: 480398 - RNA, 64 nt, hsa; identical to SEQ ID NO: 72836

SEQ ID NO: 480399 - RNA, 64 nt, hsa; identical to SEQ ID NO: 72837

SEQ ID NO: 480400 - RNA, 64 nt, hsa; identical to SEQ ID NO: 72838

SEQ ID NO: 480401 - RNA, 64 nt, hsa; identical to SEQ ID NO: 72839

SEQ ID NO: 480402 - RNA, 64 nt, hsa; identical to SEQ ID NO: 72840

SEQ ID NO: 480403 - RNA, 64 nt, hsa; identical to SEQ ID NO: 72841

SEQ ID NO: 480404 - RNA, 64 nt, hsa
aaaggcagcauauuuccaauuccaacauuacuguuucuaccaagucccauuagaagagcuguuc

SEQ ID NO: 480405 - RNA, 64 nt, hsa
agaagagcuguucuuugaagaaucauauucaaccuucuaccaaaaugcuuuaaguucuauggaa

SEQ ID NO: 480406 - RNA, 64 nt, hsa
gauacauuggucaaacacucaaaccuagaucauuuucuaccaacuaugguugccucaauauaac

SEQ ID NO: 480407 - RNA, 64 nt, hsa
auggguuuuauggauuucuuuguuauaauauauuuucuaccauuccaauaggagauacauuggu

SEQ ID NO: 480408 - RNA, 64 nt, hsa
ccauaugcaccucuagaaccuaaccagggcuuccuucuaccagcugugggcgggcuuggucugg

SEQ ID NO: 480409 - RNA, 64 nt, hsa
gcccagauuuugccacuggguauggcagaucauuuucuaccauggccugcugcucuuguagugg

SEQ ID NO: 480410 - RNA, 64 nt, hsa
aaauuaguuuaucauuauauucuaaucuugaauauucuaccauauuuaaaaauaucucaagguu

SEQ ID NO: 480411 - RNA, 64 nt, hsa
aagguuucuguucauuaugaaacaucaauauguuuucuaccauuugugaagaaaugaauuuucc

SEQ ID NO: 480412 - RNA, 64 nt, hsa; identical to SEQ ID NO: 357461

SEQ ID NO: 480413 - RNA, 64 nt, hsa; identical to SEQ ID NO: 357462

SEQ ID NO: 480414 - RNA, 64 nt, hsa; identical to SEQ ID NO: 357463

SEQ ID NO: 480415 - RNA, 64 nt, hsa; identical to SEQ ID NO: 357464

SEQ ID NO: 480416 - RNA, 64 nt, hsa; identical to SEQ ID NO: 357465

SEQ ID NO: 480417 - RNA, 64 nt, hsa; identical to SEQ ID NO: 357466

SEQ ID NO: 480418 - RNA, 64 nt, hsa; identical to SEQ ID NO: 357467

SEQ ID NO: 480419 - RNA, 64 nt, hsa; identical to SEQ ID NO: 357468

SEQ ID NO: 480420 - RNA, 64 nt, hsa; identical to SEQ ID NO: 357469

SEQ ID NO: 480421 - RNA, 64 nt, hsa; identical to SEQ ID NO: 357470

SEQ ID NO: 480422 - RNA, 64 nt, hsa; identical to SEQ ID NO: 357471

SEQ ID NO: 480423 - RNA, 64 nt, hsa; identical to SEQ ID NO: 357472

SEQ ID NO: 480424 - RNA, 64 nt, hsa; identical to SEQ ID NO: 357473

SEQ ID NO: 480425 - RNA, 64 nt, hsa; identical to SEQ ID NO: 357474

SEQ ID NO: 480426 - RNA, 64 nt, hsa; identical to SEQ ID NO: 357475

SEQ ID NO: 480427 - RNA, 64 nt, hsa; identical to SEQ ID NO: 357476

SEQ ID NO: 480428 - RNA, 64 nt, hsa; identical to SEQ ID NO: 357477

SEQ ID NO: 480429 - RNA, 64 nt, hsa; identical to SEQ ID NO: 357478

SEQ ID NO: 480430 - RNA, 64 nt, hsa; identical to SEQ ID NO: 357479

SEQ ID NO: 480431 - RNA, 64 nt, hsa; identical to SEQ ID NO: 357480

SEQ ID NO: 480432 - RNA, 64 nt, hsa; identical to SEQ ID NO: 357481

SEQ ID NO: 480433 - RNA, 64 nt, hsa; identical to SEQ ID NO: 357482

SEQ ID NO: 480434 - RNA, 64 nt, hsa; identical to SEQ ID NO: 357483

SEQ ID NO: 480435 - RNA, 64 nt, hsa; identical to SEQ ID NO: 357484

SEQ ID NO: 480436 - RNA, 64 nt, hsa; identical to SEQ ID NO: 357485

SEQ ID NO: 480437 - RNA, 64 nt, hsa; identical to SEQ ID NO: 357486

SEQ ID NO: 480438 - RNA, 64 nt, hsa; identical to SEQ ID NO: 357487

SEQ ID NO: 480439 - RNA, 64 nt, hsa; identical to SEQ ID NO: 357488

SEQ ID NO: 480440 - RNA, 64 nt, hsa; identical to SEQ ID NO: 357489

SEQ ID NO: 480441 - RNA, 64 nt, hsa; identical to SEQ ID NO: 357490

SEQ ID NO: 480442 - RNA, 64 nt, hsa; identical to SEQ ID NO: 357491

SEQ ID NO: 480443 - RNA, 64 nt, hsa; identical to SEQ ID NO: 357492

SEQ ID NO: 480444 - RNA, 64 nt, hsa; identical to SEQ ID NO: 357493

SEQ ID NO: 480445 - RNA, 64 nt, hsa; identical to SEQ ID NO: 357494

SEQ ID NO: 480446 - RNA, 64 nt, hsa; identical to SEQ ID NO: 357495

SEQ ID NO: 480447 - RNA, 64 nt, hsa; identical to SEQ ID NO: 357496

SEQ ID NO: 480448 - RNA, 64 nt, hsa; identical to SEQ ID NO: 357497

SEQ ID NO: 480449 - RNA, 64 nt, hsa; identical to SEQ ID NO: 357498

SEQ ID NO: 480450 - RNA, 64 nt, hsa; identical to SEQ ID NO: 357499

SEQ ID NO: 480451 - RNA, 64 nt, hsa; identical to SEQ ID NO: 357500

SEQ ID NO: 480452 - RNA, 64 nt, hsa; identical to SEQ ID NO: 357501

SEQ ID NO: 480453 - RNA, 64 nt, hsa; identical to SEQ ID NO: 357502

SEQ ID NO: 480454 - RNA, 64 nt, hsa; identical to SEQ ID NO: 357503

SEQ ID NO: 480455 - RNA, 64 nt, hsa; identical to SEQ ID NO: 357504

SEQ ID NO: 480456 - RNA, 64 nt, hsa; identical to SEQ ID NO: 357505

SEQ ID NO: 480457 - RNA, 64 nt, hsa; identical to SEQ ID NO: 357506

SEQ ID NO: 480458 - RNA, 64 nt, hsa; identical to SEQ ID NO: 357507

SEQ ID NO: 480459 - RNA, 64 nt, hsa; identical to SEQ ID NO: 357508

SEQ ID NO: 480460 - RNA, 64 nt, hsa; identical to SEQ ID NO: 357509

SEQ ID NO: 480461 - RNA, 64 nt, hsa; identical to SEQ ID NO: 357510

SEQ ID NO: 480462 - RNA, 64 nt, hsa; identical to SEQ ID NO: 357511

SEQ ID NO: 480463 - RNA, 64 nt, hsa; identical to SEQ ID NO: 357512

SEQ ID NO: 480464 - RNA, 64 nt, hsa; identical to SEQ ID NO: 357513

SEQ ID NO: 480465 - RNA, 64 nt, hsa; identical to SEQ ID NO: 357514

SEQ ID NO: 480466 - RNA, 64 nt, hsa; identical to SEQ ID NO: 357515

SEQ ID NO: 480467 - RNA, 64 nt, hsa; identical to SEQ ID NO: 357516

SEQ ID NO: 480468 - RNA, 64 nt, hsa; identical to SEQ ID NO: 357517

SEQ ID NO: 480469 - RNA, 64 nt, hsa; identical to SEQ ID NO: 357518

SEQ ID NO: 480470 - RNA, 64 nt, hsa; identical to SEQ ID NO: 357519

SEQ ID NO: 480471 - RNA, 64 nt, hsa; identical to SEQ ID NO: 357520

SEQ ID NO: 480472 - RNA, 64 nt, hsa; identical to SEQ ID NO: 357521

SEQ ID NO: 480473 - RNA, 64 nt, hsa; identical to SEQ ID NO: 357522

SEQ ID NO: 480474 - RNA, 64 nt, hsa; identical to SEQ ID NO: 357523

SEQ ID NO: 480475 - RNA, 64 nt, hsa; identical to SEQ ID NO: 357524

SEQ ID NO: 480476 - RNA, 64 nt, hsa; identical to SEQ ID NO: 357525

SEQ ID NO: 480477 - RNA, 64 nt, hsa; identical to SEQ ID NO: 357526

SEQ ID NO: 480478 - RNA, 64 nt, hsa; identical to SEQ ID NO: 357527

SEQ ID NO: 480479 - RNA, 64 nt, hsa; identical to SEQ ID NO: 357528

SEQ ID NO: 480480 - RNA, 64 nt, hsa; identical to SEQ ID NO: 357529

SEQ ID NO: 480481 - RNA, 64 nt, hsa; identical to SEQ ID NO: 357530

SEQ ID NO: 480482 - RNA, 64 nt, hsa; identical to SEQ ID NO: 357531

SEQ ID NO: 480483 - RNA, 64 nt, hsa; identical to SEQ ID NO: 357532

SEQ ID NO: 480484 - RNA, 64 nt, hsa; identical to SEQ ID NO: 357533

SEQ ID NO: 480485 - RNA, 64 nt, hsa; identical to SEQ ID NO: 357534

SEQ ID NO: 480486 - RNA, 64 nt, hsa; identical to SEQ ID NO: 357535

SEQ ID NO: 480487 - RNA, 64 nt, hsa; identical to SEQ ID NO: 357536

SEQ ID NO: 480488 - RNA, 64 nt, hsa; identical to SEQ ID NO: 357537

SEQ ID NO: 480489 - RNA, 64 nt, hsa; identical to SEQ ID NO: 357538

SEQ ID NO: 480490 - RNA, 64 nt, hsa; identical to SEQ ID NO: 357539

SEQ ID NO: 480491 - RNA, 64 nt, hsa; identical to SEQ ID NO: 357540

SEQ ID NO: 480492 - RNA, 64 nt, hsa; identical to SEQ ID NO: 357541

SEQ ID NO: 480493 - RNA, 64 nt, hsa; identical to SEQ ID NO: 357542

SEQ ID NO: 480494 - RNA, 64 nt, hsa; identical to SEQ ID NO: 357543

SEQ ID NO: 480495 - RNA, 64 nt, hsa; identical to SEQ ID NO: 357544

SEQ ID NO: 480496 - RNA, 64 nt, hsa; identical to SEQ ID NO: 357545

SEQ ID NO: 480497 - RNA, 64 nt, hsa; identical to SEQ ID NO: 357546

SEQ ID NO: 480498 - RNA, 64 nt, hsa; identical to SEQ ID NO: 357547

SEQ ID NO: 480499 - RNA, 64 nt, hsa; identical to SEQ ID NO: 357548

SEQ ID NO: 480500 - RNA, 64 nt, hsa; identical to SEQ ID NO: 357549

SEQ ID NO: 480501 - RNA, 64 nt, hsa; identical to SEQ ID NO: 357550

SEQ ID NO: 480502 - RNA, 64 nt, hsa; identical to SEQ ID NO: 357551

SEQ ID NO: 480503 - RNA, 64 nt, hsa; identical to SEQ ID NO: 357552

SEQ ID NO: 480504 - RNA, 64 nt, hsa; identical to SEQ ID NO: 357553

SEQ ID NO: 480505 - RNA, 64 nt, hsa; identical to SEQ ID NO: 357554

SEQ ID NO: 480506 - RNA, 64 nt, hsa; identical to SEQ ID NO: 357555

SEQ ID NO: 480507 - RNA, 64 nt, hsa; identical to SEQ ID NO: 357556

SEQ ID NO: 480508 - RNA, 64 nt, hsa; identical to SEQ ID NO: 357557

SEQ ID NO: 480509 - RNA, 64 nt, hsa; identical to SEQ ID NO: 357558

SEQ ID NO: 480510 - RNA, 64 nt, hsa; identical to SEQ ID NO: 357559

SEQ ID NO: 480511 - RNA, 64 nt, hsa; identical to SEQ ID NO: 357560

SEQ ID NO: 480512 - RNA, 64 nt, hsa; identical to SEQ ID NO: 357561

SEQ ID NO: 480513 - RNA, 64 nt, hsa; identical to SEQ ID NO: 357562

SEQ ID NO: 480514 - RNA, 64 nt, hsa; identical to SEQ ID NO: 357563

SEQ ID NO: 480515 - RNA, 64 nt, hsa; identical to SEQ ID NO: 357564

SEQ ID NO: 480516 - RNA, 64 nt, hsa; identical to SEQ ID NO: 357565

SEQ ID NO: 480517 - RNA, 64 nt, hsa; identical to SEQ ID NO: 357566

SEQ ID NO: 480518 - RNA, 64 nt, hsa; identical to SEQ ID NO: 357567

SEQ ID NO: 480519 - RNA, 64 nt, hsa; identical to SEQ ID NO: 357568

SEQ ID NO: 480520 - RNA, 64 nt, hsa; identical to SEQ ID NO: 357569

SEQ ID NO: 480521 - RNA, 64 nt, hsa; identical to SEQ ID NO: 357570

SEQ ID NO: 480522 - RNA, 64 nt, hsa; identical to SEQ ID NO: 357571

SEQ ID NO: 480523 - RNA, 64 nt, hsa; identical to SEQ ID NO: 357572

SEQ ID NO: 480524 - RNA, 64 nt, hsa; identical to SEQ ID NO: 357573

SEQ ID NO: 480525 - RNA, 64 nt, hsa; identical to SEQ ID NO: 357574

SEQ ID NO: 480526 - RNA, 64 nt, hsa; identical to SEQ ID NO: 357575

SEQ ID NO: 480527 - RNA, 64 nt, hsa; identical to SEQ ID NO: 357576

SEQ ID NO: 480528 - RNA, 64 nt, hsa; identical to SEQ ID NO: 357577

SEQ ID NO: 480529 - RNA, 64 nt, hsa; identical to SEQ ID NO: 357578

SEQ ID NO: 480530 - RNA, 64 nt, hsa; identical to SEQ ID NO: 357579

SEQ ID NO: 480531 - RNA, 64 nt, hsa; identical to SEQ ID NO: 357580

SEQ ID NO: 480532 - RNA, 64 nt, hsa; identical to SEQ ID NO: 357581

SEQ ID NO: 480533 - RNA, 64 nt, hsa; identical to SEQ ID NO: 357582

SEQ ID NO: 480534 - RNA, 64 nt, hsa; identical to SEQ ID NO: 357583

SEQ ID NO: 480535 - RNA, 64 nt, hsa; identical to SEQ ID NO: 357584

SEQ ID NO: 480536 - RNA, 64 nt, hsa; identical to SEQ ID NO: 357585

SEQ ID NO: 480537 - RNA, 64 nt, hsa; identical to SEQ ID NO: 357586

SEQ ID NO: 480538 - RNA, 64 nt, hsa; identical to SEQ ID NO: 357587

SEQ ID NO: 480539 - RNA, 64 nt, hsa; identical to SEQ ID NO: 357588

SEQ ID NO: 480540 - RNA, 64 nt, hsa; identical to SEQ ID NO: 357589

SEQ ID NO: 480541 - RNA, 64 nt, hsa; identical to SEQ ID NO: 357590

SEQ ID NO: 480542 - RNA, 64 nt, hsa; identical to SEQ ID NO: 357591

SEQ ID NO: 480543 - RNA, 64 nt, hsa; identical to SEQ ID NO: 357592

SEQ ID NO: 480544 - RNA, 64 nt, hsa; identical to SEQ ID NO: 357593

SEQ ID NO: 480545 - RNA, 64 nt, hsa; identical to SEQ ID NO: 357594

SEQ ID NO: 480546 - RNA, 64 nt, hsa; identical to SEQ ID NO: 357595

SEQ ID NO: 480547 - RNA, 64 nt, hsa; identical to SEQ ID NO: 357596

SEQ ID NO: 480548 - RNA, 64 nt, hsa; identical to SEQ ID NO: 357597

SEQ ID NO: 480549 - RNA, 64 nt, hsa; identical to SEQ ID NO: 357598

SEQ ID NO: 480550 - RNA, 64 nt, hsa; identical to SEQ ID NO: 357599

SEQ ID NO: 480551 - RNA, 64 nt, hsa; identical to SEQ ID NO: 357600

SEQ ID NO: 480552 - RNA, 64 nt, hsa; identical to SEQ ID NO: 357601

SEQ ID NO: 480553 - RNA, 64 nt, hsa; identical to SEQ ID NO: 357602

SEQ ID NO: 480554 - RNA, 64 nt, hsa; identical to SEQ ID NO: 357603

SEQ ID NO: 480555 - RNA, 64 nt, hsa; identical to SEQ ID NO: 357604

SEQ ID NO: 480556 - RNA, 64 nt, hsa; identical to SEQ ID NO: 357605

SEQ ID NO: 480557 - RNA, 64 nt, hsa; identical to SEQ ID NO: 357606

SEQ ID NO: 480558 - RNA, 64 nt, hsa; identical to SEQ ID NO: 357607

SEQ ID NO: 480559 - RNA, 64 nt, hsa; identical to SEQ ID NO: 357608

SEQ ID NO: 480560 - RNA, 64 nt, hsa; identical to SEQ ID NO: 357609

SEQ ID NO: 480561 - RNA, 64 nt, hsa; identical to SEQ ID NO: 357610

SEQ ID NO: 480562 - RNA, 64 nt, hsa; identical to SEQ ID NO: 357611

SEQ ID NO: 480563 - RNA, 64 nt, hsa; identical to SEQ ID NO: 357612

SEQ ID NO: 480564 - RNA, 64 nt, hsa; identical to SEQ ID NO: 357613

SEQ ID NO: 480565 - RNA, 64 nt, hsa; identical to SEQ ID NO: 357614

SEQ ID NO: 480566 - RNA, 64 nt, hsa; identical to SEQ ID NO: 357615

SEQ ID NO: 480567 - RNA, 64 nt, hsa; identical to SEQ ID NO: 357616

SEQ ID NO: 480568 - RNA, 64 nt, hsa; identical to SEQ ID NO: 357617

SEQ ID NO: 480569 - RNA, 64 nt, hsa; identical to SEQ ID NO: 357618

SEQ ID NO: 480570 - RNA, 64 nt, hsa; identical to SEQ ID NO: 357619

SEQ ID NO: 480571 - RNA, 64 nt, hsa
cuaaggacccaaauuucccugggggcauccugcuuccugaaagcuguuggauuucagugauuuu

SEQ ID NO: 480572 - RNA, 64 nt, hsa
uuccuccccuuuugcccccguggggcucccggcauccugaaagccagcaaagccuccagcaucu

SEQ ID NO: 480573 - RNA, 64 nt, hsa
uguuuuuagaguccugaagucuggaggcuagacuuccugaaagcaagucaagaauauagagcac

SEQ ID NO: 480574 - RNA, 64 nt, hsa
aauuaguauaacauuuacucugaauuugaagauuuccugaaacaaaguuuguacaagaagccca

SEQ ID NO: 480575 - RNA, 64 nt, hsa
gggagaauauucccuaagcaacuggcaauaguauuccugaaauaccuagaaauuucuaucugaa

SEQ ID NO: 480576 - RNA, 64 nt, hsa
cuugcuauauaguaguaugcaguauuuauauuauuccugaaaauaaaaugaggggagaauauuc

SEQ ID NO: 480577 - RNA, 64 nt, hsa
agaugaccaagccagaauauggaauguucauguauccugaaauggguuccugcaugugguuucc

SEQ ID NO: 480578 - RNA, 64 nt, hsa
gaggcauacagaaaauggaaauaguauuucgcuguccugaaacuuucagugaaagagaucaccc

SEQ ID NO: 480579 - RNA, 64 nt, hsa
aaggaagucuaaauauucagaaucuuuguuaagguccugaaaguaacucauaaucuauaaacaa

SEQ ID NO: 480580 - RNA, 64 nt, hsa
aaaauaauguaauuguaauuuugaaaugugguuuuccugaaaucaagucaucuauaguugauau

SEQ ID NO: 480581 - RNA, 64 nt, hsa
cccagguagccuguuucuaacacaacugucauaauccugaaauccaaaauugcacuguguuuga

SEQ ID NO: 480582 - RNA, 64 nt, hsa
augucacccacgaaagaacuuuauucccuuauauuccugaaaagaaaucagaauuaacauuuuu

SEQ ID NO: 480583 - RNA, 64 nt, hsa
aucccgagaaguugugacaucuaucccuuccccuuccugaaaguuuuaaagaaagcaggagcug

SEQ ID NO: 480584 - RNA, 64 nt, hsa
aaggaaaagaacaccuaucucuccaacucucugauccugaaauaucuauuccaaaggaaaauca

SEQ ID NO: 480585 - RNA, 64 nt, hsa
ccaaaaagagauugcucucagauuuuccugaaaauccugaaaaccaggauuuuccaaucucuac

SEQ ID NO: 480586 - RNA, 64 nt, hsa
ggagagcuuccaaaaagagauugcucucagauuuuccugaaaauccugaaaaccaggauuuucc

SEQ ID NO: 480587 - RNA, 64 nt, hsa
guuucuuaggaaauagaauguuaugcuuuggggcuccugaaacaccucguuuugaaggugaauc

SEQ ID NO: 480588 - RNA, 64 nt, hsa
gucuuauauauacucuacugaauucuaacugaucuccugaaaauguugaucuacguguuguguc

SEQ ID NO: 480589 - RNA, 64 nt, hsa
aggcuuuuuccccgccuuugguuguuaacggcauuccugaaagccacauguguuuauucauugg

SEQ ID NO: 480590 - RNA, 64 nt, hsa
uugccaguccuugaagaauggguucugugucuaauccugaaacaaagaaaacuacaagcuggag

SEQ ID NO: 480591 - RNA, 64 nt, hsa
aaacuuagaaagggaaggaaaucccaucagugaauccugaaacugguuuuaagugcuuuccuuc

SEQ ID NO: 480592 - RNA, 64 nt, hsa
uggcaguggcagagaauccaaacucaacaagugcuccugaaagaaacgcuagaagccuaagaac

SEQ ID NO: 480593 - RNA, 64 nt, hsa
uguccuugcaguuagcccccaugucuuauguguguccugaaaaaauaagagccugcccaagacu

SEQ ID NO: 480594 - RNA, 64 nt, hsa
accugaugaguagauaaguggagcucaugguauuuccugaaagaugcuaaucuauuugccaaac

SEQ ID NO: 480595 - RNA, 64 nt, hsa
uaugcguuccaucuccaauccaggcagugaggaauccugaaacaccaggagaggcgucagaagu

SEQ ID NO: 480596 - RNA, 64 nt, hsa
uucuuguccucagugccacccggccucccgucuuuccugaaaccccucgccagauuuugcacuc

SEQ ID NO: 480597 - RNA, 64 nt, hsa
ucaguugugaauccuaugguguuauuuauuuuguuccugaaaugggauuuagugcaaaaaguuu

SEQ ID NO: 480598 - RNA, 64 nt, hsa
cuguuaacuucccaccaccaucaaucaucugauuuccugaaaguaauuaauugugcauuuaaua

SEQ ID NO: 480599 - RNA, 61 nt, hsa
gcaaagugaaccgccccugagguggggcuucuccugaaaucuacaggccucagggugggag

SEQ ID NO: 480600 - RNA, 64 nt, hsa
uacaaggaucagauucuugcugugacccaagaacuccugaaaucauauagaaaggcuggggugg

SEQ ID NO: 480601 - RNA, 64 nt, hsa
uguugguucaacgugguuuccuuguacuugauccuccugaaaugagagauuuuccugagaugac

SEQ ID NO: 480602 - RNA, 64 nt, hsa
accauuauucauuuauuggcuuaaguaugcuuucuccugaaaacuuuagcauugggugcaaaua

SEQ ID NO: 480603 - RNA, 64 nt, hsa
cuuccauuuccaucguccuuucugaaggaacagcuccugaaaccagucucccugggcugagaca

SEQ ID NO: 480604 - RNA, 64 nt, hsa
gacagaaccugcagcucuguggaaagaggcaaaguccugaaaaggcaaaggguugucacuuagg

SEQ ID NO: 480605 - RNA, 64 nt, hsa
ccucaguggggaggcuuccuuaccaagaaugaguuccugaaacccagggccagagacaaggaca

SEQ ID NO: 480606 - RNA, 64 nt, hsa
gagccacacuggggccccccccccguggaaccguuccugaaaggccaccaggcgcccaguguag

SEQ ID NO: 480607 - RNA, 64 nt, hsa
auaaacaaagucuuccuggaaguaauuguaagcauccugaaauaaaaaagcaagaauaugaaga

SEQ ID NO: 480608 - RNA, 64 nt, hsa
uuaucaagaaagcagauuuggcaguucaaaagacuccugaaaugauaaaucagggaacuaacca

SEQ ID NO: 480609 - RNA, 64 nt, hsa
gaguccccuccccggccaccauccugcgugaauauccugaaauucaugggcuuccucgggggcc

SEQ ID NO: 480610 - RNA, 64 nt, hsa
agcuuguggaaggauuuagcuuaacaacugucacuccugaaaagcaaucucuguuccaucaagg

SEQ ID NO: 480611 - RNA, 64 nt, hsa
cucagccucucagacuugaugaugaaguaggugguccugaaaguuaacaggagggcuggggucc

SEQ ID NO: 480612 - RNA, 64 nt, hsa
uugaauuucaaacuaaauuguauuuucagagcuauccugaaacugaacagcugaaacuuuaaaa

SEQ ID NO: 480613 - RNA, 64 nt, hsa
cuuacuuaaugucuucuuuucccuacucuaaugcauuucuaacucacuuuggagcuuugguuuu

SEQ ID NO: 480614 - RNA, 64 nt, hsa
cuuagaaaugucaauggggcaggaagaaaacacaauuucuaacugccuguuuuuguauaauuua

SEQ ID NO: 480615 - RNA, 64 nt, hsa
guugaaaucuaaagcaaauuugcaauuucuuaagauuucuaaaauuuaccagaacaguuuagcc

SEQ ID NO: 480616 - RNA, 64 nt, hsa
gaauguagcuuaaugauuuucuguuucccauaccauuucuaaucuuuuguguaauuuucucuua

SEQ ID NO: 480617 - RNA, 64 nt, hsa
uugaaauaguauugauuuagaaaaaguauauugcauuucuaaaaaacaucuaccaagguuacuc

SEQ ID NO: 480618 - RNA, 64 nt, hsa
cugcuucauaugcuuuuuuuaauuucacuauuccauuucuaaauuaaaguuaugcuaaauugag

SEQ ID NO: 480619 - RNA, 64 nt, hsa
agcaaaacuuguaaacagaguaaaaaucuuuaauauuucuaaagacauacuguuuaucugcuuc

SEQ ID NO: 480620 - RNA, 64 nt, hsa
uaguugcuguaaaugauaucuuauguuuuauuacauuucuaauaggauaugguguuggugaaau

SEQ ID NO: 480621 - RNA, 64 nt, hsa
augaaugugguucuguacagugauguauguggagauuucuaaaauauucuaugugugauuucug

SEQ ID NO: 480622 - RNA, 64 nt, hsa
aaaacaauauuuauagggcuuaaagcccauuuucauuucuaaucuaaauuaugugugccuaucu

SEQ ID NO: 480623 - RNA, 64 nt, hsa
agccagcccugauaaugaaggaugaacuagugugauuucuaauccucccuuuuuugauuuaguu

SEQ ID NO: 480624 - RNA, 64 nt, hsa
aauaacuuccugauuggaguguguaagcugagcgauuucuaauaaaauuuuaguuguacacuuu

SEQ ID NO: 480625 - RNA, 64 nt, hsa
aaauuggauuuuacauguacauuugaaugccagaauuucuaaauaaauccccugguuaggaaau

SEQ ID NO: 480626 - RNA, 64 nt, hsa
agaaaggacaucaucauagauaugaucuaacaguauuucuaacuauauuugaucauuaaaagcc

SEQ ID NO: 480627 - RNA, 64 nt, hsa
auuuuaaaaggaauauuuauuagccauaugcagaauuucuaaugaugauauuguacagcuucua

SEQ ID NO: 480628 - RNA, 64 nt, hsa
uucuuucacugguuauauuaaagggagagcuauuauuucuaaauacuuuacaccuuugacaaaa

SEQ ID NO: 480629 - RNA, 64 nt, hsa
auuauuuaaaaacacauggaaaaauaugagacauauuucuaacauacgaacuauagugccugga

SEQ ID NO: 480630 - RNA, 64 nt, hsa
gauuucaguuuacauaucgacagcauauccacugauuucuaaaugggcuggucccaucaucuga

SEQ ID NO: 480631 - RNA, 64 nt, hsa
uauuccuuuaugcugcaaguggugacauguucagauuucuaauuugguucauuguggccuaucu

SEQ ID NO: 480632 - RNA, 64 nt, hsa
aggauucuaauagcuacaucuacuuaauaucuucauuucuaaauugacugcuuuuaccuuuuuc

SEQ ID NO: 480633 - RNA, 64 nt, hsa
uccaucagugcaacucgagcuccauccuccuccgauuucuaagguuccaguuuucuggagggac

SEQ ID NO: 480634 - RNA, 64 nt, hsa
ccuaaauaagauccacccacaccuaagucacagaauuucuaaguuccccaacuacucucacacc

SEQ ID NO: 480635 - RNA, 64 nt, hsa
aucauuguauuuuuuauuaaaaguuuuguaauaaauuucuaaauuaucuucuggugugggacuu

SEQ ID NO: 480636 - RNA, 64 nt, hsa
uuauuacaauuauucauaauaauauucuuuucuuauuucuaagccuuucugggaaaucauuuca

SEQ ID NO: 480637 - RNA, 64 nt, hsa
uuagaaaugguauagucaaagacauuuuauccacauuucuaauaguggacuugauuaaguagau

SEQ ID NO: 480638 - RNA, 64 nt, hsa
uuuccaauauuaauaccuuauguuguccuuaaauauuucuaaaagcgccuuuauuucagcauua

SEQ ID NO: 480639 - RNA, 64 nt, hsa
agguaucaguauuucagaauccugcgacgauuuuauuucuaaauucauguacuguauguccaua

SEQ ID NO: 480640 - RNA, 64 nt, hsa
agucaaucauuucucacuguguacauaaugcuuaauuucuaaagauaauauuacuguuuauuuc

SEQ ID NO: 480641 - RNA, 64 nt, hsa
agaaaacaaugcaaaaccuuugagguagaccaggauuucuaaucaaaagggaaaagaagauguu

SEQ ID NO: 480642 - RNA, 64 nt, hsa
gaaagaaagccuuuuucauauauauauauauuggauuucuaaggauggugguuugagccuugau

SEQ ID NO: 480643 - RNA, 64 nt, hsa
uacguuccuauuguuuaauaauaaauucaaaaauauuucuaaaaccuuaaaaccaacuaugcca

SEQ ID NO: 480644 - RNA, 64 nt, hsa
uuacuguuaguuuguuuugauaaggaauaaaggaauuucuaacaugacuaauuuuuuuuuuuuu

SEQ ID NO: 480645 - RNA, 64 nt, hsa
uacugcaagaccugacuauucauaacggaaaacgauuucuaaagcaacagcagguauuuuugua

SEQ ID NO: 480646 - RNA, 64 nt, hsa
agaagcaagauacuuuaagagaaauacaaaggaaauuucuaaagcacaagaaauagugagguag

SEQ ID NO: 480647 - RNA, 64 nt, hsa
ggcaugagccaccacacccagccccuuuccaaccauuucuaaguagauuuuuugacauuaaugu

SEQ ID NO: 480648 - RNA, 64 nt, hsa
cguuaucugugcagaauauauuuccuuauucagaauuucuaaaaauuuaaguucuguaagggcu

SEQ ID NO: 480649 - RNA, 64 nt, hsa
guacuuguauugucauuuggagaaacaauaaaagauuucuaaaccacugauguuguuucuccuu

SEQ ID NO: 480650 - RNA, 64 nt, hsa
gucuuuauuuuguccuuugaauaaacauuaaaagauuucuaaacuucacucauauuguuucucc

SEQ ID NO: 480651 - RNA, 64 nt, hsa
ccuuaucuauguagaauauauuuccuuauucagaauuucuaaaaguuuaaguucuaugagggcu

SEQ ID NO: 480652 - RNA, 64 nt, hsa
agucuagagagaaggugaucuauucccacaugucauuucuaauguugaguuuccaugacugaac

SEQ ID NO: 480653 - RNA, 64 nt, hsa
ugaucugaguuucuaucacuaauuuggauagaaaauuucuaagggacaugguaauccagcauuc

SEQ ID NO: 480654 - RNA, 64 nt, hsa
guauuucaguuccgugucuuaacaguuugugauaauuucuaaaacugucuuuucaacuuaugua

SEQ ID NO: 480655 - RNA, 64 nt, hsa
ugaccauugugaaauccuuucucaguguaacugcauuucuaauaaaaauuuauugagugaaaca

SEQ ID NO: 480656 - RNA, 64 nt, hsa
uguuuguuuucaccuugacgcucuucuuuucauuauuucuaaugcuacaagaaugcuguaaagu

SEQ ID NO: 480657 - RNA, 64 nt, hsa
gcccugguucauguuuucaucaaucuaaggugcaauuucuaaauuuguaagaguagguuuaaaa

SEQ ID NO: 480658 - RNA, 64 nt, hsa
gggaaauuauuugaagugauauauuugguuaaacauuucuaaaaauaaacuaccaauacuaaau

SEQ ID NO: 480659 - RNA, 64 nt, hsa
ugcuaaucuuuacuaaauagugagcuaaauuagaauuucuaacucuuauauugugcucuuuuaa

SEQ ID NO: 480660 - RNA, 64 nt, hsa
ccaauauauagucauauugcugccauuguacuuaauuucuaaauauauaaaauccacauuuaaa

SEQ ID NO: 480661 - RNA, 64 nt, hsa
ucuugcccauccauuaagguaccuucucacaaacauuucuaaucuacuggcuggagugcagugg

SEQ ID NO: 480662 - RNA, 64 nt, hsa
cauguaagguacuguguuguaccuuuauuucuguauuucuaaaagaagaaaguucuuuccuagc

SEQ ID NO: 480663 - RNA, 64 nt, hsa
ugucuuugcauucagaccaauauuucagguggauauuucuaaguauuacuagaaaauacguuug

SEQ ID NO: 480664 - RNA, 64 nt, hsa
auuagacugguaaaauaaagaccaaaauaugcagauuucuaauuggcauucauaaggugaauaa

SEQ ID NO: 480665 - RNA, 64 nt, hsa
uugaccacuuggagaacucagaaaauuauuuuaaauuucuaaguuauaauaaauuugcacacag

SEQ ID NO: 480666 - RNA, 64 nt, hsa
uugggaugauuugauuucuguuguuguugaucccauuucuaacuuggaauugugagccucuaug

SEQ ID NO: 480667 - RNA, 64 nt, hsa
agaaaccaacaaacaagaaccucucuuucuagggauuucuaaauauauaaaaugacuguuccuu

SEQ ID NO: 480668 - RNA, 64 nt, hsa
gaauguggaguguggagaggaaggaggcagauucauuucuaagacgcacucuggagccauguag

SEQ ID NO: 480669 - RNA, 64 nt, hsa
gcauguuucacauugugacagauaaagauguaugauuucuaaggcuuuaaaaauuauucauaaa

SEQ ID NO: 480670 - RNA, 64 nt, hsa
aggguaauaaaaaggaccuaaucuuaaaaauacaauuucuaagcacuuguaagaacccaguggg

SEQ ID NO: 480671 - RNA, 64 nt, hsa
uucuugaaucugggaugagaugacggauguaaauauuucuaaauuuuaaaugcuacauuacuug

SEQ ID NO: 480672 - RNA, 64 nt, hsa
uucuuuucaugcuaccuucaaucuucaacuaaagauuucuaaaagggguaagaaaugaggcagu

SEQ ID NO: 480673 - RNA, 64 nt, hsa
uguggaaauggaauagaauugguauaaauucauaauuucuaaaccauguauauguacguuuaua

SEQ ID NO: 480674 - RNA, 64 nt, hsa
aguuuauccauucuacuauuaagacaauugagcuauuucuaauuuucggcugcuaugaauaaag

SEQ ID NO: 480675 - RNA, 64 nt, hsa
ccauagaacugucccacaaaauauuucuaagcuuauuucuaacuauuaggaggaaugugcuuuu

SEQ ID NO: 480676 - RNA, 64 nt, hsa
uauuuuagacaaccauagaacugucccacaaaauauuucuaagcuuauuucuaacuauuaggag

SEQ ID NO: 480677 - RNA, 64 nt, hsa
uuuuguuucuguuuccuaaauacuccuaaauaauauuucuaaucagccauuaugcuggggcauc

SEQ ID NO: 480678 - RNA, 64 nt, hsa
cacguacguggaaacacaagagcccaccacuugaauuucuaagaccauuucauucugaaacuuc

SEQ ID NO: 480679 - RNA, 64 nt, hsa
uauuuucaccucaaugugauuuaagcagaccaaaauuucuaauucugcuaauucugaaggggaa

SEQ ID NO: 480680 - RNA, 64 nt, hsa
agaugcaguguuguuucuguucaucaggguuaauauuucuaacuauauugcuuguaggugaccc

SEQ ID NO: 480681 - RNA, 64 nt, hsa
ccugugcaccuaccccuuggaaaugucugcugguauuucuaauuccacaggucaucagaugccu

SEQ ID NO: 480682 - RNA, 64 nt, hsa
uuaaugauaaacucagaucugaucaagaguccggauuucuaacaguccuugcuuuggggggugu

SEQ ID NO: 480683 - RNA, 64 nt, hsa
uaagguaacucccauaucuccuuuaaugacauugauuucuaaugauauaaauuucagccuacau

SEQ ID NO: 480684 - RNA, 64 nt, hsa
cuucuggccuuuccuagcuagagaaggaguuaauauuucuaagguaacucccauaucuccuuua

SEQ ID NO: 480685 - RNA, 64 nt, hsa
gcaccucaaccauuuuuuuugcuuaugaacuaaaauuucuaacauuaacauuucggcauguaau

SEQ ID NO: 480686 - RNA, 64 nt, hsa
gaaauuauucugcaucacaaauacuaaauuuuauauuucuaaauuacuauaggucauuuaauau

SEQ ID NO: 480687 - RNA, 64 nt, hsa
cccaguguuagaugagugaccuaaauauacuuagauuucuaaguauggugcucucagguccaag

SEQ ID NO: 480688 - RNA, 64 nt, hsa
uguguaucaaaaaaaucacauuuuauuaauguaaauuucuaaucguauacuugcucacuguucu

SEQ ID NO: 480689 - RNA, 64 nt, hsa
ggucaccaagaagguuuacuuaauuaaauaccgcauuucuaagagaagauacuuuguguaagaa

SEQ ID NO: 480690 - RNA, 64 nt, hsa
cauacugaacaaaugucauucuaguuuagauagcauuucuaagauaacugauacuaauacuugu

SEQ ID NO: 480691 - RNA, 64 nt, hsa
cgguauuuagaaaaaauaaauuauagcaaguaugauuucuaagaauguuuuucuauaaauuacu

SEQ ID NO: 480692 - RNA, 64 nt, hsa
aaaggaaaucaugcaaaacauuugaaugcaaagcauuucuaacaaaaagugacuggagcacuug

SEQ ID NO: 480693 - RNA, 64 nt, hsa
gcaauauaaagucacaauagauaauauauaucaaauuucuaaaagguaaagaauguuguggguu

SEQ ID NO: 480694 - RNA, 64 nt, hsa
uauuuuuaugccccuucugaucuuuuccauauguauuucuaaauggauaaauuauucuaggcuu

SEQ ID NO: 480695 - RNA, 64 nt, hsa
auguagugaaagaacaaauccuagagucuuugaaauuucuaagggcauucuagaccucuguugg

SEQ ID NO: 480696 - RNA, 64 nt, hsa
auuggacugugcccuguuuuuaguuuucaaaucaauuucuaauucuggugauugugugauguaa

SEQ ID NO: 480697 - RNA, 64 nt, hsa
aauuccauacuaaaacuaggaaugaaagugagagauuucuaaacuuuugcgaaagugggucauu

SEQ ID NO: 480698 - RNA, 64 nt, hsa
ugguauaaaaaagaggucuucauuuagacaugugauuucuaaaauuccagaaagcaaaauugau

SEQ ID NO: 480699 - RNA, 64 nt, hsa
aguuuucugaaaaaaugcaguaaauauaagccacauuucuaaaguuuauuuuuaugaaagcuuc

SEQ ID NO: 480700 - RNA, 64 nt, hsa
uuaauuaugaaaacuagcauuacauuauuaaacgauuucuaaaaucaaaacauacuuaaucuga

SEQ ID NO: 480701 - RNA, 64 nt, hsa
cucuggacguugugagaauugugcuuucaccagaauuucuaagaauuucugcuaaauaucaccu

SEQ ID NO: 480702 - RNA, 64 nt, hsa
caguugugacuaacuagacaccaaaguucuaauaauuucuaauguuggacaccuuuagguucuu

SEQ ID NO: 480703 - RNA, 64 nt, hsa
cucuaggaccaugguuaagaguccaagaauccacauuucuaaaaucuuauaguucuaggcacug

SEQ ID NO: 480704 - RNA, 64 nt, hsa
ugaugggguagcaucacugcuaagcaaugaaugaauuucuaaauacaguaugugcuggguaaac

SEQ ID NO: 480705 - RNA, 64 nt, hsa
uggucuaagaagauacugucuuucaauagaaaugauuucuaaacugcuacagauuaagaauaga

SEQ ID NO: 480706 - RNA, 64 nt, hsa
cuagaaaacuuuauucauuuuagaauagaacauaauuucuaacuguaaaauugucauuuuguac

SEQ ID NO: 480707 - RNA, 64 nt, hsa
uguucaauauugccguuacauuuauuagccuguaauuucuaaauuggagauucucuacauuuca

SEQ ID NO: 480708 - RNA, 64 nt, hsa
agcaucuaauuucaauuauagugucaugcagaguauuucuaaaguaauugguuaucaugggaaa

SEQ ID NO: 480709 - RNA, 64 nt, hsa
uugguguaauggggcagaaaucugaggaauggacauuucuaauuccuguuuguugaagggaagu

SEQ ID NO: 480710 - RNA, 64 nt, hsa
gaugccaagacacccggguucugaaaaugugcuguguuccuaccucggcaagaucaccagcacu

SEQ ID NO: 480711 - RNA, 64 nt, hsa
caaacuucuuauuugucuaaauugccccuuuuucuguuccuaaaaggaaggauaagagagaaca

SEQ ID NO: 480712 - RNA, 64 nt, hsa
gguuugguaggccucacugcucuccagaggcuaguguuccuaucccaggauggcuguugggauu

SEQ ID NO: 480713 - RNA, 64 nt, hsa
uuucucugucagaucaauuuguuuuucuuaauguuguuccuaucaaaaaaaaaaaaaaggaaga

SEQ ID NO: 480714 - RNA, 64 nt, hsa
cacuuguuuuuuacauuuuaagaguuguagaaguuguuccuaacuuggggacuggaccuacccu

SEQ ID NO: 480715 - RNA, 64 nt, hsa
gguuguucaccuuguaccagugguuauuugaguuuguuccuauuacaccaauccuuacuugagg

SEQ ID NO: 480716 - RNA, 64 nt, hsa
aagcucaaacagaagggaaugcuauuacuggugguguuccuacgguaagacuuaagcaaagccu

SEQ ID NO: 480717 - RNA, 64 nt, hsa
ccuuuuucauauuugaaaauguggaaagaaaagauguuccuaaaagguuagauauuuugagcua

SEQ ID NO: 480718 - RNA, 64 nt, hsa
ggaauugaggugggucaggugaaggaagaguguauguuccuauuuuuauuccagccuuuuaaau

SEQ ID NO: 480719 - RNA, 64 nt, hsa
uggagcaagcucucgagggcagcacugacaaauguguuccuaagaagacauucagacccaggug

SEQ ID NO: 480720 - RNA, 64 nt, hsa
uucaaaaauuucaucugagcuggaugcaguggcuuguuccuauagucccagcacuuugggaggc

SEQ ID NO: 480721 - RNA, 64 nt, hsa
uugguuguagauuuuaucuuauccuuuaguguuguguuccuacugugaugucuugguuuuuguc

SEQ ID NO: 480722 - RNA, 64 nt, hsa
gagccagauuccacauucaugggacuaccagacauguuccuagcucaacuugauuauagagaag

SEQ ID NO: 480723 - RNA, 64 nt, hsa
cuggcagccuugcccaguuguucucucuggacucuguuccuauaccacaacagcagcaggggcc

SEQ ID NO: 480724 - RNA, 62 nt, hsa
acaauagccaagauauaggagcaaccuagguguccaacaacagaugaauggauaaagaaaau

SEQ ID NO: 480725 - RNA, 62 nt, hsa
aagacuuaguuaaggauaguuaacuauuauacuccaacaauucaugagcaacaguauauaca

SEQ ID NO: 480726 - RNA, 62 nt, hsa
ccaggucucaaaaauucaucaagcaauuucccuccaacaagggcugcaguucuagugauaaa

SEQ ID NO: 480727 - RNA, 62 nt, hsa
uagaauuuuuuauagcuuagauauaaaaggucuccaacaaagaccuuugcaauauauuuuaa

SEQ ID NO: 480728 - RNA, 62 nt, hsa
gauaucaagaguuuguuauuuucaaauacccauccaacaagagagauggggagguuuuuagu

SEQ ID NO: 480729 - RNA, 62 nt, hsa
uauuguuugaacaggaagugaacauagucguuuccaacaaaguuuuacuuuuuguaggauuu

SEQ ID NO: 480730 - RNA, 62 nt, hsa
cacaaggaauaaguuccaacaaaguaauaaauuccaacaaagcaacaaaucaaauaacuuac

SEQ ID NO: 480731 - RNA, 52 nt, hsa
agaaaucccacaaggaauaaguuccaacaaaguaauaaauuccaacaaagca

SEQ ID NO: 480732 - RNA, 62 nt, hsa
acaagugggaguuaagagaggucuggaaaguguccaacaaggaauucacaccucugccuccu

SEQ ID NO: 480733 - RNA, 62 nt, hsa
ucuaauucauuuucucuuuaguguuaguagacuccaacaacagaaguggcaucuguguauuc

SEQ ID NO: 480734 - RNA, 64 nt, hsa; identical to SEQ ID NO: 80857

SEQ ID NO: 480735 - RNA, 64 nt, hsa; identical to SEQ ID NO: 80858

SEQ ID NO: 480736 - RNA, 64 nt, hsa; identical to SEQ ID NO: 80859

SEQ ID NO: 480737 - RNA, 64 nt, hsa; identical to SEQ ID NO: 80860

SEQ ID NO: 480738 - RNA, 64 nt, hsa; identical to SEQ ID NO: 80861

SEQ ID NO: 480739 - RNA, 64 nt, hsa; identical to SEQ ID NO: 80862

SEQ ID NO: 480740 - RNA, 64 nt, hsa; identical to SEQ ID NO: 80863

SEQ ID NO: 480741 - RNA, 64 nt, hsa; identical to SEQ ID NO: 80864

SEQ ID NO: 480742 - RNA, 64 nt, hsa; identical to SEQ ID NO: 80865

SEQ ID NO: 480743 - RNA, 64 nt, hsa; identical to SEQ ID NO: 80866

SEQ ID NO: 480744 - RNA, 64 nt, hsa; identical to SEQ ID NO: 80867

SEQ ID NO: 480745 - RNA, 64 nt, hsa; identical to SEQ ID NO: 80868

SEQ ID NO: 480746 - RNA, 64 nt, hsa; identical to SEQ ID NO: 80869

SEQ ID NO: 480747 - RNA, 64 nt, hsa; identical to SEQ ID NO: 80870

SEQ ID NO: 480748 - RNA, 64 nt, hsa; identical to SEQ ID NO: 80871

SEQ ID NO: 480749 - RNA, 64 nt, hsa; identical to SEQ ID NO: 80872

SEQ ID NO: 480750 - RNA, 64 nt, hsa; identical to SEQ ID NO: 80873

SEQ ID NO: 480751 - RNA, 64 nt, hsa; identical to SEQ ID NO: 80874

SEQ ID NO: 480752 - RNA, 64 nt, hsa; identical to SEQ ID NO: 80875

SEQ ID NO: 480753 - RNA, 64 nt, hsa; identical to SEQ ID NO: 80876

SEQ ID NO: 480754 - RNA, 64 nt, hsa; identical to SEQ ID NO: 80877

SEQ ID NO: 480755 - RNA, 64 nt, hsa; identical to SEQ ID NO: 80878

SEQ ID NO: 480756 - RNA, 64 nt, hsa; identical to SEQ ID NO: 80879

SEQ ID NO: 480757 - RNA, 64 nt, hsa; identical to SEQ ID NO: 80880

SEQ ID NO: 480758 - RNA, 64 nt, hsa; identical to SEQ ID NO: 80881

SEQ ID NO: 480759 - RNA, 64 nt, hsa; identical to SEQ ID NO: 80882

SEQ ID NO: 480760 - RNA, 59 nt, hsa; identical to SEQ ID NO: 80883

SEQ ID NO: 480761 - RNA, 64 nt, hsa; identical to SEQ ID NO: 80884

SEQ ID NO: 480762 - RNA, 64 nt, hsa; identical to SEQ ID NO: 80885

SEQ ID NO: 480763 - RNA, 64 nt, hsa; identical to SEQ ID NO: 80886

SEQ ID NO: 480764 - RNA, 64 nt, hsa; identical to SEQ ID NO: 80887

SEQ ID NO: 480765 - RNA, 64 nt, hsa; identical to SEQ ID NO: 80888

SEQ ID NO: 480766 - RNA, 64 nt, hsa; identical to SEQ ID NO: 80889

SEQ ID NO: 480767 - RNA, 64 nt, hsa; identical to SEQ ID NO: 80890

SEQ ID NO: 480768 - RNA, 64 nt, hsa; identical to SEQ ID NO: 80891

SEQ ID NO: 480769 - RNA, 64 nt, hsa; identical to SEQ ID NO: 80892

SEQ ID NO: 480770 - RNA, 64 nt, hsa; identical to SEQ ID NO: 80893

SEQ ID NO: 480771 - RNA, 64 nt, hsa; identical to SEQ ID NO: 80894

SEQ ID NO: 480772 - RNA, 64 nt, hsa; identical to SEQ ID NO: 80895

SEQ ID NO: 480773 - RNA, 64 nt, hsa; identical to SEQ ID NO: 80896

SEQ ID NO: 480774 - RNA, 64 nt, hsa; identical to SEQ ID NO: 80897

SEQ ID NO: 480775 - RNA, 64 nt, hsa; identical to SEQ ID NO: 80898

SEQ ID NO: 480776 - RNA, 64 nt, hsa; identical to SEQ ID NO: 80899

SEQ ID NO: 480777 - RNA, 64 nt, hsa; identical to SEQ ID NO: 80900

SEQ ID NO: 480778 - RNA, 64 nt, hsa; identical to SEQ ID NO: 80901

SEQ ID NO: 480779 - RNA, 64 nt, hsa; identical to SEQ ID NO: 80902

SEQ ID NO: 480780 - RNA, 64 nt, hsa; identical to SEQ ID NO: 80903

SEQ ID NO: 480781 - RNA, 64 nt, hsa; identical to SEQ ID NO: 80904

SEQ ID NO: 480782 - RNA, 64 nt, hsa; identical to SEQ ID NO: 80905

SEQ ID NO: 480783 - RNA, 59 nt, hsa
cuuauuuuaaaagccagucaaagauuccacugauugacauuugauaaauaaacaucagg

SEQ ID NO: 480784 - RNA, 59 nt, hsa
auuuuuguacacauauauuuauauaaucacugauugagauuuaggaaaaagcauuucua

SEQ ID NO: 480785 - RNA, 59 nt, hsa
auuuugugagcaaaacauacuuggaaaugcugauugauuuuuaugcuuguuaguguauu

SEQ ID NO: 480786 - RNA, 59 nt, hsa
uaauguguguuuugggagagggagggaugcugauugauauuucacauuguaugaaauac

SEQ ID NO: 480787 - RNA, 59 nt, hsa
aaugagguuaggccucuccuccuaauauacugauugacaaugcauauuagccagguaau

SEQ ID NO: 480788 - RNA, 59 nt, hsa
cucugucucccugucuucuuuagaucggucugauugauuuuaaaaguggacccaaacuu

SEQ ID NO: 480789 - RNA, 59 nt, hsa
ucuuuuagaaaguuaaaaauguauaguaacugauugagggggaaaagaaugaucuuuau

SEQ ID NO: 480790 - RNA, 59 nt, hsa
acucgucauaagugagaggcguguguugacugauugacccagcgcuuuggaaauaaaug

SEQ ID NO: 480791 - RNA, 64 nt, hsa
auuuaccuuaucaaaaccacguuccuuggaaccacauuauuaugaugguuuuugugcucuugua

SEQ ID NO: 480792 - RNA, 64 nt, hsa
uauauacauuugcuaucauacaugacaguugugucauuauuagagauuucaguaauuaaaaugg

SEQ ID NO: 480793 - RNA, 64 nt, hsa
auauaguauccuuuuagauacaaaagcuuauuuucauuauuauuauaauaaacaguuaaugguu

SEQ ID NO: 480794 - RNA, 64 nt, hsa
aaggaaugaaacuugguuaagauuuugacuacuucauuauuaaaaauugauagaauuuuagcuc

SEQ ID NO: 480795 - RNA, 64 nt, hsa
gggaaauaaaauguggucuguccacgcaauggaacauuauuagacucuaaaaagaaaugaagua

SEQ ID NO: 480796 - RNA, 64 nt, hsa
caaauggcuacuaagcacaugaaaaaauacucaacauuauuauucauuagggaaaugcaaguca

SEQ ID NO: 480797 - RNA, 64 nt, hsa
agaaccgccaccucaaugcauugucaguaggauacauuauuagaaacuguuagggucuuuccca

SEQ ID NO: 480798 - RNA, 64 nt, hsa
agaaccgccaccucaaugcauugucaguagaauacauuauuagaaacuguuaaggucuuucccg

SEQ ID NO: 480799 - RNA, 64 nt, hsa
cagugauagaacaaaagaggauuaguagaaaauacauuauuagaauauaaaaaauguuauuacu

SEQ ID NO: 480800 - RNA, 64 nt, hsa
uaguaccuuuuuaacagcaugugggugucagugucauuauuagucuccuaauaaguuccucuga

SEQ ID NO: 480801 - RNA, 64 nt, hsa
uguugacaugaauagaccauggaaacauuuucaucauuauuauucagccugugcuguaguuaau

SEQ ID NO: 480802 - RNA, 64 nt, hsa
uauauuacuguuaaauuucuuagugcagaaauaacauuauuaauagaguauuguuuucaaaaca

SEQ ID NO: 480803 - RNA, 64 nt, hsa
uauuuauuuuuucuaaguuccagaauaauagugucauuauuauagacuauauguuuugaaguuu

SEQ ID NO: 480804 - RNA, 64 nt, hsa
uuguuuaauauuuauuuuaaucuuaauauuuuuacauuauuauauugcauuauuuauuuuuucu

SEQ ID NO: 480805 - RNA, 64 nt, hsa
uccuugcacuuagauuuaauuuauauguuaguuacauuauuaaaagucauaaggcauuuaucug

SEQ ID NO: 480806 - RNA, 64 nt, hsa
ccccagcgcucucaguccaaucaguuugucuuagcauuauuagcaugcuuuccagcugcaagga

SEQ ID NO: 480807 - RNA, 64 nt, hsa
cugccugauccaaucauuaucaaguuccauaauucauuauuaagcucugaaauucaggacacau

SEQ ID NO: 480808 - RNA, 64 nt, hsa
guguguguguguggugugucuuucaugacacugacauuauuaaagaguucaggcaaguuugugg

SEQ ID NO: 480809 - RNA, 64 nt, hsa
ucacggugugauaauacucuuuagauugugcuuucauuauuauagaugcaucaugucuucugcu

SEQ ID NO: 480810 - RNA, 64 nt, hsa
uuuuccauuugggggcaaacucuauucuugugagcauuauuaaaucuuguuuguaaauauauug

SEQ ID NO: 480811 - RNA, 64 nt, hsa
aaacuuccauauucuguuuuugaaaagauguggccauuauuacaguaauuuuauuauaggacuu

SEQ ID NO: 480812 - RNA, 64 nt, hsa
ugcccuuuagcuaacuaauaaaguuugauauaggcauuauuauauaauucugagucauucaugg

SEQ ID NO: 480813 - RNA, 64 nt, hsa
gcccuguuuuuagccggaaaggauucaggauaaacauuauuaugcauucugaauuggaugcaua

SEQ ID NO: 480814 - RNA, 64 nt, hsa
uugugcaacuuuacaguagauuucaccuuuguuucauuauuacagcagcacuguauauaccugu

SEQ ID NO: 480815 - RNA, 64 nt, hsa
ugaaguucuaaugucuguguuccaaaacacaucacauuauuagguuguagggagauauguaggu

SEQ ID NO: 480816 - RNA, 64 nt, hsa
uugaguggaaaacacuuuagaaaguaauaacaaacauuauuauaaacuaauauaugugagagua

SEQ ID NO: 480817 - RNA, 64 nt, hsa; identical to SEQ ID NO: 351843

SEQ ID NO: 480818 - RNA, 64 nt, hsa; identical to SEQ ID NO: 351844

SEQ ID NO: 480819 - RNA, 64 nt, hsa; identical to SEQ ID NO: 247175

SEQ ID NO: 480820 - RNA, 64 nt, hsa; identical to SEQ ID NO: 247176

SEQ ID NO: 480821 - RNA, 64 nt, hsa; identical to SEQ ID NO: 247177

SEQ ID NO: 480822 - RNA, 64 nt, hsa; identical to SEQ ID NO: 247178

SEQ ID NO: 480823 - RNA, 64 nt, hsa; identical to SEQ ID NO: 247179

SEQ ID NO: 480824 - RNA, 64 nt, hsa; identical to SEQ ID NO: 247180

SEQ ID NO: 480825 - RNA, 64 nt, hsa; identical to SEQ ID NO: 247181

SEQ ID NO: 480826 - RNA, 64 nt, hsa; identical to SEQ ID NO: 247182

SEQ ID NO: 480827 - RNA, 64 nt, hsa; identical to SEQ ID NO: 247183

SEQ ID NO: 480828 - RNA, 64 nt, hsa; identical to SEQ ID NO: 247184

SEQ ID NO: 480829 - RNA, 64 nt, hsa; identical to SEQ ID NO: 247185

SEQ ID NO: 480830 - RNA, 64 nt, hsa; identical to SEQ ID NO: 247186

SEQ ID NO: 480831 - RNA, 64 nt, hsa; identical to SEQ ID NO: 247187

SEQ ID NO: 480832 - RNA, 64 nt, hsa; identical to SEQ ID NO: 247188

SEQ ID NO: 480833 - RNA, 64 nt, hsa; identical to SEQ ID NO: 247189

SEQ ID NO: 480834 - RNA, 64 nt, hsa; identical to SEQ ID NO: 247190

SEQ ID NO: 480835 - RNA, 64 nt, hsa; identical to SEQ ID NO: 247191

SEQ ID NO: 480836 - RNA, 64 nt, hsa; identical to SEQ ID NO: 247192

SEQ ID NO: 480837 - RNA, 64 nt, hsa; identical to SEQ ID NO: 247193

SEQ ID NO: 480838 - RNA, 64 nt, hsa; identical to SEQ ID NO: 247194

SEQ ID NO: 480839 - RNA, 64 nt, hsa; identical to SEQ ID NO: 247195

SEQ ID NO: 480840 - RNA, 64 nt, hsa; identical to SEQ ID NO: 247196

SEQ ID NO: 480841 - RNA, 64 nt, hsa; identical to SEQ ID NO: 247197

SEQ ID NO: 480842 - RNA, 64 nt, hsa; identical to SEQ ID NO: 247198

SEQ ID NO: 480843 - RNA, 64 nt, hsa; identical to SEQ ID NO: 247199

SEQ ID NO: 480844 - RNA, 64 nt, hsa; identical to SEQ ID NO: 247200

SEQ ID NO: 480845 - RNA, 64 nt, hsa; identical to SEQ ID NO: 247201

SEQ ID NO: 480846 - RNA, 61 nt, hsa; identical to SEQ ID NO: 247202

SEQ ID NO: 480847 - RNA, 64 nt, hsa; identical to SEQ ID NO: 247203

SEQ ID NO: 480848 - RNA, 64 nt, hsa; identical to SEQ ID NO: 247204

SEQ ID NO: 480849 - RNA, 64 nt, hsa; identical to SEQ ID NO: 247205

SEQ ID NO: 480850 - RNA, 64 nt, hsa; identical to SEQ ID NO: 247206

SEQ ID NO: 480851 - RNA, 64 nt, hsa; identical to SEQ ID NO: 247207

SEQ ID NO: 480852 - RNA, 64 nt, hsa; identical to SEQ ID NO: 247208

SEQ ID NO: 480853 - RNA, 64 nt, hsa; identical to SEQ ID NO: 247209

SEQ ID NO: 480854 - RNA, 64 nt, hsa; identical to SEQ ID NO: 247210

SEQ ID NO: 480855 - RNA, 64 nt, hsa; identical to SEQ ID NO: 247211

SEQ ID NO: 480856 - RNA, 64 nt, hsa; identical to SEQ ID NO: 247212

SEQ ID NO: 480857 - RNA, 64 nt, hsa; identical to SEQ ID NO: 247213

SEQ ID NO: 480858 - RNA, 64 nt, hsa; identical to SEQ ID NO: 247214

SEQ ID NO: 480859 - RNA, 64 nt, hsa; identical to SEQ ID NO: 247215

SEQ ID NO: 480860 - RNA, 64 nt, hsa; identical to SEQ ID NO: 247216

SEQ ID NO: 480861 - RNA, 64 nt, hsa; identical to SEQ ID NO: 247217

SEQ ID NO: 480862 - RNA, 64 nt, hsa; identical to SEQ ID NO: 247218

SEQ ID NO: 480863 - RNA, 64 nt, hsa; identical to SEQ ID NO: 247219

SEQ ID NO: 480864 - RNA, 64 nt, hsa; identical to SEQ ID NO: 247220

SEQ ID NO: 480865 - RNA, 64 nt, hsa; identical to SEQ ID NO: 247221

SEQ ID NO: 480866 - RNA, 64 nt, hsa; identical to SEQ ID NO: 247222

SEQ ID NO: 480867 - RNA, 64 nt, hsa; identical to SEQ ID NO: 247223

SEQ ID NO: 480868 - RNA, 64 nt, hsa; identical to SEQ ID NO: 247224

SEQ ID NO: 480869 - RNA, 64 nt, hsa; identical to SEQ ID NO: 247225

SEQ ID NO: 480870 - RNA, 64 nt, hsa; identical to SEQ ID NO: 247226

SEQ ID NO: 480871 - RNA, 64 nt, hsa; identical to SEQ ID NO: 247227

SEQ ID NO: 480872 - RNA, 64 nt, hsa; identical to SEQ ID NO: 247228

SEQ ID NO: 480873 - RNA, 64 nt, hsa; identical to SEQ ID NO: 247229

SEQ ID NO: 480874 - RNA, 64 nt, hsa; identical to SEQ ID NO: 247230

SEQ ID NO: 480875 - RNA, 64 nt, hsa; identical to SEQ ID NO: 247231

SEQ ID NO: 480876 - RNA, 64 nt, hsa; identical to SEQ ID NO: 247232

SEQ ID NO: 480877 - RNA, 64 nt, hsa; identical to SEQ ID NO: 247233

SEQ ID NO: 480878 - RNA, 64 nt, hsa; identical to SEQ ID NO: 247234

SEQ ID NO: 480879 - RNA, 64 nt, hsa; identical to SEQ ID NO: 247235

SEQ ID NO: 480880 - RNA, 64 nt, hsa; identical to SEQ ID NO: 247236

SEQ ID NO: 480881 - RNA, 64 nt, hsa; identical to SEQ ID NO: 247237

SEQ ID NO: 480882 - RNA, 64 nt, hsa; identical to SEQ ID NO: 247238

SEQ ID NO: 480883 - RNA, 64 nt, hsa; identical to SEQ ID NO: 247239

SEQ ID NO: 480884 - RNA, 64 nt, hsa; identical to SEQ ID NO: 247240

SEQ ID NO: 480885 - RNA, 64 nt, hsa; identical to SEQ ID NO: 247241

SEQ ID NO: 480886 - RNA, 64 nt, hsa; identical to SEQ ID NO: 247242

SEQ ID NO: 480887 - RNA, 64 nt, hsa; identical to SEQ ID NO: 247243

SEQ ID NO: 480888 - RNA, 64 nt, hsa; identical to SEQ ID NO: 247244

SEQ ID NO: 480889 - RNA, 64 nt, hsa; identical to SEQ ID NO: 247245

SEQ ID NO: 480890 - RNA, 64 nt, hsa; identical to SEQ ID NO: 247246

SEQ ID NO: 480891 - RNA, 64 nt, hsa; identical to SEQ ID NO: 247247

SEQ ID NO: 480892 - RNA, 64 nt, hsa; identical to SEQ ID NO: 247248

SEQ ID NO: 480893 - RNA, 64 nt, hsa; identical to SEQ ID NO: 247249

SEQ ID NO: 480894 - RNA, 64 nt, hsa; identical to SEQ ID NO: 247250

SEQ ID NO: 480895 - RNA, 64 nt, hsa; identical to SEQ ID NO: 247251

SEQ ID NO: 480896 - RNA, 64 nt, hsa; identical to SEQ ID NO: 247252

SEQ ID NO: 480897 - RNA, 64 nt, hsa
guuugaccugguuguguuauuuuaccagaccuugguaaaagaacuauuuuggaaacaguauuug

SEQ ID NO: 480898 - RNA, 64 nt, hsa
aaccugcauaacuuuuugucuuuaagucguguuuguaaaagaaguaauugcuagaaacauuuga

SEQ ID NO: 480899 - RNA, 64 nt, hsa
aaccuuuuuuuuuuucuucuccacucuaacaaaaguaaaagaacaaaacuuuugcugaggucuu

SEQ ID NO: 480900 - RNA, 64 nt, hsa
cugauaucaaaacaucucuaagauacaguauuuaguaaaagagaaaguuucaggaaauaaaacu

SEQ ID NO: 480901 - RNA, 64 nt, hsa
ucaggauuuuuuuuuuuuaaguaagaagggaacuguaaaagagaaaaaaagaaauucaugcaua

SEQ ID NO: 480902 - RNA, 64 nt, hsa
auucauguucaugugauuaacucuuagaaguguuguaaaagaugcagaguaaguauuaugcccc

SEQ ID NO: 480903 - RNA, 64 nt, hsa
gccauuuguguuucagcucacaguucuuugcuggguaaaagaaauacuuucugacagucaccug

SEQ ID NO: 480904 - RNA, 64 nt, hsa
aaucagcagacuggaagcugaggaagaucuagaaguaaaagaaaaaauuagaugcguuaaaaug

SEQ ID NO: 480905 - RNA, 64 nt, hsa
agguaccagugcauagcagcugaaugccagcccuguaaaagaccaccauaaagagagcuccaug

SEQ ID NO: 480906 - RNA, 64 nt, hsa
auuacugaagaaugagguuuuucauaccugaagaguaaaagaaaaacuaagagaucaaacugag

SEQ ID NO: 480907 - RNA, 64 nt, hsa
gguuauauguaaugugauaaauuagcuaugaaugguaaaagaacaaaacugaucagaguaaauu

SEQ ID NO: 480908 - RNA, 64 nt, hsa
aauucuguuaucaauaacuugcaaguaauuuuuuguaaaagauugaauuacaguaaacccaucu

SEQ ID NO: 480909 - RNA, 64 nt, hsa
aaacauugguuuaauuuucaagagaauuaagaaaguaaaagagaaauucuguuaucaauaacuu

SEQ ID NO: 480910 - RNA, 64 nt, hsa
guauguguuccaggaauguuaaugagaugguauuguaaaagaguugcauggauaaaacuuggcc

SEQ ID NO: 480911 - RNA, 64 nt, hsa
uuucugcuuuuaugacuguauuuauuccuuuacuguaaaagaauaugaagaacucauacauguu

SEQ ID NO: 480912 - RNA, 64 nt, hsa
gaaucaugcaucuauuuauaauucuaauuauuuuguaaaagaagacaaaauuaugaaucuuaag

SEQ ID NO: 480913 - RNA, 64 nt, hsa
aucuuugcaccuuaauauuaauggacuguuucagguaaaagagaaugaauguaugauugugaac

SEQ ID NO: 480914 - RNA, 64 nt, hsa
ccuaguguuguugggaacuaauugaacagcuacaguaaaagaaguuccuaucucauugccuuug

SEQ ID NO: 480915 - RNA, 64 nt, hsa
ucucauugccuuuguggaaaggcuucccuaugugguaaaagaaaggcauuccuccguaaccuag

SEQ ID NO: 480916 - RNA, 64 nt, hsa
ugcauguaaaagauguauuacaaucucaaagccaguaaaagaaaucuugcuucacuguucaccu

SEQ ID NO: 480917 - RNA, 64 nt, hsa
ucaacgauuaagucuaccaaagaacacacugcauguaaaagauguauuacaaucucaaagccag

SEQ ID NO: 480918 - RNA, 64 nt, hsa
uauaauucuugaaugaggcaauuucaagauauuuguaaaagaacaguaaacauugguaagaaug

SEQ ID NO: 480919 - RNA, 64 nt, hsa
augcuuagcaauguucuaaucacuauggacagauguaaaagaaacuauacaucauuuuugcccu

SEQ ID NO: 480920 - RNA, 64 nt, hsa
ggauuuuacuacuaaaauuggacauuuaagcgaaguaaaagaggccgggugcgguggcucacgc

SEQ ID NO: 480921 - RNA, 64 nt, hsa
ggagacugcaucucaaaaaagaaaaauaaacgaaguaaaagauauuuaucagagcuguuacagg

SEQ ID NO: 480922 - RNA, 64 nt, hsa
acaauagcugccuuccccuaucgaacaguuaucaguaaaagacauuucaaucuuacaaagcaac

SEQ ID NO: 480923 - RNA, 64 nt, hsa
uuuaagcaagcagucauagacuggucgggauuaaguaaaagacggcuaguuggccuccucauuu

SEQ ID NO: 480924 - RNA, 64 nt, hsa
ugcccgacucucacuucauauguuuaaagaaugaguaaaagaaagcaauuacuacugcuaaaug

SEQ ID NO: 480925 - RNA, 64 nt, hsa
ugguuuuuacuuagaucaugaguugaacaaacauguaaaagaagagauacuuaacaauaauugg

SEQ ID NO: 480926 - RNA, 64 nt, hsa
cuuugauucuguaauaacuagaacaaauaaaguaguaaaagaagaaauaguucugugacuagga

SEQ ID NO: 480927 - RNA, 64 nt, hsa
cagucucaaaggccagguugcuaagaaaccaggaguaaaagagucaagugaccaucauuucacc

SEQ ID NO: 480928 - RNA, 64 nt, hsa; identical to SEQ ID NO: 411269

SEQ ID NO: 480929 - RNA, 64 nt, hsa; identical to SEQ ID NO: 411270

SEQ ID NO: 480930 - RNA, 64 nt, hsa; identical to SEQ ID NO: 411271

SEQ ID NO: 480931 - RNA, 64 nt, hsa; identical to SEQ ID NO: 411272

SEQ ID NO: 480932 - RNA, 64 nt, hsa; identical to SEQ ID NO: 411273

SEQ ID NO: 480933 - RNA, 64 nt, hsa; identical to SEQ ID NO: 411274

SEQ ID NO: 480934 - RNA, 64 nt, hsa; identical to SEQ ID NO: 411275

SEQ ID NO: 480935 - RNA, 64 nt, hsa; identical to SEQ ID NO: 411276

SEQ ID NO: 480936 - RNA, 64 nt, hsa; identical to SEQ ID NO: 411277

SEQ ID NO: 480937 - RNA, 64 nt, hsa; identical to SEQ ID NO: 411278

SEQ ID NO: 480938 - RNA, 64 nt, hsa; identical to SEQ ID NO: 411279

SEQ ID NO: 480939 - RNA, 64 nt, hsa; identical to SEQ ID NO: 411280

SEQ ID NO: 480940 - RNA, 64 nt, hsa; identical to SEQ ID NO: 411281

SEQ ID NO: 480941 - RNA, 64 nt, hsa; identical to SEQ ID NO: 411282

SEQ ID NO: 480942 - RNA, 64 nt, hsa; identical to SEQ ID NO: 411283

SEQ ID NO: 480943 - RNA, 64 nt, hsa; identical to SEQ ID NO: 411284

SEQ ID NO: 480944 - RNA, 64 nt, hsa; identical to SEQ ID NO: 411285

SEQ ID NO: 480945 - RNA, 64 nt, hsa; identical to SEQ ID NO: 411286

SEQ ID NO: 480946 - RNA, 64 nt, hsa; identical to SEQ ID NO: 411287

SEQ ID NO: 480947 - RNA, 64 nt, hsa; identical to SEQ ID NO: 411288

SEQ ID NO: 480948 - RNA, 64 nt, hsa; identical to SEQ ID NO: 411289

SEQ ID NO: 480949 - RNA, 64 nt, hsa; identical to SEQ ID NO: 411290

SEQ ID NO: 480950 - RNA, 64 nt, hsa; identical to SEQ ID NO: 411291

SEQ ID NO: 480951 - RNA, 64 nt, hsa; identical to SEQ ID NO: 411292

SEQ ID NO: 480952 - RNA, 64 nt, hsa; identical to SEQ ID NO: 411293

SEQ ID NO: 480953 - RNA, 64 nt, hsa; identical to SEQ ID NO: 411294

SEQ ID NO: 480954 - RNA, 64 nt, hsa; identical to SEQ ID NO: 411295

SEQ ID NO: 480955 - RNA, 64 nt, hsa; identical to SEQ ID NO: 411296

SEQ ID NO: 480956 - RNA, 64 nt, hsa; identical to SEQ ID NO: 411297

SEQ ID NO: 480957 - RNA, 64 nt, hsa; identical to SEQ ID NO: 411298

SEQ ID NO: 480958 - RNA, 64 nt, hsa; identical to SEQ ID NO: 411299

SEQ ID NO: 480959 - RNA, 64 nt, hsa; identical to SEQ ID NO: 411300

SEQ ID NO: 480960 - RNA, 64 nt, hsa; identical to SEQ ID NO: 411301

SEQ ID NO: 480961 - RNA, 64 nt, hsa; identical to SEQ ID NO: 411302

SEQ ID NO: 480962 - RNA, 64 nt, hsa; identical to SEQ ID NO: 411303

SEQ ID NO: 480963 - RNA, 64 nt, hsa; identical to SEQ ID NO: 411304

SEQ ID NO: 480964 - RNA, 64 nt, hsa; identical to SEQ ID NO: 411305

SEQ ID NO: 480965 - RNA, 64 nt, hsa; identical to SEQ ID NO: 411306

SEQ ID NO: 480966 - RNA, 64 nt, hsa; identical to SEQ ID NO: 411307

SEQ ID NO: 480967 - RNA, 64 nt, hsa; identical to SEQ ID NO: 411308

SEQ ID NO: 480968 - RNA, 64 nt, hsa; identical to SEQ ID NO: 411309

SEQ ID NO: 480969 - RNA, 64 nt, hsa; identical to SEQ ID NO: 411310

SEQ ID NO: 480970 - RNA, 64 nt, hsa; identical to SEQ ID NO: 411311

SEQ ID NO: 480971 - RNA, 64 nt, hsa; identical to SEQ ID NO: 411312

SEQ ID NO: 480972 - RNA, 64 nt, hsa; identical to SEQ ID NO: 411313

SEQ ID NO: 480973 - RNA, 64 nt, hsa; identical to SEQ ID NO: 411314

SEQ ID NO: 480974 - RNA, 64 nt, hsa; identical to SEQ ID NO: 411315

SEQ ID NO: 480975 - RNA, 64 nt, hsa; identical to SEQ ID NO: 411316

SEQ ID NO: 480976 - RNA, 64 nt, hsa; identical to SEQ ID NO: 411317

SEQ ID NO: 480977 - RNA, 64 nt, hsa; identical to SEQ ID NO: 411318

SEQ ID NO: 480978 - RNA, 64 nt, hsa; identical to SEQ ID NO: 411319

SEQ ID NO: 480979 - RNA, 64 nt, hsa; identical to SEQ ID NO: 411320

SEQ ID NO: 480980 - RNA, 64 nt, hsa; identical to SEQ ID NO: 411321

SEQ ID NO: 480981 - RNA, 64 nt, hsa; identical to SEQ ID NO: 411322

SEQ ID NO: 480982 - RNA, 64 nt, hsa; identical to SEQ ID NO: 411323

SEQ ID NO: 480983 - RNA, 64 nt, hsa; identical to SEQ ID NO: 411324

SEQ ID NO: 480984 - RNA, 64 nt, hsa; identical to SEQ ID NO: 411325

SEQ ID NO: 480985 - RNA, 64 nt, hsa; identical to SEQ ID NO: 411326

SEQ ID NO: 480986 - RNA, 64 nt, hsa; identical to SEQ ID NO: 411327

SEQ ID NO: 480987 - RNA, 64 nt, hsa; identical to SEQ ID NO: 411328

SEQ ID NO: 480988 - RNA, 64 nt, hsa; identical to SEQ ID NO: 411329

SEQ ID NO: 480989 - RNA, 64 nt, hsa; identical to SEQ ID NO: 411330

SEQ ID NO: 480990 - RNA, 64 nt, hsa; identical to SEQ ID NO: 411331

SEQ ID NO: 480991 - RNA, 52 nt, hsa; identical to SEQ ID NO: 264778

SEQ ID NO: 480992 - RNA, 64 nt, hsa; identical to SEQ ID NO: 411333

SEQ ID NO: 480993 - RNA, 64 nt, hsa; identical to SEQ ID NO: 411334

SEQ ID NO: 480994 - RNA, 64 nt, hsa; identical to SEQ ID NO: 411335

SEQ ID NO: 480995 - RNA, 64 nt, hsa; identical to SEQ ID NO: 411336

SEQ ID NO: 480996 - RNA, 64 nt, hsa; identical to SEQ ID NO: 411337

SEQ ID NO: 480997 - RNA, 64 nt, hsa; identical to SEQ ID NO: 411338

SEQ ID NO: 480998 - RNA, 64 nt, hsa; identical to SEQ ID NO: 411339

SEQ ID NO: 480999 - RNA, 64 nt, hsa; identical to SEQ ID NO: 411340

SEQ ID NO: 481000 - RNA, 64 nt, hsa; identical to SEQ ID NO: 411341

SEQ ID NO: 481001 - RNA, 64 nt, hsa; identical to SEQ ID NO: 411342

SEQ ID NO: 481002 - RNA, 64 nt, hsa; identical to SEQ ID NO: 411343

SEQ ID NO: 481003 - RNA, 64 nt, hsa; identical to SEQ ID NO: 411344

SEQ ID NO: 481004 - RNA, 64 nt, hsa; identical to SEQ ID NO: 411345

SEQ ID NO: 481005 - RNA, 64 nt, hsa; identical to SEQ ID NO: 411346

SEQ ID NO: 481006 - RNA, 64 nt, hsa; identical to SEQ ID NO: 411347

SEQ ID NO: 481007 - RNA, 64 nt, hsa; identical to SEQ ID NO: 411348

SEQ ID NO: 481008 - RNA, 64 nt, hsa; identical to SEQ ID NO: 411349

SEQ ID NO: 481009 - RNA, 63 nt, hsa
uaguaguaaggaagucaaauuuguuuuuuuaucauugauuauaagugguauauuuguuuuuug

SEQ ID NO: 481010 - RNA, 63 nt, hsa
cauugauuauaagugguauauuuguuuuuugucauugauuaaaagugauuuuagcccuaggcc

SEQ ID NO: 481011 - RNA, 63 nt, hsa
guuaccccaauucuaaauagguaccaaaagaguauugauuaugaccuggagccugagcuuugg

SEQ ID NO: 481012 - RNA, 63 nt, hsa
uaggaagcuuaaguaaauuucugauuuuccuuuauugauuauguaacccacgugauuugcaua

SEQ ID NO: 481013 - RNA, 63 nt, hsa
aguuaaagugucaugccuugaccaaucuaaugaauugauuaauuaacugggccuuuauacuua

SEQ ID NO: 481014 - RNA, 63 nt, hsa
cuaggaaguuagucuaauaauucacugcagaaaauugauuaaguggcuguccuuuuaauuaag

SEQ ID NO: 481015 - RNA, 63 nt, hsa
uuugaguccaugaaugcuauggucauuaaaauaauugauuauacuuuccuaaagaaaagccau

SEQ ID NO: 481016 - RNA, 63 nt, hsa
caacaaugcaaauucuucuucaagacugaagacauugauuagauauaaaauucaguuuaaaaa

SEQ ID NO: 481017 - RNA, 63 nt, hsa
auuaauaaucuuuugggaggguagaauaaaauaauugauuacuauugcugcauacccggggug

SEQ ID NO: 481018 - RNA, 63 nt, hsa
ggaacauuguguggguuuuguuuuguuuaauuuauugauuagucuuuaaaguaggcuuuuuuu

SEQ ID NO: 481019 - RNA, 63 nt, hsa
aaguauguuucauuauucuuucuaaauuugauaauugauuaggaaguauuuuauauauaacca

SEQ ID NO: 481020 - RNA, 63 nt, hsa
ccccuuaaaaugucuaguaaagcuugcacauggauugauuaaaagcaaauaccugucuuaggg

SEQ ID NO: 481021 - RNA, 63 nt, hsa
uggacaaaaagucuggaaacuuucauaucaauaauugauuauguauuaacugaaacaaaagac

SEQ ID NO: 481022 - RNA, 63 nt, hsa
ugaaacaaaagacuagagaaagacacagugggaauugauuauguauuaacugaggaauaaaag

SEQ ID NO: 481023 - RNA, 63 nt, hsa
gugaaugaaaauaugcuuguauuuaguaaaaugauugauuaugugacugugagauuccaagug

SEQ ID NO: 481024 - RNA, 63 nt, hsa
aauguucucuacauguuaggauauguuuuccuuauugauuacaacucagcuauaauccugagg

SEQ ID NO: 481025 - RNA, 64 nt, hsa; identical to SEQ ID NO: 394591

SEQ ID NO: 481026 - RNA, 64 nt, hsa; identical to SEQ ID NO: 394592

SEQ ID NO: 481027 - RNA, 64 nt, hsa; identical to SEQ ID NO: 394593

SEQ ID NO: 481028 - RNA, 64 nt, hsa; identical to SEQ ID NO: 394594

SEQ ID NO: 481029 - RNA, 64 nt, hsa; identical to SEQ ID NO: 394595

SEQ ID NO: 481030 - RNA, 64 nt, hsa; identical to SEQ ID NO: 394596

SEQ ID NO: 481031 - RNA, 64 nt, hsa; identical to SEQ ID NO: 394597

SEQ ID NO: 481032 - RNA, 64 nt, hsa; identical to SEQ ID NO: 394598

SEQ ID NO: 481033 - RNA, 64 nt, hsa; identical to SEQ ID NO: 394599

SEQ ID NO: 481034 - RNA, 64 nt, hsa; identical to SEQ ID NO: 394600

SEQ ID NO: 481035 - RNA, 64 nt, hsa; identical to SEQ ID NO: 394601

SEQ ID NO: 481036 - RNA, 64 nt, hsa; identical to SEQ ID NO: 394602

SEQ ID NO: 481037 - RNA, 64 nt, hsa; identical to SEQ ID NO: 394603

SEQ ID NO: 481038 - RNA, 64 nt, hsa; identical to SEQ ID NO: 394604

SEQ ID NO: 481039 - RNA, 64 nt, hsa; identical to SEQ ID NO: 394605

SEQ ID NO: 481040 - RNA, 64 nt, hsa; identical to SEQ ID NO: 394606

SEQ ID NO: 481041 - RNA, 64 nt, hsa; identical to SEQ ID NO: 394607

SEQ ID NO: 481042 - RNA, 64 nt, hsa; identical to SEQ ID NO: 394608

SEQ ID NO: 481043 - RNA, 64 nt, hsa; identical to SEQ ID NO: 394609

SEQ ID NO: 481044 - RNA, 64 nt, hsa; identical to SEQ ID NO: 394610

SEQ ID NO: 481045 - RNA, 64 nt, hsa; identical to SEQ ID NO: 455473

SEQ ID NO: 481046 - RNA, 64 nt, hsa; identical to SEQ ID NO: 455474

SEQ ID NO: 481047 - RNA, 64 nt, hsa; identical to SEQ ID NO: 455475

SEQ ID NO: 481048 - RNA, 64 nt, hsa; identical to SEQ ID NO: 455476

SEQ ID NO: 481049 - RNA, 64 nt, hsa; identical to SEQ ID NO: 455477

SEQ ID NO: 481050 - RNA, 64 nt, hsa; identical to SEQ ID NO: 455478

SEQ ID NO: 481051 - RNA, 64 nt, hsa; identical to SEQ ID NO: 455479

SEQ ID NO: 481052 - RNA, 64 nt, hsa; identical to SEQ ID NO: 455480

SEQ ID NO: 481053 - RNA, 64 nt, hsa; identical to SEQ ID NO: 455481

SEQ ID NO: 481054 - RNA, 64 nt, hsa; identical to SEQ ID NO: 455482

SEQ ID NO: 481055 - RNA, 64 nt, hsa
auguucuuuuuuguaaaauguuuguacauauguugucuuugauaauguugcuguaauuuuuuaa

SEQ ID NO: 481056 - RNA, 64 nt, hsa
aagccuguuucagcugccugaacgcaguuuggaugucuuugaggacagacauugcccggaaacu

SEQ ID NO: 481057 - RNA, 64 nt, hsa
uuuuauuaguuggccuguuuaaccaagacagaaagucuuugaauuacucauaguuuuaaacugc

SEQ ID NO: 481058 - RNA, 64 nt, hsa
guccuacugagaaaaugagcacuuugaucauucagucuuugaacuuuaaccuuugacuggaagu

SEQ ID NO: 481059 - RNA, 64 nt, hsa
gaggugguugucaauugaccuuacuaaguuagcugucuuugaugaggaauuauuguuauugguu

SEQ ID NO: 481060 - RNA, 64 nt, hsa
ccccagucagcauuauuuaacacuccccuuaacugucuuugaacuuucucuuuuaacaaaaaug

SEQ ID NO: 481061 - RNA, 64 nt, hsa
uuuaaagguagauuucuuccugguacuuuuaucugucuuugaaagugucugaacuuuaaaaagu

SEQ ID NO: 481062 - RNA, 64 nt, hsa
uuuugauuuguaacaaauauugugaucucacauugucuuugaaaguguggauguugguguuuug

SEQ ID NO: 481063 - RNA, 64 nt, hsa
ucugaaugugugcgcugguucucuuuaggugaucgucuuugaaguucagcaaagcugcuuguuc

SEQ ID NO: 481064 - RNA, 64 nt, hsa
uggcccaggauguagugaaagaacaaauccuagagucuuugaaauuucuaagggcauucuagac

SEQ ID NO: 481065 - RNA, 64 nt, hsa
cagcugugcuuguuaucuuccauucucacaaacugucuuugaagcaauagaauaaagaaugugu

SEQ ID NO: 481066 - RNA, 64 nt, hsa
gguuuuugcagacucgaagucucacugcaccagugucuuugaugguggugagggugggugaugg

SEQ ID NO: 481067 - RNA, 64 nt, hsa
cacacacaaaaaaggcaguaggaaaaaugcuggcccugaugaccuguccuuauucagaaugaga

SEQ ID NO: 481068 - RNA, 64 nt, hsa
auccucacguguucgguacugagcagccacuaccccugaugagaacaguaugaagaaagggggc

SEQ ID NO: 481069 - RNA, 64 nt, hsa
uucuucuaggcaucauguccuauaguuugucaucccugaugaauguaaaguuacacuguucaca

SEQ ID NO: 481070 - RNA, 64 nt, hsa
cugaaacauugagggaacacaaauuuaugggcuuccugaugaugauucuucuaggcaucauguc

SEQ ID NO: 481071 - RNA, 64 nt, hsa
ucagagaacuggaccccauccugacugaggucacccugaugaaugcccgcagugagcuauacuu

SEQ ID NO: 481072 - RNA, 64 nt, hsa
gugguauguugcaguuccggcauguucagaacaaccugaugagaaauucuacaacagaaaaaau

SEQ ID NO: 481073 - RNA, 64 nt, hsa
ccugaugacaacucuuaugccagcacaacuuugaccugaugaccucaucccagcccuugaucgc

SEQ ID NO: 481074 - RNA, 64 nt, hsa
ugagguugcuuguuucgucccugacuccuuaaccccugaugacaacucuuaugccagcacaacu

SEQ ID NO: 481075 - RNA, 64 nt, hsa; identical to SEQ ID NO: 236085

SEQ ID NO: 481076 - RNA, 64 nt, hsa; identical to SEQ ID NO: 236086

SEQ ID NO: 481077 - RNA, 64 nt, hsa; identical to SEQ ID NO: 236087

SEQ ID NO: 481078 - RNA, 64 nt, hsa; identical to SEQ ID NO: 236088

SEQ ID NO: 481079 - RNA, 64 nt, hsa; identical to SEQ ID NO: 236089

SEQ ID NO: 481080 - RNA, 64 nt, hsa; identical to SEQ ID NO: 236090

SEQ ID NO: 481081 - RNA, 64 nt, hsa; identical to SEQ ID NO: 236091

SEQ ID NO: 481082 - RNA, 64 nt, hsa; identical to SEQ ID NO: 236092

SEQ ID NO: 481083 - RNA, 64 nt, hsa; identical to SEQ ID NO: 236093

SEQ ID NO: 481084 - RNA, 64 nt, hsa; identical to SEQ ID NO: 236094

SEQ ID NO: 481085 - RNA, 64 nt, hsa; identical to SEQ ID NO: 236095

SEQ ID NO: 481086 - RNA, 64 nt, hsa; identical to SEQ ID NO: 236096

SEQ ID NO: 481087 - RNA, 64 nt, hsa; identical to SEQ ID NO: 236097

SEQ ID NO: 481088 - RNA, 64 nt, hsa; identical to SEQ ID NO: 236098

SEQ ID NO: 481089 - RNA, 64 nt, hsa; identical to SEQ ID NO: 236099

SEQ ID NO: 481090 - RNA, 64 nt, hsa; identical to SEQ ID NO: 236100

SEQ ID NO: 481091 - RNA, 64 nt, hsa; identical to SEQ ID NO: 236101

SEQ ID NO: 481092 - RNA, 64 nt, hsa; identical to SEQ ID NO: 236102

SEQ ID NO: 481093 - RNA, 64 nt, hsa; identical to SEQ ID NO: 236103

SEQ ID NO: 481094 - RNA, 64 nt, hsa; identical to SEQ ID NO: 236104

SEQ ID NO: 481095 - RNA, 64 nt, hsa; identical to SEQ ID NO: 236105

SEQ ID NO: 481096 - RNA, 64 nt, hsa; identical to SEQ ID NO: 236106

SEQ ID NO: 481097 - RNA, 64 nt, hsa; identical to SEQ ID NO: 236107

SEQ ID NO: 481098 - RNA, 64 nt, hsa; identical to SEQ ID NO: 236108

SEQ ID NO: 481099 - RNA, 64 nt, hsa; identical to SEQ ID NO: 236109

SEQ ID NO: 481100 - RNA, 64 nt, hsa; identical to SEQ ID NO: 236110

SEQ ID NO: 481101 - RNA, 64 nt, hsa; identical to SEQ ID NO: 236111

SEQ ID NO: 481102 - RNA, 64 nt, hsa; identical to SEQ ID NO: 236112

SEQ ID NO: 481103 - RNA, 64 nt, hsa; identical to SEQ ID NO: 236113

SEQ ID NO: 481104 - RNA, 64 nt, hsa; identical to SEQ ID NO: 236114

SEQ ID NO: 481105 - RNA, 64 nt, hsa; identical to SEQ ID NO: 236115

SEQ ID NO: 481106 - RNA, 64 nt, hsa; identical to SEQ ID NO: 236116

SEQ ID NO: 481107 - RNA, 64 nt, hsa; identical to SEQ ID NO: 236117

SEQ ID NO: 481108 - RNA, 64 nt, hsa; identical to SEQ ID NO: 236118

SEQ ID NO: 481109 - RNA, 64 nt, hsa; identical to SEQ ID NO: 236119

SEQ ID NO: 481110 - RNA, 64 nt, hsa; identical to SEQ ID NO: 236120

SEQ ID NO: 481111 - RNA, 64 nt, hsa; identical to SEQ ID NO: 236121

SEQ ID NO: 481112 - RNA, 64 nt, hsa; identical to SEQ ID NO: 236122

SEQ ID NO: 481113 - RNA, 64 nt, hsa; identical to SEQ ID NO: 236123

SEQ ID NO: 481114 - RNA, 64 nt, hsa; identical to SEQ ID NO: 236124

SEQ ID NO: 481115 - RNA, 64 nt, hsa; identical to SEQ ID NO: 236125

SEQ ID NO: 481116 - RNA, 64 nt, hsa; identical to SEQ ID NO: 236126

SEQ ID NO: 481117 - RNA, 64 nt, hsa; identical to SEQ ID NO: 236127

SEQ ID NO: 481118 - RNA, 64 nt, hsa; identical to SEQ ID NO: 236128

SEQ ID NO: 481119 - RNA, 64 nt, hsa; identical to SEQ ID NO: 236129

SEQ ID NO: 481120 - RNA, 64 nt, hsa; identical to SEQ ID NO: 236130

SEQ ID NO: 481121 - RNA, 64 nt, hsa; identical to SEQ ID NO: 236131

SEQ ID NO: 481122 - RNA, 64 nt, hsa; identical to SEQ ID NO: 236132

SEQ ID NO: 481123 - RNA, 64 nt, hsa; identical to SEQ ID NO: 236133

SEQ ID NO: 481124 - RNA, 64 nt, hsa; identical to SEQ ID NO: 236134

SEQ ID NO: 481125 - RNA, 64 nt, hsa; identical to SEQ ID NO: 236135

SEQ ID NO: 481126 - RNA, 64 nt, hsa; identical to SEQ ID NO: 236136

SEQ ID NO: 481127 - RNA, 64 nt, hsa; identical to SEQ ID NO: 236137

SEQ ID NO: 481128 - RNA, 64 nt, hsa; identical to SEQ ID NO: 236138

SEQ ID NO: 481129 - RNA, 64 nt, hsa; identical to SEQ ID NO: 236139

SEQ ID NO: 481130 - RNA, 64 nt, hsa; identical to SEQ ID NO: 236140

SEQ ID NO: 481131 - RNA, 64 nt, hsa; identical to SEQ ID NO: 236141

SEQ ID NO: 481132 - RNA, 64 nt, hsa; identical to SEQ ID NO: 53373

SEQ ID NO: 481133 - RNA, 64 nt, hsa; identical to SEQ ID NO: 53374

SEQ ID NO: 481134 - RNA, 64 nt, hsa; identical to SEQ ID NO: 53375

SEQ ID NO: 481135 - RNA, 64 nt, hsa; identical to SEQ ID NO: 53376

SEQ ID NO: 481136 - RNA, 64 nt, hsa; identical to SEQ ID NO: 53377

SEQ ID NO: 481137 - RNA, 64 nt, hsa; identical to SEQ ID NO: 53378

SEQ ID NO: 481138 - RNA, 64 nt, hsa; identical to SEQ ID NO: 53379

SEQ ID NO: 481139 - RNA, 64 nt, hsa; identical to SEQ ID NO: 53380

SEQ ID NO: 481140 - RNA, 64 nt, hsa; identical to SEQ ID NO: 53381

SEQ ID NO: 481141 - RNA, 64 nt, hsa; identical to SEQ ID NO: 53382

SEQ ID NO: 481142 - RNA, 64 nt, hsa; identical to SEQ ID NO: 53383

SEQ ID NO: 481143 - RNA, 64 nt, hsa; identical to SEQ ID NO: 53384

SEQ ID NO: 481144 - RNA, 64 nt, hsa; identical to SEQ ID NO: 53385

SEQ ID NO: 481145 - RNA, 64 nt, hsa; identical to SEQ ID NO: 53386

SEQ ID NO: 481146 - RNA, 64 nt, hsa; identical to SEQ ID NO: 53387

SEQ ID NO: 481147 - RNA, 64 nt, hsa; identical to SEQ ID NO: 53388

SEQ ID NO: 481148 - RNA, 64 nt, hsa; identical to SEQ ID NO: 53389

SEQ ID NO: 481149 - RNA, 64 nt, hsa; identical to SEQ ID NO: 53390

SEQ ID NO: 481150 - RNA, 64 nt, hsa; identical to SEQ ID NO: 53391

SEQ ID NO: 481151 - RNA, 64 nt, hsa; identical to SEQ ID NO: 53392

SEQ ID NO: 481152 - RNA, 64 nt, hsa; identical to SEQ ID NO: 53393

SEQ ID NO: 481153 - RNA, 64 nt, hsa; identical to SEQ ID NO: 53394

SEQ ID NO: 481154 - RNA, 64 nt, hsa; identical to SEQ ID NO: 53395

SEQ ID NO: 481155 - RNA, 64 nt, hsa; identical to SEQ ID NO: 53396

SEQ ID NO: 481156 - RNA, 64 nt, hsa; identical to SEQ ID NO: 53397

SEQ ID NO: 481157 - RNA, 64 nt, hsa; identical to SEQ ID NO: 53398

SEQ ID NO: 481158 - RNA, 64 nt, hsa; identical to SEQ ID NO: 53399

SEQ ID NO: 481159 - RNA, 64 nt, hsa; identical to SEQ ID NO: 53400

SEQ ID NO: 481160 - RNA, 64 nt, hsa; identical to SEQ ID NO: 53401

SEQ ID NO: 481161 - RNA, 64 nt, hsa; identical to SEQ ID NO: 53402

SEQ ID NO: 481162 - RNA, 64 nt, hsa; identical to SEQ ID NO: 53403

SEQ ID NO: 481163 - RNA, 64 nt, hsa; identical to SEQ ID NO: 53404

SEQ ID NO: 481164 - RNA, 64 nt, hsa; identical to SEQ ID NO: 53405

SEQ ID NO: 481165 - RNA, 64 nt, hsa; identical to SEQ ID NO: 53406

SEQ ID NO: 481166 - RNA, 64 nt, hsa; identical to SEQ ID NO: 53407

SEQ ID NO: 481167 - RNA, 64 nt, hsa; identical to SEQ ID NO: 53408

SEQ ID NO: 481168 - RNA, 64 nt, hsa; identical to SEQ ID NO: 53409

SEQ ID NO: 481169 - RNA, 64 nt, hsa; identical to SEQ ID NO: 53410

SEQ ID NO: 481170 - RNA, 64 nt, hsa; identical to SEQ ID NO: 53411

SEQ ID NO: 481171 - RNA, 64 nt, hsa; identical to SEQ ID NO: 53412

SEQ ID NO: 481172 - RNA, 64 nt, hsa; identical to SEQ ID NO: 53413

SEQ ID NO: 481173 - RNA, 64 nt, hsa; identical to SEQ ID NO: 53414

SEQ ID NO: 481174 - RNA, 64 nt, hsa; identical to SEQ ID NO: 53415

SEQ ID NO: 481175 - RNA, 64 nt, hsa; identical to SEQ ID NO: 53416

SEQ ID NO: 481176 - RNA, 64 nt, hsa; identical to SEQ ID NO: 53417

SEQ ID NO: 481177 - RNA, 64 nt, hsa; identical to SEQ ID NO: 53418

SEQ ID NO: 481178 - RNA, 64 nt, hsa; identical to SEQ ID NO: 53419

SEQ ID NO: 481179 - RNA, 64 nt, hsa; identical to SEQ ID NO: 53420

SEQ ID NO: 481180 - RNA, 64 nt, hsa; identical to SEQ ID NO: 53421

SEQ ID NO: 481181 - RNA, 64 nt, hsa; identical to SEQ ID NO: 53422

SEQ ID NO: 481182 - RNA, 64 nt, hsa; identical to SEQ ID NO: 53423

SEQ ID NO: 481183 - RNA, 64 nt, hsa; identical to SEQ ID NO: 53424

SEQ ID NO: 481184 - RNA, 64 nt, hsa; identical to SEQ ID NO: 53425

SEQ ID NO: 481185 - RNA, 64 nt, hsa; identical to SEQ ID NO: 53426

SEQ ID NO: 481186 - RNA, 64 nt, hsa; identical to SEQ ID NO: 236085

SEQ ID NO: 481187 - RNA, 64 nt, hsa; identical to SEQ ID NO: 236086

SEQ ID NO: 481188 - RNA, 64 nt, hsa; identical to SEQ ID NO: 236087

SEQ ID NO: 481189 - RNA, 64 nt, hsa; identical to SEQ ID NO: 236088

SEQ ID NO: 481190 - RNA, 64 nt, hsa; identical to SEQ ID NO: 236089

SEQ ID NO: 481191 - RNA, 64 nt, hsa; identical to SEQ ID NO: 236090

SEQ ID NO: 481192 - RNA, 64 nt, hsa; identical to SEQ ID NO: 236091

SEQ ID NO: 481193 - RNA, 64 nt, hsa; identical to SEQ ID NO: 236092

SEQ ID NO: 481194 - RNA, 64 nt, hsa; identical to SEQ ID NO: 236093

SEQ ID NO: 481195 - RNA, 64 nt, hsa; identical to SEQ ID NO: 236094

SEQ ID NO: 481196 - RNA, 64 nt, hsa; identical to SEQ ID NO: 236095

SEQ ID NO: 481197 - RNA, 64 nt, hsa; identical to SEQ ID NO: 236096

SEQ ID NO: 481198 - RNA, 64 nt, hsa; identical to SEQ ID NO: 236097

SEQ ID NO: 481199 - RNA, 64 nt, hsa; identical to SEQ ID NO: 236098

SEQ ID NO: 481200 - RNA, 64 nt, hsa; identical to SEQ ID NO: 236099

SEQ ID NO: 481201 - RNA, 64 nt, hsa; identical to SEQ ID NO: 236100

SEQ ID NO: 481202 - RNA, 64 nt, hsa; identical to SEQ ID NO: 236101

SEQ ID NO: 481203 - RNA, 64 nt, hsa; identical to SEQ ID NO: 236102

SEQ ID NO: 481204 - RNA, 64 nt, hsa; identical to SEQ ID NO: 236103

SEQ ID NO: 481205 - RNA, 64 nt, hsa; identical to SEQ ID NO: 236104

SEQ ID NO: 481206 - RNA, 64 nt, hsa; identical to SEQ ID NO: 236105

SEQ ID NO: 481207 - RNA, 64 nt, hsa; identical to SEQ ID NO: 236106

SEQ ID NO: 481208 - RNA, 64 nt, hsa; identical to SEQ ID NO: 236107

SEQ ID NO: 481209 - RNA, 64 nt, hsa; identical to SEQ ID NO: 236108

SEQ ID NO: 481210 - RNA, 64 nt, hsa; identical to SEQ ID NO: 236109

SEQ ID NO: 481211 - RNA, 64 nt, hsa; identical to SEQ ID NO: 236110

SEQ ID NO: 481212 - RNA, 64 nt, hsa; identical to SEQ ID NO: 236111

SEQ ID NO: 481213 - RNA, 64 nt, hsa; identical to SEQ ID NO: 236112

SEQ ID NO: 481214 - RNA, 64 nt, hsa; identical to SEQ ID NO: 236113

SEQ ID NO: 481215 - RNA, 64 nt, hsa; identical to SEQ ID NO: 236114

SEQ ID NO: 481216 - RNA, 64 nt, hsa; identical to SEQ ID NO: 236115

SEQ ID NO: 481217 - RNA, 64 nt, hsa; identical to SEQ ID NO: 236116

SEQ ID NO: 481218 - RNA, 64 nt, hsa; identical to SEQ ID NO: 236117

SEQ ID NO: 481219 - RNA, 64 nt, hsa; identical to SEQ ID NO: 236118

SEQ ID NO: 481220 - RNA, 64 nt, hsa; identical to SEQ ID NO: 236119

SEQ ID NO: 481221 - RNA, 64 nt, hsa; identical to SEQ ID NO: 236120

SEQ ID NO: 481222 - RNA, 64 nt, hsa; identical to SEQ ID NO: 236121

SEQ ID NO: 481223 - RNA, 64 nt, hsa; identical to SEQ ID NO: 236122

SEQ ID NO: 481224 - RNA, 64 nt, hsa; identical to SEQ ID NO: 236123

SEQ ID NO: 481225 - RNA, 64 nt, hsa; identical to SEQ ID NO: 236124

SEQ ID NO: 481226 - RNA, 64 nt, hsa; identical to SEQ ID NO: 236125

SEQ ID NO: 481227 - RNA, 64 nt, hsa; identical to SEQ ID NO: 236126

SEQ ID NO: 481228 - RNA, 64 nt, hsa; identical to SEQ ID NO: 236127

SEQ ID NO: 481229 - RNA, 64 nt, hsa; identical to SEQ ID NO: 236128

SEQ ID NO: 481230 - RNA, 64 nt, hsa; identical to SEQ ID NO: 236129

SEQ ID NO: 481231 - RNA, 64 nt, hsa; identical to SEQ ID NO: 236130

SEQ ID NO: 481232 - RNA, 64 nt, hsa; identical to SEQ ID NO: 236131

SEQ ID NO: 481233 - RNA, 64 nt, hsa; identical to SEQ ID NO: 236132

SEQ ID NO: 481234 - RNA, 64 nt, hsa; identical to SEQ ID NO: 236133

SEQ ID NO: 481235 - RNA, 64 nt, hsa; identical to SEQ ID NO: 236134

SEQ ID NO: 481236 - RNA, 64 nt, hsa; identical to SEQ ID NO: 236135

SEQ ID NO: 481237 - RNA, 64 nt, hsa; identical to SEQ ID NO: 236136

SEQ ID NO: 481238 - RNA, 64 nt, hsa; identical to SEQ ID NO: 236137

SEQ ID NO: 481239 - RNA, 64 nt, hsa; identical to SEQ ID NO: 236138

SEQ ID NO: 481240 - RNA, 64 nt, hsa; identical to SEQ ID NO: 236139

SEQ ID NO: 481241 - RNA, 64 nt, hsa; identical to SEQ ID NO: 236140

SEQ ID NO: 481242 - RNA, 64 nt, hsa; identical to SEQ ID NO: 236141

SEQ ID NO: 481243 - RNA, 64 nt, hsa; identical to SEQ ID NO: 53373

SEQ ID NO: 481244 - RNA, 64 nt, hsa; identical to SEQ ID NO: 53374

SEQ ID NO: 481245 - RNA, 64 nt, hsa; identical to SEQ ID NO: 53375

SEQ ID NO: 481246 - RNA, 64 nt, hsa; identical to SEQ ID NO: 53376

SEQ ID NO: 481247 - RNA, 64 nt, hsa; identical to SEQ ID NO: 53377

SEQ ID NO: 481248 - RNA, 64 nt, hsa; identical to SEQ ID NO: 53378

SEQ ID NO: 481249 - RNA, 64 nt, hsa; identical to SEQ ID NO: 53379

SEQ ID NO: 481250 - RNA, 64 nt, hsa; identical to SEQ ID NO: 53380

SEQ ID NO: 481251 - RNA, 64 nt, hsa; identical to SEQ ID NO: 53381

SEQ ID NO: 481252 - RNA, 64 nt, hsa; identical to SEQ ID NO: 53382

SEQ ID NO: 481253 - RNA, 64 nt, hsa; identical to SEQ ID NO: 53383

SEQ ID NO: 481254 - RNA, 64 nt, hsa; identical to SEQ ID NO: 53384

SEQ ID NO: 481255 - RNA, 64 nt, hsa; identical to SEQ ID NO: 53385

SEQ ID NO: 481256 - RNA, 64 nt, hsa; identical to SEQ ID NO: 53386

SEQ ID NO: 481257 - RNA, 64 nt, hsa; identical to SEQ ID NO: 53387

SEQ ID NO: 481258 - RNA, 64 nt, hsa; identical to SEQ ID NO: 53388

SEQ ID NO: 481259 - RNA, 64 nt, hsa; identical to SEQ ID NO: 53389

SEQ ID NO: 481260 - RNA, 64 nt, hsa; identical to SEQ ID NO: 53390

SEQ ID NO: 481261 - RNA, 64 nt, hsa; identical to SEQ ID NO: 53391

SEQ ID NO: 481262 - RNA, 64 nt, hsa; identical to SEQ ID NO: 53392

SEQ ID NO: 481263 - RNA, 64 nt, hsa; identical to SEQ ID NO: 53393

SEQ ID NO: 481264 - RNA, 64 nt, hsa; identical to SEQ ID NO: 53394

SEQ ID NO: 481265 - RNA, 64 nt, hsa; identical to SEQ ID NO: 53395

SEQ ID NO: 481266 - RNA, 64 nt, hsa; identical to SEQ ID NO: 53396

SEQ ID NO: 481267 - RNA, 64 nt, hsa; identical to SEQ ID NO: 53397

SEQ ID NO: 481268 - RNA, 64 nt, hsa; identical to SEQ ID NO: 53398

SEQ ID NO: 481269 - RNA, 64 nt, hsa; identical to SEQ ID NO: 53399

SEQ ID NO: 481270 - RNA, 64 nt, hsa; identical to SEQ ID NO: 53400

SEQ ID NO: 481271 - RNA, 64 nt, hsa; identical to SEQ ID NO: 53401

SEQ ID NO: 481272 - RNA, 64 nt, hsa; identical to SEQ ID NO: 53402

SEQ ID NO: 481273 - RNA, 64 nt, hsa; identical to SEQ ID NO: 53403

SEQ ID NO: 481274 - RNA, 64 nt, hsa; identical to SEQ ID NO: 53404

SEQ ID NO: 481275 - RNA, 64 nt, hsa; identical to SEQ ID NO: 53405

SEQ ID NO: 481276 - RNA, 64 nt, hsa; identical to SEQ ID NO: 53406

SEQ ID NO: 481277 - RNA, 64 nt, hsa; identical to SEQ ID NO: 53407

SEQ ID NO: 481278 - RNA, 64 nt, hsa; identical to SEQ ID NO: 53408

SEQ ID NO: 481279 - RNA, 64 nt, hsa; identical to SEQ ID NO: 53409

SEQ ID NO: 481280 - RNA, 64 nt, hsa; identical to SEQ ID NO: 53410

SEQ ID NO: 481281 - RNA, 64 nt, hsa; identical to SEQ ID NO: 53411

SEQ ID NO: 481282 - RNA, 64 nt, hsa; identical to SEQ ID NO: 53412

SEQ ID NO: 481283 - RNA, 64 nt, hsa; identical to SEQ ID NO: 53413

SEQ ID NO: 481284 - RNA, 64 nt, hsa; identical to SEQ ID NO: 53414

SEQ ID NO: 481285 - RNA, 64 nt, hsa; identical to SEQ ID NO: 53415

SEQ ID NO: 481286 - RNA, 64 nt, hsa; identical to SEQ ID NO: 53416

SEQ ID NO: 481287 - RNA, 64 nt, hsa; identical to SEQ ID NO: 53417

SEQ ID NO: 481288 - RNA, 64 nt, hsa; identical to SEQ ID NO: 53418

SEQ ID NO: 481289 - RNA, 64 nt, hsa; identical to SEQ ID NO: 53419

SEQ ID NO: 481290 - RNA, 64 nt, hsa; identical to SEQ ID NO: 53420

SEQ ID NO: 481291 - RNA, 64 nt, hsa; identical to SEQ ID NO: 53421

SEQ ID NO: 481292 - RNA, 64 nt, hsa; identical to SEQ ID NO: 53422

SEQ ID NO: 481293 - RNA, 64 nt, hsa; identical to SEQ ID NO: 53423

SEQ ID NO: 481294 - RNA, 64 nt, hsa; identical to SEQ ID NO: 53424

SEQ ID NO: 481295 - RNA, 64 nt, hsa; identical to SEQ ID NO: 53425

SEQ ID NO: 481296 - RNA, 64 nt, hsa; identical to SEQ ID NO: 53426

SEQ ID NO: 481297 - RNA, 64 nt, hsa; identical to SEQ ID NO: 179118

SEQ ID NO: 481298 - RNA, 64 nt, hsa; identical to SEQ ID NO: 179119

SEQ ID NO: 481299 - RNA, 64 nt, hsa; identical to SEQ ID NO: 179120

SEQ ID NO: 481300 - RNA, 64 nt, hsa; identical to SEQ ID NO: 179121

SEQ ID NO: 481301 - RNA, 64 nt, hsa; identical to SEQ ID NO: 179122

SEQ ID NO: 481302 - RNA, 64 nt, hsa; identical to SEQ ID NO: 179123

SEQ ID NO: 481303 - RNA, 64 nt, hsa; identical to SEQ ID NO: 179124

SEQ ID NO: 481304 - RNA, 64 nt, hsa; identical to SEQ ID NO: 179125

SEQ ID NO: 481305 - RNA, 64 nt, hsa; identical to SEQ ID NO: 179126

SEQ ID NO: 481306 - RNA, 64 nt, hsa; identical to SEQ ID NO: 179127

SEQ ID NO: 481307 - RNA, 64 nt, hsa; identical to SEQ ID NO: 179128

SEQ ID NO: 481308 - RNA, 64 nt, hsa; identical to SEQ ID NO: 179129

SEQ ID NO: 481309 - RNA, 64 nt, hsa; identical to SEQ ID NO: 179130

SEQ ID NO: 481310 - RNA, 64 nt, hsa; identical to SEQ ID NO: 179131

SEQ ID NO: 481311 - RNA, 64 nt, hsa; identical to SEQ ID NO: 179132

SEQ ID NO: 481312 - RNA, 64 nt, hsa; identical to SEQ ID NO: 179133

SEQ ID NO: 481313 - RNA, 64 nt, hsa; identical to SEQ ID NO: 179134

SEQ ID NO: 481314 - RNA, 64 nt, hsa; identical to SEQ ID NO: 179135

SEQ ID NO: 481315 - RNA, 64 nt, hsa; identical to SEQ ID NO: 179136

SEQ ID NO: 481316 - RNA, 64 nt, hsa; identical to SEQ ID NO: 179137

SEQ ID NO: 481317 - RNA, 64 nt, hsa; identical to SEQ ID NO: 179138

SEQ ID NO: 481318 - RNA, 64 nt, hsa; identical to SEQ ID NO: 179139

SEQ ID NO: 481319 - RNA, 64 nt, hsa; identical to SEQ ID NO: 179140

SEQ ID NO: 481320 - RNA, 64 nt, hsa; identical to SEQ ID NO: 179141

SEQ ID NO: 481321 - RNA, 64 nt, hsa
aggccgaggcggguggaucacgaggucaggagaucgagaccauccuggcuaacacagugaaacg

SEQ ID NO: 481322 - RNA, 64 nt, hsa
aggccgaggggggcggaucgugaagucaggagaucgagaccauccuggcuaacauggugaaacc

SEQ ID NO: 481323 - RNA, 64 nt, hsa
aggccaaggugggcggaucacaaggucaggagaucgagaccauccuggcgaacacggugaaacc

SEQ ID NO: 481324 - RNA, 64 nt, hsa
gccgaggcagguggaucaccugaggucaggaguucgagaccagccugaccaacauggcgaaacc

SEQ ID NO: 481325 - RNA, 64 nt, hsa
aggccgaggcaggcggaucacaagguccagagaucgagaccauccuggccaacauggugaaacc

SEQ ID NO: 481326 - RNA, 64 nt, hsa
aggccaaggugggcggaucaugaggucaggagaucgagaccauccugaccaacguggugaaacc

SEQ ID NO: 481327 - RNA, 64 nt, hsa
aggcgggugaaucacuugauugaggucaggaguucgagaccagccuggccaacauggcaaaacc

SEQ ID NO: 481328 - RNA, 64 nt, hsa
gccgaggaggguggaucacuugaggucaggaguucgagaccagccugaccaacauggcgaaacc

SEQ ID NO: 481329 - RNA, 64 nt, hsa
ccaaggcaggcuggaucaccugaggacaggaguucgagaccagucuggccaacauggggaaacc

SEQ ID NO: 481330 - RNA, 64 nt, hsa
gccaaggugggaggauggcuuguguccagaaguucgagaccagccuggacaacauagugagauc

SEQ ID NO: 481331 - RNA, 64 nt, hsa
gccaaggcugguggaucaccugaggucaggaguucgagaccagccuggccaacacggugaaacc

SEQ ID NO: 481332 - RNA, 64 nt, hsa
gcugagauggguggaucaccugagguugggaguucgagaccagccugacaaaacauagugaaac

SEQ ID NO: 481333 - RNA, 64 nt, hsa
gccaaggcaggugggucaccuggggucaggaguucgagaccagccugaccaauauggugaaacc

SEQ ID NO: 481334 - RNA, 64 nt, hsa
aggccuaggcgggcggaucaugaagucaagaguucgagaccagcaauggccaguauggugaaac

SEQ ID NO: 481335 - RNA, 64 nt, hsa
gucggaaaugaucuggcugaauccgugguggcaccgagaccaaacucauucaccaaaugaugcc

SEQ ID NO: 481336 - RNA, 64 nt, hsa
aggccgaggcggguggaucaugaggucaggagaucgagaccauccuggcuaacacgugaaaccc

SEQ ID NO: 481337 - RNA, 64 nt, hsa
aggccgaggcgggcagaucacgaggucaggagaucgagaccauccuggcuaacacggugaaacc

SEQ ID NO: 481338 - RNA, 64 nt, hsa
acugaggcaggaggaucacuuaaggccaggaguucgagaccagccugggcaacagcaagaccuc

SEQ ID NO: 481339 - RNA, 64 nt, hsa
gcugagaugggcagaucacuugaggucaggaguucgagaccagccuggccaacauggugaaacc

SEQ ID NO: 481340 - RNA, 64 nt, hsa
gccaaggagggaggaucacuugaacucaggaauucgagaccagccugggcuacauagugagacc

SEQ ID NO: 481341 - RNA, 64 nt, hsa
aggccgaggcggguggaucacaaggucagcagaucgagaccauccuggccaacauggugaaacc

SEQ ID NO: 481342 - RNA, 64 nt, hsa
gccgaggugggaggaucacuugagcccaggaguucgagaccagccuaggcaacauagcaagacc

SEQ ID NO: 481343 - RNA, 64 nt, hsa
ccgggcgugguggcucacgcugaggucaggaguucgagaccagccuggccaaccaacaugguga

SEQ ID NO: 481344 - RNA, 64 nt, hsa
gccgaggugggcagaucagcugaggucaggagaucgagaccagccuggccaacauggcgaaacc

SEQ ID NO: 481345 - RNA, 64 nt, hsa
ugauggaaagacuuaaagaugaauuugagaaaaauugaaagaaauuagauuaucagguucuguu

SEQ ID NO: 481346 - RNA, 64 nt, hsa
auuacaagucuuucacagaaguuuggugguaauauugaaagaacuagcauugggcagaaugugu

SEQ ID NO: 481347 - RNA, 64 nt, hsa
ugguaauaaacaugaaaacugguuuguagcaguuuugaaagaauagaaugcauucaaauguaag

SEQ ID NO: 481348 - RNA, 64 nt, hsa
uaaacauucuauauauucuaugccugcucuagaauugaaagacuucagcaguauuaaagcauuu

SEQ ID NO: 481349 - RNA, 64 nt, hsa
ugggaaaaaaaugcaauuguugcugugagugacuuugaaagacucuggugccuuguggugcccu

SEQ ID NO: 481350 - RNA, 64 nt, hsa
ugggggccccugaugccaagagcucuggagguucuugaaagaggggacacgaaggaggagugac

SEQ ID NO: 481351 - RNA, 64 nt, hsa
gaccauuauaauaaagcauggccccgugaggguuuugaaagagagagagacuuggcuuccuuag

SEQ ID NO: 481352 - RNA, 63 nt, hsa
aggagaagcgugcugaauaggauucuucucaguuugaaagacaaugaaaaaugguuuuguaug

SEQ ID NO: 481353 - RNA, 64 nt, hsa
aucauaacuguuaauucucagccaucuuugaagcuugaaagaagagucuuugguauuuuguaaa

SEQ ID NO: 481354 - RNA, 64 nt, hsa
ucauuuuaaaacuuuuuuuuaacuaauaauagcuuugaaagaagaggcuuaauuuggggguggu

SEQ ID NO: 481355 - RNA, 64 nt, hsa
uuacucacugcugcaaauacuguauauucaggacuugaaagaaauggugaaugccuauggugga

SEQ ID NO: 481356 - RNA, 64 nt, hsa
uuguuuuggauauaguauaagcagugucuguguuuugaaagaauagaacacaguuuguagugcc

SEQ ID NO: 481357 - RNA, 64 nt, hsa
aaugggucuuggaguauagauuuuuauuaguagcuugaaagagcuuaaucauaugcaguaagua

SEQ ID NO: 481358 - RNA, 64 nt, hsa
ggcaucuaucuugaaaguaaucuuguauuggagauugaaagaugcuguaauuuagaaauuaaca

SEQ ID NO: 481359 - RNA, 64 nt, hsa
ucuguccaggagaacagaagggaaaaaaagauacuugaaagaaacugaaggaaauuuaaacaaa

SEQ ID NO: 481360 - RNA, 64 nt, hsa
aaagaaacugaaggaaauuuaaacaaagaaacacuugaaagaaacuggaaagaaaaauaauuuu

SEQ ID NO: 481361 - RNA, 64 nt, hsa
ugugacuuccuuggaaaucaaauguaaaguuuaauugaaagaauguaaagcaaccaaaaagaaa

SEQ ID NO: 481362 - RNA, 64 nt, hsa
ggaccaugguuaagcaaccauauagaaagcuuuguugaaagaaaguauggcaucuuguaccacu

SEQ ID NO: 481363 - RNA, 64 nt, hsa
cuauuaucuauuacucuugagagcuggcuguccuuugaaagaaagaaguaauguucuuugaaag

SEQ ID NO: 481364 - RNA, 64 nt, hsa
cuggcuguccuuugaaagaaagaaguaauguucuuugaaagaaagaaaaaucucuugcuguguc

SEQ ID NO: 481365 - RNA, 64 nt, hsa
ugugauuuauuaauuuuaaaacauucagaacuuguugaaagaaaaauuauaucugaaucaagau

SEQ ID NO: 481366 - RNA, 64 nt, hsa
gaguucgaaagaagaagcaagcgcuggccuggccuugaaagaaccgaagucuuucccauucacu

SEQ ID NO: 481367 - RNA, 64 nt, hsa
gggggggggggguguugucugcagaaccaccaccuugaaagauccauguucuuagagccucagc

SEQ ID NO: 481368 - RNA, 64 nt, hsa
auuuuuugccagauaaaaauguagucauuuuuauuugaaagaugugcuuuuuguuuuuguauau

SEQ ID NO: 481369 - RNA, 64 nt, hsa
aguucuuuguuauuuuuguuucuuccaaagcacauugaaagagaaccaguuucagguguuuagu

SEQ ID NO: 481370 - RNA, 64 nt, hsa
caacuucauuugaugcuaaauaggagauaccagguugaaagaccuucuccaaaugagaucuaag

SEQ ID NO: 481371 - RNA, 64 nt, hsa
uugcagacuaaauuauuuuauaaggcuguugcuauugaaagaucaauuuugucuuuaccugcau

SEQ ID NO: 481372 - RNA, 64 nt, hsa
cucuauuugcagcuuuuauguuuaaauuaguuacuugaaagaauguaguaauuuuaggaagaag

SEQ ID NO: 481373 - RNA, 64 nt, hsa
auaucucaccucuaggauaugauggaagaagugcuugaaagagaauuuuagcagaugguacuuu

SEQ ID NO: 481374 - RNA, 64 nt, hsa
auuuagauaauguaacaggauuuuagagagcacuuugaaagauaacauuuuauuaugauggugc

SEQ ID NO: 481375 - RNA, 64 nt, hsa
gugaagauagucuguugaagauugaacaaugaccuugaaagacagcugaguugcuguggguaua

SEQ ID NO: 481376 - RNA, 64 nt, hsa
ggcauagguggguauuuuagauguuugaguaaauuugaaagaguaugauguuuaaauuaccuuu

SEQ ID NO: 481377 - RNA, 64 nt, hsa
aucaguaacuuugcuugccacggaaaagguguuuuugaaagauguggcuauaaugagaauugca

SEQ ID NO: 481378 - RNA, 64 nt, hsa
aaggggcaaguuucacccaaaugccugagacugcuugaaagauauauuuuaaguggugcacuaa

SEQ ID NO: 481379 - RNA, 64 nt, hsa
ucauuauaauucugagcaggaaauuuauaagaaauugaaagagcagaagaauuacagcccuguc

SEQ ID NO: 481380 - RNA, 64 nt, hsa
uuauuuuugccaguguacuauaccucaguccuauuugaaagaccuaauugaaagaaaaaucaua

SEQ ID NO: 481381 - RNA, 64 nt, hsa
uguacuauaccucaguccuauuugaaagaccuaauugaaagaaaaaucauagaaauaaguaaaa

SEQ ID NO: 481382 - RNA, 64 nt, hsa
ucagcauuuuaucauuccauggaaggagaaucuuuugaaagaaagcauugccuccuaccagaac

SEQ ID NO: 481383 - RNA, 64 nt, hsa
gaucugggaaaccaacauugcgagaguagcuauuuugaaagaauaauucuccagaaguuaacau

SEQ ID NO: 481384 - RNA, 64 nt, hsa
uacuuacauugaaccugguggcauaaugaguauuuugaaagaagaaauuucuucacucucauuu

SEQ ID NO: 481385 - RNA, 64 nt, hsa
gguuucaaaucuugcaucuuccuuuuuuagauuuuugaaagaaaacccuuugguuucauugugu

SEQ ID NO: 481386 - RNA, 64 nt, hsa
ucauaacaucugggucuacucaaacacuuauuguuugaaagacuuaugucuuggaccuaucaaa

SEQ ID NO: 481387 - RNA, 64 nt, hsa
uugucauaugcuccuagagaggagaaaggggugauugaaagaaaaaaaaauacuuaaauauuug

SEQ ID NO: 481388 - RNA, 64 nt, hsa
uuauuuaacagaucccuaaucaucaaauuguugauugaaagacugaucauaaaccaaugcuggu

SEQ ID NO: 481389 - RNA, 64 nt, hsa
guuacauguucgguacuaagucauuuucaggggauugaaagacuauugcuggauuucaugaugc

SEQ ID NO: 481390 - RNA, 64 nt, hsa
ccaguguuuuaucucagcagggaacuacgccaaguugaaagaugggguuggguaaaguagauua

SEQ ID NO: 481391 - RNA, 64 nt, hsa
uaggcuagcuucuacaaauugcaauaugcaguuuuugaaagauuuucuaacaaaaagccaauaa

SEQ ID NO: 481392 - RNA, 64 nt, hsa
uggucauaugagaagcaggugcgcagagaauuccuugaaagaucugagguuuuuaacaugaagu

SEQ ID NO: 481393 - RNA, 64 nt, hsa
caaauuuggcuuauuuuuucugauuuaugaggguuugaaagaaagaauucaccuaaaagauucc

SEQ ID NO: 481394 - RNA, 64 nt, hsa
guuuaauaauuugacuuuuuucuaauauuuuaguuugaaagaaaauuucuucccaagcaaugcu

SEQ ID NO: 481395 - RNA, 64 nt, hsa
auaaucuuuugcuuuaauugcuacuguacuugcuuugaaagauuaccuacuauuuuaugauaaa

SEQ ID NO: 481396 - RNA, 64 nt, hsa
gggggagaggggcaaaugccuccgggacugacacuccaggcagcuuugccuucucuccccuguc

SEQ ID NO: 481397 - RNA, 64 nt, hsa
ucuguccccucuccuggggcuuaaguggguugcuuccaggcagaagcagccaaggaccgauucc

SEQ ID NO: 481398 - RNA, 64 nt, hsa
gguugcuuccaggcagaagcagccaaggaccgauuccaggcacuuucuguagcaaaugacugug

SEQ ID NO: 481399 - RNA, 64 nt, hsa
ccaggcaccagagccuugaguacuuucuccugccuccaggcauuggcucagggugaauuacaag

SEQ ID NO: 481400 - RNA, 64 nt, hsa
gugaagccuagacaaagccgccaggucuuguggcuccaggcaccagagccuugaguacuuucuc

SEQ ID NO: 481401 - RNA, 64 nt, hsa
uggagguguguggaaggcacucuuuccaccucucuccaggcauuauccccaggugcugaaaugg

SEQ ID NO: 481402 - RNA, 64 nt, hsa
gugccccacugcugcccucugcagagccaucugcuccaggcacccaccugccucugcuugcuuu

SEQ ID NO: 481403 - RNA, 64 nt, hsa
caaaucuuuaagugcacgauauaguauuguuaauuccaggcaccauguuguacaacagaucuuu

SEQ ID NO: 481404 - RNA, 64 nt, hsa
ggcugaggugggagaaucuccugagccuggaagguccaggcagugagccaagauugugccacca

SEQ ID NO: 481405 - RNA, 64 nt, hsa
aaaaagaaaacaaaagccagacaaacccaaguuguccaggcaaauaaacucaaaucuuugucac

SEQ ID NO: 481406 - RNA, 64 nt, hsa
uaaccaacagaaguuauuuacagaaauucauauauccaggcaacacaaaacuccuuuauucaaa

SEQ ID NO: 481407 - RNA, 64 nt, hsa
aucuggaaguuauuacagggccagcuugccauauuccaggcacacguuaucaaguuugggccua

SEQ ID NO: 481408 - RNA, 64 nt, hsa
cucccuuccauaauuccccucauccaccgcccacuccaggcacucacucaaacuugcucuucaa

SEQ ID NO: 481409 - RNA, 64 nt, hsa
uuuuuacaaaacgaaugcucuaaauucugaggauuccaggcaggccauccauagagaaauaacu

SEQ ID NO: 481410 - RNA, 64 nt, hsa
ggcaggaaguuccaagggauguauguuuauagcauccaggcaaugaucuuuuuuuuuccacgaa

SEQ ID NO: 481411 - RNA, 64 nt, hsa
cuggagcuggacagcacacgccaugccgugaagauccaggcaucuugccgggcucggggcccca

SEQ ID NO: 481412 - RNA, 64 nt, hsa
ggagaugcccuagugguggcccagcuggcuggaguccaggcagccaaggugaccagccagcuga

SEQ ID NO: 481413 - RNA, 64 nt, hsa
ucugauuuucacaucucuaccuggacauugagccuccaggcaccauguugaggagagaugaaaa

SEQ ID NO: 481414 - RNA, 64 nt, hsa
ccaggucagccggacagcuccagcagcuccacguuccaggcagccucgcccgccggcugcgcuc

SEQ ID NO: 481415 - RNA, 64 nt, hsa
gggccuguuuucagguguuccuagcauuucugccuccaggcaggacggcaggggugagcagcuu

SEQ ID NO: 481416 - RNA, 64 nt, hsa
uggggcaggaaagugagccauuccuaggcugagguccaggcagcccugccccugaagacccucu

SEQ ID NO: 481417 - RNA, 64 nt, hsa
ugcuucccucaugcccuggaauacaacucagagcuccaggcagcggaaccaucuauuguuuugu

SEQ ID NO: 481418 - RNA, 64 nt, hsa
uugguauuuuuuaauuaugaaugcauauccuauuuccaggcaggcucucuuacuugaacacaaa

SEQ ID NO: 481419 - RNA, 64 nt, hsa
ccaccaagcucccugucacccagccauggugugguccaggcagggacaucucgguacccuuucu

SEQ ID NO: 481420 - RNA, 64 nt, hsa
guccacaaacacuccguggcugagaggcagcggauccaggcagcgaugcugagccaccuccucc

SEQ ID NO: 481421 - RNA, 64 nt, hsa
gcugcucucaggaccagagaagggaaaugacuucuccaggcagaggcagaucugagucuagaac

SEQ ID NO: 481422 - RNA, 64 nt, hsa
ccaaagcaaaggagaguccugggagcccacaagauccaggcagaaggagauggguuuggggcug

SEQ ID NO: 481423 - RNA, 64 nt, hsa
uuuuauuggggaggggagcauccuaaaaaugggguccaggcagaccccuccagaccucacacug

SEQ ID NO: 481424 - RNA, 64 nt, hsa
gguucagagcauuacucucccacugugccugccauccaggcagccaugggaggcggccucccug

SEQ ID NO: 481425 - RNA, 64 nt, hsa
acaagggccccuuugccuucucauccucaggaguuccaggcacaugagucaccguccauccaca

SEQ ID NO: 481426 - RNA, 64 nt, hsa
caccacugggaggacguggagaggacagugaacuuccaggcaagagcuuccuucuuuugucuca

SEQ ID NO: 481427 - RNA, 64 nt, hsa
cagagggaagguuaagguuggcucuggccaggauuccaggcagcagguuggagugacugguggg

SEQ ID NO: 481428 - RNA, 64 nt, hsa
gcagaggaaugauggagaaucuaguguagcagccuccaggcaggauucagcacaacacugggga

SEQ ID NO: 481429 - RNA, 64 nt, hsa
auggcccuggagagugggccugggugguaccugcuccaggcagggaaacugggggcucgcccuu

SEQ ID NO: 481430 - RNA, 64 nt, hsa
ugccacccacccaguuuuauaaucccgcucccucuccaggcaaccccacccaccagccuaggcc

SEQ ID NO: 481431 - RNA, 64 nt, hsa
ccugucuccuuugcuacaugugaugauucugaaauccaggcagcaggcuggaauaaacgcugcu

SEQ ID NO: 481432 - RNA, 64 nt, hsa
agugcaucaguggccugguugccaggggcugggguccaggcaucuguggacucaaggaguccag

SEQ ID NO: 481433 - RNA, 64 nt, hsa
gagucugagggcugcuugguguagucagguuguguccaggcaugcggagcugugagugccugca

SEQ ID NO: 481434 - RNA, 64 nt, hsa
caccugcaaaugaguuaaagaagaggcgugggaauccaggcagugguuuuuccuuucggagccu

SEQ ID NO: 481435 - RNA, 64 nt, hsa
uaguccaggggcaccuggcuucagguagguuugauccaggcaucaggccauugcaucuauuuuu

SEQ ID NO: 481436 - RNA, 64 nt, hsa
gaaacuccaguauauuccagagucagaucuaagcuccaggcacgccugaagauguguugcuacu

SEQ ID NO: 481437 - RNA, 64 nt, hsa
gcgauguaugcuuugguugacaggaaguuccuuuuccaggcaggucccguugccaccuccugcu

SEQ ID NO: 481438 - RNA, 64 nt, hsa
augccccgaggagccaaguuugggacauuuacccuccaggcaucuguguccccucuugaagaga

SEQ ID NO: 481439 - RNA, 64 nt, hsa
ccccucuugaagagaaaacacacagcuucacacauccaggcauagggggcaagcucuuggggca

SEQ ID NO: 481440 - RNA, 64 nt, hsa
gcaucccauuucuucuggggucugugguccauccuccaggcauccauguccaccauagaauuug

SEQ ID NO: 481441 - RNA, 64 nt, hsa
aauagaccaacgcuaaagccugugcuccagagccuccaggcaauuggaucagaagucgcagcuc

SEQ ID NO: 481442 - RNA, 64 nt, hsa; identical to SEQ ID NO: 219832

SEQ ID NO: 481443 - RNA, 64 nt, hsa; identical to SEQ ID NO: 219833

SEQ ID NO: 481444 - RNA, 64 nt, hsa; identical to SEQ ID NO: 219834

SEQ ID NO: 481445 - RNA, 64 nt, hsa; identical to SEQ ID NO: 219835

SEQ ID NO: 481446 - RNA, 64 nt, hsa; identical to SEQ ID NO: 219836

SEQ ID NO: 481447 - RNA, 64 nt, hsa; identical to SEQ ID NO: 219837

SEQ ID NO: 481448 - RNA, 64 nt, hsa; identical to SEQ ID NO: 219838

SEQ ID NO: 481449 - RNA, 64 nt, hsa; identical to SEQ ID NO: 219839

SEQ ID NO: 481450 - RNA, 61 nt, hsa
augaagacacuuguaacauauucaacguccuguacuccaguuuugacuacgagaucagauu

SEQ ID NO: 481451 - RNA, 61 nt, hsa
cuacuucaaagaaauugagccagcacuaucuguacuccaacauuaccggaucuggauuggg

SEQ ID NO: 481452 - RNA, 61 nt, hsa
agagguugcagugagccgggauugcgccauuguacuccagccugggugaagaagugagacu

SEQ ID NO: 481453 - RNA, 61 nt, hsa
ggaguuugcagugagccgagauagugccauuguacuccagcuugggcaacagaguaagacu

SEQ ID NO: 481454 - RNA, 64 nt, hsa
cuguuugccuggcaccuagacaccccuguggugaggucagcagggggccgccugugcuuucuua

SEQ ID NO: 481455 - RNA, 64 nt, hsa
cuacacgaggcgcugcggcuccaccugaccagugggucagcaggcacggcuggcagccuucucu

SEQ ID NO: 481456 - RNA, 64 nt, hsa
cucagccaccaccugugcggcgcuugcuccgaggggucagcaagagcaacugauggcugccacu

SEQ ID NO: 481457 - RNA, 64 nt, hsa
agacccagccaagaacuacagggcggcgggcugcggucagcacgugugcucgggacacagcgga

SEQ ID NO: 481458 - RNA, 64 nt, hsa
uuucaaauagggucuaacucagcaacucgcuuuaggucagcagccucccugaagaccaaaauua

SEQ ID NO: 481459 - RNA, 64 nt, hsa
agccagcuuucccugccucucaucaacugaaugaggucagcaugucuauucagcuucguuuauu

SEQ ID NO: 481460 - RNA, 64 nt, hsa
guucuucugccagccugcagguggccacucauguggucagcaggucggcggagagacugggaug

SEQ ID NO: 481461 - RNA, 64 nt, hsa
aagauauugauuucauuuagauuucccuccacgaggucagcaaacuaucauguucuuauguaaa

SEQ ID NO: 481462 - RNA, 64 nt, hsa
ugugcugcaggccuccccucgaaagacacugggaggucagcauguuccacagguguucagaggg

SEQ ID NO: 481463 - RNA, 64 nt, hsa
agaaaaugccagggauccaccacaagauggagauggucagcacaaaccgauucuguuccucuuu

SEQ ID NO: 481464 - RNA, 64 nt, hsa
aagcccgugaucgcucguuuucaggggucuuaccggucagcaaccuuggcauugauacauaggc

SEQ ID NO: 481465 - RNA, 64 nt, hsa
uuuucucuuguucuugaaacauugcaaccaaaaaggucagcacaaaggccuucaccuacgugaa

SEQ ID NO: 481466 - RNA, 64 nt, hsa
gaccuauuugcuaggggugcugccggggauuuggggucagcaucuggcccccuaucuccugacc

SEQ ID NO: 481467 - RNA, 64 nt, hsa
gugccgcgggccacagugggcagguggcaccgggggucagcaugcaggggcgccagaggcccag

SEQ ID NO: 481468 - RNA, 64 nt, hsa
ccacgggaggauccugaccccugcagggcucaggggucagcagggacccacugccccaucuccc

SEQ ID NO: 481469 - RNA, 64 nt, hsa
gcgugggaucacggguccuuacgcugggcugucuggucagcacgugcaggucagggcagguccu

SEQ ID NO: 481470 - RNA, 64 nt, hsa
cccuuugcccuaagcagacagcugcagaugagagggucagcaucuccacuaguggcugcucugu

SEQ ID NO: 481471 - RNA, 64 nt, hsa
agaaggucccaaucacacaugauuggccucauugggucagcaccugugaaaggaagauuaaaaa

SEQ ID NO: 481472 - RNA, 64 nt, hsa
cugucaucccaggacacuugaggcccaaggagguggaguggagagugggcucggguacauggga

SEQ ID NO: 481473 - RNA, 64 nt, hsa
ugacacugcacgugggcguaguggggagcacccuggaguggagaugauugucagcgggcucaca

SEQ ID NO: 481474 - RNA, 64 nt, hsa
accuugguccuuuuguuuuuguucuggacucuugggaguggaaaugagaaugaguuuauuccua

SEQ ID NO: 481475 - RNA, 64 nt, hsa
aaguccccaaacuaccucuuguuacaguagccagggaguggaauuucgucaaccgguacuuuua

SEQ ID NO: 481476 - RNA, 64 nt, hsa
aauggcuaagauugcucuaaaauuugcaaaaugaggaguggauugcaaauaauugagggauuua

SEQ ID NO: 481477 - RNA, 64 nt, hsa
aggaccuagguguuugggguacacugccacccagggaguggaucaaaaauauacauagaaagag

SEQ ID NO: 481478 - RNA, 64 nt, hsa
agagagucucuguacacagccccgugaacccugaggaguggagucauacgcgaagggugugugg

SEQ ID NO: 481479 - RNA, 64 nt, hsa
agagagucucuguacacagccccgugaacccugaggaguggagucauacacgaagggcgugugg

SEQ ID NO: 481480 - RNA, 64 nt, hsa
ugucagcagagucuccaagccccacgaacccugaggaguggagucauacgcgaaggccauaugg

SEQ ID NO: 481481 - RNA, 64 nt, hsa
aagacaucacaaucccauuauucagagcgcguauggaguggaaacgcuuguaggguuucaccag

SEQ ID NO: 481482 - RNA, 64 nt, hsa; identical to SEQ ID NO: 481481

SEQ ID NO: 481483 - RNA, 64 nt, hsa
cagaauuccuaaacuuuaaaaugguacugucugcggaguggaguauggaugguuaugucaaagu

SEQ ID NO: 481484 - RNA, 64 nt, hsa
uagaggcacauacaaaaccuacauucucuaguugggaguggauuuuuaaaguuuuccuuuuauc

SEQ ID NO: 481485 - RNA, 64 nt, hsa
uccccugugaugacuggcagcuaaggaggaccucggaguggacccgagccaggaauaacgaaug

SEQ ID NO: 481486 - RNA, 64 nt, hsa
cacaggcuggccacagcugggcaaggcucuccguggaguggacucgagucccuggagcaggcag

SEQ ID NO: 481487 - RNA, 64 nt, hsa
ggagggcguggagggcgugggagcgugggaggcgggaguggaguggaagaagagggagaggugg

SEQ ID NO: 481488 - RNA, 64 nt, hsa
gcguggagggcgugggagcgugggaggcgggaguggaguggaagaagagggagagguggagcaa

SEQ ID NO: 481489 - RNA, 64 nt, hsa
cagggcauggggggcaguggugagcuaaggcugaggaguggagaugaccagaauauaagggugc

SEQ ID NO: 481490 - RNA, 64 nt, hsa
gagcccuuccucucagcccccauguugggagaggggaguggauucuugcugcugguaugagacu

SEQ ID NO: 481491 - RNA, 64 nt, hsa
caagauuucagccuggaagagggcaaaguggacgggaguggacaggaguggaugcgauaagaug

SEQ ID NO: 481492 - RNA, 64 nt, hsa
gccuggaagagggcaaaguggacgggaguggacaggaguggaugcgauaagaugugguuugaag

SEQ ID NO: 481493 - RNA, 64 nt, hsa; identical to SEQ ID NO: 481491

SEQ ID NO: 481494 - RNA, 64 nt, hsa; identical to SEQ ID NO: 481492

SEQ ID NO: 481495 - RNA, 64 nt, hsa
ucagugccuggaaggcaggugugcccgucagcggggaguggaacucaucaggcuugccaagagg

SEQ ID NO: 481496 - RNA, 64 nt, hsa
ugcagcagcugagggggugcccuggcacuggcugggaguggagaggcacuguggugaaauggcu

SEQ ID NO: 481497 - RNA, 64 nt, hsa
augggaugcgguggguugcccaauaaacggcuguggaguggaaauuccuccagagccaaaaagg

SEQ ID NO: 481498 - RNA, 64 nt, hsa
ggcagacauuuauggacacccgccacguggucccggaguggaacggugccucccacugcagccu

SEQ ID NO: 481499 - RNA, 64 nt, hsa
augcuggggaaauggaaccauggugcaguaguguggaguggaugaguguuccaugagccuagga

SEQ ID NO: 481500 - RNA, 64 nt, hsa
ggagugggaggcuccccugcccuccuucuccuuaggaguggaggagauguguguucugcuccuc

SEQ ID NO: 481501 - RNA, 64 nt, hsa
guauucauaauucuaucaagucaucuuugauuccuggaccuaauaaauuuuuuuucccuuucuu

SEQ ID NO: 481502 - RNA, 64 nt, hsa
uugugucuacugauuggcuaucagaaccuuaggcuggaccuaaauagauugauuucauuucuaa

SEQ ID NO: 481503 - RNA, 64 nt, hsa
auaaaauaaugauuuuucacucucuuuaaaaauacuaaaucauuuauguccauuucucaauuuu

SEQ ID NO: 481504 - RNA, 64 nt, hsa
uuuaaucauuucaaaguuaaucucugccaucucgcuaaaucaucagucucggcucuucugaaau

SEQ ID NO: 481505 - RNA, 60 nt, hsa
gguccucugaugaauucugaagauaaucuccuaaaucacugacguugagaugucaucauc

SEQ ID NO: 481506 - RNA, 64 nt, hsa
uaaaaggaauuuaaauuuuguuuauauacauuaacuaaaucaguacaaguuuggggugaaaagg

SEQ ID NO: 481507 - RNA, 64 nt, hsa
uuccuauuauuucucuucuuagcuucuccauugucuaaaucaggaaaacaggaaaacacagcuu

SEQ ID NO: 481508 - RNA, 64 nt, hsa
uugaaaugauuuguuucucuuccuaggaugaaaacuaaaucaauuaauuauucaauuagguaag

SEQ ID NO: 481509 - RNA, 64 nt, hsa
ggcggcuugcuguccagccugugugggggccgucccgucccacacuccccugggcauucuugga

SEQ ID NO: 481510 - RNA, 64 nt, hsa
ggucguaacccucuguggcuccccugcaucagcaccgucccaccaccaaguucaccagguucac

SEQ ID NO: 481511 - RNA, 64 nt, hsa
aggagggcuggucuccgcuccucaggggcuuaguccgucccaccccuucccuucccuggcgccc

SEQ ID NO: 481512 - RNA, 64 nt, hsa
ccuggugccucuggcuggaggcucccucccuuggccgucccaauagagcccggggcuacuucca

SEQ ID NO: 481513 - RNA, 64 nt, hsa; identical to SEQ ID NO: 169421

SEQ ID NO: 481514 - RNA, 64 nt, hsa; identical to SEQ ID NO: 169422

SEQ ID NO: 481515 - RNA, 64 nt, hsa; identical to SEQ ID NO: 169423

SEQ ID NO: 481516 - RNA, 64 nt, hsa; identical to SEQ ID NO: 169424

SEQ ID NO: 481517 - RNA, 64 nt, hsa; identical to SEQ ID NO: 169425

SEQ ID NO: 481518 - RNA, 64 nt, hsa; identical to SEQ ID NO: 169426

SEQ ID NO: 481519 - RNA, 64 nt, hsa; identical to SEQ ID NO: 169427

SEQ ID NO: 481520 - RNA, 64 nt, hsa; identical to SEQ ID NO: 169428

SEQ ID NO: 481521 - RNA, 64 nt, hsa; identical to SEQ ID NO: 169429

SEQ ID NO: 481522 - RNA, 64 nt, hsa; identical to SEQ ID NO: 169430

SEQ ID NO: 481523 - RNA, 64 nt, hsa; identical to SEQ ID NO: 169431

SEQ ID NO: 481524 - RNA, 64 nt, hsa; identical to SEQ ID NO: 169432

SEQ ID NO: 481525 - RNA, 64 nt, hsa; identical to SEQ ID NO: 169433

SEQ ID NO: 481526 - RNA, 64 nt, hsa; identical to SEQ ID NO: 169434

SEQ ID NO: 481527 - RNA, 64 nt, hsa; identical to SEQ ID NO: 169435

SEQ ID NO: 481528 - RNA, 64 nt, hsa; identical to SEQ ID NO: 169436

SEQ ID NO: 481529 - RNA, 64 nt, hsa; identical to SEQ ID NO: 169437

SEQ ID NO: 481530 - RNA, 64 nt, hsa; identical to SEQ ID NO: 169438

SEQ ID NO: 481531 - RNA, 64 nt, hsa; identical to SEQ ID NO: 169439

SEQ ID NO: 481532 - RNA, 64 nt, hsa; identical to SEQ ID NO: 169440

SEQ ID NO: 481533 - RNA, 64 nt, hsa; identical to SEQ ID NO: 169441

SEQ ID NO: 481534 - RNA, 64 nt, hsa; identical to SEQ ID NO: 169442

SEQ ID NO: 481535 - RNA, 64 nt, hsa; identical to SEQ ID NO: 169443

SEQ ID NO: 481536 - RNA, 64 nt, hsa; identical to SEQ ID NO: 169442

SEQ ID NO: 481537 - RNA, 64 nt, hsa; identical to SEQ ID NO: 169443

SEQ ID NO: 481538 - RNA, 64 nt, hsa; identical to SEQ ID NO: 56858

SEQ ID NO: 481539 - RNA, 64 nt, hsa; identical to SEQ ID NO: 56859

SEQ ID NO: 481540 - RNA, 64 nt, hsa; identical to SEQ ID NO: 56860

SEQ ID NO: 481541 - RNA, 64 nt, hsa; identical to SEQ ID NO: 56861

SEQ ID NO: 481542 - RNA, 64 nt, hsa; identical to SEQ ID NO: 56862

SEQ ID NO: 481543 - RNA, 64 nt, hsa; identical to SEQ ID NO: 56863

SEQ ID NO: 481544 - RNA, 64 nt, hsa; identical to SEQ ID NO: 56864

SEQ ID NO: 481545 - RNA, 64 nt, hsa; identical to SEQ ID NO: 56865

SEQ ID NO: 481546 - RNA, 64 nt, hsa; identical to SEQ ID NO: 56866

SEQ ID NO: 481547 - RNA, 64 nt, hsa; identical to SEQ ID NO: 56867

SEQ ID NO: 481548 - RNA, 64 nt, hsa; identical to SEQ ID NO: 56868

SEQ ID NO: 481549 - RNA, 64 nt, hsa; identical to SEQ ID NO: 56869

SEQ ID NO: 481550 - RNA, 64 nt, hsa; identical to SEQ ID NO: 56870

SEQ ID NO: 481551 - RNA, 64 nt, hsa; identical to SEQ ID NO: 56871

SEQ ID NO: 481552 - RNA, 64 nt, hsa; identical to SEQ ID NO: 56872

SEQ ID NO: 481553 - RNA, 64 nt, hsa; identical to SEQ ID NO: 56873

SEQ ID NO: 481554 - RNA, 64 nt, hsa; identical to SEQ ID NO: 56874

SEQ ID NO: 481555 - RNA, 64 nt, hsa; identical to SEQ ID NO: 56875

SEQ ID NO: 481556 - RNA, 64 nt, hsa; identical to SEQ ID NO: 56876

SEQ ID NO: 481557 - RNA, 64 nt, hsa; identical to SEQ ID NO: 56877

SEQ ID NO: 481558 - RNA, 64 nt, hsa; identical to SEQ ID NO: 56878

SEQ ID NO: 481559 - RNA, 64 nt, hsa; identical to SEQ ID NO: 56879

SEQ ID NO: 481560 - RNA, 64 nt, hsa; identical to SEQ ID NO: 56880

SEQ ID NO: 481561 - RNA, 64 nt, hsa; identical to SEQ ID NO: 56881

SEQ ID NO: 481562 - RNA, 64 nt, hsa; identical to SEQ ID NO: 478274

SEQ ID NO: 481563 - RNA, 64 nt, hsa; identical to SEQ ID NO: 478275

SEQ ID NO: 481564 - RNA, 64 nt, hsa; identical to SEQ ID NO: 478276

SEQ ID NO: 481565 - RNA, 64 nt, hsa; identical to SEQ ID NO: 478277

SEQ ID NO: 481566 - RNA, 64 nt, hsa; identical to SEQ ID NO: 478278

SEQ ID NO: 481567 - RNA, 64 nt, hsa; identical to SEQ ID NO: 478279

SEQ ID NO: 481568 - RNA, 64 nt, hsa; identical to SEQ ID NO: 478280

SEQ ID NO: 481569 - RNA, 64 nt, hsa; identical to SEQ ID NO: 478281

SEQ ID NO: 481570 - RNA, 64 nt, hsa; identical to SEQ ID NO: 478282

SEQ ID NO: 481571 - RNA, 64 nt, hsa; identical to SEQ ID NO: 478283

SEQ ID NO: 481572 - RNA, 64 nt, hsa; identical to SEQ ID NO: 478284

SEQ ID NO: 481573 - RNA, 64 nt, hsa; identical to SEQ ID NO: 478285

SEQ ID NO: 481574 - RNA, 64 nt, hsa; identical to SEQ ID NO: 478286

SEQ ID NO: 481575 - RNA, 64 nt, hsa; identical to SEQ ID NO: 478287

SEQ ID NO: 481576 - RNA, 64 nt, hsa; identical to SEQ ID NO: 478288

SEQ ID NO: 481577 - RNA, 64 nt, hsa; identical to SEQ ID NO: 478289

SEQ ID NO: 481578 - RNA, 64 nt, hsa; identical to SEQ ID NO: 478290

SEQ ID NO: 481579 - RNA, 64 nt, hsa; identical to SEQ ID NO: 478291

SEQ ID NO: 481580 - RNA, 64 nt, hsa; identical to SEQ ID NO: 478292

SEQ ID NO: 481581 - RNA, 64 nt, hsa; identical to SEQ ID NO: 478293

SEQ ID NO: 481582 - RNA, 64 nt, hsa; identical to SEQ ID NO: 478294

SEQ ID NO: 481583 - RNA, 64 nt, hsa; identical to SEQ ID NO: 478295

SEQ ID NO: 481584 - RNA, 64 nt, hsa; identical to SEQ ID NO: 478296

SEQ ID NO: 481585 - RNA, 64 nt, hsa; identical to SEQ ID NO: 478297

SEQ ID NO: 481586 - RNA, 64 nt, hsa
agcacuuugggaagccgaggugggcagaucauaaggucgggagauuaagaccauccuggcuaac

SEQ ID NO: 481587 - RNA, 64 nt, hsa
ucaugcuguucucuuugcugacacugugacccugggucgggacagaccagcagcaaucugucuu

SEQ ID NO: 481588 - RNA, 64 nt, hsa
gggagcaagcaagguuagcaacugugaacagagaggucgggauuugcccugggggaggaagaga

SEQ ID NO: 481589 - RNA, 64 nt, hsa
aaguguccuaagucagugguucccaaaucuggcuggucgggaauaccugggaaguuuguuaaaa

SEQ ID NO: 481590 - RNA, 64 nt, hsa
cacuuugggaggcugaggcagguggaucucuugaggucgggaguuugagaccagccuggccaac

SEQ ID NO: 481591 - RNA, 64 nt, hsa
gcuuuccugagggacucgaaauucuccggcggguggucgggagcuggggcucugaggggcucua

SEQ ID NO: 481592 - RNA, 64 nt, hsa
cacuuugggaggcugaggcgggcggaucaccugaggucgggaguucgaggccagccugaccaac

SEQ ID NO: 481593 - RNA, 64 nt, hsa
uucgguauccccccaucuugcuucccuaaucuauggucgggagacagcaucaggguuaagaaga

SEQ ID NO: 481594 - RNA, 64 nt, hsa
uuuucugucuguuuuaaucauguaucuggaauagggucgggaaggguuugugcuauuccccacu

SEQ ID NO: 481595 - RNA, 64 nt, hsa
uucugcugggggacugaggcuggcccucauucggggucgggaaccaagggugugucugcucuuu

SEQ ID NO: 481596 - RNA, 64 nt, hsa
aggggcccaacuuucacguccagcccuggccuggggucgggagaggugggcgcuagaagaugca

SEQ ID NO: 481597 - RNA, 64 nt, hsa
ugaucuguccugggcggggaccaggagggagcggggucgggaucaccugccagugugcagacuc

SEQ ID NO: 481598 - RNA, 64 nt, hsa
cacuuugggaggcugagacagguggaucacuugaggucgggaguucgagaccagccuggccaac

SEQ ID NO: 481599 - RNA, 64 nt, hsa
ucuuuggggcccugggcggccucuugcugcugggggucgggacguucgugguccugcgcuucug

SEQ ID NO: 481600 - RNA, 64 nt, hsa
cacuuugggaguccaaggugggcggaucaccugaggucgggaguucgagaccagccugaccaac

SEQ ID NO: 481601 - RNA, 64 nt, hsa
gcacuuugggaggcugaggggguggaucaccugaggucgggaguucuagaccagccugaccaac

SEQ ID NO: 481602 - RNA, 64 nt, hsa
cccaagagagguauccucagccccuccugccccaggucgggagacagcagcuuuggagacacaa

SEQ ID NO: 481603 - RNA, 64 nt, hsa
caccuugggaggcccaggcaggcagaucaccugaggucgggaguucgagaccagcgugaccaac

SEQ ID NO: 481604 - RNA, 64 nt, hsa
aauacgcugagccugugaccagaggaugauggauggucgggauugaggcuguugaccugggcag

SEQ ID NO: 481605 - RNA, 64 nt, hsa
ucccagcacuuugggagguggguggaucaccugaggucgggaguucgagaccagccugaccagc

SEQ ID NO: 481606 - RNA, 64 nt, hsa
gguaaguuccucugggucgcagaucgguuucucgggucgggauagugugagugccuagcacagu

SEQ ID NO: 481607 - RNA, 64 nt, hsa
cacuuugggaggccgaggcgggcggaugaguugaggucgggaguuugaguccccgucucuacua

SEQ ID NO: 481608 - RNA, 64 nt, hsa
aaugaugggcgcauccugucugccacgugcugacggucgggaagcuucaguggagaggccuaac

SEQ ID NO: 481609 - RNA, 64 nt, hsa
gggggggggggggggggcagagggcagggggacgggucgggacaccagugaaacuugaaccggg

SEQ ID NO: 481610 - RNA, 64 nt, hsa
gcaucacagaccccagcuggggcgcgaugucaaaggucgggacagcugugccgggaggcagcca

SEQ ID NO: 481611 - RNA, 64 nt, hsa
gccuuuuacuuucguguggauaugugaagcauugggucgggaacuagcuguagaacacaacuaa

SEQ ID NO: 481612 - RNA, 64 nt, hsa
cugguccuucaugaagagcagacacuuagaggcuggucgggaauggggaggucgccccugggag

SEQ ID NO: 481613 - RNA, 64 nt, hsa
aacuuuguguuuuuucggaggggguugguggggaggucgggaugccugggaucccuuccuggag

SEQ ID NO: 481614 - RNA, 64 nt, hsa
agaacaagaguguggcaaagaacacccgugcuggggucgggaugagguugaagggucuugguca

SEQ ID NO: 481615 - RNA, 64 nt, hsa
uuuuuuuuuuuuuuuuucuggcggugagccagagggucgggagaaacgcugcucgccccacacc

SEQ ID NO: 481616 - RNA, 64 nt, hsa
ggaauauggaaucuauuucugucugcacuagagaggucgggaggaaguuaauucucacuguacu

SEQ ID NO: 481617 - RNA, 64 nt, hsa
cacucugggaggcugaggugggcggauugcuugaggucgggaguuugaaaccagucucaccagg

SEQ ID NO: 481618 - RNA, 64 nt, hsa
cacuuugggaggccgaggugggcggaucaccugaggucgggaguuugagaccagccugaccaac

SEQ ID NO: 481619 - RNA, 64 nt, hsa
cacuuugggaggcugagguaggaggaucacgugaggucgggaguucaagaccagccuggccauc

SEQ ID NO: 481620 - RNA, 64 nt, hsa
cacuuugggaggccgagacaggcggaucaccugaggucgggaguucgagaccagccuuaccaac

SEQ ID NO: 481621 - RNA, 64 nt, hsa
uaagagcuaugugaaaacagacaauauuaguuuaggucgggaacugagauauuguaaucaaaua

SEQ ID NO: 481622 - RNA, 64 nt, hsa
guggagguuugucgggcaccagccagcguagcagggucgggaaaggccaccugucccacuccua

SEQ ID NO: 481623 - RNA, 64 nt, hsa
cuuccuacuguacauauuggggaguggggggcagggucgggaagggacaugccaggccaggccu

SEQ ID NO: 481624 - RNA, 64 nt, hsa
gaggcacagggcagugcaggggacucugcaguggggucgggaagugaguuucuuugcagugagc

SEQ ID NO: 481625 - RNA, 64 nt, hsa
guaggagaagcuauaaggaaagacgcaauuggaaggucgggagguuuuccaaagcuucaggaga

SEQ ID NO: 481626 - RNA, 51 nt, hsa
cuugguccugccauaccuagaggucgggacagacgacgcuaccugcccaga

SEQ ID NO: 481627 - RNA, 64 nt, hsa
cgcuuugggaggccgaggcaggcagaucaccugaggucgggaguuggagacccgccuggcuaac

SEQ ID NO: 481628 - RNA, 64 nt, hsa
caguuugggaggucgagguagguggaucaccugaggucgggaguucgagaccaaccugaccaac

SEQ ID NO: 481629 - RNA, 64 nt, hsa
cacuuugggaggcugaggcggguggaucaccugaggucgggaguuugagaccagccuggccaac

SEQ ID NO: 481630 - RNA, 64 nt, hsa
ugaaggcggccggugagcggggcggguucugcugggucgggaagaaaaauaauucugcaaggua

SEQ ID NO: 481631 - RNA, 64 nt, hsa
cuagaaacuauguucaucagucacucauuuuuaaggucgggaguuagauuuuaugauagaauua

SEQ ID NO: 481632 - RNA, 64 nt, hsa
cgcuuugggaggcagaggcagguggaucaccugaggucgggaguucgagaccagccugaccaac

SEQ ID NO: 481633 - RNA, 64 nt, hsa
cuaagaugauccuuuaagcaagcagucauagacuggucgggauuaaguaaaagacggcuaguug

SEQ ID NO: 481634 - RNA, 64 nt, hsa
cccgaggccucacuguauggugcccucuccaaagggucgggaggguagcucuccaggccagagc

SEQ ID NO: 481635 - RNA, 63 nt, hsa
uccuccagagcuugagcuagaagucuccaaggaggucgggauggggcuuguagcagaaggcaa

SEQ ID NO: 481636 - RNA, 64 nt, hsa
cacugugggaggccgaggcggauggaucaccugaggucgggaauucgagaccagccugaccaac

SEQ ID NO: 481637 - RNA, 64 nt, hsa
ucugccuauuaucagugcuggggacaccccugggggucgggacguguacccugggaggccuggc

SEQ ID NO: 481638 - RNA, 64 nt, hsa
cacuuugggaggccaaggcgggcggaucaccugaggucgggaguuugagaccagcccgaccaac

SEQ ID NO: 481639 - RNA, 64 nt, hsa
guuuuguccaguggccaauagcaagauaugaaccggucgggacauguauggacuuggucugaug

SEQ ID NO: 481640 - RNA, 64 nt, hsa
auucucuccccagcuggaaggccgaugacuggguggucgggagggagacccagcucuccuuucu

SEQ ID NO: 481641 - RNA, 64 nt, hsa
ccggggaagggcaugggcuagaagaggagaggggggucgggaauggggggaauguuuuggcugg

SEQ ID NO: 481642 - RNA, 64 nt, hsa
cccgcuuuaagggguaaagggcgcaaagggcaugggucgggagaggggacgcaggccccucucc

SEQ ID NO: 481643 - RNA, 64 nt, hsa
uuugccuuccuguuggcugucuggccuuggagcaggucgggagaguagaguacauaaucagugc

SEQ ID NO: 481644 - RNA, 64 nt, hsa
acgccccugaguucagagucggggacccaggccaggucgggagcacagccgcuccccaaaccca

SEQ ID NO: 481645 - RNA, 64 nt, hsa
cacuuugggaggccaagacgggcggaucuuuugaggucgggaguuggaggccagccuggccaaa

SEQ ID NO: 481646 - RNA, 64 nt, hsa
uccgggugccucccucugcuuguacagagcccauggucgggacagugcccuggccuuugccggg

SEQ ID NO: 481647 - RNA, 64 nt, hsa
cagcuggggcagccccucuggcuucuaaauccgcggucgggauucuuccuccuguuuaguuuuu

SEQ ID NO: 481648 - RNA, 64 nt, hsa
ccgcagggaagacgaagccaggugccagggcuggggucgggacacccauguucugggcggcuug

SEQ ID NO: 481649 - RNA, 64 nt, hsa
ccacaaggcuugucccccagaggcccuggcuccuggucgggaagggagguggccucccgccaac

SEQ ID NO: 481650 - RNA, 64 nt, hsa
cacuuugggaggccauggcagguggaucaccugaggucgggauuuugagaccagccugaccaac

SEQ ID NO: 481651 - RNA, 64 nt, hsa
cacuuugggagguugaggugggcagaucgccugaggucgggaguucgagaccagccuggccaac

SEQ ID NO: 481652 - RNA, 64 nt, hsa
cacuuugggaggcugaggcagguggaucaccugaggucgggaguucgagaccagccugaccaac

SEQ ID NO: 481653 - RNA, 64 nt, hsa
cacuuugggaggccgaagcgggcggaucaccugaggucgggaguucgagaccagccugaccaac

SEQ ID NO: 481654 - RNA, 64 nt, hsa
cacuuugggaggccgaggugggcggaucacuugaggucgggaguucaagaccagccuggccaac

SEQ ID NO: 481655 - RNA, 64 nt, hsa
ugaaaugguauggcugaaguucauuuguuuacagggucgggaaugucuucaguucuugagaguc

SEQ ID NO: 481656 - RNA, 64 nt, hsa
gagcccacccucgugguccccagacauuucaggaggucgggaaauuuuuaaacccaggcagcuu

SEQ ID NO: 481657 - RNA, 64 nt, hsa
cuaauuuugauuuuaacauuaguguaacaaauaaggucgggacauauauuuacauagaucccag

SEQ ID NO: 481658 - RNA, 64 nt, hsa
agcagcucagggcucagggggccacaaggaggcaggucgggaggaagaagagguggaggugugg

SEQ ID NO: 481659 - RNA, 64 nt, hsa
ccgaggggcggacaccggagagacacgggaaaggggucgggacaggagcacguggcucagacac

SEQ ID NO: 481660 - RNA, 64 nt, hsa
gcagauuagcugcuacuacuuuuaaaagacuuaaggucgggaugccuuuuuuuccauguaagga

SEQ ID NO: 481661 - RNA, 63 nt, hsa
cuuuuccacccugggccccaaugccguccuuuccccgcagagacuggucuuggaaacccucag

SEQ ID NO: 481662 - RNA, 63 nt, hsa
cccuuaccgguggcucuuccugccugggacccucccgcagagucccacuagccagcggccuca

SEQ ID NO: 481663 - RNA, 63 nt, hsa
cagagcagccaggcuggggccccucugucucaacccgcagacccuugacugaaugagagaggc

SEQ ID NO: 481664 - RNA, 63 nt, hsa
gcuggcauggucagguaacacuaguggcccagccccgcagacccacaagcccuacccgugcug

SEQ ID NO: 481665 - RNA, 63 nt, hsa
gggacaugaggggcagcuagacuucacccccuucccgcagaccugccuccagagcaaggagaa

SEQ ID NO: 481666 - RNA, 63 nt, hsa
gcaucaccugucaaaaauggaguuccacuucuccccgcagaccuaggucagacuuuuccuuuc

SEQ ID NO: 481667 - RNA, 63 nt, hsa
gagaggcaguacgcauccuuacccaggggaggacccgcagauccuguagacuaucugccagca

SEQ ID NO: 481668 - RNA, 63 nt, hsa
ggguguugggauacugcagggccaggacugagccccgcagaccuccccagccccuagcccagg

SEQ ID NO: 481669 - RNA, 63 nt, hsa
gagaggcccgcccgcccaccgugggcagugccacccgcagaugacacgcgcucuccaccaccc

SEQ ID NO: 481670 - RNA, 63 nt, hsa
uggucacagcggagguguggagccgaggccuaccccgcagacaccuuggacauccuccuccca

SEQ ID NO: 481671 - RNA, 63 nt, hsa
cgguagggcguggaaaggggcaggccagagcuacccgcagaguucucagaaucaugcugagag

SEQ ID NO: 481672 - RNA, 63 nt, hsa
uggggcccagacaccagccuagccuggcucugccccgcagacggucugugugcuguuugaaaa

SEQ ID NO: 481673 - RNA, 63 nt, hsa
cagagcuggcugcuggacgcaccgugcucgcugcccgcagaagcggcacugugcuggcgggcu

SEQ ID NO: 481674 - RNA, 63 nt, hsa
ugagacucuguuuaucacuagccuucugucccucccgcagaagacuguuggauugaacaaaau

SEQ ID NO: 481675 - RNA, 63 nt, hsa
gagucccuggcaguagccuuggggcagagggcacccgcagagucccagagaugaugugggcag

SEQ ID NO: 481676 - RNA, 63 nt, hsa
gacccguucagacacugcguugcgggcuccuuccccgcagaggccggggccucccugacuuug

SEQ ID NO: 481677 - RNA, 63 nt, hsa
ugccaguagccuaggugucucaggccccugggccccgcagauggccauuuccggugccugccc

SEQ ID NO: 481678 - RNA, 63 nt, hsa
cagugugaaguuucuggcauagaguccuggcuucccgcagacgacuuucacacucugccaugu

SEQ ID NO: 481679 - RNA, 63 nt, hsa
agcgcugagcugagggacgaggaagagcuggagcccgcagaagccguccacagcccugccuca

SEQ ID NO: 481680 - RNA, 63 nt, hsa
augcaccauguccugaaagauggcacccucccacccgcagagugcuuccugcaagcuggcguu

SEQ ID NO: 481681 - RNA, 63 nt, hsa
uaaggagguagcucccagcacucaaccaaccuccccgcagagcucccuuccugacccuccgcu

SEQ ID NO: 481682 - RNA, 63 nt, hsa
ccucggagcccggcccgcccuccggcuacaauccccgcagagucuccggugcagacgcgcugc

SEQ ID NO: 481683 - RNA, 63 nt, hsa
acggaauaguguggggugugugcagggcugcaucccgcagauggcuggaauauuaaaauucuu

SEQ ID NO: 481684 - RNA, 63 nt, hsa
auccuggccugagaauugaggggagguggccagcccgcagagguggggugcuggggcugcaug

SEQ ID NO: 481685 - RNA, 63 nt, hsa
ccugggucgcagacgaggucggccucgucauuccccgcagaccgccgcgcgucccucuugugc

SEQ ID NO: 481686 - RNA, 63 nt, hsa
uuuaucuuccgaggccaccguuuaacaggaguccccgcagauggguucugcccuguggaguau

SEQ ID NO: 481687 - RNA, 63 nt, hsa
uuguuuagcuuaccuuucugcuaggauuggcuucccgcagagggcagggcccauccuaagcag

SEQ ID NO: 481688 - RNA, 63 nt, hsa
ugcgcuuguuggcgcgacuguggcucgagcuggcccgcagacacguggguuucaucacucuga

SEQ ID NO: 481689 - RNA, 63 nt, hsa
agcauugcucaggguggggggcugggaccauggcccgcagaggcacugccacagcugugaggg

SEQ ID NO: 481690 - RNA, 63 nt, hsa
ccuggcaccaugcacggccagcaagaaucaaggcccgcagaugcuaagagggccuauugucag

SEQ ID NO: 481691 - RNA, 63 nt, hsa
uuacaagccuuuuuaagauaugaaauaugccuacccgcagagcuuggcacaaaguggagucaa

SEQ ID NO: 481692 - RNA, 63 nt, hsa
cggcguggaccgagggucccagccugcaggcuccccgcagagagcacaggaagaggcaggggc

SEQ ID NO: 481693 - RNA, 63 nt, hsa
cccaggugccccccucaccuugaugggugcguucccgcagaccaaagagagugugacucccuu

SEQ ID NO: 481694 - RNA, 63 nt, hsa
aggccccaggaguggcaccuuagugugggucggcccgcagauggcacccaaggccgggaaggg

SEQ ID NO: 481695 - RNA, 63 nt, hsa
acccaggguggggaggccacccuuccugcccuacccgcagaauggugcucuccuuugcccucc

SEQ ID NO: 481696 - RNA, 63 nt, hsa
ucagcagaaugacucuggaaccauccucuguuacccgcagauccugucccaugggcucuggcc

SEQ ID NO: 481697 - RNA, 63 nt, hsa
agcagguggugguggaaauuccagcaggugggucccgcagaggcccugaggccucacuuuucg

SEQ ID NO: 481698 - RNA, 63 nt, hsa
gagacuccccgcccgcccuccucugcccccucccccgcagacagacagacagacggacgggac

SEQ ID NO: 481699 - RNA, 63 nt, hsa
gaagucacgccuuggcccugacauccccacaugcccgcagagauccucuuugagugucugucu

SEQ ID NO: 481700 - RNA, 63 nt, hsa
ccugcccauauauuauaccaguugcuucugcagcccgcagaugccagcgaugccaggaaacaa

SEQ ID NO: 481701 - RNA, 63 nt, hsa
cuucuggccccucugaggauucccuagggcugccccgcagaggggcuuccccaagcucuguuu

SEQ ID NO: 481702 - RNA, 63 nt, hsa
gaucaugucccauccaguccagugaauccacgacccgcagaccuguccccccgcaacagcuua

SEQ ID NO: 481703 - RNA, 63 nt, hsa
ggcaugccccccagcuacuguaugcccccgacccccgcagaggcagaaugaacccauagggag

SEQ ID NO: 481704 - RNA, 63 nt, hsa
acgcacgaccccaagcccgcggaggcaccgaugcccgcagagcccgcaccccccggcccugcc

SEQ ID NO: 481705 - RNA, 63 nt, hsa
cgacuuguggcucggacccagggaccuucagggcccgcagacccucccggcgccuugagaccc

SEQ ID NO: 481706 - RNA, 63 nt, hsa
ccucauuucauccuugcaacagcucugcagggccccgcagaugaggaaauccguaggcaggag

SEQ ID NO: 481707 - RNA, 63 nt, hsa
gaaaaacuucaagaagaaaagaaucgucacgaccccgcagacuguccuccggauaaacagcau

SEQ ID NO: 481708 - RNA, 63 nt, hsa
agcaaagaggcucuuuagaggcagcgggggaggcccgcagagcgcgccccuagccgguuccug

SEQ ID NO: 481709 - RNA, 63 nt, hsa
cugucuugcugccggccuugauaccaccccucacccgcagagucacugcauucccucccagcc

SEQ ID NO: 481710 - RNA, 63 nt, hsa
cuuccaugcugagugaugcucagggaagugaugcccgcagaaggcgucugggccuaaggaucc

SEQ ID NO: 481711 - RNA, 61 nt, hsa
gcucaggaccaaccgcauagcugccuaugcccccgcagaacuggcugcugcgugugaacug

SEQ ID NO: 481712 - RNA, 63 nt, hsa
gaaggucaggaggcaaguggaggauggacugggcccgcagaugcccugaccucugcccccagg

SEQ ID NO: 481713 - RNA, 63 nt, hsa
ggggcacacagacuguggcagagcugcgcccaucccgcagaggccccuguccaccuggagacc

SEQ ID NO: 481714 - RNA, 63 nt, hsa
ugggccucggcccuucccgcaccgccgccagcgcccgcagacacccuggcaucucaagaggga

SEQ ID NO: 481715 - RNA, 63 nt, hsa
cccuccuaccccugggcagguguccagcgcagccccgcagagcuccaggguggccaaguggau

SEQ ID NO: 481716 - RNA, 63 nt, hsa
ggggugcagaucuccuggcguguccaccauggccccgcagaacgccagggaccgccugcugcc

SEQ ID NO: 481717 - RNA, 63 nt, hsa
ucucugagccgcggacaugcccucgcauugcuucccgcagagugcagagacaggaagcuggag

SEQ ID NO: 481718 - RNA, 63 nt, hsa
cugaggauggagccgcccccagccgacuccaagcccgcagagggcagacgccacccuggacug

SEQ ID NO: 481719 - RNA, 63 nt, hsa
ggaggauuccagaacagcagcacugagcucccacccgcagagccucuggacggccuuggcaac

SEQ ID NO: 481720 - RNA, 63 nt, hsa
caaggacgccuaccccgaaaccggccccgacgccccgcagaggcccgccugaagccagcccgg

SEQ ID NO: 481721 - RNA, 61 nt, hsa
ucacccaguggcucugcugacacagucgguccccgcagaggucacuguggcaaagccucac

SEQ ID NO: 481722 - RNA, 63 nt, hsa
caaaccacucaggacaguacccguggcacugggcccgcagaagcaagggaugacuugguucuu

SEQ ID NO: 481723 - RNA, 63 nt, hsa
agaggcccccgagguguguguaggaggcggaggcccgcagagcacagagcaggagaagggcuu

SEQ ID NO: 481724 - RNA, 63 nt, hsa
cgaguuggggggaggggguguggcaacgugccccccgcagaggccacgcauguuugaccaaag

SEQ ID NO: 481725 - RNA, 63 nt, hsa
cugagucuuuuggaggcuccaagccucaaagugcccgcagagcccaccuugaggguuuugcua

SEQ ID NO: 481726 - RNA, 63 nt, hsa
auaguguagauggacauuugccacaacacacugcccgcagaaauggacuuaccgugaagccaa

SEQ ID NO: 481727 - RNA, 63 nt, hsa
gguggcgcuucucagccggcugucccagccagccccgcagagcgcccacggacaguguccacu

SEQ ID NO: 481728 - RNA, 63 nt, hsa
uuuccaggagccccaggcccggaggaggcgaagcccgcagagcaaagguggaaacacgugccu

SEQ ID NO: 481729 - RNA, 63 nt, hsa
agggccaaggacaauugggagggcagcaggcagcccgcagaugguggccauguggcacgcugc

SEQ ID NO: 481730 - RNA, 63 nt, hsa
gccccuccuucugcugccuggccaagccccacacccgcagacccuccuucccauccucugaaa

SEQ ID NO: 481731 - RNA, 63 nt, hsa
cgguacccggccgccguucugcaaugcaucacucccgcagaggggggugcagaucaggcgccg

SEQ ID NO: 481732 - RNA, 63 nt, hsa
acugaacagaacgucgcugauggagaaagggcucccgcagaaggaacggccuguaccgugcgc

SEQ ID NO: 481733 - RNA, 63 nt, hsa
guguaugcgagcgcccgccucccagccccggugcccgcagaagacgcuuuuccccagcagguc

SEQ ID NO: 481734 - RNA, 63 nt, hsa
ggcccucgggaagccuuggacagaacccuccaccccgcagaccaggcgucguguguguguggg

SEQ ID NO: 481735 - RNA, 63 nt, hsa
uacgggggcgcggcagggguccccggccccucccccgcagaggucaaugccaacgaacaaacg

SEQ ID NO: 481736 - RNA, 63 nt, hsa
cgcccccuccgccgccccuuccccagcccugcccccgcagacucccccugccgccaagacuuc

SEQ ID NO: 481737 - RNA, 63 nt, hsa
cgguuucggggcucccccuuccucucccucccucccgcagaaggggguuuuaggggccugggc

SEQ ID NO: 481738 - RNA, 63 nt, hsa
ggcugggccccuccaggagucacagaugaggcccccgcagagacuggugaguggugacccugu

SEQ ID NO: 481739 - RNA, 63 nt, hsa
gguccggaagggugaucaucgacccccaagggacccgcagacccuuaaaaaaaucacccacaa

SEQ ID NO: 481740 - RNA, 56 nt, hsa
acucccuguccuuuucauagcuccugcccgcagaccucuggauuaggucucuguug

SEQ ID NO: 481741 - RNA, 63 nt, hsa
uggaggucagaguggaagcaggugugagagggucccgcagaagaaaacauggcugccaaagug

SEQ ID NO: 481742 - RNA, 63 nt, hsa
ccgggagcugauggccccucucucccggcuccgcccgcagacucuggcuccuccgacuacacc

SEQ ID NO: 481743 - RNA, 63 nt, hsa
cccauccccccucagauccagacaugccccucccccgcagacacaccccaaggcagcccaacc

SEQ ID NO: 481744 - RNA, 63 nt, hsa
cuccacuccaccuccacccacuguccgccucugcccgcagagcccacgcccgacuagcaggca

SEQ ID NO: 481745 - RNA, 63 nt, hsa
gugugaggggcuuggccugcgccccgccagcugcccgcagaggugcagccucgaggaaucuga

SEQ ID NO: 481746 - RNA, 63 nt, hsa
acuaggcguggaccugcccauggugccugucagcccgcagagcccaucuacgcccaacacaga

SEQ ID NO: 481747 - RNA, 63 nt, hsa
ugggacaucugaggauugggauucuuuguucaccccgcagauaguuaaugaauggucugcccu

SEQ ID NO: 481748 - RNA, 63 nt, hsa
gauuaacggugcuaaccccgucugcuccucccucccgcagagacuggggccuggacuggacau

SEQ ID NO: 481749 - RNA, 63 nt, hsa
ccccguccucugcugcuggccucugggucgugccccgcagacugagcugcgcuuggggguccu

SEQ ID NO: 481750 - RNA, 60 nt, hsa
gcagagaucggcccuacuagaugcagagaccccgcagagcugcauugacuaccagauuua

SEQ ID NO: 481751 - RNA, 63 nt, hsa
cccacgccucggggcccccgccgccccuccggacccgcagagcuggggacauggcaugcccug

SEQ ID NO: 481752 - RNA, 63 nt, hsa
gugagcuagcccuuagagaaggcugucccggggcccgcagaggugcccuuacugaggugacag

SEQ ID NO: 481753 - RNA, 63 nt, hsa
gcuaccugagccugacgcccgagcaguggaggucccgcagaagcuacagcugccaggucaugc

SEQ ID NO: 481754 - RNA, 63 nt, hsa
gccccucuccaauagguguggccccuaccagaccccgcagacccgggcacuucucagcauggc

SEQ ID NO: 481755 - RNA, 63 nt, hsa
gccuaaguauguggagcucugcuuuggcacugccccgcagaggccacgccuauuuauucuguu

SEQ ID NO: 481756 - RNA, 63 nt, hsa
cuguccccaaauuggccucgguggcaggggagccccgcagagcuggacagcgacacgcagggg

SEQ ID NO: 481757 - RNA, 63 nt, hsa
uuccugaccauccucagaaucucaugccauuuucccgcagagcugagggauguggucagcagu

SEQ ID NO: 481758 - RNA, 64 nt, hsa
aauuuuuaaaguugaaaagcaucccaguuaaacuagaugugauaguuaaaccagaugaaagcau

SEQ ID NO: 481759 - RNA, 64 nt, hsa
cauaucuauaaugcccuucuauaugugcuaccauagaugugacauuuuugaccuuaauaucguc

SEQ ID NO: 481760 - RNA, 64 nt, hsa
agagaauccucgaggugcuuccuggcaggagagcagaugugauucugagcgacauggcgcccaa

SEQ ID NO: 481761 - RNA, 64 nt, hsa
ugcccaccucggccucccaaagugcugggauuacagaugugagccauggugcccggcuacucuu

SEQ ID NO: 481762 - RNA, 50 nt, hsa
agaauuccuucauggugugaagaugugaauaauugcacaugguuuugaga

SEQ ID NO: 481763 - RNA, 64 nt, hsa
guugugggaggggaaagaggaaacagagcuagucagaugugaauuguaucuguuguaauaaaca

SEQ ID NO: 481764 - RNA, 64 nt, hsa
cccuuagggcauacuacugucagucagaacugcaagaugugaaugaagcucuuaacggcuugga

SEQ ID NO: 481765 - RNA, 64 nt, hsa
agagcuacuucgugacacuggccaucugagucacagaugugaagucgauuucacuuuauaacua

SEQ ID NO: 481766 - RNA, 64 nt, hsa
acugauuuccagccccaccaugugugcuguuuucagaugugauugagggguguucugcccugcc

SEQ ID NO: 481767 - RNA, 64 nt, hsa
ucugcccugccuccacugucacagccuuuaauaaagaugugaaucuugaaagccugaugcucca

SEQ ID NO: 481768 - RNA, 64 nt, hsa
gcucuuccacgcuuagaucaugucuucagaacuuagaugugaaaaucuacacacugggagaugc

SEQ ID NO: 481769 - RNA, 64 nt, hsa
caauuuugcccaugacauugccuacaggauuuccagaugugacuugcacucagaagaucagugg

SEQ ID NO: 481770 - RNA, 64 nt, hsa
auauaagauaauucauauuggagagaaauucuacagaugugaagaauguggcaaaggcuuuaau

SEQ ID NO: 481771 - RNA, 64 nt, hsa
aauucuuacugcagagaaacucuacaaaccaguaagaugugacagugcuucugacaacaucuca

SEQ ID NO: 481772 - RNA, 64 nt, hsa
uuaacaugccaagagaugugaaauguggccaaagagaugugaggguaaggggaaagccaaagcu

SEQ ID NO: 481773 - RNA, 64 nt, hsa
ugaaaagaaugaauugagaguuuaacaugccaagagaugugaaauguggccaaagagaugugag

SEQ ID NO: 481774 - RNA, 63 nt, hsa
uuuauaauauaagcaacauuuagcuaguuguuuugaagacacccaguacuaaguaauauuguu

SEQ ID NO: 481775 - RNA, 63 nt, hsa
gucugaaguuucuuuggaaacucugcaaugcacugaagacaucuguaauaugauguuaccaaa

SEQ ID NO: 481776 - RNA, 63 nt, hsa
gaguuucuguggauauauuugcacagauaucuuugaagacacaaacacucaccugggacguug

SEQ ID NO: 481777 - RNA, 63 nt, hsa
aauguauauaauucaaacagagcaucuuguaacugaagacacaccauaucuaugauaucgcau

SEQ ID NO: 481778 - RNA, 63 nt, hsa
uaguggaggagggagaaccauauuuauuuauaaugaagacaucuaagaucccuaugaugaaug

SEQ ID NO: 481779 - RNA, 63 nt, hsa
uguucuguuggcaagccacagugcucccuugacugaagacauuuccagguagauuucucagcc

SEQ ID NO: 481780 - RNA, 63 nt, hsa
guguuuuaaagaaaugcagggaggcaauguuucugaagacauuuucuguuuauaagagaguag

SEQ ID NO: 481781 - RNA, 63 nt, hsa
uucuauuaaauaucaauuaguaaguauagcuaaugaagacauauaaugaaaguaauuuuaugc

SEQ ID NO: 481782 - RNA, 63 nt, hsa
agucucuaagauugagaggucugaguuagccaaugaagacaucugagauccuauccaagauuu

SEQ ID NO: 481783 - RNA, 63 nt, hsa
ggaauccccucacagugggcgacagaucugaagugaagacaggagaugaugagaaaagcucac

SEQ ID NO: 481784 - RNA, 63 nt, hsa
ugccugcacucccuggccuugcccgucgugugcugaagacauguuucaagaaccgcauuucgg

SEQ ID NO: 481785 - RNA, 63 nt, hsa
ccggagggaggcacuagucaccgacagcggccuugaagacagagcaaagcgcccacccagguc

SEQ ID NO: 481786 - RNA, 63 nt, hsa
uaaaaaaagauauaguauuaaugccuguauuuaugaagacagggccauugcacugcugcuaug

SEQ ID NO: 481787 - RNA, 63 nt, hsa
ucagaggccaaaucuguaaaaucaaaaugagguugaagacaauuagugaaaguaauguuauag

SEQ ID NO: 481788 - RNA, 63 nt, hsa
uaaaugaaauuugcaaaaucacuuagcagcaacugaagacaauuaucaaccacguggagaaaa

SEQ ID NO: 481789 - RNA, 63 nt, hsa
uguucucacaguguggggcagccguccuucuaaugaagacaaugauauugacacugucccucu

SEQ ID NO: 481790 - RNA, 63 nt, hsa
aaggaauuguggauggaagacaagcagaaaagcugaagacaauaguuccucagacagaccuca

SEQ ID NO: 481791 - RNA, 63 nt, hsa
gauggcucugcacgaaggagaaccacgcauuuaugaagacauccaggacuacgaggcggccaa

SEQ ID NO: 481792 - RNA, 63 nt, hsa
gcucuaucagccccuguaccccacacugcccucugaagacaacacaggcuccugcuuccaccu

SEQ ID NO: 481793 - RNA, 63 nt, hsa
uaccucacugggaauguguuuugaaaaugaauuugaagacaagccaacaaacccugcacucca

SEQ ID NO: 481794 - RNA, 63 nt, hsa
caguaugggguuucccucuggaaaaagaaaaucugaagacauuacaguugccuauugccucuu

SEQ ID NO: 481795 - RNA, 63 nt, hsa
caguugcacaaauggguaacuaucaggaauaucugaagacauuggcuucuccacugcgagaga

SEQ ID NO: 481796 - RNA, 64 nt, hsa
uccuggaaggaacugggcaucuaacuguuacaccaaaucuuaagugaauaaaacuuuaccaagg

SEQ ID NO: 481797 - RNA, 64 nt, hsa
uucuaaaauguaaauauuugccacaauguaaagcaaaucuuagcuauauuuuaaaucauaaaua

SEQ ID NO: 481798 - RNA, 64 nt, hsa
gcucacaagucaauugcaaacaaacugaauguacaaaucuuagugcuggugcugaaaucucuuc

SEQ ID NO: 481799 - RNA, 64 nt, hsa
uccaaacuaagauaagagacuaaaauaaaaugcuaaaucuuaaaagaaacuggguuuaugcacu

SEQ ID NO: 481800 - RNA, 64 nt, hsa
uagaguauauucugaaaauuuaggaaugaggaagaaaucuuaauacuuccuuccuuaacauaca

SEQ ID NO: 481801 - RNA, 64 nt, hsa
gaaaacuaugucaguaacauguugcuuuguauaaaaaucuuauuuauaaaugugaagcuuuuug

SEQ ID NO: 481802 - RNA, 64 nt, hsa
gggcuagauugggauuugaagacaaaauuguaggaaaucuuacauuuuugcaauaacaaacauu

SEQ ID NO: 481803 - RNA, 64 nt, hsa
auguuaugcugugaauuauucagugcauuauaagaaaucuuaguuaaucaugcuuuugggcuuc

SEQ ID NO: 481804 - RNA, 64 nt, hsa
uuauuuaaaugugugaucagaaagaauggcguacaaaucuuauuauuucuaaaaauaagaauaa

SEQ ID NO: 481805 - RNA, 64 nt, hsa
cuggcaaacugaguugccggucauauugaggacaaaaucuuaaauaugugcuauuagcauuguu

SEQ ID NO: 481806 - RNA, 64 nt, hsa
aauguucugauacauuaggaugaaguuaaaucuuaaaucuuauuaguugaauuguuguaaggac

SEQ ID NO: 481807 - RNA, 64 nt, hsa
uuuuuuuaauguucugauacauuaggaugaaguuaaaucuuaaaucuuauuaguugaauuguug

SEQ ID NO: 481808 - RNA, 64 nt, hsa
uauuuuuccuuuaaauuuuaaucuuauaauauagaaaucuuauguaaaugaaauuuugucaugu

SEQ ID NO: 481809 - RNA, 64 nt, hsa
ucaaaugaauuauuuucuucuuguuaaauaaauuaaaucuuacuuucuuuuaaugaccaaccuu

SEQ ID NO: 481810 - RNA, 64 nt, hsa
cauaauucagcauaagaaaauucacaccagagccaaaucuuacaaauguagcaguugugaaaga

SEQ ID NO: 481811 - RNA, 64 nt, hsa
ucuuaaucgacuccugcaaaucuauaccagugagaaaucuuacaaauguauugaauguggcaaa

SEQ ID NO: 481812 - RNA, 64 nt, hsa
uguagugcaaacuuuaagcaccuuaaaacauuuaaaaucuuauuacaggugauagagauagaua

SEQ ID NO: 481813 - RNA, 64 nt, hsa
guucaagauauauucuuuuugguuuuaaaaugcaaaaucuuauuggcuguucuguugaauguca

SEQ ID NO: 481814 - RNA, 64 nt, hsa
agauuucaaagaauuacugguuuuaccaugacucaaaucuuaagaucuguuucuacuauucagu

SEQ ID NO: 481815 - RNA, 64 nt, hsa
cagaauuuucucauauacaguauucagugcacagaaaucuuaugauuggcucaaguacaguaag

SEQ ID NO: 481816 - RNA, 64 nt, hsa
uuaaaauuuuuaguuuuggauuguauacuaaugaaaaucuuaaugauguuuuugauuuuuauau

SEQ ID NO: 481817 - RNA, 64 nt, hsa
gauguuuuugauuuuuauauacuuauuuuaaagaaaaucuuauauaguacauuuuacaaaaauu

SEQ ID NO: 481818 - RNA, 64 nt, hsa
uugaaaagaagauauugcauuuuuaagaguuuaaaaaucuuaugagugagaaauauuaaaaaaa

SEQ ID NO: 481819 - RNA, 64 nt, hsa
aguuuaaaaaucuuaugagugagaaauauuaaaaaaaucuuauuuucaccucuuuagaagaaau

SEQ ID NO: 481820 - RNA, 64 nt, hsa
cauguaauuggacauguaaacuuguuaaaaaucaaaaucuuacugauuguacagggagaaauua

SEQ ID NO: 481821 - RNA, 64 nt, hsa
gugucauuuuauaguacuuuacaguugucaaaaaaaaucuuacauauauugaucuaguugaucg

SEQ ID NO: 481822 - RNA, 64 nt, hsa
caguuaacaaauuauuuguaauguauuuuuuuagaaaucuuaaaauugccuuugcacugaagua

SEQ ID NO: 481823 - RNA, 64 nt, hsa
aaugucaacuuugagcacuuuguugaguuuugaaaaaucuuauuuguugcugcacagguuaaua

SEQ ID NO: 481824 - RNA, 64 nt, hsa
gcauuuuuguuuguuuuuuauauguagcuuuaagaaaucuuaacacauauauugauucauguca

SEQ ID NO: 481825 - RNA, 64 nt, hsa
uaaguuuuuauuuugaaauaaguuuagauucacaaaaucuuaccaaaauauuccagaguucuug

SEQ ID NO: 481826 - RNA, 64 nt, hsa
ccucaauagacaucagagaauccaugcuggacagaaaucuuacaaaugucaucagugugguaag

SEQ ID NO: 481827 - RNA, 64 nt, hsa
ccuugcaagucaucauagucuucauacugcagagaaaucuuacaaaugugaagacugugacaaa

SEQ ID NO: 481828 - RNA, 64 nt, hsa
ccucauuagacaucagagaauccaugcuggacagaaaucuuacaaaugucaucaguguggaagg

SEQ ID NO: 481829 - RNA, 64 nt, hsa
ccuugcaagucaucauagacuucauacugcauagaaaucuuacaaacgugaacaaugugacaaa

SEQ ID NO: 481830 - RNA, 64 nt, hsa
acuguggcuuaggauacuuauugggguauaaugaaaaucuuacugaaaguuaauuucacauucu

SEQ ID NO: 481831 - RNA, 64 nt, hsa
gaaagccuacuauugcguuucaaugugaacuuugaaaucuuauugugcauccuuacacaccuuc

SEQ ID NO: 481832 - RNA, 64 nt, hsa
agcuuuguuuguucuuguuuuuaaguuugcacucaaaucuuaagaaauaaauccacccauguua

SEQ ID NO: 481833 - RNA, 64 nt, hsa
ucacacuugaaccauaguuacuguaaaaugcaaaaaaucuuaauacuguuauucuuugcacuuu

SEQ ID NO: 481834 - RNA, 64 nt, hsa; identical to SEQ ID NO: 216241

SEQ ID NO: 481835 - RNA, 64 nt, hsa; identical to SEQ ID NO: 216242

SEQ ID NO: 481836 - RNA, 64 nt, hsa; identical to SEQ ID NO: 216243

SEQ ID NO: 481837 - RNA, 64 nt, hsa; identical to SEQ ID NO: 216244

SEQ ID NO: 481838 - RNA, 64 nt, hsa
caguacaggaggguggcgaggccccucccucacuggcacgcaugagcaccacccgccuccccga

SEQ ID NO: 481839 - RNA, 64 nt, hsa
ccgcugucacaauggcacacugccacugucccuuggcacgcacacagccacagccacacgugug

SEQ ID NO: 481840 - RNA, 64 nt, hsa
ccucaaggauacagggagccggcggccucucgacggcacgcacuugccuguuggcugcugcggc

SEQ ID NO: 481841 - RNA, 64 nt, hsa
cacggccccggguccaggagaagugcucccuggaggcacgcaccacugcuucccacuggggccg

SEQ ID NO: 481842 - RNA, 64 nt, hsa; identical to SEQ ID NO: 361028

SEQ ID NO: 481843 - RNA, 64 nt, hsa; identical to SEQ ID NO: 361029

SEQ ID NO: 481844 - RNA, 64 nt, hsa
gucguagagucucaccaucuccaaggauuggucuugagaacacuguucagugacggccaugcag

SEQ ID NO: 481845 - RNA, 64 nt, hsa
cgcucuuccugcggguucuuggcgagacacagcuugagaacagaagggcgucgggggaaccugc

SEQ ID NO: 481846 - RNA, 64 nt, hsa
gaguagcugcccuuucucagggcagaugaugcuuugagaacauacuuuggccauuacccccagc

SEQ ID NO: 481847 - RNA, 64 nt, hsa
gaaguauauauaucauagcaaauaagucaucugaugagaacaagcuauuugggcacaacacauc

SEQ ID NO: 481848 - RNA, 64 nt, hsa
auuugucuguaaaagugcaggaacaguuauucuaugagaacacugcaucugcauucauagccac

SEQ ID NO: 481849 - RNA, 64 nt, hsa
uucaggccccuauauuuucuguaggaaaaaucguugagaacacuuuucuauaugggugauuuug

SEQ ID NO: 481850 - RNA, 64 nt, hsa
guuguuugagcccaggaauuugagaacaggauuuugagaacagcuuggacaucaugacgaaacc

SEQ ID NO: 481851 - RNA, 64 nt, hsa
gcugaggcaagcagguuguuugagcccaggaauuugagaacaggauuuugagaacagcuuggac

SEQ ID NO: 481852 - RNA, 64 nt, hsa
uuucuccuuugaagucauuuauuauuuuauaaauugagaacaaccacaccaccaaaugucacac

SEQ ID NO: 481853 - RNA, 64 nt, hsa
aacagugguguugcauugaauugaacuuuggcaaugagaacacagcacacagcucccuuuucaa

SEQ ID NO: 481854 - RNA, 64 nt, hsa
ucuccaucuagagcccaaugaaggaagcuucaaaugagaacaugauggaaucaguaaccauuca

SEQ ID NO: 481855 - RNA, 64 nt, hsa
aaaauaucagacauguuuuggaaaagucuuaauuugagaacaccaaaggaaacuaccccagaau

SEQ ID NO: 481856 - RNA, 64 nt, hsa
cauggguacucaauguuuagcucucccuuauacgugagaacaugugauguuugguuuucuguuc

SEQ ID NO: 481857 - RNA, 64 nt, hsa
gaagacauauggauguuagcagccauauuggaacugagaacacaggaaugguggaaagguagaa

SEQ ID NO: 481858 - RNA, 64 nt, hsa
gauuccacuucuccuacauuuaauuauuuuuaauugagaacaacucaugaucacaauucauaaa

SEQ ID NO: 481859 - RNA, 64 nt, hsa
ugucugcuuauaauauucacugaucugcaguuuaugagaacacauuuucacaguuauguuucuu

SEQ ID NO: 481860 - RNA, 64 nt, hsa
agauauuuuaccaugaagagauugcacuuauccuugagaacagucuaaauauaaaugaagauau

SEQ ID NO: 481861 - RNA, 64 nt, hsa
agauauuuuaccaugaagagauugcacuuauccuugagaacagucuaaugauacuuuuuuuacu

SEQ ID NO: 481862 - RNA, 64 nt, hsa
aauugucugugugaggugcuuaaccuaucagcccugagaacacaaagcaauaaucuuuguuacu

SEQ ID NO: 481863 - RNA, 64 nt, hsa
gcagggggcaaggggccaggugccccccaccagcugagaacaaagugucuaucugggugugggc

SEQ ID NO: 481864 - RNA, 64 nt, hsa
uuuuacauaaaugccauauuuaugguuuccuuccugagaacaaucuugcucuugccauguucuu

SEQ ID NO: 481865 - RNA, 64 nt, hsa
gaggcugacaugucaguaacugacuggggugcacugagaacaggcaagacuuuaaauucccaua

SEQ ID NO: 481866 - RNA, 64 nt, hsa
uguauccauuugaguccugcaugcugugaaaugcugagaacagaagcauuaaauugguuuuucu

SEQ ID NO: 481867 - RNA, 64 nt, hsa
gagcauggcccagacaagcagcuggguuggcuucugagaacaggacuuacccugggcuucagga

SEQ ID NO: 481868 - RNA, 64 nt, hsa
aacauucaaugucaccugaaagagaaaugggaaaugagaacauuccaaguacagugagcacaau

SEQ ID NO: 481869 - RNA, 64 nt, hsa
guggcacaaauacucaugccagcucauuacagcaugagaacagcaguuuauuacucacuaaaga

SEQ ID NO: 481870 - RNA, 64 nt, hsa
aaguaacugacaugucuauuuccuugggagcaugugagaacauagcaguagggaccaaaagucu

SEQ ID NO: 481871 - RNA, 64 nt, hsa
gauacgacuucuacuauauacauuucucugucccugagaacagagaaacguaacccuguagggg

SEQ ID NO: 481872 - RNA, 64 nt, hsa
agggguugccccagaaggcaggggaaggaccugaugagaacagaauagcugggaggcugcagag

SEQ ID NO: 481873 - RNA, 64 nt, hsa
cgcuuccucaaaaagaucacagagggaggagcucugagaacagucuccuucaacaguucggcca

SEQ ID NO: 481874 - RNA, 64 nt, hsa
uucccaccaaggaggaauggccaaaccagaugggugagaacaagcccaaugugaugcacaccua

SEQ ID NO: 481875 - RNA, 64 nt, hsa
aaugaagauguuguaugacaagaaggaaaguuacugagaacaaaaacccagauuggugagauag

SEQ ID NO: 481876 - RNA, 64 nt, hsa
cgucccgugucuccaggggaucacacgagcuagcuucugcaauguuuaucuagaauggauucaa

SEQ ID NO: 481877 - RNA, 64 nt, hsa
gaucauugcuggcaugaagcuguugcggacaucauucugcaacccgguuuaccaguuuauuaac

SEQ ID NO: 481878 - RNA, 64 nt, hsa
uaaguuguuccauucuuuggccauuauaacuuuuuucugcaaauauucuggugacuuaucuuug

SEQ ID NO: 481879 - RNA, 64 nt, hsa
auaaacuguugauaauagaucaucuuguauauacuucugcaauuauaagauguuuuuugaugau

SEQ ID NO: 481880 - RNA, 64 nt, hsa
agcuacuucuuuguuagaggauugagaaugaaauuucugcaaaagggcccaugguucauuuggu

SEQ ID NO: 481881 - RNA, 64 nt, hsa
guggaacucccugauucuauacccucuuccuucuuucugcaaggcagaggaauaauauuuuuaa

SEQ ID NO: 481882 - RNA, 64 nt, hsa
ggaaugcauuugcauaaugacccagaucaucauuuucugcaacugagaauuauauuucaucauu

SEQ ID NO: 481883 - RNA, 64 nt, hsa
ugacauguaaaagaccaaaguaauuuuucugaacuucugcaauucugagaacucuccaaggaau

SEQ ID NO: 481884 - RNA, 64 nt, hsa
gaaaagaaagcauacaugcuuaugcaugaaacaauucugcaaaaaaaggaugaauuuccuccau

SEQ ID NO: 481885 - RNA, 64 nt, hsa
ucugcgucaauuaagucaagcugaagcuacugacuucugcaaaguauuagugguacaguaaaaa

SEQ ID NO: 481886 - RNA, 64 nt, hsa
acuuuuauguauaauucuuucugccugccuacuuuucugcaaaaaugagauguacagauuucgg

SEQ ID NO: 481887 - RNA, 64 nt, hsa
agaaaaugaaggccaaacagaagcaggcuccagcuucugcaaaaacuuggauucacaaaugucc

SEQ ID NO: 481888 - RNA, 64 nt, hsa
ucccacacaccuuggccuucugcaagccaagugguucugcaaggucaaggcacuaguaucagau

SEQ ID NO: 481889 - RNA, 64 nt, hsa
ccucccuaccucauccaucccacacaccuuggccuucugcaagccaagugguucugcaagguca

SEQ ID NO: 481890 - RNA, 64 nt, hsa
agccugacacauacuaagggcaccugcagacacuuucugcaauaagcucucagaccaucagcau

SEQ ID NO: 481891 - RNA, 64 nt, hsa
agccucacccaugcuaagggcacaugcacacauuuucugcaauucacucucagaccaucagcau

SEQ ID NO: 481892 - RNA, 64 nt, hsa
uaauacauuuaagaucuuguuuaaacaauguuucuucugcaacuggcuacuccucuuauauuaa

SEQ ID NO: 481893 - RNA, 64 nt, hsa
auugcucuucuucuuuuagacugguugucauaguuucugcaaagggcaaguucauugugcuacc

SEQ ID NO: 481894 - RNA, 64 nt, hsa
cuuggcaauuaauagcggcaaaaauagacccagcuucugcaagguuuuccaggaaaaucugcuu

SEQ ID NO: 481895 - RNA, 64 nt, hsa
uugccuccauugucagacuauuucgucugaucuuuucugcaauguuccucugacaucaaaaaau

SEQ ID NO: 481896 - RNA, 64 nt, hsa
gcagggaccaucaagaaccuacagacuccaucucuucugcaagccucaugccaacccugggcua

SEQ ID NO: 481897 - RNA, 64 nt, hsa
aagaauuaaugacuuacuuuaauuacuggaauucuucugcaacauuugacaaaacuaaccuuga

SEQ ID NO: 481898 - RNA, 64 nt, hsa
aguggaugaauguucuuuaaauuuguguaaauacuucugcaaagguacugaugcuguaaaguca

SEQ ID NO: 481899 - RNA, 64 nt, hsa
guguaauggaauuaaagugcuuuugcacaauaaguucugcaaaacccucucauucaugaaaagg

SEQ ID NO: 481900 - RNA, 64 nt, hsa
aauauuuugaauauuuuagcuauauuuaguggcuuucugcaagcaacuagaacagagaaguaau

SEQ ID NO: 481901 - RNA, 64 nt, hsa
ugaaaaagaaauauaaaaaggacccuaaaaagaauucugcaaaauaagagaagaaauaauuugu

SEQ ID NO: 481902 - RNA, 64 nt, hsa
uccaccauguuccugacaccuaucuauuaaaccauucugcaaauacgguuuuucuaccugauug

SEQ ID NO: 481903 - RNA, 64 nt, hsa
uaaacaacagaacuuuaugcuuaauuuagauccuuucugcaaagugcacugaauugcugaaagu

SEQ ID NO: 481904 - RNA, 64 nt, hsa
uuccagguuuuguugaagagauaccugccagcacuucugcaagcugaaauuuacagaagcaaau

SEQ ID NO: 481905 - RNA, 64 nt, hsa
ccucauguaaacuggauugagaaauucucagugauucugcaauggauuuuuuuuuaaugcagaa

SEQ ID NO: 481906 - RNA, 64 nt, hsa
ucuuacuaaggauguuuuuaccagccugccugacuucugcaaaccuacccugucaaggagauca

SEQ ID NO: 481907 - RNA, 64 nt, hsa
aaacaaaaaacaaaaacuaaaaaccucuuagcuuuucugcaauucaacuuuuuauuuuuauuuu

SEQ ID NO: 481908 - RNA, 64 nt, hsa
guaugugucauagaauacuuaguucugcuagauauucugcaaauauauuugggaauuacuuccu

SEQ ID NO: 481909 - RNA, 64 nt, hsa
uucauauacccaauaauaagcuacagaacuaauauucugcaaaugucucuuggaacacacugcc

SEQ ID NO: 481910 - RNA, 64 nt, hsa; identical to SEQ ID NO: 87706

SEQ ID NO: 481911 - RNA, 64 nt, hsa; identical to SEQ ID NO: 87707

SEQ ID NO: 481912 - RNA, 64 nt, hsa; identical to SEQ ID NO: 87708

SEQ ID NO: 481913 - RNA, 64 nt, hsa; identical to SEQ ID NO: 87709

SEQ ID NO: 481914 - RNA, 64 nt, hsa; identical to SEQ ID NO: 87710

SEQ ID NO: 481915 - RNA, 64 nt, hsa; identical to SEQ ID NO: 87711

SEQ ID NO: 481916 - RNA, 64 nt, hsa; identical to SEQ ID NO: 87712

SEQ ID NO: 481917 - RNA, 64 nt, hsa; identical to SEQ ID NO: 87713

SEQ ID NO: 481918 - RNA, 64 nt, hsa; identical to SEQ ID NO: 87714

SEQ ID NO: 481919 - RNA, 64 nt, hsa; identical to SEQ ID NO: 87715

SEQ ID NO: 481920 - RNA, 64 nt, hsa; identical to SEQ ID NO: 87716

SEQ ID NO: 481921 - RNA, 64 nt, hsa; identical to SEQ ID NO: 87717

SEQ ID NO: 481922 - RNA, 64 nt, hsa; identical to SEQ ID NO: 87718

SEQ ID NO: 481923 - RNA, 64 nt, hsa; identical to SEQ ID NO: 87719

SEQ ID NO: 481924 - RNA, 64 nt, hsa; identical to SEQ ID NO: 87720

SEQ ID NO: 481925 - RNA, 64 nt, hsa; identical to SEQ ID NO: 87721

SEQ ID NO: 481926 - RNA, 64 nt, hsa; identical to SEQ ID NO: 87722

SEQ ID NO: 481927 - RNA, 64 nt, hsa; identical to SEQ ID NO: 87723

SEQ ID NO: 481928 - RNA, 64 nt, hsa; identical to SEQ ID NO: 87724

SEQ ID NO: 481929 - RNA, 64 nt, hsa; identical to SEQ ID NO: 87725

SEQ ID NO: 481930 - RNA, 64 nt, hsa; identical to SEQ ID NO: 87726

SEQ ID NO: 481931 - RNA, 64 nt, hsa; identical to SEQ ID NO: 87727

SEQ ID NO: 481932 - RNA, 64 nt, hsa; identical to SEQ ID NO: 87728

SEQ ID NO: 481933 - RNA, 64 nt, hsa; identical to SEQ ID NO: 87729

SEQ ID NO: 481934 - RNA, 64 nt, hsa; identical to SEQ ID NO: 87730

SEQ ID NO: 481935 - RNA, 64 nt, hsa; identical to SEQ ID NO: 87731

SEQ ID NO: 481936 - RNA, 64 nt, hsa; identical to SEQ ID NO: 87732

SEQ ID NO: 481937 - RNA, 64 nt, hsa; identical to SEQ ID NO: 87733

SEQ ID NO: 481938 - RNA, 64 nt, hsa; identical to SEQ ID NO: 87734

SEQ ID NO: 481939 - RNA, 64 nt, hsa; identical to SEQ ID NO: 87735

SEQ ID NO: 481940 - RNA, 64 nt, hsa; identical to SEQ ID NO: 87736

SEQ ID NO: 481941 - RNA, 64 nt, hsa; identical to SEQ ID NO: 87737

SEQ ID NO: 481942 - RNA, 64 nt, hsa; identical to SEQ ID NO: 87738

SEQ ID NO: 481943 - RNA, 64 nt, hsa; identical to SEQ ID NO: 87739

SEQ ID NO: 481944 - RNA, 64 nt, hsa; identical to SEQ ID NO: 87740

SEQ ID NO: 481945 - RNA, 64 nt, hsa; identical to SEQ ID NO: 87741

SEQ ID NO: 481946 - RNA, 64 nt, hsa; identical to SEQ ID NO: 87742

SEQ ID NO: 481947 - RNA, 64 nt, hsa; identical to SEQ ID NO: 87743

SEQ ID NO: 481948 - RNA, 64 nt, hsa; identical to SEQ ID NO: 87744

SEQ ID NO: 481949 - RNA, 64 nt, hsa; identical to SEQ ID NO: 87745

SEQ ID NO: 481950 - RNA, 64 nt, hsa; identical to SEQ ID NO: 87746

SEQ ID NO: 481951 - RNA, 64 nt, hsa; identical to SEQ ID NO: 87747

SEQ ID NO: 481952 - RNA, 64 nt, hsa; identical to SEQ ID NO: 87748

SEQ ID NO: 481953 - RNA, 64 nt, hsa; identical to SEQ ID NO: 87749

SEQ ID NO: 481954 - RNA, 64 nt, hsa; identical to SEQ ID NO: 87750

SEQ ID NO: 481955 - RNA, 64 nt, hsa; identical to SEQ ID NO: 87751

SEQ ID NO: 481956 - RNA, 64 nt, hsa; identical to SEQ ID NO: 87752

SEQ ID NO: 481957 - RNA, 64 nt, hsa; identical to SEQ ID NO: 87753

SEQ ID NO: 481958 - RNA, 64 nt, hsa; identical to SEQ ID NO: 87754

SEQ ID NO: 481959 - RNA, 64 nt, hsa; identical to SEQ ID NO: 87755

SEQ ID NO: 481960 - RNA, 64 nt, hsa; identical to SEQ ID NO: 87756

SEQ ID NO: 481961 - RNA, 63 nt, hsa; identical to SEQ ID NO: 87757

SEQ ID NO: 481962 - RNA, 64 nt, hsa; identical to SEQ ID NO: 87758

SEQ ID NO: 481963 - RNA, 62 nt, hsa
uuuuuuuaauaaggacaccucuuuccaaacagugccaucaaauauguucuuaucucagacuu

SEQ ID NO: 481964 - RNA, 62 nt, hsa
gguaaagaaauacauuuucuuuuucucaaauaugccaucauaugggauggguagguuccagu

SEQ ID NO: 481965 - RNA, 62 nt, hsa
accucccacugcucccugucaggggcccaggcugccaucacuggaggcugcagggaccaaga

SEQ ID NO: 481966 - RNA, 62 nt, hsa
gccacccggggugcuguucagcugccccucccugccaucagcaggugggugagggguugccc

SEQ ID NO: 481967 - RNA, 62 nt, hsa
agucacuugccuuccacgguggccagcccugcugccaucauuggcugaagcaccaccaggau

SEQ ID NO: 481968 - RNA, 62 nt, hsa
caaccucccaaguagcugggacuacaggcauaugccaucacacccagcuaauuuuuguuuuu

SEQ ID NO: 481969 - RNA, 62 nt, hsa
ucauggucauugccuucauauaacaugcuucgugccaucaugauccuugccuucauauaaca

SEQ ID NO: 481970 - RNA, 62 nt, hsa
agggugugcugguaaaguauuuugguggcagcugccaucauggucauugccuucauauaaca

SEQ ID NO: 481971 - RNA, 62 nt, hsa
cagccuccugaguagcugggacuacaggcucaugccaucaugcccagcuaauauuuuuuuau

SEQ ID NO: 481972 - RNA, 62 nt, hsa
cucacuuugacacccaggcuggagugcaguggugccaucaccacggcucacugcagccucag

SEQ ID NO: 481973 - RNA, 64 nt, hsa; identical to SEQ ID NO: 276706

SEQ ID NO: 481974 - RNA, 64 nt, hsa; identical to SEQ ID NO: 276707

SEQ ID NO: 481975 - RNA, 64 nt, hsa; identical to SEQ ID NO: 276708

SEQ ID NO: 481976 - RNA, 64 nt, hsa; identical to SEQ ID NO: 276709

SEQ ID NO: 481977 - RNA, 64 nt, hsa; identical to SEQ ID NO: 276710

SEQ ID NO: 481978 - RNA, 64 nt, hsa; identical to SEQ ID NO: 276711

SEQ ID NO: 481979 - RNA, 64 nt, hsa; identical to SEQ ID NO: 276712

SEQ ID NO: 481980 - RNA, 62 nt, hsa; identical to SEQ ID NO: 276713

SEQ ID NO: 481981 - RNA, 64 nt, hsa; identical to SEQ ID NO: 276714

SEQ ID NO: 481982 - RNA, 64 nt, hsa; identical to SEQ ID NO: 276715

SEQ ID NO: 481983 - RNA, 64 nt, hsa; identical to SEQ ID NO: 276716

SEQ ID NO: 481984 - RNA, 64 nt, hsa; identical to SEQ ID NO: 276717

SEQ ID NO: 481985 - RNA, 64 nt, hsa; identical to SEQ ID NO: 276718

SEQ ID NO: 481986 - RNA, 64 nt, hsa; identical to SEQ ID NO: 276719

SEQ ID NO: 481987 - RNA, 64 nt, hsa; identical to SEQ ID NO: 276720

SEQ ID NO: 481988 - RNA, 64 nt, hsa; identical to SEQ ID NO: 276721

SEQ ID NO: 481989 - RNA, 64 nt, hsa; identical to SEQ ID NO: 276722

SEQ ID NO: 481990 - RNA, 64 nt, hsa; identical to SEQ ID NO: 276723

SEQ ID NO: 481991 - RNA, 64 nt, hsa; identical to SEQ ID NO: 276724

SEQ ID NO: 481992 - RNA, 64 nt, hsa; identical to SEQ ID NO: 276725

SEQ ID NO: 481993 - RNA, 64 nt, hsa; identical to SEQ ID NO: 276726

SEQ ID NO: 481994 - RNA, 64 nt, hsa; identical to SEQ ID NO: 276727

SEQ ID NO: 481995 - RNA, 64 nt, hsa; identical to SEQ ID NO: 276728

SEQ ID NO: 481996 - RNA, 64 nt, hsa; identical to SEQ ID NO: 276729

SEQ ID NO: 481997 - RNA, 64 nt, hsa; identical to SEQ ID NO: 276730

SEQ ID NO: 481998 - RNA, 64 nt, hsa; identical to SEQ ID NO: 276731

SEQ ID NO: 481999 - RNA, 64 nt, hsa; identical to SEQ ID NO: 276732

SEQ ID NO: 482000 - RNA, 64 nt, hsa; identical to SEQ ID NO: 276733

SEQ ID NO: 482001 - RNA, 64 nt, hsa; identical to SEQ ID NO: 276734

SEQ ID NO: 482002 - RNA, 64 nt, hsa; identical to SEQ ID NO: 276735

SEQ ID NO: 482003 - RNA, 64 nt, hsa; identical to SEQ ID NO: 276736

SEQ ID NO: 482004 - RNA, 64 nt, hsa; identical to SEQ ID NO: 276737

SEQ ID NO: 482005 - RNA, 64 nt, hsa; identical to SEQ ID NO: 276738

SEQ ID NO: 482006 - RNA, 64 nt, hsa; identical to SEQ ID NO: 276739

SEQ ID NO: 482007 - RNA, 64 nt, hsa; identical to SEQ ID NO: 276740

SEQ ID NO: 482008 - RNA, 64 nt, hsa; identical to SEQ ID NO: 276741

SEQ ID NO: 482009 - RNA, 64 nt, hsa; identical to SEQ ID NO: 276742

SEQ ID NO: 482010 - RNA, 64 nt, hsa; identical to SEQ ID NO: 276743

SEQ ID NO: 482011 - RNA, 64 nt, hsa; identical to SEQ ID NO: 276744

SEQ ID NO: 482012 - RNA, 64 nt, hsa; identical to SEQ ID NO: 276745

SEQ ID NO: 482013 - RNA, 64 nt, hsa; identical to SEQ ID NO: 276746

SEQ ID NO: 482014 - RNA, 64 nt, hsa; identical to SEQ ID NO: 276747

SEQ ID NO: 482015 - RNA, 64 nt, hsa; identical to SEQ ID NO: 276748

SEQ ID NO: 482016 - RNA, 64 nt, hsa; identical to SEQ ID NO: 276749

SEQ ID NO: 482017 - RNA, 64 nt, hsa; identical to SEQ ID NO: 276750

SEQ ID NO: 482018 - RNA, 64 nt, hsa; identical to SEQ ID NO: 276751

SEQ ID NO: 482019 - RNA, 64 nt, hsa; identical to SEQ ID NO: 276752

SEQ ID NO: 482020 - RNA, 64 nt, hsa; identical to SEQ ID NO: 276753

SEQ ID NO: 482021 - RNA, 64 nt, hsa; identical to SEQ ID NO: 276754

SEQ ID NO: 482022 - RNA, 64 nt, hsa; identical to SEQ ID NO: 276755

SEQ ID NO: 482023 - RNA, 64 nt, hsa; identical to SEQ ID NO: 276756

SEQ ID NO: 482024 - RNA, 64 nt, hsa; identical to SEQ ID NO: 276757

SEQ ID NO: 482025 - RNA, 64 nt, hsa; identical to SEQ ID NO: 276758

SEQ ID NO: 482026 - RNA, 64 nt, hsa; identical to SEQ ID NO: 276759

SEQ ID NO: 482027 - RNA, 64 nt, hsa; identical to SEQ ID NO: 276760

SEQ ID NO: 482028 - RNA, 64 nt, hsa; identical to SEQ ID NO: 276759

SEQ ID NO: 482029 - RNA, 64 nt, hsa; identical to SEQ ID NO: 105601

SEQ ID NO: 482030 - RNA, 64 nt, hsa; identical to SEQ ID NO: 105602

SEQ ID NO: 482031 - RNA, 64 nt, hsa; identical to SEQ ID NO: 105603

SEQ ID NO: 482032 - RNA, 64 nt, hsa; identical to SEQ ID NO: 105604

SEQ ID NO: 482033 - RNA, 64 nt, hsa; identical to SEQ ID NO: 105605

SEQ ID NO: 482034 - RNA, 64 nt, hsa; identical to SEQ ID NO: 105606

SEQ ID NO: 482035 - RNA, 64 nt, hsa; identical to SEQ ID NO: 105607

SEQ ID NO: 482036 - RNA, 64 nt, hsa; identical to SEQ ID NO: 105608

SEQ ID NO: 482037 - RNA, 64 nt, hsa; identical to SEQ ID NO: 105609

SEQ ID NO: 482038 - RNA, 64 nt, hsa; identical to SEQ ID NO: 105610

SEQ ID NO: 482039 - RNA, 64 nt, hsa; identical to SEQ ID NO: 105611

SEQ ID NO: 482040 - RNA, 64 nt, hsa; identical to SEQ ID NO: 105612

SEQ ID NO: 482041 - RNA, 64 nt, hsa; identical to SEQ ID NO: 105613

SEQ ID NO: 482042 - RNA, 64 nt, hsa; identical to SEQ ID NO: 105614

SEQ ID NO: 482043 - RNA, 64 nt, hsa; identical to SEQ ID NO: 88792

SEQ ID NO: 482044 - RNA, 64 nt, hsa; identical to SEQ ID NO: 88793

SEQ ID NO: 482045 - RNA, 64 nt, hsa; identical to SEQ ID NO: 88794

SEQ ID NO: 482046 - RNA, 64 nt, hsa; identical to SEQ ID NO: 88795

SEQ ID NO: 482047 - RNA, 64 nt, hsa; identical to SEQ ID NO: 88796

SEQ ID NO: 482048 - RNA, 64 nt, hsa; identical to SEQ ID NO: 88797

SEQ ID NO: 482049 - RNA, 64 nt, hsa; identical to SEQ ID NO: 88798

SEQ ID NO: 482050 - RNA, 64 nt, hsa; identical to SEQ ID NO: 88799

SEQ ID NO: 482051 - RNA, 64 nt, hsa; identical to SEQ ID NO: 88800

SEQ ID NO: 482052 - RNA, 64 nt, hsa; identical to SEQ ID NO: 88801

SEQ ID NO: 482053 - RNA, 64 nt, hsa; identical to SEQ ID NO: 88802

SEQ ID NO: 482054 - RNA, 64 nt, hsa
gaggauggcuugaagccaguaguucaagaccagccugggcaacauaguaagaccccaucucuau

SEQ ID NO: 482055 - RNA, 64 nt, hsa
gcagugagcugugauugugccacuguuuuccagccugggcaauacagugagacccugucucaaa

SEQ ID NO: 482056 - RNA, 64 nt, hsa
gagaauugcuugaguccaggaguuugagaugcgccugggcaacauagaaaccugugucuacaaa

SEQ ID NO: 482057 - RNA, 64 nt, hsa
gcagugagcugagaucgcaccauuacacuccagccugggcaacagagccagacucugucucaaa

SEQ ID NO: 482058 - RNA, 64 nt, hsa
ucccucucccaucuucucauauccuggcucuucucugggcaagaugagccaagcagaacauucc

SEQ ID NO: 482059 - RNA, 64 nt, hsa
ccuguccaaggaccuucccucuucuccccaguuccugggcaaucacuucaccuuggacaaagga

SEQ ID NO: 482060 - RNA, 64 nt, hsa
gaagauggcuugaacucaggaguucgagacuagccugggcaacgugaugagacuccgucucuac

SEQ ID NO: 482061 - RNA, 64 nt, hsa
guaguaagcuacgaucaugccacugcacuccacucugggcaacagaaugagauccugucucuua

SEQ ID NO: 482062 - RNA, 64 nt, hsa
uaguaccccaagaagaaaauguuacuucucucaucugggcaaaacccacagaagacuucccagc

SEQ ID NO: 482063 - RNA, 64 nt, hsa
gaggaucaguugaggccaggaguuuaagaccagccugggcaacauagugagaccccugucuccc

SEQ ID NO: 482064 - RNA, 64 nt, hsa
gcagugagccaagaucaugccacaucacuccaaccugggcaacagaacaagaacccaucucaaa

SEQ ID NO: 482065 - RNA, 64 nt, hsa
gcggauugccugagcucaggaguucaagaucagucugggcaacacgaugaaacuccgucucuac

SEQ ID NO: 482066 - RNA, 64 nt, hsa
caguaagccaagaucacaccacuggcacuccagccugggcaacagagugagacccugucucaaa

SEQ ID NO: 482067 - RNA, 64 nt, hsa
gcuaagcauuuuuuaaauugaguuugagacuagccugggcaacauagugagaccccaucucuau

SEQ ID NO: 482068 - RNA, 64 nt, hsa
guguuauuaaaaaauuacaaaggccuagaccagccugggcaacauggugaaaccccaucucuac

SEQ ID NO: 482069 - RNA, 64 nt, hsa
gcagugaaucaugaucaugccacuguacuccagccugggcaacagagaccaucuuaaaaaaaaa

SEQ ID NO: 482070 - RNA, 64 nt, hsa
gcagugagcagagaucgcaccacugcacuccagccugggcaagagugagacugugucucaaaag

SEQ ID NO: 482071 - RNA, 64 nt, hsa
gaggaucacuuagguccaggaguucgagacuagccugggcaacauagugagacaccggaucuac

SEQ ID NO: 482072 - RNA, 64 nt, hsa
gcagugagccgugauugcaccacugcacuccagccugggcaacagagcaagacccugucuugga

SEQ ID NO: 482073 - RNA, 64 nt, hsa
uucugccucuuaagccugcucccucacccaggcacugggcaagugaagaguuugccuguacucu

SEQ ID NO: 482074 - RNA, 64 nt, hsa
gcagugagccaagauugcgccguuguacuccagccugggcaacagagcaagacccaucucaaaa

SEQ ID NO: 482075 - RNA, 64 nt, hsa
agauuaccauuagaagcaaaauuaaaaguacaagcugggcaaacugacagaauacuagauagga

SEQ ID NO: 482076 - RNA, 64 nt, hsa
aggcuaugacuaagaauuuagguggaauugaugucugggcaauuaaaauaaauggcauaagagc

SEQ ID NO: 482077 - RNA, 64 nt, hsa
gcaguucgcuugggcccaagaguucgagaccagccugggcaacauggugaaacccuaucuccgu

SEQ ID NO: 482078 - RNA, 64 nt, hsa
gagccgaggucaugccacugcacuccagccuggccugggcaacagagcaagacccugucucaaa

SEQ ID NO: 482079 - RNA, 64 nt, hsa
gcauugagcugagaucaugcuagugcgcuccagccugggcaacagagcgagacuucaucucaga

SEQ ID NO: 482080 - RNA, 64 nt, hsa
ggagugagcugagaucgcgccaccgcacuccagccugggcaacagagcgagacuccaucucaaa

SEQ ID NO: 482081 - RNA, 64 nt, hsa
gcaaugagcuaugauuucaccacugcauucuagccugggcaacagagugagauccugacucaaa

SEQ ID NO: 482082 - RNA, 64 nt, hsa
gaggauugcuugaggccgaggguucaagacuagccugggcaacauagcgagacugcaucucuac

SEQ ID NO: 482083 - RNA, 64 nt, hsa
gcagugagcacagaucacaccacugcacuccagccugggcaacagagugagacccuauuucaaa

SEQ ID NO: 482084 - RNA, 64 nt, hsa
guggauugcuuaagcccaggaguucaagaccagccugggcaacauggcuaaaccccaucucuac

SEQ ID NO: 482085 - RNA, 64 nt, hsa
gcagugagccaaggucacgucacugcacucuagccugggcaacagaguaagacaaaaaaauaua

SEQ ID NO: 482086 - RNA, 64 nt, hsa
guagauuacuugagcccaggaauucaagaccagccugggcaacauggugaaacccuguuucuau

SEQ ID NO: 482087 - RNA, 64 nt, hsa
gaggauugcuugaagcuaggaguuugagaccagccugggcaacaggguaagguccugucucuac

SEQ ID NO: 482088 - RNA, 64 nt, hsa
ugcagugagcugugaugugcccuuaugcuauagccugggcaagagcgugagacccugucucaaa

SEQ ID NO: 482089 - RNA, 64 nt, hsa
gcggaucacuugaggccaggaauuugaaaccagccugggcaaaacccugucucuacuaaaaaua

SEQ ID NO: 482090 - RNA, 64 nt, hsa
gggcagaugggcacaggugcuggugaugccucuccugggcaaaacgccccauuuguggcacuuu

SEQ ID NO: 482091 - RNA, 64 nt, hsa
cuagagugagccgugaucaccagugcacucuagccugggcaacagagaaagacccugucucaaa

SEQ ID NO: 482092 - RNA, 64 nt, hsa
gaggaucgcuugaggccaggaguucgagaccacccugggcaacagagcgagaucccaucacuac

SEQ ID NO: 482093 - RNA, 64 nt, hsa
gagaaucgcuugagcucaggaguucgagaccagccugggcaacguggcgaaauccccgucuuua

SEQ ID NO: 482094 - RNA, 64 nt, hsa
aggaucaccuugaggccaggaguuuaaggccagccugggcaacauagcaaaaccuagucccuaa

SEQ ID NO: 482095 - RNA, 64 nt, hsa
gcagugagccgagaucgcaccauugcacuccugccugggcaacaagagugaaacuccaucucca

SEQ ID NO: 482096 - RNA, 64 nt, hsa
gcagauuauuugagcucaggaguuugagaccauccugggcaacauggcgaaacccuaucucuac

SEQ ID NO: 482097 - RNA, 64 nt, hsa
gcagugagcugagaucacaucauugcacuccagccugggcaacgggcgagacucugucucaaaa

SEQ ID NO: 482098 - RNA, 64 nt, hsa
gcaagaguuuuuuuaagacucuuaaaaaaagagccugggcaauuuuuuuaagacucugucuuaa

SEQ ID NO: 482099 - RNA, 64 nt, hsa
gcagcgagccaagaucgugccacugcacuccagccugggcaagaguuuuuuuaagacucuuaaa

SEQ ID NO: 482100 - RNA, 64 nt, hsa
gcagugggcugugaucacaccacugcacuccagccugggcaacagagugagacccugucucuga

SEQ ID NO: 482101 - RNA, 64 nt, hsa
gaggaucacuugagcccaggaguucaagaccagccugggcaacauagugagacuccugucucua

SEQ ID NO: 482102 - RNA, 64 nt, hsa
uaaccagugagcacugguuaguacugguccccuucugggcaacauggcccuaccagacacugcu

SEQ ID NO: 482103 - RNA, 64 nt, hsa
gugagccaucaucauggcaucauugcauuccagccugggcaacagagcaagaccucgucucaaa

SEQ ID NO: 482104 - RNA, 64 nt, hsa
guagugagccaagaucgugccacuacacuccagccugggcaacaaagcaagaccuugucucaaa

SEQ ID NO: 482105 - RNA, 64 nt, hsa
gcagaucacuugagcccaggaguucgagagcagccugggcaacaugacgaaaccccgucucuac

SEQ ID NO: 482106 - RNA, 64 nt, hsa
acagauggcuugagcucaggaguucgugaccagccugggcaacccugucucuacaaaaaauaca

SEQ ID NO: 482107 - RNA, 64 nt, hsa
gaggacugcuugagcccaggaguuugagaccagccugggcaauguagcaagaccccaucucuau

SEQ ID NO: 482108 - RNA, 64 nt, hsa
acuucccccugaggacugacucuuccuagcagagcugggcaacuugucccaaaucuagcuuugc

SEQ ID NO: 482109 - RNA, 64 nt, hsa
gcagugagccgagaucacgccacugcacuccagccugggcaacaagagugaaacuccgucucaa

SEQ ID NO: 482110 - RNA, 64 nt, hsa
gggaggaucacuugaguccagguucaagacuagccugggcaacauggcaagacccugucccuau

SEQ ID NO: 482111 - RNA, 64 nt, hsa
gcagugaacugagaucacgacacugcacuccagccugggcaacaguaaaaccuggucuccaaaa

SEQ ID NO: 482112 - RNA, 64 nt, hsa
uacaguagccgagaucgcgccacugcauuccagccugggcaacaaaagcgaaacucugucucaa

SEQ ID NO: 482113 - RNA, 64 nt, hsa
gcagugagcugagaucgcaccauugcacuccagccugggcaacaagagcgaaacucugucucaa

SEQ ID NO: 482114 - RNA, 64 nt, hsa
gcagugagccaagaucgcgccacugcacuccagucugggcaacagagugagacccugucucaau

SEQ ID NO: 482115 - RNA, 64 nt, hsa
agguuagacguucccugcccugggacgcucaccccugggcaagaggcuggaaguucacaccauc

SEQ ID NO: 482116 - RNA, 64 nt, hsa
gcagugagccaagauugcaccacugugcucccaccugggcaacagugagacccugucucaaaaa

SEQ ID NO: 482117 - RNA, 64 nt, hsa
gcagaucacugaagcucaggaguucaagaccagccugggcaacauggcgaaacuccauuucuau

SEQ ID NO: 482118 - RNA, 64 nt, hsa
aaggaucgcugcagcccaggaguucgagacuagccugggcaacauagcgagaccucgucucuac

SEQ ID NO: 482119 - RNA, 64 nt, hsa
gaggauugcuugagcccaggaguuugagaccagccugggcaacacagcgagaccuugucucuua

SEQ ID NO: 482120 - RNA, 64 nt, hsa
agcucacccuucgucauggaccgagguucccacucugggcaaagccccucacacugcaagggau

SEQ ID NO: 482121 - RNA, 63 nt, hsa
uuuuuuuauaccuaaauaaagaaaaaucuuuagccugggcaacauagggagacccuaucucua

SEQ ID NO: 482122 - RNA, 64 nt, hsa
gcaaugagcuauaauugcaucauugcacuccagccugggcaacagagacccugucucaaccacc

SEQ ID NO: 482123 - RNA, 64 nt, hsa
cacacaaggaauauaaaaaccaccacccuccagccugggcaacguaguaaaaccucaucuauac

SEQ ID NO: 482124 - RNA, 64 nt, hsa
agccguaggguggcacugggagggggugggggaucugggcaaggugggugauuccucccaggag

SEQ ID NO: 482125 - RNA, 64 nt, hsa
agccuuccuuucuccugccccaagggcccagacccugggcaaacagagcuacugagacuuggaa

SEQ ID NO: 482126 - RNA, 64 nt, hsa
gcagugagucaagaucacgccauugcacuccagccugggcaacaagagcgaaacuccaucucaa

SEQ ID NO: 482127 - RNA, 64 nt, hsa
gaggauuacuugaaacccacaguuugagaccagccugggcaacauagugagacccugucucuaa

SEQ ID NO: 482128 - RNA, 64 nt, hsa
ggcggggaggauccauugagcccagcaguccaaccugggcaaaauagugagagacccuguaucu

SEQ ID NO: 482129 - RNA, 64 nt, hsa
gcagugagcugagauugugccacugcacuccagccugggcaacaaagcaagacucugucucaaa

SEQ ID NO: 482130 - RNA, 64 nt, hsa
gcagugagccaagaucaugucacugcauuccagccugggcaacagaggaagacuccgucucaaa

SEQ ID NO: 482131 - RNA, 64 nt, hsa
ggcccccaggguuguccagcuccauaagguggagcugggcaagauuuuggguuugcugcucccu

SEQ ID NO: 482132 - RNA, 64 nt, hsa
agugauugugaugcuauuuaucuucagggucacucugggcaaagagaagguccucagccaugcc

SEQ ID NO: 482133 - RNA, 64 nt, hsa
gcgacuccaucucuacaaauaaauaaaaaauuagcugggcaauuggcgggcauggaggugggug

SEQ ID NO: 482134 - RNA, 64 nt, hsa
gcagugaguugugauugcaccacugcccuccagccugggcaacagagugaaaccuugucucucu

SEQ ID NO: 482135 - RNA, 64 nt, hsa
gucgugagcuaugauuaugccacugcuuuccagccugggcaacauaguaagaccccaucucuua

SEQ ID NO: 482136 - RNA, 64 nt, hsa
gcagugagccaugaucgagccacugcacuccagccugggcaacagaugaagacccuauuucaga

SEQ ID NO: 482137 - RNA, 64 nt, hsa
gaggauugcuugaagccaggaguuugggaccagccugggcaacauagggggaucccaucucuac

SEQ ID NO: 482138 - RNA, 64 nt, hsa
gcagugagcuaugauuguaccacugcacuccagccugggcaacagagcaagaccuugucucaaa

SEQ ID NO: 482139 - RNA, 64 nt, hsa
gaggaucacuuaaggccaggaguucgagaccagccugggcaacagcaagaccucaucucuacaa

SEQ ID NO: 482140 - RNA, 64 nt, hsa
gcaggaggaucacucgagcucaagaauucaagaccugggcaagagagagagacuuugucucuau

SEQ ID NO: 482141 - RNA, 64 nt, hsa
gcagugagcuguguucacaccacugcacuccagucugggcaacagugcaagacccugucacuua

SEQ ID NO: 482142 - RNA, 64 nt, hsa
gaagagagcuaugacugcaucacugcacuccagccugggcaacacagcaagauccugucuaaaa

SEQ ID NO: 482143 - RNA, 64 nt, hsa
gaggacugcuuaagcucaggaguuugagaccagccugggcaacauagcaagacccccaccaucu

SEQ ID NO: 482144 - RNA, 64 nt, hsa
gguagggggcaggaagaggagcagaaaagaagggcugggcaaggcauaguggcuuaugccugua

SEQ ID NO: 482145 - RNA, 64 nt, hsa
gaggaucaguugagccccagaguucaagaccagccugggcaauguaguaagacccccaucgcua

SEQ ID NO: 482146 - RNA, 64 nt, hsa
gcagugaaccaagaucaugccacugcacuccagccugggcaacacagcgagacuccgucucaaa

SEQ ID NO: 482147 - RNA, 64 nt, hsa
gcauugagccaugauugcaccacugcacuccagccugggcaacagagggagcccccgucucaac

SEQ ID NO: 482148 - RNA, 64 nt, hsa
ggggauugauugaggccaggaguucaagaccagccugggcaacauggugagaccccaucucuac

SEQ ID NO: 482149 - RNA, 64 nt, hsa
gcagugagccgagaucgucccacugcacuccagccugggcaacagagugagacucuguuucuaa

SEQ ID NO: 482150 - RNA, 64 nt, hsa
uggguggaucacaagucaggaguucaagaccagccugggcaagauggugaaaccccaucucuac

SEQ ID NO: 482151 - RNA, 64 nt, hsa
aggaucacuugagaccaggaguugugaggucaaccugggcaauauagggagauccugucucuau

SEQ ID NO: 482152 - RNA, 64 nt, hsa
aaggauugcuugaggccaggaguuccagaucaaccugggcaacaugaugagaccccaucucuac

SEQ ID NO: 482153 - RNA, 64 nt, hsa
gaggaucccuuuagcccaggaguuaaagaccagccugggcaacauagggagacccugucuuuuu

SEQ ID NO: 482154 - RNA, 64 nt, hsa
ugaggugggaggaucccaggaguucaaauccugccugggcaacauagcaagacccugucucuua

SEQ ID NO: 482155 - RNA, 64 nt, hsa
gcagugagcugagaucacgccacugcacuccagccugggcaacagagugagacucugucucaaa

SEQ ID NO: 482156 - RNA, 64 nt, hsa
gcagugagcugaagucccgccacugcacuccagccugggcaacagagcgagacucagucucaaa

SEQ ID NO: 482157 - RNA, 64 nt, hsa
cagccaaaacccucccagacgucuccucuccugccugggcaaaguccagcuuggcaccccgucu

SEQ ID NO: 482158 - RNA, 64 nt, hsa
gcagugagcugagauugcgccauugcacuccagccugggcaacaagagcaaaauucugccucaa

SEQ ID NO: 482159 - RNA, 64 nt, hsa
ccccaccaugggcugugggagaguugaccguauucugggcaagacuccaugaccccucugauuc

SEQ ID NO: 482160 - RNA, 64 nt, hsa
uccuccaccucucccauuccauccccaguccagccugggcaaccccaccccugggagggaugag

SEQ ID NO: 482161 - RNA, 64 nt, hsa
guagugagcugagaucgugccacugcacuccagccugggcaacagagccagacuccgucucuaa

SEQ ID NO: 482162 - RNA, 64 nt, hsa
gcagaucaccugagaucaggaguucgggaccagccugggcaacauggugaaacccugucucuac

SEQ ID NO: 482163 - RNA, 64 nt, hsa
gcagugagccaagaucuugccauugcacuccagccugggcaacaagagugaaauucugucucaa

SEQ ID NO: 482164 - RNA, 64 nt, hsa
gcaaugagccgagaucacaccacugcacuccagccugggcaacagugaaacuccaucucaaaaa

SEQ ID NO: 482165 - RNA, 64 nt, hsa; identical to SEQ ID NO: 293686

SEQ ID NO: 482166 - RNA, 64 nt, hsa; identical to SEQ ID NO: 293687

SEQ ID NO: 482167 - RNA, 64 nt, hsa; identical to SEQ ID NO: 293688

SEQ ID NO: 482168 - RNA, 64 nt, hsa; identical to SEQ ID NO: 293689

SEQ ID NO: 482169 - RNA, 64 nt, hsa; identical to SEQ ID NO: 293690

SEQ ID NO: 482170 - RNA, 64 nt, hsa; identical to SEQ ID NO: 293691

SEQ ID NO: 482171 - RNA, 64 nt, hsa; identical to SEQ ID NO: 293692

SEQ ID NO: 482172 - RNA, 64 nt, hsa; identical to SEQ ID NO: 293693

SEQ ID NO: 482173 - RNA, 64 nt, hsa; identical to SEQ ID NO: 293694

SEQ ID NO: 482174 - RNA, 64 nt, hsa; identical to SEQ ID NO: 293695

SEQ ID NO: 482175 - RNA, 64 nt, hsa; identical to SEQ ID NO: 293696

SEQ ID NO: 482176 - RNA, 64 nt, hsa; identical to SEQ ID NO: 293697

SEQ ID NO: 482177 - RNA, 64 nt, hsa; identical to SEQ ID NO: 293698

SEQ ID NO: 482178 - RNA, 64 nt, hsa; identical to SEQ ID NO: 293699

SEQ ID NO: 482179 - RNA, 64 nt, hsa; identical to SEQ ID NO: 293700

SEQ ID NO: 482180 - RNA, 64 nt, hsa; identical to SEQ ID NO: 293701

SEQ ID NO: 482181 - RNA, 64 nt, hsa; identical to SEQ ID NO: 44368

SEQ ID NO: 482182 - RNA, 64 nt, hsa; identical to SEQ ID NO: 44369

SEQ ID NO: 482183 - RNA, 64 nt, hsa; identical to SEQ ID NO: 44370

SEQ ID NO: 482184 - RNA, 64 nt, hsa; identical to SEQ ID NO: 44371

SEQ ID NO: 482185 - RNA, 64 nt, hsa; identical to SEQ ID NO: 44372

SEQ ID NO: 482186 - RNA, 64 nt, hsa; identical to SEQ ID NO: 44373

SEQ ID NO: 482187 - RNA, 64 nt, hsa; identical to SEQ ID NO: 128910

SEQ ID NO: 482188 - RNA, 64 nt, hsa; identical to SEQ ID NO: 128911

SEQ ID NO: 482189 - RNA, 64 nt, hsa; identical to SEQ ID NO: 128912

SEQ ID NO: 482190 - RNA, 64 nt, hsa; identical to SEQ ID NO: 128913

SEQ ID NO: 482191 - RNA, 64 nt, hsa; identical to SEQ ID NO: 128914

SEQ ID NO: 482192 - RNA, 64 nt, hsa; identical to SEQ ID NO: 128915

SEQ ID NO: 482193 - RNA, 64 nt, hsa; identical to SEQ ID NO: 128916

SEQ ID NO: 482194 - RNA, 64 nt, hsa; identical to SEQ ID NO: 128917

SEQ ID NO: 482195 - RNA, 64 nt, hsa; identical to SEQ ID NO: 128918

SEQ ID NO: 482196 - RNA, 64 nt, hsa; identical to SEQ ID NO: 128919

SEQ ID NO: 482197 - RNA, 64 nt, hsa; identical to SEQ ID NO: 128920

SEQ ID NO: 482198 - RNA, 64 nt, hsa; identical to SEQ ID NO: 128921

SEQ ID NO: 482199 - RNA, 64 nt, hsa; identical to SEQ ID NO: 128922

SEQ ID NO: 482200 - RNA, 64 nt, hsa; identical to SEQ ID NO: 128923

SEQ ID NO: 482201 - RNA, 64 nt, hsa; identical to SEQ ID NO: 128924

SEQ ID NO: 482202 - RNA, 64 nt, hsa; identical to SEQ ID NO: 128925

SEQ ID NO: 482203 - RNA, 64 nt, hsa; identical to SEQ ID NO: 128926

SEQ ID NO: 482204 - RNA, 64 nt, hsa; identical to SEQ ID NO: 128927

SEQ ID NO: 482205 - RNA, 64 nt, hsa; identical to SEQ ID NO: 128928

SEQ ID NO: 482206 - RNA, 64 nt, hsa; identical to SEQ ID NO: 128929

SEQ ID NO: 482207 - RNA, 64 nt, hsa; identical to SEQ ID NO: 128930

SEQ ID NO: 482208 - RNA, 64 nt, hsa; identical to SEQ ID NO: 128931

SEQ ID NO: 482209 - RNA, 64 nt, hsa; identical to SEQ ID NO: 128932

SEQ ID NO: 482210 - RNA, 64 nt, hsa; identical to SEQ ID NO: 128933

SEQ ID NO: 482211 - RNA, 64 nt, hsa; identical to SEQ ID NO: 128934

SEQ ID NO: 482212 - RNA, 64 nt, hsa; identical to SEQ ID NO: 128935

SEQ ID NO: 482213 - RNA, 64 nt, hsa; identical to SEQ ID NO: 128936

SEQ ID NO: 482214 - RNA, 64 nt, hsa; identical to SEQ ID NO: 128937

SEQ ID NO: 482215 - RNA, 64 nt, hsa; identical to SEQ ID NO: 128938

SEQ ID NO: 482216 - RNA, 64 nt, hsa; identical to SEQ ID NO: 128939

SEQ ID NO: 482217 - RNA, 64 nt, hsa; identical to SEQ ID NO: 128940

SEQ ID NO: 482218 - RNA, 64 nt, hsa; identical to SEQ ID NO: 128941

SEQ ID NO: 482219 - RNA, 64 nt, hsa; identical to SEQ ID NO: 128942

SEQ ID NO: 482220 - RNA, 64 nt, hsa; identical to SEQ ID NO: 128943

SEQ ID NO: 482221 - RNA, 64 nt, hsa
agcgugugugaacaaauggaaauaaagcagggacugugaacauuuguuuuuggucuguugaaga

SEQ ID NO: 482222 - RNA, 64 nt, hsa
gugcauguguuuuuuuuuuuuuuuuuaaagcgugugugaacaaauggaaauaaagcagggacug

SEQ ID NO: 482223 - RNA, 64 nt, hsa
uaugagcuauaauaaacuuguaaaauuaaguugaugugaacauaauuuugauuaauuaauaagg

SEQ ID NO: 482224 - RNA, 64 nt, hsa
uagaaucuaaaauuuguuauucaaauuaaauggcugugaacaauguuaaauagcaucaguuugu

SEQ ID NO: 482225 - RNA, 64 nt, hsa
guuuguaguucucuacauuucucuggauggagacugugaacaucugauuguucagcaaccuuca

SEQ ID NO: 482226 - RNA, 64 nt, hsa
caagcucucaucauaugcaaauucucagaagggcugugaacaccuuaguaauaaauuuaucuuu

SEQ ID NO: 482227 - RNA, 64 nt, hsa
cuguuugagaaugaugcuacucugaucuaaugaaugugaacauguagauguuuuguguguauuu

SEQ ID NO: 482228 - RNA, 64 nt, hsa
agaaaaauuuuguuaggccacaaaaacacugcacugugaacauuuuagaaaagguaugucagac

SEQ ID NO: 482229 - RNA, 64 nt, hsa
uaaauauguguguuuacacauaugucugcaugcaugugaacacacacacacacacacacacacc

SEQ ID NO: 482230 - RNA, 64 nt, hsa
gaauguuucuauuuacaacugugcuuaucaaaauugugaacacccccacccccgcauuuuugug

SEQ ID NO: 482231 - RNA, 64 nt, hsa
cuccuuugugcuauguggagcucacagccucacaugugaacacccgugucuggguugccugggg

SEQ ID NO: 482232 - RNA, 64 nt, hsa
uucuuacacacucacacacauaacucaaaaguuuugugaacaaguacuuuccuuuuuuacaugu

SEQ ID NO: 482233 - RNA, 64 nt, hsa
aaagcugcugugaacauucauguacagguuuuuaugugaacauacauuuucauuuucugggaua

SEQ ID NO: 482234 - RNA, 64 nt, hsa
aguuguuuucaguuuuuugcccuaauaaagcugcugugaacauucauguacagguuuuuaugug

SEQ ID NO: 482235 - RNA, 64 nt, hsa
guauaaagagcugauaacaguacucagaagaaucugugaacaaauacuugaaaauggguucaau

SEQ ID NO: 482236 - RNA, 64 nt, hsa
guagacugccauuauguguggucuucccauuaaaugugaacauuuuaauauguaugcauucacc

SEQ ID NO: 482237 - RNA, 64 nt, hsa
ugcuggucacgugguagaugaagccucuuacugccccacuuaggguggccacggcugcuuguga

SEQ ID NO: 482238 - RNA, 64 nt, hsa
aauaaccagugagaggggcaguucucuggccacacccacuuauguacuuuaacuacugugacuu

SEQ ID NO: 482239 - RNA, 64 nt, hsa
gauggguagggauuuauccaaucuaagcccuaaccccacuuagugaccucaguguuuucuucca

SEQ ID NO: 482240 - RNA, 64 nt, hsa
cuuuaaaaaccuuccugagacuuaagcauucugccccacuuacuaacugccaguucuccagcac

SEQ ID NO: 482241 - RNA, 64 nt, hsa
gguguagccaguguuucccauaugccccuggagccccacuuauugaggccagcagaauaggugc

SEQ ID NO: 482242 - RNA, 64 nt, hsa
gaaaagacugggggauaugaaaucuucccccuaccccacuuaaugcguuggauaugauuuuuca

SEQ ID NO: 482243 - RNA, 64 nt, hsa
caaugugcuacgauccaagauaucagccaaggagcccacuuaggggagaacuagguguccagau

SEQ ID NO: 482244 - RNA, 64 nt, hsa
auaagcuaagaucacuauagguccauuucuugaacccacuuauacauaaaauguaacccauuua

SEQ ID NO: 482245 - RNA, 64 nt, hsa; identical to SEQ ID NO: 112922

SEQ ID NO: 482246 - RNA, 64 nt, hsa; identical to SEQ ID NO: 112923

SEQ ID NO: 482247 - RNA, 64 nt, hsa; identical to SEQ ID NO: 112924

SEQ ID NO: 482248 - RNA, 64 nt, hsa; identical to SEQ ID NO: 112925

SEQ ID NO: 482249 - RNA, 64 nt, hsa; identical to SEQ ID NO: 112926

SEQ ID NO: 482250 - RNA, 64 nt, hsa; identical to SEQ ID NO: 112927

SEQ ID NO: 482251 - RNA, 64 nt, hsa; identical to SEQ ID NO: 112928

SEQ ID NO: 482252 - RNA, 64 nt, hsa; identical to SEQ ID NO: 112929

SEQ ID NO: 482253 - RNA, 64 nt, hsa; identical to SEQ ID NO: 112930

SEQ ID NO: 482254 - RNA, 64 nt, hsa; identical to SEQ ID NO: 112931

SEQ ID NO: 482255 - RNA, 64 nt, hsa; identical to SEQ ID NO: 112932

SEQ ID NO: 482256 - RNA, 64 nt, hsa; identical to SEQ ID NO: 112933

SEQ ID NO: 482257 - RNA, 64 nt, hsa; identical to SEQ ID NO: 112934

SEQ ID NO: 482258 - RNA, 64 nt, hsa; identical to SEQ ID NO: 112935

SEQ ID NO: 482259 - RNA, 64 nt, hsa; identical to SEQ ID NO: 112936

SEQ ID NO: 482260 - RNA, 64 nt, hsa; identical to SEQ ID NO: 112937

SEQ ID NO: 482261 - RNA, 64 nt, hsa; identical to SEQ ID NO: 112938

SEQ ID NO: 482262 - RNA, 64 nt, hsa; identical to SEQ ID NO: 112939

SEQ ID NO: 482263 - RNA, 64 nt, hsa; identical to SEQ ID NO: 112940

SEQ ID NO: 482264 - RNA, 64 nt, hsa; identical to SEQ ID NO: 112941

SEQ ID NO: 482265 - RNA, 64 nt, hsa; identical to SEQ ID NO: 112942

SEQ ID NO: 482266 - RNA, 64 nt, hsa; identical to SEQ ID NO: 112943

SEQ ID NO: 482267 - RNA, 64 nt, hsa; identical to SEQ ID NO: 112944

SEQ ID NO: 482268 - RNA, 64 nt, hsa; identical to SEQ ID NO: 112945

SEQ ID NO: 482269 - RNA, 64 nt, hsa; identical to SEQ ID NO: 112946

SEQ ID NO: 482270 - RNA, 64 nt, hsa; identical to SEQ ID NO: 112947

SEQ ID NO: 482271 - RNA, 64 nt, hsa; identical to SEQ ID NO: 112948

SEQ ID NO: 482272 - RNA, 64 nt, hsa; identical to SEQ ID NO: 112949

SEQ ID NO: 482273 - RNA, 64 nt, hsa; identical to SEQ ID NO: 112950

SEQ ID NO: 482274 - RNA, 64 nt, hsa; identical to SEQ ID NO: 112951

SEQ ID NO: 482275 - RNA, 64 nt, hsa; identical to SEQ ID NO: 112952

SEQ ID NO: 482276 - RNA, 64 nt, hsa; identical to SEQ ID NO: 112953

SEQ ID NO: 482277 - RNA, 64 nt, hsa; identical to SEQ ID NO: 112954

SEQ ID NO: 482278 - RNA, 50 nt, hsa; identical to SEQ ID NO: 112955

SEQ ID NO: 482279 - RNA, 64 nt, hsa; identical to SEQ ID NO: 112956

SEQ ID NO: 482280 - RNA, 64 nt, hsa; identical to SEQ ID NO: 112957

SEQ ID NO: 482281 - RNA, 64 nt, hsa; identical to SEQ ID NO: 112958

SEQ ID NO: 482282 - RNA, 64 nt, hsa; identical to SEQ ID NO: 112959

SEQ ID NO: 482283 - RNA, 64 nt, hsa; identical to SEQ ID NO: 112960

SEQ ID NO: 482284 - RNA, 64 nt, hsa; identical to SEQ ID NO: 112961

SEQ ID NO: 482285 - RNA, 64 nt, hsa
ucccuggggcuuuaacuccugcuagaacagucucuugaggcacagaaacuccuguucaugccca

SEQ ID NO: 482286 - RNA, 64 nt, hsa
caucucagguguguugcagugucugcuggagacauugaggcaggcacugccaaaacaucaaccu

SEQ ID NO: 482287 - RNA, 64 nt, hsa
caaaagucccaauuaagaaccuccgaacucuguuuugaggcaaaggggaguaguucuugguagg

SEQ ID NO: 482288 - RNA, 64 nt, hsa
cgagauauaugauuccaguucugcauguaccaucuugaggcacagcagccacugcucguuguaa

SEQ ID NO: 482289 - RNA, 64 nt, hsa
ggugcaugcuuguggucccagcuacuuugggagguugaggcaggaggaucgcuugagcccagga

SEQ ID NO: 482290 - RNA, 64 nt, hsa
uuucaggaggugccagcagcucuguuggcucaaguugaggcagguugaaggauucacaggguaa

SEQ ID NO: 482291 - RNA, 64 nt, hsa
uggugcacgccugcagucccagcuacucaggagguugaggcagaagaaucgcuugaacccagga

SEQ ID NO: 482292 - RNA, 64 nt, hsa
acugaggcucagagaaggugugaccucuuguugcuugaggcacagaguuauaaaguaacauauc

SEQ ID NO: 482293 - RNA, 64 nt, hsa; identical to SEQ ID NO: 163189

SEQ ID NO: 482294 - RNA, 64 nt, hsa; identical to SEQ ID NO: 163190

SEQ ID NO: 482295 - RNA, 64 nt, hsa; identical to SEQ ID NO: 163191

SEQ ID NO: 482296 - RNA, 64 nt, hsa; identical to SEQ ID NO: 163192

SEQ ID NO: 482297 - RNA, 64 nt, hsa; identical to SEQ ID NO: 163193

SEQ ID NO: 482298 - RNA, 64 nt, hsa; identical to SEQ ID NO: 163194

SEQ ID NO: 482299 - RNA, 64 nt, hsa; identical to SEQ ID NO: 163195

SEQ ID NO: 482300 - RNA, 64 nt, hsa; identical to SEQ ID NO: 163196

SEQ ID NO: 482301 - RNA, 64 nt, hsa; identical to SEQ ID NO: 163197

SEQ ID NO: 482302 - RNA, 64 nt, hsa; identical to SEQ ID NO: 163198

SEQ ID NO: 482303 - RNA, 64 nt, hsa; identical to SEQ ID NO: 163199

SEQ ID NO: 482304 - RNA, 64 nt, hsa; identical to SEQ ID NO: 163200

SEQ ID NO: 482305 - RNA, 64 nt, hsa; identical to SEQ ID NO: 163201

SEQ ID NO: 482306 - RNA, 64 nt, hsa; identical to SEQ ID NO: 163202

SEQ ID NO: 482307 - RNA, 64 nt, hsa; identical to SEQ ID NO: 163203

SEQ ID NO: 482308 - RNA, 64 nt, hsa; identical to SEQ ID NO: 163204

SEQ ID NO: 482309 - RNA, 64 nt, hsa; identical to SEQ ID NO: 163205

SEQ ID NO: 482310 - RNA, 64 nt, hsa; identical to SEQ ID NO: 163206

SEQ ID NO: 482311 - RNA, 64 nt, hsa; identical to SEQ ID NO: 163207

SEQ ID NO: 482312 - RNA, 64 nt, hsa; identical to SEQ ID NO: 163208

SEQ ID NO: 482313 - RNA, 64 nt, hsa; identical to SEQ ID NO: 163209

SEQ ID NO: 482314 - RNA, 64 nt, hsa; identical to SEQ ID NO: 163210

SEQ ID NO: 482315 - RNA, 64 nt, hsa; identical to SEQ ID NO: 163211

SEQ ID NO: 482316 - RNA, 64 nt, hsa; identical to SEQ ID NO: 163212

SEQ ID NO: 482317 - RNA, 64 nt, hsa; identical to SEQ ID NO: 163213

SEQ ID NO: 482318 - RNA, 64 nt, hsa; identical to SEQ ID NO: 163214

SEQ ID NO: 482319 - RNA, 64 nt, hsa; identical to SEQ ID NO: 163215

SEQ ID NO: 482320 - RNA, 64 nt, hsa; identical to SEQ ID NO: 163216

SEQ ID NO: 482321 - RNA, 64 nt, hsa; identical to SEQ ID NO: 163217

SEQ ID NO: 482322 - RNA, 64 nt, hsa; identical to SEQ ID NO: 163218

SEQ ID NO: 482323 - RNA, 64 nt, hsa; identical to SEQ ID NO: 163219

SEQ ID NO: 482324 - RNA, 64 nt, hsa; identical to SEQ ID NO: 163220

SEQ ID NO: 482325 - RNA, 64 nt, hsa; identical to SEQ ID NO: 163221

SEQ ID NO: 482326 - RNA, 64 nt, hsa; identical to SEQ ID NO: 163222

SEQ ID NO: 482327 - RNA, 64 nt, hsa; identical to SEQ ID NO: 163223

SEQ ID NO: 482328 - RNA, 64 nt, hsa; identical to SEQ ID NO: 163224

SEQ ID NO: 482329 - RNA, 64 nt, hsa; identical to SEQ ID NO: 163225

SEQ ID NO: 482330 - RNA, 64 nt, hsa; identical to SEQ ID NO: 163226

SEQ ID NO: 482331 - RNA, 64 nt, hsa; identical to SEQ ID NO: 163227

SEQ ID NO: 482332 - RNA, 64 nt, hsa; identical to SEQ ID NO: 163228

SEQ ID NO: 482333 - RNA, 64 nt, hsa; identical to SEQ ID NO: 163229

SEQ ID NO: 482334 - RNA, 64 nt, hsa; identical to SEQ ID NO: 163230

SEQ ID NO: 482335 - RNA, 64 nt, hsa
gcuggcuaaugaaagccuccucaccucuucccaacccuuacaagcaagggugcuaggggcucag

SEQ ID NO: 482336 - RNA, 64 nt, hsa
acaaguguccucucuucugcauacauuugggcuccccuuacagagcccuuugcccuggcucucu

SEQ ID NO: 482337 - RNA, 64 nt, hsa
acucaauggggaccaccuuccuggagaggcugcucccuuacagaccugguaguuuggggaaagg

SEQ ID NO: 482338 - RNA, 64 nt, hsa
cccucuacgucucucuagaaugacaucuuuaaaccccuuacacucuuuggucuuacacauccuu

SEQ ID NO: 482339 - RNA, 64 nt, hsa
uggacuauugugccaacugccaggcugccuccugcccuuacagcccuaaguggcugccuucuuu

SEQ ID NO: 482340 - RNA, 64 nt, hsa
aaaggacuugauguacauaacuccugucccuuuucccuuacaagguggggauugccccuggcuu

SEQ ID NO: 482341 - RNA, 64 nt, hsa
cgaguggccagcuucacucucugggggagugcaggguggacaucaccuuggaggcccugcacug

SEQ ID NO: 482342 - RNA, 64 nt, hsa
aucagaagcucccagcugaccagacacugccugggguggacauucagcagagugcgaguggaga

SEQ ID NO: 482343 - RNA, 64 nt, hsa
caggaauaauaaaccaaugaguuagcucagggccgguggacauguucacugguggaccaguugg

SEQ ID NO: 482344 - RNA, 64 nt, hsa
acguuccccuugguuaacugauuuuuuaauccaggguggacauuuuuucaaccuuuauuaaaaa

SEQ ID NO: 482345 - RNA, 64 nt, hsa
gcgggccggcaaggccauaccucggugagggacagguggacaacggucaccuaucuguagccag

SEQ ID NO: 482346 - RNA, 64 nt, hsa
gguccucuugguaaguguggcccacacccagccugguggacauggaaaggcuucucagccucug

SEQ ID NO: 482347 - RNA, 64 nt, hsa
cugaaccacguaaagcucgaaccacguggcaagugguggacaaaacuucaacgcaugauauuua

SEQ ID NO: 482348 - RNA, 64 nt, hsa
cugggggcucuuccaagucagaagaauggaggaagguggacaagcaacccagcaucccccgacc

SEQ ID NO: 482349 - RNA, 64 nt, hsa
acaccuugguggcacugguggacaugggaaagcagguggacaugagcuaacccugagcuugucc

SEQ ID NO: 482350 - RNA, 64 nt, hsa
gacccgcuggccagagggacaccuugguggcacugguggacaugggaaagcagguggacaugag

SEQ ID NO: 482351 - RNA, 64 nt, hsa
uauccgcuuacgguacaagcugacauucaaccaagguggacagccuuucagcgaaguaggagaa

SEQ ID NO: 482352 - RNA, 64 nt, hsa
gcugcaugaagaccugcccccugauugacuuggagguggacaauggaccugcgcagauggggac

SEQ ID NO: 482353 - RNA, 64 nt, hsa
gaacucaugccaacagucuuuaugaugggauuaagguggacaagaucuccuaagaucugugaau

SEQ ID NO: 482354 - RNA, 64 nt, hsa
gacaagaucuccuaagaucugugaaugggauuaagguggacaagaucuccuaagaucugaaaag

SEQ ID NO: 482355 - RNA, 64 nt, hsa
cuccuaugcugguggaaggcggaggaccggagucccugcagaaggccccgugcacucgggggcc

SEQ ID NO: 482356 - RNA, 64 nt, hsa
ccccucggugcugcaggcuggggggccuuggguaccugcagagccuuuucucugaauuccuuau

SEQ ID NO: 482357 - RNA, 64 nt, hsa
cuuuuuucucuaauuuucuaccuuccucucuguuccugcagacaguuuugccagcuuugcuucu

SEQ ID NO: 482358 - RNA, 64 nt, hsa
ugccuuggucuuguuucugugguugguucuagccccugcagagccugggagcugcaggaacugu

SEQ ID NO: 482359 - RNA, 64 nt, hsa
uacuugcugacuuaaccccccauagugugggggaccugcagagaaccauggcauucccuauucc

SEQ ID NO: 482360 - RNA, 64 nt, hsa
aacucggucccuuccugucucuaguucaucagcaccugcagaugccugacucuuguuagccuua

SEQ ID NO: 482361 - RNA, 64 nt, hsa
caauggcccuuucacaagcucuugccucacaaccccugcagaaguccuucaacaaaacuaauaa

SEQ ID NO: 482362 - RNA, 64 nt, hsa
ucaccguuggcuacccggucacggaggccggccaccugcagagccucuacacagguagugcccc

SEQ ID NO: 482363 - RNA, 64 nt, hsa
gggucucagaaccgagugagguguacauugccguccugcagagauccaggcugcacgcggcgga

SEQ ID NO: 482364 - RNA, 64 nt, hsa
gaggaugaccuucggucggucugucuggguucucccugcagacagcuuccuagcucaugcccau

SEQ ID NO: 482365 - RNA, 64 nt, hsa
uguccacugccacucccccaguucaaauccuuacccugcagaaauaucacaguuagcuggggcu

SEQ ID NO: 482366 - RNA, 64 nt, hsa
aaagccucuauagaaaguccucugugaucugacuccugcagacucuuccagauuuuucugccca

SEQ ID NO: 482367 - RNA, 64 nt, hsa
aaaauacgcauguucucacccagagugacaaaauccugcagauagguuuaagaccuaguggcuc

SEQ ID NO: 482368 - RNA, 64 nt, hsa
ccaccccgcccccaaaucgugacaaucaaaaaugccugcagacacgcccgcauuucuccagggc

SEQ ID NO: 482369 - RNA, 64 nt, hsa
uccgcacgggggaccucggagcugcucuaaggcgccugcagaggcgagcagagcccgcagccca

SEQ ID NO: 482370 - RNA, 64 nt, hsa
ucuggggcugaggacacacagauacauaaugacaccugcagaaauguauucucugaggacacuu

SEQ ID NO: 482371 - RNA, 64 nt, hsa
agaagcagacgcuggcaccgugcugcuuguacagccugcagagccgugagccaaguaaaccucu

SEQ ID NO: 482372 - RNA, 64 nt, hsa
gaggggcgcauuccuccagcgccaagcgucagagccugcagacaacggagggcagcgccccccc

SEQ ID NO: 482373 - RNA, 64 nt, hsa
gaagcuucuccuccccaaggcggccauggggcagccugcagaggacaguggacguggagcugcg

SEQ ID NO: 482374 - RNA, 64 nt, hsa
aaagcugggacaucccaccacacgcugagccagaccugcagagugggaagcuggaccagggcag

SEQ ID NO: 482375 - RNA, 64 nt, hsa
aucuguucccagcagaggagagcugcugcgcugaccugcagagguugguggucccagcacagag

SEQ ID NO: 482376 - RNA, 64 nt, hsa
cagacucaccaacuuugcaauagaaauacuggugccugcagagcagcacuaacaguggcaggug

SEQ ID NO: 482377 - RNA, 64 nt, hsa
ugguccaaguccuuauucugcuugccccaacuuaccugcagacacuccuuuugcuaccacucaa

SEQ ID NO: 482378 - RNA, 64 nt, hsa
guggccuuagugcaggaaacucagcccugguggcccugcagaacaaugcaucugacaugugcga

SEQ ID NO: 482379 - RNA, 64 nt, hsa
ccaggaccgagcucuuccugcuguuugccggccuccugcagagguaccgccugcugcccccgcc

SEQ ID NO: 482380 - RNA, 64 nt, hsa
cgugcgagcccugcaccccccagguccugggacuccugcagaccccacuccauucccgcuccug

SEQ ID NO: 482381 - RNA, 64 nt, hsa
gaguuuagccaacagaacagguaauuuacuccugccugcagaauacuuuucguuggggaagaga

SEQ ID NO: 482382 - RNA, 64 nt, hsa
uuccuagagcccaucccgcaccagcauuuuggaaccugcagagagccuuucucccagcuuugcc

SEQ ID NO: 482383 - RNA, 64 nt, hsa
agcaccugcagaggagcaggaggccggagcugagccugcagaccccgguuucuauuuugcacac

SEQ ID NO: 482384 - RNA, 64 nt, hsa
cagagcccggcaccccaugaggacaugcagagcaccugcagaggagcaggaggccggagcugag

SEQ ID NO: 482385 - RNA, 64 nt, hsa
uguccaggcacaguggcuccucaagccugccuguccugcagaguccccauggcauggagcuuac

SEQ ID NO: 482386 - RNA, 64 nt, hsa
gcuuccccuccagcacagggaccaagugggggagccugcagaaccuguccaggcacaguggcuc

SEQ ID NO: 482387 - RNA, 64 nt, hsa
ccaguguggcguugaauagauguguauuuccuccccugcagaaaauaagcacagaaaauuauaa

SEQ ID NO: 482388 - RNA, 64 nt, hsa
cugugaucuucccagcucugcaucaacacagcagccugcagauaacacuuggggggaccucagc

SEQ ID NO: 482389 - RNA, 64 nt, hsa
gggagcagcccaaacuggcuggguuucagcaauuccugcagagccugcagcccaggacgacuga

SEQ ID NO: 482390 - RNA, 64 nt, hsa
ccugcagcccaggacgacugaagcucuugcagccccugcagacgagagucaggccagcacccug

SEQ ID NO: 482391 - RNA, 64 nt, hsa
uugcagaaaagaaacauguuaaaaucauggcacaccugcagaauuucagaugacagugugguca

SEQ ID NO: 482392 - RNA, 64 nt, hsa
agauguaccaugaacuaacaauucuuugaaaggaccugcagaagcauuuuuaauaccucauucu

SEQ ID NO: 482393 - RNA, 64 nt, hsa
agauagcuugcuguauucuguauagcuuacucuaccugcagacagaaaaugaaagaaaaaaaug

SEQ ID NO: 482394 - RNA, 64 nt, hsa
gguucagcuuuuagcaaaaagggcuacaguucacccugcagaguauuaagguuucuggauuuuu

SEQ ID NO: 482395 - RNA, 64 nt, hsa
gauagcgauagcuuuuaguagacagcgguaggugccugcagaacuuguguuuuucucaucuuua

SEQ ID NO: 482396 - RNA, 64 nt, hsa
ggguggaggcucugccuugccucaagaaccauccccugcagagcauccagggagguuucucgcc

SEQ ID NO: 482397 - RNA, 64 nt, hsa
gguccuuccccaaucaggugugggacauccagaaccugcagaaggugaacaccauccgggccca

SEQ ID NO: 482398 - RNA, 64 nt, hsa
ucugggacauccgaacccuugacugcauccacguccugcagacgucugguggcagcgucuacuc

SEQ ID NO: 482399 - RNA, 64 nt, hsa
cucacagaggcacaaacccacauaguuguggacgccugcagagacucaaauauugagaggacuu

SEQ ID NO: 482400 - RNA, 64 nt, hsa
ucauggcaacagaacgugggaugcuggaggcaugccugcagaaggacuguugaugcgacccaaa

SEQ ID NO: 482401 - RNA, 64 nt, hsa
ucagcuggaccuugcugugucgcccgcaggcagcccugcagacaccggugaggugggaugauuu

SEQ ID NO: 482402 - RNA, 64 nt, hsa
aucugagccagcaccgccggcuuucagggcagccccugcagacgucuggcccuggcggguggcu

SEQ ID NO: 482403 - RNA, 64 nt, hsa
uguuucucucuugaagaggauucuuugaaaagguccugcagagaaaucaguacagguuaucccg

SEQ ID NO: 482404 - RNA, 64 nt, hsa
caggagcggcgggcuuucccgaggggccacugucccugcagaguggaugcuucugccuagugac

SEQ ID NO: 482405 - RNA, 64 nt, hsa
ugcugcugcagaacgcacaggugcaccaguugguccugcagaacuggaugcucaaggcccugcc

SEQ ID NO: 482406 - RNA, 64 nt, hsa
ucccuccaggaaaugaggaccggccggacgaugcccugcagacugcucugaagagaaggaggga

SEQ ID NO: 482407 - RNA, 64 nt, hsa
uggcuaucuuucuuggcuaacauuaaauauucuuguaccagagcauggaaaaucguuuauaauu

SEQ ID NO: 482408 - RNA, 64 nt, hsa
gcucauucacucaguaauacugagcacuuaccauguaccagaauuuuacuaggcacaaccauga

SEQ ID NO: 482409 - RNA, 64 nt, hsa; identical to SEQ ID NO: 123292

SEQ ID NO: 482410 - RNA, 64 nt, hsa; identical to SEQ ID NO: 123293

SEQ ID NO: 482411 - RNA, 64 nt, hsa; identical to SEQ ID NO: 123294

SEQ ID NO: 482412 - RNA, 64 nt, hsa; identical to SEQ ID NO: 123295

SEQ ID NO: 482413 - RNA, 64 nt, hsa; identical to SEQ ID NO: 123296

SEQ ID NO: 482414 - RNA, 64 nt, hsa; identical to SEQ ID NO: 123297

SEQ ID NO: 482415 - RNA, 64 nt, hsa; identical to SEQ ID NO: 123298

SEQ ID NO: 482416 - RNA, 64 nt, hsa; identical to SEQ ID NO: 123299

SEQ ID NO: 482417 - RNA, 64 nt, hsa; identical to SEQ ID NO: 123300

SEQ ID NO: 482418 - RNA, 64 nt, hsa; identical to SEQ ID NO: 123301

SEQ ID NO: 482419 - RNA, 64 nt, hsa; identical to SEQ ID NO: 123302

SEQ ID NO: 482420 - RNA, 64 nt, hsa; identical to SEQ ID NO: 123303

SEQ ID NO: 482421 - RNA, 64 nt, hsa; identical to SEQ ID NO: 123304

SEQ ID NO: 482422 - RNA, 64 nt, hsa; identical to SEQ ID NO: 123305

SEQ ID NO: 482423 - RNA, 64 nt, hsa; identical to SEQ ID NO: 123306

SEQ ID NO: 482424 - RNA, 64 nt, hsa; identical to SEQ ID NO: 123307

SEQ ID NO: 482425 - RNA, 64 nt, hsa; identical to SEQ ID NO: 234336

SEQ ID NO: 482426 - RNA, 64 nt, hsa; identical to SEQ ID NO: 234337

SEQ ID NO: 482427 - RNA, 64 nt, hsa; identical to SEQ ID NO: 234338

SEQ ID NO: 482428 - RNA, 64 nt, hsa; identical to SEQ ID NO: 234339

SEQ ID NO: 482429 - RNA, 64 nt, hsa; identical to SEQ ID NO: 234340

SEQ ID NO: 482430 - RNA, 64 nt, hsa; identical to SEQ ID NO: 234341

SEQ ID NO: 482431 - RNA, 64 nt, hsa; identical to SEQ ID NO: 234342

SEQ ID NO: 482432 - RNA, 64 nt, hsa; identical to SEQ ID NO: 234343

SEQ ID NO: 482433 - RNA, 64 nt, hsa; identical to SEQ ID NO: 234344

SEQ ID NO: 482434 - RNA, 64 nt, hsa; identical to SEQ ID NO: 234345

SEQ ID NO: 482435 - RNA, 64 nt, hsa
gcucuuuuaggcagaagaauccaggcccgagcuggcagaagagacuuagagaugcuaauggaau

SEQ ID NO: 482436 - RNA, 64 nt, hsa
caguggggagcagaagcacucauagcucuuuuaggcagaagaauccaggcccgagcuggcagaa

SEQ ID NO: 482437 - RNA, 64 nt, hsa
ucaacacaccuaagccaguggcccucuaggaggggcagaagagccaaccagaggguuccuggag

SEQ ID NO: 482438 - RNA, 64 nt, hsa
ugcucugggccugacucaaagcaaacacgugggugcagaagacccaugggaggaggaggugggg

SEQ ID NO: 482439 - RNA, 64 nt, hsa
uuuuauuucuuuggucugugagcaacucaaagaggcagaagaggagaaugacuuuuccagaaua

SEQ ID NO: 482440 - RNA, 64 nt, hsa
gcugguaaguccuagggauuuccagaaguagccugcagaagaagguaaguuugaaagccacucc

SEQ ID NO: 482441 - RNA, 64 nt, hsa
auucugagcaggaaauuuauaagaaauugaaagagcagaagaauuacagcccugucacaugugc

SEQ ID NO: 482442 - RNA, 64 nt, hsa
ccacaggcugguggccauguucucugaauugggugcagaagacaagggcagaguggcugcggcc

SEQ ID NO: 482443 - RNA, 64 nt, hsa
gccccuauuaccuuuguagcagccacaucagaaagcagaagaaaacaguauuucugaaggcauu

SEQ ID NO: 482444 - RNA, 64 nt, hsa
caugcggcaaaccgcaugcucuuacccacacuacgcagaagagaaaguacaaccacuaucuuuu

SEQ ID NO: 482445 - RNA, 64 nt, hsa
caaguuuuuuucaaaguccaacuacagccaaauugcagaagaaacuccuggaucccuuucacua

SEQ ID NO: 482446 - RNA, 64 nt, hsa
ccgguaaacgcaagcccuuggggcagaugcagaagcagaagagggaggggaaaccugccucugg

SEQ ID NO: 482447 - RNA, 64 nt, hsa
cucaucgaggccccucgcuucuaugacugugcuugcagaagaguaaacacucucggaugccgcu

SEQ ID NO: 482448 - RNA, 64 nt, hsa
gggaagugaugcagagagcccacccgugcagagggcagaagaggacgaaaugccuuuggguggg

SEQ ID NO: 482449 - RNA, 64 nt, hsa
uuggaccuuuggguggcaauuccagcuuagcaacgcagaagaguacaaaguguggaagccaggg

SEQ ID NO: 482450 - RNA, 64 nt, hsa
acacacacacacacacacucugacugucuuuauugcagaagacaguguguugccuuacccagaa

SEQ ID NO: 482451 - RNA, 64 nt, hsa
acacacacacacacacacacacacagucuuuauugcagaagacaguguguugccuuaccagaau

SEQ ID NO: 482452 - RNA, 64 nt, hsa
auacacacacauacacacacacagagucuuuauugcagaagacaguguguugccuuauaggcgu

SEQ ID NO: 482453 - RNA, 64 nt, hsa
uguucauucagcgaauagcacccaguccugccuggcagaagaucaugcaguuuggaaguuuuca

SEQ ID NO: 482454 - RNA, 64 nt, hsa
uguucauuccaguguugagaugcuuugcaucucugcagaagaaauuuauuuuaaauuguuuaaa

SEQ ID NO: 482455 - RNA, 64 nt, hsa
ccacccccacccccgcacccccauucuacacaaggcagaagaggcacggguuuuucugggagcg

SEQ ID NO: 482456 - RNA, 64 nt, hsa
acgaccccaccucgaggagcuuccugagcagguggcagaagaugcgguaagaugggccuuguga

SEQ ID NO: 482457 - RNA, 64 nt, hsa
ggacggccagagcgagcugugcaagcuggaagcugcagaagacauugcauaccagcucucaugc

SEQ ID NO: 482458 - RNA, 64 nt, hsa
gaggucagaguggaagcaggugugagagggucccgcagaagaaaacauggcugccaaaguguuu

SEQ ID NO: 482459 - RNA, 64 nt, hsa
caucuggugaugccaaagccccauggauucaggugcagaagagggccaggacuaggucuucugc

SEQ ID NO: 482460 - RNA, 64 nt, hsa
cccuccccacagaaagcugcuccuggaugccccugcagaagaccccaauuaccugccccucccu

SEQ ID NO: 482461 - RNA, 64 nt, hsa; identical to SEQ ID NO: 267144

SEQ ID NO: 482462 - RNA, 64 nt, hsa; identical to SEQ ID NO: 267145

SEQ ID NO: 482463 - RNA, 64 nt, hsa; identical to SEQ ID NO: 267146

SEQ ID NO: 482464 - RNA, 64 nt, hsa; identical to SEQ ID NO: 267147

SEQ ID NO: 482465 - RNA, 64 nt, hsa; identical to SEQ ID NO: 267148

SEQ ID NO: 482466 - RNA, 64 nt, hsa; identical to SEQ ID NO: 267149

SEQ ID NO: 482467 - RNA, 64 nt, hsa; identical to SEQ ID NO: 267150

SEQ ID NO: 482468 - RNA, 64 nt, hsa; identical to SEQ ID NO: 267151

SEQ ID NO: 482469 - RNA, 64 nt, hsa; identical to SEQ ID NO: 267152

SEQ ID NO: 482470 - RNA, 64 nt, hsa; identical to SEQ ID NO: 267153

SEQ ID NO: 482471 - RNA, 64 nt, hsa; identical to SEQ ID NO: 267154

SEQ ID NO: 482472 - RNA, 64 nt, hsa; identical to SEQ ID NO: 267155

SEQ ID NO: 482473 - RNA, 64 nt, hsa; identical to SEQ ID NO: 267156

SEQ ID NO: 482474 - RNA, 64 nt, hsa; identical to SEQ ID NO: 267157

SEQ ID NO: 482475 - RNA, 64 nt, hsa; identical to SEQ ID NO: 267157

SEQ ID NO: 482476 - RNA, 64 nt, hsa; identical to SEQ ID NO: 267159

SEQ ID NO: 482477 - RNA, 64 nt, hsa; identical to SEQ ID NO: 267160

SEQ ID NO: 482478 - RNA, 64 nt, hsa; identical to SEQ ID NO: 267161

SEQ ID NO: 482479 - RNA, 64 nt, hsa; identical to SEQ ID NO: 267162

SEQ ID NO: 482480 - RNA, 64 nt, hsa; identical to SEQ ID NO: 267163

SEQ ID NO: 482481 - RNA, 64 nt, hsa; identical to SEQ ID NO: 267164

SEQ ID NO: 482482 - RNA, 64 nt, hsa; identical to SEQ ID NO: 267165

SEQ ID NO: 482483 - RNA, 64 nt, hsa; identical to SEQ ID NO: 482435

SEQ ID NO: 482484 - RNA, 64 nt, hsa; identical to SEQ ID NO: 482436

SEQ ID NO: 482485 - RNA, 64 nt, hsa; identical to SEQ ID NO: 482437

SEQ ID NO: 482486 - RNA, 64 nt, hsa; identical to SEQ ID NO: 482438

SEQ ID NO: 482487 - RNA, 64 nt, hsa; identical to SEQ ID NO: 482439

SEQ ID NO: 482488 - RNA, 64 nt, hsa; identical to SEQ ID NO: 482440

SEQ ID NO: 482489 - RNA, 64 nt, hsa; identical to SEQ ID NO: 482441

SEQ ID NO: 482490 - RNA, 64 nt, hsa; identical to SEQ ID NO: 482442

SEQ ID NO: 482491 - RNA, 64 nt, hsa; identical to SEQ ID NO: 482443

SEQ ID NO: 482492 - RNA, 64 nt, hsa; identical to SEQ ID NO: 482444

SEQ ID NO: 482493 - RNA, 64 nt, hsa; identical to SEQ ID NO: 482445

SEQ ID NO: 482494 - RNA, 64 nt, hsa; identical to SEQ ID NO: 482446

SEQ ID NO: 482495 - RNA, 64 nt, hsa; identical to SEQ ID NO: 482447

SEQ ID NO: 482496 - RNA, 64 nt, hsa; identical to SEQ ID NO: 482448

SEQ ID NO: 482497 - RNA, 64 nt, hsa; identical to SEQ ID NO: 482449

SEQ ID NO: 482498 - RNA, 64 nt, hsa; identical to SEQ ID NO: 482450

SEQ ID NO: 482499 - RNA, 64 nt, hsa; identical to SEQ ID NO: 482451

SEQ ID NO: 482500 - RNA, 64 nt, hsa; identical to SEQ ID NO: 482452

SEQ ID NO: 482501 - RNA, 64 nt, hsa; identical to SEQ ID NO: 482453

SEQ ID NO: 482502 - RNA, 64 nt, hsa; identical to SEQ ID NO: 482454

SEQ ID NO: 482503 - RNA, 64 nt, hsa; identical to SEQ ID NO: 482455

SEQ ID NO: 482504 - RNA, 64 nt, hsa; identical to SEQ ID NO: 482456

SEQ ID NO: 482505 - RNA, 64 nt, hsa; identical to SEQ ID NO: 482457

SEQ ID NO: 482506 - RNA, 64 nt, hsa; identical to SEQ ID NO: 482458

SEQ ID NO: 482507 - RNA, 64 nt, hsa; identical to SEQ ID NO: 482459

SEQ ID NO: 482508 - RNA, 64 nt, hsa; identical to SEQ ID NO: 482460

SEQ ID NO: 482509 - RNA, 64 nt, hsa; identical to SEQ ID NO: 267144

SEQ ID NO: 482510 - RNA, 64 nt, hsa; identical to SEQ ID NO: 267145

SEQ ID NO: 482511 - RNA, 64 nt, hsa; identical to SEQ ID NO: 267146

SEQ ID NO: 482512 - RNA, 64 nt, hsa; identical to SEQ ID NO: 267147

SEQ ID NO: 482513 - RNA, 64 nt, hsa; identical to SEQ ID NO: 267148

SEQ ID NO: 482514 - RNA, 64 nt, hsa; identical to SEQ ID NO: 267149

SEQ ID NO: 482515 - RNA, 64 nt, hsa; identical to SEQ ID NO: 267150

SEQ ID NO: 482516 - RNA, 64 nt, hsa; identical to SEQ ID NO: 267151

SEQ ID NO: 482517 - RNA, 64 nt, hsa; identical to SEQ ID NO: 267152

SEQ ID NO: 482518 - RNA, 64 nt, hsa; identical to SEQ ID NO: 267153

SEQ ID NO: 482519 - RNA, 64 nt, hsa; identical to SEQ ID NO: 267154

SEQ ID NO: 482520 - RNA, 64 nt, hsa; identical to SEQ ID NO: 267155

SEQ ID NO: 482521 - RNA, 64 nt, hsa; identical to SEQ ID NO: 267156

SEQ ID NO: 482522 - RNA, 64 nt, hsa; identical to SEQ ID NO: 267157

SEQ ID NO: 482523 - RNA, 64 nt, hsa; identical to SEQ ID NO: 267157

SEQ ID NO: 482524 - RNA, 64 nt, hsa; identical to SEQ ID NO: 267159

SEQ ID NO: 482525 - RNA, 64 nt, hsa; identical to SEQ ID NO: 267160

SEQ ID NO: 482526 - RNA, 64 nt, hsa; identical to SEQ ID NO: 267161

SEQ ID NO: 482527 - RNA, 64 nt, hsa; identical to SEQ ID NO: 267162

SEQ ID NO: 482528 - RNA, 64 nt, hsa; identical to SEQ ID NO: 267163

SEQ ID NO: 482529 - RNA, 64 nt, hsa; identical to SEQ ID NO: 267164

SEQ ID NO: 482530 - RNA, 64 nt, hsa; identical to SEQ ID NO: 267165

SEQ ID NO: 482531 - RNA, 64 nt, hsa
aggcgggaguguuucacuuucuggugauaaacuugauggucauuguuaugauuaagauaaugcc

SEQ ID NO: 482532 - RNA, 64 nt, hsa
acauaaaggauuaaaaucacacuaauaaccccuggauggucaaucugauaauaggaucagauuu

SEQ ID NO: 482533 - RNA, 64 nt, hsa
aaauaggccccuuugaggcuccugagugcccucagauggucaaaacccaguuuucccucuggga

SEQ ID NO: 482534 - RNA, 64 nt, hsa
uagcauuuuucacucuuggcuucuuuucucccuugauggucaagucucuuauguuucaauauuu

SEQ ID NO: 482535 - RNA, 64 nt, hsa
uguuuuaaauuuugugaugugggaaucaauuuuagauggucacaaucuagauuauaaucaauag

SEQ ID NO: 482536 - RNA, 64 nt, hsa
aauuuauccagaauggcaguagcuuuagcaagcagauggucacaaucuguuuucuaaaucauuu

SEQ ID NO: 482537 - RNA, 64 nt, hsa
aguguuauagugaaaauuuuccaguuugauaauugauggucagagccagcacuggaauuuugaa

SEQ ID NO: 482538 - RNA, 64 nt, hsa
gucucuguuucccagugggguggacaguauaucagauggucagaacaaauaaaguucaguguca

SEQ ID NO: 482539 - RNA, 64 nt, hsa
guucccacccagaacuaauuuauuuuuuauuaaagauggucaugacaaaugagaaaugagcucu

SEQ ID NO: 482540 - RNA, 64 nt, hsa
gccgacaccucccucaucucucuuauaguggaaggauggucagcauuaggcugauggggacuga

SEQ ID NO: 482541 - RNA, 64 nt, hsa
aaguauuccacaaaucuuaccucuuuaggucacugauggucacuccgauucugagugccacauu

SEQ ID NO: 482542 - RNA, 64 nt, hsa
auaguuuaugucaucucuucauuauuuagggcuggauggucaacucagucagugauuuuuugau

SEQ ID NO: 482543 - RNA, 64 nt, hsa
gagggguuuggguuaaguaugaggugaaaugggagauggucaguguggagaggggugcacccac

SEQ ID NO: 482544 - RNA, 64 nt, hsa
ccuguuccagagagaggugggacugcaaggagaggauggucagcccuacccaccugcccuguuu

SEQ ID NO: 482545 - RNA, 64 nt, hsa
ccccuauggaccagaagccaaggaucucucuagugauggucagagggcccaaauggcagggaua

SEQ ID NO: 482546 - RNA, 64 nt, hsa
cuggggaucuugcccccuuugaccuuccccaaaggauggucacacaccagcacuuuauacacuu

SEQ ID NO: 482547 - RNA, 64 nt, hsa
auauucucauggcuuuguuaaacuuauuucaagugauggucauucauaucacuaugaacuugga

SEQ ID NO: 482548 - RNA, 64 nt, hsa
gacaagaggcuggccccagucccaaggaacaagagauggucaagucgcuagagacauaucaggg

SEQ ID NO: 482549 - RNA, 64 nt, hsa
caucuagcaaguucccaaaggcaagacucucucugauggucacuuuguggucugugcuuucaga

SEQ ID NO: 482550 - RNA, 64 nt, hsa
gguuagggguggaguccgccaaaggcccaaaggugauggucaucgagauggagcuacgaaagga

SEQ ID NO: 482551 - RNA, 64 nt, hsa
accuggggcccuggcaucacacaagugugauuaggauggucaaggucaucaggaguacagccua

SEQ ID NO: 482552 - RNA, 64 nt, hsa
gauucuagauaaaucaucauuagcaauucauucagauggucaauaacuugaaauuuauagcugu

SEQ ID NO: 482553 - RNA, 64 nt, hsa
aaauguaauuuuuuguuguuuaaggccuugccuugauggucacaguuaucccaauggacacuaa

SEQ ID NO: 482554 - RNA, 64 nt, hsa
ucaucagacacuggaaugcagugauucuucuaaugauggucaacugcaaggagaaacuguuuac

SEQ ID NO: 482555 - RNA, 64 nt, hsa
gaaauuuguaacacuuuggucacaucugucucuagauggucauugaauuuguuuaaagauggau

SEQ ID NO: 482556 - RNA, 64 nt, hsa
cuuuuugugaaguuagguucuuaaaagugcccaugauggucacuuaaaaugugcaguaauagca

SEQ ID NO: 482557 - RNA, 64 nt, hsa
ggacacuucacuaccagaugugugcagugcaacagauggucauauacacugugaggcacugaaa

SEQ ID NO: 482558 - RNA, 64 nt, hsa
acacugcuuuauaaugaaaaugaggacacuuucugauggucaguaaaaucuuaaaugauuuuug

SEQ ID NO: 482559 - RNA, 64 nt, hsa
uuacugcugccauuuuccucaccaguauuccagagauggucauagcucauuacucuaccaccaa

SEQ ID NO: 482560 - RNA, 64 nt, hsa
ugcugcagaauguuaaacugcauaacaggcaccagauggucaagacgagggaaauaugagaagg

SEQ ID NO: 482561 - RNA, 64 nt, hsa
uucaagaaauuaguuuucuuuccuuuauuugauugauggucauugacuacugaaauaaaauaug

SEQ ID NO: 482562 - RNA, 64 nt, hsa
cugguugcuagcacauacuuuauuaucccccaaggauggucagccauuucuucccacagccaaa

SEQ ID NO: 482563 - RNA, 64 nt, hsa
uggcagcagcucauuuucuuuaauaggaggucaggauggucagcuccaguaucuccccuaaguu

SEQ ID NO: 482564 - RNA, 64 nt, hsa
uucgcugacaaauggcuguggggauggugggguggauggucagggagggaugcucagggaggga

SEQ ID NO: 482565 - RNA, 64 nt, hsa
cagauucuuggauucacuuggucacugggcugcugauggucagcucugagacagugguuugaga

SEQ ID NO: 482566 - RNA, 64 nt, hsa
ucaucuuucaugcagugacauguugauaaaaaaugauggucaguaugaaacugguaacagguug

SEQ ID NO: 482567 - RNA, 64 nt, hsa
caacuaguauuuguugagcuccuauuugcccagagauggucauauuuaaacagaaguauacguu

SEQ ID NO: 482568 - RNA, 64 nt, hsa
uccccuagucacucauccauccccuggcuccagagauggucacaugacccaggccuggccaguc

SEQ ID NO: 482569 - RNA, 64 nt, hsa
accaguaacuucauggaggcccuuaacguuuccugauggucauacuacaauuuuuggaguccac

SEQ ID NO: 482570 - RNA, 64 nt, hsa
uuuuuuucuuuuauuugcucgaguucacauuaaugauggucacaaggcugccuuguugggcagg

SEQ ID NO: 482571 - RNA, 64 nt, hsa
ggcccugcaaggcccacacucacgcccugugggugauggucacggugggugggugggggcugac

SEQ ID NO: 482572 - RNA, 64 nt, hsa
aacagcagaagggcagggcaaggcugagcucugagauggucaguuuagaguaggaugcugggca

SEQ ID NO: 482573 - RNA, 64 nt, hsa
ugcacuuaguauuaaguugaaacuugaacaaauagauggucacauugcugaacauaauucuaaa

SEQ ID NO: 482574 - RNA, 64 nt, hsa
aaugucaacaaagggaaaauaaacuaucagcuuggauggucacuugaauagaagaugguuauac

SEQ ID NO: 482575 - RNA, 64 nt, hsa
ugauucuuuuuuugugacuagaaauucuuaagccgauggucacuauagcucauccuuaauguau

SEQ ID NO: 482576 - RNA, 64 nt, hsa
gcugggauggggccauaucuacuagcagaggccagauggucagauaugauuucugcaaacccau

SEQ ID NO: 482577 - RNA, 64 nt, hsa
uguccccucaggcugucaccgugccuacuguggagauggucaccggcaugaggguguggaggac

SEQ ID NO: 482578 - RNA, 64 nt, hsa
cggagcuuggcccugcgcccugugcagggaaagggauggucaggcccaguucucgugcccuuag

SEQ ID NO: 482579 - RNA, 64 nt, hsa
cagagagaagccauucgugaugcuuagaaccaaggauggucauguacacaaagaccaucgagac

SEQ ID NO: 482580 - RNA, 64 nt, hsa
cagcaccggccucgggaagccccauccaacacuggauggucaucucggaguuccaguaccgccc

SEQ ID NO: 482581 - RNA, 64 nt, hsa
ucaguugguugcaccguuagccccucuccucccggauggucauguuuuugucacauuagagaau

SEQ ID NO: 482582 - RNA, 64 nt, hsa
uauguuccuaauaagugaagggaaagauaauaaugauggucaacaauaagccacgucaaugcau

SEQ ID NO: 482583 - RNA, 64 nt, hsa
gagggagagauugggggaauggggagaugaugaugauggucaaagggugcaaaaucucacacaa

SEQ ID NO: 482584 - RNA, 64 nt, hsa
aaaacuuggcuucucucuaccucucagcacuaaugauggucaaaugccuuacaucuuuucugau

SEQ ID NO: 482585 - RNA, 64 nt, hsa
gugugcauacaucucauccacaggggaagauaaagauggucacacaaacaguuuccauaaagau

SEQ ID NO: 482586 - RNA, 64 nt, hsa
ucuuaguuugcaguuacacuaaaaggugaccaaugauggucaccaaaucagcugcuacuacucc

SEQ ID NO: 482587 - RNA, 64 nt, hsa
ugcugcaaauaguuaaauuauauuuauuugaauugauggucaagagauuuuccauuuuuuuuac

SEQ ID NO: 482588 - RNA, 64 nt, hsa
aguuuaacagaaagagcacauuuguggacuuccagauggucaggagaugagcaaaggauuggua

SEQ ID NO: 482589 - RNA, 64 nt, hsa
aaauuuuggaagaugcuuuacuauguaaaguauagauggucauuuuaaucauucagccacauac

SEQ ID NO: 482590 - RNA, 64 nt, hsa
cugcucucucaugaaacaagagcuagaaacucaggauggucaucuuggagggaccaaggggugg

SEQ ID NO: 482591 - RNA, 64 nt, hsa
acccaccaccuucuucuccuacauaucccuuccagauggucauccagacucagagcucucucua

SEQ ID NO: 482592 - RNA, 64 nt, hsa
ucuauuuaagaaauaugaagaaaaaauacaccaagauggucaaauuacuacacaaaucagcacc

SEQ ID NO: 482593 - RNA, 64 nt, hsa
ucaugucuguuguauuuucaguaaugugauuucagauggucaucuggauucucccacuucucua

SEQ ID NO: 482594 - RNA, 64 nt, hsa
cugcuugucucuuugugucuguuauccugggcaggauggucauucucaaaaacccugggguccu

SEQ ID NO: 482595 - RNA, 64 nt, hsa
uaaauauacaaacuuauucauguuuuuaggugaugauggucauugaaacucacuucuuuucagg

SEQ ID NO: 482596 - RNA, 64 nt, hsa
uuauauuaacagaauaucaugggcauuucucuaugauggucauucaagguaguaggucucuuuc

SEQ ID NO: 482597 - RNA, 64 nt, hsa
ugugauuuguauuaaugcaccagucaucauaaaagauggucaugauaguacacccauugcuccu

SEQ ID NO: 482598 - RNA, 64 nt, hsa
gcucuccccagagggagggcgagaaggguguggugauggucaaucuggcugucggaacagauuc

SEQ ID NO: 482599 - RNA, 64 nt, hsa
agaguauccacuguuuauucaacaacuacuacuugauggucagacacaaacaaacaagcuaggu

SEQ ID NO: 482600 - RNA, 64 nt, hsa
gagacacccaggggccuggcccgccagcccaaaagauggucaucgggaagagaaaaagaaaaaa

SEQ ID NO: 482601 - RNA, 64 nt, hsa
guuucaucguuugucaaaguuccguaggaucagugauggucauucagcaugacugguucuggga

SEQ ID NO: 482602 - RNA, 64 nt, hsa
aaaaccccagacuuugaauuaguaacagcucuaagauggucaugcagugagauaggaaaucaag

SEQ ID NO: 482603 - RNA, 64 nt, hsa
ggagccuucauauguuaaauauuccugcacuagugauggucacuuagaauguuuauagaaaugu

SEQ ID NO: 482604 - RNA, 64 nt, hsa
agcccaggaaagggggauguuuuccugguguuuggauggucagcugggaguguccaucaucagg

SEQ ID NO: 482605 - RNA, 64 nt, hsa
accuccucgagugcccugggaccacugggccacagauggucaucaggggaagccaccagggagu

SEQ ID NO: 482606 - RNA, 64 nt, hsa
ccugggagguccugcugcaacucaaguuccacaggauggucaagcugucagacauccaaguuua

SEQ ID NO: 482607 - RNA, 64 nt, hsa
cgcugcugggcguucugcaccucgucgcgguagagauggucaaguugggagcaucggcagccga

SEQ ID NO: 482608 - RNA, 64 nt, hsa
cacugauagaauuucugaaagagaaagagaaguagauggucaaccagucacuaguugguuggca

SEQ ID NO: 482609 - RNA, 64 nt, hsa
uuuacuauuuaaagagcguaaauagugaaaguaagauggucauacuuacugacuuuaucuauuu

SEQ ID NO: 482610 - RNA, 64 nt, hsa
aaugaaagcacuaaguuugguuuugcuuuugugagauggucagcuuuggugcucuccacaacau

SEQ ID NO: 482611 - RNA, 64 nt, hsa
gggucaguuguagcugcugcaaaguucuguagcugauggucauuuaauugcauggggguuauuu

SEQ ID NO: 482612 - RNA, 64 nt, hsa
uuugcaauccaaauccagccuuuggaggaauagagauggucaauuaacaaucaaaaagaggaga

SEQ ID NO: 482613 - RNA, 64 nt, hsa
uucuguguaaugaggcuauuuccaagucuccaaagauggucacuguaacagcacuuugcugaga

SEQ ID NO: 482614 - RNA, 64 nt, hsa
uuauuuucuauaggcaaugucuagaguauggagagauggucagaaauauccuguacauauuuac

SEQ ID NO: 482615 - RNA, 64 nt, hsa
cuaccucccuccccgucucauuccguugucuguggauggucauugcaguuuaagagcagaacag

SEQ ID NO: 482616 - RNA, 64 nt, hsa
gcagcugagggaggggcgcuggccacaugucacugauggucagauuccaaaguccuuucuuuau

SEQ ID NO: 482617 - RNA, 64 nt, hsa
uguggggucauacaucaucguguuuguaagagaagauggucauuuuauucucuguauaaaacuu

SEQ ID NO: 482618 - RNA, 64 nt, hsa
agaguuuucaagaaacugcguucuacuuccagaagauggucacuuuaaccuuguaaauauuuau

SEQ ID NO: 482619 - RNA, 64 nt, hsa
agcuccuggaccugugucuaguacauacugaagcgauggucagaguguguagagugaaguugcu

SEQ ID NO: 482620 - RNA, 64 nt, hsa
caaugcaugcccaccuguugaucuaaggggccgcgauggucagggccacggccaagggccacgg

SEQ ID NO: 482621 - RNA, 64 nt, hsa
auaucagucaugacuagugccuagaaagcaaugugauggucaggaucucaugacauuauauuug

SEQ ID NO: 482622 - RNA, 64 nt, hsa
ccaggucccaggcuguggaaagccccagcccagggauggucagaacucaggggcagauuccacu

SEQ ID NO: 482623 - RNA, 55 nt, hsa
cucaucaugaacacagcuaaggaaugauggucaaucaguguuaacuugcauauug

SEQ ID NO: 482624 - RNA, 64 nt, hsa
accuggucuuacuguccauguguguuugggcccggauggucaggguggggagcagggacggcca

SEQ ID NO: 482625 - RNA, 59 nt, hsa
ucacccccucuucagguugauacugccuggauggucaccucuggugcgcagcaagugca

SEQ ID NO: 482626 - RNA, 64 nt, hsa
uuugccaagaccgugaucaagguagcuuaagagagauggucaggagaaaacacuguuuuuguuu

SEQ ID NO: 482627 - RNA, 64 nt, hsa
gaggcaaaccaagccuccuuagugcccuggggcugauggucacccagagccauagagcacccuu

SEQ ID NO: 482628 - RNA, 64 nt, hsa
aucuuauaugaauaauuuugaaauaacucugaaagauggucauaugauauuccuucauuuucag

SEQ ID NO: 482629 - RNA, 64 nt, hsa
uucucuucuuucucucuuuuucuuugaggagaaugauggucaccaccacaauuaauuguaauua

SEQ ID NO: 482630 - RNA, 64 nt, hsa
uuggccagugauggggaaucagugagugcuccaugauggucauguuccaggugcuaguacauca

SEQ ID NO: 482631 - RNA, 64 nt, hsa
gcuggggucauuuuuaggggaaaaaggaggauaugauggucacauggggaaccuccccucaucg

SEQ ID NO: 482632 - RNA, 64 nt, hsa
acucccuccacccccccuccacuguaggccacuggauggucauuugcaucuccguaaaugugcu

SEQ ID NO: 482633 - RNA, 64 nt, hsa
uccccucccccaccugguugggguagagcaaaaggauggucacucuuccgaggucucccugaaa

SEQ ID NO: 482634 - RNA, 64 nt, hsa
uaggccuaguccucucauuccucccacccuccgagauggucagugugucaugggaagcccaccc

SEQ ID NO: 482635 - RNA, 64 nt, hsa
cuaaucacaucaaucucucuugauuacacugugugauggucauauuagucucucuacaugggaa

SEQ ID NO: 482636 - RNA, 64 nt, hsa
ucuaaguauucaauuaagugggaauuuucuggaagauggucagcuaugaaguaauagaguuugc

SEQ ID NO: 482637 - RNA, 64 nt, hsa
aguuagacucuuaaaauccuuugccaaaauaagggauggucaaauauaugaaacaugucuuuag

SEQ ID NO: 482638 - RNA, 64 nt, hsa
uccauucagacuccuuuccugccuugugaccucagauggucaccaucauuccugugcucagagg

SEQ ID NO: 482639 - RNA, 64 nt, hsa
agaaggagaccuuuucacaauggaaaaccugggggauggucagagcccagucgagaccucacac

SEQ ID NO: 482640 - RNA, 64 nt, hsa
ccucccuugcuuccagauuguuuuagugggcccugauggucauuuuucuaaacagaggcccugc

SEQ ID NO: 482641 - RNA, 64 nt, hsa
aucuacccuugauuaucuagaaagacuugguaaugauggucaguuccuuuuagauuucagaaaa

SEQ ID NO: 482642 - RNA, 64 nt, hsa
cugaugcaaaaaacagaaaaggggugauguaggagauggucagguugguaggagaagcuauaag

SEQ ID NO: 482643 - RNA, 64 nt, hsa
uacagcuuuggaaggaucuuuuuuucuuuaacuagauggucaccuucuucccuaccacacaugg

SEQ ID NO: 482644 - RNA, 64 nt, hsa
aguaccugugaaaucuauaacucagaaauggucagauggucaggagccagcuaugcagcaguau

SEQ ID NO: 482645 - RNA, 64 nt, hsa
uuguggaucuugguguuauuuaaaaaauugaggugauggucauugcaagcucaucuauuaagua

SEQ ID NO: 482646 - RNA, 64 nt, hsa
aagcuaagcaagagagccaaauuuuuagaaaucugauggucaaaauagcugaaagcaguaaaca

SEQ ID NO: 482647 - RNA, 64 nt, hsa
aaggaaccucaggcaccaacagugagcccacgaggauggucacaugccaugugcagaauuugac

SEQ ID NO: 482648 - RNA, 64 nt, hsa
uccacugccaacagaaaacaaagcagcugacugagauggucaaaggacuuuggaccauagggga

SEQ ID NO: 482649 - RNA, 64 nt, hsa
gacugcaaagcuuacucaggaaaugaaaacaaaugauggucauguugcaguuuuuuccuugaag

SEQ ID NO: 482650 - RNA, 64 nt, hsa
caggcaaaaugaagcuggccacugaaaacuguaagauggucaaaagcugacagccuguguaugu

SEQ ID NO: 482651 - RNA, 64 nt, hsa
cacagagauaugcacacacacggaugcacacacagauggucacacagagauacgcaaacacacc

SEQ ID NO: 482652 - RNA, 64 nt, hsa
auauuuauauaauuuuauagaaaauaaccuuuuagauggucaaaguguaaggaguuuuuuuguc

SEQ ID NO: 482653 - RNA, 64 nt, hsa
gcugcaggacgaacugucgauguuucuuagcagagauggucacagagggcagcagggacaggac

SEQ ID NO: 482654 - RNA, 64 nt, hsa
cucacacucagaaccucauaccccagagcaaaccgauggucagggagagggcuagagcucacac

SEQ ID NO: 482655 - RNA, 64 nt, hsa
gcuucucuguauuaaauagucuagaaguuaaggggauggucacauuuaccauguauuguguuau

SEQ ID NO: 482656 - RNA, 64 nt, hsa
uugguuaaauuaacaucuauacgauggaauacuagauggucauuaaaauuaugugucagaagaa

SEQ ID NO: 482657 - RNA, 64 nt, hsa
agugagacugucucaaaaaaaaaaaaaaauuaaugauggucaaaggguauaaaaucucagacag

SEQ ID NO: 482658 - RNA, 64 nt, hsa
caccuugcccuuccuuccaccaccgaagaaaaaagauggucauacuaacaggugaaauguacaa

SEQ ID NO: 482659 - RNA, 64 nt, hsa
aagggcauaggaaaauuuucccaguaaauccccugauggucacauuaagguaaagguuuuggcu

SEQ ID NO: 482660 - RNA, 64 nt, hsa
aauugaaugccuugaaaguauuauccacuggucagauggucaacuuuuuucaguauuauuuaua

SEQ ID NO: 482661 - RNA, 64 nt, hsa
uuguggaggguuauuuaaaaaaacaaaaaaggaagauggucaaguuuguaaaauauuuguuugu

SEQ ID NO: 482662 - RNA, 64 nt, hsa
cccuaguguuggaaagggcagugccucguggacagauggucauuuagccucuggggugaaauac

SEQ ID NO: 482663 - RNA, 64 nt, hsa
aaagggauagagguuggguuuccccccuuuuauagauggucacgcaccuggguguuacaaaguu

SEQ ID NO: 482664 - RNA, 64 nt, hsa
uuuuguauuuuuaauagaguugagauuucaccaugauggucaggcuggucucgaacuccugacc

SEQ ID NO: 482665 - RNA, 64 nt, hsa
acccaggacccaggccuagccacugcccacagcugauggucacuguuuuggcuggcuccagagu

SEQ ID NO: 482666 - RNA, 64 nt, hsa
uagauggcugcugggugugcagcaggagaaggaggauggucagccuuggagcaucucucaauua

SEQ ID NO: 482667 - RNA, 64 nt, hsa
ugucaauguuacuuucuugucacuuuccuacccugauggucacacuagcccaccccaagcuccg

SEQ ID NO: 482668 - RNA, 64 nt, hsa
uccagagggucagcccauggggagcuuuguguuggauggucagcaacacauggggauccggccu

SEQ ID NO: 482669 - RNA, 64 nt, hsa
ugagccuuccacuguggaugggggccgugauccugauggucacauugcuuuaacccagcagggc

SEQ ID NO: 482670 - RNA, 64 nt, hsa
ucaccgguucucacugugucugggaaguaggacugauggucaucuucaugacaggcggcaucuc

SEQ ID NO: 482671 - RNA, 64 nt, hsa
ccaugucugcacaagauucuucuuuguauaugaggauggucaggugggcgaugccaacauuaau

SEQ ID NO: 482672 - RNA, 64 nt, hsa
aggugccuccaucucucccuuccccaauauaccugauggucaacucuccugcuuuguccaguuc

SEQ ID NO: 482673 - RNA, 64 nt, hsa
ucaggggcuccuucuggcugcaguaagcucccuggauggucacagugccgccccauccccaggc

SEQ ID NO: 482674 - RNA, 64 nt, hsa
auucuggugauugugugauguaaagaggugcuaugauggucaugcaauuaauacuaaauauuga

SEQ ID NO: 482675 - RNA, 64 nt, hsa
ucauguauugaaugagugaaccagaaaauuagaagauggucaaaaaaaguccaaguuaccaauu

SEQ ID NO: 482676 - RNA, 64 nt, hsa
uguagaaaaugccagggauccaccacaagauggagauggucagcacaaaccgauucuguuccuc

SEQ ID NO: 482677 - RNA, 64 nt, hsa
ccucucccuggccugagguucaaaggccucaucggauggucaguacaguggggucaccuguugu

SEQ ID NO: 482678 - RNA, 64 nt, hsa
aggcagcgagcagcccaggccagcuuucugcauggauggucagucucuugcccucaaacacuac

SEQ ID NO: 482679 - RNA, 64 nt, hsa
guuccuacaaaacccucuuugaugcggcggagacgauggucagccuucagcugggaaucuucaa

SEQ ID NO: 482680 - RNA, 64 nt, hsa
ugugucugccugccucaugcucucuauagaggaggauggucaucgugacagcagcagcucaagu

SEQ ID NO: 482681 - RNA, 64 nt, hsa
cugcagcuagcauaguuucaugcucagugaggaugauggucaccguguuuguuguguacuuacu

SEQ ID NO: 482682 - RNA, 64 nt, hsa
guuuuggaaaagugagcucuggguucugcucugagauggucagagaagaugcgggccaggagac

SEQ ID NO: 482683 - RNA, 64 nt, hsa
uuucagguuuuuacucacuuuacuaaacaguuuggauggucagucucuacugggacauguuagg

SEQ ID NO: 482684 - RNA, 64 nt, hsa
agcugaggggacagggaggagcagaagccaucaagauggucaaagggccugcagagggagaugu

SEQ ID NO: 482685 - RNA, 64 nt, hsa
augggccaccucuuccuccaagcccagaugcagagauggucaugggcagcuggaggguaggcuc

SEQ ID NO: 482686 - RNA, 64 nt, hsa
gugugaggagaccaucaccucgaccagaacuccagauggucaccugcccuggccccuccucugg

SEQ ID NO: 482687 - RNA, 64 nt, hsa
cggugacccacggggcuccuggcuugcagcuggugauggucaagaacugacuacaaaacaggaa

SEQ ID NO: 482688 - RNA, 64 nt, hsa
cccaggucccucuccuguagucagucugaguucugauggucagagguuggagcugugacagugg

SEQ ID NO: 482689 - RNA, 64 nt, hsa
ggguggggagauggagcagggaaguacagagugggauggucaggaccugggccauugcaaccaa

SEQ ID NO: 482690 - RNA, 64 nt, hsa
ggcuggggugggagucuggaauuguuuucaaagugauggucagacccuccaggcuucggggaaa

SEQ ID NO: 482691 - RNA, 64 nt, hsa
cacggcccugagcggcugcagccugcuuugggacgauggucaggucccauguugucccugcugc

SEQ ID NO: 482692 - RNA, 64 nt, hsa
aauuaguuuaaaagccaaggucauaacaugaauugauggucaauuucccuucagcagaaggaaa

SEQ ID NO: 482693 - RNA, 64 nt, hsa
agaagacuugaaugaaguuggagggacauugaaugauggucagagggcagacgaaugugucgug

SEQ ID NO: 482694 - RNA, 64 nt, hsa
uuggagucuugcacuggccaugaguguugugacugauggucaacccaggcgggcauuuuaauaa

SEQ ID NO: 482695 - RNA, 64 nt, hsa
ucucccggguccagcgccuggggcugccccucaagauggucauguacucagcugugaguccuug

SEQ ID NO: 482696 - RNA, 64 nt, hsa
gcauuuuaucaaaugcauuuucuacauguauuaagauggucauauuauucuucuucuuuuaugu

SEQ ID NO: 482697 - RNA, 64 nt, hsa
cccucccucaggaugacgcuaguuagcugacacagauggucaccuccauuaccaaguagaguca

SEQ ID NO: 482698 - RNA, 64 nt, hsa
ugccuggcccugcugccccuccugaaucucguaugauggucacaguccgguggccgugggggug

SEQ ID NO: 482699 - RNA, 64 nt, hsa
ccacacagaagucuggucaccucugggcgccugggauggucaccgaagagaagcacgcuguccc

SEQ ID NO: 482700 - RNA, 64 nt, hsa
ccaugguccuggacccagcaaaaagaaugauuaugauggucagaguaagaugagcaauugcaac

SEQ ID NO: 482701 - RNA, 64 nt, hsa
aacuuguuaauuagaauguuguugaaugagggcugauggucagaaauuaaugauggugagaaga

SEQ ID NO: 482702 - RNA, 64 nt, hsa
ugcaggagcucagcauagacccagcucucugggggauggucaccuggugauuucaaugauggca

SEQ ID NO: 482703 - RNA, 64 nt, hsa
cagagauuacucuggcuuugacccuuguuuagcugauggucauuucugggauuggaauauuuaa

SEQ ID NO: 482704 - RNA, 64 nt, hsa
ccuggggcacuggaacacauuccugggggucaccgauggucagagucacuagaaguuaccugag

SEQ ID NO: 482705 - RNA, 64 nt, hsa
acaacaaaaaagaauguuuugguauuggagaagggauggucaguuagccugucugucacacgac

SEQ ID NO: 482706 - RNA, 64 nt, hsa
uguucccagauaagaucacuccuucuggggacaagauggucacuaguagauccagguuuacuuu

SEQ ID NO: 482707 - RNA, 64 nt, hsa
uaguuggaagccggcguucgguaucagaagcgcugauggucauauccaaucucaauaucugggu

SEQ ID NO: 482708 - RNA, 64 nt, hsa
ccaguugacauccaggauggcugcaagcgcacuugauggucaggaaguuugcagauacucgcca

SEQ ID NO: 482709 - RNA, 64 nt, hsa
ggggcauaucucagucaggcagcggcuuccugaugauggucauuggggugguugucaugugaug

SEQ ID NO: 482710 - RNA, 64 nt, hsa
ggggggccucaacccucuccuggagcgccugugagauggucagcguggagcgcaagugcuggac

SEQ ID NO: 482711 - RNA, 64 nt, hsa
cccgcacccggagccucagggaugggcucaggcugauggucagcugggcgcuuggaaaguguuu

SEQ ID NO: 482712 - RNA, 64 nt, hsa
aaacucugaauguauuuauaacuauuuauuucuggauggucauuaucuuguagccaaauuugac

SEQ ID NO: 482713 - RNA, 64 nt, hsa
aggcucguaggauauuucaggugagucaggguuggauggucaucggcuuucagaaggagaccac

SEQ ID NO: 482714 - RNA, 64 nt, hsa
uuggcuacaucuuucccacaaccguauaacgaccgauggucauuucuccaagagcaggcuuggc

SEQ ID NO: 482715 - RNA, 64 nt, hsa
ccaugacuuuguaauuuugagaauuccucccagugauggucaguauucuuuuggaauguaaacc

SEQ ID NO: 482716 - RNA, 64 nt, hsa
auguauggcauuaagaaauagagaaagaguguaagauggucaauauuugguuuccuaaaugcuu

SEQ ID NO: 482717 - RNA, 64 nt, hsa
ucacgacccaucacucuaccucuaccagcgcacugauggucacugguggaacuccacucacugg

SEQ ID NO: 482718 - RNA, 64 nt, hsa
guugaugacuucuuguggcauuucacacacuguagauggucacucccuucauguccauguuagc

SEQ ID NO: 482719 - RNA, 64 nt, hsa
uuuuuuuuuuuuuuuuguccacuaaaaacacacugauggucaacacaggucaaaaccaagagag

SEQ ID NO: 482720 - RNA, 52 nt, hsa
gucaagaaucauggaaguaaacaucugagaaaccuguugaagauuauuucau

SEQ ID NO: 482721 - RNA, 64 nt, hsa
caaacucuucaguuaauucuuagauacacuaaaaaucugagaaacucuacauguaacuauuucu

SEQ ID NO: 482722 - RNA, 64 nt, hsa
uuacagaaugggagaaaauuguugcaaacuaugcaucugagaaaggucugaaauccagcaucua

SEQ ID NO: 482723 - RNA, 64 nt, hsa
aaaggaacuuuuaaaagauuaucucagaaaguaaaucugagagguaagaaguaauaaugaguaa

SEQ ID NO: 482724 - RNA, 64 nt, hsa
ggacacauuugggaguauuuaaucagguguggcuaucugagaaaucaacuuugggggaaaugua

SEQ ID NO: 482725 - RNA, 64 nt, hsa
cacuaauuuuacuuaccuauuagauuuugaaaguaucugagauauacaaaucucccuguaggaa

SEQ ID NO: 482726 - RNA, 64 nt, hsa
aaguugaccucaagauaacauuuuucauuaaagcaucugagaucuaagaacacaauuauuauuc

SEQ ID NO: 482727 - RNA, 64 nt, hsa
acugacauggcuaacugcaagaauuaaaucuucuaucugagaguaauaauuuaugaugacucag

SEQ ID NO: 482728 - RNA, 64 nt, hsa
ucaaauuuacaucaaagauaccugaaguguugguaucugagaauaucugucacuccucuuaucu

SEQ ID NO: 482729 - RNA, 64 nt, hsa
guguugguaucugagaauaucugucacuccucuuaucugagaagugaccuuuuauuuuuaagau

SEQ ID NO: 482730 - RNA, 64 nt, hsa
ccagcaccacgauggccccaggacguuguuuaagaucugagaucccuugguuucucucuuguug

SEQ ID NO: 482731 - RNA, 64 nt, hsa
uaagaucugagaucccuugguuucucucuuguugaucugagaugcuacaucagggcccuugcug

SEQ ID NO: 482732 - RNA, 64 nt, hsa
gcagcuucuaagagcgaacuucacauaggaagggaucugagaacacguugccaggggcuugaga

SEQ ID NO: 482733 - RNA, 64 nt, hsa
ucuauuaauaucaacucugaagcuaauuguacuaaucugagauuguguuuguucauaauaaaag

SEQ ID NO: 482734 - RNA, 64 nt, hsa
agcauuaacccaaaaguccgcaguccaaaguuucaucugagacaaggcaagucccuuccacuua

SEQ ID NO: 482735 - RNA, 64 nt, hsa
cuuuacuccaguucccaaaaaguuuuucaucuccaucugagaccaccucagccugaauuuuauu

SEQ ID NO: 482736 - RNA, 64 nt, hsa
uggguuggacaaccucauuuuaacucagucuuuaaucugagaggccacagugcaauuuuauuuu

SEQ ID NO: 482737 - RNA, 64 nt, hsa
ggauauugauacuguuuguguuuuuaguugggagaucugagagaccuggcuuuggcaagagcag

SEQ ID NO: 482738 - RNA, 64 nt, hsa
agacucaguauagcuuaaaauuuuguauuucuuuaucugagagaacugaguucccaggcuaaau

SEQ ID NO: 482739 - RNA, 64 nt, hsa
guacaacucaaaaggugcuucagagacuagauguaucugagagggucuccagaccagguuacug

SEQ ID NO: 482740 - RNA, 64 nt, hsa
gcugcucagacccuccagaugagguccagcccagaucugagaggaacccuggaaaugugaaguc

SEQ ID NO: 482741 - RNA, 64 nt, hsa
ugcaagaaugaccucugucuguugaagccuugguaucugagaggucaggaaggggaccucuuug

SEQ ID NO: 482742 - RNA, 64 nt, hsa
uaucuaauuagagaaauaauuguuguauuuuaagaucugagaguguguacaaguuuuaguauac

SEQ ID NO: 482743 - RNA, 64 nt, hsa
gcauggugggucauugaggagacccaggaaucucaucugagaacccacucucugccggagaacc

SEQ ID NO: 482744 - RNA, 64 nt, hsa
uuagaucuuaaaugaguuuggcagccucuuuagaaucugagagagaucacugucaaguugcacu

SEQ ID NO: 482745 - RNA, 64 nt, hsa
uguuucucacaugcauacuacauugguuuugagcaucugagaggcauugguuugucuugcauuc

SEQ ID NO: 482746 - RNA, 64 nt, hsa
aggagauccuaauaugaaagaaaaauggaucccaaucugagaaaaggcaaaagaauggcuacuu

SEQ ID NO: 482747 - RNA, 64 nt, hsa
uauuucuguggaaauaugaggaaaauccaugguuaucugagauaggagauacaaacuuuguaau

SEQ ID NO: 482748 - RNA, 64 nt, hsa; identical to SEQ ID NO: 284001

SEQ ID NO: 482749 - RNA, 64 nt, hsa; identical to SEQ ID NO: 284002

SEQ ID NO: 482750 - RNA, 64 nt, hsa; identical to SEQ ID NO: 284003

SEQ ID NO: 482751 - RNA, 64 nt, hsa; identical to SEQ ID NO: 284004

SEQ ID NO: 482752 - RNA, 64 nt, hsa; identical to SEQ ID NO: 284005

SEQ ID NO: 482753 - RNA, 64 nt, hsa; identical to SEQ ID NO: 284006

SEQ ID NO: 482754 - RNA, 64 nt, hsa; identical to SEQ ID NO: 284007

SEQ ID NO: 482755 - RNA, 64 nt, hsa; identical to SEQ ID NO: 284008

SEQ ID NO: 482756 - RNA, 64 nt, hsa; identical to SEQ ID NO: 284009

SEQ ID NO: 482757 - RNA, 64 nt, hsa; identical to SEQ ID NO: 284010

SEQ ID NO: 482758 - RNA, 64 nt, hsa; identical to SEQ ID NO: 284011

SEQ ID NO: 482759 - RNA, 64 nt, hsa; identical to SEQ ID NO: 284012

SEQ ID NO: 482760 - RNA, 64 nt, hsa; identical to SEQ ID NO: 284013

SEQ ID NO: 482761 - RNA, 64 nt, hsa; identical to SEQ ID NO: 284014

SEQ ID NO: 482762 - RNA, 64 nt, hsa; identical to SEQ ID NO: 284015

SEQ ID NO: 482763 - RNA, 64 nt, hsa; identical to SEQ ID NO: 284016

SEQ ID NO: 482764 - RNA, 64 nt, hsa; identical to SEQ ID NO: 284017

SEQ ID NO: 482765 - RNA, 64 nt, hsa; identical to SEQ ID NO: 284018

SEQ ID NO: 482766 - RNA, 64 nt, hsa; identical to SEQ ID NO: 284019

SEQ ID NO: 482767 - RNA, 64 nt, hsa; identical to SEQ ID NO: 284020

SEQ ID NO: 482768 - RNA, 64 nt, hsa; identical to SEQ ID NO: 284021

SEQ ID NO: 482769 - RNA, 64 nt, hsa; identical to SEQ ID NO: 284022

SEQ ID NO: 482770 - RNA, 64 nt, hsa; identical to SEQ ID NO: 284023

SEQ ID NO: 482771 - RNA, 64 nt, hsa; identical to SEQ ID NO: 284024

SEQ ID NO: 482772 - RNA, 64 nt, hsa; identical to SEQ ID NO: 284025

SEQ ID NO: 482773 - RNA, 64 nt, hsa; identical to SEQ ID NO: 284026

SEQ ID NO: 482774 - RNA, 64 nt, hsa; identical to SEQ ID NO: 284027

SEQ ID NO: 482775 - RNA, 64 nt, hsa; identical to SEQ ID NO: 284028

SEQ ID NO: 482776 - RNA, 64 nt, hsa; identical to SEQ ID NO: 284029

SEQ ID NO: 482777 - RNA, 54 nt, hsa; identical to SEQ ID NO: 284030

SEQ ID NO: 482778 - RNA, 64 nt, hsa; identical to SEQ ID NO: 284031

SEQ ID NO: 482779 - RNA, 64 nt, hsa; identical to SEQ ID NO: 284032

SEQ ID NO: 482780 - RNA, 64 nt, hsa; identical to SEQ ID NO: 284033

SEQ ID NO: 482781 - RNA, 64 nt, hsa; identical to SEQ ID NO: 284034

SEQ ID NO: 482782 - RNA, 64 nt, hsa; identical to SEQ ID NO: 284035

SEQ ID NO: 482783 - RNA, 64 nt, hsa; identical to SEQ ID NO: 284036

SEQ ID NO: 482784 - RNA, 64 nt, hsa; identical to SEQ ID NO: 284037

SEQ ID NO: 482785 - RNA, 64 nt, hsa; identical to SEQ ID NO: 284038

SEQ ID NO: 482786 - RNA, 64 nt, hsa; identical to SEQ ID NO: 286991

SEQ ID NO: 482787 - RNA, 64 nt, hsa; identical to SEQ ID NO: 286992

SEQ ID NO: 482788 - RNA, 64 nt, hsa; identical to SEQ ID NO: 286993

SEQ ID NO: 482789 - RNA, 64 nt, hsa; identical to SEQ ID NO: 286994

SEQ ID NO: 482790 - RNA, 64 nt, hsa; identical to SEQ ID NO: 286995

SEQ ID NO: 482791 - RNA, 64 nt, hsa; identical to SEQ ID NO: 286996

SEQ ID NO: 482792 - RNA, 64 nt, hsa; identical to SEQ ID NO: 286997

SEQ ID NO: 482793 - RNA, 64 nt, hsa; identical to SEQ ID NO: 286998

SEQ ID NO: 482794 - RNA, 64 nt, hsa; identical to SEQ ID NO: 286999

SEQ ID NO: 482795 - RNA, 64 nt, hsa; identical to SEQ ID NO: 287000

SEQ ID NO: 482796 - RNA, 64 nt, hsa; identical to SEQ ID NO: 287001

SEQ ID NO: 482797 - RNA, 64 nt, hsa; identical to SEQ ID NO: 287002

SEQ ID NO: 482798 - RNA, 64 nt, hsa; identical to SEQ ID NO: 287003

SEQ ID NO: 482799 - RNA, 64 nt, hsa; identical to SEQ ID NO: 287004

SEQ ID NO: 482800 - RNA, 64 nt, hsa; identical to SEQ ID NO: 287005

SEQ ID NO: 482801 - RNA, 64 nt, hsa; identical to SEQ ID NO: 287006

SEQ ID NO: 482802 - RNA, 64 nt, hsa; identical to SEQ ID NO: 287007

SEQ ID NO: 482803 - RNA, 64 nt, hsa; identical to SEQ ID NO: 287008

SEQ ID NO: 482804 - RNA, 64 nt, hsa; identical to SEQ ID NO: 287009

SEQ ID NO: 482805 - RNA, 64 nt, hsa; identical to SEQ ID NO: 287010

SEQ ID NO: 482806 - RNA, 64 nt, hsa; identical to SEQ ID NO: 287011

SEQ ID NO: 482807 - RNA, 64 nt, hsa; identical to SEQ ID NO: 287012

SEQ ID NO: 482808 - RNA, 64 nt, hsa; identical to SEQ ID NO: 287013

SEQ ID NO: 482809 - RNA, 64 nt, hsa; identical to SEQ ID NO: 287014

SEQ ID NO: 482810 - RNA, 64 nt, hsa; identical to SEQ ID NO: 287015

SEQ ID NO: 482811 - RNA, 64 nt, hsa; identical to SEQ ID NO: 287016

SEQ ID NO: 482812 - RNA, 64 nt, hsa; identical to SEQ ID NO: 287017

SEQ ID NO: 482813 - RNA, 64 nt, hsa; identical to SEQ ID NO: 287018

SEQ ID NO: 482814 - RNA, 64 nt, hsa; identical to SEQ ID NO: 287019

SEQ ID NO: 482815 - RNA, 64 nt, hsa; identical to SEQ ID NO: 287020

SEQ ID NO: 482816 - RNA, 64 nt, hsa; identical to SEQ ID NO: 287021

SEQ ID NO: 482817 - RNA, 64 nt, hsa; identical to SEQ ID NO: 287022

SEQ ID NO: 482818 - RNA, 64 nt, hsa; identical to SEQ ID NO: 287023

SEQ ID NO: 482819 - RNA, 64 nt, hsa; identical to SEQ ID NO: 287024

SEQ ID NO: 482820 - RNA, 64 nt, hsa; identical to SEQ ID NO: 287025

SEQ ID NO: 482821 - RNA, 64 nt, hsa; identical to SEQ ID NO: 287026

SEQ ID NO: 482822 - RNA, 64 nt, hsa; identical to SEQ ID NO: 287027

SEQ ID NO: 482823 - RNA, 64 nt, hsa; identical to SEQ ID NO: 287028

SEQ ID NO: 482824 - RNA, 64 nt, hsa; identical to SEQ ID NO: 287029

SEQ ID NO: 482825 - RNA, 64 nt, hsa; identical to SEQ ID NO: 287030

SEQ ID NO: 482826 - RNA, 64 nt, hsa; identical to SEQ ID NO: 287031

SEQ ID NO: 482827 - RNA, 64 nt, hsa; identical to SEQ ID NO: 287032

SEQ ID NO: 482828 - RNA, 64 nt, hsa; identical to SEQ ID NO: 287033

SEQ ID NO: 482829 - RNA, 64 nt, hsa; identical to SEQ ID NO: 287034

SEQ ID NO: 482830 - RNA, 64 nt, hsa; identical to SEQ ID NO: 287035

SEQ ID NO: 482831 - RNA, 64 nt, hsa; identical to SEQ ID NO: 287036

SEQ ID NO: 482832 - RNA, 64 nt, hsa; identical to SEQ ID NO: 287037

SEQ ID NO: 482833 - RNA, 64 nt, hsa; identical to SEQ ID NO: 287038

SEQ ID NO: 482834 - RNA, 64 nt, hsa; identical to SEQ ID NO: 287039

SEQ ID NO: 482835 - RNA, 64 nt, hsa; identical to SEQ ID NO: 287040

SEQ ID NO: 482836 - RNA, 64 nt, hsa; identical to SEQ ID NO: 287041

SEQ ID NO: 482837 - RNA, 64 nt, hsa; identical to SEQ ID NO: 287042

SEQ ID NO: 482838 - RNA, 64 nt, hsa; identical to SEQ ID NO: 287043

SEQ ID NO: 482839 - RNA, 64 nt, hsa; identical to SEQ ID NO: 287044

SEQ ID NO: 482840 - RNA, 64 nt, hsa; identical to SEQ ID NO: 287045

SEQ ID NO: 482841 - RNA, 64 nt, hsa; identical to SEQ ID NO: 287046

SEQ ID NO: 482842 - RNA, 64 nt, hsa; identical to SEQ ID NO: 287047

SEQ ID NO: 482843 - RNA, 64 nt, hsa; identical to SEQ ID NO: 287048

SEQ ID NO: 482844 - RNA, 64 nt, hsa; identical to SEQ ID NO: 287049

SEQ ID NO: 482845 - RNA, 64 nt, hsa; identical to SEQ ID NO: 287050

SEQ ID NO: 482846 - RNA, 64 nt, hsa; identical to SEQ ID NO: 287051

SEQ ID NO: 482847 - RNA, 64 nt, hsa; identical to SEQ ID NO: 287052

SEQ ID NO: 482848 - RNA, 64 nt, hsa; identical to SEQ ID NO: 287053

SEQ ID NO: 482849 - RNA, 64 nt, hsa; identical to SEQ ID NO: 287054

SEQ ID NO: 482850 - RNA, 64 nt, hsa; identical to SEQ ID NO: 287055

SEQ ID NO: 482851 - RNA, 64 nt, hsa; identical to SEQ ID NO: 287056

SEQ ID NO: 482852 - RNA, 64 nt, hsa; identical to SEQ ID NO: 287057

SEQ ID NO: 482853 - RNA, 64 nt, hsa; identical to SEQ ID NO: 287058

SEQ ID NO: 482854 - RNA, 64 nt, hsa; identical to SEQ ID NO: 287059

SEQ ID NO: 482855 - RNA, 64 nt, hsa; identical to SEQ ID NO: 287060

SEQ ID NO: 482856 - RNA, 64 nt, hsa; identical to SEQ ID NO: 287061

SEQ ID NO: 482857 - RNA, 64 nt, hsa; identical to SEQ ID NO: 287062

SEQ ID NO: 482858 - RNA, 64 nt, hsa; identical to SEQ ID NO: 287063

SEQ ID NO: 482859 - RNA, 64 nt, hsa; identical to SEQ ID NO: 287064

SEQ ID NO: 482860 - RNA, 64 nt, hsa; identical to SEQ ID NO: 287065

SEQ ID NO: 482861 - RNA, 64 nt, hsa; identical to SEQ ID NO: 287066

SEQ ID NO: 482862 - RNA, 64 nt, hsa; identical to SEQ ID NO: 287067

SEQ ID NO: 482863 - RNA, 64 nt, hsa; identical to SEQ ID NO: 287068

SEQ ID NO: 482864 - RNA, 64 nt, hsa; identical to SEQ ID NO: 287069

SEQ ID NO: 482865 - RNA, 64 nt, hsa; identical to SEQ ID NO: 287070

SEQ ID NO: 482866 - RNA, 64 nt, hsa; identical to SEQ ID NO: 287071

SEQ ID NO: 482867 - RNA, 64 nt, hsa; identical to SEQ ID NO: 287072

SEQ ID NO: 482868 - RNA, 64 nt, hsa; identical to SEQ ID NO: 287073

SEQ ID NO: 482869 - RNA, 64 nt, hsa; identical to SEQ ID NO: 287074

SEQ ID NO: 482870 - RNA, 64 nt, hsa; identical to SEQ ID NO: 287075

SEQ ID NO: 482871 - RNA, 55 nt, hsa; identical to SEQ ID NO: 287076

SEQ ID NO: 482872 - RNA, 64 nt, hsa; identical to SEQ ID NO: 287077

SEQ ID NO: 482873 - RNA, 64 nt, hsa; identical to SEQ ID NO: 287078

SEQ ID NO: 482874 - RNA, 64 nt, hsa; identical to SEQ ID NO: 287079

SEQ ID NO: 482875 - RNA, 64 nt, hsa; identical to SEQ ID NO: 287080

SEQ ID NO: 482876 - RNA, 64 nt, hsa; identical to SEQ ID NO: 287081

SEQ ID NO: 482877 - RNA, 64 nt, hsa; identical to SEQ ID NO: 287082

SEQ ID NO: 482878 - RNA, 64 nt, hsa; identical to SEQ ID NO: 287083

SEQ ID NO: 482879 - RNA, 64 nt, hsa; identical to SEQ ID NO: 287084

SEQ ID NO: 482880 - RNA, 64 nt, hsa; identical to SEQ ID NO: 287085

SEQ ID NO: 482881 - RNA, 64 nt, hsa; identical to SEQ ID NO: 287086

SEQ ID NO: 482882 - RNA, 64 nt, hsa; identical to SEQ ID NO: 287087

SEQ ID NO: 482883 - RNA, 64 nt, hsa; identical to SEQ ID NO: 287088

SEQ ID NO: 482884 - RNA, 64 nt, hsa; identical to SEQ ID NO: 287089

SEQ ID NO: 482885 - RNA, 64 nt, hsa; identical to SEQ ID NO: 287090

SEQ ID NO: 482886 - RNA, 64 nt, hsa; identical to SEQ ID NO: 287091

SEQ ID NO: 482887 - RNA, 64 nt, hsa; identical to SEQ ID NO: 287092

SEQ ID NO: 482888 - RNA, 64 nt, hsa; identical to SEQ ID NO: 287093

SEQ ID NO: 482889 - RNA, 64 nt, hsa; identical to SEQ ID NO: 287094

SEQ ID NO: 482890 - RNA, 64 nt, hsa; identical to SEQ ID NO: 287095

SEQ ID NO: 482891 - RNA, 64 nt, hsa; identical to SEQ ID NO: 287096

SEQ ID NO: 482892 - RNA, 64 nt, hsa; identical to SEQ ID NO: 287097

SEQ ID NO: 482893 - RNA, 64 nt, hsa; identical to SEQ ID NO: 287098

SEQ ID NO: 482894 - RNA, 64 nt, hsa; identical to SEQ ID NO: 287099

SEQ ID NO: 482895 - RNA, 64 nt, hsa; identical to SEQ ID NO: 287100

SEQ ID NO: 482896 - RNA, 64 nt, hsa; identical to SEQ ID NO: 287101

SEQ ID NO: 482897 - RNA, 64 nt, hsa; identical to SEQ ID NO: 287102

SEQ ID NO: 482898 - RNA, 64 nt, hsa; identical to SEQ ID NO: 287103

SEQ ID NO: 482899 - RNA, 64 nt, hsa; identical to SEQ ID NO: 287104

SEQ ID NO: 482900 - RNA, 64 nt, hsa; identical to SEQ ID NO: 287105

SEQ ID NO: 482901 - RNA, 64 nt, hsa; identical to SEQ ID NO: 287106

SEQ ID NO: 482902 - RNA, 64 nt, hsa; identical to SEQ ID NO: 287107

SEQ ID NO: 482903 - RNA, 64 nt, hsa; identical to SEQ ID NO: 287108

SEQ ID NO: 482904 - RNA, 64 nt, hsa; identical to SEQ ID NO: 287109

SEQ ID NO: 482905 - RNA, 64 nt, hsa; identical to SEQ ID NO: 287110

SEQ ID NO: 482906 - RNA, 64 nt, hsa; identical to SEQ ID NO: 287111

SEQ ID NO: 482907 - RNA, 64 nt, hsa; identical to SEQ ID NO: 287112

SEQ ID NO: 482908 - RNA, 64 nt, hsa; identical to SEQ ID NO: 287113

SEQ ID NO: 482909 - RNA, 64 nt, hsa; identical to SEQ ID NO: 287114

SEQ ID NO: 482910 - RNA, 64 nt, hsa; identical to SEQ ID NO: 287115

SEQ ID NO: 482911 - RNA, 64 nt, hsa; identical to SEQ ID NO: 287116

SEQ ID NO: 482912 - RNA, 64 nt, hsa; identical to SEQ ID NO: 287117

SEQ ID NO: 482913 - RNA, 64 nt, hsa; identical to SEQ ID NO: 287118

SEQ ID NO: 482914 - RNA, 52 nt, hsa; identical to SEQ ID NO: 287119

SEQ ID NO: 482915 - RNA, 64 nt, hsa; identical to SEQ ID NO: 287120

SEQ ID NO: 482916 - RNA, 64 nt, hsa; identical to SEQ ID NO: 287121

SEQ ID NO: 482917 - RNA, 64 nt, hsa; identical to SEQ ID NO: 287122

SEQ ID NO: 482918 - RNA, 55 nt, hsa; identical to SEQ ID NO: 287123

SEQ ID NO: 482919 - RNA, 64 nt, hsa; identical to SEQ ID NO: 287124

SEQ ID NO: 482920 - RNA, 64 nt, hsa; identical to SEQ ID NO: 287125

SEQ ID NO: 482921 - RNA, 64 nt, hsa; identical to SEQ ID NO: 287126

SEQ ID NO: 482922 - RNA, 64 nt, hsa; identical to SEQ ID NO: 287127

SEQ ID NO: 482923 - RNA, 64 nt, hsa; identical to SEQ ID NO: 287128

SEQ ID NO: 482924 - RNA, 64 nt, hsa; identical to SEQ ID NO: 287129

SEQ ID NO: 482925 - RNA, 64 nt, hsa; identical to SEQ ID NO: 287130

SEQ ID NO: 482926 - RNA, 64 nt, hsa; identical to SEQ ID NO: 287131

SEQ ID NO: 482927 - RNA, 64 nt, hsa; identical to SEQ ID NO: 287132

SEQ ID NO: 482928 - RNA, 64 nt, hsa; identical to SEQ ID NO: 287133

SEQ ID NO: 482929 - RNA, 64 nt, hsa; identical to SEQ ID NO: 287134

SEQ ID NO: 482930 - RNA, 64 nt, hsa; identical to SEQ ID NO: 287135

SEQ ID NO: 482931 - RNA, 64 nt, hsa; identical to SEQ ID NO: 287136

SEQ ID NO: 482932 - RNA, 64 nt, hsa; identical to SEQ ID NO: 287137

SEQ ID NO: 482933 - RNA, 64 nt, hsa; identical to SEQ ID NO: 287138

SEQ ID NO: 482934 - RNA, 64 nt, hsa; identical to SEQ ID NO: 287139

SEQ ID NO: 482935 - RNA, 64 nt, hsa; identical to SEQ ID NO: 287140

SEQ ID NO: 482936 - RNA, 64 nt, hsa; identical to SEQ ID NO: 287141

SEQ ID NO: 482937 - RNA, 64 nt, hsa; identical to SEQ ID NO: 287142

SEQ ID NO: 482938 - RNA, 64 nt, hsa; identical to SEQ ID NO: 287143

SEQ ID NO: 482939 - RNA, 64 nt, hsa; identical to SEQ ID NO: 287144

SEQ ID NO: 482940 - RNA, 64 nt, hsa; identical to SEQ ID NO: 287145

SEQ ID NO: 482941 - RNA, 64 nt, hsa; identical to SEQ ID NO: 287146

SEQ ID NO: 482942 - RNA, 64 nt, hsa; identical to SEQ ID NO: 287147

SEQ ID NO: 482943 - RNA, 64 nt, hsa; identical to SEQ ID NO: 287148

SEQ ID NO: 482944 - RNA, 64 nt, hsa; identical to SEQ ID NO: 287149

SEQ ID NO: 482945 - RNA, 64 nt, hsa; identical to SEQ ID NO: 287150

SEQ ID NO: 482946 - RNA, 64 nt, hsa; identical to SEQ ID NO: 287151

SEQ ID NO: 482947 - RNA, 64 nt, hsa; identical to SEQ ID NO: 287152

SEQ ID NO: 482948 - RNA, 64 nt, hsa; identical to SEQ ID NO: 287153

SEQ ID NO: 482949 - RNA, 64 nt, hsa; identical to SEQ ID NO: 287154

SEQ ID NO: 482950 - RNA, 64 nt, hsa; identical to SEQ ID NO: 287155

SEQ ID NO: 482951 - RNA, 64 nt, hsa; identical to SEQ ID NO: 287156

SEQ ID NO: 482952 - RNA, 64 nt, hsa; identical to SEQ ID NO: 287157

SEQ ID NO: 482953 - RNA, 64 nt, hsa; identical to SEQ ID NO: 287158

SEQ ID NO: 482954 - RNA, 64 nt, hsa; identical to SEQ ID NO: 287159

SEQ ID NO: 482955 - RNA, 64 nt, hsa; identical to SEQ ID NO: 287160

SEQ ID NO: 482956 - RNA, 64 nt, hsa; identical to SEQ ID NO: 287161

SEQ ID NO: 482957 - RNA, 64 nt, hsa; identical to SEQ ID NO: 287162

SEQ ID NO: 482958 - RNA, 64 nt, hsa; identical to SEQ ID NO: 287163

SEQ ID NO: 482959 - RNA, 64 nt, hsa; identical to SEQ ID NO: 287164

SEQ ID NO: 482960 - RNA, 64 nt, hsa; identical to SEQ ID NO: 287165

SEQ ID NO: 482961 - RNA, 64 nt, hsa; identical to SEQ ID NO: 287166

SEQ ID NO: 482962 - RNA, 64 nt, hsa; identical to SEQ ID NO: 287167

SEQ ID NO: 482963 - RNA, 64 nt, hsa; identical to SEQ ID NO: 287168

SEQ ID NO: 482964 - RNA, 64 nt, hsa; identical to SEQ ID NO: 287169

SEQ ID NO: 482965 - RNA, 64 nt, hsa; identical to SEQ ID NO: 287170

SEQ ID NO: 482966 - RNA, 64 nt, hsa; identical to SEQ ID NO: 287171

SEQ ID NO: 482967 - RNA, 64 nt, hsa; identical to SEQ ID NO: 287172

SEQ ID NO: 482968 - RNA, 64 nt, hsa; identical to SEQ ID NO: 287173

SEQ ID NO: 482969 - RNA, 64 nt, hsa; identical to SEQ ID NO: 287174

SEQ ID NO: 482970 - RNA, 64 nt, hsa; identical to SEQ ID NO: 287175

SEQ ID NO: 482971 - RNA, 64 nt, hsa; identical to SEQ ID NO: 287176

SEQ ID NO: 482972 - RNA, 64 nt, hsa; identical to SEQ ID NO: 194853

SEQ ID NO: 482973 - RNA, 64 nt, hsa; identical to SEQ ID NO: 194854

SEQ ID NO: 482974 - RNA, 64 nt, hsa; identical to SEQ ID NO: 194855

SEQ ID NO: 482975 - RNA, 64 nt, hsa; identical to SEQ ID NO: 194856

SEQ ID NO: 482976 - RNA, 64 nt, hsa; identical to SEQ ID NO: 194857

SEQ ID NO: 482977 - RNA, 64 nt, hsa; identical to SEQ ID NO: 194858

SEQ ID NO: 482978 - RNA, 64 nt, hsa; identical to SEQ ID NO: 194859

SEQ ID NO: 482979 - RNA, 64 nt, hsa; identical to SEQ ID NO: 194860

SEQ ID NO: 482980 - RNA, 64 nt, hsa; identical to SEQ ID NO: 194861

SEQ ID NO: 482981 - RNA, 64 nt, hsa; identical to SEQ ID NO: 194862

SEQ ID NO: 482982 - RNA, 64 nt, hsa; identical to SEQ ID NO: 194863

SEQ ID NO: 482983 - RNA, 64 nt, hsa; identical to SEQ ID NO: 194864

SEQ ID NO: 482984 - RNA, 64 nt, hsa; identical to SEQ ID NO: 194865

SEQ ID NO: 482985 - RNA, 64 nt, hsa; identical to SEQ ID NO: 194866

SEQ ID NO: 482986 - RNA, 64 nt, hsa; identical to SEQ ID NO: 194867

SEQ ID NO: 482987 - RNA, 64 nt, hsa; identical to SEQ ID NO: 194868

SEQ ID NO: 482988 - RNA, 64 nt, hsa; identical to SEQ ID NO: 194869

SEQ ID NO: 482989 - RNA, 64 nt, hsa; identical to SEQ ID NO: 194870

SEQ ID NO: 482990 - RNA, 64 nt, hsa; identical to SEQ ID NO: 194871

SEQ ID NO: 482991 - RNA, 64 nt, hsa; identical to SEQ ID NO: 194872

SEQ ID NO: 482992 - RNA, 64 nt, hsa; identical to SEQ ID NO: 194873

SEQ ID NO: 482993 - RNA, 64 nt, hsa; identical to SEQ ID NO: 194874

SEQ ID NO: 482994 - RNA, 64 nt, hsa; identical to SEQ ID NO: 194875

SEQ ID NO: 482995 - RNA, 64 nt, hsa; identical to SEQ ID NO: 194876

SEQ ID NO: 482996 - RNA, 64 nt, hsa; identical to SEQ ID NO: 194877

SEQ ID NO: 482997 - RNA, 64 nt, hsa; identical to SEQ ID NO: 194878

SEQ ID NO: 482998 - RNA, 64 nt, hsa; identical to SEQ ID NO: 194879

SEQ ID NO: 482999 - RNA, 64 nt, hsa; identical to SEQ ID NO: 194880

SEQ ID NO: 483000 - RNA, 64 nt, hsa; identical to SEQ ID NO: 194881

SEQ ID NO: 483001 - RNA, 64 nt, hsa; identical to SEQ ID NO: 194882

SEQ ID NO: 483002 - RNA, 64 nt, hsa; identical to SEQ ID NO: 194883

SEQ ID NO: 483003 - RNA, 64 nt, hsa; identical to SEQ ID NO: 194884

SEQ ID NO: 483004 - RNA, 64 nt, hsa; identical to SEQ ID NO: 194885

SEQ ID NO: 483005 - RNA, 64 nt, hsa; identical to SEQ ID NO: 194886

SEQ ID NO: 483006 - RNA, 64 nt, hsa; identical to SEQ ID NO: 194887

SEQ ID NO: 483007 - RNA, 64 nt, hsa; identical to SEQ ID NO: 194888

SEQ ID NO: 483008 - RNA, 64 nt, hsa; identical to SEQ ID NO: 194889

SEQ ID NO: 483009 - RNA, 64 nt, hsa; identical to SEQ ID NO: 194890

SEQ ID NO: 483010 - RNA, 64 nt, hsa; identical to SEQ ID NO: 194891

SEQ ID NO: 483011 - RNA, 64 nt, hsa; identical to SEQ ID NO: 194892

SEQ ID NO: 483012 - RNA, 64 nt, hsa; identical to SEQ ID NO: 194893

SEQ ID NO: 483013 - RNA, 64 nt, hsa; identical to SEQ ID NO: 194894

SEQ ID NO: 483014 - RNA, 64 nt, hsa; identical to SEQ ID NO: 194895

SEQ ID NO: 483015 - RNA, 64 nt, hsa; identical to SEQ ID NO: 194896

SEQ ID NO: 483016 - RNA, 64 nt, hsa; identical to SEQ ID NO: 194897

SEQ ID NO: 483017 - RNA, 64 nt, hsa; identical to SEQ ID NO: 194898

SEQ ID NO: 483018 - RNA, 64 nt, hsa; identical to SEQ ID NO: 194899

SEQ ID NO: 483019 - RNA, 64 nt, hsa; identical to SEQ ID NO: 194900

SEQ ID NO: 483020 - RNA, 64 nt, hsa; identical to SEQ ID NO: 194901

SEQ ID NO: 483021 - RNA, 64 nt, hsa; identical to SEQ ID NO: 194902

SEQ ID NO: 483022 - RNA, 64 nt, hsa; identical to SEQ ID NO: 194903

SEQ ID NO: 483023 - RNA, 64 nt, hsa; identical to SEQ ID NO: 194904

SEQ ID NO: 483024 - RNA, 64 nt, hsa; identical to SEQ ID NO: 194905

SEQ ID NO: 483025 - RNA, 64 nt, hsa; identical to SEQ ID NO: 194906

SEQ ID NO: 483026 - RNA, 64 nt, hsa; identical to SEQ ID NO: 194907

SEQ ID NO: 483027 - RNA, 64 nt, hsa; identical to SEQ ID NO: 194908

SEQ ID NO: 483028 - RNA, 64 nt, hsa; identical to SEQ ID NO: 194909

SEQ ID NO: 483029 - RNA, 64 nt, hsa; identical to SEQ ID NO: 194910

SEQ ID NO: 483030 - RNA, 64 nt, hsa; identical to SEQ ID NO: 194911

SEQ ID NO: 483031 - RNA, 64 nt, hsa; identical to SEQ ID NO: 194912

SEQ ID NO: 483032 - RNA, 64 nt, hsa; identical to SEQ ID NO: 194913

SEQ ID NO: 483033 - RNA, 64 nt, hsa; identical to SEQ ID NO: 194914

SEQ ID NO: 483034 - RNA, 64 nt, hsa; identical to SEQ ID NO: 194915

SEQ ID NO: 483035 - RNA, 64 nt, hsa; identical to SEQ ID NO: 194916

SEQ ID NO: 483036 - RNA, 64 nt, hsa; identical to SEQ ID NO: 194917

SEQ ID NO: 483037 - RNA, 64 nt, hsa; identical to SEQ ID NO: 194918

SEQ ID NO: 483038 - RNA, 64 nt, hsa; identical to SEQ ID NO: 194919

SEQ ID NO: 483039 - RNA, 64 nt, hsa; identical to SEQ ID NO: 194920

SEQ ID NO: 483040 - RNA, 64 nt, hsa; identical to SEQ ID NO: 194921

SEQ ID NO: 483041 - RNA, 64 nt, hsa; identical to SEQ ID NO: 194922

SEQ ID NO: 483042 - RNA, 64 nt, hsa; identical to SEQ ID NO: 194923

SEQ ID NO: 483043 - RNA, 64 nt, hsa; identical to SEQ ID NO: 194924

SEQ ID NO: 483044 - RNA, 64 nt, hsa; identical to SEQ ID NO: 194925

SEQ ID NO: 483045 - RNA, 64 nt, hsa; identical to SEQ ID NO: 194926

SEQ ID NO: 483046 - RNA, 64 nt, hsa; identical to SEQ ID NO: 194927

SEQ ID NO: 483047 - RNA, 64 nt, hsa; identical to SEQ ID NO: 194928

SEQ ID NO: 483048 - RNA, 64 nt, hsa; identical to SEQ ID NO: 194929

SEQ ID NO: 483049 - RNA, 64 nt, hsa; identical to SEQ ID NO: 194930

SEQ ID NO: 483050 - RNA, 64 nt, hsa; identical to SEQ ID NO: 194931

SEQ ID NO: 483051 - RNA, 64 nt, hsa; identical to SEQ ID NO: 194932

SEQ ID NO: 483052 - RNA, 64 nt, hsa; identical to SEQ ID NO: 194933

SEQ ID NO: 483053 - RNA, 64 nt, hsa; identical to SEQ ID NO: 194934

SEQ ID NO: 483054 - RNA, 64 nt, hsa; identical to SEQ ID NO: 194935

SEQ ID NO: 483055 - RNA, 64 nt, hsa; identical to SEQ ID NO: 194936

SEQ ID NO: 483056 - RNA, 64 nt, hsa; identical to SEQ ID NO: 194937

SEQ ID NO: 483057 - RNA, 64 nt, hsa; identical to SEQ ID NO: 194938

SEQ ID NO: 483058 - RNA, 64 nt, hsa; identical to SEQ ID NO: 194939

SEQ ID NO: 483059 - RNA, 64 nt, hsa; identical to SEQ ID NO: 194940

SEQ ID NO: 483060 - RNA, 64 nt, hsa; identical to SEQ ID NO: 194941

SEQ ID NO: 483061 - RNA, 64 nt, hsa; identical to SEQ ID NO: 194942

SEQ ID NO: 483062 - RNA, 64 nt, hsa; identical to SEQ ID NO: 194943

SEQ ID NO: 483063 - RNA, 64 nt, hsa; identical to SEQ ID NO: 194944

SEQ ID NO: 483064 - RNA, 64 nt, hsa; identical to SEQ ID NO: 194945

SEQ ID NO: 483065 - RNA, 51 nt, hsa; identical to SEQ ID NO: 194946

SEQ ID NO: 483066 - RNA, 64 nt, hsa; identical to SEQ ID NO: 194947

SEQ ID NO: 483067 - RNA, 64 nt, hsa; identical to SEQ ID NO: 194948

SEQ ID NO: 483068 - RNA, 64 nt, hsa; identical to SEQ ID NO: 194949

SEQ ID NO: 483069 - RNA, 64 nt, hsa; identical to SEQ ID NO: 194950

SEQ ID NO: 483070 - RNA, 64 nt, hsa
guaggugugggguuccagaggacagcaggacacucucgcauacuuugccaaaugaggccugcuc

SEQ ID NO: 483071 - RNA, 64 nt, hsa
agcucaguauuuaaacaucaucucccuucucuuucucgcauaacuccccaccccuuucuccccg

SEQ ID NO: 483072 - RNA, 64 nt, hsa
cuguaauaguuaaauccuacagcauaaucaauaacucgcauaugaaguaaaaaggaauacugug

SEQ ID NO: 483073 - RNA, 64 nt, hsa
acuucugccuggagacuuagggcaccagggguuucucgcauaggaccuuuccaccacagccagc

SEQ ID NO: 483074 - RNA, 64 nt, hsa
gaagcuuuauggugauuauuuugagguuuucauucucgcauaaagcacaaugcugucuucauca

SEQ ID NO: 483075 - RNA, 64 nt, hsa
aacugaaacuguuugucuuccuuugguauauagucucgcauauuauauuauagcaggccaagau

SEQ ID NO: 483076 - RNA, 64 nt, hsa
ucacauccucucaccaugcguuagcaacgacuuucucgcauacuaacuagguuugacuguauua

SEQ ID NO: 483077 - RNA, 64 nt, hsa
cugccuuccugggccagcuuccugcuugcagucacucgcauagcacagagguggggcuucgggc

SEQ ID NO: 483078 - RNA, 64 nt, hsa
ccagcuggagguuucagggcuucuggaggaugcucucgcauagcucgagguccucugcccaccu

SEQ ID NO: 483079 - RNA, 64 nt, hsa
uacaagaguuccuauggacagaacuacauucuuucucgcauagugacuugugacaauuuagacu

SEQ ID NO: 483080 - RNA, 64 nt, hsa
ucugagcagcgaaagcucccuuccuaagaugcaucucgcauaggcugccuaugaugaaggaccg

SEQ ID NO: 483081 - RNA, 64 nt, hsa
cucugucagaaucaaagacuaagcuuaagaguuccucgcauauaucguugugcacaggaucaac

SEQ ID NO: 483082 - RNA, 64 nt, hsa
cugggcaaaucuuacuuggcaucaacuuggauggcucgcauaugacaggaaacuggauugccaa

SEQ ID NO: 483083 - RNA, 64 nt, hsa
ugcaguauucucuugcuaagaggaaggaaacugucucgcauaggagccuauauaaauauaaaca

SEQ ID NO: 483084 - RNA, 64 nt, hsa
ucaucuuauguaaguguuaauuaauauuaagggaaaugacuacaaacuuucaaagcaaaugcuc

SEQ ID NO: 483085 - RNA, 64 nt, hsa
aaauaugggaggacaaagaaucgcaaauucuucaaaugacuauuaucaguauuauuaacaugcg

SEQ ID NO: 483086 - RNA, 64 nt, hsa
aaguggcaacauuuuuauucuucagagucagguaaaugacuauaauaguuugguuucuaaugaa

SEQ ID NO: 483087 - RNA, 64 nt, hsa
cacaaagaacucacagucugauuaggaugaacuuaaugacuauuuacaccucaaaauauauuca

SEQ ID NO: 483088 - RNA, 64 nt, hsa
uucuuauaaagucaguuagaaggacuuccuuaacaaugacuauuauaaugucuuacuuaaaaua

SEQ ID NO: 483089 - RNA, 64 nt, hsa
caauagguaagaauaaacuguauuaaguagauguaaugacuagaaagcugcuuugcucccuaua

SEQ ID NO: 483090 - RNA, 64 nt, hsa
aggaacuaaaccuccaggucagcugcagcugcaaaaugacuacagccugaagggccauuuucag

SEQ ID NO: 483091 - RNA, 64 nt, hsa
cuguuuggaaguguaaugauuuuaucacauggugaaugacuacuaagaguaaugauuauaucac

SEQ ID NO: 483092 - RNA, 64 nt, hsa
ugacuacuaagaguaaugauuauaucacauugugaaugacuacuugccacaguaaaaauacaug

SEQ ID NO: 483093 - RNA, 64 nt, hsa
aguaaaggugaccaagucucuuucuuaaagucacaaugacuaaaguauuaguugaauuuuuuuu

SEQ ID NO: 483094 - RNA, 64 nt, hsa
accucuguaucuaaauguauaccauccacuuguaaaugacuauaaacuauuaugugauugcuuu

SEQ ID NO: 483095 - RNA, 64 nt, hsa
aaauaacuaggcguggacuuacuauuuauugcugaaugacuaccaacagugagagcccuucaug

SEQ ID NO: 483096 - RNA, 64 nt, hsa
agguugaccaauaaccaugcccaagaaugagaagaaugacuaugcaaccuuuggaugcacuuua

SEQ ID NO: 483097 - RNA, 64 nt, hsa
aaauaugcaccuaggagaaugugcuuuuuaaaauaaugacuacuguuuuuauuaaaacauaaga

SEQ ID NO: 483098 - RNA, 64 nt, hsa
accccuuuugaugaccccaggcuugaguuuuuaaaaugacuacccagaagggcacaagggggaa

SEQ ID NO: 483099 - RNA, 64 nt, hsa
gugggcuauacuguauuauuuugguaugcuuacaaaugacuaaccaaucaaauugucauuaaug

SEQ ID NO: 483100 - RNA, 64 nt, hsa; identical to SEQ ID NO: 50174

SEQ ID NO: 483101 - RNA, 64 nt, hsa; identical to SEQ ID NO: 50175

SEQ ID NO: 483102 - RNA, 64 nt, hsa; identical to SEQ ID NO: 50176

SEQ ID NO: 483103 - RNA, 64 nt, hsa; identical to SEQ ID NO: 50177

SEQ ID NO: 483104 - RNA, 64 nt, hsa; identical to SEQ ID NO: 50178

SEQ ID NO: 483105 - RNA, 64 nt, hsa; identical to SEQ ID NO: 50179

SEQ ID NO: 483106 - RNA, 64 nt, hsa; identical to SEQ ID NO: 50180

SEQ ID NO: 483107 - RNA, 64 nt, hsa; identical to SEQ ID NO: 50181

SEQ ID NO: 483108 - RNA, 64 nt, hsa; identical to SEQ ID NO: 50182

SEQ ID NO: 483109 - RNA, 64 nt, hsa; identical to SEQ ID NO: 50183

SEQ ID NO: 483110 - RNA, 64 nt, hsa; identical to SEQ ID NO: 50184

SEQ ID NO: 483111 - RNA, 64 nt, hsa; identical to SEQ ID NO: 50185

SEQ ID NO: 483112 - RNA, 64 nt, hsa; identical to SEQ ID NO: 50186

SEQ ID NO: 483113 - RNA, 64 nt, hsa; identical to SEQ ID NO: 50187

SEQ ID NO: 483114 - RNA, 64 nt, hsa; identical to SEQ ID NO: 50188

SEQ ID NO: 483115 - RNA, 64 nt, hsa; identical to SEQ ID NO: 50189

SEQ ID NO: 483116 - RNA, 64 nt, hsa; identical to SEQ ID NO: 50190

SEQ ID NO: 483117 - RNA, 64 nt, hsa; identical to SEQ ID NO: 50191

SEQ ID NO: 483118 - RNA, 64 nt, hsa; identical to SEQ ID NO: 50192

SEQ ID NO: 483119 - RNA, 64 nt, hsa; identical to SEQ ID NO: 50193

SEQ ID NO: 483120 - RNA, 64 nt, hsa; identical to SEQ ID NO: 50194

SEQ ID NO: 483121 - RNA, 64 nt, hsa; identical to SEQ ID NO: 50195

SEQ ID NO: 483122 - RNA, 64 nt, hsa; identical to SEQ ID NO: 50196

SEQ ID NO: 483123 - RNA, 64 nt, hsa; identical to SEQ ID NO: 50197

SEQ ID NO: 483124 - RNA, 64 nt, hsa; identical to SEQ ID NO: 50198

SEQ ID NO: 483125 - RNA, 64 nt, hsa; identical to SEQ ID NO: 50199

SEQ ID NO: 483126 - RNA, 64 nt, hsa; identical to SEQ ID NO: 50200

SEQ ID NO: 483127 - RNA, 64 nt, hsa; identical to SEQ ID NO: 50201

SEQ ID NO: 483128 - RNA, 64 nt, hsa; identical to SEQ ID NO: 50202

SEQ ID NO: 483129 - RNA, 64 nt, hsa; identical to SEQ ID NO: 50203

SEQ ID NO: 483130 - RNA, 64 nt, hsa; identical to SEQ ID NO: 50204

SEQ ID NO: 483131 - RNA, 64 nt, hsa; identical to SEQ ID NO: 50205

SEQ ID NO: 483132 - RNA, 64 nt, hsa; identical to SEQ ID NO: 50206

SEQ ID NO: 483133 - RNA, 64 nt, hsa; identical to SEQ ID NO: 50207

SEQ ID NO: 483134 - RNA, 64 nt, hsa; identical to SEQ ID NO: 50208

SEQ ID NO: 483135 - RNA, 64 nt, hsa; identical to SEQ ID NO: 50209

SEQ ID NO: 483136 - RNA, 64 nt, hsa; identical to SEQ ID NO: 50210

SEQ ID NO: 483137 - RNA, 64 nt, hsa; identical to SEQ ID NO: 50211

SEQ ID NO: 483138 - RNA, 64 nt, hsa; identical to SEQ ID NO: 50212

SEQ ID NO: 483139 - RNA, 64 nt, hsa; identical to SEQ ID NO: 50213

SEQ ID NO: 483140 - RNA, 64 nt, hsa; identical to SEQ ID NO: 50214

SEQ ID NO: 483141 - RNA, 64 nt, hsa; identical to SEQ ID NO: 50215

SEQ ID NO: 483142 - RNA, 64 nt, hsa; identical to SEQ ID NO: 50216

SEQ ID NO: 483143 - RNA, 64 nt, hsa; identical to SEQ ID NO: 50217

SEQ ID NO: 483144 - RNA, 64 nt, hsa; identical to SEQ ID NO: 50218

SEQ ID NO: 483145 - RNA, 64 nt, hsa; identical to SEQ ID NO: 50219

SEQ ID NO: 483146 - RNA, 64 nt, hsa; identical to SEQ ID NO: 50220

SEQ ID NO: 483147 - RNA, 64 nt, hsa; identical to SEQ ID NO: 50221

SEQ ID NO: 483148 - RNA, 64 nt, hsa; identical to SEQ ID NO: 50222

SEQ ID NO: 483149 - RNA, 64 nt, hsa; identical to SEQ ID NO: 50223

SEQ ID NO: 483150 - RNA, 64 nt, hsa; identical to SEQ ID NO: 50224

SEQ ID NO: 483151 - RNA, 64 nt, hsa; identical to SEQ ID NO: 50225

SEQ ID NO: 483152 - RNA, 64 nt, hsa; identical to SEQ ID NO: 50226

SEQ ID NO: 483153 - RNA, 64 nt, hsa; identical to SEQ ID NO: 50227

SEQ ID NO: 483154 - RNA, 64 nt, hsa; identical to SEQ ID NO: 50228

SEQ ID NO: 483155 - RNA, 64 nt, hsa; identical to SEQ ID NO: 50229

SEQ ID NO: 483156 - RNA, 64 nt, hsa; identical to SEQ ID NO: 50230

SEQ ID NO: 483157 - RNA, 64 nt, hsa; identical to SEQ ID NO: 50231

SEQ ID NO: 483158 - RNA, 64 nt, hsa; identical to SEQ ID NO: 50232

SEQ ID NO: 483159 - RNA, 64 nt, hsa; identical to SEQ ID NO: 50233

SEQ ID NO: 483160 - RNA, 64 nt, hsa; identical to SEQ ID NO: 50234

SEQ ID NO: 483161 - RNA, 64 nt, hsa; identical to SEQ ID NO: 50235

SEQ ID NO: 483162 - RNA, 64 nt, hsa; identical to SEQ ID NO: 50236

SEQ ID NO: 483163 - RNA, 64 nt, hsa; identical to SEQ ID NO: 50237

SEQ ID NO: 483164 - RNA, 64 nt, hsa; identical to SEQ ID NO: 50238

SEQ ID NO: 483165 - RNA, 64 nt, hsa; identical to SEQ ID NO: 50239

SEQ ID NO: 483166 - RNA, 64 nt, hsa; identical to SEQ ID NO: 50240

SEQ ID NO: 483167 - RNA, 64 nt, hsa; identical to SEQ ID NO: 50241

SEQ ID NO: 483168 - RNA, 64 nt, hsa; identical to SEQ ID NO: 50242

SEQ ID NO: 483169 - RNA, 64 nt, hsa; identical to SEQ ID NO: 50243

SEQ ID NO: 483170 - RNA, 64 nt, hsa
ccuguccauaucuggcuugcaugugccagaaagcagagaauagaaaauguaaucuccaacaucc

SEQ ID NO: 483171 - RNA, 64 nt, hsa
uuucccuuuuuccugggaguuuagcaaguuuaggagagaauagucaugaaaagaaagggaagaa

SEQ ID NO: 483172 - RNA, 64 nt, hsa
uuucucauaaaauucugucaauucacugaauaucagagaauacugacaucuucaaccuagcaca

SEQ ID NO: 483173 - RNA, 64 nt, hsa
ucuaagaaaugauauuuuucucaucuuaaaugagagagaauauucauaugaaaauacuugauuu

SEQ ID NO: 483174 - RNA, 64 nt, hsa
uggacaugagaccagugugaagacucacccuggaagagaauauucuccccaaacugcccuaccu

SEQ ID NO: 483175 - RNA, 64 nt, hsa
aggcuuuucucugucuuccaugucuugagaucucagagaauaauaauaaaaauguuacuuuaua

SEQ ID NO: 483176 - RNA, 64 nt, hsa
caggcauucugucauguugaacaauuuuaaauaaagagaauaucugguguuaggagcuuguuuu

SEQ ID NO: 483177 - RNA, 64 nt, hsa
gcucuuuccuaaaacauggcaaaugaauagauguagagaauaacaauauuacuuacaagaugaa

SEQ ID NO: 483178 - RNA, 64 nt, hsa
aaauguaugcuacucugaaaacaaagcuuauguuagagaauaucuuacuguaagaaacaaggaa

SEQ ID NO: 483179 - RNA, 64 nt, hsa
uuggaugcagugaaaagggcagaaauaccacagcagagaauaaaauugauaauguuggcaacac

SEQ ID NO: 483180 - RNA, 64 nt, hsa
uuuacuaagguaggguagcauuugcuauugguaaagagaauaaauacacuuaauuucacaauac

SEQ ID NO: 483181 - RNA, 64 nt, hsa
caugauuaacauaauccagguaugucauuucugaagagaauagucaucaaauuuauaucucgaa

SEQ ID NO: 483182 - RNA, 64 nt, hsa
gccucugggugucauguggaccagacuucugaauagagaauauuuauaacuuuuguaugagaga

SEQ ID NO: 483183 - RNA, 64 nt, hsa
cucuccucccggauggucauguuuuugucacauuagagaauaaacagccacacacacauuuuuu

SEQ ID NO: 483184 - RNA, 64 nt, hsa
aauuuuggccucucauaguuuucucucucuuuaaagagaauaaauagagggccagguguggugg

SEQ ID NO: 483185 - RNA, 64 nt, hsa
uuaaaaaaaaaaaaaaaaaaaaaaaaagagagagagagaauaaauagaaaagaauguggcuggg

SEQ ID NO: 483186 - RNA, 64 nt, hsa
uauucugcaguucucagcuuggugaggcuccaaaagagaauaugucagauguauuccuacuucc

SEQ ID NO: 483187 - RNA, 64 nt, hsa
cugacgguaaaguuaagauuaaauuaagacagagagagaauacauaucacugccaggccugaua

SEQ ID NO: 483188 - RNA, 64 nt, hsa
ccccuaacucacagcacaaacccugcaaacccaaagagaauauuaauacuugaagcaagaaggg

SEQ ID NO: 483189 - RNA, 64 nt, hsa
cccgagggucagugccccagugaagacagaagcgagagaauaaaguucccuguagguccucugu

SEQ ID NO: 483190 - RNA, 64 nt, hsa
agcuuagcuuguuuucuggugcuguugaccugcaagagaauauacuuuugcauauacaggugaa

SEQ ID NO: 483191 - RNA, 64 nt, hsa
ugagauauagcaggagaccaaaacauguuuggaaagagaauaaauauaugaagagagacugguu

SEQ ID NO: 483192 - RNA, 64 nt, hsa
uugggucaagaagugaucuuuagcuaauaaagaaagagaauagaaaacacgcaugagauauuca

SEQ ID NO: 483193 - RNA, 64 nt, hsa
uauaagccaaagcuauauguuguaacuuuuuuuuagagaauagcuuuaucuugguuuaacucuu

SEQ ID NO: 483194 - RNA, 64 nt, hsa
auggugccgcuggggacuuuuuagagaaauguaaagagaauagcuauucagugucuacuagcag

SEQ ID NO: 483195 - RNA, 64 nt, hsa
cugcuacuguaaacaugaauauugaauacugacaagagaauacccauacaaaucgucccaccgc

SEQ ID NO: 483196 - RNA, 64 nt, hsa
auaagggaaaaauaugagaaaaauaaaaauaaaaagagaauaauaggccaggcacuguggcuca

SEQ ID NO: 483197 - RNA, 64 nt, hsa
aacaagagcgagacuccguuuccaaaaaaauaagagagaauagaagaagcuacugcaugauguu

SEQ ID NO: 483198 - RNA, 64 nt, hsa
cauuuacuucaacucuaccuuaguagauacaaguagagaauauggagaggaucauuacauugaa

SEQ ID NO: 483199 - RNA, 64 nt, hsa
uuuaauuuagguguuuuggguuuuuuuccuuuaaagagaauaguguucacaaaauuugagcugc

SEQ ID NO: 483200 - RNA, 64 nt, hsa
uaaaauuuuauuugacuuauagagaauagcauauagagaauaaucauguugacuuugugaaugu

SEQ ID NO: 483201 - RNA, 64 nt, hsa
aaaaacauuaccacuaaaauuuuauuugacuuauagagaauagcauauagagaauaaucauguu

SEQ ID NO: 483202 - RNA, 64 nt, hsa
gccucuucuugucuuucauaggugaaaaagcaccagagaauacauacaugaagggacaaaucuu

SEQ ID NO: 483203 - RNA, 64 nt, hsa; identical to SEQ ID NO: 218133

SEQ ID NO: 483204 - RNA, 64 nt, hsa; identical to SEQ ID NO: 218134

SEQ ID NO: 483205 - RNA, 64 nt, hsa; identical to SEQ ID NO: 218135

SEQ ID NO: 483206 - RNA, 64 nt, hsa; identical to SEQ ID NO: 218136

SEQ ID NO: 483207 - RNA, 64 nt, hsa; identical to SEQ ID NO: 218137

SEQ ID NO: 483208 - RNA, 64 nt, hsa; identical to SEQ ID NO: 218138

SEQ ID NO: 483209 - RNA, 64 nt, hsa; identical to SEQ ID NO: 218139

SEQ ID NO: 483210 - RNA, 64 nt, hsa; identical to SEQ ID NO: 218140

SEQ ID NO: 483211 - RNA, 64 nt, hsa; identical to SEQ ID NO: 218141

SEQ ID NO: 483212 - RNA, 64 nt, hsa; identical to SEQ ID NO: 218142

SEQ ID NO: 483213 - RNA, 64 nt, hsa; identical to SEQ ID NO: 218143

SEQ ID NO: 483214 - RNA, 64 nt, hsa; identical to SEQ ID NO: 218144

SEQ ID NO: 483215 - RNA, 64 nt, hsa; identical to SEQ ID NO: 218145

SEQ ID NO: 483216 - RNA, 64 nt, hsa; identical to SEQ ID NO: 218146

SEQ ID NO: 483217 - RNA, 64 nt, hsa; identical to SEQ ID NO: 218147

SEQ ID NO: 483218 - RNA, 64 nt, hsa; identical to SEQ ID NO: 218148

SEQ ID NO: 483219 - RNA, 64 nt, hsa; identical to SEQ ID NO: 218149

SEQ ID NO: 483220 - RNA, 64 nt, hsa; identical to SEQ ID NO: 218150

SEQ ID NO: 483221 - RNA, 64 nt, hsa; identical to SEQ ID NO: 218151

SEQ ID NO: 483222 - RNA, 64 nt, hsa; identical to SEQ ID NO: 218152

SEQ ID NO: 483223 - RNA, 64 nt, hsa; identical to SEQ ID NO: 218153

SEQ ID NO: 483224 - RNA, 64 nt, hsa; identical to SEQ ID NO: 218154

SEQ ID NO: 483225 - RNA, 64 nt, hsa; identical to SEQ ID NO: 218155

SEQ ID NO: 483226 - RNA, 64 nt, hsa; identical to SEQ ID NO: 218156

SEQ ID NO: 483227 - RNA, 64 nt, hsa; identical to SEQ ID NO: 218157

SEQ ID NO: 483228 - RNA, 64 nt, hsa; identical to SEQ ID NO: 218158

SEQ ID NO: 483229 - RNA, 64 nt, hsa; identical to SEQ ID NO: 218159

SEQ ID NO: 483230 - RNA, 64 nt, hsa; identical to SEQ ID NO: 218160

SEQ ID NO: 483231 - RNA, 64 nt, hsa; identical to SEQ ID NO: 218161

SEQ ID NO: 483232 - RNA, 64 nt, hsa; identical to SEQ ID NO: 218162

SEQ ID NO: 483233 - RNA, 64 nt, hsa; identical to SEQ ID NO: 218163

SEQ ID NO: 483234 - RNA, 64 nt, hsa; identical to SEQ ID NO: 218164

SEQ ID NO: 483235 - RNA, 64 nt, hsa; identical to SEQ ID NO: 218165

SEQ ID NO: 483236 - RNA, 64 nt, hsa; identical to SEQ ID NO: 218166

SEQ ID NO: 483237 - RNA, 64 nt, hsa; identical to SEQ ID NO: 218167

SEQ ID NO: 483238 - RNA, 64 nt, hsa; identical to SEQ ID NO: 218168

SEQ ID NO: 483239 - RNA, 64 nt, hsa; identical to SEQ ID NO: 360611

SEQ ID NO: 483240 - RNA, 64 nt, hsa; identical to SEQ ID NO: 360612

SEQ ID NO: 483241 - RNA, 64 nt, hsa; identical to SEQ ID NO: 360613

SEQ ID NO: 483242 - RNA, 64 nt, hsa; identical to SEQ ID NO: 360614

SEQ ID NO: 483243 - RNA, 64 nt, hsa; identical to SEQ ID NO: 360615

SEQ ID NO: 483244 - RNA, 64 nt, hsa; identical to SEQ ID NO: 360616

SEQ ID NO: 483245 - RNA, 64 nt, hsa; identical to SEQ ID NO: 360617

SEQ ID NO: 483246 - RNA, 64 nt, hsa; identical to SEQ ID NO: 360618

SEQ ID NO: 483247 - RNA, 64 nt, hsa; identical to SEQ ID NO: 360619

SEQ ID NO: 483248 - RNA, 64 nt, hsa; identical to SEQ ID NO: 360620

SEQ ID NO: 483249 - RNA, 64 nt, hsa; identical to SEQ ID NO: 360621

SEQ ID NO: 483250 - RNA, 64 nt, hsa; identical to SEQ ID NO: 360622

SEQ ID NO: 483251 - RNA, 64 nt, hsa; identical to SEQ ID NO: 360623

SEQ ID NO: 483252 - RNA, 64 nt, hsa; identical to SEQ ID NO: 360624

SEQ ID NO: 483253 - RNA, 64 nt, hsa; identical to SEQ ID NO: 360625

SEQ ID NO: 483254 - RNA, 64 nt, hsa; identical to SEQ ID NO: 360626

SEQ ID NO: 483255 - RNA, 64 nt, hsa; identical to SEQ ID NO: 360627

SEQ ID NO: 483256 - RNA, 64 nt, hsa; identical to SEQ ID NO: 360628

SEQ ID NO: 483257 - RNA, 64 nt, hsa; identical to SEQ ID NO: 360629

SEQ ID NO: 483258 - RNA, 64 nt, hsa; identical to SEQ ID NO: 360630

SEQ ID NO: 483259 - RNA, 64 nt, hsa; identical to SEQ ID NO: 360631

SEQ ID NO: 483260 - RNA, 64 nt, hsa; identical to SEQ ID NO: 360632

SEQ ID NO: 483261 - RNA, 64 nt, hsa; identical to SEQ ID NO: 360633

SEQ ID NO: 483262 - RNA, 64 nt, hsa; identical to SEQ ID NO: 360634

SEQ ID NO: 483263 - RNA, 64 nt, hsa; identical to SEQ ID NO: 360635

SEQ ID NO: 483264 - RNA, 64 nt, hsa; identical to SEQ ID NO: 360636

SEQ ID NO: 483265 - RNA, 64 nt, hsa; identical to SEQ ID NO: 360637

SEQ ID NO: 483266 - RNA, 64 nt, hsa; identical to SEQ ID NO: 360638

SEQ ID NO: 483267 - RNA, 64 nt, hsa
uuuuugguuaaacagcagcacuuuuuaguucccuaaacuuuagaagaaaugcuaucagaaauag

SEQ ID NO: 483268 - RNA, 64 nt, hsa
ggauuauugcuuagauaacucuuguuuucugguaaaacuuuaguuguauugccauccacuccuu

SEQ ID NO: 483269 - RNA, 64 nt, hsa
ugaauaguuguuucguuacauuuagaugaaaguuaaacuuuacugaauuucaguacauuaguuu

SEQ ID NO: 483270 - RNA, 64 nt, hsa
uuuacugaauuucaguacauuaguuuuuacacuaaaacuuuacaagauaaaauuggacuucauu

SEQ ID NO: 483271 - RNA, 64 nt, hsa
ccucuaaguuguagccuguaauuaugagaacaguaaacuuuaaguaauaauaaagaaucccauc

SEQ ID NO: 483272 - RNA, 64 nt, hsa
uccauuacacaauuagacuccuacaguuuaaaacaaacuuuaaaccacuaucuugcacugcuaa

SEQ ID NO: 483273 - RNA, 64 nt, hsa
aagagauaaaauauuguaccauuaaacuuuaauaaaacuuuaaaaggaaaugugcugugauggc

SEQ ID NO: 483274 - RNA, 64 nt, hsa
auuaacaaaaaaagagauaaaauauuguaccauuaaacuuuaauaaaacuuuaaaaggaaaugu

SEQ ID NO: 483275 - RNA, 64 nt, hsa
ggacucagggagcaaccacaggcucuccacuuugaaacuuuaguuugaauuuuaaaagauagga

SEQ ID NO: 483276 - RNA, 64 nt, hsa
uuucaucauagaaaacauguuuaagauaaaauacaaacuuuaccuaccccaaauucauaaagua

SEQ ID NO: 483277 - RNA, 64 nt, hsa
aaauguuuauauuagauaaccauauucacaauggaaacuuuaggucuaguuucuuuugauagua

SEQ ID NO: 483278 - RNA, 64 nt, hsa
caaggaaauacauaugcagauacuuauuaagagcaaacuuuagugucucuaaguuaugacugug

SEQ ID NO: 483279 - RNA, 64 nt, hsa
aacaggguagcuccugagccuuucccuuuauuggaaacuuuaacugcaguguuaauauauacac

SEQ ID NO: 483280 - RNA, 64 nt, hsa
agucagaaugguuggaauuuuggcuuucuaagaaaaacuuuauuuugcauaagcauguggucag

SEQ ID NO: 483281 - RNA, 64 nt, hsa
gaauugcuugaagaguucaucacggaaauucaagaaacuuuacuucaaaauauucacaaggcua

SEQ ID NO: 483282 - RNA, 64 nt, hsa
uauuguauagagcuauucaugccauuuuuugggaaaacuuuaaaaauugccccaaauacugaca

SEQ ID NO: 483283 - RNA, 64 nt, hsa
uuuuuuuuuuuuugguuuuaaaagcacaaucacuaaacuuuauuuguaaaccauuguaacuauu

SEQ ID NO: 483284 - RNA, 64 nt, hsa
cguuuuuauuccucuuauugggauaucauuuuaaaaacuuuauuggguuuuuauuguuguuguu

SEQ ID NO: 483285 - RNA, 64 nt, hsa
acucuuucuaaauaagagguuuuaaaauauauaaaaacuuuaugauccaauuauagauaaauuu

SEQ ID NO: 483286 - RNA, 64 nt, hsa
guuacuugaaugucacaaaauuaugccuucaucaaaacuuuaaaggaaaaaucaauuuauaaaa

SEQ ID NO: 483287 - RNA, 64 nt, hsa
auauuuaaaaaucugaauuuuuuagaagaaugcaaaacuuuaguaaacccuaaguaaagucaaa

SEQ ID NO: 483288 - RNA, 64 nt, hsa
uuaauuauuuagauauuuaauuucgcagauuuuuaaacuuuauuuucauaauuucugcuuaaug

SEQ ID NO: 483289 - RNA, 64 nt, hsa
ugcacucugcuggaugaaauggcaguggauuuuuaaacuuuaauuucccaaaugucucucucag

SEQ ID NO: 483290 - RNA, 64 nt, hsa
uaauugcuaagauuuaaggacguucuuuauuaugaaacuuuaucacauucgaaauguuuguuua

SEQ ID NO: 483291 - RNA, 64 nt, hsa
gccauuuuuuuuaaugguacuuaguauuuugaucaaacuuuagucuccagaacuaaacaagucc

SEQ ID NO: 483292 - RNA, 64 nt, hsa
auacuguugguuucuguaaauguugcaggguuuuaaacuuuauaauuacuuuaauauuuuugau

SEQ ID NO: 483293 - RNA, 64 nt, hsa
ugacaauagcugcuuaguuuccuguuaagagaagaaacuuuaucuuuuaauuaugugcucuuaa

SEQ ID NO: 483294 - RNA, 64 nt, hsa
ccuuacuuuguuuuacuugccauuuauuguaaggaaacuuuaaagcauuuuuuaggaaauacuc

SEQ ID NO: 483295 - RNA, 64 nt, hsa
uuacaacugcuauauagacauuuuguuucaaaugaaacuuuaaaagacugaaaaauuuuguaaa

SEQ ID NO: 483296 - RNA, 64 nt, hsa
cagaaguauauuuuagaaucccugccuguuaaggaaacuuuauuugugguagguacaguucugg

SEQ ID NO: 483297 - RNA, 64 nt, hsa
aguuucagaagcauagauuguaguguaccuuuuuaaacuuuauuuuuuuaaaaaaaguuguuuu

SEQ ID NO: 483298 - RNA, 64 nt, hsa
uauucauacuacuguucaaucuuuauuuagaaauaaacuuuaucuaugauuucauuuucuuaua

SEQ ID NO: 483299 - RNA, 64 nt, hsa
ggaucacaaaaugugauaaaacuuuaaauguauaaaacuuuaucaaauaaaguuuuauuuuccc

SEQ ID NO: 483300 - RNA, 64 nt, hsa
ucugauaauuggcacuggaucacaaaaugugauaaaacuuuaaauguauaaaacuuuaucaaau

SEQ ID NO: 483301 - RNA, 64 nt, hsa
ucagcacaacaaggaacaaaacaaagcuuugaaaaaacuuuaacaugaaaaaacgcacugacau

SEQ ID NO: 483302 - RNA, 64 nt, hsa
ggauuauguauauuuuuauaucucugugguuuugaaacuuuaguacuuagaauuuuggccuucu

SEQ ID NO: 483303 - RNA, 64 nt, hsa
accucuaaggagaccuuugaagcuuuuugagggcaaacuuuaccuuugugguccccaaaugaug

SEQ ID NO: 483304 - RNA, 64 nt, hsa
auuucacauuauucugggcaccacaaaauauacaaaacuuuaucagggaaacuaagauucuuuu

SEQ ID NO: 483305 - RNA, 64 nt, hsa
aauaaaaagacaaccacauaguucguuuaccuucaaacuuuagguuuuuuuaaugauauacuga

SEQ ID NO: 483306 - RNA, 64 nt, hsa
caaaauaucucugaguucuguguauuuucagucaaaacuuuaaaccuguagaaucaauuuaagu

SEQ ID NO: 483307 - RNA, 64 nt, hsa
ucaauacaccaaggaaacuggauccagaauuccuaaacuuuaaaaugguacugucugcggagug

SEQ ID NO: 483308 - RNA, 64 nt, hsa
uaaauuaggauuucuuaaagaaaacauagggagaaaacuuuacaugcaauuaaaaauggacuuu

SEQ ID NO: 483309 - RNA, 64 nt, hsa
cuuauuuuuaaucaaauaacuagacauauaucagaaacuuuaaaauguaaaaguuguacacuuu

SEQ ID NO: 483310 - RNA, 64 nt, hsa
aggagaaaagcaauccuccugauuguauuguuuuaaacuuuaagaauuuaucaaaaugccggua

SEQ ID NO: 483311 - RNA, 64 nt, hsa
auuauuaccaagaaaauauugaguuuaccugauuaaacuuuaaaaguuaauuguagauuuaaau

SEQ ID NO: 483312 - RNA, 64 nt, hsa
ucuuuccucuuuaggcgugguugagaaaaagcagaaacuuuacauaaagcuguauuucuuaauc

SEQ ID NO: 483313 - RNA, 64 nt, hsa
caaacuuuacuaaacauaagaaaauuaauacuggaaacuuuacaaaccugaaagaugugacaau

SEQ ID NO: 483314 - RNA, 64 nt, hsa
gugaagaauguggcaaugcuuguaacuaaaucucaaacuuuacuaaacauaagaaaauuaauac

SEQ ID NO: 483315 - RNA, 64 nt, hsa
aaaugcuacauuacuugguguccuuuuuucucccaaacuuuauuuagaaauggaaggaguucaa

SEQ ID NO: 483316 - RNA, 64 nt, hsa
guauuuuuaccacaauaaacaaaaaacccuaaaaaaacuuuaaugaaagguggaaaauaauuua

SEQ ID NO: 483317 - RNA, 64 nt, hsa
gaucaauauuuugaauaugugaaaggauuaauuuaaacuuuacaauuuacaucaauauuuugaa

SEQ ID NO: 483318 - RNA, 64 nt, hsa
aauauauuaguacauucuagaauguaaaaggauuaaacuuuacaauuuagaucaauauuuugaa

SEQ ID NO: 483319 - RNA, 64 nt, hsa
accccaagauuucagauauucugcucuauuauauaaacuuuauauuuuuauauuugugaucuac

SEQ ID NO: 483320 - RNA, 64 nt, hsa
gggagaugguaagaaacaaugaaugucuuuuuucaaacuuuauugacaagugauuuucaagucu

SEQ ID NO: 483321 - RNA, 64 nt, hsa
uuccacaugcauuuuauuucccagugaguuguauaaacuuuauuuuuguugaagguuguauguu

SEQ ID NO: 483322 - RNA, 64 nt, hsa
accacgaccacauggaaacauauuuuuggaagcaaaacuuuaauuuuauauaacguaugcuaug

SEQ ID NO: 483323 - RNA, 64 nt, hsa
uaaauguuaucagccagucuuccaaaauggucauaaacuuuauaaacugcuuuggguaaacuga

SEQ ID NO: 483324 - RNA, 64 nt, hsa
auugcuuaaauauuacauauuagggauuguaagaaaacuuuaauuaaaaauuaaagacuauaua

SEQ ID NO: 483325 - RNA, 64 nt, hsa
augaacaugaggaugggaucaaugugggaugaauaaacuuuaguucagaaacaggacuuacuaa

SEQ ID NO: 483326 - RNA, 64 nt, hsa
ucugcuguguuaacuuugugaaacuggauggaacaaacuuuaacuuaccaagcaccaaguguga

SEQ ID NO: 483327 - RNA, 64 nt, hsa
cuguggggauccaggauuuguaauuucuugaucuaaacuuuaugcugcauaaaucacuuaucgg

SEQ ID NO: 483328 - RNA, 64 nt, hsa
uaauagcauuaaaauugcagaucagcucacucugaaacuuuaaggguaccagauauuuucuaua

SEQ ID NO: 483329 - RNA, 64 nt, hsa
ucauagaaaggagcaaccaaaaugucacaacccaaaacuuuacaagcuuugcuucagaauuaga

SEQ ID NO: 483330 - RNA, 64 nt, hsa
aguguguaccuuuuaaaauuauucccucucaacaaaacuuuauaggcagucuucugcagacuua

SEQ ID NO: 483331 - RNA, 64 nt, hsa
ucuaauaaaaagucacaaaguuaucuucuuuaacaaacuuuacucuuauucuuagcuguauaua

SEQ ID NO: 483332 - RNA, 64 nt, hsa
uguaaauagguggaauaugaaugcuuggaaaauuaaacuuuaauuuauugacauuguacauagc

SEQ ID NO: 483333 - RNA, 64 nt, hsa
aacacauuaacaugauucuguuugugcagauuaaaaacuuuauagggacuugcauuaucgguuc

SEQ ID NO: 483334 - RNA, 64 nt, hsa
ucuggauaccuuuuucuuauacuuucuccuaggaaaacuuuaaaacuuuaaaaaggcaaaccua

SEQ ID NO: 483335 - RNA, 64 nt, hsa
ccuuuuucuuauacuuucuccuaggaaaacuuuaaaacuuuaaaaaggcaaaccuaccaauagg

SEQ ID NO: 483336 - RNA, 64 nt, hsa
aaauguaaacuuaaaaauguuuagaucuuguuucaaacuuuacaauagcauucuucaaaauauu

SEQ ID NO: 483337 - RNA, 64 nt, hsa
gccaaauaggacuuuccacucaugcucaagaucaaaacuuuauagaacagucaacauuuuagau

SEQ ID NO: 483338 - RNA, 64 nt, hsa
uugaaguuugagaucugaugagaaugguuguuauaaacuuuauuuuaaaaccaaauuuaggugu

SEQ ID NO: 483339 - RNA, 64 nt, hsa
cacuuuuguucuugguuuguaaauuaacuuuuauaaacuuuaccuuuuuuauacauaaacaaga

SEQ ID NO: 483340 - RNA, 64 nt, hsa
uuugaggucuguucuuuccaaaguacacuguuucaaacuuuacuauggcccuggccuagcauac

SEQ ID NO: 483341 - RNA, 64 nt, hsa
caucaucauucauguuuuuuaaggccuggucauaaaacuuuaaauuuuacuaguguuacuuaau

SEQ ID NO: 483342 - RNA, 64 nt, hsa
ccuuucuccauccuugaucagagauaaacuauuaaaacuuuaaaaaauacucaaaaauauguaa

SEQ ID NO: 483343 - RNA, 64 nt, hsa
ugaagcuugcuuggaaggggaaaacuuuaaauaaaaacuuuauguacuaauucaacugucucuc

SEQ ID NO: 483344 - RNA, 64 nt, hsa
uagaauguguaaaugaagcuugcuuggaaggggaaaacuuuaaauaaaaacuuuauguacuaau

SEQ ID NO: 483345 - RNA, 64 nt, hsa
aucauaaaugaaugaucauggcuauguuuuaauaaaacuuuauggacacugagcuugaacuuca

SEQ ID NO: 483346 - RNA, 64 nt, hsa
aucauaaaugaaugaucauggcuauguuuuaauaaaacuuuacagacacugaacuugaacuucc

SEQ ID NO: 483347 - RNA, 64 nt, hsa
ccuugcacgucaucauagaauucauacugcagagaaacuuuacaaauaggaagaaugugacaaa

SEQ ID NO: 483348 - RNA, 64 nt, hsa
ccuuguaagucacaaagccauucauacuggagagaaacuuuacaaguguaaugaauguggcaag

SEQ ID NO: 483349 - RNA, 64 nt, hsa
uguguuuuaauuauuuucacauuuucucucugcaaaacuuuaguuuucugaugaucuacacaca

SEQ ID NO: 483350 - RNA, 64 nt, hsa
ucuuauaugcuacgugcauacacauucuuuucuuaaacuuuaccuguguuuuaacuaauauugu

SEQ ID NO: 483351 - RNA, 64 nt, hsa
ggucugucauuuuugaauacuguaaaacugugauaaacuuuauauugaagcuguauuuuaauau

SEQ ID NO: 483352 - RNA, 64 nt, hsa
cuucaguuuaaaaaaggaaaaggacuuuuuuuuuaaacuuuaagagcuaaauauucuaaacugg

SEQ ID NO: 483353 - RNA, 64 nt, hsa
ugggccuaauuuuuuaaagaauccaagacaaacuaaacuuuacuggguauauaaccuucucaau

SEQ ID NO: 483354 - RNA, 64 nt, hsa
aauuuucauucggaauccgaaggauacagucuuuaaacuuuagaauucccaagaaggcuuuauu

SEQ ID NO: 483355 - RNA, 64 nt, hsa; identical to SEQ ID NO: 483353

SEQ ID NO: 483356 - RNA, 64 nt, hsa; identical to SEQ ID NO: 483354

SEQ ID NO: 483357 - RNA, 64 nt, hsa
aaagcuugaaaguaaguugcuuccaugagcauggauuacccaguagcuacuuuuuaauagagac

SEQ ID NO: 483358 - RNA, 64 nt, hsa
ggguaauuuuucacagccaccuauguacauacuaauuacccauuggauacuuauaucuaaaagu

SEQ ID NO: 483359 - RNA, 64 nt, hsa
agacagaaccccuacuuccaagugcucuauuuguauuacccagaugacugaagcuuaagagaag

SEQ ID NO: 483360 - RNA, 64 nt, hsa
gucauggaucuuagagcuaaaaaggacuguaaaaauuacccagaacagcguccucagacuuaac

SEQ ID NO: 483361 - RNA, 64 nt, hsa
caccucucuugaaccccaaaugcucucucuucuuauuacccaaacccauggcucuauuucuucu

SEQ ID NO: 483362 - RNA, 64 nt, hsa
auggugacaccccgucucuacuaaaaauacaaaaauuacccaggcauaguggcacacgccugua

SEQ ID NO: 483363 - RNA, 64 nt, hsa
caagugaacuaaacuauaagcuggaucuaaagaaauuacccagugagcagugaggagaaacaag

SEQ ID NO: 483364 - RNA, 64 nt, hsa
agugguaacagauggguagaggcagcucaggugaauuacccagcuugccucucaauucauuccu

SEQ ID NO: 483365 - RNA, 64 nt, hsa
gaagguaacugauaaaccaaaauugagcauaguaauuacccacagaaggaggaaguggaaggga

SEQ ID NO: 483366 - RNA, 64 nt, hsa
uuuuacuuacagguguucugcuggugacgguagcauuacccaaauaaacugugcauaugaaaug

SEQ ID NO: 483367 - RNA, 64 nt, hsa
auugccugcuccucagagucucuccuauuuuuguauuacccagcuuucuuuuuaauacaaaugu

SEQ ID NO: 483368 - RNA, 64 nt, hsa
uaauugcaacaccagucuguuuuuaacagguucuauuacccagaacuuuuuuguaaaugcggca

SEQ ID NO: 483369 - RNA, 64 nt, hsa
ggaacugugagucgaaaauuaaaccucuuuuauaauuacccagucucggguauuucuucauagc

SEQ ID NO: 483370 - RNA, 64 nt, hsa
gcaguugcuaaauaaaucuccccacuccagaagcauuacccauaggucuuaagaugcaaaucaa

SEQ ID NO: 483371 - RNA, 64 nt, hsa
uuuucugacuuacccuuuuggaaucuccuccauuauuacccaggcuuugcuuuaaguugcacuu

SEQ ID NO: 483372 - RNA, 64 nt, hsa
uccuuuaaacauacaaaaauugcucguguuauaaauuacccaguuuagaggggaaaaaaaaaca

SEQ ID NO: 483373 - RNA, 64 nt, hsa
gaaucacaucuucagaagagaagacacuaauauuauuacccauauacaugauuucagaagauga

SEQ ID NO: 483374 - RNA, 64 nt, hsa
uccaugcacuggaaugcggggacucugcagguggauuacccaggcucaggguuaacagcuagcc

SEQ ID NO: 483375 - RNA, 64 nt, hsa
cauccccacagaccagaaacaaggaauuucugggauuacccagucccccuucaacccaguugau

SEQ ID NO: 483376 - RNA, 64 nt, hsa
gauuacagauacuuauaaaacccucuauaaauagauuacccaagguuuuucagugagaaugaaa

SEQ ID NO: 483377 - RNA, 64 nt, hsa
accuguauuguagccccaaugucauuauguaauuauuacccagaauugcucuuccauaaagcuu

SEQ ID NO: 483378 - RNA, 64 nt, hsa
acagaagacuucagacucaccauaauugcugauaauuacccacucuuaaauuugucgagugauu

SEQ ID NO: 483379 - RNA, 64 nt, hsa
aguagcauuucauuuaagauaaggcucauauaguauuacccaacuaguugguaaugugauuaug

SEQ ID NO: 483380 - RNA, 64 nt, hsa
aaauuccauccuucacuuauguaacauguugcaaauuacccaaagaugagucuuucuucuuucu

SEQ ID NO: 483381 - RNA, 64 nt, hsa
uaguaaggaagaaaaacugaaaauguuuuaguuuauuacccaguauauuuggguaauaaugaaa

SEQ ID NO: 483382 - RNA, 64 nt, hsa
auguguacaaaguuaugcuaccuaauuacagaccauuacccaaauauccuaccaggcuuuccau

SEQ ID NO: 483383 - RNA, 64 nt, hsa
ccucuucuccugagggcugcuccagacaacauuuauuacccagaagaccuuuugucugaaaacc

SEQ ID NO: 483384 - RNA, 64 nt, hsa
acauugucucuaaauugugggucuauuucuaguuauuacccagaguuuuuauguagcagggaaa

SEQ ID NO: 483385 - RNA, 64 nt, hsa
ucugacaaagucacaaagucucagacuagaaauaauuacccaguaugaucauggcauccaagac

SEQ ID NO: 483386 - RNA, 54 nt, hsa
gggagcaacaaagcuccuaauucuauuacccacuacaugacaugugggccaagu

SEQ ID NO: 483387 - RNA, 64 nt, hsa
agaaauucagaaacuacagacaaagagaguggaaauuacccacugucaggccucugagcccaag

SEQ ID NO: 483388 - RNA, 64 nt, hsa
aauaguuuuauagaacuuaaaaauuuuuuauacaauuacccaauuggugauaugaucuuaagcu

SEQ ID NO: 483389 - RNA, 64 nt, hsa
uuuuuuucaguucauaugcagaacguauuuagccauuacccacgugacaccaccgaauauauua

SEQ ID NO: 483390 - RNA, 64 nt, hsa
aaacaaacuugauuaaaacuggugcuuaaaguuuauuacccacaacuccacagucucuguguaa

SEQ ID NO: 483391 - RNA, 64 nt, hsa
ccaagcauuaaagguguggccaugaguuuacagaauuacccacauuccaguugccacugggaug

SEQ ID NO: 483392 - RNA, 64 nt, hsa
ggugauccagccugccuauaaggacaagauaaacauuacccagcugggacuccaaaacucaacc

SEQ ID NO: 483393 - RNA, 64 nt, hsa
uugagguuugggcgggaacaaauagucaaauuauauuacccaucuacaugguuuucuuuuucuu

SEQ ID NO: 483394 - RNA, 64 nt, hsa
ugucaggaugccauagugcuguggggagcacaguauuacccaguggguagggcuucugucuucc

SEQ ID NO: 483395 - RNA, 64 nt, hsa
cuuuaagaguuuugguggcucucccauguuuccuauuacccauggauuuacccugagccuuccu

SEQ ID NO: 483396 - RNA, 64 nt, hsa
acuuagcuugccaguugagacaaucaccacaguuauuacccaaauacuaugaacauauuuuugu

SEQ ID NO: 483397 - RNA, 64 nt, hsa
auaaaacauuuugagaagggguaagcagugaguuauuacccacaauuuaaagcaaauuuugaau

SEQ ID NO: 483398 - RNA, 64 nt, hsa
uuacucaaaaacagcuggaagaagaaauugcuagauuacccaaagaaauagaucaguuggagaa

SEQ ID NO: 483399 - RNA, 64 nt, hsa
uaucagucucggaaacuucugaaaaaugcuaauaauuacccaaggauuaugucaaauuuuaaaa

SEQ ID NO: 483400 - RNA, 64 nt, hsa
auaaugugcugaauaagcucagcaacuaaaaaccauuacccaagaacguuucuugugagugagc

SEQ ID NO: 483401 - RNA, 64 nt, hsa
aaaagaguuagacucuauuggcaauugauagaguauuacccacggugcuuauuauuguuuauga

SEQ ID NO: 483402 - RNA, 64 nt, hsa
aagagcugagcagggcacugccagccugucccucauuacccaaggcaaggggcaggacaggccc

SEQ ID NO: 483403 - RNA, 64 nt, hsa
gcugucuaacccccagcugggucuaauccuucucauuacccacccgaccuggcugccccucacc

SEQ ID NO: 483404 - RNA, 64 nt, hsa
ccaguguaaccagcuuaguaaccagaguaucuggauuacccaggaagguugagcugcugagauu

SEQ ID NO: 483405 - RNA, 64 nt, hsa
uucagggugauaacuacuuagcacugcccuggugauuacccagagauaucuaugaaaaccagug

SEQ ID NO: 483406 - RNA, 64 nt, hsa
ucccuuuuugcagugacagaagaggagcauguaaauuacccaagggaauguuggugaaugucaa

SEQ ID NO: 483407 - RNA, 64 nt, hsa
agcaugacccaggucaacuuuuuuuuuccccugaauuacccaucaaauugaucugcagcugacu

SEQ ID NO: 483408 - RNA, 64 nt, hsa
acuugauuugcuagcugguggcagaauuggcaccauuacccaggucugacugaccaccagucag

SEQ ID NO: 483409 - RNA, 64 nt, hsa
gccugcagagccgugagccaaguaaaccucuuuaauuacccagccucagguaauccuuuauagc

SEQ ID NO: 483410 - RNA, 64 nt, hsa
cauaaaccugugcugaacauaacuucucauguauauuacccaauggaaaauauaaugaucagca

SEQ ID NO: 483411 - RNA, 64 nt, hsa
gaaugcccaaaauagugaauuauuuaaacagauuauuacccauauuaugaagaaauacucugca

SEQ ID NO: 483412 - RNA, 64 nt, hsa
uggccagaugaguuuaucaugucagugaaaaauaauuacccacaaaugccaccagaacuuacga

SEQ ID NO: 483413 - RNA, 64 nt, hsa
uaggugcauucuuuuuuucuuuggugucucacaaauuacccaauuguugaauaaaacuauaaau

SEQ ID NO: 483414 - RNA, 64 nt, hsa
auaaaaacuuacauuguuuauuggaguauaaaauauuacccaaguuucuucaugaguugacaug

SEQ ID NO: 483415 - RNA, 64 nt, hsa
cauacaguccuccuucaccuuacucuguauuuauauuacccauaacuagcaagaaguucuuguu

SEQ ID NO: 483416 - RNA, 64 nt, hsa
ggcccagcaggagcugcuucagccgagagggacuauuacccaagagagguauccucagccccuc

SEQ ID NO: 483417 - RNA, 64 nt, hsa
cacacuguuguuuaguuaaguuuuaaauagguguauuacccaagaaguaaagauggaaacguua

SEQ ID NO: 483418 - RNA, 57 nt, hsa
aggcagaagaagaauuuuaaugaaaaaauuacccagauuggcuccauggaaaaggag

SEQ ID NO: 483419 - RNA, 64 nt, hsa
augguucagccacugguacuacgagaauguuuguauuacccacauuugaaaugauuugcuauga

SEQ ID NO: 483420 - RNA, 64 nt, hsa
gcaagaaggcccaguugccacagauuauacaaccauuacccaaaccacucugacagucuccucc

SEQ ID NO: 483421 - RNA, 64 nt, hsa
cauaaccuuuacacuccucguccauuuuauuaggauuacccaaauauaaccauuuaaagaaaga

SEQ ID NO: 483422 - RNA, 64 nt, hsa
aaauuugaaaugaauguuuuuuuauuuaccccacauuacccaaucaguaaaacauuuagguguu

SEQ ID NO: 483423 - RNA, 64 nt, hsa
ccccaacccucuuaaaugucaaagacccuuuuugauuacccacacuggugguuauuacagcaug

SEQ ID NO: 483424 - RNA, 64 nt, hsa
gcagacugguguuguucaucgcaguguggacaccauuacccacccccguuccccugaggugcuc

SEQ ID NO: 483425 - RNA, 64 nt, hsa
augagacuuugaaacuaucucaugccagugccuuauuacccaggaagauuuuaaaggaccucau

SEQ ID NO: 483426 - RNA, 64 nt, hsa
ugggaguucuggaucacaauaugucugggcucucauuacccaaacaucugagauuccauuuuug

SEQ ID NO: 483427 - RNA, 64 nt, hsa
agaaagugagacauggacaagacucuagucauaaauuacccaucuuuuugaaaacaguguagcg

SEQ ID NO: 483428 - RNA, 64 nt, hsa
ggacaauggcauucucuacaaugcaauaaaaacaauuacccaugauuuugcugcggccgcuucc

SEQ ID NO: 483429 - RNA, 64 nt, hsa
agcauuguacauaacuuggggguaugugugcaggauuacccaagaauaacuuaaguagaagaaa

SEQ ID NO: 483430 - RNA, 64 nt, hsa
aacauccugcaacaccauccugggagacaagagcauuacccagcuuggcuuucacgggggaggg

SEQ ID NO: 483431 - RNA, 64 nt, hsa
auaaucauuuacuguuccucaaagaauugucuacauuacccaucuccucuuuugccucugagaa

SEQ ID NO: 483432 - RNA, 64 nt, hsa
gaagaauacaugguagggaggaauuccaaaaaugauuacccauuaaaaggcaggcuggaaggcc

SEQ ID NO: 483433 - RNA, 64 nt, hsa
aacgcagauuacaauggaguggggaaguacuuucauuacccaagccucagaaaaacacacaaga

SEQ ID NO: 483434 - RNA, 64 nt, hsa
guuuaaacacaacucuauagaaagaaaggagauuauuacccagaauucacauguagugauuauu

SEQ ID NO: 483435 - RNA, 64 nt, hsa
uaaaugaugcuuuguauaauucauuuuaucaaaaauuacccauaacuuucauuuguuuuuauau

SEQ ID NO: 483436 - RNA, 64 nt, hsa
aaaucaguguugggaauuauaauuugagaaaaauauuacccaguaacauugaauguagauggcu

SEQ ID NO: 483437 - RNA, 64 nt, hsa
cccuuucccuuuuucccacuaaauuuuuucuuaaauuacccauguaaccauuuuaacucuccag

SEQ ID NO: 483438 - RNA, 64 nt, hsa
cagauuucagaugaggcaacauuuucuugagauaauuacccaaguuucauccauguugaauggu

SEQ ID NO: 483439 - RNA, 64 nt, hsa
uuggaaagcucuuuauagccauuugguauuuccuauuacccaccuccuauuuuaaauauuuauc

SEQ ID NO: 483440 - RNA, 64 nt, hsa
aagacaggcaaaguuguggacuguuugaucuuguauuacccacaggaaugagggcagcuaaacc

SEQ ID NO: 483441 - RNA, 64 nt, hsa
auacaaagugagaguaggaagacucaaacacgauauuacccaaguuccugagacuagagaagug

SEQ ID NO: 483442 - RNA, 64 nt, hsa
caaaggccauggauaacccuacccgcuuuaugucauuacccauugggaaacacaauggcuacuu

SEQ ID NO: 483443 - RNA, 64 nt, hsa
cuucauggaauccuugagaagagaggccuuuacaauuacccaguucugaggguucagguucacg

SEQ ID NO: 483444 - RNA, 64 nt, hsa
uccuuggagucccaggggcagccacaccacugccauuacccagugccgaggacaugcaugacac

SEQ ID NO: 483445 - RNA, 64 nt, hsa
acaugucacagggguuugguguacauauuauuucauuacccagguaauaagcauaguacccaau

SEQ ID NO: 483446 - RNA, 64 nt, hsa
cuuuuuacucugcucaaaaagcaucucuccucccauuacccaaccuuggucauaagugugccug

SEQ ID NO: 483447 - RNA, 64 nt, hsa
uaucauagcagagacaucuguaugcauuccugucauuacccauuguaacagagccacaaacuaa

SEQ ID NO: 483448 - RNA, 64 nt, hsa
aaauaauuuuuuuaaaaaagaaaaagacaauaguauuacccaugggacaaaauuuguacuauua

SEQ ID NO: 483449 - RNA, 64 nt, hsa
gugcuguuuguucuuaaaaugcauuuaaagaaaaauuacccauauugacuuucacaccucauau

SEQ ID NO: 483450 - RNA, 64 nt, hsa
augaaaggaccgccuuaucaugcuggcaauguuaauuacccagguguaggaagccauacacuga

SEQ ID NO: 483451 - RNA, 64 nt, hsa
aacugugaguuaauuaaaccucuuuccuuuauaaauuacccagucaugggcaguccuuuacagc

SEQ ID NO: 483452 - RNA, 64 nt, hsa
agcugcauggcgcuccuaggcggucccagcuggaauuacccaaccccaugacggacccuuucau

SEQ ID NO: 483453 - RNA, 64 nt, hsa
uugucgaaucauaccagauuauuaaaugugacaaauuacccaaggcgguaaaaaagacauguuc

SEQ ID NO: 483454 - RNA, 64 nt, hsa
uaaucccagcacuuugggaggccaaagcagguggauuacccaaggccaggaguucaagaccagc

SEQ ID NO: 483455 - RNA, 64 nt, hsa
cuuuauugacucauuuuauugcaaaacaaaaaggauuacccaaacaacauguuucgaacaagga

SEQ ID NO: 483456 - RNA, 64 nt, hsa
gaacugaaauuaaaacuauucaugcuacccagccauuacccagcuaaauaaucuuacucuagau

SEQ ID NO: 483457 - RNA, 64 nt, hsa
acugaugacugauagaaagcccucuuucacucugauuacccacucacuacaugaaguccugaaa

SEQ ID NO: 483458 - RNA, 64 nt, hsa
guagcucuggacuggagggguagauggggagucaauuacccaucacauaaauaugaaacauuua

SEQ ID NO: 483459 - RNA, 64 nt, hsa
ugccucugccccaugggcccgagagaagcugacaauuacccauagugagguaauugagggcuuu

SEQ ID NO: 483460 - RNA, 64 nt, hsa
agcgauggcaccuccgucccaggguggugugaggauuacccagugugguaggugcucaauaaau

SEQ ID NO: 483461 - RNA, 64 nt, hsa
auuauaguauuuauuguauuuuuauguucugaaaauuacccauggaacaauaugcuuaggauua

SEQ ID NO: 483462 - RNA, 64 nt, hsa
ccccuuccaucucugacuuaagcaaaagaaaaagauuacccaaaaacugucuuuaaaagagaga

SEQ ID NO: 483463 - RNA, 64 nt, hsa
ugagguauucccacauagaaauaacaaugcauguauuacccagaauuuaauguugcguaccuua

SEQ ID NO: 483464 - RNA, 64 nt, hsa
acccuaauaucccaggcacauacaaaacuuaugaauuacccagcacaacugugaaacucuguau

SEQ ID NO: 483465 - RNA, 64 nt, hsa
uucuagagaaaaagggaucuaggaaugcugaaagauuacccaacauaccauuauagucucuucu

SEQ ID NO: 483466 - RNA, 64 nt, hsa
gaaaaauauucuauuuuuuauucagugcugcguaauuacccaugguagccaacccuacaaaaga

SEQ ID NO: 483467 - RNA, 64 nt, hsa
uacuguugugaccugaaguucaccauuaaaagggauuacccaagcaaaaucauggaaugguuau

SEQ ID NO: 483468 - RNA, 64 nt, hsa
aucaaaccacuucugacaaaauuagcuguuuugaauuacccauaucacugccaguuuuauuuua

SEQ ID NO: 483469 - RNA, 64 nt, hsa
uuugaauccuguuguagaauggaaaugagcuuaaauuacccaagcuuacuuuccaucuauaaaa

SEQ ID NO: 483470 - RNA, 64 nt, hsa
gucagaccaucaaucucuuggggugauuaaucaaauuacccacccaaggcuucuagaaggagcu

SEQ ID NO: 483471 - RNA, 64 nt, hsa
uuaaaaacaauucauguucaaaggagcuuuucaaauuacccaguccaccacagaaucagcuaau

SEQ ID NO: 483472 - RNA, 64 nt, hsa
guuuuccaaacuggauagcugccaaccagcagacauuacccacuugaaauggaguacucaguua

SEQ ID NO: 483473 - RNA, 64 nt, hsa
ucaucuuagauuuuuugagaacucaccagcuuuuauuacccacugaauuuucagacuaucuuag

SEQ ID NO: 483474 - RNA, 64 nt, hsa
agaaagaaacuaaagacccugaaugaauuugcagauuacccaugugcacaguggggaccuggcc

SEQ ID NO: 483475 - RNA, 64 nt, hsa
ucuuuaaggauuauuaguguuucauugauacuaaauuacccagcuuaaucaacagaaugguuua

SEQ ID NO: 483476 - RNA, 64 nt, hsa
aagguugaaacaugacagugcuuaucucaaacagauuacccaucugcagaacuaaggaaagcaa

SEQ ID NO: 483477 - RNA, 64 nt, hsa
uagacaagcaagugcacaugauaaacaucaaaauauuacccagcugaauaguuacugcugcacu

SEQ ID NO: 483478 - RNA, 64 nt, hsa
ggacaguggcgacugcccggcugcaugcacuccgauuacccacgugcugccguccuggucucau

SEQ ID NO: 483479 - RNA, 64 nt, hsa
agaucuugcaggucuaguauuuuaauaaugcacuauuacccagggcagauauuaugagaaacug

SEQ ID NO: 483480 - RNA, 64 nt, hsa
gauuaacuuuuuuuaacgcaaaaauauucugcacauuacccauauauuguugaauuuuacauac

SEQ ID NO: 483481 - RNA, 64 nt, hsa
acacagagcaugucccagaacauuucugugcuuaauuacccaaccaaagagaucugaaguaugu

SEQ ID NO: 483482 - RNA, 64 nt, hsa
gaacugugagccaauuauaccucuuuucuuauaaauuacccaguaucaaguauuucuuuauagc

SEQ ID NO: 483483 - RNA, 64 nt, hsa
gcuggguccuccuuuggccuggacccaggacuuaauuacccagugcccaguugugccacauucc

SEQ ID NO: 483484 - RNA, 64 nt, hsa
ugcacucacaguaaacuacauuacucaacugaguauuacccaguuauacccaaucccugaugaa

SEQ ID NO: 483485 - RNA, 64 nt, hsa
uugggagagauggcaaacacaguggcaagacaacauuacccaacuauagaagagaggcuaacua

SEQ ID NO: 483486 - RNA, 64 nt, hsa
guguacacaaaaacauaauguaucuuaugaaagcauuacccaaccuguuugaguugagaaugca

SEQ ID NO: 483487 - RNA, 64 nt, hsa
uguaucucuucucccccagccccuauugggaaaaauuacccaguauaguucagguuaugaggag

SEQ ID NO: 483488 - RNA, 64 nt, hsa
cugcccccagcaucuggacaagcuaauagcaaauauuacccauugcuaucaagggaggaggggg

SEQ ID NO: 483489 - RNA, 64 nt, hsa
uccuaagcaaaaagaacaaagcuggaggcaucgcauuacccaacuucaaacuauacuacagggc

SEQ ID NO: 483490 - RNA, 64 nt, hsa
agugaucacuugacaguuuuuuuuuuuuuuaaauauuacccaaaaugcuccccaaauaagaaau

SEQ ID NO: 483491 - RNA, 64 nt, hsa
ugggcacacacccagcggccugcagaguaagcuuauuacccacaacugugcccgcuuugugcuu

SEQ ID NO: 483492 - RNA, 64 nt, hsa
aucucauacaagugaaaggauacuggagagagaaauuacccauuucuaaaaaaaaaccacacuc

SEQ ID NO: 483493 - RNA, 64 nt, hsa
auuuccaagacacaaacaugaccuauccaagcgcauuacccacuuguggccaaucaguggccag

SEQ ID NO: 483494 - RNA, 64 nt, hsa
aauuuaagaacucugaaacaaucuacauauacuuauuacccaguacaguuuuuuuuccccugaa

SEQ ID NO: 483495 - RNA, 64 nt, hsa
acccuauugacuuccggguaaggggagucaauugauuacccagcagcacaguauuugcuuuuua

SEQ ID NO: 483496 - RNA, 64 nt, hsa
uucacagcaaggaaauucaccuucaaaagcacugauuacccaaugcaccucccuccccagcucg

SEQ ID NO: 483497 - RNA, 64 nt, hsa
gaggugaauuuuccgggaacuuugcagcauaccaauuacccauaaacagcacaccuguguccaa

SEQ ID NO: 483498 - RNA, 64 nt, hsa
aaaaauugacagcuaguguuuuuuaccauccgucauuacccaaagacuugggaacuaaaauguu

SEQ ID NO: 483499 - RNA, 64 nt, hsa
aaaugagcgauauaugaacggcauaaaaacagaaauuacccaguaaaaaggaugucagaaauug

SEQ ID NO: 483500 - RNA, 64 nt, hsa
acuauauggacugguaaugguuacagguucagagauuacccagugaggccuuauuccucccuuc

SEQ ID NO: 483501 - RNA, 64 nt, hsa
gcagucaacguagaaugcuugggaaauagucauaauuacccacauauaguaauuaauagauggu

SEQ ID NO: 483502 - RNA, 64 nt, hsa
auucaaauagaacauuuaaaaugauuucauuauuauuacccauacuguugccacucauauugua

SEQ ID NO: 483503 - RNA, 64 nt, hsa
aucagagacauuuaugaacaaugacagaagaaaaauuacccaaauaaauguggaagcaagcaaa

SEQ ID NO: 483504 - RNA, 64 nt, hsa
uuugcccaggcugguuuggaacuccugacuucaaauuacccaccugccucagccucccaaagug

SEQ ID NO: 483505 - RNA, 64 nt, hsa
ugugauugccauagugggauauucccucucccacauuacccaagagggaaaugggcugucuuac

SEQ ID NO: 483506 - RNA, 64 nt, hsa
acccugucucaagaaagaaaagaaaaagagacaaauuacccagaaaccccucccuuccccacau

SEQ ID NO: 483507 - RNA, 64 nt, hsa
ggcugagccacaggcauuuccugcuuauuuuaggauuacccacucaucagaaaaaaaaaaaaaa

SEQ ID NO: 483508 - RNA, 64 nt, hsa
gaaacgaaacaaauguaauaugcauccugaggccauuacccagugaccgaugguaagugaggau

SEQ ID NO: 483509 - RNA, 64 nt, hsa
uuucuguaucacugugucccagacaauauuuagaauuacccagcuuuccaguuuuuacuuuaga

SEQ ID NO: 483510 - RNA, 64 nt, hsa
auggugaaacccugucucuacuaaaaauacaaaaauuacccaagcauaguggugggugccugua

SEQ ID NO: 483511 - RNA, 64 nt, hsa
uugcaucuucuuccacugggcucuggauuaaucaauuacccaaaggcugcaccugccguguugu

SEQ ID NO: 483512 - RNA, 64 nt, hsa
uaugaaauuucaacuuuuccuuucauacgucuuuauuacccaagucuucucccguccauuccag

SEQ ID NO: 483513 - RNA, 64 nt, hsa
ugguccagggccugggaaauuucuacuuauccucauuacccaggucccuccuuuggacccugua

SEQ ID NO: 483514 - RNA, 64 nt, hsa
uagcuuugaggguaaaugaaaauauaacccauagauuacccagccacuugggaacagcagguaa

SEQ ID NO: 483515 - RNA, 64 nt, hsa
gaccccgucuaacacugcauccucccaacugggcauuacccaccauuguagccaccugugcgcc

SEQ ID NO: 483516 - RNA, 64 nt, hsa
aaugaauagugagucagaucuauugcuucucuguauuacccacaugacaacugucuauaaugag

SEQ ID NO: 483517 - RNA, 64 nt, hsa
cuacaacuuaguuuuaaauuacuugcuacuggggauuacccauggauauccuuaauaggcagga

SEQ ID NO: 483518 - RNA, 64 nt, hsa
aaugaaaucaaauuuaucaguuuuuuucccccuaauuacccaaaagaucuuuugcaaacuaugu

SEQ ID NO: 483519 - RNA, 64 nt, hsa
guuagcaagaauccucuaaaucaguuuauggagaauuacccacccucgauaucugaucccauuc

SEQ ID NO: 483520 - RNA, 64 nt, hsa
uguguucuggguguucaggugcugcugguccuccauuacccacugcuccccaaggcugguggga

SEQ ID NO: 483521 - RNA, 64 nt, hsa
gcauacacaagcaccaaaccuacuaggucuucucauuacccauguaaaccacauguuagauaaa

SEQ ID NO: 483522 - RNA, 64 nt, hsa
ccuccaugauccgagagugggaaaaggcccgauuauuacccauaaggcacacucucuaaggccu

SEQ ID NO: 483523 - RNA, 64 nt, hsa
ucugauggguucgagaaaacuuauguuuuugcagauuacccagcuuuguucuuguuauaaagau

SEQ ID NO: 483524 - RNA, 64 nt, hsa
agggagaguggucgugagcuggucuuggggcacaauuacccagagauauauuuauuaacagcca

SEQ ID NO: 483525 - RNA, 64 nt, hsa
cuaacuguaagaaauuaauucuuuuucuuuauaaauuacccagguucuguuuuaagccucagaa

SEQ ID NO: 483526 - RNA, 64 nt, hsa
gaacaauaaaaaagguacaaaaagugaaguacaaauuacccaaaucucuccacccuuauauaau

SEQ ID NO: 483527 - RNA, 64 nt, hsa
cugccaaaaccaaauugagcucagcuuccuaggcauuacccaaaagcaagguguuuaaguaauu

SEQ ID NO: 483528 - RNA, 64 nt, hsa
uuagaacuagaaguaaacacauaaauccuuauaaauuacccaauccaacuuucucauauugcau

SEQ ID NO: 483529 - RNA, 64 nt, hsa
uguauauugcuuuuuaaaaguuaaguccauucuaauuacccaaauaugcaugaauucauucucc

SEQ ID NO: 483530 - RNA, 64 nt, hsa
aguugggaggauggggagacagcuaaccaacugcauuacccaaaccauauugcacuuuuaguuc

SEQ ID NO: 483531 - RNA, 64 nt, hsa
ggugagaggaggaguuagagcuggucguuuugugauuacccauaauauuggaagcagccugagg

SEQ ID NO: 483532 - RNA, 64 nt, hsa
gcccaagcugcaugucaccugagggcuggcaggaaggggcgagaaaucccagggcauuguacca

SEQ ID NO: 483533 - RNA, 64 nt, hsa
uugucuuccggcuccucccagcuggccuugucccaggggcgacggcugccccggacgacugcgc

SEQ ID NO: 483534 - RNA, 64 nt, hsa
agucugacugaugagaugcugcuccaagccugugaggggcgaacagcacacaaguaaguagugg

SEQ ID NO: 483535 - RNA, 64 nt, hsa
ggcauggacauguccucugugcaguggaaggaggaggggcgaaaguacgcccuuagccuuugga

SEQ ID NO: 483536 - RNA, 64 nt, hsa
guguucacuaagaggccuuuaauccuggggaguaaggggcgaaggcccuuagacaaccauggcu

SEQ ID NO: 483537 - RNA, 64 nt, hsa
ggacagaaagaaggagggacaggcaggcagcaggaggggcgagcugggaggcaggaggcagcgg

SEQ ID NO: 483538 - RNA, 64 nt, hsa
cacacgcuguauggaagggugugggugugugugaaggggcgaguggagacacuguguguaucuc

SEQ ID NO: 483539 - RNA, 64 nt, hsa
uccacaagaagcaaugaggacugcccaguggaggaggggcgauguggcuggggagcuagggaga

SEQ ID NO: 483540 - RNA, 64 nt, hsa
cccaaacaaaaucacaaaaccuggacaucccucaaggggcgaagaggcggccgggagacugcag

SEQ ID NO: 483541 - RNA, 64 nt, hsa
acucuucuccugcucccccccugcccuggaggggaggggcgauaaauaccuuugauuguaacgu

SEQ ID NO: 483542 - RNA, 64 nt, hsa
uuguuuuagaaaaaaaaacaacauaguuuucugaaggggcgacuuaaaacuguggagagugggg

SEQ ID NO: 483543 - RNA, 64 nt, hsa
uaggaaaugcuacaugcggaaugugcacguuuccaggggcgaguauugucaaucaaaagguuug

SEQ ID NO: 483544 - RNA, 64 nt, hsa
ugccugugaaugcugagugagcgaguaagggaggaggggcgauugaggguucaccucugccuug

SEQ ID NO: 483545 - RNA, 64 nt, hsa
uauuuauuuauuuauucuccuugggguuggugucaggggcgagccaaccccaccucuaugcccu

SEQ ID NO: 483546 - RNA, 64 nt, hsa
caccuuguaaaugcucuaacuggacaugaaggaaaggggcgagggaggggggugggauuuuugg

SEQ ID NO: 483547 - RNA, 64 nt, hsa
agccggagggacgcggaggaggaagaggguagacaggggcgaccugugauuguuguuauugaug

SEQ ID NO: 483548 - RNA, 64 nt, hsa
agggccugagcuggggcaggccucccucagggccaggggcgauggcaccccggggacaggcaga

SEQ ID NO: 483549 - RNA, 64 nt, hsa
gagcgugggguucggcggccuggugcagcuccggaggggcgagaggguguacgucaacaucagu

SEQ ID NO: 483550 - RNA, 64 nt, hsa
cugagcgcccagcgggcagggccggaggagguguaggggcgagagggguuguucuccuacgccu

SEQ ID NO: 483551 - RNA, 64 nt, hsa
ggcugggguugggcuggugcagcccagcuggcggaggggcgaagcuuuggugacagacggagag

SEQ ID NO: 483552 - RNA, 64 nt, hsa
ggaagugcagaguggauggacggguuuagaggggaggggcgaaggugcuguaaacagguuuggg

SEQ ID NO: 483553 - RNA, 64 nt, hsa
accaugaugauuuguuccaguucucccagggcagaggggcgagggagaggcuuuugcugugaga

SEQ ID NO: 483554 - RNA, 64 nt, hsa
uccaccucccugcacuuguagucuaaaaaguaaaaggggcgaucagguccaucucaaaggucac

SEQ ID NO: 483555 - RNA, 64 nt, hsa
uagggacaguugucugguuugugccaaaccuucgaggggcgaguagggagugggggaggugggu

SEQ ID NO: 483556 - RNA, 64 nt, hsa
cuguacagagcagcgucccuuugguuuggcccagaggggcgaacaauugcaagggagagggccu

SEQ ID NO: 483557 - RNA, 64 nt, hsa
ggcugugguugaccugccuuggggagcagggcugaggggcgaagaggacauguggauauccagc

SEQ ID NO: 483558 - RNA, 64 nt, hsa
agaacaccuccuucagagcccuuuguuaaauaagaggggcgacguugaucauagaugccaccug

SEQ ID NO: 483559 - RNA, 64 nt, hsa
gggcugggcaggcauucugggggcagggugggggaggggcgagaguauuuuuuucuucguguaa

SEQ ID NO: 483560 - RNA, 64 nt, hsa
gcugaaaugggguugccaggacaacaagcauggcaggggcgaauggggacaucaggugacugac

SEQ ID NO: 483561 - RNA, 64 nt, hsa
cccgcggggcuggggccagacaaagacucggcaaaggggcgagaggagggaacgagcgggcgcc

SEQ ID NO: 483562 - RNA, 64 nt, hsa
cugaacacugagggcaggagcaagggaggaagccaggggcgaggcaggccgcgggaaagccagg

SEQ ID NO: 483563 - RNA, 64 nt, hsa
ucgcagcucacucgaggccuggggaaggggacucaggggcgaggaggaugacuggguccggucg

SEQ ID NO: 483564 - RNA, 64 nt, hsa
uuauucaugugggacaugagcaaauggcagaauuaggggcgagugcuuucaaugcucgaaacua

SEQ ID NO: 483565 - RNA, 64 nt, hsa
agcccccccauuccugggccuuucugagggcaggaggggcgaccagauaaggagccccucucug

SEQ ID NO: 483566 - RNA, 64 nt, hsa
ggguccugggucucuugcauuuauaugucagaaaaggggcgauaugcugcugaggggugagugc

SEQ ID NO: 483567 - RNA, 64 nt, hsa
cucaacccugcccugaacaugccccagggcacugaggggcgaagccagugcuugggcucugcug

SEQ ID NO: 483568 - RNA, 64 nt, hsa
ugaguguccccuugggcccauggcccagucacucaggggcgaguuucuuuucuaacauagcccu

SEQ ID NO: 483569 - RNA, 64 nt, hsa
ggggacccagacauauccuuugcacugucccuagaggggcgaugagcuuugcagcauuaaaaaa

SEQ ID NO: 483570 - RNA, 64 nt, hsa
gcgacaaugucuugcugcucggauuaggugggggaggggcgacaguagugagcgccugagccga

SEQ ID NO: 483571 - RNA, 64 nt, hsa
gacaagcacauagcaagcugaacuguccuaaggcaggggcgagcacggaacaauggggccuuca

SEQ ID NO: 483572 - RNA, 64 nt, hsa
uaagccaucagaaguuacuuuuaggaugggggagaggggcgagaaggggaaaaaugggaaauag

SEQ ID NO: 483573 - RNA, 59 nt, hsa
ugggggggcaagaacgguagugggcccucaggggcgauuagcuuagugagcuuaccccg

SEQ ID NO: 483574 - RNA, 64 nt, hsa
uuguucccagacacacaaccccucuagcucucggaggggcgaucaugagaaaccuuccagggaa

SEQ ID NO: 483575 - RNA, 64 nt, hsa
aagcuacaacagguuuggaaaaccucugugggggaggggcgaguauaaaguuuuccucuuuuuu

SEQ ID NO: 483576 - RNA, 64 nt, hsa
aaauuauaaacuuuuauacuuggguaagucccccaggggcgaguuccucgcucugggaugcagg

SEQ ID NO: 483577 - RNA, 64 nt, hsa
aagaguggguggcuggcuggcuggcuggaaggggaggggcgagagggcugucucggugaugagc

SEQ ID NO: 483578 - RNA, 64 nt, hsa
ggcugcggccacgugaggcuccgcaucagcagccaggggcgagcacuaguggacaaagccagca

SEQ ID NO: 483579 - RNA, 64 nt, hsa
uccccggccuggguuggagggagcggauggguguaggggcgaggcgccucccgcccucggcugg

SEQ ID NO: 483580 - RNA, 64 nt, hsa
gggugagucacagcccucuccgucugcucuagccaggggcgacguguccccagguuucuggcag

SEQ ID NO: 483581 - RNA, 64 nt, hsa
aggggaggggaccaugaggcagccagccccuggcaggggcgacugugccaccgcaggcagcgcu

SEQ ID NO: 483582 - RNA, 64 nt, hsa
gagacugggccuaggccaggaguucccaaaugugaggggcgagaaacaagacaagcuccucccu

SEQ ID NO: 483583 - RNA, 64 nt, hsa
gugguagagaacucucuuccuucuuuccaccgacaggggcgagggcugcuuccucgcggcagcc

SEQ ID NO: 483584 - RNA, 64 nt, hsa
ccccuuugccauagccugauuuuggggaggaggaaggggcgauuugagggagaaggggagaaag

SEQ ID NO: 483585 - RNA, 64 nt, hsa
gcgggccugccagcugggggccuuugcggcgcgcaggggcgaagccuguaaucacugcagccgc

SEQ ID NO: 483586 - RNA, 64 nt, hsa
cugaggccacagggagcggccaucgccauugggaaggggcgacuccacggaaagcccagacggg

SEQ ID NO: 483587 - RNA, 64 nt, hsa
gguccccagccucugggcuccuguuuccauaggaaggggcgacaccuuccucccaggaagcuga

SEQ ID NO: 483588 - RNA, 64 nt, hsa
cccccuccaguuguaaaugccacuucaugaggggaggggcgaggggaagcccaccccugcaugc

SEQ ID NO: 483589 - RNA, 64 nt, hsa
cacccucauuuucugguccucgcgacugagagccaggggcgacaucaugaccuucugucccggc

SEQ ID NO: 483590 - RNA, 64 nt, hsa
cccucuggaaguggccuugcccgguccccuucccaggggcgaggucggcaaagcaacauggcag

SEQ ID NO: 483591 - RNA, 64 nt, hsa
gcuguugguccucucucuguggggcugaauugccaggggcgaggcccuuccucuuugguggcau

SEQ ID NO: 483592 - RNA, 64 nt, hsa
ccauuucugaccugaaugaaauauucagggacuuaggggcgaugauuguagaacagguacguga

SEQ ID NO: 483593 - RNA, 64 nt, hsa
ucaggguggggccuugagaaggggaaugugggacaggggcgauggugccuggucucugaguaag

SEQ ID NO: 483594 - RNA, 64 nt, hsa
aggaaacaggucaugaagguggagauaagcugcaaggggcgaagcaacuuuaugucaguggaaa

SEQ ID NO: 483595 - RNA, 64 nt, hsa
ccaagaccgguugcucugagaguagcugguaaagaggggcgaacuaaagaccuguccaccugua

SEQ ID NO: 483596 - RNA, 64 nt, hsa
acuuuugccccucccuucagagccuggucacacaaggggcgagcaccaggccagccugggacug

SEQ ID NO: 483597 - RNA, 64 nt, hsa
ugucuuuccagggggaaggggcuccccaugagggaggggcgacgggggaggggggugauggugc

SEQ ID NO: 483598 - RNA, 64 nt, hsa
gcggacagguggucggcgucggggugcgguggguaggggcgaggacaacgcagggugcgcuggg

SEQ ID NO: 483599 - RNA, 64 nt, hsa
ugcuccaaaaccaaaaagcuggguccucuggaggaggggcgagcuguggagcagccacccacug

SEQ ID NO: 483600 - RNA, 64 nt, hsa
ggccucccacugccccacacgccgcgggaccuccaggggcgacucuaguggccugaggagaugu

SEQ ID NO: 483601 - RNA, 64 nt, hsa
gggcuuggaagggcgcugagggcaggguucuagaaggggcgaggcuuuaagcgaggcagaaugg

SEQ ID NO: 483602 - RNA, 64 nt, hsa
ggccagggugggagggagggacaagggggaggaaaggggcgagcacccacgugagagaaucugc

SEQ ID NO: 483603 - RNA, 64 nt, hsa
ccauggaugauguuaaggauagaagccacucaguaggauagaagaaaagaaagauggaagaagg

SEQ ID NO: 483604 - RNA, 64 nt, hsa
guccagcagugaacuugggccauggaugauguuaaggauagaagccacucaguaggauagaaga

SEQ ID NO: 483605 - RNA, 64 nt, hsa
guucucagcaucaggccaccuccaccccaaugccaggauagauguauucuagaguaggggugga

SEQ ID NO: 483606 - RNA, 64 nt, hsa
aauaaacucuaggcccagggcuacuaaagacuucaggauagaauucuccaucaaauauacagca

SEQ ID NO: 483607 - RNA, 64 nt, hsa; identical to SEQ ID NO: 334332

SEQ ID NO: 483608 - RNA, 64 nt, hsa; identical to SEQ ID NO: 334333

SEQ ID NO: 483609 - RNA, 64 nt, hsa; identical to SEQ ID NO: 334334

SEQ ID NO: 483610 - RNA, 64 nt, hsa; identical to SEQ ID NO: 334335

SEQ ID NO: 483611 - RNA, 64 nt, hsa; identical to SEQ ID NO: 334336

SEQ ID NO: 483612 - RNA, 64 nt, hsa; identical to SEQ ID NO: 334337

SEQ ID NO: 483613 - RNA, 64 nt, hsa; identical to SEQ ID NO: 334338

SEQ ID NO: 483614 - RNA, 64 nt, hsa; identical to SEQ ID NO: 334339

SEQ ID NO: 483615 - RNA, 64 nt, hsa; identical to SEQ ID NO: 334340

SEQ ID NO: 483616 - RNA, 64 nt, hsa; identical to SEQ ID NO: 334341

SEQ ID NO: 483617 - RNA, 64 nt, hsa; identical to SEQ ID NO: 334342

SEQ ID NO: 483618 - RNA, 64 nt, hsa; identical to SEQ ID NO: 334343

SEQ ID NO: 483619 - RNA, 64 nt, hsa; identical to SEQ ID NO: 334344

SEQ ID NO: 483620 - RNA, 64 nt, hsa; identical to SEQ ID NO: 334345

SEQ ID NO: 483621 - RNA, 64 nt, hsa; identical to SEQ ID NO: 334346

SEQ ID NO: 483622 - RNA, 64 nt, hsa; identical to SEQ ID NO: 334347

SEQ ID NO: 483623 - RNA, 64 nt, hsa; identical to SEQ ID NO: 334348

SEQ ID NO: 483624 - RNA, 64 nt, hsa; identical to SEQ ID NO: 334349

SEQ ID NO: 483625 - RNA, 64 nt, hsa; identical to SEQ ID NO: 334350

SEQ ID NO: 483626 - RNA, 64 nt, hsa; identical to SEQ ID NO: 334351

SEQ ID NO: 483627 - RNA, 64 nt, hsa; identical to SEQ ID NO: 334352

SEQ ID NO: 483628 - RNA, 64 nt, hsa; identical to SEQ ID NO: 334353

SEQ ID NO: 483629 - RNA, 64 nt, hsa; identical to SEQ ID NO: 334354

SEQ ID NO: 483630 - RNA, 64 nt, hsa; identical to SEQ ID NO: 334355

SEQ ID NO: 483631 - RNA, 64 nt, hsa; identical to SEQ ID NO: 334356

SEQ ID NO: 483632 - RNA, 64 nt, hsa; identical to SEQ ID NO: 334357

SEQ ID NO: 483633 - RNA, 64 nt, hsa; identical to SEQ ID NO: 277107

SEQ ID NO: 483634 - RNA, 64 nt, hsa; identical to SEQ ID NO: 277108

SEQ ID NO: 483635 - RNA, 63 nt, hsa
uggaaccucaggacccgcccauuucucggcaguacugugaauuuugaaguuaaacuaaauuuu

SEQ ID NO: 483636 - RNA, 63 nt, hsa
ugacaugaagaguuuaguuuuuuuacuuuauaaacugugaauaugaguaugccagcugcauac

SEQ ID NO: 483637 - RNA, 63 nt, hsa
aacaacaacaacaaaccacaaaauuauuugaguacugugaaggauuauuugucuaacaguuca

SEQ ID NO: 483638 - RNA, 63 nt, hsa
uguggaaagagcguccauaggagaagugagaauacugugaaaaagggauguuagcauucauua

SEQ ID NO: 483639 - RNA, 63 nt, hsa
cgacaugaagaguuuaguuuuuuuacuuuauaaacugugaauaugaguaugccagcugcauua

SEQ ID NO: 483640 - RNA, 63 nt, hsa; identical to SEQ ID NO: 483635

SEQ ID NO: 483641 - RNA, 63 nt, hsa
gccucauucuccaagagccacaacucaagcugaacugugaaagugguuuaacacuguauccua

SEQ ID NO: 483642 - RNA, 63 nt, hsa
cauuuuucuggaguggaaaagcuuaaaaaaauuacugugaauuguuuuuguacaguuaucaug

SEQ ID NO: 483643 - RNA, 63 nt, hsa
aaggcuguaauuggagcagcuuuuggcugcguaacugugaacuauggccauauauaauuuuuu

SEQ ID NO: 483644 - RNA, 63 nt, hsa
cuguugagagcauuucagccagaggacuuuggaacugugaauauacuuccugaaggggaggga

SEQ ID NO: 483645 - RNA, 63 nt, hsa
uauuaugggauugcuaccuguauaaacaauggcacugugaaaauacuguuaguuuuaauacaa

SEQ ID NO: 483646 - RNA, 63 nt, hsa
uuaacacuagcuuuguauuuuuuuuucuguaaaacugugaacugauauauuuuccuuuaucac

SEQ ID NO: 483647 - RNA, 63 nt, hsa
acuccuugaaguguugcaagggaaccuccuagcacugugaaagucagaaucgccucagcauuu

SEQ ID NO: 483648 - RNA, 63 nt, hsa
uagacugaucacucagaaauuaaaguccguuuuacugugaauauagcaauauaguacuggaca

SEQ ID NO: 483649 - RNA, 63 nt, hsa
caucuuugggacaccucagaaaacuuauuaacaacugugaauaugagaaauacagaagaaaau

SEQ ID NO: 483650 - RNA, 63 nt, hsa
auuucaaggccauauuuuaaaaaaucaaaaggcacugugaacuauuuugaagaaaacacaaca

SEQ ID NO: 483651 - RNA, 63 nt, hsa
uaguaaucauguuggcuggucuggucacaggugacugugaaacagaugcccuggucuugcuuu

SEQ ID NO: 483652 - RNA, 61 nt, hsa; identical to SEQ ID NO: 379771

SEQ ID NO: 483653 - RNA, 63 nt, hsa
aauuuauuucuuaagaaaaagcaucccucauuuacugugaacuaaaguucauucuguagugca

SEQ ID NO: 483654 - RNA, 63 nt, hsa
gugguuaaugaucagaagaugucuccugagccaacugugaaccucacccaggcaaaauggcua

SEQ ID NO: 483655 - RNA, 63 nt, hsa
ggagauacaauaucacaccccuuccccacaaggacugugaauauugggauuuauguccuugcc

SEQ ID NO: 483656 - RNA, 63 nt, hsa
gccuccccccaugguguuuucauaugagguacuacugugaaggaucugguuccucauucacug

SEQ ID NO: 483657 - RNA, 63 nt, hsa
cucagccuuuuccuccucaguuuucucuuuaaaacugugaaguacuaacuuuccaaggccugc

SEQ ID NO: 483658 - RNA, 63 nt, hsa
cagggcccacaucaucuaggcuccccagcccccacugugaaggggcuggccaggggcccgagc

SEQ ID NO: 483659 - RNA, 63 nt, hsa
gugcauuaggcuguaguucuaauauugaguucaacugugaaauccaucagaugugccaaaugg

SEQ ID NO: 483660 - RNA, 63 nt, hsa
ucuucacuggaaaacagggaggggggauuucagacugugaagaaaguugaauggugguuuuua

SEQ ID NO: 483661 - RNA, 63 nt, hsa
uaaacauaauuaaugauggagagaaaccauacaacugugaagaauguggcaaagcuuuuaacc

SEQ ID NO: 483662 - RNA, 63 nt, hsa
cauuuauauuugagaaaaauuguagaaauauagacugugaaaaagacgucaauaucugcucac

SEQ ID NO: 483663 - RNA, 63 nt, hsa
caauuauucugaugcugggacaggugagaagaaacugugaaguauaugagccuuugaaaguuc

SEQ ID NO: 483664 - RNA, 63 nt, hsa
agcauucaacagagaacucugucuuaagcuucaacugugaaaaugaugacgggcuuguagcac

SEQ ID NO: 483665 - RNA, 63 nt, hsa
uuuauacuugagaaauauuguacaaauauaaagacugugaaaaagccauuaauacaugcucac

SEQ ID NO: 483666 - RNA, 63 nt, hsa
auaaaaaaauucauacuggagggaacuccugugacugugaagaauauggcaaagccuuuaaua

SEQ ID NO: 483667 - RNA, 63 nt, hsa
aggguagcaccgugagaaaugggcuguauugauacugugaauguuuguuuuccaagcuguuuu

SEQ ID NO: 483668 - RNA, 63 nt, hsa
ugucacaaaaaggaggugccccccugugcugucacugugaauggaaaggaugggucaccucuc

SEQ ID NO: 483669 - RNA, 63 nt, hsa
gcaaugccuguggcuucagucaauugucuugagacugugaagaggcugaaagacaccuucccg

SEQ ID NO: 483670 - RNA, 63 nt, hsa
cccuucuccuuugaaugcuguuuugugaaagaaacugugaauguaauggaaacguaggagcau

SEQ ID NO: 483671 - RNA, 63 nt, hsa
gcuggcccguugguuuucugagcagggggcugaacugugaacaagucagacaaauaaagcaag

SEQ ID NO: 483672 - RNA, 63 nt, hsa
ugauaaagaacuuagucaucccuuccaccuccuacugugaagaacagacccugggucccacac

SEQ ID NO: 483673 - RNA, 64 nt, hsa; identical to SEQ ID NO: 110800

SEQ ID NO: 483674 - RNA, 64 nt, hsa; identical to SEQ ID NO: 110801

SEQ ID NO: 483675 - RNA, 64 nt, hsa; identical to SEQ ID NO: 110802

SEQ ID NO: 483676 - RNA, 64 nt, hsa; identical to SEQ ID NO: 110803

SEQ ID NO: 483677 - RNA, 64 nt, hsa; identical to SEQ ID NO: 110804

SEQ ID NO: 483678 - RNA, 64 nt, hsa; identical to SEQ ID NO: 110805

SEQ ID NO: 483679 - RNA, 64 nt, hsa; identical to SEQ ID NO: 110806

SEQ ID NO: 483680 - RNA, 64 nt, hsa; identical to SEQ ID NO: 110807

SEQ ID NO: 483681 - RNA, 64 nt, hsa; identical to SEQ ID NO: 110808

SEQ ID NO: 483682 - RNA, 64 nt, hsa; identical to SEQ ID NO: 110809

SEQ ID NO: 483683 - RNA, 64 nt, hsa; identical to SEQ ID NO: 110810

SEQ ID NO: 483684 - RNA, 64 nt, hsa; identical to SEQ ID NO: 110811

SEQ ID NO: 483685 - RNA, 64 nt, hsa
auauauuugaaauugcuuuggacaaguuuucuaggcuaucuaccagguagcucauuaaacguaa

SEQ ID NO: 483686 - RNA, 64 nt, hsa
uucugaguaaauuugcugaaaauauaagagagaagcuaucuaauaccuuggagguaggucaucc

SEQ ID NO: 483687 - RNA, 64 nt, hsa
gaugcuauggucagguuauacuccuccucccccagcuaucuauauggaauugcuuaccaaagga

SEQ ID NO: 483688 - RNA, 64 nt, hsa
ccuaaccucuuuucugcaucaucuguagauacuagcuaucuagguggaguugaaagaguuaaga

SEQ ID NO: 483689 - RNA, 64 nt, hsa
ccaaggaacuaggaagcagccaugggagaggggaaggguucaagcccgggaugggcccgcguga

SEQ ID NO: 483690 - RNA, 64 nt, hsa
gcggcccccuugcccaaccucggguuuagggaggaggguucacaguguuuuugugggggcgggg

SEQ ID NO: 483691 - RNA, 64 nt, hsa
aaugacuauuuacaccucaaaauauauucagcaaaggguucacuuaguugccccucaugcuuca

SEQ ID NO: 483692 - RNA, 64 nt, hsa
augugacuacagaacucuaggugaaaaaucagguaggguucaaauuaaguagaacugcccuugc

SEQ ID NO: 483693 - RNA, 64 nt, hsa
gaagcagcaauuaauuagaucaacacuuuucuccaggguucaccaugcaggcaacauuaccuug

SEQ ID NO: 483694 - RNA, 64 nt, hsa
cguguaguuucugguaucguucgcuuguuuuaaaaggguucaaggacuaacgaacguuuuaaag

SEQ ID NO: 483695 - RNA, 64 nt, hsa
aaggaaguugcacuaauucucaacucugguugagaggguucauaaauuucaugaaaauaucucc

SEQ ID NO: 483696 - RNA, 64 nt, hsa
aaauguaaauuccaagagggcuuucacaguccacaggguucaaaugacuuggguaacagaaguu

SEQ ID NO: 483697 - RNA, 64 nt, hsa
caaaaugauauuuuuauuuuaggaggguuuaaauaggguucagagaucauaggaauauuaggag

SEQ ID NO: 483698 - RNA, 64 nt, hsa
uuauacaguguuucguucuaaaucuaugagguuuaggguucaaaaugauggaaggccgaagagc

SEQ ID NO: 483699 - RNA, 64 nt, hsa
caaaaagaaagaagugacuaggguucagagaaccaggguucaaagcccagggaugcaaagguug

SEQ ID NO: 483700 - RNA, 64 nt, hsa
agagcgagaccgucucaaaaagaaagaagugacuaggguucagagaaccaggguucaaagccca

SEQ ID NO: 483701 - RNA, 64 nt, hsa
uuaaguuacaagagaccacauccacccagggauuaggguucaaguagcagcugcuaacccuugc

SEQ ID NO: 483702 - RNA, 64 nt, hsa
uuuuuagggggaaugggaaacggacaccucauaaaggguucaaagaucaucaauuuuucugacu

SEQ ID NO: 483703 - RNA, 64 nt, hsa
agaagcaauuccaccaaacucauguuuucacaggaggguucaguguggagagcaaaaaagcuga

SEQ ID NO: 483704 - RNA, 64 nt, hsa
guuucuucuucgaggaaagccaagcuccucaaacaggguucaguccacguuguguuuucacacc

SEQ ID NO: 483705 - RNA, 64 nt, hsa; identical to SEQ ID NO: 86065

SEQ ID NO: 483706 - RNA, 64 nt, hsa; identical to SEQ ID NO: 86066

SEQ ID NO: 483707 - RNA, 64 nt, hsa; identical to SEQ ID NO: 86067

SEQ ID NO: 483708 - RNA, 64 nt, hsa; identical to SEQ ID NO: 86068

SEQ ID NO: 483709 - RNA, 64 nt, hsa; identical to SEQ ID NO: 86069

SEQ ID NO: 483710 - RNA, 64 nt, hsa; identical to SEQ ID NO: 86070

SEQ ID NO: 483711 - RNA, 64 nt, hsa; identical to SEQ ID NO: 86071

SEQ ID NO: 483712 - RNA, 64 nt, hsa; identical to SEQ ID NO: 86072

SEQ ID NO: 483713 - RNA, 64 nt, hsa; identical to SEQ ID NO: 86073

SEQ ID NO: 483714 - RNA, 64 nt, hsa; identical to SEQ ID NO: 86074

SEQ ID NO: 483715 - RNA, 64 nt, hsa; identical to SEQ ID NO: 86075

SEQ ID NO: 483716 - RNA, 64 nt, hsa; identical to SEQ ID NO: 86076

SEQ ID NO: 483717 - RNA, 64 nt, hsa; identical to SEQ ID NO: 86077

SEQ ID NO: 483718 - RNA, 64 nt, hsa; identical to SEQ ID NO: 86078

SEQ ID NO: 483719 - RNA, 64 nt, hsa; identical to SEQ ID NO: 86079

SEQ ID NO: 483720 - RNA, 64 nt, hsa; identical to SEQ ID NO: 86080

SEQ ID NO: 483721 - RNA, 64 nt, hsa; identical to SEQ ID NO: 86081

SEQ ID NO: 483722 - RNA, 64 nt, hsa; identical to SEQ ID NO: 86082

SEQ ID NO: 483723 - RNA, 64 nt, hsa; identical to SEQ ID NO: 86083

SEQ ID NO: 483724 - RNA, 64 nt, hsa; identical to SEQ ID NO: 86084

SEQ ID NO: 483725 - RNA, 64 nt, hsa; identical to SEQ ID NO: 86085

SEQ ID NO: 483726 - RNA, 64 nt, hsa; identical to SEQ ID NO: 86086

SEQ ID NO: 483727 - RNA, 64 nt, hsa; identical to SEQ ID NO: 86087

SEQ ID NO: 483728 - RNA, 64 nt, hsa; identical to SEQ ID NO: 86088

SEQ ID NO: 483729 - RNA, 64 nt, hsa; identical to SEQ ID NO: 86089

SEQ ID NO: 483730 - RNA, 64 nt, hsa; identical to SEQ ID NO: 86090

SEQ ID NO: 483731 - RNA, 64 nt, hsa; identical to SEQ ID NO: 86091

SEQ ID NO: 483732 - RNA, 64 nt, hsa; identical to SEQ ID NO: 86092

SEQ ID NO: 483733 - RNA, 64 nt, hsa; identical to SEQ ID NO: 86093

SEQ ID NO: 483734 - RNA, 64 nt, hsa; identical to SEQ ID NO: 86094

SEQ ID NO: 483735 - RNA, 64 nt, hsa; identical to SEQ ID NO: 86095

SEQ ID NO: 483736 - RNA, 64 nt, hsa; identical to SEQ ID NO: 86096

SEQ ID NO: 483737 - RNA, 64 nt, hsa; identical to SEQ ID NO: 86097

SEQ ID NO: 483738 - RNA, 64 nt, hsa; identical to SEQ ID NO: 86098

SEQ ID NO: 483739 - RNA, 64 nt, hsa; identical to SEQ ID NO: 86099

SEQ ID NO: 483740 - RNA, 64 nt, hsa; identical to SEQ ID NO: 86100

SEQ ID NO: 483741 - RNA, 64 nt, hsa; identical to SEQ ID NO: 86101

SEQ ID NO: 483742 - RNA, 64 nt, hsa; identical to SEQ ID NO: 86102

SEQ ID NO: 483743 - RNA, 64 nt, hsa; identical to SEQ ID NO: 86103

SEQ ID NO: 483744 - RNA, 64 nt, hsa; identical to SEQ ID NO: 86104

SEQ ID NO: 483745 - RNA, 64 nt, hsa; identical to SEQ ID NO: 86105

SEQ ID NO: 483746 - RNA, 64 nt, hsa; identical to SEQ ID NO: 86106

SEQ ID NO: 483747 - RNA, 64 nt, hsa; identical to SEQ ID NO: 86107

SEQ ID NO: 483748 - RNA, 64 nt, hsa; identical to SEQ ID NO: 86108

SEQ ID NO: 483749 - RNA, 64 nt, hsa; identical to SEQ ID NO: 86109

SEQ ID NO: 483750 - RNA, 64 nt, hsa; identical to SEQ ID NO: 86110

SEQ ID NO: 483751 - RNA, 64 nt, hsa; identical to SEQ ID NO: 86111

SEQ ID NO: 483752 - RNA, 64 nt, hsa; identical to SEQ ID NO: 86112

SEQ ID NO: 483753 - RNA, 64 nt, hsa; identical to SEQ ID NO: 86113

SEQ ID NO: 483754 - RNA, 64 nt, hsa; identical to SEQ ID NO: 86114

SEQ ID NO: 483755 - RNA, 64 nt, hsa; identical to SEQ ID NO: 86115

SEQ ID NO: 483756 - RNA, 64 nt, hsa; identical to SEQ ID NO: 86116

SEQ ID NO: 483757 - RNA, 64 nt, hsa; identical to SEQ ID NO: 86117

SEQ ID NO: 483758 - RNA, 64 nt, hsa; identical to SEQ ID NO: 86118

SEQ ID NO: 483759 - RNA, 64 nt, hsa; identical to SEQ ID NO: 86119

SEQ ID NO: 483760 - RNA, 64 nt, hsa; identical to SEQ ID NO: 86120

SEQ ID NO: 483761 - RNA, 64 nt, hsa; identical to SEQ ID NO: 86121

SEQ ID NO: 483762 - RNA, 64 nt, hsa; identical to SEQ ID NO: 86122

SEQ ID NO: 483763 - RNA, 64 nt, hsa; identical to SEQ ID NO: 86123

SEQ ID NO: 483764 - RNA, 64 nt, hsa; identical to SEQ ID NO: 86124

SEQ ID NO: 483765 - RNA, 64 nt, hsa; identical to SEQ ID NO: 120972

SEQ ID NO: 483766 - RNA, 64 nt, hsa; identical to SEQ ID NO: 120973

SEQ ID NO: 483767 - RNA, 64 nt, hsa; identical to SEQ ID NO: 120974

SEQ ID NO: 483768 - RNA, 64 nt, hsa; identical to SEQ ID NO: 120975

SEQ ID NO: 483769 - RNA, 64 nt, hsa; identical to SEQ ID NO: 120976

SEQ ID NO: 483770 - RNA, 64 nt, hsa; identical to SEQ ID NO: 120977

SEQ ID NO: 483771 - RNA, 64 nt, hsa; identical to SEQ ID NO: 120978

SEQ ID NO: 483772 - RNA, 64 nt, hsa; identical to SEQ ID NO: 120979

SEQ ID NO: 483773 - RNA, 64 nt, hsa; identical to SEQ ID NO: 120980

SEQ ID NO: 483774 - RNA, 64 nt, hsa; identical to SEQ ID NO: 120981

SEQ ID NO: 483775 - RNA, 64 nt, hsa; identical to SEQ ID NO: 120982

SEQ ID NO: 483776 - RNA, 64 nt, hsa; identical to SEQ ID NO: 120983

SEQ ID NO: 483777 - RNA, 64 nt, hsa; identical to SEQ ID NO: 120984

SEQ ID NO: 483778 - RNA, 64 nt, hsa; identical to SEQ ID NO: 120985

SEQ ID NO: 483779 - RNA, 64 nt, hsa; identical to SEQ ID NO: 120986

SEQ ID NO: 483780 - RNA, 64 nt, hsa; identical to SEQ ID NO: 120987

SEQ ID NO: 483781 - RNA, 64 nt, hsa; identical to SEQ ID NO: 120988

SEQ ID NO: 483782 - RNA, 64 nt, hsa; identical to SEQ ID NO: 120989

SEQ ID NO: 483783 - RNA, 64 nt, hsa; identical to SEQ ID NO: 120990

SEQ ID NO: 483784 - RNA, 64 nt, hsa; identical to SEQ ID NO: 120991

SEQ ID NO: 483785 - RNA, 64 nt, hsa
uuucauuucaaauauguuuuaauguaucucuaaugcauuugaagacuuauuacauggcuuacuu

SEQ ID NO: 483786 - RNA, 64 nt, hsa
agcugguuuagauacauuagcugcaauuuuuuuugcauuugacacaauauuguaauaauccaug

SEQ ID NO: 483787 - RNA, 64 nt, hsa
gccaucuguugaucaggaacuacuucagcuacuugcauuugauuauuuccuuuuuuuuuuuuuu

SEQ ID NO: 483788 - RNA, 64 nt, hsa
cuuaacuuuaaccaauauuuucuucuguuuugcugcauuugaaagguaacaguggagcuagggc

SEQ ID NO: 483789 - RNA, 64 nt, hsa
aacaaagaaugcuugcauuugauuaguuucaccagcauuugagagaaggacccuuuagcucugu

SEQ ID NO: 483790 - RNA, 64 nt, hsa
uugaaaaauuauuagcauguaacaaagaaugcuugcauuugauuaguuucaccagcauuugaga

SEQ ID NO: 483791 - RNA, 64 nt, hsa
gcaaagagauuguucugaagaccgugcucuaagggcauuugaaagacugccagguagugcgagc

SEQ ID NO: 483792 - RNA, 64 nt, hsa
uucaggggugggagaaacuccuuuccuucagcuggcauuugaauguuuccaaaucuauuuuauc

SEQ ID NO: 483793 - RNA, 64 nt, hsa
auauauuuguaucucuacagaaaggcucuaaaaagcauuugaggaaaauauuugguucccuuuu

SEQ ID NO: 483794 - RNA, 64 nt, hsa
ugcuauuguacgguuucaugcauuuuuuuaaagggcauuugaggggaggauuauugcuaugaau

SEQ ID NO: 483795 - RNA, 64 nt, hsa
gaaaaggauaagccaagauggcuguaaacacagagcauuugagcugccacucuuggagcacauu

SEQ ID NO: 483796 - RNA, 64 nt, hsa
acuccggcggucugaggccauggaggugguugcugcauuugagagggaguagggggcuagaugu

SEQ ID NO: 483797 - RNA, 64 nt, hsa
ggggcaguggugguuuucuguucuuucuggcuaugcauuugaaaauuuugauguuuuaaggaug

SEQ ID NO: 483798 - RNA, 64 nt, hsa
auuuccguuaaaauaccagccaguaaaugggggugcauuugaggucuguucuuuccaaaguaca

SEQ ID NO: 483799 - RNA, 64 nt, hsa
ucuuuaaauuaggauugcaaaccaaggaaagaacgcauuugagauuuuaagaugucacuuauaa

SEQ ID NO: 483800 - RNA, 64 nt, hsa
aacagauuuugaagaaauccuguaagaugauaaagcauuugaaugguacaguagauguaaaaaa

SEQ ID NO: 483801 - RNA, 64 nt, hsa
gauuugcaagaggaauugaucaguaucacuuuaaguccugcauuuaauuggcagcacaagaucc

SEQ ID NO: 483802 - RNA, 64 nt, hsa
gaaugggucaggagaccgcugcuucugggcauaaguccugcaaggaaagcaacauggaaaacag

SEQ ID NO: 483803 - RNA, 64 nt, hsa; identical to SEQ ID NO: 154299

SEQ ID NO: 483804 - RNA, 64 nt, hsa; identical to SEQ ID NO: 154300

SEQ ID NO: 483805 - RNA, 64 nt, hsa; identical to SEQ ID NO: 154301

SEQ ID NO: 483806 - RNA, 64 nt, hsa; identical to SEQ ID NO: 154302

SEQ ID NO: 483807 - RNA, 64 nt, hsa; identical to SEQ ID NO: 154303

SEQ ID NO: 483808 - RNA, 64 nt, hsa; identical to SEQ ID NO: 154304

SEQ ID NO: 483809 - RNA, 64 nt, hsa; identical to SEQ ID NO: 154305

SEQ ID NO: 483810 - RNA, 64 nt, hsa; identical to SEQ ID NO: 154306

SEQ ID NO: 483811 - RNA, 64 nt, hsa; identical to SEQ ID NO: 154307

SEQ ID NO: 483812 - RNA, 64 nt, hsa; identical to SEQ ID NO: 154308

SEQ ID NO: 483813 - RNA, 64 nt, hsa; identical to SEQ ID NO: 154309

SEQ ID NO: 483814 - RNA, 64 nt, hsa; identical to SEQ ID NO: 154310

SEQ ID NO: 483815 - RNA, 64 nt, hsa; identical to SEQ ID NO: 154311

SEQ ID NO: 483816 - RNA, 64 nt, hsa; identical to SEQ ID NO: 154312

SEQ ID NO: 483817 - RNA, 64 nt, hsa; identical to SEQ ID NO: 154313

SEQ ID NO: 483818 - RNA, 54 nt, hsa; identical to SEQ ID NO: 154314

SEQ ID NO: 483819 - RNA, 64 nt, hsa; identical to SEQ ID NO: 154315

SEQ ID NO: 483820 - RNA, 64 nt, hsa; identical to SEQ ID NO: 154316

SEQ ID NO: 483821 - RNA, 64 nt, hsa; identical to SEQ ID NO: 154317

SEQ ID NO: 483822 - RNA, 64 nt, hsa; identical to SEQ ID NO: 154318

SEQ ID NO: 483823 - RNA, 64 nt, hsa; identical to SEQ ID NO: 154319

SEQ ID NO: 483824 - RNA, 64 nt, hsa; identical to SEQ ID NO: 154320

SEQ ID NO: 483825 - RNA, 64 nt, hsa; identical to SEQ ID NO: 154321

SEQ ID NO: 483826 - RNA, 64 nt, hsa; identical to SEQ ID NO: 154322

SEQ ID NO: 483827 - RNA, 64 nt, hsa; identical to SEQ ID NO: 154323

SEQ ID NO: 483828 - RNA, 64 nt, hsa; identical to SEQ ID NO: 154324

SEQ ID NO: 483829 - RNA, 64 nt, hsa; identical to SEQ ID NO: 154325

SEQ ID NO: 483830 - RNA, 64 nt, hsa; identical to SEQ ID NO: 154326

SEQ ID NO: 483831 - RNA, 64 nt, hsa; identical to SEQ ID NO: 154327

SEQ ID NO: 483832 - RNA, 64 nt, hsa; identical to SEQ ID NO: 154328

SEQ ID NO: 483833 - RNA, 64 nt, hsa; identical to SEQ ID NO: 154329

SEQ ID NO: 483834 - RNA, 64 nt, hsa; identical to SEQ ID NO: 154330

SEQ ID NO: 483835 - RNA, 64 nt, hsa; identical to SEQ ID NO: 154331

SEQ ID NO: 483836 - RNA, 64 nt, hsa; identical to SEQ ID NO: 154332

SEQ ID NO: 483837 - RNA, 64 nt, hsa; identical to SEQ ID NO: 154333

SEQ ID NO: 483838 - RNA, 64 nt, hsa; identical to SEQ ID NO: 154334

SEQ ID NO: 483839 - RNA, 64 nt, hsa; identical to SEQ ID NO: 154335

SEQ ID NO: 483840 - RNA, 64 nt, hsa; identical to SEQ ID NO: 154336

SEQ ID NO: 483841 - RNA, 64 nt, hsa; identical to SEQ ID NO: 154337

SEQ ID NO: 483842 - RNA, 64 nt, hsa; identical to SEQ ID NO: 154338

SEQ ID NO: 483843 - RNA, 64 nt, hsa; identical to SEQ ID NO: 154339

SEQ ID NO: 483844 - RNA, 64 nt, hsa; identical to SEQ ID NO: 154340

SEQ ID NO: 483845 - RNA, 64 nt, hsa; identical to SEQ ID NO: 154341

SEQ ID NO: 483846 - RNA, 64 nt, hsa; identical to SEQ ID NO: 154342

SEQ ID NO: 483847 - RNA, 64 nt, hsa; identical to SEQ ID NO: 154343

SEQ ID NO: 483848 - RNA, 64 nt, hsa; identical to SEQ ID NO: 154344

SEQ ID NO: 483849 - RNA, 64 nt, hsa; identical to SEQ ID NO: 154345

SEQ ID NO: 483850 - RNA, 55 nt, hsa; identical to SEQ ID NO: 154346

SEQ ID NO: 483851 - RNA, 64 nt, hsa; identical to SEQ ID NO: 154347

SEQ ID NO: 483852 - RNA, 64 nt, hsa; identical to SEQ ID NO: 154348

SEQ ID NO: 483853 - RNA, 64 nt, hsa; identical to SEQ ID NO: 154349

SEQ ID NO: 483854 - RNA, 64 nt, hsa; identical to SEQ ID NO: 154350

SEQ ID NO: 483855 - RNA, 64 nt, hsa; identical to SEQ ID NO: 154351

SEQ ID NO: 483856 - RNA, 64 nt, hsa; identical to SEQ ID NO: 154352

SEQ ID NO: 483857 - RNA, 64 nt, hsa; identical to SEQ ID NO: 154353

SEQ ID NO: 483858 - RNA, 64 nt, hsa; identical to SEQ ID NO: 154354

SEQ ID NO: 483859 - RNA, 64 nt, hsa; identical to SEQ ID NO: 154355

SEQ ID NO: 483860 - RNA, 64 nt, hsa; identical to SEQ ID NO: 154356

SEQ ID NO: 483861 - RNA, 64 nt, hsa
auuucagggaaaugaagauggaauuugaaggucacuuuuaaaauuaagucauugaugcugcugu

SEQ ID NO: 483862 - RNA, 64 nt, hsa
uugacuuaggucuuucaguuuuccuuucgguucccuuuuaaaaaugugauuguuaaccugccuc

SEQ ID NO: 483863 - RNA, 64 nt, hsa
aucuucaaagguucaugcucaauauugugaaaagcuuuuaaaaguuguuuugaaaagacaauca

SEQ ID NO: 483864 - RNA, 64 nt, hsa
cuuaauauaugcagaccaacaggucuuugcauuccuuuuaaauaacugguugugacaaagcuug

SEQ ID NO: 483865 - RNA, 64 nt, hsa
gauuuuccucaucucuuuauagcuuucccaaaaucuuuuaaaaaagaauuuaauuaaaugacag

SEQ ID NO: 483866 - RNA, 64 nt, hsa
caaaugggguaacgauauuuucugcauagauuuucuuuuaaauugguucuuuguuucugaagaa

SEQ ID NO: 483867 - RNA, 64 nt, hsa
ugaaagaguucaguucuguaguaucugaauuugucuuuuaaaaugaguacauauauaggcaaua

SEQ ID NO: 483868 - RNA, 64 nt, hsa
uuaaguaauuaaauuccuaugucaguugccaaaucuuuuaaacuuauguauucaccaagcccaa

SEQ ID NO: 483869 - RNA, 64 nt, hsa
auauuuugucucucugacuugauuucuauaaaugcuuuuaaaaacaagugaagccccucuuuau

SEQ ID NO: 483870 - RNA, 64 nt, hsa
gugagaggagucaagccaauauuaaauaugcauucuuuuaaaguaugugcaaucacuuuuagaa

SEQ ID NO: 483871 - RNA, 64 nt, hsa
guaggggagccuccuucuagauguaggcauuuggcuuuuaaaggggaacucagcucugauucug

SEQ ID NO: 483872 - RNA, 64 nt, hsa
aucaggguuaaaagcugcacugaccaaagcuguacuuuuaaaacacaaccccugggcuagugau

SEQ ID NO: 483873 - RNA, 64 nt, hsa
uagcacaguaucaguaccauuuauuugucugccgcuuuuaaaaaauacccauuggcuaugccac

SEQ ID NO: 483874 - RNA, 64 nt, hsa
ucccauuuucugaauuuuuuuuuaaauuuccccccuuuuaaaauuguucgaaagcccacaguua

SEQ ID NO: 483875 - RNA, 64 nt, hsa
uguuuccuuuuauuuuauagagcagaacccuagucuuuuaaacaguuuagagugaaauauaugc

SEQ ID NO: 483876 - RNA, 64 nt, hsa
ucagaauauacuaaauuaacuuuuuaaaacacaacuuuuaaaaaauguaucaaaauaauaaacg

SEQ ID NO: 483877 - RNA, 64 nt, hsa
cuacuccagccugagcgacagaguaagaccuuaucuuuuaaaaaagaaaagaaaaauuuaaacg

SEQ ID NO: 483878 - RNA, 64 nt, hsa
auucgugaaugucauauaguagucuuaaguuucucuuuuaaagcugcaugagcuagaauuuguu

SEQ ID NO: 483879 - RNA, 64 nt, hsa
guaauagacaucuaaaauuccacuccucauagagcuuuuaaaaugguuucauuggauauaggcc

SEQ ID NO: 483880 - RNA, 58 nt, hsa
uugcucauucugaaauuuaagcauuuuucuuuuaaaagacaaguguaauagacaucua

SEQ ID NO: 483881 - RNA, 64 nt, hsa
uuuaccuuauuaaaaugaaaagugccauacuuaacuuuuaaaggaaagaccugacuugcuuuuu

SEQ ID NO: 483882 - RNA, 64 nt, hsa
aaauuuuguacaaucuguccuggaaagcaaaccccuuuuaaaaucuaaugucugggcuuugagu

SEQ ID NO: 483883 - RNA, 64 nt, hsa
aguuuuauuaugcaguuaaaucuguaucaguggacuuuuaaaacuugguacuacuacuaaaucu

SEQ ID NO: 483884 - RNA, 64 nt, hsa
auacuaauucauuuuaucacuuucauugguaaaacuuuuaaauucaacaccugaaaaucaugag

SEQ ID NO: 483885 - RNA, 64 nt, hsa
cccugaagggcauaccuaaccucaauaguguuggcuuuuaaaacguauguuuguaugguagaga

SEQ ID NO: 483886 - RNA, 64 nt, hsa
aaaggguugaguaacuuagaacugaaaaugaucucuuuuaaaaagaaauuaaaucagacaccac

SEQ ID NO: 483887 - RNA, 64 nt, hsa
uuuuuuaaaauuaaguaauuuuuuaaagaaggcacuuuuaaaauuaacacacacaugaacugca

SEQ ID NO: 483888 - RNA, 64 nt, hsa
uauucuuuguaaaauucucccucaccccacccugcuuuuaaaaauucuaaucuauccccucuaa

SEQ ID NO: 483889 - RNA, 64 nt, hsa
ugucucauuagccugaaugugccauaagacugaccuuuuaaaauguuuugagggaucuguggau

SEQ ID NO: 483890 - RNA, 64 nt, hsa
cucuuaagaagauuaaaagagaaaaaaaaaggcccuuuuaaaaauaguauacacuuauuuuaag

SEQ ID NO: 483891 - RNA, 64 nt, hsa
guauaaaccuuuuuagugugacuguuaaaacuuccuuuuaaaucaaaaugccaaauuuauuaag

SEQ ID NO: 483892 - RNA, 64 nt, hsa
gagguacuguuagucuguuagucuuucaaauugacuuuuaaaaauacauaucuuuaugauuuuc

SEQ ID NO: 483893 - RNA, 64 nt, hsa
uuggaugguuauaugcuaaugguagagaugauagcuuuuaaauuuguggggcugcuauuuucuu

SEQ ID NO: 483894 - RNA, 64 nt, hsa
cuugaaaaaagccuuuugacaacauacaggcauucuuuuaaaaccaggcugaaacauuuuauuu

SEQ ID NO: 483895 - RNA, 64 nt, hsa
caguguuaaugaauaucaugccucagcacugucacuuuuaaaaccugucaggaucccacuguaa

SEQ ID NO: 483896 - RNA, 64 nt, hsa
ucuaauccucccuuuuuugauuuaguuggaugugcuuuuaaauguccuuugccugcaugaggug

SEQ ID NO: 483897 - RNA, 64 nt, hsa
agcuagcauacacuaccucuuaccugagaggugucuuuuaaaaacaaaucuuggcagcuguccu

SEQ ID NO: 483898 - RNA, 64 nt, hsa
ugucauucaaaaaugaguuaaguaacaugauaaucuuuuaaauuuaccuagcuacaacuuuuau

SEQ ID NO: 483899 - RNA, 64 nt, hsa
uuuuaaaguaaguuauauuggaugugaaaaacaccuuuuaaaguccaagacuuuacuacuuaaa

SEQ ID NO: 483900 - RNA, 64 nt, hsa
uaaaaaguguguuugguuauuaauauauaugagacuuuuaaagaaaguuauauaacuacauaga

SEQ ID NO: 483901 - RNA, 64 nt, hsa
uuacuuaaaguagcaaagucauggauuguauugacuuuuaaaaauauaguaaaagucauauuua

SEQ ID NO: 483902 - RNA, 64 nt, hsa
aagagagaaugagaacuaagugaaaagggaaacccuuuuaaaaccaucagauaucgugagacuu

SEQ ID NO: 483903 - RNA, 64 nt, hsa
uuaaaaacuaaggaugauggauugcaaaacaguucuuuuaaauuaguuuauaugcuuuaggugu

SEQ ID NO: 483904 - RNA, 64 nt, hsa
uuaacuagucauuugacuggaaaaaaauaaaauacuuuuaaauggacaugguuuuauuuuuaau

SEQ ID NO: 483905 - RNA, 64 nt, hsa
gauauuuaucacaaucauccucauuauggaagaccuuuuaaagcauuguuuuagaaugucugag

SEQ ID NO: 483906 - RNA, 64 nt, hsa
auaaugccuacuacuccgacuuuuauagaagcuacuuuuaaaucagaauauuuaauuuuugaua

SEQ ID NO: 483907 - RNA, 64 nt, hsa
cccuucuuuugaaaauaaacugagucaauuuagccuuuuaaaaauauagucaucucuuuuaaau

SEQ ID NO: 483908 - RNA, 64 nt, hsa
gagucaauuuagccuuuuaaaaauauagucaucucuuuuaaauagaauccucuuccaccaucaa

SEQ ID NO: 483909 - RNA, 64 nt, hsa
gaaaaaagucucuccccaagggcagccuuuguuacuuuuaaauauuuucuguuauuacaagugc

SEQ ID NO: 483910 - RNA, 64 nt, hsa
uauuuucuguuauuacaagugcucuaauugugaacuuuuaaauaaaauacuauuaagagguaau

SEQ ID NO: 483911 - RNA, 64 nt, hsa
agugauggaaagucugguauuaaaaccucucuuacuuuuaaacuugauuuugcagacucuggca

SEQ ID NO: 483912 - RNA, 64 nt, hsa
ucaaaaagcuuuaaauaaauucuugggcauuuaucuuuuaaaacuucacuaauauagcauugug

SEQ ID NO: 483913 - RNA, 64 nt, hsa
ugaaguuuuuuuauauauuugugguagccuccaucuuuuaaacuuuuugaacucaguagaaaaa

SEQ ID NO: 483914 - RNA, 64 nt, hsa
ugagcacuaugauuaucaaggugacuuuggaaaccuuuuaaaaaugcauuuuugcaaaacaaga

SEQ ID NO: 483915 - RNA, 64 nt, hsa
gcaagaacagaaguguucacauggcucucauguacuuuuaaauuauacaaugauauccaauauu

SEQ ID NO: 483916 - RNA, 64 nt, hsa
cuccuuugauuagagaccagaucagauaauuaugcuuuuaaacugauuacguuuacauucuucu

SEQ ID NO: 483917 - RNA, 64 nt, hsa
uucuccauucauauuuuuaugaguagaaucugggcuuuuaaauuucucuucuuauucuuugaag

SEQ ID NO: 483918 - RNA, 64 nt, hsa
auggggucugugggcuaguuaaaauagaaauaaacuuuuaaaauauccacagaauugauauugu

SEQ ID NO: 483919 - RNA, 64 nt, hsa
ucauugaauuguagguuuccuuuuuuuuucuuuacuuuuaaauuuuaacuuuuaaaaucuauuu

SEQ ID NO: 483920 - RNA, 64 nt, hsa
guuuccuuuuuuuuucuuuacuuuuaaauuuuaacuuuuaaaaucuauuucauuucuuaguuau

SEQ ID NO: 483921 - RNA, 64 nt, hsa
auuaacaaaaauugacaaaucuuccaagggacaucuuuuaaaacaagugcuucagauccagaaa

SEQ ID NO: 483922 - RNA, 64 nt, hsa
uacagaaggguuugacguuuuauugggcuuuugucuuuuaaagaauaugucuacuauggguauu

SEQ ID NO: 483923 - RNA, 64 nt, hsa
ugcacaagcugauuuuaagugauauucagauggccuuuuaaauuuaauuauuauguauuuaaaa

SEQ ID NO: 483924 - RNA, 64 nt, hsa
aagugauaugaacugugauaaugcagaagguuuccuuuuaaaauaaaguucagucaaaaaagug

SEQ ID NO: 483925 - RNA, 64 nt, hsa
uuuuugguuggcaguaaccgauuuuaaugacuagcuuuuaaaaauacaguacaaagacuuugua

SEQ ID NO: 483926 - RNA, 64 nt, hsa
gaaaggagucuuuaucuuggggagcaaaagcugacuuuuaaacuugaccccugcuguuuuuaaa

SEQ ID NO: 483927 - RNA, 64 nt, hsa
augaaaugugcguguugauagcaauaauuuguuucuuuuaaagauucuaaaaggucugagaccu

SEQ ID NO: 483928 - RNA, 64 nt, hsa
cuuaaagaauuugcauccauuuuugagucuaaaucuuuuaaaauauacugagauccacaucuag

SEQ ID NO: 483929 - RNA, 64 nt, hsa
ggucuaaaauacuacauugucacuguaagcuauacuuuuaaaauauuuauuuuuuuuaaaguau

SEQ ID NO: 483930 - RNA, 64 nt, hsa
uguuuaugaagagaguugaguuuaacaauccuagcuuuuaaaagaaacuauuuaauguaaaaua

SEQ ID NO: 483931 - RNA, 64 nt, hsa
ugcaaaaucuaagaguugggugguuauuaaaaugcuuuuaaagucaacuguggcaccaauucua

SEQ ID NO: 483932 - RNA, 64 nt, hsa
aucuguaauuuauuagcuaacaauguaaaaccaucuuuuaaagccuucagacugucaagacgac

SEQ ID NO: 483933 - RNA, 64 nt, hsa
uauuucauucccaauuuguguguguugggggguacuuuuaaaggugacuauuguuuuguacauc

SEQ ID NO: 483934 - RNA, 64 nt, hsa
auucauaauguuaggaagaugauaaaaauucgcucuuuuaaagugcagcuuauuauucucaauu

SEQ ID NO: 483935 - RNA, 64 nt, hsa
uuuuaaaaaaugcuaauaagaaaauuggaagauucuuuuaaaaauuuuucuuuuuuguuguugu

SEQ ID NO: 483936 - RNA, 64 nt, hsa
agacuucggaaaauuaagucagagaugguauuaccuuuuaaaaaaugcuaauaagaaaauugga

SEQ ID NO: 483937 - RNA, 64 nt, hsa
ugauuaaaauggaauaaagaaagagcagcugccacuuuuaaacaacauaaaggaauaucuuuuu

SEQ ID NO: 483938 - RNA, 64 nt, hsa
gagugaaucaguuucuuguuuauauuuuuuucaccuuuuaaacaaaaaauucuuuaaaauauuu

SEQ ID NO: 483939 - RNA, 64 nt, hsa
caucuauuuuguguacuuguacacaguguacauucuuuuaaauuauaucguguauauagcuuua

SEQ ID NO: 483940 - RNA, 64 nt, hsa
aucauguaggccauuuuuauauuugaaauuuguccuuuuaaagauaguuuugcuguugcuccua

SEQ ID NO: 483941 - RNA, 64 nt, hsa
accagcucagugcugguuuacggaacaacucuuacuuuuaaaaauuacuuguucccccaaauug

SEQ ID NO: 483942 - RNA, 64 nt, hsa
auuaauuccaucugagugauugucaguguaaggccuuuuaaaacaaaagcaaguucuuuguuag

SEQ ID NO: 483943 - RNA, 64 nt, hsa
uuugacuuacaacacacuucucuaacaucuagcccuuuuaaauuuuuaauuaauuucaaagcuu

SEQ ID NO: 483944 - RNA, 64 nt, hsa
cuuuugccuuagugugaaaauguaacauuuuaugcuuuuaaaaucaauagauucaucaccuuag

SEQ ID NO: 483945 - RNA, 64 nt, hsa
gaaugcauucauuuuuuggacauugcuuacuuaucuuuuaaauguuucuuuuauuacaaagccu

SEQ ID NO: 483946 - RNA, 64 nt, hsa
auguuucuuuuauuacaaagccuauuuugaguagcuuuuaaaacugaauuuccuuuaauugguu

SEQ ID NO: 483947 - RNA, 64 nt, hsa
auguauuuuaaaauaaggggaagagucauuuucacuuuuaaacuacuauuuuucuuuccaaguc

SEQ ID NO: 483948 - RNA, 64 nt, hsa
uguaauaaucauuuuagaauuaaaauuuauucuacuuuuaaauaaauuaugaauauuaaaggug

SEQ ID NO: 483949 - RNA, 64 nt, hsa
gugauuuuuaguaaccuuuaaaaauguauaaugacuuuuaaaauuuguagaauugaaaagacgc

SEQ ID NO: 483950 - RNA, 64 nt, hsa
accaacauuuauaccugaccagauggcuaaagugcuuuuaaaguuuuguuuaaguagagcugga

SEQ ID NO: 483951 - RNA, 64 nt, hsa
cagauucuuuauuuucccaaacacuacaaaaaaacuuuuaaaacuuugccauuucaucuguuua

SEQ ID NO: 483952 - RNA, 64 nt, hsa
auuucuauuuuuuuauugucuaaguggguugggacuuuuaaauacugagccugguugauguguu

SEQ ID NO: 483953 - RNA, 64 nt, hsa
aagaauuuaugggagccuauauaaacauaucuugcuuuuaaaaaguucuugagggaauagcaac

SEQ ID NO: 483954 - RNA, 64 nt, hsa
gcaacuuucccauggcugugccuauuuccuagaccuuuuaaaagaugugcagagcagcuuagca

SEQ ID NO: 483955 - RNA, 64 nt, hsa
gguauuuuuaaauuguuuuuaaucuuuuuuggugcuuuuaaacauguuuagcaaaaaccaauuc

SEQ ID NO: 483956 - RNA, 64 nt, hsa
cuagaaaguaugguuuaacuggacccuauuaugccuuuuaaaaauaauuucaguaacccauaaa

SEQ ID NO: 483957 - RNA, 64 nt, hsa
guaaauauuaauaaauggauacacauucaaaauacuuuuaaaaaaaagaaaauguuaccaguuu

SEQ ID NO: 483958 - RNA, 64 nt, hsa
ugguugaauuuuuggauauauuauguugauuuaacuuuuaaaauguuguuuaaaagugugaagc

SEQ ID NO: 483959 - RNA, 64 nt, hsa
uuuaauuguguaguuuccauuucuuagcuuuugccuuuuaaauuuauacuucagccaggcauag

SEQ ID NO: 483960 - RNA, 64 nt, hsa
cuguacuccagacuggauaacagcaagagcccaucuuuuaaaaaaaguaaaaauuaaaaauaua

SEQ ID NO: 483961 - RNA, 64 nt, hsa
acugaaguuggcauguuucguaaaacuugcgugucuuuuaaaaauaauaaaaggaagaugagua

SEQ ID NO: 483962 - RNA, 64 nt, hsa
acuuaguuuuuucauuuaauaauucaaaccaacacuuuuaaaaaaauaauucagaugagacuga

SEQ ID NO: 483963 - RNA, 64 nt, hsa
uggcuuuuccauguuguuuuauuaccuuuucucacuuuuaaaacuaauacagacuuaucuccuc

SEQ ID NO: 483964 - RNA, 64 nt, hsa
augggcauuaucauuggauguuuccccacauuggcuuuuaaaauacccaucuugcuuucuuuuu

SEQ ID NO: 483965 - RNA, 64 nt, hsa
gcauugcugagcuuuuuagaugccuauuguguaucuuuuaaagguuuugaccauuuuguuauga

SEQ ID NO: 483966 - RNA, 64 nt, hsa
uuaagcuauuucaccuuuguuuggaaauccuucccuuuuaaagagaaaaugugacacuugugaa

SEQ ID NO: 483967 - RNA, 64 nt, hsa
uuaucuuuuuaguauggcaaacugccaucauuuacuuuuaaacuuugauuuuauaugcuauuua

SEQ ID NO: 483968 - RNA, 64 nt, hsa
ccucuuuguaauaggaaacuauaugggaugaacacuuuuaaacuuuccgacacaacuuccauua

SEQ ID NO: 483969 - RNA, 64 nt, hsa
ccaccucaguguuguuccuacauaaacagggccccuuuuaaacuuguauguggacugcuguuug

SEQ ID NO: 483970 - RNA, 64 nt, hsa
uguuaauacuucauaauaugugaaaaacucggaucuuuuaaaaagcaucauagaucauuuuucc

SEQ ID NO: 483971 - RNA, 64 nt, hsa
uagccuaaccuucaacauaaaauaaugaagagaacuuuuaaacuuuuuuaugaauuccuaaaca

SEQ ID NO: 483972 - RNA, 64 nt, hsa
caaagggauuaaagaccuaaauaugaagacaaaacuuuuaaaugagaaucuauaagguuauuuu

SEQ ID NO: 483973 - RNA, 64 nt, hsa
auauuugagagcugacuacaaacauuaaaucgcacuuuuaaagugagucauugaaauaaauagu

SEQ ID NO: 483974 - RNA, 64 nt, hsa
aauuuauuuuuauauggaauugcauaaugugugccuuuuaaaacaauaacaaaaaccagagaug

SEQ ID NO: 483975 - RNA, 64 nt, hsa
gcuaaauuagaauuucuaacucuuauauugugcucuuuuaaaugccaauuacagucccuuacug

SEQ ID NO: 483976 - RNA, 64 nt, hsa
ccuauuuaauuggguuccacugaaccucaugggacuuuuaaaagaagggcuauuuaaggaauuc

SEQ ID NO: 483977 - RNA, 64 nt, hsa
uuuaaggaauucacuugguaguacuuugcuuuagcuuuuaaauggcuugauuuuaaaggagaaa

SEQ ID NO: 483978 - RNA, 64 nt, hsa
aaacaacuuuauaagagaaacaguggucuucaaucuuuuaaagacaugaaauccuauauggcau

SEQ ID NO: 483979 - RNA, 64 nt, hsa
ccuuuuuggugagaagaaauaagacauuuucucccuuuuaaagaucaucucuucagagcugcau

SEQ ID NO: 483980 - RNA, 64 nt, hsa
cuucaaaaaauuauuuuaggcaaaguccauacuccuuuuaaaacaauauuuauguccuauguuu

SEQ ID NO: 483981 - RNA, 64 nt, hsa
guagcauucugugcgaaaaaguauugaagauuagcuuuuaaaaacugaaaaaaaaaaaugaaug

SEQ ID NO: 483982 - RNA, 64 nt, hsa
ugcugucuaauauucaaacauagaaagggagcugcuuuuaaagaauucccugcaaauacugaaa

SEQ ID NO: 483983 - RNA, 64 nt, hsa
uucuaauuggaauguucauuugccucuuuuuacucuuuuaaaugcuuguagguggcuuggggug

SEQ ID NO: 483984 - RNA, 64 nt, hsa
uugauguuaaguguuugauucagagaugucugcucuuuuaaauuauauauaaggaaaaaaaaua

SEQ ID NO: 483985 - RNA, 64 nt, hsa
gggggaagaaaaggaggaaccaauuaaauaggaccuuuuaaaaauuguuaauuuuguaaacuuu

SEQ ID NO: 483986 - RNA, 64 nt, hsa
auaugcacacauugcuacuuauuugauuauguaucuuuuaaauugauucagugcauagaaaacu

SEQ ID NO: 483987 - RNA, 64 nt, hsa
ggcgugagccaccgcacccggccuccauaucccccuuuuaaaauucuguaguguaugguaaguc

SEQ ID NO: 483988 - RNA, 64 nt, hsa
cacaauaauguaaaugcagagaaugaggaggcaucuuuuaaaagccuuaggauauucuauauga

SEQ ID NO: 483989 - RNA, 64 nt, hsa
acaccugcucuuuaugugaaaauguauaugaauccuuuuaaaaugauuaggauuauugaaaugu

SEQ ID NO: 483990 - RNA, 64 nt, hsa
uccccccagauuugggggacaaaauaaaauuaaucuuuuaaaaugugucagccauauguauggg

SEQ ID NO: 483991 - RNA, 64 nt, hsa
ggucaacagcaaaaugccugcaccaugacuguggcuuuuaaaauaaagaaauguguuuuuaucg

SEQ ID NO: 483992 - RNA, 64 nt, hsa
aauucaucauggauaaaaacuaagcgcuugccuucuuuuaaaaagaaaaacugaugauuagauu

SEQ ID NO: 483993 - RNA, 64 nt, hsa
caaagaacuagagaagaaaucuuaaauguucauucuuuuaaaucucgugauugguuaguccaua

SEQ ID NO: 483994 - RNA, 64 nt, hsa
auguguauuucuaauuauauaaaauauuaagaaucuuuuaaaaaaaucugugaaauuaacaugc

SEQ ID NO: 483995 - RNA, 64 nt, hsa
aaaaaaaagucagguacucuguuuuguaaaaguacuuuuaaauugccucagugauacaguauaa

SEQ ID NO: 483996 - RNA, 64 nt, hsa
gauccauaaacuuuuaaagaagccucaaaacauacuuuuaaagcauuaagcuuuaaagugcuag

SEQ ID NO: 483997 - RNA, 64 nt, hsa
ggcuccgacuccagcucugggcaagauccauaaacuuuuaaagaagccucaaaacauacuuuua

SEQ ID NO: 483998 - RNA, 64 nt, hsa
guacuucugugguuaauguauauuuuuauucuggcuuuuaaaaugggaauaauuuguauguauc

SEQ ID NO: 483999 - RNA, 64 nt, hsa
uaguuuuugaguuauuuauguaccagauauuauacuuuuaaauauuuuaauauucucugaucuu

SEQ ID NO: 484000 - RNA, 64 nt, hsa
agcaagaagaaaaacucagagaauauaaaaucaacuuuuaaaauugugugcucucuucuucacg

SEQ ID NO: 484001 - RNA, 64 nt, hsa
acuaaccgugacuacaacaaaaauucuugauugacuuuuaaaguuauuuccuggcauucuggua

SEQ ID NO: 484002 - RNA, 64 nt, hsa
uggugggguuaauauagcauguuauccugucuaucuuuuaaagauuucuguauaagacuguuga

SEQ ID NO: 484003 - RNA, 64 nt, hsa
uuaauuuuuuauauuuaaauguagacuuuugacacuuuuaaaaaacaaaaaaagacaagagaga

SEQ ID NO: 484004 - RNA, 64 nt, hsa
gagcugaucugcaucuguuuauccauuuuaguagcuuuuaaauaugauuuuaugugaagugcca

SEQ ID NO: 484005 - RNA, 64 nt, hsa
ggaaugagugugguaagaaauuuauaaaguuuugcuuuuaaaacguggacauaacucauuuuuc

SEQ ID NO: 484006 - RNA, 64 nt, hsa
uugauacaauagaagcugacuuuuaaggcauuggcuuuuaaauuaauacauauauccaaggaua

SEQ ID NO: 484007 - RNA, 64 nt, hsa
guuuuuaacuacucagacuuuugaggaauuaauccuuuuaaaacauuuuuguuaaaguuagugu

SEQ ID NO: 484008 - RNA, 64 nt, hsa
ucuccccagaggaacuuagggauuucaccccuggcuuuuaaaaaaaacgaaauaccgacaagcc

SEQ ID NO: 484009 - RNA, 64 nt, hsa
gcuucagagucaucucuguccugcccgggaugcacuuuuaaaugaagaguuagaauauuuuauu

SEQ ID NO: 484010 - RNA, 64 nt, hsa
uauauagaaaagcuacaaaguaaauugagcaaugcuuuuaaaguuaucuuuguuuuauagacuu

SEQ ID NO: 484011 - RNA, 64 nt, hsa
acaauuaaucuacaaagggaauuaauauuguugacuuuuaaaacaucugcuggauauauuauau

SEQ ID NO: 484012 - RNA, 64 nt, hsa
aguggguucuuuuuaauguuuauacuuagauuuucuuuuaaaaaaauuaaaauaaaacaaaaaa

SEQ ID NO: 484013 - RNA, 64 nt, hsa
ucuauucuuuuuuuugcauccaauugugccugaacuuuuaaaauauguaaaugcugccauguuc

SEQ ID NO: 484014 - RNA, 64 nt, hsa
guuuaaaaccacaaucuguaggcuuuaagaauugcuuuuaaaccuuuuuaagugauaaacucuu

SEQ ID NO: 484015 - RNA, 64 nt, hsa
guuauuuucauuaauaacuuuugcuaaaauuuaccuuuuaaaaguucugaaauuugggguuggu

SEQ ID NO: 484016 - RNA, 64 nt, hsa
agggauacagagauggaugccacuuaccucagaucuuuuaaaguggaaauccaaauugaauuuu

SEQ ID NO: 484017 - RNA, 64 nt, hsa
cauuuuuguccaguguuuuucuuuuuaagaugaacuuuuaaagaaccuugcgauuugcacauau

SEQ ID NO: 484018 - RNA, 64 nt, hsa
aaauccugaguuuccauaaggaaaaugaaaacuccuuuuaaaaauaaaaucugaggaguguaca

SEQ ID NO: 484019 - RNA, 64 nt, hsa
cucuuuguauauuuguacaaauguuucagcugugcuuuuaaaaaaucuggauguuuuuuauuua

SEQ ID NO: 484020 - RNA, 64 nt, hsa
ucuauuguugccuuuccaagugaccucuccucuucuuuuaaaaaaagaacacuuucugcucaua

SEQ ID NO: 484021 - RNA, 64 nt, hsa
aaaaaaaaaaggcuuuucuuuuuaaacaguuccacuuuuaaaaccugccucuggguuuuuguuu

SEQ ID NO: 484022 - RNA, 64 nt, hsa
guuccagauuguucaucuagaggcagagacaucucuuuuaaaaaagugccagaugccccagugc

SEQ ID NO: 484023 - RNA, 64 nt, hsa
aagaguucuuucacuuacccuuuuuauuagucagcuuuuaaaguaauuguuuuacugagccuuc

SEQ ID NO: 484024 - RNA, 64 nt, hsa
agguuacucaaguagaagccugaaaauuaaucugcuuuuaaaauaaagagcaguguucuccauu

SEQ ID NO: 484025 - RNA, 64 nt, hsa
augaacugauuuagcaacacagguaaaaaugcaccuuuuaaagcacuacguuuucacagacaau

SEQ ID NO: 484026 - RNA, 64 nt, hsa
cuuuuuucaaucucauaaaaaagggauagugcaucuuuuaaaauacauuuuauuuggggaggaa

SEQ ID NO: 484027 - RNA, 64 nt, hsa
cuuaaauaaucuuagaauuaauugauaaaugucucuuuuaaaaucuacuguauuuauuauaauu

SEQ ID NO: 484028 - RNA, 64 nt, hsa
cacaugcaucuaaacugcugggcaauccaguugacuuuuaaauguaagaauggaauuccaaaca

SEQ ID NO: 484029 - RNA, 64 nt, hsa
aguaaaucuauggauaugguauuuugugaaugaucuuuuaaauaaaagaaaaccuuacguaaua

SEQ ID NO: 484030 - RNA, 64 nt, hsa
cuaagugcuagaauuuauaguuacaggcgguguccuuuuaaauguggaaaggcuuuuaaaauau

SEQ ID NO: 484031 - RNA, 64 nt, hsa
aguuacaggcgguguccuuuuaaauguggaaaggcuuuuaaaauauuuuaaaacuggaccugua

SEQ ID NO: 484032 - RNA, 64 nt, hsa
ugaucauugacaugugauuucaaaacacaguguucuuuuaaaaaucuauaauaugucaaaauac

SEQ ID NO: 484033 - RNA, 64 nt, hsa
ccucucacaucuuacagaucuauaaggucacaugcuuuuaaaauaguagcaaguuaaacuucac

SEQ ID NO: 484034 - RNA, 64 nt, hsa
acuccaauucaguaaaugguaucacuguuuaccccuuuuaaagauaugauuagacuucguuagu

SEQ ID NO: 484035 - RNA, 64 nt, hsa
uguuuauaauuauuaggaauuauauauuauguaucuuuuaaaaauugaaauuuuaaaauaugga

SEQ ID NO: 484036 - RNA, 64 nt, hsa
uuucuacuggaaagauuuuuuucuuuuuaauuuucuuuuaaacuuauuuaauuuguuugaacaa

SEQ ID NO: 484037 - RNA, 64 nt, hsa
guagaauuuuuaaacagauuuuuuuaaagcuuuucuuuuaaauuuuucuccguugcaaagaaug

SEQ ID NO: 484038 - RNA, 64 nt, hsa
gauccucagguccagaauuccagcaucauuuauucuuuuaaaauuuuuaagaacuugauccauu

SEQ ID NO: 484039 - RNA, 64 nt, hsa
gaggugcuuggccuccaguagcugccuccauucucuuuuaaaaaaagggggugauucugaggca

SEQ ID NO: 484040 - RNA, 64 nt, hsa
cccagccuauaaaaaaaggaagguacacguuguccuuuuaaagguugugagguagauuggagug

SEQ ID NO: 484041 - RNA, 64 nt, hsa
uccaauuuauaaucaagaaggggcucuggauccccuuuuaaauuacacacacucucacacacau

SEQ ID NO: 484042 - RNA, 64 nt, hsa
gugcaaucuuuagccccagggaggucaauaaugucuuuuaaagccagaagucacauuuuaccaa

SEQ ID NO: 484043 - RNA, 64 nt, hsa
gauuauuuguaagaccuucaccaaguucugauaucuuuuaaagacauaguucaaaauugcuuuu

SEQ ID NO: 484044 - RNA, 64 nt, hsa
aaauuauguuuucuuuaaguguuuaugguaaacucuuuuaaagaaaauuuaauauguuauagcu

SEQ ID NO: 484045 - RNA, 64 nt, hsa
ggguagccugaauugcuuucugcucuuuacauuucuuuuaaaauaagcauuuagugcucagucc

SEQ ID NO: 484046 - RNA, 64 nt, hsa
uauccugaaaggcaacauaauucuuccuucccuccuuuuaaaauuuuguguuccuuuuugcagc

SEQ ID NO: 484047 - RNA, 64 nt, hsa
ugaaaauaucagcuuuucuuauuccuuuuuauuccuuuuaaaaugguaugccaacuuaaguauu

SEQ ID NO: 484048 - RNA, 64 nt, hsa
agccuacugagauccaugugacauuggaggagaucuuuuaaauguuuaguauucgucauuagca

SEQ ID NO: 484049 - RNA, 64 nt, hsa
aauuuucauuaagccaguauaaaauagaaacuagcuuuuaaacugagcuuuggaaccauuugug

SEQ ID NO: 484050 - RNA, 64 nt, hsa
uguuaauuucuacuuuuuuuaauauuuaaaauugcuuuuaaauaaacauauucucaguugaucc

SEQ ID NO: 484051 - RNA, 64 nt, hsa
uauuuucuuaguuuuguucuuggacaaauuuaaacuuuuaaaagauuauucaagaugaauuuaa

SEQ ID NO: 484052 - RNA, 64 nt, hsa
uguacuuaaaaugcauagcauuauuaaaaacaaucuuuuaaaauauaauuuauaacauagauug

SEQ ID NO: 484053 - RNA, 64 nt, hsa
ugcuuacucuacaguuauucaaaugagagucacgcuuuuaaauuuacagcucaucacagaaauc

SEQ ID NO: 484054 - RNA, 64 nt, hsa
guuucccuucauaaaauguaauguacauuguaaucuuuuaaaagaaaaaucaggguugcacuug

SEQ ID NO: 484055 - RNA, 64 nt, hsa
ucuuuuaaaagaaaaaucaggguugcacuugcaacuuuuaaaaaaccgaguguggaaacauugg

SEQ ID NO: 484056 - RNA, 64 nt, hsa
uuucuuuuucaaauccaauuuaaaauaaccuuuccuuuuaaaugugcugcaacguuuuuaaaaa

SEQ ID NO: 484057 - RNA, 64 nt, hsa
augguaaauuucagauguuuauuuaaaauuuucacuuuuaaacaguaaccaaaucuaaauuuaa

SEQ ID NO: 484058 - RNA, 64 nt, hsa
ucagcauguuugugauggaugagacuauggacugcuuuuaaacuaccauaauuccauuuuuucc

SEQ ID NO: 484059 - RNA, 64 nt, hsa
cucuggaguguccauuuagacuacacuaacuagacuuuuaaaagauuuugugugguuuggugca

SEQ ID NO: 484060 - RNA, 64 nt, hsa
uaucuucaaucagcuguuggucaagacuaacuuucuuuuaaagguucauuuguaugauaaauuc

SEQ ID NO: 484061 - RNA, 64 nt, hsa
aacaauauguggggagagcacucgguugucuuuacuuuuaaaaguaauacuuggugcuaagaau

SEQ ID NO: 484062 - RNA, 64 nt, hsa
ccuugaagaauaucuaagcuuuuucugagaugggcuuuuaaaauuauaauaagggaaguuuauu

SEQ ID NO: 484063 - RNA, 64 nt, hsa
agaccugaagauuguaauauucaugucugugaagcuuuuaaacauuacacuugagaucagucau

SEQ ID NO: 484064 - RNA, 64 nt, hsa
ugaauauauuuuuuucuuuaaauaggaacaaccucuuuuaaaagagaaaaauuauuucagugau

SEQ ID NO: 484065 - RNA, 64 nt, hsa
ucucaaaugcuggguugaaaaauguuuugaaagccuuuuaaaauauauaucuuuauaaaguaau

SEQ ID NO: 484066 - RNA, 64 nt, hsa
gguuguuaauauuuguauuguaaguguaauauuccuuuuaaauuauaaggcaucuuuuuauccu

SEQ ID NO: 484067 - RNA, 64 nt, hsa
aaaaggaaaccugcaaaugucuacauauaugaagcuuuuaaaaagcacaaguuaucaggcaaca

SEQ ID NO: 484068 - RNA, 64 nt, hsa
auccuccuuaacugucugcagugcccccugacuucuuuuaaauggaugugaauauauguggaaa

SEQ ID NO: 484069 - RNA, 64 nt, hsa
ucuauuguuuaacucacuaguuuauaggccugaccuuuuaaauuccugggauaaauuuuagaau

SEQ ID NO: 484070 - RNA, 64 nt, hsa
uugcccugaguauuaaagcuagcuuagcaaaauacuuuuaaaaacauauugguaaaugauaccc

SEQ ID NO: 484071 - RNA, 64 nt, hsa
aauacaggcuuucuagagaucuuuuucauuaauacuuuuaaauaccuuucagguaguuacauca

SEQ ID NO: 484072 - RNA, 64 nt, hsa
gguuaauauaggcagggcgaauacuacuuuguaacuuuuaaagucuuaaacuuuucaauaaaau

SEQ ID NO: 484073 - RNA, 64 nt, hsa
ccagugucucaaccauaguauugucucuuuaagucuuuuaaauaucacugauguguaaaaaggu

SEQ ID NO: 484074 - RNA, 64 nt, hsa
gauauuucauagggcccugucuuauucaacuuuacuuuuaaaaucagugauuuggaugaaggca

SEQ ID NO: 484075 - RNA, 64 nt, hsa
agaaugcauuaagugugguuacccuaaauguucccuuuuaaaucugcuuuucauguugaaaauc

SEQ ID NO: 484076 - RNA, 64 nt, hsa
aaaaggggccucaaugaugauaggaaaaucaguucuuuuaaaauuucuucaagaaaauccaggc

SEQ ID NO: 484077 - RNA, 64 nt, hsa
agcucccacuaaugaaacccugcuuuccuuguaucuuuuaaacucaguucugcauccaacuuga

SEQ ID NO: 484078 - RNA, 64 nt, hsa
uucaauaauaggcuaaggaaagacauguuuuucucuuuuaaaucucugcaacuccaaaguagac

SEQ ID NO: 484079 - RNA, 64 nt, hsa
ugaugcauaucauuuuucuauaaguaaucaguugcuuuuaaaaucagaaggcuauauuauucua

SEQ ID NO: 484080 - RNA, 64 nt, hsa
uguucuccucccuuuauaaauuuuauucauaggacuuuuaaaaggcuugugcuaucuuuccagu

SEQ ID NO: 484081 - RNA, 64 nt, hsa
cuuccauguugaagccagauuuucuguaguaaaacuuuuaaauauuauuuuaaaagaaauaugu

SEQ ID NO: 484082 - RNA, 64 nt, hsa
uuuuuuaaaauaacuggcaaaugcuaugcuucuacuuuuaaaauuugugguaauacccagaaug

SEQ ID NO: 484083 - RNA, 64 nt, hsa
gcaaaacagguucagauuucaucuuuugugauuucuuuuaaauacuauucauuuuuauuuaaau

SEQ ID NO: 484084 - RNA, 64 nt, hsa
uacuagcccuuuuuauauauuuacacaagcaaaacuuuuaaauauuugaauugacaguuacaug

SEQ ID NO: 484085 - RNA, 64 nt, hsa
ccuuggucuuuuaauuaaaagaaauuccaacugacuuuuaaacuuuguucuuguccaaaguugc

SEQ ID NO: 484086 - RNA, 64 nt, hsa
ucuguccucuugccuuuuacuuaaauuccucugacuuuuaaaaauggugacacucuuaucguaa

SEQ ID NO: 484087 - RNA, 64 nt, hsa
cucugguuggaaaugccauuguuuuggggacagacuuuuaaaaugcccuugugucucccaguga

SEQ ID NO: 484088 - RNA, 64 nt, hsa
uugguuuuugaauuguugauuuuguucacaaccucuuuuaaaucuaacaaguccuguucuguuu

SEQ ID NO: 484089 - RNA, 64 nt, hsa
uaaaacaucagauuaaauaauuacacuguucaggcuuuuaaaaaaauaccacugugagaauaaa

SEQ ID NO: 484090 - RNA, 64 nt, hsa
aagguauguaaguuauuaaaugguuaaucauggccuuuuaaaaauaaaauaaagugauaccuuu

SEQ ID NO: 484091 - RNA, 64 nt, hsa
cugacaguuccaucuuggaagguuucaaaauuaccuuuuaaaaugaucucagaagucuguagau

SEQ ID NO: 484092 - RNA, 64 nt, hsa
gaauuuggcaggaauucccaagauggacauugugcuuuuaaacuagaacuuguaagacauuaug

SEQ ID NO: 484093 - RNA, 64 nt, hsa
aagguucuaaacuguguuacagauacuuguaagacuuuuaaaaucagaguaaguauguucuuac

SEQ ID NO: 484094 - RNA, 64 nt, hsa
gaaauagaaauaguucuuuaaaaauauuucucuacuuuuaaaacaagauacuuaauauuuuuaa

SEQ ID NO: 484095 - RNA, 64 nt, hsa
uuuucuaaauaagauaauucucauuuguguuugucuuuuaaaaggccaauaaaauaucuuucag

SEQ ID NO: 484096 - RNA, 64 nt, hsa
uugaauaccaacauuuaaaaugaugguauuuuaucuuuuaaacuuaaaaauuauuuaauacagc

SEQ ID NO: 484097 - RNA, 64 nt, hsa
auacugcagaauauaguguaucaaaaacuuuuuucuuuuaaauuauuaaagugucuuuuauacu

SEQ ID NO: 484098 - RNA, 64 nt, hsa
uuuuuuuuucuuuugauguugcaacuuuuggguucuuuuaaacugugauagugaugguaacuga

SEQ ID NO: 484099 - RNA, 64 nt, hsa
uuuuucuuuuugauacuccagguuuauaaacuaucuuuuaaaauuuuaagccaggacuucaaaa

SEQ ID NO: 484100 - RNA, 64 nt, hsa
gcaaacauuuacauuuguuuuuuacaauaaauuucuuuuaaaauauacuuucuauuuuucugua

SEQ ID NO: 484101 - RNA, 64 nt, hsa
ucuuccuaaaaauugagagguuuccuuuuauuaacuuuuaaaauaaagaaauaaguaguuucau

SEQ ID NO: 484102 - RNA, 64 nt, hsa
gucucauuaggcaauuuaugcuuuaauggucaagcuuuuaaaaauuuguauuugauaacauccu

SEQ ID NO: 484103 - RNA, 64 nt, hsa
uggcacaugugccagcugaauuuaaaauauaauacuuuuaaaaagaaaauuauuacauccuuua

SEQ ID NO: 484104 - RNA, 64 nt, hsa
auauaaaggaagaauaagucacuguaaaacagaacuuuuaaaugaagcuuaaauuacucaauuu

SEQ ID NO: 484105 - RNA, 64 nt, hsa
uauuguaacuuucauuagaaauaaguugcuuugacuuuuaaaaaugacauaguuagauuauuua

SEQ ID NO: 484106 - RNA, 64 nt, hsa
uuuuacuuagauacuaauaaaauacauuuagaaacuuuuaaagucaugaaaaagcauuaaccuu

SEQ ID NO: 484107 - RNA, 64 nt, hsa
auauauauacaugcacacacaccgauacauuuaccuuuuaaaaaaaugauuuauaagugaacug

SEQ ID NO: 484108 - RNA, 64 nt, hsa
cauguuuuauuggaaaugcacgugguuucuuaggcuuuuaaacaaauacauggaaugguugaaa

SEQ ID NO: 484109 - RNA, 64 nt, hsa
gaagcaccugggugugccuaccuacuccucuuuucuuuuaaaagggcccacaaugcuccaauuu

SEQ ID NO: 484110 - RNA, 64 nt, hsa
guaauuuauuuguuuugcuacauacuguuccagacuuuuaaaggggacaaugaaggugacugug

SEQ ID NO: 484111 - RNA, 64 nt, hsa
caauuuauaauagaacuuauagcuuuuaaaagaccuuuuaaagacauuaaauguaaacuuaaaa

SEQ ID NO: 484112 - RNA, 64 nt, hsa
uaauuuaguuggcaauuuauaauagaacuuauagcuuuuaaaagaccuuuuaaagacauuaaau

SEQ ID NO: 484113 - RNA, 64 nt, hsa
gcgugagccaccacacccagccuccaucuuuaaacuuuuaaaugugaaauuucuaucauguacc

SEQ ID NO: 484114 - RNA, 64 nt, hsa
uuguugcauguaugaauaguuucuuccuuuuuuucuuuuaaaaauguuuuauauauuuaggggg

SEQ ID NO: 484115 - RNA, 64 nt, hsa
cuggagcucguaauuuuuuaacuguaagcuuguccuuuuaaagggauuuaauguaccuuuuugu

SEQ ID NO: 484116 - RNA, 64 nt, hsa
guaauuucuugugaagaagccaacacucaaaugacuuuuaaaguuguuuacuuuuucauuccuu

SEQ ID NO: 484117 - RNA, 64 nt, hsa
augacucgcaagcaauguuagaggggaagcauaucuuuuaaauuauaauuuggggggaggggug

SEQ ID NO: 484118 - RNA, 64 nt, hsa
aagcuagcuaauucuuguuuucugauuuaaagcacuuuuaaaucuuauccugcccccuaaaaac

SEQ ID NO: 484119 - RNA, 64 nt, hsa
cccugaauuaaguguuaauuugauggaaacucugcuuuuaaaaucaucauuuacuggguucuaa

SEQ ID NO: 484120 - RNA, 64 nt, hsa
uuuucauuagauugguuguaccaugucaccuuagcuuuuaaaaauacucuuuucagauucacgu

SEQ ID NO: 484121 - RNA, 64 nt, hsa
uucaagaucaauaugucuaauaagugcugguguccuuuuaaaguauuuaaauauauauguugcu

SEQ ID NO: 484122 - RNA, 64 nt, hsa
cauccuuaucuuuguuccucuuuacauaauguuccuuuuaaaaaaaaucacugauuaugaugug

SEQ ID NO: 484123 - RNA, 64 nt, hsa
gaaguugucucacagcucacuuguauucuguugacuuuuaaaaaauuaugcuuucuguuucacu

SEQ ID NO: 484124 - RNA, 64 nt, hsa
uuuugggucuuuuuauauauguucugugucuaaccuuuuaaaaccuggaacacagauauaacaa

SEQ ID NO: 484125 - RNA, 64 nt, hsa
ucccagcgccuuuuaaaaguuguuaugugguuuucuuuuaaaaagcuccuguuuuuggaaagua

SEQ ID NO: 484126 - RNA, 64 nt, hsa
cagcauugaucuagaagcagaggaaucccagcgccuuuuaaaaguuguuaugugguuuucuuuu

SEQ ID NO: 484127 - RNA, 64 nt, hsa
uaauuuguauuaaauuuauuacuauuucuuaugccuuuuaaaauacuguuuacuaugaagacaa

SEQ ID NO: 484128 - RNA, 64 nt, hsa
uugaagaaauaguacgacaacuuauuuuuaaucacuuuuaaauaauguguugcauuuacacagu

SEQ ID NO: 484129 - RNA, 64 nt, hsa
cagagaugaguuaguguuucuugacguuggagaccuuuuaaaugccucaucuguuguacugaac

SEQ ID NO: 484130 - RNA, 64 nt, hsa
aaaucguuguggaaggugauuaaaaaucaaaauucuuuuaaauaucaacuuaauuuuuucuaag

SEQ ID NO: 484131 - RNA, 64 nt, hsa
gaaaccagacaaagcauugacuuuuaaauguagacuuuuaaaauaaacuguuuucuuuuggaac

SEQ ID NO: 484132 - RNA, 64 nt, hsa
caacagcccuaugggaaaccagacaaagcauugacuuuuaaauguagacuuuuaaaauaaacug

SEQ ID NO: 484133 - RNA, 64 nt, hsa
acuucaugauuuugcauccaauucgugucugugccuuuuaaagggugaggucugugucacuuug

SEQ ID NO: 484134 - RNA, 64 nt, hsa
agccaccgugcccagccaagaauuuuuauuuuugcuuuuaaauagcaaaagaagaagauucugu

SEQ ID NO: 484135 - RNA, 64 nt, hsa
gugaaaugcaaaugugcaauuuuuuuuaaaggagcuuuuaaacaaaguaauaauaauugguguu

SEQ ID NO: 484136 - RNA, 64 nt, hsa
gauuuuuacaagucagauuuuuuguuccccaaaucuuuuaaaugaagccagugacucccaguuc

SEQ ID NO: 484137 - RNA, 64 nt, hsa
cuccuuguuugucccauucauauaugaaaauagacuuuuaaaacuguccaacacuaaugguuua

SEQ ID NO: 484138 - RNA, 64 nt, hsa
ggaauagccuuuccucagucugagaaauuggucucuuuuaaaagacgaaucucaugaauauuca

SEQ ID NO: 484139 - RNA, 64 nt, hsa
ugcagugccagaggggccucuggagcaggccuggcuuuuaaauggggggcugaauuccagcuca

SEQ ID NO: 484140 - RNA, 64 nt, hsa
auacauuucuuguaaaaccuggcuuguugcuuggcuuuuaaagaugguguauguuuguaaaaau

SEQ ID NO: 484141 - RNA, 64 nt, hsa
agcaucauacucaccgagucuagucaguguagugcuuuuaaaaauuuuguccuuucauguaacu

SEQ ID NO: 484142 - RNA, 64 nt, hsa
agauucccuguuggauuuacuucggauuuauucccuuuuaaagaauuuuugcccauaucuggaa

SEQ ID NO: 484143 - RNA, 64 nt, hsa
ccaguuucccauccuuugucccugcugucccccacuuuuaaagaugggucucaaccccucccca

SEQ ID NO: 484144 - RNA, 64 nt, hsa
ggcauucaugcagagcaaagcacuuuaaccauuucuuuuaaaaggucuauagauugggguagag

SEQ ID NO: 484145 - RNA, 64 nt, hsa
cccuaccucugccaaggcaaguaaugguagugggcuuuuaaacugccccccguauguuuuaaga

SEQ ID NO: 484146 - RNA, 64 nt, hsa
uugugaggggaagagacugcauuguggccccagacuuuuaaaacagcacuaaauaacuuggggg

SEQ ID NO: 484147 - RNA, 64 nt, hsa
auggaguguaguaguaguguguacagguagaaaacuuuuaaauacagcaugcagguguuucagu

SEQ ID NO: 484148 - RNA, 64 nt, hsa
auugcuuaauguuuuaagcuuaauagccuuugcacuuuuaaaauaaaaaccaaguaugcaaauc

SEQ ID NO: 484149 - RNA, 64 nt, hsa
guaaguuaaguuguaaagacuuuggaauaaguuucuuuuaaaaauaugacauagccagugaugu

SEQ ID NO: 484150 - RNA, 64 nt, hsa
aaauaacucuaaugaauauucaagauauuuuagccuuuuaaaaaguugagauuuagcucaugga

SEQ ID NO: 484151 - RNA, 64 nt, hsa
cuuucuuauaauauguuguaguuacuagugaauucuuuuaaaagcaauaccuagaguuagaaca

SEQ ID NO: 484152 - RNA, 64 nt, hsa
ccgugguauacagcuccugugacauuugaaguuucuuuuaaagggguuuuucuuaaucaaaguu

SEQ ID NO: 484153 - RNA, 64 nt, hsa
uuugauacuugucuauccuucauagugcccucuacuuuuaaaggguuuauauguugaaaaacug

SEQ ID NO: 484154 - RNA, 64 nt, hsa
cuccuagauucauuauucuuucauucugguuucacuuuuaaaauaaauggcaacuuggcacacc

SEQ ID NO: 484155 - RNA, 64 nt, hsa
caugcuggcugggguuagugaccauuugcauacucuuuuaaaucaaggaggcuguaguagaagc

SEQ ID NO: 484156 - RNA, 64 nt, hsa
uuuuuuuuccucuauuuaucaaugauauauuucacuuuuaaaggaaauuuuagaggaaaauuaa

SEQ ID NO: 484157 - RNA, 64 nt, hsa
uauuauaagcaugaucuuuuaaaaauauauuuggcuuuuaaaguaugcaccguguuugccuguu

SEQ ID NO: 484158 - RNA, 64 nt, hsa
ccuuaauguguaauuuacuuauuauaagcaugaucuuuuaaaaauauauuuggcuuuuaaagua

SEQ ID NO: 484159 - RNA, 64 nt, hsa
uaaaaccuuagacugauuuuaaauauauuaauuucuuuuaaacucaauauaauguuaauauuac

SEQ ID NO: 484160 - RNA, 64 nt, hsa
cugcauaaccaguauuagcauuagaaauuagccacuuuuaaaaugagaaaacugugucacucuu

SEQ ID NO: 484161 - RNA, 64 nt, hsa
ugccuggccucauuugaguauuuuuauaaugucucuuuuaaagucuuugucagauaauuucacu

SEQ ID NO: 484162 - RNA, 64 nt, hsa
uuaucugugucgucccacugagugcauucaccaccuuuuaaauuuuggucacuguauguaucag

SEQ ID NO: 484163 - RNA, 64 nt, hsa
agaauagaugaaaauuuugaugaauaguggaauucuuuuaaauggaaaccucuuacaugugauu

SEQ ID NO: 484164 - RNA, 64 nt, hsa
uccucaagaaugucugaagaagguaguaauauuccuuuuaaauuuuuuccaaccauugcuugau

SEQ ID NO: 484165 - RNA, 64 nt, hsa
uagacauucgucaucaguuguucuugaacauggucuuuuaaaaacuagucagaugaauuguuuu

SEQ ID NO: 484166 - RNA, 64 nt, hsa
uguuuugaaauggagaggaaaauuggcaccucaucuuuuaaaggcaguaauggaauugauuuuc

SEQ ID NO: 484167 - RNA, 64 nt, hsa
aguacucaguuuucagguucuuccuagcucggggcuuuuaaauuuugaaaucuaaacauucuuu

SEQ ID NO: 484168 - RNA, 64 nt, hsa
uccccgguuauugauguacuagauuuguguaugucuuuuaaacaguucuaguuucaccuuacac

SEQ ID NO: 484169 - RNA, 64 nt, hsa
cucccaauagcuuucaauuguucuuucuggaagacuuuuaaaaaaauauaaauaugcauauaua

SEQ ID NO: 484170 - RNA, 64 nt, hsa
gccagaaauuuauaccauuuaaaacucaguaagucuuuuaaauaucaggaaggagagaagcgac

SEQ ID NO: 484171 - RNA, 64 nt, hsa
cccaggaauucauuaauaaucauccuuggcuuuccuuuuaaaggcuauuuugaaauggucuuuu

SEQ ID NO: 484172 - RNA, 64 nt, hsa
aaugaaauagauguaaggaaggagggauuuaaaccuuuuaaaaaacuuuugcugacuuauauua

SEQ ID NO: 484173 - RNA, 64 nt, hsa
ucuuuauaaugcaguggcaaaagguucugaaagccuuuuaaacucgaaccagugggggaaagau

SEQ ID NO: 484174 - RNA, 64 nt, hsa
uauuuuuuaacaaucuucaauaauguaaagauuacuuuuaaaauauuuaaguuaaaacuacuug

SEQ ID NO: 484175 - RNA, 64 nt, hsa
auaugaaaaauuauggucuuauugcugaauaaaacuuuuaaaaaguacagaauaauugugcuug

SEQ ID NO: 484176 - RNA, 64 nt, hsa
guaugugccuugauccaacgcuacauguauucagcuuuuaaaacuccacaaauuuuucauacuc

SEQ ID NO: 484177 - RNA, 64 nt, hsa
aacaacuucauauaugaggacuugugucucugugcuuuuaaaugcauaaaugcauuauaggauc

SEQ ID NO: 484178 - RNA, 64 nt, hsa
auagaaauuacacccaaagagguauuuaucuuuacuuuuaaacagugagccugaauuuuguugc

SEQ ID NO: 484179 - RNA, 64 nt, hsa
uccuacaaaucagcguaguuacaaaggggucagucuuuuaaaauaaguauuuccuauuaaacua

SEQ ID NO: 484180 - RNA, 64 nt, hsa
uauaggguaaagcuuugucuaaaguccucauuuucuuuuaaaauugaauaaaauuucuguauac

SEQ ID NO: 484181 - RNA, 64 nt, hsa
gaaauaaggagaaaccccauaacuuuuuagcucucuuuuaaaaauaaaugucuccuucuguguu

SEQ ID NO: 484182 - RNA, 64 nt, hsa
uuugaguuggauuggaaaggaauauuuuaagugccuuuuaaaaauacuaauaguccggccaggc

SEQ ID NO: 484183 - RNA, 64 nt, hsa
guuauauauuuaauauuaagugaaccucccgugccuuuuaaaaaauaccaacauuaugaaauuu

SEQ ID NO: 484184 - RNA, 64 nt, hsa
gcacuggaggaaaaauaauugacaaauauuuauacuuuuaaauuguuuugaacuguauuuacau

SEQ ID NO: 484185 - RNA, 64 nt, hsa
cauuaacagcuggggaggagggaaaagcuucagacuuuuaaacuagcaaaacaguuauuucucu

SEQ ID NO: 484186 - RNA, 64 nt, hsa
aagggucuuaaagaauuuuuuuaaucgucaaccacuuuuaaacauaaagaauucacacaacuac

SEQ ID NO: 484187 - RNA, 64 nt, hsa
augacaaucuuauugucaacacuauauaaauaagcuuuuaaacaagucauuuuucuugaucguu

SEQ ID NO: 484188 - RNA, 64 nt, hsa
uuaaauggcuagaaaauggucuuuuugcuuugcccuuuuaaagcugaaauaaccagcuccauuc

SEQ ID NO: 484189 - RNA, 64 nt, hsa
ccuuuccacuccauuguaucaauuuuuugaguaacuuuuaaauggcuagaaaauggucuuuuug

SEQ ID NO: 484190 - RNA, 64 nt, hsa
aaccucuaggaccagagcauagucagagcauuuucuuuuaaauugugcacuaacaaaaugcuau

SEQ ID NO: 484191 - RNA, 64 nt, hsa
caucuguaagaucuauacucgagguuuuguuuuccuuuuaaaauucuuuagggagagagggaug

SEQ ID NO: 484192 - RNA, 64 nt, hsa
caaagagggauugcccugcacauuuucuuuugugcuuuuaaauguuucuuaaguuggaacaggu

SEQ ID NO: 484193 - RNA, 64 nt, hsa
gcuuaaaauggcauucucuagcaaagagauuagacuuuuaaauaacucuuauaaaacagguugg

SEQ ID NO: 484194 - RNA, 64 nt, hsa
agcaaaaaguagaaguaucaaauaaaaagggcaacuuuuaaaauauuaagccugaagacuucua

SEQ ID NO: 484195 - RNA, 64 nt, hsa
ugcacaaaaagauaccuuaaaauuugaaacauugcuuuuaaaacuacuuagcacuucagggcag

SEQ ID NO: 484196 - RNA, 64 nt, hsa
caaacugcacaugauuucacaaauauuaaaaagucuuuuaaaaaguauugccaaacauuaaugu

SEQ ID NO: 484197 - RNA, 64 nt, hsa
aaauugauguugaugcaauccuuacaaaugauugcuuuuaaaauuuuaagcuaggaaaagaaau

SEQ ID NO: 484198 - RNA, 64 nt, hsa
agaaauacugugcugaaaguuuuaugacauccaucuuuuaaauuuucaggcccugaacaggaaa

SEQ ID NO: 484199 - RNA, 64 nt, hsa
ugcaaauugcuauguguguggugauggcaaaaggcuuuuaaaaguugguguuuucuuuuucuua

SEQ ID NO: 484200 - RNA, 64 nt, hsa
uuauuuucuaccuggauaaacuucuggaacuuggcuuuuaaauuuaacuuuucuaguuuuuaag

SEQ ID NO: 484201 - RNA, 64 nt, hsa
augucuuuauaagguucacuuaacuuaaaaacagcuuuuaaaacaacuuuuuaucuucugucuu

SEQ ID NO: 484202 - RNA, 64 nt, hsa
gucuuuuuuugaaauaaaaaguagcuugagcuuucuuuuaaaaucauguaucuugauuguugau

SEQ ID NO: 484203 - RNA, 64 nt, hsa
cuacugaauuucugucuugccucuccuucagugccuuuuaaaagguuuucccuuuucugaucug

SEQ ID NO: 484204 - RNA, 64 nt, hsa
guguucauuacauuccccaagggucaaauuggagcuuuuaaagaauuaaagcuucuaugaguau

SEQ ID NO: 484205 - RNA, 64 nt, hsa
auuuaugcuauuuaauuuugugaaacuuaaucaucuuuuaaaauguauuauuugaagaguauuu

SEQ ID NO: 484206 - RNA, 64 nt, hsa
uucaugcuauucagaaucacuuguaaauagucugcuuuuaaaggagggcauguucaguuuucug

SEQ ID NO: 484207 - RNA, 64 nt, hsa
cagugucuucuagaaggugccugaccagguucaccuuuuaaacgacaaagcaugguuuguggcu

SEQ ID NO: 484208 - RNA, 64 nt, hsa
cuaagcuuccauagaaauacacuuuguaucuggaccucaaaauuaugggaacauuuacuuaaac

SEQ ID NO: 484209 - RNA, 64 nt, hsa
aauuaugauaaaggacaaaauaagcuguuugccaccucaaaacuuuaugaacuucaccaccacu

SEQ ID NO: 484210 - RNA, 64 nt, hsa
ggaagagagacugaagucacaaccccugacugcuccucaaaagcuaacgguugcaccuccaagu

SEQ ID NO: 484211 - RNA, 64 nt, hsa
gcugccuauaaaucuuggaggaaucauuucuccuccucaaaaacugauucagaaacugacuugg

SEQ ID NO: 484212 - RNA, 64 nt, hsa
caaaguuggggcaggcuggcuggcccgucauguuccucaaaagcacccuugacgucaagucucc

SEQ ID NO: 484213 - RNA, 64 nt, hsa
gacaacaugcgaccgugaccaggaacacccgacuccucaaaagcaaaugagaucccgccucuuc

SEQ ID NO: 484214 - RNA, 64 nt, hsa
uauaauacuugucuuucucuccucucccuccaucccucaaaagaucuuuaugcauuucccacua

SEQ ID NO: 484215 - RNA, 64 nt, hsa
gagugaggggcauagugaaaaaggaacagccaugccucaaaaucaaaucauuugcauucccaca

SEQ ID NO: 484216 - RNA, 64 nt, hsa
ugaacuuccaguaggcccacaguuguugguuguuccucaaaacagguuguggcuccuguugaau

SEQ ID NO: 484217 - RNA, 64 nt, hsa
guuugccauggagcacuagaugguccuuuucacuccucaaaaugcaugcccauugucuucaggu

SEQ ID NO: 484218 - RNA, 64 nt, hsa
gcacuccagccugggcgacaagagugaaacuccaccucaaaaaaaaaaaaaaaagaguuaaucu

SEQ ID NO: 484219 - RNA, 64 nt, hsa
agaagugucgcuuuccagccuuuuguuucuggauccucaaaacucagaacguggccgggcgugg

SEQ ID NO: 484220 - RNA, 64 nt, hsa
cuguggcacaugccuguauuacugaaagcuaaauccucaaaaccuaguaaggggacuaaugauu

SEQ ID NO: 484221 - RNA, 64 nt, hsa
aaaugagcauguaauaauacaagaacuguuucccccucaaaaccugaaccugaauuauuuguaa

SEQ ID NO: 484222 - RNA, 64 nt, hsa
uuguguacaauuuggggccucaaauuugacucugccucaaaaaaaagaaauauauccuaugcag

SEQ ID NO: 484223 - RNA, 64 nt, hsa
ucagccucucacccacucccagacacacacaaguccucaaaaguuucagcuccgugugugagau

SEQ ID NO: 484224 - RNA, 64 nt, hsa
ucucugaguguuuagggaaauagcuucuuuaaaaccucaaaaccaugaccauccugucaaagac

SEQ ID NO: 484225 - RNA, 64 nt, hsa
ugcauuccagccugggugacagagugagacucccccucaaaaaaaaaaaaaaaaaaaaaaaaaa

SEQ ID NO: 484226 - RNA, 64 nt, hsa
auacauacacacacacacauacaguauauucuuuccucaaaaggguuaagaugucuaaaauagg

SEQ ID NO: 484227 - RNA, 64 nt, hsa
aucucuagaugcaaauacauugaguuuaaaagugccucaaaauaauugagaucacauuucagga

SEQ ID NO: 484228 - RNA, 64 nt, hsa
uguacgaaucacggcuguuggacaucucgguaucaccguugaugaacucauugguuucacaagu

SEQ ID NO: 484229 - RNA, 64 nt, hsa
caccgaagucaacuugacuguaaaaguaccccauaccguugacgcgcuguggcagaccuguggg

SEQ ID NO: 484230 - RNA, 64 nt, hsa
cguccaacauuccuuguuuguaaguguuguauguaccguugauguugauaaaaagaaaguuuau

SEQ ID NO: 484231 - RNA, 64 nt, hsa
uuagugcaaauaugacccuggucagggcuuugccaccguugaagcccugcagaaggugcaaugu

SEQ ID NO: 484232 - RNA, 64 nt, hsa
aaacugaaacccucuuuccaggaccucaguaggcaccguugagguguccuuuguuuuugugugu

SEQ ID NO: 484233 - RNA, 64 nt, hsa
ugugaagucuacuuuaguauuccuguaauacuaaaccguugaguuucuaaauauuuauuuauuc

SEQ ID NO: 484234 - RNA, 64 nt, hsa
ccuucaaugcuugacuugaauggauuuaugacguaccguugagaagaucaauuucagcuacaau

SEQ ID NO: 484235 - RNA, 64 nt, hsa
auuuuugagguuugcacucaugcaauuugagaacaccguugacaagaaggcugaguuuacauaa

SEQ ID NO: 484236 - RNA, 64 nt, hsa
gagagagaaagcacggcugaggcugagucaguugaccguugaggaagaccuaaggagcugucca

SEQ ID NO: 484237 - RNA, 64 nt, hsa
aguucucugacuguguugggaaaggauaagugcuaccguugagaagggaagaaaggcugagucu

SEQ ID NO: 484238 - RNA, 64 nt, hsa
guuuaaaaagggaaacaaugugggaggaagaaucaccguugacgcaucuugauuugguugguuu

SEQ ID NO: 484239 - RNA, 64 nt, hsa
cugcuggcuuugcaaauagaaguggucuccagcaaccguugaaaggcauagaauugacucuguu

SEQ ID NO: 484240 - RNA, 64 nt, hsa
ugaguguuucucaggauuccuaacgauucaaauuaccguugaguauauauaaagaaugagucuc

SEQ ID NO: 484241 - RNA, 64 nt, hsa
acaggccgcagcuccauuuucuuauugcgcugcuaccguugacuuccaggcacgguuuggaaau

SEQ ID NO: 484242 - RNA, 64 nt, hsa
cacucacuuauuaauucuaguaacuuuuuguaagaccguugaguauucuacauagacaaucaug

SEQ ID NO: 484243 - RNA, 64 nt, hsa
cagcauuugagcucagcuaugaucagaaaaaagcaccguugagguugcagugagccgagaucac

SEQ ID NO: 484244 - RNA, 64 nt, hsa
cucguagcacucaauuuaguaacuucuagaugcuaccguugaccugaguuaaauucauuuaguc

SEQ ID NO: 484245 - RNA, 64 nt, hsa
gccaauguuaugccagcuccauguucucccaaauaccguugaugugaauuauuuuaaaggcaaa

SEQ ID NO: 484246 - RNA, 64 nt, hsa
caggaugacgugcagaaaaaugggugaaggauaaaccguugagacguggccccacugguaggau

SEQ ID NO: 484247 - RNA, 64 nt, hsa
agaaucauuaaagaaaaagaaaaaagauuuuaagaccguugaaaucaauuaucaagaacguccu

SEQ ID NO: 484248 - RNA, 64 nt, hsa
cccguucuggcagcgcaccggccggguuucucggaccguugacuuuauuugggggaguuuuccc

SEQ ID NO: 484249 - RNA, 64 nt, hsa
ccccuuuacauucccuccuugccuucccuaggaaaccguugauuuacauuuuuuacuuuagauu

SEQ ID NO: 484250 - RNA, 64 nt, hsa
gaugaauuugcugucauguuuuguggaaugagggaccguugagcucacuaccaccuggaguuug

SEQ ID NO: 484251 - RNA, 64 nt, hsa
acucuaggacugggcccgagggugguuuaccugcaccguugacucaguauaguuuaaaaaucug

SEQ ID NO: 484252 - RNA, 64 nt, hsa
aaguguucagagcagacagaagcagggugguggcaccguugaaaggcagaaagagccaggagaa

SEQ ID NO: 484253 - RNA, 60 nt, hsa
ucuucuccuggauccaguaagaguuucggcaccguugacgaacugcagcgaucuuacugg

SEQ ID NO: 484254 - RNA, 64 nt, hsa; identical to SEQ ID NO: 183939

SEQ ID NO: 484255 - RNA, 64 nt, hsa; identical to SEQ ID NO: 183940

SEQ ID NO: 484256 - RNA, 64 nt, hsa; identical to SEQ ID NO: 183941

SEQ ID NO: 484257 - RNA, 64 nt, hsa; identical to SEQ ID NO: 183942

SEQ ID NO: 484258 - RNA, 64 nt, hsa; identical to SEQ ID NO: 183943

SEQ ID NO: 484259 - RNA, 64 nt, hsa; identical to SEQ ID NO: 183944

SEQ ID NO: 484260 - RNA, 64 nt, hsa; identical to SEQ ID NO: 183945

SEQ ID NO: 484261 - RNA, 64 nt, hsa; identical to SEQ ID NO: 183946

SEQ ID NO: 484262 - RNA, 64 nt, hsa; identical to SEQ ID NO: 183947

SEQ ID NO: 484263 - RNA, 64 nt, hsa; identical to SEQ ID NO: 183948

SEQ ID NO: 484264 - RNA, 64 nt, hsa; identical to SEQ ID NO: 183949

SEQ ID NO: 484265 - RNA, 64 nt, hsa; identical to SEQ ID NO: 183950

SEQ ID NO: 484266 - RNA, 64 nt, hsa; identical to SEQ ID NO: 183951

SEQ ID NO: 484267 - RNA, 64 nt, hsa; identical to SEQ ID NO: 183952

SEQ ID NO: 484268 - RNA, 64 nt, hsa; identical to SEQ ID NO: 183953

SEQ ID NO: 484269 - RNA, 64 nt, hsa; identical to SEQ ID NO: 183954

SEQ ID NO: 484270 - RNA, 64 nt, hsa; identical to SEQ ID NO: 183955

SEQ ID NO: 484271 - RNA, 64 nt, hsa; identical to SEQ ID NO: 183956

SEQ ID NO: 484272 - RNA, 64 nt, hsa; identical to SEQ ID NO: 183957

SEQ ID NO: 484273 - RNA, 64 nt, hsa; identical to SEQ ID NO: 183958

SEQ ID NO: 484274 - RNA, 64 nt, hsa; identical to SEQ ID NO: 183959

SEQ ID NO: 484275 - RNA, 64 nt, hsa; identical to SEQ ID NO: 183960

SEQ ID NO: 484276 - RNA, 64 nt, hsa; identical to SEQ ID NO: 183961

SEQ ID NO: 484277 - RNA, 64 nt, hsa; identical to SEQ ID NO: 183962

SEQ ID NO: 484278 - RNA, 64 nt, hsa; identical to SEQ ID NO: 183963

SEQ ID NO: 484279 - RNA, 64 nt, hsa; identical to SEQ ID NO: 183964

SEQ ID NO: 484280 - RNA, 64 nt, hsa; identical to SEQ ID NO: 183965

SEQ ID NO: 484281 - RNA, 64 nt, hsa; identical to SEQ ID NO: 183966

SEQ ID NO: 484282 - RNA, 64 nt, hsa; identical to SEQ ID NO: 293061

SEQ ID NO: 484283 - RNA, 64 nt, hsa; identical to SEQ ID NO: 293062

SEQ ID NO: 484284 - RNA, 64 nt, hsa; identical to SEQ ID NO: 293063

SEQ ID NO: 484285 - RNA, 64 nt, hsa; identical to SEQ ID NO: 293064

SEQ ID NO: 484286 - RNA, 64 nt, hsa; identical to SEQ ID NO: 293065

SEQ ID NO: 484287 - RNA, 64 nt, hsa; identical to SEQ ID NO: 293066

SEQ ID NO: 484288 - RNA, 64 nt, hsa; identical to SEQ ID NO: 293067

SEQ ID NO: 484289 - RNA, 64 nt, hsa; identical to SEQ ID NO: 293068

SEQ ID NO: 484290 - RNA, 64 nt, hsa; identical to SEQ ID NO: 293069

SEQ ID NO: 484291 - RNA, 64 nt, hsa; identical to SEQ ID NO: 293070

SEQ ID NO: 484292 - RNA, 64 nt, hsa
uaaaaucaguggaaaagggcagguugaaucaaggugaaucaaucugaaauugagcacaccugcc

SEQ ID NO: 484293 - RNA, 64 nt, hsa
aaacugguuuuaaaaucaguggaaaagggcagguugaaucaaggugaaucaaucugaaauugag

SEQ ID NO: 484294 - RNA, 64 nt, hsa
ugacaucuaaccaagacugugucaacaauauugcugaaucaaugguuuuguccaguuuauuggc

SEQ ID NO: 484295 - RNA, 64 nt, hsa
cacauuuguuccuuuauaucuguuuacaaaacugugaaucaaaaagacaaaacuuucuuccuag

SEQ ID NO: 484296 - RNA, 64 nt, hsa
ucuccuacuuugaaaacugaaugucagggcugagugaaucaaagugucuagacauauuugcaua

SEQ ID NO: 484297 - RNA, 64 nt, hsa
agguuaaaauuuuaauuucuacaaaauaacauucugaaucaagcacacuguauguucaguaggu

SEQ ID NO: 484298 - RNA, 64 nt, hsa
aaguuaaagacuucuuuccaguccaaggcaggccugaaucaacugucuuuaaauaaaauuuuaa

SEQ ID NO: 484299 - RNA, 64 nt, hsa
agugaaaaccuccuguuuagacuuugguggaagaugaaucaaggaagcagggcccugucuuaug

SEQ ID NO: 484300 - RNA, 64 nt, hsa
ccgaaaaaacaugaaauuuuucauuaaaaugccaugaaucaagccagggccguuggcuuaugcc

SEQ ID NO: 484301 - RNA, 64 nt, hsa
agacccagccucaaaaaaaaaaaaaaaaaagugaugaaucaaaauuagaaauuaagaguuuuaa

SEQ ID NO: 484302 - RNA, 64 nt, hsa
uguugggauuacaggcaugagacacugccuggccugaaucaaccuuuuuuaaguguaaucagaa

SEQ ID NO: 484303 - RNA, 64 nt, hsa
guagggaguuuccaccuuguacguaagcaaacacugaaucaacuuuuuuuuuuuuuucggacag

SEQ ID NO: 484304 - RNA, 64 nt, hsa
uggcagugauggggaaagcuuuuucugaagcugccuucaccacugccuaccuguucacuucaga

SEQ ID NO: 484305 - RNA, 64 nt, hsa
aagccacugagucugcccugggcucugauaaaaccuucaccauuaacuugcugugugaccuugg

SEQ ID NO: 484306 - RNA, 64 nt, hsa
accacgguaauggacagaguuaucgaggcacauacuucaccacugucacaggaagaaccugcca

SEQ ID NO: 484307 - RNA, 64 nt, hsa
accauggaaauggacagaguuaucgaggcacauacuucaccaccgucacaggaagcacuugcca

SEQ ID NO: 484308 - RNA, 64 nt, hsa
uaaauugucguaaaauacucauaaaacauacugucuucaccauuuuuaagugcacaguucagua

SEQ ID NO: 484309 - RNA, 64 nt, hsa
agguggaucuuggaaagcacuagaaacuaaacaucuucaccaggugcugaagaaaagugucuuc

SEQ ID NO: 484310 - RNA, 64 nt, hsa
uauuuuaaaugucaaugugccugagaaaugucagcuucaccacgcucuugcuuccuaaugcucu

SEQ ID NO: 484311 - RNA, 64 nt, hsa
ugucggccggcacacuggccuucuccgucacccucuucaccaucuuugcauuugucugcaucag

SEQ ID NO: 484312 - RNA, 64 nt, hsa
cguagagucacucccugcccgucucccagagaugcuucaccagcaccugccucugagaccucgc

SEQ ID NO: 484313 - RNA, 64 nt, hsa
gaccccgcgaccucuccaucuucagcuucuucaucuucaccagaggaaucacucuuguggaugu

SEQ ID NO: 484314 - RNA, 64 nt, hsa
cuucaguuuuacugcauuuucacaacauaucagacuucaccaaauauaugccuuacuauuguau

SEQ ID NO: 484315 - RNA, 64 nt, hsa
uguuccugauaauugugcacaccugaguucacagcuucaccacuuguccauugcguuauuuucu

SEQ ID NO: 484316 - RNA, 64 nt, hsa; identical to SEQ ID NO: 72506

SEQ ID NO: 484317 - RNA, 64 nt, hsa; identical to SEQ ID NO: 72507

SEQ ID NO: 484318 - RNA, 64 nt, hsa; identical to SEQ ID NO: 72508

SEQ ID NO: 484319 - RNA, 64 nt, hsa; identical to SEQ ID NO: 72509

SEQ ID NO: 484320 - RNA, 64 nt, hsa; identical to SEQ ID NO: 72510

SEQ ID NO: 484321 - RNA, 64 nt, hsa; identical to SEQ ID NO: 72511

SEQ ID NO: 484322 - RNA, 64 nt, hsa; identical to SEQ ID NO: 72512

SEQ ID NO: 484323 - RNA, 64 nt, hsa; identical to SEQ ID NO: 72513

SEQ ID NO: 484324 - RNA, 64 nt, hsa; identical to SEQ ID NO: 72514

SEQ ID NO: 484325 - RNA, 64 nt, hsa; identical to SEQ ID NO: 72515

SEQ ID NO: 484326 - RNA, 64 nt, hsa; identical to SEQ ID NO: 72516

SEQ ID NO: 484327 - RNA, 64 nt, hsa; identical to SEQ ID NO: 72517

SEQ ID NO: 484328 - RNA, 64 nt, hsa; identical to SEQ ID NO: 72518

SEQ ID NO: 484329 - RNA, 64 nt, hsa; identical to SEQ ID NO: 72519

SEQ ID NO: 484330 - RNA, 64 nt, hsa; identical to SEQ ID NO: 72520

SEQ ID NO: 484331 - RNA, 64 nt, hsa; identical to SEQ ID NO: 72521

SEQ ID NO: 484332 - RNA, 64 nt, hsa; identical to SEQ ID NO: 72522

SEQ ID NO: 484333 - RNA, 64 nt, hsa; identical to SEQ ID NO: 72523

SEQ ID NO: 484334 - RNA, 64 nt, hsa; identical to SEQ ID NO: 72524

SEQ ID NO: 484335 - RNA, 64 nt, hsa; identical to SEQ ID NO: 72525

SEQ ID NO: 484336 - RNA, 64 nt, hsa; identical to SEQ ID NO: 72526

SEQ ID NO: 484337 - RNA, 64 nt, hsa; identical to SEQ ID NO: 72527

SEQ ID NO: 484338 - RNA, 64 nt, hsa; identical to SEQ ID NO: 72528

SEQ ID NO: 484339 - RNA, 64 nt, hsa; identical to SEQ ID NO: 72529

SEQ ID NO: 484340 - RNA, 64 nt, hsa; identical to SEQ ID NO: 72530

SEQ ID NO: 484341 - RNA, 64 nt, hsa; identical to SEQ ID NO: 72531

SEQ ID NO: 484342 - RNA, 64 nt, hsa; identical to SEQ ID NO: 72532

SEQ ID NO: 484343 - RNA, 64 nt, hsa; identical to SEQ ID NO: 72533

SEQ ID NO: 484344 - RNA, 64 nt, hsa; identical to SEQ ID NO: 72534

SEQ ID NO: 484345 - RNA, 64 nt, hsa; identical to SEQ ID NO: 72535

SEQ ID NO: 484346 - RNA, 64 nt, hsa; identical to SEQ ID NO: 72536

SEQ ID NO: 484347 - RNA, 64 nt, hsa; identical to SEQ ID NO: 72537

SEQ ID NO: 484348 - RNA, 64 nt, hsa; identical to SEQ ID NO: 72538

SEQ ID NO: 484349 - RNA, 64 nt, hsa; identical to SEQ ID NO: 72539

SEQ ID NO: 484350 - RNA, 64 nt, hsa; identical to SEQ ID NO: 72540

SEQ ID NO: 484351 - RNA, 64 nt, hsa; identical to SEQ ID NO: 72541

SEQ ID NO: 484352 - RNA, 64 nt, hsa; identical to SEQ ID NO: 72542

SEQ ID NO: 484353 - RNA, 64 nt, hsa; identical to SEQ ID NO: 72543

SEQ ID NO: 484354 - RNA, 64 nt, hsa; identical to SEQ ID NO: 72544

SEQ ID NO: 484355 - RNA, 64 nt, hsa; identical to SEQ ID NO: 72545

SEQ ID NO: 484356 - RNA, 64 nt, hsa; identical to SEQ ID NO: 72546

SEQ ID NO: 484357 - RNA, 64 nt, hsa; identical to SEQ ID NO: 72547

SEQ ID NO: 484358 - RNA, 64 nt, hsa; identical to SEQ ID NO: 72548

SEQ ID NO: 484359 - RNA, 64 nt, hsa; identical to SEQ ID NO: 72549

SEQ ID NO: 484360 - RNA, 64 nt, hsa; identical to SEQ ID NO: 72550

SEQ ID NO: 484361 - RNA, 64 nt, hsa; identical to SEQ ID NO: 72551

SEQ ID NO: 484362 - RNA, 64 nt, hsa; identical to SEQ ID NO: 72552

SEQ ID NO: 484363 - RNA, 64 nt, hsa; identical to SEQ ID NO: 72553

SEQ ID NO: 484364 - RNA, 64 nt, hsa; identical to SEQ ID NO: 72554

SEQ ID NO: 484365 - RNA, 64 nt, hsa; identical to SEQ ID NO: 72555

SEQ ID NO: 484366 - RNA, 64 nt, hsa; identical to SEQ ID NO: 72556

SEQ ID NO: 484367 - RNA, 64 nt, hsa; identical to SEQ ID NO: 72557

SEQ ID NO: 484368 - RNA, 64 nt, hsa; identical to SEQ ID NO: 72558

SEQ ID NO: 484369 - RNA, 64 nt, hsa; identical to SEQ ID NO: 72559

SEQ ID NO: 484370 - RNA, 64 nt, hsa; identical to SEQ ID NO: 72560

SEQ ID NO: 484371 - RNA, 64 nt, hsa; identical to SEQ ID NO: 72561

SEQ ID NO: 484372 - RNA, 64 nt, hsa; identical to SEQ ID NO: 72562

SEQ ID NO: 484373 - RNA, 64 nt, hsa; identical to SEQ ID NO: 72563

SEQ ID NO: 484374 - RNA, 64 nt, hsa; identical to SEQ ID NO: 72564

SEQ ID NO: 484375 - RNA, 64 nt, hsa; identical to SEQ ID NO: 72565

SEQ ID NO: 484376 - RNA, 64 nt, hsa; identical to SEQ ID NO: 72566

SEQ ID NO: 484377 - RNA, 64 nt, hsa; identical to SEQ ID NO: 72567

SEQ ID NO: 484378 - RNA, 64 nt, hsa; identical to SEQ ID NO: 72568

SEQ ID NO: 484379 - RNA, 64 nt, hsa; identical to SEQ ID NO: 72569

SEQ ID NO: 484380 - RNA, 64 nt, hsa; identical to SEQ ID NO: 72570

SEQ ID NO: 484381 - RNA, 64 nt, hsa; identical to SEQ ID NO: 72571

SEQ ID NO: 484382 - RNA, 64 nt, hsa; identical to SEQ ID NO: 72572

SEQ ID NO: 484383 - RNA, 64 nt, hsa; identical to SEQ ID NO: 72573

SEQ ID NO: 484384 - RNA, 64 nt, hsa; identical to SEQ ID NO: 72574

SEQ ID NO: 484385 - RNA, 64 nt, hsa; identical to SEQ ID NO: 72575

SEQ ID NO: 484386 - RNA, 64 nt, hsa; identical to SEQ ID NO: 72576

SEQ ID NO: 484387 - RNA, 64 nt, hsa; identical to SEQ ID NO: 72577

SEQ ID NO: 484388 - RNA, 64 nt, hsa; identical to SEQ ID NO: 72578

SEQ ID NO: 484389 - RNA, 64 nt, hsa; identical to SEQ ID NO: 72579

SEQ ID NO: 484390 - RNA, 64 nt, hsa; identical to SEQ ID NO: 72580

SEQ ID NO: 484391 - RNA, 64 nt, hsa; identical to SEQ ID NO: 72581

SEQ ID NO: 484392 - RNA, 64 nt, hsa; identical to SEQ ID NO: 72582

SEQ ID NO: 484393 - RNA, 64 nt, hsa; identical to SEQ ID NO: 72583

SEQ ID NO: 484394 - RNA, 64 nt, hsa; identical to SEQ ID NO: 72584

SEQ ID NO: 484395 - RNA, 64 nt, hsa; identical to SEQ ID NO: 72585

SEQ ID NO: 484396 - RNA, 64 nt, hsa; identical to SEQ ID NO: 72586

SEQ ID NO: 484397 - RNA, 64 nt, hsa; identical to SEQ ID NO: 72587

SEQ ID NO: 484398 - RNA, 64 nt, hsa; identical to SEQ ID NO: 72588

SEQ ID NO: 484399 - RNA, 64 nt, hsa; identical to SEQ ID NO: 72589

SEQ ID NO: 484400 - RNA, 64 nt, hsa; identical to SEQ ID NO: 72590

SEQ ID NO: 484401 - RNA, 64 nt, hsa; identical to SEQ ID NO: 72591

SEQ ID NO: 484402 - RNA, 64 nt, hsa; identical to SEQ ID NO: 72592

SEQ ID NO: 484403 - RNA, 64 nt, hsa; identical to SEQ ID NO: 72593

SEQ ID NO: 484404 - RNA, 64 nt, hsa; identical to SEQ ID NO: 72594

SEQ ID NO: 484405 - RNA, 64 nt, hsa; identical to SEQ ID NO: 72595

SEQ ID NO: 484406 - RNA, 64 nt, hsa; identical to SEQ ID NO: 72596

SEQ ID NO: 484407 - RNA, 64 nt, hsa; identical to SEQ ID NO: 72597

SEQ ID NO: 484408 - RNA, 64 nt, hsa; identical to SEQ ID NO: 72598

SEQ ID NO: 484409 - RNA, 64 nt, hsa; identical to SEQ ID NO: 72599

SEQ ID NO: 484410 - RNA, 64 nt, hsa; identical to SEQ ID NO: 72600

SEQ ID NO: 484411 - RNA, 64 nt, hsa; identical to SEQ ID NO: 72601

SEQ ID NO: 484412 - RNA, 64 nt, hsa; identical to SEQ ID NO: 130638

SEQ ID NO: 484413 - RNA, 64 nt, hsa; identical to SEQ ID NO: 130639

SEQ ID NO: 484414 - RNA, 64 nt, hsa; identical to SEQ ID NO: 130640

SEQ ID NO: 484415 - RNA, 64 nt, hsa; identical to SEQ ID NO: 130641

SEQ ID NO: 484416 - RNA, 64 nt, hsa; identical to SEQ ID NO: 130642

SEQ ID NO: 484417 - RNA, 64 nt, hsa; identical to SEQ ID NO: 130643

SEQ ID NO: 484418 - RNA, 64 nt, hsa; identical to SEQ ID NO: 130644

SEQ ID NO: 484419 - RNA, 64 nt, hsa; identical to SEQ ID NO: 130645

SEQ ID NO: 484420 - RNA, 64 nt, hsa; identical to SEQ ID NO: 130646

SEQ ID NO: 484421 - RNA, 64 nt, hsa; identical to SEQ ID NO: 130647

SEQ ID NO: 484422 - RNA, 64 nt, hsa; identical to SEQ ID NO: 130648

SEQ ID NO: 484423 - RNA, 64 nt, hsa; identical to SEQ ID NO: 130649

SEQ ID NO: 484424 - RNA, 64 nt, hsa; identical to SEQ ID NO: 130650

SEQ ID NO: 484425 - RNA, 64 nt, hsa; identical to SEQ ID NO: 130651

SEQ ID NO: 484426 - RNA, 64 nt, hsa; identical to SEQ ID NO: 130652

SEQ ID NO: 484427 - RNA, 64 nt, hsa; identical to SEQ ID NO: 130653

SEQ ID NO: 484428 - RNA, 64 nt, hsa; identical to SEQ ID NO: 130654

SEQ ID NO: 484429 - RNA, 64 nt, hsa; identical to SEQ ID NO: 130655

SEQ ID NO: 484430 - RNA, 64 nt, hsa; identical to SEQ ID NO: 130656

SEQ ID NO: 484431 - RNA, 64 nt, hsa; identical to SEQ ID NO: 130657

SEQ ID NO: 484432 - RNA, 64 nt, hsa; identical to SEQ ID NO: 130658

SEQ ID NO: 484433 - RNA, 64 nt, hsa; identical to SEQ ID NO: 130659

SEQ ID NO: 484434 - RNA, 64 nt, hsa
uguuuuuguuuuuuugauuugggcuuuauuuuuuucuguguacuguacuauauuguaaaaggga

SEQ ID NO: 484435 - RNA, 64 nt, hsa
cuucccuuuccucccccucccaugcguaagacguucuguguaaccuccauuaaauuugguacaa

SEQ ID NO: 484436 - RNA, 64 nt, hsa
accuaauaccaguaugugauaaauguugauguuuucuguguacaaacacauuuucuaugcaugu

SEQ ID NO: 484437 - RNA, 64 nt, hsa
uucuguguacaaacacauuuucuaugcaugugucucuguguauauggcauauaccuaguaagua

SEQ ID NO: 484438 - RNA, 64 nt, hsa
uaaguccaagccccggcuggccugcucucacgugucuguguaagaucaugcaagagaaaucaca

SEQ ID NO: 484439 - RNA, 64 nt, hsa
uagaaacaaauaaaacucucuauauauguguaugucuguguacaaaaaaaugacagagcugaug

SEQ ID NO: 484440 - RNA, 64 nt, hsa
guauagauauguauauaugguucacauaucuggaucuguguauuugauuuuguacuuuaaaugu

SEQ ID NO: 484441 - RNA, 64 nt, hsa
cuauaacuccacaggaaauaugacuuggaagugcucuguguacuaaacaaaauaaagccccucu

SEQ ID NO: 484442 - RNA, 64 nt, hsa
aacguuguguuuccuguuucuuaaaccuagcaccucuguguauuugaaaauaaugagacaucuu

SEQ ID NO: 484443 - RNA, 64 nt, hsa
aacaucuaauauauuuaauuucuuugaagaggguucuguguacguuauuguaguucccaguuua

SEQ ID NO: 484444 - RNA, 64 nt, hsa
gaaaguggugcuagacagagcugaggucauuguaucuguguauccacauaggauuucucuuaau

SEQ ID NO: 484445 - RNA, 64 nt, hsa
cugucaugguaugugagguguggguguggcgguuucuguguacguuugcucauacacgcacauc

SEQ ID NO: 484446 - RNA, 64 nt, hsa
cugcuaagcuaaagaaacugcuuacaguuuauuuucuguguaaaaugaguaggaugucucuugg

SEQ ID NO: 484447 - RNA, 64 nt, hsa
ugacacagcuugugaauguuuagugugcugcuguucuguguacauaaagucaucaaaguggggu

SEQ ID NO: 484448 - RNA, 64 nt, hsa
ucugauguguucuuccuuuagucaucauguuaggucuguguacccuaaaucagcauauuacuca

SEQ ID NO: 484449 - RNA, 64 nt, hsa
cagaaagguuuuacaauccaaacauuauauguucucuguguaacugaauuucacuuaucuuuua

SEQ ID NO: 484450 - RNA, 64 nt, hsa
ucaaaagugaauguauaauacaauucuguuuuaaucuguguauucuuuuucuccuacuuuuuac

SEQ ID NO: 484451 - RNA, 64 nt, hsa
uucuccaggauaaaauuaaaaacccaagcauugaucuguguacguguccucgaggaucccggau

SEQ ID NO: 484452 - RNA, 64 nt, hsa
uagucgaguauucauccgagacugcagcauggugucuguguacccgcuggucuuguuuggagga

SEQ ID NO: 484453 - RNA, 64 nt, hsa
gucaucugaggugagaccaccgaggccuuuucucucuguguacagaggggaguuaggaguugcu

SEQ ID NO: 484454 - RNA, 64 nt, hsa
augccuuugggacauuaggacugcagccuuugcuucuguguauuuuggaguuuuggugacuuuu

SEQ ID NO: 484455 - RNA, 64 nt, hsa
uagacggccuuguaaauagggcaugaggaacucaucuguguauugggaugguauuagagagaga

SEQ ID NO: 484456 - RNA, 64 nt, hsa
uaccuuugucccuaguacuguaacugccaaucugucuguguaagcuggaaucuguggcaacuau

SEQ ID NO: 484457 - RNA, 64 nt, hsa
ugccccaugucuccuuggcagcaggaugcuggcaucuguguaguccucauacuguuuacugaua

SEQ ID NO: 484458 - RNA, 64 nt, hsa
uuauuuaccucugugcuguuuuaauuaccuaacgucuguguaacugcugauuugaguagugauu

SEQ ID NO: 484459 - RNA, 64 nt, hsa
acaucaccaucagcaggcuccaguugaacacuagucuguguaacuuuaaacaucuagcaguaaa

SEQ ID NO: 484460 - RNA, 64 nt, hsa
gaaaaauacuuugauuuuuauccauuucuuuuacucuguguaaagacuugagaagucuaauuca

SEQ ID NO: 484461 - RNA, 64 nt, hsa
uauaagauuaagauuauacuucaagugaugcgugucuguguauuuagcauguguacuauaauca

SEQ ID NO: 484462 - RNA, 64 nt, hsa
caaggucaacacaucaguucagucuugaugaacaucuguguacccuagaauuuccucuauacac

SEQ ID NO: 484463 - RNA, 64 nt, hsa
ccauagaucggcgggugcugcagccucacuguguucuguguacgugacaacagacuaacucgga

SEQ ID NO: 484464 - RNA, 64 nt, hsa
cgaggucaaucaugccauugaccgagugaccacuucuguguagaguuucaccuccaaguuuuac

SEQ ID NO: 484465 - RNA, 64 nt, hsa
uuuauugugguaauuauguuuugugauucaaacuucuguguacugggugaugcacccauuguga

SEQ ID NO: 484466 - RNA, 64 nt, hsa
cacaacuguugaugguaggcuguauaguuuuuagucuguguaguuaauuuaauuugcaguuugu

SEQ ID NO: 484467 - RNA, 64 nt, hsa
cuugagacccuucaccagaaugucaaucuuuuuuucuguguaacauggaaacuugugugaccau

SEQ ID NO: 484468 - RNA, 64 nt, hsa
auauuuggcucucugccuucucuucauguuggccucuguguacuauagacccuuuggacuuuag

SEQ ID NO: 484469 - RNA, 64 nt, hsa
ucuguguauguuguguaugguauaguaugcuauuucuguguauguucaaauuguuuauguauau

SEQ ID NO: 484470 - RNA, 64 nt, hsa
agcugggagcuaaauaaggguauaauaugcuacuucuguguauguuguguaugguauaguaugc

SEQ ID NO: 484471 - RNA, 64 nt, hsa
guuuguguauuuguauguuguaagcguuuccuaaucuguguauaucuagauguuuuuaauaaga

SEQ ID NO: 484472 - RNA, 64 nt, hsa
uacuagucauuccauaagagucuuaaaggacugcucuguguaacacugugacugccgugugugc

SEQ ID NO: 484473 - RNA, 64 nt, hsa
acccccaggccuccccggccuuguacaguguaccucuguguaucuguacagccucgcuccugcc

SEQ ID NO: 484474 - RNA, 64 nt, hsa
guguguaugauuuuugccucagaaacuauacucuucuguguaacagaccaauaaacaacauuug

SEQ ID NO: 484475 - RNA, 64 nt, hsa
gaccacggcgcuuaucagcauuguuucuuuggagucuguguaauggaauguauuuuucaaauac

SEQ ID NO: 484476 - RNA, 64 nt, hsa
cccuagugaugcugcgagugcuguuggucccaguucuguguagcuugcccugccccaugaaggg

SEQ ID NO: 484477 - RNA, 64 nt, hsa
gguggaggaucucgguuugcaaauuagauaauacucuguguauaaugcuacauaucaauaacua

SEQ ID NO: 484478 - RNA, 64 nt, hsa
accaucaugguuaggcacgauaacuaaucuuuguucuguguaaaaaaauauggagagugaaaca

SEQ ID NO: 484479 - RNA, 64 nt, hsa
uguauucuguguauuauucuuuauuuugggaccuucuguguaaaagaaaauauuaccuaaauug

SEQ ID NO: 484480 - RNA, 64 nt, hsa
ugugaaguaaauugauauaaccuauugacuguauucuguguauuauucuuuauuuugggaccuu

SEQ ID NO: 484481 - RNA, 64 nt, hsa
auuaugggaaguuucuugucugugauauggggugucuguguacauauauguauauuuccuuuuu

SEQ ID NO: 484482 - RNA, 64 nt, hsa
gcucuuaauaguuuuuaauaaguugauauuuuuuucuguguagauuuaaauaauuucuuuaaaa

SEQ ID NO: 484483 - RNA, 64 nt, hsa
acuuacuguaauguauuauaccuaaauguuuauuaaaaguuagaagaaaugaguaccaacagga

SEQ ID NO: 484484 - RNA, 64 nt, hsa
uggauuagugccauuauucagggcugguauuaauaaaaguuagcuuuuaucugcagggcuaggu

SEQ ID NO: 484485 - RNA, 64 nt, hsa
augaauuaauaaacauuuggagguauauaaaguaaaaaguuaaagucuuuccuguaaguuaaca

SEQ ID NO: 484486 - RNA, 64 nt, hsa
uguuaccaaauuagaacuaaaacaaaguuacauaaaaaguuauugugacuccacuuaauuuuag

SEQ ID NO: 484487 - RNA, 64 nt, hsa
gccucagcuuacugaguaaggauauguauuucuuaaaaguuaguuuauccacuucagauuucau

SEQ ID NO: 484488 - RNA, 64 nt, hsa
ggggagaaaguaaucucaguuguuuuagaaacgaaaaaguuaagcauuguuuacuugaaguggg

SEQ ID NO: 484489 - RNA, 64 nt, hsa
cuuuuuguauaggcuaagaaacagguuaucagugaaaaguuaauuauggcuuuggcacuagaau

SEQ ID NO: 484490 - RNA, 64 nt, hsa
aucuauuuuuucuugacuucuuuuauauaguaauaaaaguuauuuuggaagcucuuuguguguu

SEQ ID NO: 484491 - RNA, 64 nt, hsa
cuaccuguccugaaccugguccugugggccauugaaaaguuagaucugugaucucugggguuuu

SEQ ID NO: 484492 - RNA, 64 nt, hsa
gaauuuaccauauaucuuuguuuuucuucaacgaaaaaguuaauugaggcaaugucaucugcuc

SEQ ID NO: 484493 - RNA, 64 nt, hsa
auguuuaucucaaaaguuaaaauuauccauucucaaaaguuaaaauuauauauauauauauaua

SEQ ID NO: 484494 - RNA, 64 nt, hsa
gauuuauguuuuaugcaggcugaauguuuaucucaaaaguuaaaauuauccauucucaaaaguu

SEQ ID NO: 484495 - RNA, 64 nt, hsa
gaccagaaauuuuucuucuaaagaauuuaauucuaaaaguuauagacauucccaaagauauacc

SEQ ID NO: 484496 - RNA, 64 nt, hsa
aaaaaaucaaaauaauuaaaauaaauuguuagagaaaaguuacuuuaaaaauagcuauaacgcu

SEQ ID NO: 484497 - RNA, 64 nt, hsa
uuggucucuaauauauuuggaacugauucauaagaaaaguuauuaaaauuaucuuugaaacacc

SEQ ID NO: 484498 - RNA, 64 nt, hsa
caaagucaagaggaggaaguuuuuguggacaaugaaaaguuauuuucguaccuuucuaccaaaa

SEQ ID NO: 484499 - RNA, 64 nt, hsa
aauuuauuauucuaauccaaaaguuaccccacacaaaaguuacugagcuuccuuauguuucaca

SEQ ID NO: 484500 - RNA, 64 nt, hsa
uaugggcuuauauugaaauuuauuauucuaauccaaaaguuaccccacacaaaaguuacugagc

SEQ ID NO: 484501 - RNA, 64 nt, hsa
guuuugaggcugaacauaauuucauuaucccucaaaaaguuaccaccacaucagaaaaaauaaa

SEQ ID NO: 484502 - RNA, 64 nt, hsa
uuuuuuccaguguauugcucauauuaucagaaggaaaaguuauuuaaguaugucaguuaauugu

SEQ ID NO: 484503 - RNA, 64 nt, hsa
ccauauuuuagaagcuaugaaaguccuuuuaugaaaaaguuacugauugcuucucaguuauuag

SEQ ID NO: 484504 - RNA, 64 nt, hsa
agaguaagauaaagcagauucugucuucauugcaaaaaguuauucucaauggaagaauggcauc

SEQ ID NO: 484505 - RNA, 64 nt, hsa
auauugcagauuacuuaaauauggccaucaaaacaaaaguuacaacacguaucucuuuucaucu

SEQ ID NO: 484506 - RNA, 64 nt, hsa
cagaauuguguugacugggggaggugaaucacaaaaaaguuacgaggaguuuaagaguuaaaua

SEQ ID NO: 484507 - RNA, 64 nt, hsa
auccucauuuuacacaugagggaccgaaggauagaaaaguuauuuuucaaaggucuugcaguua

SEQ ID NO: 484508 - RNA, 64 nt, hsa
uaugcuuaaccacuuaaugugaugaaauauuccuaaaaguuaaaugacuauuaaagcauauauu

SEQ ID NO: 484509 - RNA, 64 nt, hsa
cuguauaauauuagacaaaauaguaagcuuuauaaaaaguuauuuuugguaaaugguaaggaau

SEQ ID NO: 484510 - RNA, 64 nt, hsa
cucauaagcuauucuaauuuuugagagaaacacaaaaaguuauagauugauagucuguauaaua

SEQ ID NO: 484511 - RNA, 64 nt, hsa
agaaggaagaaaugguuuucuuaaauaccuacaaaaaaguuacugugguaucuaugaguuauca

SEQ ID NO: 484512 - RNA, 64 nt, hsa
cuuccuacucaacuauuuauaaucucauuaauuaaaaaguuauaauuuuagauaaaaauucuag

SEQ ID NO: 484513 - RNA, 64 nt, hsa
cacagcccuaugacuacuaucuuugcauuaguuaaaaaguuaguauauaggcaucaaacaaccu

SEQ ID NO: 484514 - RNA, 64 nt, hsa
uaaaacuuugguuguuuuccuguaauauaaaagaaaaaguuaauuuaucaauugauugaauaca

SEQ ID NO: 484515 - RNA, 64 nt, hsa
cauucauuucauacucucaaaacaccaaacuucaaaaaguuaauuauugucauaaugcauuauu

SEQ ID NO: 484516 - RNA, 64 nt, hsa
guaccuauuauuguucccuggugaaacugaggagaaaaguuaaucaaccagguuacucccacag

SEQ ID NO: 484517 - RNA, 64 nt, hsa
auggacccaugagaguauauuuuuaugagggagcaaaaguuagacugagaacaaacguuagaaa

SEQ ID NO: 484518 - RNA, 64 nt, hsa
uugauuauguauacaugacaccuaaagagggaacaaaaguuaguuuuauuuuuuuaauaaacaa

SEQ ID NO: 484519 - RNA, 64 nt, hsa
gauaaaguuuccauauuuuucuggaaaaguuaaaaaaaguuacaugucauuuggagaaaauacg

SEQ ID NO: 484520 - RNA, 64 nt, hsa
auaagugguugauaaaguuuccauauuuuucuggaaaaguuaaaaaaaguuacaugucauuugg

SEQ ID NO: 484521 - RNA, 64 nt, hsa
gagacucugucucaaaaaaaaaaaaaauuaugaaaaaaguuaugggauuaaagaaagucaggau

SEQ ID NO: 484522 - RNA, 64 nt, hsa
ugggauaaaaaagguuauggguaacuuaugguauaaaaguuaugaaaaaaggccaggugcagug

SEQ ID NO: 484523 - RNA, 64 nt, hsa
aaauuaaaaaaaaauuaaaaguuaugggauuaaaaaaaguuaugggauaaaaaagguuaugggu

SEQ ID NO: 484524 - RNA, 64 nt, hsa
aucuaaaagcuggccacuaaauuaaaaaaaaauuaaaaguuaugggauuaaaaaaaguuauggg

SEQ ID NO: 484525 - RNA, 64 nt, hsa
aauccaugauuuauacucagaaucgacauucuuaaaaaguuauuucaagggauggcauaacugu

SEQ ID NO: 484526 - RNA, 64 nt, hsa
uuuggggguaaagcauuuuggaggaauaaccuuaaaaaguuaaaaagucauuguaauaacugau

SEQ ID NO: 484527 - RNA, 64 nt, hsa
ccuuccaagaccaggcgcgguggcuaaaaauacaaaaaguuagccgggcgugguggcaugcgug

SEQ ID NO: 484528 - RNA, 64 nt, hsa
aauagagacccacagagcuaauguuuauccauuuaaaaguuauaaaucaaaauaacagauuauc

SEQ ID NO: 484529 - RNA, 64 nt, hsa
uaauauaaugcaacauuuaagucaucuuaaggugaaaaguuauugaaguguucuucucucaagu

SEQ ID NO: 484530 - RNA, 64 nt, hsa
agggaaaugauucaaauuuuuucauaauucaaacaaaaguuauuacacuaaaaguauuauagua

SEQ ID NO: 484531 - RNA, 64 nt, hsa
gagaaagcaagauccaaauugauuuugggauauuaaaaguuaacagaacacugaacaaggaaag

SEQ ID NO: 484532 - RNA, 64 nt, hsa
aggauaagucucuggagcagaauuuaucacacacaaaaguuacaccaacagaauaccaagcaga

SEQ ID NO: 484533 - RNA, 64 nt, hsa
uauccuuuaaaucaaacugggcuauaauagcaauaaaaguuagacgaaguguagaaaauaaaau

SEQ ID NO: 484534 - RNA, 64 nt, hsa
agaugagacaucuuaauuuguuuugacauauuuuaaaaguuaauuauuagauaaaggcucaaag

SEQ ID NO: 484535 - RNA, 64 nt, hsa
gcaaacuuaguucuguaacugcauuuuucaccuuaaaaguuaaaugaaaugcaugaugguauuu

SEQ ID NO: 484536 - RNA, 64 nt, hsa
aggcaagauaucauuuauuggacuucuugaaaauaaaaguuacaaaauccaacaacaacaacaa

SEQ ID NO: 484537 - RNA, 64 nt, hsa
aagugcacuaggggacaguugauuucaaucuaagaaaaguuaacacuugggaauuacaagaagu

SEQ ID NO: 484538 - RNA, 64 nt, hsa
agcaaguuguuuucuuucagaguuuccuccuucaaaaaguuauauugcauuuacaaauguuuua

SEQ ID NO: 484539 - RNA, 64 nt, hsa
gcugaucaagaaauuuaaaacaacaacaacaacaaaaaguuacgggguucaucuccuacacaau

SEQ ID NO: 484540 - RNA, 64 nt, hsa
uguguuucuaauuuaccguuuaaauuuauuuguaaaaaguuaagggagaguuggucuuucccug

SEQ ID NO: 484541 - RNA, 64 nt, hsa
auuaucgcccacauuuguaauauagucgccauugaaaaguuaauuauccuuuuuuuagggauuu

SEQ ID NO: 484542 - RNA, 64 nt, hsa
auauagaacgaauuuggguuuuuaaagaaauauuaaaaguuagguacuguaaguguucuuaaaa

SEQ ID NO: 484543 - RNA, 64 nt, hsa
aagcucaguuaguuuuuuuauuauuauuauuauuaaaaguuaauucaggacugaugugaccuac

SEQ ID NO: 484544 - RNA, 64 nt, hsa
caaaccaaagcaacuuaguaaaauaauagguauaaaaaguuauucuguaagucuguugguugua

SEQ ID NO: 484545 - RNA, 64 nt, hsa
gaaaguaaauauuccagaaguugauagccugguuaaaaguuagauccucuauuaccauucuaag

SEQ ID NO: 484546 - RNA, 64 nt, hsa
aauguauauggguaaggaccugaaagauccauggaaaaguuaacccaguugagauuuuuaaaaa

SEQ ID NO: 484547 - RNA, 64 nt, hsa
agagaaaauuaaugaaugagaugacuaacgguagaaaaguuauugccuaggagugugagacuga

SEQ ID NO: 484548 - RNA, 64 nt, hsa
caccaguuagaaguuuguuugcgauaauccaagcaaaaguuaaugguggcuucaacuagguagu

SEQ ID NO: 484549 - RNA, 64 nt, hsa
cuaugucucgacuuuucugaugaaguuauaccagaaaaguuaauuauuugaugggccugccaug

SEQ ID NO: 484550 - RNA, 64 nt, hsa
agcaauaucaacguuuuaacaugcucaccucagcaaaaguuaagacagcuguaaauggacugau

SEQ ID NO: 484551 - RNA, 64 nt, hsa
auaccaauaaaugcuuuagcugcaacuaaaauaaaaaaguuaaagguaagaaaaugacugccuc

SEQ ID NO: 484552 - RNA, 64 nt, hsa
ggcuuuucuuuggacaguuuucaccaucucuuguaaaaguuaauucucaccauuccugugguac

SEQ ID NO: 484553 - RNA, 64 nt, hsa
uacuaaauuaauacuccuccuuuuacagaauuagaaaaguuaacauuuaucuuuaggugguuuc

SEQ ID NO: 484554 - RNA, 64 nt, hsa
cauuuaguguucucacagcuuggauauuuuucugaaaaguuauuugccaaaacugaaauccuuc

SEQ ID NO: 484555 - RNA, 64 nt, hsa
uuuggauccuauugaggggauaagaggaugucaaaaaaguuaaauaccuaaguagaaaaaaaua

SEQ ID NO: 484556 - RNA, 64 nt, hsa
agguucuacauuuuucuuaaauaaauuagggaguaaaaguuauacuuaacuugucugucuauua

SEQ ID NO: 484557 - RNA, 64 nt, hsa
caaauuccucuuccucugagaaccagugaaacagaaaaguuaaucugcuuucaaauuacaaugg

SEQ ID NO: 484558 - RNA, 64 nt, hsa
aacugaaaagcugagaccaagagcaaggaagguaaaaaguuaacaggcaaacauuuucucuuag

SEQ ID NO: 484559 - RNA, 64 nt, hsa
uuaguuuugcauaguucuagugcagcugaaauugaaaaguuauuucccuuuagcuguguuauua

SEQ ID NO: 484560 - RNA, 64 nt, hsa
cauucuaaagauagaguaaaaagaaaacaaaaccaaaaguuauuaaaauuguuguccgguuuac

SEQ ID NO: 484561 - RNA, 64 nt, hsa; identical to SEQ ID NO: 237905

SEQ ID NO: 484562 - RNA, 64 nt, hsa; identical to SEQ ID NO: 237906

SEQ ID NO: 484563 - RNA, 64 nt, hsa
aagaguggggaacagggccagcaagacagaccaccagccagaaaucucugauaucaaccucaug

SEQ ID NO: 484564 - RNA, 64 nt, hsa
auggggaagaaauaccccagacccaacaaaccuccagccagaaagccagcuauuuugcauuuga

SEQ ID NO: 484565 - RNA, 64 nt, hsa
ccaagacuggaugcuggaucucauagaaaauucacagccagacaaucuucuaaucuggagucuu

SEQ ID NO: 484566 - RNA, 64 nt, hsa
cuucauggaccaacagugauugaggauuugugggcagccagagggagucugacugaaguuuacu

SEQ ID NO: 484567 - RNA, 64 nt, hsa
cuuuccaucugcuuguauuuuccauacacauccccagccagaaguuaguguccgaagaccgaau

SEQ ID NO: 484568 - RNA, 64 nt, hsa
gacagggccuagcuuucauuugacacacagacuacagccagaagcccauggagcagggauguca

SEQ ID NO: 484569 - RNA, 64 nt, hsa
agagauacaguccacagguggacaaagggauccccagccagagagagagagaccagccaacagc

SEQ ID NO: 484570 - RNA, 64 nt, hsa
gagagagaccagccaacagcuugauagaccagugcagccagagagaccaccaaacagagccccc

SEQ ID NO: 484571 - RNA, 64 nt, hsa
cccccagcaaaucaggaccuaucuaggcagaccccagccagacccccgccagacagacucccaa

SEQ ID NO: 484572 - RNA, 64 nt, hsa
gagggaugcucagggagggauaugcuggugugagcagccagagggagagugugucuccuuccug

SEQ ID NO: 484573 - RNA, 64 nt, hsa
ugguuuuguuucuccuggggcuguguucugcaggcagccagaaaaggaggaggcacgggugagc

SEQ ID NO: 484574 - RNA, 64 nt, hsa
ggcaccacgcaagggcagagcugggcggcauccacagccagagaggcagaggcaagagcagagc

SEQ ID NO: 484575 - RNA, 64 nt, hsa
uugcauggaugcaguugugacucuggggacaaugcagccagaagcugagggaccagcacuuggu

SEQ ID NO: 484576 - RNA, 64 nt, hsa
ugagagaugugcccacugcccgugcagccuccuucagccagagcccagagcauagacaggagug

SEQ ID NO: 484577 - RNA, 64 nt, hsa
agguuuccuggagcucuuggcuucagccagcccccagccagaguccuggcuaggacagugaccu

SEQ ID NO: 484578 - RNA, 64 nt, hsa
gguagcccuggcuagacugaauuacacuagaaaucagccagaaggaagcguccuugggauccca

SEQ ID NO: 484579 - RNA, 64 nt, hsa
ugggugauucuguccucaaauaaagcccuucacucagccagaccucuccacagcucaaagcauu

SEQ ID NO: 484580 - RNA, 64 nt, hsa
ugccugcaucuauucuuuguaccaucugucuugccagccagaagccucugccucccuagcuuuu

SEQ ID NO: 484581 - RNA, 64 nt, hsa
ggcagcuugagagggcaaacccaaaaccucaugacagccagagccugucuuucagcauucaguc

SEQ ID NO: 484582 - RNA, 64 nt, hsa
guggcucuuucagaagacccaggaagggcagcuccagccagaggaccuuccuggcuaugcaggu

SEQ ID NO: 484583 - RNA, 64 nt, hsa
uucacuucagccgcccaauuccaucucuccucugcagccagauucacuggcugaugcucacugc

SEQ ID NO: 484584 - RNA, 64 nt, hsa
cgagucucggggguggucacaaccccacaucccacagccagaaagaacaauggucaucugagaa

SEQ ID NO: 484585 - RNA, 64 nt, hsa
ccuucacauagucauugucccuuacugccagacccagccagacuuugcccugacggaguggccc

SEQ ID NO: 484586 - RNA, 64 nt, hsa
aguucacuaauguuagccuuauuuaggacaaagucagccagacaccuuguacugggcacgcguc

SEQ ID NO: 484587 - RNA, 64 nt, hsa
gccuuuucuacacaggauccaaggucacgagaagcagccagagugccccgccuccgccggcucu

SEQ ID NO: 484588 - RNA, 64 nt, hsa
cagcgcgguggcugggucugcacacuggccucugcagccagauuucuauauugggaguuuuuua

SEQ ID NO: 484589 - RNA, 64 nt, hsa
cccguggugaggccauguucucauaaucaggcuccagccagaaaaauaagaaacaccgcaacag

SEQ ID NO: 484590 - RNA, 64 nt, hsa
uucucacagaagcugcgacucuagaccaggccugcagccagaacgccgauuccgggagcuuggg

SEQ ID NO: 484591 - RNA, 64 nt, hsa
agacucggagggagcugcucagggccggugagcgcagccagaagcccuggccagugaggagcuc

SEQ ID NO: 484592 - RNA, 64 nt, hsa
ggcauuggccccagccuucugaaagccggcgcugcagccagaggccgcacgcugcacugucgcg

SEQ ID NO: 484593 - RNA, 64 nt, hsa
caaaggaacaccaggcccagcgcccucuuugguccagccagacccugggcccucucuccucacu

SEQ ID NO: 484594 - RNA, 64 nt, hsa
ucccuggccugugcgucugcccccuucugagaugcagccagaagcucugugccugcugcaaaga

SEQ ID NO: 484595 - RNA, 64 nt, hsa
ucuggcuguuguccaaagcaugggauucuggaggcagccagagcccugcugaguuccugcuuuc

SEQ ID NO: 484596 - RNA, 64 nt, hsa
acaggcuucuuccugagauauccucagguuuucucagccagagagcugccuuuagaguccaacu

SEQ ID NO: 484597 - RNA, 64 nt, hsa
aucccaccucccuuucuuagcagaaucuaaauuacagccagaccucuggcugcagaggagucug

SEQ ID NO: 484598 - RNA, 64 nt, hsa
ccuccuuggugguaaaagaggguugcauuucuugcagccagaaggcagagaaagugaagaccaa

SEQ ID NO: 484599 - RNA, 64 nt, hsa
cucaggcagcuggggcugaggcccaaaggcagaacagccagagggggcaggaggggaccaaaaa

SEQ ID NO: 484600 - RNA, 64 nt, hsa
ugcugcccaggcagcguggaggggaaggguagggcagccagagaaaggagcagagaaggcacac

SEQ ID NO: 484601 - RNA, 58 nt, hsa; identical to SEQ ID NO: 165744

SEQ ID NO: 484602 - RNA, 64 nt, hsa
uggauaggggcagggcacucauuaaagugcaucacagccagagccuguugugucucaguugggu

SEQ ID NO: 484603 - RNA, 64 nt, hsa
ggggggugacugggacccagccuuugggccuccccagccagagcagcccagcaacagugugucc

SEQ ID NO: 484604 - RNA, 64 nt, hsa
cauguguccucugacguaugcccccaaagcucuccagccagacugaggucacagaugugggaga

SEQ ID NO: 484605 - RNA, 64 nt, hsa
cccuccucccguccaccccagaggggaaguuccucagccagacucuucagccaaaugccccaac

SEQ ID NO: 484606 - RNA, 64 nt, hsa
cagcagaugaguugaguggggcagagggacagggcagccagaccaaggccaagccuucucaccc

SEQ ID NO: 484607 - RNA, 64 nt, hsa
gacaggagacccuaaggccccgggagcccagugccagccagagguugugcaggcaaggagacca

SEQ ID NO: 484608 - RNA, 64 nt, hsa
cauuguugauuguuaugacugguacacucuggcccagccagagcuauaauuguuuuuuaaaugu

SEQ ID NO: 484609 - RNA, 64 nt, hsa
cagaaaccucagugaaaucaagaaauaaugaucccagccagacugagaaaauguaagcagacag

SEQ ID NO: 484610 - RNA, 60 nt, hsa
agauguauccuagcuuuuagcuauaaaccacucaaagauucagcccccagaucccacagu

SEQ ID NO: 484611 - RNA, 60 nt, hsa
ucugcuccugaaggcagggugaguucucuccucaaagaagacuucaaaccauuuaacugg

SEQ ID NO: 484612 - RNA, 60 nt, hsa
aaauggauugaaagagugaaagucacuggucucaaagaaucuacggaauuuagcauuuug

SEQ ID NO: 484613 - RNA, 60 nt, hsa
cauuugacuuggaagcaauguuugaacaaacucaaagaacagcuguggaaagaagucaca

SEQ ID NO: 484614 - RNA, 60 nt, hsa
uguaccuuauugaucuuugcccauggaagucucaaagaucuuucguugguuguuucucug

SEQ ID NO: 484615 - RNA, 60 nt, hsa
agaauccugcuuuacaggaucauguaaaugcucaaagauguaauguaguucuuuguuccu

SEQ ID NO: 484616 - RNA, 60 nt, hsa
acuucacauaaacuuccuguucuccaaaaccucaaagagauagaguuaaugaguuguugu

SEQ ID NO: 484617 - RNA, 60 nt, hsa
ucuaaagacauugucaccgagugugugugacucaaagaucaagagugaggcuaaacugcg

SEQ ID NO: 484618 - RNA, 60 nt, hsa
accaccaaccccacagaaauacgaaaaacccucaaagauuacuauaaacaccuguaugca

SEQ ID NO: 484619 - RNA, 60 nt, hsa
cagccauuguggaaagcacugcagcgauuucucaaagacauaaaagaacauagcauucaa

SEQ ID NO: 484620 - RNA, 60 nt, hsa
agugggagcuaaacauugauuacacauggacucaaagaagggaacaguagacacgggcuu

SEQ ID NO: 484621 - RNA, 60 nt, hsa
guggaaaagcauuuagauacuacuacucagcucaaagacaugaaaggacucauacuggag

SEQ ID NO: 484622 - RNA, 60 nt, hsa
gugggaaaguguucguauaucacaacucugcucaaagacaugaaaagacucauacuggag

SEQ ID NO: 484623 - RNA, 64 nt, hsa
uccauuuccucucauuccauucauggguggacagcgaccacaaagacucauggggcuucccugg

SEQ ID NO: 484624 - RNA, 64 nt, hsa
cggccucccaaaguucugggauuacaggugugagcgaccacauccggucaaguucugacuuuuc

SEQ ID NO: 484625 - RNA, 64 nt, hsa
auggaacaaagacagauaccuucagaggguuuugcgaccacaagcuucaugaugucuuaauugc

SEQ ID NO: 484626 - RNA, 64 nt, hsa
gacaaaaucagcuuuacaacaaucccuagaggcucgaccacagaauaaugccagucaccacccu

SEQ ID NO: 484627 - RNA, 64 nt, hsa
ggcacggugguacugggggugcggcagggacacccgaccacaccagagcgugggagacgguggg

SEQ ID NO: 484628 - RNA, 64 nt, hsa
ucuuacugcaucagaccuuccuuaagaaugaaaccgaccacauggagggaaaaagaaaacaauu

SEQ ID NO: 484629 - RNA, 64 nt, hsa
aagugcugggauuccaggugugagccgcugcggccgaccacauuugauguuugaaguuguaauc

SEQ ID NO: 484630 - RNA, 64 nt, hsa
caacaaaaugaaacgcaaccaccaccaaccacugcgaccacaagaaggaugauucaacagguuu

SEQ ID NO: 484631 - RNA, 64 nt, hsa
gucccccagccggcuggguggcucuggggccaaccgaccacaggugucacugaucacagguguc

SEQ ID NO: 484632 - RNA, 64 nt, hsa
ugcugugauuaacgaguaacuccaaguacaaggccgaccacaauggaugcugcaaaaacguuga

SEQ ID NO: 484633 - RNA, 64 nt, hsa
ugucagcaauagugaccucauuaccaagggguggcgaccacauuaccaagcgcaauuccccauu

SEQ ID NO: 484634 - RNA, 64 nt, hsa
cugucuugcccgccugcccgccugccccuccugccgaccacacggaguucagugccuggguguu

SEQ ID NO: 484635 - RNA, 64 nt, hsa
ccugcgcuaccgucuguggucucaauaaagaaaccgaccacauggccccggacuccuacgugcc

SEQ ID NO: 484636 - RNA, 64 nt, hsa
gguguugccaacucuuggcagcacugggccaaaccgaccacauaccaugagcucccaaauggcg

SEQ ID NO: 484637 - RNA, 64 nt, hsa
caaaaucugaaagcuaacaccccacuuugacccucgaccacaccugaaaaugucucaaaucucc

SEQ ID NO: 484638 - RNA, 64 nt, hsa
uguagugauugauccuuaccuuguauaucaucuucgaccacaucagaaagaaggaaucauauuc

SEQ ID NO: 484639 - RNA, 64 nt, hsa
ggugcuuuggcccuaauagcacuggacaacaccacgaccacauggaaacauauuuuuggaagca

SEQ ID NO: 484640 - RNA, 64 nt, hsa
uguugacagggagccaaggcgaggcggcugucugcgaccacagcagccucgaaacaccaggcag

SEQ ID NO: 484641 - RNA, 64 nt, hsa
cuuuaacagggauccaagaucuuugcaguucaaucgaccacauaggaauuuccaggcaccaaaa

SEQ ID NO: 484642 - RNA, 64 nt, hsa
ggagguuaagugacuugcccaguuucagggcuaacgaccacagggucugcacucuaacccuagg

SEQ ID NO: 484643 - RNA, 64 nt, hsa
ccugagcuuacaaagcauggcaggccaagggccucgaccacaggccagcauuagcagaacauau

SEQ ID NO: 484644 - RNA, 64 nt, hsa
ggcccucccuggcucccugucccugggcucagcacgaccacacaggacacccagccagggaauu

SEQ ID NO: 484645 - RNA, 64 nt, hsa
ggagagacacccccauccccacgcgggccgggcacgaccacaccgggcggaccgcuggacagac

SEQ ID NO: 484646 - RNA, 64 nt, hsa
agcgacguauuuccuguuguagucauuuuuagcucgaccacaucaucaggucuuugccaccgag

SEQ ID NO: 484647 - RNA, 64 nt, hsa
gggugcugcuggacggcaagcccaucagcgccuacgaccacaaguacuugcaccgugugguaug

SEQ ID NO: 484648 - RNA, 64 nt, hsa
guaaaaucugguauuuacuggcuuacacucaaaacgaccacaguccuaccucaguucaagguaa

SEQ ID NO: 484649 - RNA, 51 nt, hsa
cugaugaucauguuuuaugaccgaccacacguguccuaagcagauugcuua

SEQ ID NO: 484650 - RNA, 64 nt, hsa
ggugaagaaaagugaacgcccuuguagagcagcccgaccacaggagcauggccgcugccagccc

SEQ ID NO: 484651 - RNA, 64 nt, hsa
ugggucucccuccgagucacucugcagcuuggcccgaccacaaacaggacagagccaggcuguu

SEQ ID NO: 484652 - RNA, 64 nt, hsa
cuccagcuuuccugguuagcgcaacgcggcuccacgaccacacgcacuucaggguggaagcugg

SEQ ID NO: 484653 - RNA, 64 nt, hsa
gcggcuucucugccauuagcagcccugggcgggccgaccacacucgaggcugcggugcuacggg

SEQ ID NO: 484654 - RNA, 64 nt, hsa
gccuguguccaggccuacucccuggucucaccuccgaccacagucggcggcaccuucucagagu

SEQ ID NO: 484655 - RNA, 64 nt, hsa
ccucuaccaucuguaaacaacugggugccuuccccgaccacaccccaaugccuucccagcuugg

SEQ ID NO: 484656 - RNA, 64 nt, hsa
guucugaaaggagacauugcucuaugucugccuucgaccacagcaagccaucauccuccauugc

SEQ ID NO: 484657 - RNA, 64 nt, hsa
aguggacuuuuugcgggguguggcggccgggucucgaccacagcguggaucaccggcuguuuag

SEQ ID NO: 484658 - RNA, 64 nt, hsa
cgauuuuuccccaggcuuuccuguagcccauguucgaccacaugcaccucgagcaacacuugug

SEQ ID NO: 484659 - RNA, 64 nt, hsa
cacccagcaggcgcaaccagagucucgugugugccgaccacaggagccaagccuuuuccacugu

SEQ ID NO: 484660 - RNA, 64 nt, hsa
cccugauggcucucaccaccauggcgucacuccgcgaccacagcacaccagaaacacucagcau

SEQ ID NO: 484661 - RNA, 64 nt, hsa
uucagagagagagagggagucaaggugugaccgucgaccacagccagugucaggccucugccuc

SEQ ID NO: 484662 - RNA, 64 nt, hsa
ugcuacacucugacacaaacauuuacugcuggaucgaccacaaagcagauguggcuucuuaggu

SEQ ID NO: 484663 - RNA, 64 nt, hsa
uugcuugaggcuccagacauacucaccucuaccucgaccacaucaaccccaucaccaagaggag

SEQ ID NO: 484664 - RNA, 64 nt, hsa
gccuuccucccuggguuugucuggacaccgagagcgaccacauccuggagaagccaggagaaaa

SEQ ID NO: 484665 - RNA, 64 nt, hsa
cuaagcauuuucacagccguuucuucauauaauccgaccacagugggaggugugauuuacccau

SEQ ID NO: 484666 - RNA, 64 nt, hsa
gcauugcuguugaauggugagcacgugaccaugccgaccacaaaggugucugcggaaacucgag

SEQ ID NO: 484667 - RNA, 64 nt, hsa
cacugaacacgcgugugugcaucgcacgcggccacgaccacagacacgcaugcacacacgcaga

SEQ ID NO: 484668 - RNA, 64 nt, hsa
uguuccucugccuggccauccugcuggagcaccgcgaccacaucaugcgcaaugggcuggauua

SEQ ID NO: 484669 - RNA, 64 nt, hsa
uuggccacgucuuccuucugccugagcuuccccccgaccacaggcccuuuccucaggcaagguc

SEQ ID NO: 484670 - RNA, 64 nt, hsa
uuuuauccaauacucauuaaauaagugggccacuuaggaagauucaaaaucuugguuauuacau

SEQ ID NO: 484671 - RNA, 64 nt, hsa
agaccuguuugggggcgcugcaggaauaacuauauaggaagauuuuuccuaaaaugaaagaaca

SEQ ID NO: 484672 - RNA, 64 nt, hsa
cuccccuacucccuuauguguuguguauuccacuuaggaagaaaugcccaaaagagguccuggc

SEQ ID NO: 484673 - RNA, 64 nt, hsa
aaaguccacuuuacucaaauuggugaacaguguauaggaagaagccagcaggagcucugacuaa

SEQ ID NO: 484674 - RNA, 64 nt, hsa
accugcaugagugaaggauuuccacguagacaccuaggaagagcccgcaugcccuagacucacu

SEQ ID NO: 484675 - RNA, 64 nt, hsa
ugcgucuauuucuucuauugugcuucuuuggggauaggaagagaaacauaacuacuguuccagg

SEQ ID NO: 484676 - RNA, 64 nt, hsa
auauuuuuacugugaagguguuuucaguuguucuuaggaagaacagcugauagaaauucaagau

SEQ ID NO: 484677 - RNA, 64 nt, hsa
cuccauagcucucugcccugaugugugggggaacuaggaagaaguccuuugaccucaccaggcc

SEQ ID NO: 484678 - RNA, 64 nt, hsa
aaauacuuaguuguuccaggcaccuaaaaucaauuaggaagacauaguucccuucuuuuuuggg

SEQ ID NO: 484679 - RNA, 64 nt, hsa
caugggguuauugagacauuggaugugaaauaccuaggaagacauguauggagaaugcuuaaca

SEQ ID NO: 484680 - RNA, 64 nt, hsa
uaacaaaugcucuucuccuuuuucugucuucccuuaggaagaacguuaucucucuucugauuag

SEQ ID NO: 484681 - RNA, 64 nt, hsa
caguguggaguucaccuuggaagggcguucuagguaggaagagcccgcagggccaugcagaccu

SEQ ID NO: 484682 - RNA, 64 nt, hsa
gccuagaggagucaggagcagggacuuugacucuuaggaagagcacacaugagggcaaggcugc

SEQ ID NO: 484683 - RNA, 64 nt, hsa
ucccaguuuuagugcagcuuaggaggcugcuaguuaggaagauggcaguggcuguaggcugggu

SEQ ID NO: 484684 - RNA, 64 nt, hsa
cugaccuuuccuaccugaagagcccuuugacuucuaggaagaaaggucaaaaauguuaucuuca

SEQ ID NO: 484685 - RNA, 64 nt, hsa
aguuucuccaagcaggacauggacaaggaugaucuaggaagacuuuggaaagaguaggaagacu

SEQ ID NO: 484686 - RNA, 64 nt, hsa
ggacaaggaugaucuaggaagacuuuggaaagaguaggaagacuuuggaaagacuuuuccaacc

SEQ ID NO: 484687 - RNA, 64 nt, hsa
caaaaucaugccaaaauguaaagaccaucgagacuaggaagaaacugcaugaacuaacgagcaa

SEQ ID NO: 484688 - RNA, 64 nt, hsa
gcaaagaaauggaagagcauuccaugcucauggguaggaagaaucaauaucaugaaaauggccc

SEQ ID NO: 484689 - RNA, 64 nt, hsa
caggcaagauaaagauaugaaaggcauauauaaauaggaagaggggaagucaguuucucuugca

SEQ ID NO: 484690 - RNA, 64 nt, hsa
caauaaaaauugaaaaauaucucaugcucauggauaggaagaaucaguauuguuaaaauacugc

SEQ ID NO: 484691 - RNA, 64 nt, hsa
gauuggguguucauccagaggcgacuggguaaauuaggaagagguggaugcuccuccuguuuac

SEQ ID NO: 484692 - RNA, 64 nt, hsa
guggagggcaaggcuggggggaggggauuggguuuaggaagagcuagguuaagucguaacgagu

SEQ ID NO: 484693 - RNA, 64 nt, hsa; identical to SEQ ID NO: 236580

SEQ ID NO: 484694 - RNA, 64 nt, hsa; identical to SEQ ID NO: 236581

SEQ ID NO: 484695 - RNA, 64 nt, hsa; identical to SEQ ID NO: 236582

SEQ ID NO: 484696 - RNA, 64 nt, hsa; identical to SEQ ID NO: 236583

SEQ ID NO: 484697 - RNA, 64 nt, hsa; identical to SEQ ID NO: 236584

SEQ ID NO: 484698 - RNA, 64 nt, hsa; identical to SEQ ID NO: 236585

SEQ ID NO: 484699 - RNA, 64 nt, hsa; identical to SEQ ID NO: 236586

SEQ ID NO: 484700 - RNA, 64 nt, hsa; identical to SEQ ID NO: 236587

SEQ ID NO: 484701 - RNA, 64 nt, hsa; identical to SEQ ID NO: 236588

SEQ ID NO: 484702 - RNA, 64 nt, hsa; identical to SEQ ID NO: 236589

SEQ ID NO: 484703 - RNA, 64 nt, hsa; identical to SEQ ID NO: 236590

SEQ ID NO: 484704 - RNA, 64 nt, hsa; identical to SEQ ID NO: 236591

SEQ ID NO: 484705 - RNA, 64 nt, hsa; identical to SEQ ID NO: 236592

SEQ ID NO: 484706 - RNA, 64 nt, hsa; identical to SEQ ID NO: 236593

SEQ ID NO: 484707 - RNA, 64 nt, hsa; identical to SEQ ID NO: 236594

SEQ ID NO: 484708 - RNA, 64 nt, hsa; identical to SEQ ID NO: 236595

SEQ ID NO: 484709 - RNA, 64 nt, hsa; identical to SEQ ID NO: 236596

SEQ ID NO: 484710 - RNA, 64 nt, hsa; identical to SEQ ID NO: 236597

SEQ ID NO: 484711 - RNA, 64 nt, hsa; identical to SEQ ID NO: 236598

SEQ ID NO: 484712 - RNA, 64 nt, hsa; identical to SEQ ID NO: 236599

SEQ ID NO: 484713 - RNA, 64 nt, hsa; identical to SEQ ID NO: 236600

SEQ ID NO: 484714 - RNA, 64 nt, hsa; identical to SEQ ID NO: 236601

SEQ ID NO: 484715 - RNA, 64 nt, hsa; identical to SEQ ID NO: 236602

SEQ ID NO: 484716 - RNA, 64 nt, hsa; identical to SEQ ID NO: 236603

SEQ ID NO: 484717 - RNA, 64 nt, hsa; identical to SEQ ID NO: 236604

SEQ ID NO: 484718 - RNA, 64 nt, hsa; identical to SEQ ID NO: 236605

SEQ ID NO: 484719 - RNA, 64 nt, hsa; identical to SEQ ID NO: 236606

SEQ ID NO: 484720 - RNA, 64 nt, hsa; identical to SEQ ID NO: 236607

SEQ ID NO: 484721 - RNA, 64 nt, hsa; identical to SEQ ID NO: 236608

SEQ ID NO: 484722 - RNA, 64 nt, hsa; identical to SEQ ID NO: 236609

SEQ ID NO: 484723 - RNA, 64 nt, hsa; identical to SEQ ID NO: 236610

SEQ ID NO: 484724 - RNA, 64 nt, hsa; identical to SEQ ID NO: 236611

SEQ ID NO: 484725 - RNA, 64 nt, hsa; identical to SEQ ID NO: 236612

SEQ ID NO: 484726 - RNA, 64 nt, hsa; identical to SEQ ID NO: 236613

SEQ ID NO: 484727 - RNA, 64 nt, hsa; identical to SEQ ID NO: 236614

SEQ ID NO: 484728 - RNA, 64 nt, hsa; identical to SEQ ID NO: 236615

SEQ ID NO: 484729 - RNA, 64 nt, hsa; identical to SEQ ID NO: 236616

SEQ ID NO: 484730 - RNA, 64 nt, hsa; identical to SEQ ID NO: 236617

SEQ ID NO: 484731 - RNA, 64 nt, hsa; identical to SEQ ID NO: 236618

SEQ ID NO: 484732 - RNA, 64 nt, hsa; identical to SEQ ID NO: 236619

SEQ ID NO: 484733 - RNA, 64 nt, hsa
aagacuaacuugaaaagaaaaccacagcaggaugcuaauggaauuacugccuuacuguacauac

SEQ ID NO: 484734 - RNA, 58 nt, hsa
uuacacacuccuuucacugauagcuugacuaauggaaugauugguuaaaaugugauuu

SEQ ID NO: 484735 - RNA, 64 nt, hsa
uucgugcuguauguuuuuuuuuucccccuucacucuaauggacuguuccagggaagggaugggg

SEQ ID NO: 484736 - RNA, 64 nt, hsa
aacagcccauaaugcuccccgggagcagaggccacuaauggagagugggaagagccuggaaaga

SEQ ID NO: 484737 - RNA, 64 nt, hsa
ccucaaauggaacaggauuuuuugaugcuuugcucuaauggaacuguuuaaaaaauuuuuuuuu

SEQ ID NO: 484738 - RNA, 64 nt, hsa
agaaaaugauggguugaauuuacugauuauugaccuaauggauggcuuuuuaaaauguuuuaau

SEQ ID NO: 484739 - RNA, 64 nt, hsa; identical to SEQ ID NO: 236580

SEQ ID NO: 484740 - RNA, 64 nt, hsa; identical to SEQ ID NO: 236581

SEQ ID NO: 484741 - RNA, 64 nt, hsa; identical to SEQ ID NO: 236582

SEQ ID NO: 484742 - RNA, 64 nt, hsa; identical to SEQ ID NO: 236583

SEQ ID NO: 484743 - RNA, 64 nt, hsa; identical to SEQ ID NO: 236584

SEQ ID NO: 484744 - RNA, 64 nt, hsa; identical to SEQ ID NO: 236585

SEQ ID NO: 484745 - RNA, 64 nt, hsa; identical to SEQ ID NO: 236586

SEQ ID NO: 484746 - RNA, 64 nt, hsa; identical to SEQ ID NO: 236587

SEQ ID NO: 484747 - RNA, 64 nt, hsa; identical to SEQ ID NO: 236588

SEQ ID NO: 484748 - RNA, 64 nt, hsa; identical to SEQ ID NO: 236589

SEQ ID NO: 484749 - RNA, 64 nt, hsa; identical to SEQ ID NO: 236590

SEQ ID NO: 484750 - RNA, 64 nt, hsa; identical to SEQ ID NO: 236591

SEQ ID NO: 484751 - RNA, 64 nt, hsa; identical to SEQ ID NO: 236592

SEQ ID NO: 484752 - RNA, 64 nt, hsa; identical to SEQ ID NO: 236593

SEQ ID NO: 484753 - RNA, 64 nt, hsa; identical to SEQ ID NO: 236594

SEQ ID NO: 484754 - RNA, 64 nt, hsa; identical to SEQ ID NO: 236595

SEQ ID NO: 484755 - RNA, 64 nt, hsa; identical to SEQ ID NO: 236596

SEQ ID NO: 484756 - RNA, 64 nt, hsa; identical to SEQ ID NO: 236597

SEQ ID NO: 484757 - RNA, 64 nt, hsa; identical to SEQ ID NO: 236598

SEQ ID NO: 484758 - RNA, 64 nt, hsa; identical to SEQ ID NO: 236599

SEQ ID NO: 484759 - RNA, 64 nt, hsa; identical to SEQ ID NO: 236600

SEQ ID NO: 484760 - RNA, 64 nt, hsa; identical to SEQ ID NO: 236601

SEQ ID NO: 484761 - RNA, 64 nt, hsa; identical to SEQ ID NO: 236602

SEQ ID NO: 484762 - RNA, 64 nt, hsa; identical to SEQ ID NO: 236603

SEQ ID NO: 484763 - RNA, 64 nt, hsa; identical to SEQ ID NO: 236604

SEQ ID NO: 484764 - RNA, 64 nt, hsa; identical to SEQ ID NO: 236605

SEQ ID NO: 484765 - RNA, 64 nt, hsa; identical to SEQ ID NO: 236606

SEQ ID NO: 484766 - RNA, 64 nt, hsa; identical to SEQ ID NO: 236607

SEQ ID NO: 484767 - RNA, 64 nt, hsa; identical to SEQ ID NO: 236608

SEQ ID NO: 484768 - RNA, 64 nt, hsa; identical to SEQ ID NO: 236609

SEQ ID NO: 484769 - RNA, 64 nt, hsa; identical to SEQ ID NO: 236610

SEQ ID NO: 484770 - RNA, 64 nt, hsa; identical to SEQ ID NO: 236611

SEQ ID NO: 484771 - RNA, 64 nt, hsa; identical to SEQ ID NO: 236612

SEQ ID NO: 484772 - RNA, 64 nt, hsa; identical to SEQ ID NO: 236613

SEQ ID NO: 484773 - RNA, 64 nt, hsa; identical to SEQ ID NO: 236614

SEQ ID NO: 484774 - RNA, 64 nt, hsa; identical to SEQ ID NO: 236615

SEQ ID NO: 484775 - RNA, 64 nt, hsa; identical to SEQ ID NO: 236616

SEQ ID NO: 484776 - RNA, 64 nt, hsa; identical to SEQ ID NO: 236617

SEQ ID NO: 484777 - RNA, 64 nt, hsa; identical to SEQ ID NO: 236618

SEQ ID NO: 484778 - RNA, 64 nt, hsa; identical to SEQ ID NO: 236619

SEQ ID NO: 484779 - RNA, 64 nt, hsa; identical to SEQ ID NO: 484733

SEQ ID NO: 484780 - RNA, 58 nt, hsa; identical to SEQ ID NO: 484734

SEQ ID NO: 484781 - RNA, 64 nt, hsa; identical to SEQ ID NO: 484735

SEQ ID NO: 484782 - RNA, 64 nt, hsa; identical to SEQ ID NO: 484736

SEQ ID NO: 484783 - RNA, 64 nt, hsa; identical to SEQ ID NO: 484737

SEQ ID NO: 484784 - RNA, 64 nt, hsa; identical to SEQ ID NO: 484738

SEQ ID NO: 484785 - RNA, 64 nt, hsa; identical to SEQ ID NO: 114148

SEQ ID NO: 484786 - RNA, 64 nt, hsa; identical to SEQ ID NO: 114149

SEQ ID NO: 484787 - RNA, 64 nt, hsa; identical to SEQ ID NO: 114150

SEQ ID NO: 484788 - RNA, 64 nt, hsa; identical to SEQ ID NO: 114151

SEQ ID NO: 484789 - RNA, 64 nt, hsa; identical to SEQ ID NO: 114152

SEQ ID NO: 484790 - RNA, 64 nt, hsa; identical to SEQ ID NO: 114153

SEQ ID NO: 484791 - RNA, 64 nt, hsa; identical to SEQ ID NO: 114154

SEQ ID NO: 484792 - RNA, 64 nt, hsa; identical to SEQ ID NO: 114155

SEQ ID NO: 484793 - RNA, 64 nt, hsa; identical to SEQ ID NO: 114156

SEQ ID NO: 484794 - RNA, 64 nt, hsa; identical to SEQ ID NO: 114157

SEQ ID NO: 484795 - RNA, 64 nt, hsa; identical to SEQ ID NO: 114158

SEQ ID NO: 484796 - RNA, 64 nt, hsa; identical to SEQ ID NO: 114159

SEQ ID NO: 484797 - RNA, 64 nt, hsa
aggaggcauuccacacaggcacugccccaggacaacacaacaaggacagucacaacaaggacaa

SEQ ID NO: 484798 - RNA, 64 nt, hsa
cacaacaaggacagucacaacaaggacaacaaggacacaacacaacacacaacaaggacaguca

SEQ ID NO: 484799 - RNA, 64 nt, hsa
caaggacagucacaacaaggacaacaaggacacaacacaacacacaacaaggacagucacaaca

SEQ ID NO: 484800 - RNA, 64 nt, hsa
agucacaacaaggacaacaaggacacaacacaacacacaacaaggacagucacaacaagccuag

SEQ ID NO: 484801 - RNA, 64 nt, hsa
cagagauucugcaacacgaauucgaagcaaacaaacacaacacaacagaauuccuggaaagaag

SEQ ID NO: 484802 - RNA, 64 nt, hsa
auucugcaacacgaauucgaagcaaacaaacacaacacaacagaauuccuggaaagaagacgac

SEQ ID NO: 484803 - RNA, 64 nt, hsa
auuucccuagauugugaaagugaucacgacaaucacacaacaaauaauuaagugacuugguaug

SEQ ID NO: 484804 - RNA, 64 nt, hsa
uuuauauuuucaucauugacuacauauuucuuauacacaacacacaauuuaugaauuuuuucuc

SEQ ID NO: 484805 - RNA, 64 nt, hsa
cuguuauagacauuuauggauacauuuccucuaaacacaacagggcacagcaaauacgacuuca

SEQ ID NO: 484806 - RNA, 64 nt, hsa
cuucauuuggcuucgaguuccccaggcgcuguagacacaacaugaaucgggcucucugcucucu

SEQ ID NO: 484807 - RNA, 64 nt, hsa
ugagcaacugacuuaauuuucaagcacuugauuaacacaacacugcaaacagaagggagaaagu

SEQ ID NO: 484808 - RNA, 64 nt, hsa
ccucaucaucauucccaacaacauccucugccacacacaacaaaacguaaguuucauuugggca

SEQ ID NO: 484809 - RNA, 64 nt, hsa
ccaggagagaacccacgcacaugcacaccacaacacacaacacaccucaccucacaccacagca

SEQ ID NO: 484810 - RNA, 64 nt, hsa
caccacaucucaccacaccacagcacaccucaccacacaacacaccacaccccacaccgcacug

SEQ ID NO: 484811 - RNA, 64 nt, hsa
uuagaaaauguguugauagaaaaccuaagaauaaacacaacaaugaguuaggucuuuaucaagu

SEQ ID NO: 484812 - RNA, 64 nt, hsa
aaucugaaacaagguaucuuccaucagcauaacaacacaacacuugagcuccuagccaauguau

SEQ ID NO: 484813 - RNA, 64 nt, hsa
acacguagacaggcuguaauauucaaaccaccucugggccaaugcauuuccaaaggaugccuuu

SEQ ID NO: 484814 - RNA, 64 nt, hsa
gguuguuugaaccugagaguguguaauggucauuugggccaagccucagcuagggcugcugccu

SEQ ID NO: 484815 - RNA, 64 nt, hsa
cugcccaugcagcagagggcagaaggcuugcacuugggccaaagggccuaagguccacuggaca

SEQ ID NO: 484816 - RNA, 64 nt, hsa
auccugaccacucuugaacccagaaggaggacuuugggccaauuucggaggagagaagaaagug

SEQ ID NO: 484817 - RNA, 64 nt, hsa
aggguccuaccucuggguuuccuggaaguggauuugggccaagaaggagagggagaaaggcccg

SEQ ID NO: 484818 - RNA, 64 nt, hsa
cccauuuccucuggcaacaaaagccagaguguugugggccaaguccccccacagggccucugca

SEQ ID NO: 484819 - RNA, 64 nt, hsa
gaggcuggacucggggcauguguggaagcugcagugggccaagcaguccugguaccugagcgcc

SEQ ID NO: 484820 - RNA, 64 nt, hsa
aggccccaugaagagcgcccuggacugcugagggugggccaacagcccagagcucaggacacuu

SEQ ID NO: 484821 - RNA, 64 nt, hsa
agcuggcccaguuguccaugacaaaagaggcuuuugggccaaaaugugagggugguggguggga

SEQ ID NO: 484822 - RNA, 64 nt, hsa
uuccuugcauuaaaggagaucuuccccuaaccuuugggccaauuuacuggccacuaauuucguu

SEQ ID NO: 484823 - RNA, 64 nt, hsa
acucuuauugguaagcuauaggagacucaggaucugggccaaccucaaggugggggcuucagag

SEQ ID NO: 484824 - RNA, 64 nt, hsa
uucagcacagaaccugaaugccaggaaaaauuccugggccaagaagcuaaagcuaaagaaaccu

SEQ ID NO: 484825 - RNA, 64 nt, hsa
cuccaacauugcauccuuucuggggugaagaaucugggccaaccagggguccuugggccucuag

SEQ ID NO: 484826 - RNA, 64 nt, hsa
augcacucagcuucguguuggccaagacuccuucugggccaauggggcugccucuuuuccuuuc

SEQ ID NO: 484827 - RNA, 64 nt, hsa; identical to SEQ ID NO: 393047

SEQ ID NO: 484828 - RNA, 64 nt, hsa; identical to SEQ ID NO: 393048

SEQ ID NO: 484829 - RNA, 64 nt, hsa; identical to SEQ ID NO: 393049

SEQ ID NO: 484830 - RNA, 64 nt, hsa; identical to SEQ ID NO: 393050

SEQ ID NO: 484831 - RNA, 64 nt, hsa; identical to SEQ ID NO: 393051

SEQ ID NO: 484832 - RNA, 64 nt, hsa; identical to SEQ ID NO: 393052

SEQ ID NO: 484833 - RNA, 64 nt, hsa; identical to SEQ ID NO: 393053

SEQ ID NO: 484834 - RNA, 64 nt, hsa; identical to SEQ ID NO: 393054

SEQ ID NO: 484835 - RNA, 64 nt, hsa; identical to SEQ ID NO: 393055

SEQ ID NO: 484836 - RNA, 64 nt, hsa; identical to SEQ ID NO: 393056

SEQ ID NO: 484837 - RNA, 64 nt, hsa; identical to SEQ ID NO: 393057

SEQ ID NO: 484838 - RNA, 64 nt, hsa; identical to SEQ ID NO: 393058

SEQ ID NO: 484839 - RNA, 64 nt, hsa; identical to SEQ ID NO: 393059

SEQ ID NO: 484840 - RNA, 64 nt, hsa; identical to SEQ ID NO: 393060

SEQ ID NO: 484841 - RNA, 64 nt, hsa; identical to SEQ ID NO: 393061

SEQ ID NO: 484842 - RNA, 64 nt, hsa; identical to SEQ ID NO: 393062

SEQ ID NO: 484843 - RNA, 64 nt, hsa; identical to SEQ ID NO: 393063

SEQ ID NO: 484844 - RNA, 64 nt, hsa; identical to SEQ ID NO: 393064

SEQ ID NO: 484845 - RNA, 64 nt, hsa; identical to SEQ ID NO: 393065

SEQ ID NO: 484846 - RNA, 64 nt, hsa; identical to SEQ ID NO: 393066

SEQ ID NO: 484847 - RNA, 64 nt, hsa; identical to SEQ ID NO: 393067

SEQ ID NO: 484848 - RNA, 64 nt, hsa; identical to SEQ ID NO: 393068

SEQ ID NO: 484849 - RNA, 64 nt, hsa; identical to SEQ ID NO: 393069

SEQ ID NO: 484850 - RNA, 64 nt, hsa; identical to SEQ ID NO: 393070

SEQ ID NO: 484851 - RNA, 64 nt, hsa; identical to SEQ ID NO: 393071

SEQ ID NO: 484852 - RNA, 64 nt, hsa; identical to SEQ ID NO: 393072

SEQ ID NO: 484853 - RNA, 64 nt, hsa; identical to SEQ ID NO: 393073

SEQ ID NO: 484854 - RNA, 64 nt, hsa; identical to SEQ ID NO: 393074

SEQ ID NO: 484855 - RNA, 64 nt, hsa; identical to SEQ ID NO: 393075

SEQ ID NO: 484856 - RNA, 64 nt, hsa; identical to SEQ ID NO: 393076

SEQ ID NO: 484857 - RNA, 64 nt, hsa; identical to SEQ ID NO: 393077

SEQ ID NO: 484858 - RNA, 64 nt, hsa; identical to SEQ ID NO: 393078

SEQ ID NO: 484859 - RNA, 64 nt, hsa; identical to SEQ ID NO: 393079

SEQ ID NO: 484860 - RNA, 64 nt, hsa; identical to SEQ ID NO: 393080

SEQ ID NO: 484861 - RNA, 64 nt, hsa; identical to SEQ ID NO: 393081

SEQ ID NO: 484862 - RNA, 64 nt, hsa; identical to SEQ ID NO: 393082

SEQ ID NO: 484863 - RNA, 64 nt, hsa; identical to SEQ ID NO: 393083

SEQ ID NO: 484864 - RNA, 64 nt, hsa; identical to SEQ ID NO: 393084

SEQ ID NO: 484865 - RNA, 64 nt, hsa; identical to SEQ ID NO: 393085

SEQ ID NO: 484866 - RNA, 64 nt, hsa; identical to SEQ ID NO: 393086

SEQ ID NO: 484867 - RNA, 64 nt, hsa; identical to SEQ ID NO: 393087

SEQ ID NO: 484868 - RNA, 64 nt, hsa; identical to SEQ ID NO: 393088

SEQ ID NO: 484869 - RNA, 64 nt, hsa; identical to SEQ ID NO: 393089

SEQ ID NO: 484870 - RNA, 64 nt, hsa; identical to SEQ ID NO: 393090

SEQ ID NO: 484871 - RNA, 64 nt, hsa; identical to SEQ ID NO: 393091

SEQ ID NO: 484872 - RNA, 64 nt, hsa; identical to SEQ ID NO: 393092

SEQ ID NO: 484873 - RNA, 64 nt, hsa; identical to SEQ ID NO: 393093

SEQ ID NO: 484874 - RNA, 64 nt, hsa; identical to SEQ ID NO: 393094

SEQ ID NO: 484875 - RNA, 64 nt, hsa; identical to SEQ ID NO: 393095

SEQ ID NO: 484876 - RNA, 64 nt, hsa; identical to SEQ ID NO: 393096

SEQ ID NO: 484877 - RNA, 64 nt, hsa; identical to SEQ ID NO: 393097

SEQ ID NO: 484878 - RNA, 64 nt, hsa; identical to SEQ ID NO: 393098

SEQ ID NO: 484879 - RNA, 64 nt, hsa; identical to SEQ ID NO: 393099

SEQ ID NO: 484880 - RNA, 64 nt, hsa; identical to SEQ ID NO: 393100

SEQ ID NO: 484881 - RNA, 64 nt, hsa; identical to SEQ ID NO: 393101

SEQ ID NO: 484882 - RNA, 64 nt, hsa; identical to SEQ ID NO: 393102

SEQ ID NO: 484883 - RNA, 64 nt, hsa; identical to SEQ ID NO: 393103

SEQ ID NO: 484884 - RNA, 64 nt, hsa; identical to SEQ ID NO: 393104

SEQ ID NO: 484885 - RNA, 64 nt, hsa; identical to SEQ ID NO: 393105

SEQ ID NO: 484886 - RNA, 64 nt, hsa; identical to SEQ ID NO: 393106

SEQ ID NO: 484887 - RNA, 64 nt, hsa; identical to SEQ ID NO: 393107

SEQ ID NO: 484888 - RNA, 64 nt, hsa; identical to SEQ ID NO: 393108

SEQ ID NO: 484889 - RNA, 64 nt, hsa; identical to SEQ ID NO: 393109

SEQ ID NO: 484890 - RNA, 64 nt, hsa; identical to SEQ ID NO: 393110

SEQ ID NO: 484891 - RNA, 64 nt, hsa; identical to SEQ ID NO: 393111

SEQ ID NO: 484892 - RNA, 64 nt, hsa; identical to SEQ ID NO: 393112

SEQ ID NO: 484893 - RNA, 64 nt, hsa; identical to SEQ ID NO: 393113

SEQ ID NO: 484894 - RNA, 64 nt, hsa; identical to SEQ ID NO: 393114

SEQ ID NO: 484895 - RNA, 64 nt, hsa; identical to SEQ ID NO: 393115

SEQ ID NO: 484896 - RNA, 64 nt, hsa; identical to SEQ ID NO: 393116

SEQ ID NO: 484897 - RNA, 64 nt, hsa; identical to SEQ ID NO: 393117

SEQ ID NO: 484898 - RNA, 64 nt, hsa; identical to SEQ ID NO: 393118

SEQ ID NO: 484899 - RNA, 64 nt, hsa; identical to SEQ ID NO: 393119

SEQ ID NO: 484900 - RNA, 64 nt, hsa; identical to SEQ ID NO: 393120

SEQ ID NO: 484901 - RNA, 64 nt, hsa; identical to SEQ ID NO: 393121

SEQ ID NO: 484902 - RNA, 64 nt, hsa; identical to SEQ ID NO: 393122

SEQ ID NO: 484903 - RNA, 64 nt, hsa; identical to SEQ ID NO: 393123

SEQ ID NO: 484904 - RNA, 64 nt, hsa; identical to SEQ ID NO: 393124

SEQ ID NO: 484905 - RNA, 64 nt, hsa; identical to SEQ ID NO: 393125

SEQ ID NO: 484906 - RNA, 64 nt, hsa; identical to SEQ ID NO: 393126

SEQ ID NO: 484907 - RNA, 64 nt, hsa; identical to SEQ ID NO: 393127

SEQ ID NO: 484908 - RNA, 64 nt, hsa; identical to SEQ ID NO: 393128

SEQ ID NO: 484909 - RNA, 64 nt, hsa; identical to SEQ ID NO: 393129

SEQ ID NO: 484910 - RNA, 64 nt, hsa; identical to SEQ ID NO: 393130

SEQ ID NO: 484911 - RNA, 64 nt, hsa; identical to SEQ ID NO: 393131

SEQ ID NO: 484912 - RNA, 64 nt, hsa; identical to SEQ ID NO: 393132

SEQ ID NO: 484913 - RNA, 64 nt, hsa; identical to SEQ ID NO: 393133

SEQ ID NO: 484914 - RNA, 64 nt, hsa; identical to SEQ ID NO: 393134

SEQ ID NO: 484915 - RNA, 64 nt, hsa; identical to SEQ ID NO: 393135

SEQ ID NO: 484916 - RNA, 64 nt, hsa; identical to SEQ ID NO: 393136

SEQ ID NO: 484917 - RNA, 64 nt, hsa; identical to SEQ ID NO: 393137

SEQ ID NO: 484918 - RNA, 64 nt, hsa; identical to SEQ ID NO: 393138

SEQ ID NO: 484919 - RNA, 64 nt, hsa; identical to SEQ ID NO: 393139

SEQ ID NO: 484920 - RNA, 64 nt, hsa; identical to SEQ ID NO: 393140

SEQ ID NO: 484921 - RNA, 64 nt, hsa; identical to SEQ ID NO: 393141

SEQ ID NO: 484922 - RNA, 64 nt, hsa; identical to SEQ ID NO: 393142

SEQ ID NO: 484923 - RNA, 64 nt, hsa; identical to SEQ ID NO: 393143

SEQ ID NO: 484924 - RNA, 64 nt, hsa; identical to SEQ ID NO: 393144

SEQ ID NO: 484925 - RNA, 64 nt, hsa; identical to SEQ ID NO: 393145

SEQ ID NO: 484926 - RNA, 64 nt, hsa; identical to SEQ ID NO: 393146

SEQ ID NO: 484927 - RNA, 64 nt, hsa; identical to SEQ ID NO: 393147

SEQ ID NO: 484928 - RNA, 64 nt, hsa; identical to SEQ ID NO: 393148

SEQ ID NO: 484929 - RNA, 64 nt, hsa; identical to SEQ ID NO: 393149

SEQ ID NO: 484930 - RNA, 64 nt, hsa; identical to SEQ ID NO: 393150

SEQ ID NO: 484931 - RNA, 64 nt, hsa; identical to SEQ ID NO: 393151

SEQ ID NO: 484932 - RNA, 64 nt, hsa; identical to SEQ ID NO: 393152

SEQ ID NO: 484933 - RNA, 64 nt, hsa; identical to SEQ ID NO: 393153

SEQ ID NO: 484934 - RNA, 64 nt, hsa; identical to SEQ ID NO: 393154

SEQ ID NO: 484935 - RNA, 64 nt, hsa; identical to SEQ ID NO: 393155

SEQ ID NO: 484936 - RNA, 64 nt, hsa; identical to SEQ ID NO: 393156

SEQ ID NO: 484937 - RNA, 64 nt, hsa; identical to SEQ ID NO: 393157

SEQ ID NO: 484938 - RNA, 64 nt, hsa; identical to SEQ ID NO: 393158

SEQ ID NO: 484939 - RNA, 64 nt, hsa; identical to SEQ ID NO: 393159

SEQ ID NO: 484940 - RNA, 64 nt, hsa; identical to SEQ ID NO: 393160

SEQ ID NO: 484941 - RNA, 64 nt, hsa; identical to SEQ ID NO: 393161

SEQ ID NO: 484942 - RNA, 64 nt, hsa; identical to SEQ ID NO: 393162

SEQ ID NO: 484943 - RNA, 64 nt, hsa; identical to SEQ ID NO: 393163

SEQ ID NO: 484944 - RNA, 64 nt, hsa; identical to SEQ ID NO: 393164

SEQ ID NO: 484945 - RNA, 64 nt, hsa; identical to SEQ ID NO: 393165

SEQ ID NO: 484946 - RNA, 64 nt, hsa; identical to SEQ ID NO: 393166

SEQ ID NO: 484947 - RNA, 64 nt, hsa; identical to SEQ ID NO: 393167

SEQ ID NO: 484948 - RNA, 64 nt, hsa; identical to SEQ ID NO: 393168

SEQ ID NO: 484949 - RNA, 64 nt, hsa; identical to SEQ ID NO: 393169

SEQ ID NO: 484950 - RNA, 64 nt, hsa; identical to SEQ ID NO: 393170

SEQ ID NO: 484951 - RNA, 64 nt, hsa; identical to SEQ ID NO: 393171

SEQ ID NO: 484952 - RNA, 64 nt, hsa; identical to SEQ ID NO: 393172

SEQ ID NO: 484953 - RNA, 64 nt, hsa; identical to SEQ ID NO: 393173

SEQ ID NO: 484954 - RNA, 64 nt, hsa; identical to SEQ ID NO: 393174

SEQ ID NO: 484955 - RNA, 64 nt, hsa; identical to SEQ ID NO: 393175

SEQ ID NO: 484956 - RNA, 64 nt, hsa; identical to SEQ ID NO: 393176

SEQ ID NO: 484957 - RNA, 64 nt, hsa
ugagcaaagcauugagcaaaggggucccauagaggugagggaagccugaaaaacuaagaugcug

SEQ ID NO: 484958 - RNA, 64 nt, hsa
gggggauggcuaaaaccaucauaguacagguaaggugagggaauaguaaguggugagaacuacu

SEQ ID NO: 484959 - RNA, 64 nt, hsa
ggaguuugugagcuuggcucuagucccaagaagggugagggagaauaaggguaagggaguauuc

SEQ ID NO: 484960 - RNA, 64 nt, hsa
cuggugacuggcucuuaucacuucuaguuuacaggugagggaaccaaguuucacagaggcuaag

SEQ ID NO: 484961 - RNA, 64 nt, hsa
guggggcuguuugagagccucccaagagggccgggugagggaugaggacaggcauccuaucccc

SEQ ID NO: 484962 - RNA, 64 nt, hsa
gagaaccugauugcugaugauggccuuaaagguggugagggagauacugggggcagagcagacu

SEQ ID NO: 484963 - RNA, 64 nt, hsa
cgugugugcaaugccuuuuucugggggguggggggugagggaaaaccugguagugaauguguag

SEQ ID NO: 484964 - RNA, 64 nt, hsa
auaaaaauggaauuuugcaacauccuuuaauaaggugagggaagcaugaaccucagacuucugg

SEQ ID NO: 484965 - RNA, 64 nt, hsa
ugaucggccauagggcuuccauggguggaaacuugugagggaguuuguauuaggucuggucaug

SEQ ID NO: 484966 - RNA, 64 nt, hsa
agcagauugccccagaggggccgguaauaaucacgugagggauaaucagauuccugcguauuca

SEQ ID NO: 484967 - RNA, 64 nt, hsa
gaagcaaaguugugguucucuugcuaacuucaaggugagggacauugggcacccuaaguuuggg

SEQ ID NO: 484968 - RNA, 64 nt, hsa
uuagaaggugguaccugauggucuguucugacgggugagggacagaggcaucuggaugaaaauc

SEQ ID NO: 484969 - RNA, 64 nt, hsa
ccuugagcagcagucagcacaggugcgugggggcgugagggaggcagggucuucaccacaggcg

SEQ ID NO: 484970 - RNA, 64 nt, hsa
cuaagggcuggcauccacaucauuucacccugcagugagggaagaggccaccagguggcagcac

SEQ ID NO: 484971 - RNA, 64 nt, hsa; identical to SEQ ID NO: 21897

SEQ ID NO: 484972 - RNA, 64 nt, hsa; identical to SEQ ID NO: 21898

SEQ ID NO: 484973 - RNA, 64 nt, hsa; identical to SEQ ID NO: 21899

SEQ ID NO: 484974 - RNA, 64 nt, hsa; identical to SEQ ID NO: 21900

SEQ ID NO: 484975 - RNA, 64 nt, hsa; identical to SEQ ID NO: 21901

SEQ ID NO: 484976 - RNA, 64 nt, hsa; identical to SEQ ID NO: 21902

SEQ ID NO: 484977 - RNA, 64 nt, hsa
uggcuuagccggaggggacguggccaagggugagguggccaaaaccagaaccagcagucuccug

SEQ ID NO: 484978 - RNA, 64 nt, hsa
cucugcuuugugcuguggcuuagccggaggggacguggccaagggugagguggccaaaaccaga

SEQ ID NO: 484979 - RNA, 64 nt, hsa
gacaugaacagacacuuuucaaaagaagacaucuguggccaacaauccuauggaaaaaagccca

SEQ ID NO: 484980 - RNA, 64 nt, hsa
agagugcagggauuacaggcgugagccacugcucguggccaaaaguuuucuuuuuuuuuuuuuu

SEQ ID NO: 484981 - RNA, 64 nt, hsa
ucucucacaacuaggcgguccugggauggggcauguggccaagggcuccagggccaggguguga

SEQ ID NO: 484982 - RNA, 64 nt, hsa
uggaagucucaaggucacgggaccccuaaucagaguggccaaucccugugugucguucccuugu

SEQ ID NO: 484983 - RNA, 64 nt, hsa; identical to SEQ ID NO: 47705

SEQ ID NO: 484984 - RNA, 64 nt, hsa; identical to SEQ ID NO: 47706

SEQ ID NO: 484985 - RNA, 64 nt, hsa; identical to SEQ ID NO: 47707

SEQ ID NO: 484986 - RNA, 64 nt, hsa; identical to SEQ ID NO: 47708

SEQ ID NO: 484987 - RNA, 64 nt, hsa; identical to SEQ ID NO: 47709

SEQ ID NO: 484988 - RNA, 53 nt, hsa; identical to SEQ ID NO: 47710

SEQ ID NO: 484989 - RNA, 64 nt, hsa; identical to SEQ ID NO: 58517

SEQ ID NO: 484990 - RNA, 64 nt, hsa; identical to SEQ ID NO: 58518

SEQ ID NO: 484991 - RNA, 64 nt, hsa; identical to SEQ ID NO: 58519

SEQ ID NO: 484992 - RNA, 64 nt, hsa; identical to SEQ ID NO: 58520

SEQ ID NO: 484993 - RNA, 64 nt, hsa; identical to SEQ ID NO: 58521

SEQ ID NO: 484994 - RNA, 64 nt, hsa; identical to SEQ ID NO: 58522

SEQ ID NO: 484995 - RNA, 64 nt, hsa; identical to SEQ ID NO: 58523

SEQ ID NO: 484996 - RNA, 64 nt, hsa; identical to SEQ ID NO: 58524

SEQ ID NO: 484997 - RNA, 64 nt, hsa; identical to SEQ ID NO: 58525

SEQ ID NO: 484998 - RNA, 64 nt, hsa; identical to SEQ ID NO: 58526

SEQ ID NO: 484999 - RNA, 64 nt, hsa; identical to SEQ ID NO: 58527

SEQ ID NO: 485000 - RNA, 64 nt, hsa; identical to SEQ ID NO: 58528

SEQ ID NO: 485001 - RNA, 64 nt, hsa; identical to SEQ ID NO: 58529

SEQ ID NO: 485002 - RNA, 64 nt, hsa; identical to SEQ ID NO: 58530

SEQ ID NO: 485003 - RNA, 64 nt, hsa; identical to SEQ ID NO: 58531

SEQ ID NO: 485004 - RNA, 64 nt, hsa; identical to SEQ ID NO: 58532

SEQ ID NO: 485005 - RNA, 64 nt, hsa
cuggaaugacuagagggagccaagaggauggggugggggccagggccccccagggccuaucgug

SEQ ID NO: 485006 - RNA, 64 nt, hsa
cugacacauggauguaccuaucuuggugaugggugggggccaagaauugagcaugacaucuucc

SEQ ID NO: 485007 - RNA, 55 nt, hsa
gucuguacacaggcgagugagcucagggggccaccugugcuccccccgcuacccu

SEQ ID NO: 485008 - RNA, 64 nt, hsa
ggaguuaaccaaguuuggugcaggagcaggggcagggggccacuguagugagcguggagaaauu

SEQ ID NO: 485009 - RNA, 64 nt, hsa
accuggcugccccucaccuugggcugggggacuggggggccauuuccuuuucucugcccuuuuu

SEQ ID NO: 485010 - RNA, 64 nt, hsa
auucuggucauuucccccaaaggcaucccagccugggggccaguggggaacugagggcaagggg

SEQ ID NO: 485011 - RNA, 64 nt, hsa
ggcugguuagcggaugugggaggcugugaccccagggggccauagggugcgguggaacugcagg

SEQ ID NO: 485012 - RNA, 64 nt, hsa
gguuagggcucuggaggugcuuucacucaaccaagggggccacagcacuggggagugaaacugc

SEQ ID NO: 485013 - RNA, 64 nt, hsa
cuccugcaacugacccaguccgcaaauauuuauugggggccagcccagggcugggacugggcau

SEQ ID NO: 485014 - RNA, 64 nt, hsa
cuggcucgacccaggacuuggguugaggaugcacgggggccaccuugcccggggccacuggugg

SEQ ID NO: 485015 - RNA, 64 nt, hsa
guaagugucaagugggaggauacugcccccuugugggggccagacgggucggacacggcugugc

SEQ ID NO: 485016 - RNA, 64 nt, hsa
ucuguaacaucccacaucugccagggaagggucugggggccaguggaggccugaggugucccuc

SEQ ID NO: 485017 - RNA, 64 nt, hsa
uccuuuugguuuuguggggagaggggaaggaucagggggccaggccagcagcucgggggccaca

SEQ ID NO: 485018 - RNA, 64 nt, hsa
gaggggaaggaucagggggccaggccagcagcucgggggccacaaggagauggauaaugugccu

SEQ ID NO: 485019 - RNA, 64 nt, hsa
uagggggcacugcuugaagcacagcacuugguuagggggccacagaggccuaaguuugcuggcc

SEQ ID NO: 485020 - RNA, 64 nt, hsa
ucuguagccucccccuugcccucaaagggggagugggggccagcuuuaccucacccacugugac

SEQ ID NO: 485021 - RNA, 64 nt, hsa
gcagcagucaccacuagggggugauggagaggaagggggccaccccagggccauuaacaaccag

SEQ ID NO: 485022 - RNA, 64 nt, hsa
cuccuugaggggcucuucuggucagccccacccugggggccauuuccccauuaacuacccccag

SEQ ID NO: 485023 - RNA, 54 nt, hsa
gugcugaggaggggcugugagccugggggccacuguggacagacgugggcuuca

SEQ ID NO: 485024 - RNA, 64 nt, hsa
gguggggaagggaagccagauccagcacccccuggggggccaucgggaguguggcuggggguga

SEQ ID NO: 485025 - RNA, 64 nt, hsa
ccuaggcccagucucaaaggaagccacaaggcgcgggggccacugaggaaggaaauguucauuu

SEQ ID NO: 485026 - RNA, 64 nt, hsa
cuugucacccauugagcugcaagagggaccaagagggggccacgcagccagccagaugccuggc

SEQ ID NO: 485027 - RNA, 64 nt, hsa
ggcuggggcagcuccuggggagcaucagggaagagggggccaugagccggccagcaguggagac

SEQ ID NO: 485028 - RNA, 64 nt, hsa
ccaccaagcuccucccccagaacccugaggccaagggggccacuggcuaccccuacugcgcggc

SEQ ID NO: 485029 - RNA, 64 nt, hsa
gaggggguggaggacucuccccugccucuggggagggggccaucugcugcgcccggccccacug

SEQ ID NO: 485030 - RNA, 64 nt, hsa
aguaugcaccuuguguugagagagaggcaacccugggggccaguucaggugguccccaaccaua

SEQ ID NO: 485031 - RNA, 64 nt, hsa
ccagccccucccaccacagcaggugucauauauggggggccaacaccagggaugguacuagggg

SEQ ID NO: 485032 - RNA, 64 nt, hsa
gcaaaggacuguuuuuuccugagcuuggccagaagggggccaugaggccucaguggacuuucca

SEQ ID NO: 485033 - RNA, 64 nt, hsa
ugagcugagauggaacccuuuuggcccccgagcugggggccaugagcuccagacccccagcaac

SEQ ID NO: 485034 - RNA, 64 nt, hsa
ccgcuauuaucugcguucucugccaaagacucgugggggccaucacaccugcccugugcagcgg

SEQ ID NO: 485035 - RNA, 64 nt, hsa
guuugcuuccccugugcccacugcuguaugaucugggggccaccacccugugccgguggccucu

SEQ ID NO: 485036 - RNA, 64 nt, hsa
ccaaagaaggcagggaaugccuggaggguaacuggggggccaccaugaccccuucucucuccag

SEQ ID NO: 485037 - RNA, 64 nt, hsa
cuuaccucggggagagggggagguugguuccuuggggggccaaagaaggcagggaaugccugga

SEQ ID NO: 485038 - RNA, 64 nt, hsa
agcuguuagaguccaacguggggcagcacagagagggggccaccuccccaggccguggcugccc

SEQ ID NO: 485039 - RNA, 64 nt, hsa
ccgcaaugugcccccagacgcacgugggucuucagggggccaggugcacagacgucccuccacg

SEQ ID NO: 485040 - RNA, 64 nt, hsa
uucagguagcugcuuggcggcggccagccccacagggggccaggggcauggccacaggcccccc

SEQ ID NO: 485041 - RNA, 64 nt, hsa
ggagcugggcuggggcugcugcucuggggucuccgggggccacagcuuggggugaguugaagac

SEQ ID NO: 485042 - RNA, 64 nt, hsa
ucuccaggggcagggggauuuuaggagauggggugggggccagccccuacuggacccuuguaau

SEQ ID NO: 485043 - RNA, 64 nt, hsa
gugcucccccacuuccaggccuuaguuggggugggggggccagcuccugggccuggggucuucu

SEQ ID NO: 485044 - RNA, 64 nt, hsa
aggcccccucccuggaggccagccccuccccgcagggggccaggccggggcucccaggcgaggg

SEQ ID NO: 485045 - RNA, 64 nt, hsa
agcaauaagggcuggguuugucccccacccuggggggggccaggcuccagagagggggcaccuc

SEQ ID NO: 485046 - RNA, 64 nt, hsa
ugcugugccuagucuagugucccccaaagcaucggggggccacgcaagugugggugugugagug

SEQ ID NO: 485047 - RNA, 64 nt, hsa
aggccugcccugcuauuucaggcccucagcugucgggggccacuguguuucugugcuccaaguu

SEQ ID NO: 485048 - RNA, 64 nt, hsa
gcaugugucccaggagcaggaccuacuaggagaggggggccaagguccugcucaacucuacccc

SEQ ID NO: 485049 - RNA, 64 nt, hsa
aagugugcacuccagcuucggagggccccugugugggggccagucaggcugcagaggcaccuca

SEQ ID NO: 485050 - RNA, 64 nt, hsa
uagugguuaauagaguuuacagugagcuugccuuaggauggaccagcaagcccccguggacccu

SEQ ID NO: 485051 - RNA, 64 nt, hsa
uucuguguagauagagauggugucaaggaggugcaggauggagaugggagauuucauggagccu

SEQ ID NO: 485052 - RNA, 64 nt, hsa
gcccccugcguguguauauuggugggaggcauagaggauggauguucuagaaaugaguaagaca

SEQ ID NO: 485053 - RNA, 64 nt, hsa
ucggucacaugccagguccccagcuacgcauucaaggauggauaauauacauagcagcacaucc

SEQ ID NO: 485054 - RNA, 64 nt, hsa
acagauucugcuuugaauauagcuacagaaauaaaggauggacuacagugugggacagguaauu

SEQ ID NO: 485055 - RNA, 64 nt, hsa
gaagacucuguuucgaauauagccacagaaauaaaggauggagaaaaaucugggacagguaauu

SEQ ID NO: 485056 - RNA, 64 nt, hsa
aaagauucuguuucgaacauagccacagaaauaaaggauggagaaaaaucugggacagguaauu

SEQ ID NO: 485057 - RNA, 64 nt, hsa
gaagguucuguuuugaguauagccagagaaaacaaggauggagaaaaaucuaggacagguaauu

SEQ ID NO: 485058 - RNA, 64 nt, hsa
aaggauucuuuuucgaauauaaccagaggaaaaaaggauggagaaauaucuaggaaagguaauu

SEQ ID NO: 485059 - RNA, 64 nt, hsa
aaggauucuuuuucgaauauaaccagagaaaaaaaggauggagaaauaucuaggaaagguaauu

SEQ ID NO: 485060 - RNA, 64 nt, hsa
gaagauucuguuuuggguauagccagagaaaacaaggauggagaaaaaucuaggacagguaauu

SEQ ID NO: 485061 - RNA, 64 nt, hsa
uuccacguugccuucugcgcaaaggguuucaccaaggauggagaaagggagacagcuugcagau

SEQ ID NO: 485062 - RNA, 64 nt, hsa
aaaacacaaaacauaauaaaacaccaagaacaugaggauggagagaaguaucagcacccagaag

SEQ ID NO: 485063 - RNA, 64 nt, hsa
auucuggccagucccugcauccucccugggguggaggauggaaggaaagcugggacaagcaggg

SEQ ID NO: 485064 - RNA, 64 nt, hsa
gauguggcaaucaaugacacuauugggguuucccaggauggauuggucagggggagaaaggaaa

SEQ ID NO: 485065 - RNA, 64 nt, hsa
acacuaaaaaagaagguuucuaaauuguaggagcaggauggaaauacuuugcugcccuugccau

SEQ ID NO: 485066 - RNA, 64 nt, hsa
guauagacaaggcugagcaggguuccuguggcccaggauggaggccaccgcugcccugccaucc

SEQ ID NO: 485067 - RNA, 64 nt, hsa
guuggggagagaaggauggagauaggauggagauaggauggagauguggcucuucucaucuuug

SEQ ID NO: 485068 - RNA, 64 nt, hsa
aaccacacgcuguuggggagagaaggauggagauaggauggagauaggauggagauguggcucu

SEQ ID NO: 485069 - RNA, 64 nt, hsa
cugaaacagacaaccacacgcuguuggggagagaaggauggagauaggauggagauaggaugga

SEQ ID NO: 485070 - RNA, 64 nt, hsa
gagaaaguuaucaagagaaagaggugaggauggaaggauggagaaaaacagacugugggaagga

SEQ ID NO: 485071 - RNA, 64 nt, hsa
uuugggaagagaaaguuaucaagagaaagaggugaggauggaaggauggagaaaaacagacugu

SEQ ID NO: 485072 - RNA, 64 nt, hsa
ccauggucaguugugagcauuuugguuuccgcaaaggauggauggugagcaucaugggaaagcu

SEQ ID NO: 485073 - RNA, 64 nt, hsa
auauuggcccagcaaggcaaagaacugaaguuccaggauggaagaaccuguguucuccucauaa

SEQ ID NO: 485074 - RNA, 64 nt, hsa
uucgaguuuuucaaauugugagggggaccauaaaaggauggaaacuuuuagaugacauucuaca

SEQ ID NO: 485075 - RNA, 64 nt, hsa
uuaauguauuguaucaaauugugaauaagaaaguaggauggagcuuucuagagguugggccuua

SEQ ID NO: 485076 - RNA, 64 nt, hsa
cccuauuugcuuaaaaguacaggcucccuaagagaggauggagagggagagacugaauuguuag

SEQ ID NO: 485077 - RNA, 64 nt, hsa
acauauuccaaaacccuucuuuuuaaaaggaaaaaggauggagagaaggauggaaagccuggac

SEQ ID NO: 485078 - RNA, 64 nt, hsa
acccuucuuuuuaaaaggaaaaaggauggagagaaggauggaaagccuggacuuaaaccuuuag

SEQ ID NO: 485079 - RNA, 64 nt, hsa
cuccuuagcccgucacuccauacaguauuaggugaggauggaugcgggcgcuguccuugccggg

SEQ ID NO: 485080 - RNA, 64 nt, hsa
uguuccugggccuggcgggggaggcaggggugagaggauggaauugugugcacaagaacugugg

SEQ ID NO: 485081 - RNA, 64 nt, hsa
cucacuauggcaugcuucccuccuggugggcccuaggauggaugacacucaagauacuacagau

SEQ ID NO: 485082 - RNA, 64 nt, hsa
uaucucuacuuggaucaauucuggucauuucaagaggauggaggccucaagugugggaacuucc

SEQ ID NO: 485083 - RNA, 64 nt, hsa
gcuuuguacugcucucugggagccucccugcuugaggauggaaggaugaaauuugacgaauaua

SEQ ID NO: 485084 - RNA, 64 nt, hsa
caaagccggggaccaucuguauugcuuuguuuuuaggauggagaaugucagaucaaguuagaaa

SEQ ID NO: 485085 - RNA, 64 nt, hsa
gaugagaaggcccgucugcagcaccaggucacugaggauggagaguucuggugaguccagaacc

SEQ ID NO: 485086 - RNA, 64 nt, hsa
cauucuuucacaggagcuuuucaugcauuugacaaggauggagaugguaucaucaagcucaacg

SEQ ID NO: 485087 - RNA, 64 nt, hsa
uauggagagcucugauuccuacauaauaugaauaaggauggauaggccgggcgugguggcucau

SEQ ID NO: 485088 - RNA, 64 nt, hsa
uaacagagcgagaccccgacucaauaaauaaauaaggauggauaaauuguagcguaugcaccau

SEQ ID NO: 485089 - RNA, 64 nt, hsa
aguuucuguugacccccaccuuccaguguuggacaggauggaggggggacacuugcuuaggggc

SEQ ID NO: 485090 - RNA, 64 nt, hsa
uacagaaccaacauugugacgcccagguugcaacaggauggaauucagggacggacccagccug

SEQ ID NO: 485091 - RNA, 64 nt, hsa
cccuaacuagaguucuagaguuucugauucuguuucucaguaguccuuuuagaggcuugcuaua

SEQ ID NO: 485092 - RNA, 64 nt, hsa
aaaggguaggcauggaaaauuccacgaggcucauucucaguaucucauuaacucauugaaagau

SEQ ID NO: 485093 - RNA, 64 nt, hsa
uguuuaagaucacacagcuagugcaguuacccccucucaguaauuauguuuggcaaauaugaaa

SEQ ID NO: 485094 - RNA, 64 nt, hsa
aauuagggacauggaugaaauuggaaaucuucauucucaguaaacuaucgcaaggacaaaaaac

SEQ ID NO: 485095 - RNA, 64 nt, hsa
agaagcauagcccuuaacaaaucuucagcuugucucucaguauuucccaaucaugaaaaucccu

SEQ ID NO: 485096 - RNA, 64 nt, hsa
uuucaguucauugauuuauacgugcauauuucagucucaguauuuaugauugaagcaaauucua

SEQ ID NO: 485097 - RNA, 64 nt, hsa
ucacuaauauuuggaaguauuucauuacuaacaaucucaguacaacaugaaaauuguugcuucu

SEQ ID NO: 485098 - RNA, 64 nt, hsa
ggaauagcgauagauuuauauaaauaucuaaaugucucaguagaggaguagaauucaucugguu

SEQ ID NO: 485099 - RNA, 64 nt, hsa
acuggauggaaagacaaacugcacaggcagauguuugccucauaauagucguaaguggaguccu

SEQ ID NO: 485100 - RNA, 64 nt, hsa
gcaacccagucacacuguggccaguaaaauacuauugccucauauuguccucugcaagcuucuu

SEQ ID NO: 485101 - RNA, 64 nt, hsa
cacaugggagaaaaagucauccaguuuuucauguuugccucaaguaaucuuuacaguguuacaa

SEQ ID NO: 485102 - RNA, 64 nt, hsa
gagaaguugcuuugcucagugcuuugccccaggauugccucaaaucugaguggacuucauccuu

SEQ ID NO: 485103 - RNA, 64 nt, hsa
ucaccucagcuguacaaacuccagcauugagaauuugccucacucauuacuccugugugacagu

SEQ ID NO: 485104 - RNA, 64 nt, hsa
ugaggcucaaguaaauccucaauguguauaauuauugccucauaaacucucucuuuguuuuuaa

SEQ ID NO: 485105 - RNA, 64 nt, hsa
cuuggaacuggaauccuuucagcaagacuucucuuugccucaaauaaaaagugcuuuugugagc

SEQ ID NO: 485106 - RNA, 64 nt, hsa
cugcucguccccaagugaccuauaccuguguuucuugccucauuuuuuuccuugcaaauguagu

SEQ ID NO: 485107 - RNA, 64 nt, hsa
ugcaaccuccaccuccuggguucaagcgauucucuugccucaaccucccaagcaguugggacua

SEQ ID NO: 485108 - RNA, 64 nt, hsa
ucucuccaggcaggucugaagcucaacucucuuauugccucacuucagguauaccucacuuuac

SEQ ID NO: 485109 - RNA, 64 nt, hsa
uccagccuccaagucaccuggccugggaaaguacuugccucauguugcucugguuugugauaau

SEQ ID NO: 485110 - RNA, 64 nt, hsa
aacugaagacagccuuugugcggugccuccaacuuugccucaaaugggacaguggguugaggga

SEQ ID NO: 485111 - RNA, 64 nt, hsa
accccucccuccgagcugcaguucaccuuugaccuugccucaccuuucaccccccaccccccac

SEQ ID NO: 485112 - RNA, 64 nt, hsa
accccucccucugagcugcacuucaccgcugaccuugccucaccuuuaaccccccaccugagcc

SEQ ID NO: 485113 - RNA, 64 nt, hsa
caucauaaagcagagacuuacaugagugaaaggguugccucaucaagcagcucaguguaaaugg

SEQ ID NO: 485114 - RNA, 64 nt, hsa
ggagucaaaugcuuuuauaaaguuccuucagugguugccucacuugcguuuuccuacaagaugu

SEQ ID NO: 485115 - RNA, 64 nt, hsa
ugccgagagaagaggaguggaugagccugcggguuugccucaagaaacuucaugagggucucuu

SEQ ID NO: 485116 - RNA, 64 nt, hsa
ugcucucuaccuaggacaccagcugccacuucuuuugccucaugaagaacucuugggccagcca

SEQ ID NO: 485117 - RNA, 64 nt, hsa
gagaaagagaaauaaccugucucucauuccuaaguugccucauuaauuuucaugaacaagaaua

SEQ ID NO: 485118 - RNA, 64 nt, hsa
acacagcuaugauggaaugauauauccaaguuccuugccucagugaaauaugcauauguauauc

SEQ ID NO: 485119 - RNA, 64 nt, hsa; identical to SEQ ID NO: 72083

SEQ ID NO: 485120 - RNA, 64 nt, hsa; identical to SEQ ID NO: 72084

SEQ ID NO: 485121 - RNA, 64 nt, hsa; identical to SEQ ID NO: 72085

SEQ ID NO: 485122 - RNA, 64 nt, hsa; identical to SEQ ID NO: 72086

SEQ ID NO: 485123 - RNA, 64 nt, hsa; identical to SEQ ID NO: 72087

SEQ ID NO: 485124 - RNA, 64 nt, hsa; identical to SEQ ID NO: 72088

SEQ ID NO: 485125 - RNA, 64 nt, hsa; identical to SEQ ID NO: 72089

SEQ ID NO: 485126 - RNA, 64 nt, hsa; identical to SEQ ID NO: 72090

SEQ ID NO: 485127 - RNA, 64 nt, hsa; identical to SEQ ID NO: 72091

SEQ ID NO: 485128 - RNA, 64 nt, hsa; identical to SEQ ID NO: 72092

SEQ ID NO: 485129 - RNA, 64 nt, hsa; identical to SEQ ID NO: 72093

SEQ ID NO: 485130 - RNA, 64 nt, hsa; identical to SEQ ID NO: 72094

SEQ ID NO: 485131 - RNA, 64 nt, hsa; identical to SEQ ID NO: 72095

SEQ ID NO: 485132 - RNA, 64 nt, hsa; identical to SEQ ID NO: 72096

SEQ ID NO: 485133 - RNA, 64 nt, hsa; identical to SEQ ID NO: 72097

SEQ ID NO: 485134 - RNA, 64 nt, hsa; identical to SEQ ID NO: 72098

SEQ ID NO: 485135 - RNA, 64 nt, hsa; identical to SEQ ID NO: 72099

SEQ ID NO: 485136 - RNA, 64 nt, hsa; identical to SEQ ID NO: 72100

SEQ ID NO: 485137 - RNA, 64 nt, hsa; identical to SEQ ID NO: 72101

SEQ ID NO: 485138 - RNA, 64 nt, hsa; identical to SEQ ID NO: 72102

SEQ ID NO: 485139 - RNA, 64 nt, hsa; identical to SEQ ID NO: 72103

SEQ ID NO: 485140 - RNA, 64 nt, hsa; identical to SEQ ID NO: 72104

SEQ ID NO: 485141 - RNA, 64 nt, hsa; identical to SEQ ID NO: 72105

SEQ ID NO: 485142 - RNA, 64 nt, hsa; identical to SEQ ID NO: 72106

SEQ ID NO: 485143 - RNA, 64 nt, hsa; identical to SEQ ID NO: 72107

SEQ ID NO: 485144 - RNA, 64 nt, hsa; identical to SEQ ID NO: 72108

SEQ ID NO: 485145 - RNA, 64 nt, hsa; identical to SEQ ID NO: 72109

SEQ ID NO: 485146 - RNA, 64 nt, hsa
uagaacauuuuauuuauacugugaagacuuuguuauaccuuauuugcuacaacauagaucauau

SEQ ID NO: 485147 - RNA, 64 nt, hsa
gagcaaaacauagaacaaaaucacuaucucagaaauaccuuaauucucuaagacuggcucuuag

SEQ ID NO: 485148 - RNA, 64 nt, hsa
gugaagaauguggcaaagauuucuauugauucucauaccuuacuaaauauaagauaauucauau

SEQ ID NO: 485149 - RNA, 64 nt, hsa
augaggaaugucucaaagcuuuuuacugauucuuauaccuuacuaaacauaaaauaauucauaa

SEQ ID NO: 485150 - RNA, 64 nt, hsa; identical to SEQ ID NO: 380673

SEQ ID NO: 485151 - RNA, 64 nt, hsa; identical to SEQ ID NO: 380674

SEQ ID NO: 485152 - RNA, 64 nt, hsa; identical to SEQ ID NO: 380675

SEQ ID NO: 485153 - RNA, 64 nt, hsa; identical to SEQ ID NO: 380676

SEQ ID NO: 485154 - RNA, 63 nt, hsa; identical to SEQ ID NO: 380677

SEQ ID NO: 485155 - RNA, 64 nt, hsa; identical to SEQ ID NO: 380678

SEQ ID NO: 485156 - RNA, 64 nt, hsa; identical to SEQ ID NO: 380679

SEQ ID NO: 485157 - RNA, 64 nt, hsa; identical to SEQ ID NO: 380680

SEQ ID NO: 485158 - RNA, 64 nt, hsa; identical to SEQ ID NO: 380681

SEQ ID NO: 485159 - RNA, 64 nt, hsa; identical to SEQ ID NO: 380682

SEQ ID NO: 485160 - RNA, 64 nt, hsa; identical to SEQ ID NO: 380683

SEQ ID NO: 485161 - RNA, 64 nt, hsa; identical to SEQ ID NO: 380684

SEQ ID NO: 485162 - RNA, 64 nt, hsa; identical to SEQ ID NO: 380685

SEQ ID NO: 485163 - RNA, 64 nt, hsa; identical to SEQ ID NO: 380686

SEQ ID NO: 485164 - RNA, 58 nt, hsa; identical to SEQ ID NO: 380687

SEQ ID NO: 485165 - RNA, 64 nt, hsa; identical to SEQ ID NO: 380688

SEQ ID NO: 485166 - RNA, 64 nt, hsa; identical to SEQ ID NO: 380689

SEQ ID NO: 485167 - RNA, 64 nt, hsa; identical to SEQ ID NO: 380690

SEQ ID NO: 485168 - RNA, 64 nt, hsa; identical to SEQ ID NO: 380691

SEQ ID NO: 485169 - RNA, 64 nt, hsa; identical to SEQ ID NO: 380692

SEQ ID NO: 485170 - RNA, 64 nt, hsa; identical to SEQ ID NO: 380693

SEQ ID NO: 485171 - RNA, 64 nt, hsa; identical to SEQ ID NO: 380694

SEQ ID NO: 485172 - RNA, 64 nt, hsa; identical to SEQ ID NO: 380695

SEQ ID NO: 485173 - RNA, 64 nt, hsa; identical to SEQ ID NO: 380696

SEQ ID NO: 485174 - RNA, 64 nt, hsa; identical to SEQ ID NO: 380697

SEQ ID NO: 485175 - RNA, 64 nt, hsa; identical to SEQ ID NO: 380698

SEQ ID NO: 485176 - RNA, 64 nt, hsa; identical to SEQ ID NO: 380699

SEQ ID NO: 485177 - RNA, 64 nt, hsa; identical to SEQ ID NO: 380700

SEQ ID NO: 485178 - RNA, 64 nt, hsa; identical to SEQ ID NO: 380701

SEQ ID NO: 485179 - RNA, 64 nt, hsa
uccucugcugagaauccccacuugguguagggggagaggggaaaggggucuggcccaucgaggg

SEQ ID NO: 485180 - RNA, 64 nt, hsa
ccucccacugccugacaccugggacaggcugggcagaggggagagagggcaggacaggccagag

SEQ ID NO: 485181 - RNA, 64 nt, hsa
ugucacggagaaucuaucuaaucccacuguauuaagaggggaaaccgggccaagcgcaguggcu

SEQ ID NO: 485182 - RNA, 64 nt, hsa
agcgaaacuccgucucaaaaaaaaauaaaaaugaagaggggaaaccagaauaaauuaucuuuug

SEQ ID NO: 485183 - RNA, 64 nt, hsa
agaauggcccaaggaacuaggaagcagccaugggagaggggaaggguucaagcccgggaugggc

SEQ ID NO: 485184 - RNA, 64 nt, hsa
gucugcucuccuuugcucucugcagcuguaagccagaggggauucaagguaaauaggcuuuaca

SEQ ID NO: 485185 - RNA, 64 nt, hsa
uucuggguaaggcucaucuuuaaaaacuggcuucagaggggagaggggagaacaaugaauuggc

SEQ ID NO: 485186 - RNA, 64 nt, hsa
uaaggcucaucuuuaaaaacuggcuucagaggggagaggggagaacaaugaauuggcucuauuu

SEQ ID NO: 485187 - RNA, 64 nt, hsa
aagagcagaagggaggggagacagaggggauuaaagaggggaggagagagugcagagcuccagg

SEQ ID NO: 485188 - RNA, 64 nt, hsa
ggaugggggcugaagagcagaagggaggggagacagaggggauuaaagaggggaggagagagug

SEQ ID NO: 485189 - RNA, 64 nt, hsa
uuugccaucaccaguuucucaggcuggggagcacagaggggaggaggaggacuaaaugaaaagu

SEQ ID NO: 485190 - RNA, 64 nt, hsa
ucccuguccccagagggaggagcaggcaggagagagaggggaaggagguaugaaucccaguccc

SEQ ID NO: 485191 - RNA, 64 nt, hsa
caggaaacacccccaggaggccaagccugaaaacagaggggagggaggaaggaaggagucccag

SEQ ID NO: 485192 - RNA, 64 nt, hsa
uuuuuuuuuuucagauacugugcuugauuuuuggagaggggagagguggaaauuccuaaauggc

SEQ ID NO: 485193 - RNA, 64 nt, hsa
uuugcagagucaacagcccaucagcccauguuuuagaggggacacuuugguccucgguucccac

SEQ ID NO: 485194 - RNA, 64 nt, hsa
acaaaccugaugccuuaaggaaaagguuaagaugagaggggacuuccagagucaaugaacguca

SEQ ID NO: 485195 - RNA, 64 nt, hsa
ucuuccugccucuccccacccugcccacauccacagaggggagagaagggucauagcuaaaugc

SEQ ID NO: 485196 - RNA, 64 nt, hsa
ucuuacucuucccauuccucagaccagcaggaaaagaggggagacgucagucuuuuuccugugg

SEQ ID NO: 485197 - RNA, 64 nt, hsa
uuaccccucagcccaccucacuauggugcuggguagaggggauaccuggguucuaaccucuaaa

SEQ ID NO: 485198 - RNA, 64 nt, hsa
ccaagugugacauccuucagcacccagggacaagagaggggaaagaugcuuuauggaauguaag

SEQ ID NO: 485199 - RNA, 64 nt, hsa
gucugagauggaucauaaguaaaugagcagugugagaggggagggauggguaggugcuuuccaa

SEQ ID NO: 485200 - RNA, 64 nt, hsa
aaauucagcaaguuauuaaaucugacaugguaggagaggggagauguguccugcuuauuaaaug

SEQ ID NO: 485201 - RNA, 64 nt, hsa
augcaagggagccaguacugaauuaugccuuggcagaggggagacuccaaaagagucaucgcag

SEQ ID NO: 485202 - RNA, 64 nt, hsa
ucuucagaacacacagacuuucugugacgcagacagaggggauggggauagaggaaagggaugg

SEQ ID NO: 485203 - RNA, 64 nt, hsa
uguaaauguagcugagaccccacgugcgacagagagaggggagagagaaccaccacugccugac

SEQ ID NO: 485204 - RNA, 64 nt, hsa
auuuggaaauaaagaaugugauagagauggcugaagaggggaagccuaggcugccucaauggag

SEQ ID NO: 485205 - RNA, 64 nt, hsa
ucugcagagaugccugugagauauuugcuuuccuagaggggagugugggcaugggaggggucug

SEQ ID NO: 485206 - RNA, 64 nt, hsa
ugcuagagcccuuccucucagcccccauguugggagaggggaguggauucuugcugcugguaug

SEQ ID NO: 485207 - RNA, 64 nt, hsa
cacagagagguaaaauggaggccagugccauuucagaggggaggcucaggaaggcuucuugcuu

SEQ ID NO: 485208 - RNA, 64 nt, hsa
cucucuggcccacucaugauggagaaguguggucagaggggagcaaugggcuuugcugcuuaug

SEQ ID NO: 485209 - RNA, 64 nt, hsa
acgccagcugcggggacgcacuugggacuccucgagaggggacucgcggccgcgauggcaaggc

SEQ ID NO: 485210 - RNA, 64 nt, hsa
ugguccuguggucagagcccaagcagcacucaggagaggggagaaaggaggugcaccuggcagc

SEQ ID NO: 485211 - RNA, 64 nt, hsa
uguggagagcuccuggugucgaggacugagacugagaggggagcccccuccaucuggcccccuu

SEQ ID NO: 485212 - RNA, 64 nt, hsa
ggauaggcgcaguggucagaugaagcagcgccagagaggggaccucccagcucuuauuugcacc

SEQ ID NO: 485213 - RNA, 64 nt, hsa
ggagguagaggagcuauguggagcaaaggccgacagaggggaaggaauggaccugugagaggaa

SEQ ID NO: 485214 - RNA, 64 nt, hsa
uuuauuuuuaauuuaucucugugaccugccagggagaggggagagagagagagaugcuguugag

SEQ ID NO: 485215 - RNA, 64 nt, hsa
agagagggagagagagacagagggagagagagacagaggggaagagaggcagagagggaaagag

SEQ ID NO: 485216 - RNA, 64 nt, hsa
auggagaggaggggagagagaaagagagguggggagaggggagagagauaugaggagagagaga

SEQ ID NO: 485217 - RNA, 64 nt, hsa
uucucugcauuccuuccggggggagccuguccucagaggggacaaccugugacacccugagucc

SEQ ID NO: 485218 - RNA, 64 nt, hsa
gggcugcuggguuggaggggcuaaggaggagugcagaggggaccuugggagccugggcuugaag

SEQ ID NO: 485219 - RNA, 64 nt, hsa
ggaggggagaagcccagcagaagcugagccaggcagaggggaaagaagcugauaugaggaaggg

SEQ ID NO: 485220 - RNA, 64 nt, hsa
cccaggucugacguccuuggggguggcuugaggaagaggggaaggugcguauuuauucagggag

SEQ ID NO: 485221 - RNA, 64 nt, hsa
uuuaacccuuuagcccuaggauggcuuuggugggagaggggauagaagcccaugacuucagaca

SEQ ID NO: 485222 - RNA, 64 nt, hsa
aaguauguugguggugaaagcaagguuccccaggagaggggagggacuggccccugggaagcuc

SEQ ID NO: 485223 - RNA, 64 nt, hsa
caccccucuccuuuggccuccggcagugcagaccagaggggaccuuuuaaggaaagaagccgug

SEQ ID NO: 485224 - RNA, 64 nt, hsa
uccugggaugguacccugugcucucccguggaggagaggggauggcugaggacacuggcccuua

SEQ ID NO: 485225 - RNA, 64 nt, hsa
gcaggggcauggcacccuuuccugucgggaagggagaggggaacuacccccccagccugcccuc

SEQ ID NO: 485226 - RNA, 64 nt, hsa
ucucagugccccugcccuaggggugucugucuccagaggggagggacaaauccccuacuggggc

SEQ ID NO: 485227 - RNA, 64 nt, hsa
cucacuaccgccagacaccccgguggaagcauuuagaggggaccacgggagggacaaggcuucu

SEQ ID NO: 485228 - RNA, 64 nt, hsa
ucacauccucaggucucgggaccauggggggcucagaggggagacacaccuacugcuuccucag

SEQ ID NO: 485229 - RNA, 64 nt, hsa
ggcauguugcuccacauuccuuacacacagggguagaggggauugcuuuugugacccacguuca

SEQ ID NO: 485230 - RNA, 64 nt, hsa
cucuuguacggaugaucgcaaaacugagguguagagaggggaauggccaaaaucacaaagcaag

SEQ ID NO: 485231 - RNA, 64 nt, hsa
gaaacagaaccaauaggauauauaagcccaaauaagaggggauuuauuaugggaauuggcucuc

SEQ ID NO: 485232 - RNA, 64 nt, hsa
aaaucaaaacaaagaaccugcucugaugacacuuagaggggagagaugaaagccaaacaaauga

SEQ ID NO: 485233 - RNA, 64 nt, hsa
ccuuuagacuaacgaauauauuggggggaggaauagaggggaggugugcaggaaccagcaauga

SEQ ID NO: 485234 - RNA, 64 nt, hsa
aaggcaggaaugcuggagccuggaauaagggaggagaggggacuggagaguguggggaauagga

SEQ ID NO: 485235 - RNA, 64 nt, hsa
cuuccuuccagggcuuuuccuuugggggaggcggagaggggagaagaaggaagggaagggcaga

SEQ ID NO: 485236 - RNA, 64 nt, hsa
uucuuaggcaaacgccugcaaaacagaagccuggagaggggagugaccugcucagagucauugc

SEQ ID NO: 485237 - RNA, 64 nt, hsa
gaaggaggugugcguggcuucuggggugggacccagaggggaggcucugggacaggggcugggg

SEQ ID NO: 485238 - RNA, 64 nt, hsa
gguugcacuggccagcaugggccugucccaagcgagaggggagacacaguggacugaaaggacu

SEQ ID NO: 485239 - RNA, 64 nt, hsa
ugcuuaaaaauguaauugggggcggcgggggaggagaggggaaagagacauucgcuugguuuag

SEQ ID NO: 485240 - RNA, 62 nt, hsa
aacuaggaaaggggaucagaaacauccucuccccgcucuagguuucuucucccaaaggggac

SEQ ID NO: 485241 - RNA, 62 nt, hsa
cuaaaagggugauugacauccauguuuacacuccgcucuaauguuugauauauaaauaaguu

SEQ ID NO: 485242 - RNA, 62 nt, hsa
guggcuguguccaucucugcucccccaaaggcccgcucuaggccuuauccucccucuagguc

SEQ ID NO: 485243 - RNA, 62 nt, hsa
aauggugguuugggcuugucuucuagucugggccgcucuaaacauuuauaauuccaacauug

SEQ ID NO: 485244 - RNA, 62 nt, hsa
ggcaucauuauccggugcuugaacaaggagcuccgcucuacaacugguuuuuuuaggacuug

SEQ ID NO: 485245 - RNA, 62 nt, hsa
gcacaagccccacagagggggaacagccagcaccgcucuagcugguuguugccaugccggaa

SEQ ID NO: 485246 - RNA, 62 nt, hsa
ugcaguccuggaagcgcgagggccucaaaggcccgcucuacaucuucugccuuagucucagu

SEQ ID NO: 485247 - RNA, 62 nt, hsa
uaauuaugcuuaagcuuuuaacagcauuuuaaccgcucuaaaaauuaccagaguaagaaaaa

SEQ ID NO: 485248 - RNA, 62 nt, hsa
cacuugccggcccccaccaguucuuggguuccccgcucuaguuugaccugugcagcacauuc

SEQ ID NO: 485249 - RNA, 62 nt, hsa
ccuggccucccuggccacagcagccuuacccaccgcucuacgugucccgggcacuucccgca

SEQ ID NO: 485250 - RNA, 62 nt, hsa
uucaucuuugacuccaaaaugucagagggaggccgcucuaaacuaaaaauaacgaaagguug

SEQ ID NO: 485251 - RNA, 62 nt, hsa
ccuccccgcacaggcuguggcuugcacuccagccgcucuagucucucaggaauuugcuuguu

SEQ ID NO: 485252 - RNA, 62 nt, hsa
gggccucauuucucccagagggagcugcuggcccgcucuaaggggugcaagaggaaggagug

SEQ ID NO: 485253 - RNA, 62 nt, hsa
ccagucagcuccugggguugcgccaggcgcccccgcucuagcucacuguugccucgcugucu

SEQ ID NO: 485254 - RNA, 62 nt, hsa
acugcagucaguguugaguggugccaugugggccgcucuauuccaaaggaaucauggauuag

SEQ ID NO: 485255 - RNA, 62 nt, hsa
uucaaaccuggguggcccugagaccagagcuuccgcucuacccacuucacuauacuucucuu

SEQ ID NO: 485256 - RNA, 62 nt, hsa
uauagaugauugugccaucuucuguagccccuccgcucuacucauuccuuccaccaucugca

SEQ ID NO: 485257 - RNA, 62 nt, hsa
uggaaugccgcugucucugaggggugggggugccgcucuaaauuggcuccauaucauuugag

SEQ ID NO: 485258 - RNA, 62 nt, hsa
uccucuccaacgugcugcucuccacgccggccccgcucuacggaggccuggcacugcugacc

SEQ ID NO: 485259 - RNA, 62 nt, hsa
auccauagaaaaugacuuauuuccagaagauaccgcucuaaaaaugaaauuguuaggugaaa

SEQ ID NO: 485260 - RNA, 62 nt, hsa
ccucagccuuggggcuguuuuuccuuguugccccgcucuagacuuuuagcagaucugcagcc

SEQ ID NO: 485261 - RNA, 62 nt, hsa
acauaauugacacaguuuauuggguguuaaguccgcucuauagggauagugacuacuuuuuu

SEQ ID NO: 485262 - RNA, 62 nt, hsa
cauguugugggagcccucguccccccuccugcccgcucuacccugaccugggcuugucaucu

SEQ ID NO: 485263 - RNA, 62 nt, hsa
aaguacccaugcccugaaugugggagcuucuuccgcucuaaguccuacuugaacaaacacau

SEQ ID NO: 485264 - RNA, 62 nt, hsa
uacccuuuaaacugucacugcauaugcaaguaccgcucuaauuuuuggaucauuaaagggag

SEQ ID NO: 485265 - RNA, 64 nt, hsa; identical to SEQ ID NO: 53771

SEQ ID NO: 485266 - RNA, 64 nt, hsa; identical to SEQ ID NO: 53772

SEQ ID NO: 485267 - RNA, 64 nt, hsa; identical to SEQ ID NO: 53773

SEQ ID NO: 485268 - RNA, 64 nt, hsa; identical to SEQ ID NO: 53774

SEQ ID NO: 485269 - RNA, 64 nt, hsa; identical to SEQ ID NO: 53775

SEQ ID NO: 485270 - RNA, 64 nt, hsa; identical to SEQ ID NO: 53776

SEQ ID NO: 485271 - RNA, 64 nt, hsa; identical to SEQ ID NO: 53777

SEQ ID NO: 485272 - RNA, 64 nt, hsa; identical to SEQ ID NO: 53778

SEQ ID NO: 485273 - RNA, 64 nt, hsa; identical to SEQ ID NO: 53779

SEQ ID NO: 485274 - RNA, 64 nt, hsa; identical to SEQ ID NO: 53780

SEQ ID NO: 485275 - RNA, 64 nt, hsa; identical to SEQ ID NO: 53781

SEQ ID NO: 485276 - RNA, 64 nt, hsa; identical to SEQ ID NO: 53782

SEQ ID NO: 485277 - RNA, 64 nt, hsa; identical to SEQ ID NO: 53783

SEQ ID NO: 485278 - RNA, 64 nt, hsa; identical to SEQ ID NO: 53784

SEQ ID NO: 485279 - RNA, 64 nt, hsa; identical to SEQ ID NO: 53785

SEQ ID NO: 485280 - RNA, 64 nt, hsa; identical to SEQ ID NO: 53786

SEQ ID NO: 485281 - RNA, 64 nt, hsa; identical to SEQ ID NO: 53787

SEQ ID NO: 485282 - RNA, 64 nt, hsa; identical to SEQ ID NO: 53788

SEQ ID NO: 485283 - RNA, 64 nt, hsa; identical to SEQ ID NO: 53789

SEQ ID NO: 485284 - RNA, 64 nt, hsa; identical to SEQ ID NO: 53790

SEQ ID NO: 485285 - RNA, 64 nt, hsa; identical to SEQ ID NO: 53791

SEQ ID NO: 485286 - RNA, 64 nt, hsa; identical to SEQ ID NO: 53792

SEQ ID NO: 485287 - RNA, 64 nt, hsa; identical to SEQ ID NO: 53793

SEQ ID NO: 485288 - RNA, 64 nt, hsa; identical to SEQ ID NO: 53794

SEQ ID NO: 485289 - RNA, 64 nt, hsa; identical to SEQ ID NO: 53795

SEQ ID NO: 485290 - RNA, 64 nt, hsa; identical to SEQ ID NO: 53796

SEQ ID NO: 485291 - RNA, 64 nt, hsa; identical to SEQ ID NO: 53797

SEQ ID NO: 485292 - RNA, 64 nt, hsa; identical to SEQ ID NO: 53798

SEQ ID NO: 485293 - RNA, 64 nt, hsa; identical to SEQ ID NO: 53799

SEQ ID NO: 485294 - RNA, 64 nt, hsa; identical to SEQ ID NO: 53800

SEQ ID NO: 485295 - RNA, 64 nt, hsa; identical to SEQ ID NO: 53801

SEQ ID NO: 485296 - RNA, 64 nt, hsa; identical to SEQ ID NO: 53802

SEQ ID NO: 485297 - RNA, 64 nt, hsa; identical to SEQ ID NO: 53803

SEQ ID NO: 485298 - RNA, 64 nt, hsa; identical to SEQ ID NO: 53804

SEQ ID NO: 485299 - RNA, 64 nt, hsa; identical to SEQ ID NO: 53805

SEQ ID NO: 485300 - RNA, 64 nt, hsa; identical to SEQ ID NO: 53806

SEQ ID NO: 485301 - RNA, 64 nt, hsa; identical to SEQ ID NO: 53807

SEQ ID NO: 485302 - RNA, 64 nt, hsa; identical to SEQ ID NO: 53808

SEQ ID NO: 485303 - RNA, 64 nt, hsa; identical to SEQ ID NO: 53809

SEQ ID NO: 485304 - RNA, 64 nt, hsa; identical to SEQ ID NO: 53810

SEQ ID NO: 485305 - RNA, 64 nt, hsa; identical to SEQ ID NO: 53811

SEQ ID NO: 485306 - RNA, 64 nt, hsa; identical to SEQ ID NO: 53812

SEQ ID NO: 485307 - RNA, 64 nt, hsa; identical to SEQ ID NO: 53813

SEQ ID NO: 485308 - RNA, 64 nt, hsa; identical to SEQ ID NO: 53814

SEQ ID NO: 485309 - RNA, 64 nt, hsa; identical to SEQ ID NO: 53815

SEQ ID NO: 485310 - RNA, 64 nt, hsa
gcucauacccagcccuaccaaucaugaacuggaacuccauaaggaggggccaaauugggaggcc

SEQ ID NO: 485311 - RNA, 64 nt, hsa
gcuuagguaccucagguggcccaggagguccccccuccauaaggacgucaaacuuccaggaggg

SEQ ID NO: 485312 - RNA, 64 nt, hsa; identical to SEQ ID NO: 299632

SEQ ID NO: 485313 - RNA, 64 nt, hsa; identical to SEQ ID NO: 299633

SEQ ID NO: 485314 - RNA, 51 nt, hsa; identical to SEQ ID NO: 299634

SEQ ID NO: 485315 - RNA, 64 nt, hsa; identical to SEQ ID NO: 299635

SEQ ID NO: 485316 - RNA, 64 nt, hsa; identical to SEQ ID NO: 299636

SEQ ID NO: 485317 - RNA, 64 nt, hsa; identical to SEQ ID NO: 299637

SEQ ID NO: 485318 - RNA, 64 nt, hsa; identical to SEQ ID NO: 299638

SEQ ID NO: 485319 - RNA, 64 nt, hsa; identical to SEQ ID NO: 299639

SEQ ID NO: 485320 - RNA, 64 nt, hsa; identical to SEQ ID NO: 299640

SEQ ID NO: 485321 - RNA, 64 nt, hsa; identical to SEQ ID NO: 299641

SEQ ID NO: 485322 - RNA, 64 nt, hsa; identical to SEQ ID NO: 299642

SEQ ID NO: 485323 - RNA, 64 nt, hsa; identical to SEQ ID NO: 299643

SEQ ID NO: 485324 - RNA, 64 nt, hsa; identical to SEQ ID NO: 299644

SEQ ID NO: 485325 - RNA, 64 nt, hsa; identical to SEQ ID NO: 299645

SEQ ID NO: 485326 - RNA, 64 nt, hsa; identical to SEQ ID NO: 299646

SEQ ID NO: 485327 - RNA, 64 nt, hsa; identical to SEQ ID NO: 299647

SEQ ID NO: 485328 - RNA, 64 nt, hsa; identical to SEQ ID NO: 299648

SEQ ID NO: 485329 - RNA, 64 nt, hsa
ugagccaagaucgcgcuauugcacuccagccugggugacagagcaagacucugccucagaaaaa

SEQ ID NO: 485330 - RNA, 64 nt, hsa
uaaaauuaagucauugaugcugcuguuacagagugugacagaggauccaugucugugacacagg

SEQ ID NO: 485331 - RNA, 64 nt, hsa
ugagccgagauuaugccacuguacuccagccugggugacagagugacacucugucucaaaaaaa

SEQ ID NO: 485332 - RNA, 64 nt, hsa
ggagccgagauagugucacugcacuccagccugggugacagagcgagacuccgucucaaaaaac

SEQ ID NO: 485333 - RNA, 64 nt, hsa
ugagcugucauugugccacuauccuccaguaugggugacagagugagaccuggucucuaaaaaa

SEQ ID NO: 485334 - RNA, 64 nt, hsa
uguaugccaaaauuaguuguuuaagugaaguuuugugacagaaaaaagguuguuuuaauaucua

SEQ ID NO: 485335 - RNA, 64 nt, hsa
aaaaauaaucaaagauagcauucauugagagacagugacagauauaauuuacuacauauauuga

SEQ ID NO: 485336 - RNA, 64 nt, hsa
uaaaucuuaaaaccuucauaucuagguauccauugugacagacaaguaaaauugcaggugauuu

SEQ ID NO: 485337 - RNA, 64 nt, hsa
ugugcugugauugugacacugcccuccagccugggugacagagugagacccugucucaaaagca

SEQ ID NO: 485338 - RNA, 64 nt, hsa
ugagccgagaucaugcgacugcacuccagccugggugacagagccagacucugucucaaaaaaa

SEQ ID NO: 485339 - RNA, 64 nt, hsa
aaaccaaacaggcuaggggagaauaggucuaauugugacagacuuaaaaacaacacauuauuug

SEQ ID NO: 485340 - RNA, 64 nt, hsa
ugagacaagaucacgucacuguacuccagccugggugacagagugauacuccaucucaaaaaaa

SEQ ID NO: 485341 - RNA, 64 nt, hsa
ugagccaagaucguaccacugcacuccagccugggugacagagugagacucugucuccaaaaaa

SEQ ID NO: 485342 - RNA, 64 nt, hsa
gugagcugagaucacaccacugcacuccagccuggugacagagcaagacuccggcucuuaaaaa

SEQ ID NO: 485343 - RNA, 64 nt, hsa
uggggauggguuuaggagcuccagguugggagcagugacagagagucauggccguggugagggu

SEQ ID NO: 485344 - RNA, 64 nt, hsa
ugagcugugauugugccacuguacuccagccugggugacagagcgagacucugucucaaaaaaa

SEQ ID NO: 485345 - RNA, 64 nt, hsa
ugagccaugaucacaucacugcaguccagccugggugacagagcaagaccugucacccugccac

SEQ ID NO: 485346 - RNA, 64 nt, hsa
auauuaauauuaaucaagaauuuaacagauauaugugacagaaaucuaacuucaagugacugaa

SEQ ID NO: 485347 - RNA, 64 nt, hsa
augagccaugauuucccacugcacuccagccugagugacagagcgagacuccaucucuuuaaaa

SEQ ID NO: 485348 - RNA, 64 nt, hsa
ucagcccugauugugccagugcacuccggccugggugacagagugagacccugucucaaaaaaa

SEQ ID NO: 485349 - RNA, 64 nt, hsa
uuuauauaauucaaaagaaugcauguuucacauugugacagauaaagauguaugauuucuaagg

SEQ ID NO: 485350 - RNA, 64 nt, hsa
uacacugaagcagcucauagcaaguuaaaauauugugacagauuugaaaucauguuugaauuuc

SEQ ID NO: 485351 - RNA, 64 nt, hsa
uugcuuuaaucaccauauaaaaggaaaaaaauuggugacagagcacaaauagaaaaccuauuuu

SEQ ID NO: 485352 - RNA, 64 nt, hsa
uuuaucccacaguggauugacucagccucugugggugacagacuucuaagcaggaagauagacg

SEQ ID NO: 485353 - RNA, 64 nt, hsa
ugagccaggaucacaccauugcuguccagccugggugacagagcaagacugcguuucaaaaaaa

SEQ ID NO: 485354 - RNA, 64 nt, hsa
ugagcugagauccugccacugcacuccagucugggugacagagcaagacuccaucucaaaaaau

SEQ ID NO: 485355 - RNA, 64 nt, hsa
gagaaacugagccaaggccacauagcuaccuacagugacagaaucaaaauucaaacucagguuu

SEQ ID NO: 485356 - RNA, 64 nt, hsa
ugaucaggaauugugccacugcacuccaaccugagugacagagcaacacucugucuuaaaagaa

SEQ ID NO: 485357 - RNA, 64 nt, hsa
ccauccucuugucagggcccuuuccuguguacacgugacagagugccuuuucgagacuggcagg

SEQ ID NO: 485358 - RNA, 64 nt, hsa
aaagacccacaugcuacaagacgggcaaaauaaagugacagaugaccacccugcagcucuccag

SEQ ID NO: 485359 - RNA, 64 nt, hsa
uucucagaccugugauccguguaucuucuccccagugacagaaguagagaagagaauggaaagc

SEQ ID NO: 485360 - RNA, 64 nt, hsa
cucuucuuagggaaaucuccugaaggaaaaaaaugugacagaauguuccauagucugagagaau

SEQ ID NO: 485361 - RNA, 64 nt, hsa
cacagagccauaccauaucagcccagaucaaguagugacagaguagggauuugaauacagguua

SEQ ID NO: 485362 - RNA, 64 nt, hsa
ugagccaagaucgcgccacugcacuccagccugggugacagaacaagacugucucaaaaaaaaa

SEQ ID NO: 485363 - RNA, 64 nt, hsa
gacauugcggacagccacggccaggccagagggagugacagaggcagccccauucugccugccc

SEQ ID NO: 485364 - RNA, 64 nt, hsa
ugagccgagaucacgccacugcacuauagccuaggugacagagugagacucugucucaaaaaaa

SEQ ID NO: 485365 - RNA, 64 nt, hsa
ugagccgagauugcaccaccgcacuccagccugggugacagagcgagacuuaucucauaaauaa

SEQ ID NO: 485366 - RNA, 64 nt, hsa
ucucauaaauaaauagauagauacuccagccugggugacagagcgagacuuauagauagauaga

SEQ ID NO: 485367 - RNA, 64 nt, hsa
cgcagugagauugcgccauugcauuccagccugggugacagagcgagacuccguaucagaaaga

SEQ ID NO: 485368 - RNA, 64 nt, hsa
gugaccccucauugcaccacuuuacuuagccugggugacagagugagacccuaucucaaaaaaa

SEQ ID NO: 485369 - RNA, 64 nt, hsa
ugagccaagaucgcacuacugcacuccagccugggugacagaguaagacccugucucaacaaaa

SEQ ID NO: 485370 - RNA, 64 nt, hsa
ugagccgagaucgcgccacugcacuccagccugggugacagagccagacuccaucucaaagaaa

SEQ ID NO: 485371 - RNA, 64 nt, hsa
ggggucauaaucaugccacuguacuccagccugggugacagagugagacccugucuccgaaaaa

SEQ ID NO: 485372 - RNA, 64 nt, hsa
ugagcucagauagugccacugcacuccagccugggugacagagcgagacuccgucucaaaaaaa

SEQ ID NO: 485373 - RNA, 64 nt, hsa
aaauguuuguuaauaaaaauaagaaauagcuacagugacagauuuuagagcaaaaauuaguaau

SEQ ID NO: 485374 - RNA, 64 nt, hsa
ugagccaagaucgcgccacugcacuccagccugggugacagagcgagaccgucucaaaaagaaa

SEQ ID NO: 485375 - RNA, 64 nt, hsa
ugagcagagaucaugcuacugcacuccagccugggugacagagcgagacuccaucucaaaaaaa

SEQ ID NO: 485376 - RNA, 64 nt, hsa
ggagccaugaucaugccauuguacuccagcaugggugacagagacagauaguguaucgaaaaau

SEQ ID NO: 485377 - RNA, 64 nt, hsa
gugagcuaagacugcaccacugcacuccagccuggugacagaacgagacucugucuuaaaaaca

SEQ ID NO: 485378 - RNA, 64 nt, hsa
ugagcugugaucucaccacugcauuccagccugggugacagaguuagauuccacccucucccac

SEQ ID NO: 485379 - RNA, 64 nt, hsa; identical to SEQ ID NO: 155381

SEQ ID NO: 485380 - RNA, 64 nt, hsa; identical to SEQ ID NO: 155382

SEQ ID NO: 485381 - RNA, 64 nt, hsa; identical to SEQ ID NO: 458775

SEQ ID NO: 485382 - RNA, 64 nt, hsa; identical to SEQ ID NO: 458776

SEQ ID NO: 485383 - RNA, 64 nt, hsa; identical to SEQ ID NO: 458777

SEQ ID NO: 485384 - RNA, 64 nt, hsa; identical to SEQ ID NO: 458778

SEQ ID NO: 485385 - RNA, 64 nt, hsa; identical to SEQ ID NO: 458779

SEQ ID NO: 485386 - RNA, 64 nt, hsa; identical to SEQ ID NO: 458780

SEQ ID NO: 485387 - RNA, 64 nt, hsa; identical to SEQ ID NO: 458781

SEQ ID NO: 485388 - RNA, 64 nt, hsa; identical to SEQ ID NO: 458782

SEQ ID NO: 485389 - RNA, 64 nt, hsa; identical to SEQ ID NO: 458783

SEQ ID NO: 485390 - RNA, 64 nt, hsa; identical to SEQ ID NO: 458784

SEQ ID NO: 485391 - RNA, 64 nt, hsa; identical to SEQ ID NO: 458785

SEQ ID NO: 485392 - RNA, 64 nt, hsa; identical to SEQ ID NO: 458786

SEQ ID NO: 485393 - RNA, 64 nt, hsa; identical to SEQ ID NO: 458787

SEQ ID NO: 485394 - RNA, 64 nt, hsa; identical to SEQ ID NO: 458788

SEQ ID NO: 485395 - RNA, 64 nt, hsa; identical to SEQ ID NO: 458789

SEQ ID NO: 485396 - RNA, 64 nt, hsa; identical to SEQ ID NO: 458790

SEQ ID NO: 485397 - RNA, 64 nt, hsa; identical to SEQ ID NO: 458791

SEQ ID NO: 485398 - RNA, 64 nt, hsa; identical to SEQ ID NO: 458792

SEQ ID NO: 485399 - RNA, 64 nt, hsa; identical to SEQ ID NO: 458793

SEQ ID NO: 485400 - RNA, 64 nt, hsa; identical to SEQ ID NO: 458794

SEQ ID NO: 485401 - RNA, 64 nt, hsa; identical to SEQ ID NO: 458795

SEQ ID NO: 485402 - RNA, 64 nt, hsa; identical to SEQ ID NO: 458796

SEQ ID NO: 485403 - RNA, 64 nt, hsa; identical to SEQ ID NO: 458797

SEQ ID NO: 485404 - RNA, 64 nt, hsa; identical to SEQ ID NO: 458798

SEQ ID NO: 485405 - RNA, 64 nt, hsa; identical to SEQ ID NO: 458799

SEQ ID NO: 485406 - RNA, 64 nt, hsa; identical to SEQ ID NO: 458800

SEQ ID NO: 485407 - RNA, 64 nt, hsa; identical to SEQ ID NO: 458801

SEQ ID NO: 485408 - RNA, 64 nt, hsa; identical to SEQ ID NO: 458802

SEQ ID NO: 485409 - RNA, 64 nt, hsa; identical to SEQ ID NO: 458803

SEQ ID NO: 485410 - RNA, 65 nt, hsa; identical to SEQ ID NO: 58812

SEQ ID NO: 485411 - RNA, 65 nt, hsa; identical to SEQ ID NO: 58813

SEQ ID NO: 485412 - RNA, 65 nt, hsa; identical to SEQ ID NO: 58814

SEQ ID NO: 485413 - RNA, 65 nt, hsa; identical to SEQ ID NO: 58815

SEQ ID NO: 485414 - RNA, 65 nt, hsa; identical to SEQ ID NO: 58816

SEQ ID NO: 485415 - RNA, 65 nt, hsa; identical to SEQ ID NO: 58817

SEQ ID NO: 485416 - RNA, 65 nt, hsa; identical to SEQ ID NO: 58818

SEQ ID NO: 485417 - RNA, 65 nt, hsa; identical to SEQ ID NO: 58819

SEQ ID NO: 485418 - RNA, 65 nt, hsa; identical to SEQ ID NO: 58820

SEQ ID NO: 485419 - RNA, 65 nt, hsa; identical to SEQ ID NO: 58821

SEQ ID NO: 485420 - RNA, 65 nt, hsa; identical to SEQ ID NO: 58822

SEQ ID NO: 485421 - RNA, 65 nt, hsa; identical to SEQ ID NO: 58823

SEQ ID NO: 485422 - RNA, 65 nt, hsa; identical to SEQ ID NO: 58824

SEQ ID NO: 485423 - RNA, 65 nt, hsa; identical to SEQ ID NO: 58825

SEQ ID NO: 485424 - RNA, 65 nt, hsa; identical to SEQ ID NO: 58826

SEQ ID NO: 485425 - RNA, 65 nt, hsa; identical to SEQ ID NO: 58827

SEQ ID NO: 485426 - RNA, 65 nt, hsa; identical to SEQ ID NO: 58828

SEQ ID NO: 485427 - RNA, 65 nt, hsa; identical to SEQ ID NO: 58829

SEQ ID NO: 485428 - RNA, 65 nt, hsa; identical to SEQ ID NO: 58830

SEQ ID NO: 485429 - RNA, 65 nt, hsa; identical to SEQ ID NO: 58831

SEQ ID NO: 485430 - RNA, 65 nt, hsa; identical to SEQ ID NO: 58832

SEQ ID NO: 485431 - RNA, 65 nt, hsa; identical to SEQ ID NO: 58833

SEQ ID NO: 485432 - RNA, 65 nt, hsa; identical to SEQ ID NO: 58834

SEQ ID NO: 485433 - RNA, 65 nt, hsa; identical to SEQ ID NO: 58835

SEQ ID NO: 485434 - RNA, 65 nt, hsa; identical to SEQ ID NO: 58836

SEQ ID NO: 485435 - RNA, 65 nt, hsa; identical to SEQ ID NO: 58837

SEQ ID NO: 485436 - RNA, 65 nt, hsa; identical to SEQ ID NO: 58838

SEQ ID NO: 485437 - RNA, 65 nt, hsa; identical to SEQ ID NO: 58839

SEQ ID NO: 485438 - RNA, 65 nt, hsa; identical to SEQ ID NO: 58840

SEQ ID NO: 485439 - RNA, 65 nt, hsa; identical to SEQ ID NO: 58841

SEQ ID NO: 485440 - RNA, 65 nt, hsa; identical to SEQ ID NO: 58842

SEQ ID NO: 485441 - RNA, 65 nt, hsa; identical to SEQ ID NO: 58843

SEQ ID NO: 485442 - RNA, 65 nt, hsa; identical to SEQ ID NO: 58844

SEQ ID NO: 485443 - RNA, 65 nt, hsa; identical to SEQ ID NO: 58845

SEQ ID NO: 485444 - RNA, 65 nt, hsa; identical to SEQ ID NO: 58846

SEQ ID NO: 485445 - RNA, 65 nt, hsa; identical to SEQ ID NO: 58847

SEQ ID NO: 485446 - RNA, 65 nt, hsa; identical to SEQ ID NO: 58848

SEQ ID NO: 485447 - RNA, 65 nt, hsa; identical to SEQ ID NO: 58849

SEQ ID NO: 485448 - RNA, 65 nt, hsa; identical to SEQ ID NO: 58850

SEQ ID NO: 485449 - RNA, 65 nt, hsa; identical to SEQ ID NO: 58851

SEQ ID NO: 485450 - RNA, 65 nt, hsa; identical to SEQ ID NO: 58852

SEQ ID NO: 485451 - RNA, 65 nt, hsa; identical to SEQ ID NO: 58853

SEQ ID NO: 485452 - RNA, 65 nt, hsa; identical to SEQ ID NO: 58854

SEQ ID NO: 485453 - RNA, 65 nt, hsa; identical to SEQ ID NO: 58855

SEQ ID NO: 485454 - RNA, 65 nt, hsa; identical to SEQ ID NO: 58856

SEQ ID NO: 485455 - RNA, 65 nt, hsa; identical to SEQ ID NO: 58857

SEQ ID NO: 485456 - RNA, 65 nt, hsa; identical to SEQ ID NO: 58858

SEQ ID NO: 485457 - RNA, 65 nt, hsa; identical to SEQ ID NO: 58859

SEQ ID NO: 485458 - RNA, 65 nt, hsa; identical to SEQ ID NO: 58860

SEQ ID NO: 485459 - RNA, 65 nt, hsa; identical to SEQ ID NO: 58861

SEQ ID NO: 485460 - RNA, 65 nt, hsa; identical to SEQ ID NO: 58862

SEQ ID NO: 485461 - RNA, 65 nt, hsa; identical to SEQ ID NO: 58863

SEQ ID NO: 485462 - RNA, 65 nt, hsa; identical to SEQ ID NO: 58864

SEQ ID NO: 485463 - RNA, 65 nt, hsa; identical to SEQ ID NO: 58865

SEQ ID NO: 485464 - RNA, 65 nt, hsa; identical to SEQ ID NO: 58866

SEQ ID NO: 485465 - RNA, 65 nt, hsa; identical to SEQ ID NO: 58867

SEQ ID NO: 485466 - RNA, 65 nt, hsa; identical to SEQ ID NO: 58868

SEQ ID NO: 485467 - RNA, 65 nt, hsa; identical to SEQ ID NO: 58869

SEQ ID NO: 485468 - RNA, 65 nt, hsa; identical to SEQ ID NO: 58870

SEQ ID NO: 485469 - RNA, 65 nt, hsa; identical to SEQ ID NO: 58871

SEQ ID NO: 485470 - RNA, 65 nt, hsa; identical to SEQ ID NO: 58872

SEQ ID NO: 485471 - RNA, 65 nt, hsa; identical to SEQ ID NO: 58873

SEQ ID NO: 485472 - RNA, 65 nt, hsa; identical to SEQ ID NO: 58874

SEQ ID NO: 485473 - RNA, 65 nt, hsa; identical to SEQ ID NO: 58875

SEQ ID NO: 485474 - RNA, 65 nt, hsa; identical to SEQ ID NO: 58876

SEQ ID NO: 485475 - RNA, 65 nt, hsa; identical to SEQ ID NO: 58877

SEQ ID NO: 485476 - RNA, 65 nt, hsa; identical to SEQ ID NO: 58878

SEQ ID NO: 485477 - RNA, 65 nt, hsa; identical to SEQ ID NO: 58879

SEQ ID NO: 485478 - RNA, 65 nt, hsa; identical to SEQ ID NO: 58880

SEQ ID NO: 485479 - RNA, 65 nt, hsa; identical to SEQ ID NO: 58881

SEQ ID NO: 485480 - RNA, 65 nt, hsa; identical to SEQ ID NO: 58882

SEQ ID NO: 485481 - RNA, 65 nt, hsa; identical to SEQ ID NO: 58883

SEQ ID NO: 485482 - RNA, 65 nt, hsa; identical to SEQ ID NO: 58884

SEQ ID NO: 485483 - RNA, 65 nt, hsa; identical to SEQ ID NO: 58885

SEQ ID NO: 485484 - RNA, 65 nt, hsa; identical to SEQ ID NO: 58886

SEQ ID NO: 485485 - RNA, 65 nt, hsa; identical to SEQ ID NO: 58887

SEQ ID NO: 485486 - RNA, 65 nt, hsa; identical to SEQ ID NO: 58888

SEQ ID NO: 485487 - RNA, 59 nt, hsa; identical to SEQ ID NO: 58889

SEQ ID NO: 485488 - RNA, 65 nt, hsa; identical to SEQ ID NO: 58890

SEQ ID NO: 485489 - RNA, 65 nt, hsa; identical to SEQ ID NO: 58891

SEQ ID NO: 485490 - RNA, 65 nt, hsa; identical to SEQ ID NO: 58892

SEQ ID NO: 485491 - RNA, 65 nt, hsa; identical to SEQ ID NO: 58893

SEQ ID NO: 485492 - RNA, 65 nt, hsa; identical to SEQ ID NO: 58894

SEQ ID NO: 485493 - RNA, 65 nt, hsa; identical to SEQ ID NO: 58895

SEQ ID NO: 485494 - RNA, 65 nt, hsa; identical to SEQ ID NO: 58896

SEQ ID NO: 485495 - RNA, 65 nt, hsa; identical to SEQ ID NO: 58897

SEQ ID NO: 485496 - RNA, 65 nt, hsa; identical to SEQ ID NO: 58898

SEQ ID NO: 485497 - RNA, 65 nt, hsa; identical to SEQ ID NO: 58899

SEQ ID NO: 485498 - RNA, 65 nt, hsa; identical to SEQ ID NO: 58900

SEQ ID NO: 485499 - RNA, 65 nt, hsa; identical to SEQ ID NO: 58901

SEQ ID NO: 485500 - RNA, 65 nt, hsa; identical to SEQ ID NO: 58902

SEQ ID NO: 485501 - RNA, 65 nt, hsa; identical to SEQ ID NO: 58903

SEQ ID NO: 485502 - RNA, 65 nt, hsa; identical to SEQ ID NO: 58904

SEQ ID NO: 485503 - RNA, 65 nt, hsa; identical to SEQ ID NO: 58905

SEQ ID NO: 485504 - RNA, 65 nt, hsa; identical to SEQ ID NO: 58906

SEQ ID NO: 485505 - RNA, 65 nt, hsa; identical to SEQ ID NO: 58907

SEQ ID NO: 485506 - RNA, 65 nt, hsa; identical to SEQ ID NO: 58908

SEQ ID NO: 485507 - RNA, 65 nt, hsa; identical to SEQ ID NO: 58909

SEQ ID NO: 485508 - RNA, 65 nt, hsa; identical to SEQ ID NO: 58910

SEQ ID NO: 485509 - RNA, 65 nt, hsa; identical to SEQ ID NO: 58911

SEQ ID NO: 485510 - RNA, 65 nt, hsa; identical to SEQ ID NO: 58912

SEQ ID NO: 485511 - RNA, 65 nt, hsa; identical to SEQ ID NO: 58913

SEQ ID NO: 485512 - RNA, 65 nt, hsa; identical to SEQ ID NO: 58914

SEQ ID NO: 485513 - RNA, 65 nt, hsa; identical to SEQ ID NO: 58915

SEQ ID NO: 485514 - RNA, 65 nt, hsa; identical to SEQ ID NO: 58916

SEQ ID NO: 485515 - RNA, 65 nt, hsa; identical to SEQ ID NO: 58917

SEQ ID NO: 485516 - RNA, 65 nt, hsa; identical to SEQ ID NO: 58918

SEQ ID NO: 485517 - RNA, 65 nt, hsa; identical to SEQ ID NO: 58919

SEQ ID NO: 485518 - RNA, 65 nt, hsa; identical to SEQ ID NO: 58920

SEQ ID NO: 485519 - RNA, 65 nt, hsa; identical to SEQ ID NO: 58921

SEQ ID NO: 485520 - RNA, 65 nt, hsa; identical to SEQ ID NO: 58922

SEQ ID NO: 485521 - RNA, 65 nt, hsa; identical to SEQ ID NO: 58923

SEQ ID NO: 485522 - RNA, 65 nt, hsa; identical to SEQ ID NO: 58924

SEQ ID NO: 485523 - RNA, 65 nt, hsa; identical to SEQ ID NO: 58925

SEQ ID NO: 485524 - RNA, 64 nt, hsa; identical to SEQ ID NO: 325832

SEQ ID NO: 485525 - RNA, 64 nt, hsa; identical to SEQ ID NO: 325833

SEQ ID NO: 485526 - RNA, 64 nt, hsa; identical to SEQ ID NO: 325834

SEQ ID NO: 485527 - RNA, 64 nt, hsa; identical to SEQ ID NO: 325835

SEQ ID NO: 485528 - RNA, 64 nt, hsa; identical to SEQ ID NO: 325836

SEQ ID NO: 485529 - RNA, 64 nt, hsa; identical to SEQ ID NO: 325837

SEQ ID NO: 485530 - RNA, 64 nt, hsa; identical to SEQ ID NO: 325838

SEQ ID NO: 485531 - RNA, 64 nt, hsa; identical to SEQ ID NO: 325839

SEQ ID NO: 485532 - RNA, 64 nt, hsa; identical to SEQ ID NO: 325840

SEQ ID NO: 485533 - RNA, 64 nt, hsa; identical to SEQ ID NO: 325841

SEQ ID NO: 485534 - RNA, 64 nt, hsa; identical to SEQ ID NO: 325842

SEQ ID NO: 485535 - RNA, 64 nt, hsa; identical to SEQ ID NO: 325843

SEQ ID NO: 485536 - RNA, 64 nt, hsa; identical to SEQ ID NO: 325844

SEQ ID NO: 485537 - RNA, 64 nt, hsa; identical to SEQ ID NO: 325845

SEQ ID NO: 485538 - RNA, 64 nt, hsa; identical to SEQ ID NO: 325846

SEQ ID NO: 485539 - RNA, 64 nt, hsa; identical to SEQ ID NO: 325847

SEQ ID NO: 485540 - RNA, 64 nt, hsa; identical to SEQ ID NO: 325848

SEQ ID NO: 485541 - RNA, 64 nt, hsa; identical to SEQ ID NO: 325849

SEQ ID NO: 485542 - RNA, 64 nt, hsa; identical to SEQ ID NO: 325850

SEQ ID NO: 485543 - RNA, 64 nt, hsa; identical to SEQ ID NO: 325851

SEQ ID NO: 485544 - RNA, 64 nt, hsa; identical to SEQ ID NO: 325852

SEQ ID NO: 485545 - RNA, 64 nt, hsa; identical to SEQ ID NO: 325853

SEQ ID NO: 485546 - RNA, 64 nt, hsa; identical to SEQ ID NO: 325854

SEQ ID NO: 485547 - RNA, 64 nt, hsa; identical to SEQ ID NO: 325855

SEQ ID NO: 485548 - RNA, 64 nt, hsa; identical to SEQ ID NO: 325856

SEQ ID NO: 485549 - RNA, 64 nt, hsa; identical to SEQ ID NO: 325857

SEQ ID NO: 485550 - RNA, 64 nt, hsa; identical to SEQ ID NO: 325858

SEQ ID NO: 485551 - RNA, 64 nt, hsa; identical to SEQ ID NO: 325859

SEQ ID NO: 485552 - RNA, 64 nt, hsa; identical to SEQ ID NO: 325860

SEQ ID NO: 485553 - RNA, 64 nt, hsa; identical to SEQ ID NO: 325861

SEQ ID NO: 485554 - RNA, 64 nt, hsa; identical to SEQ ID NO: 325862

SEQ ID NO: 485555 - RNA, 64 nt, hsa; identical to SEQ ID NO: 325863

SEQ ID NO: 485556 - RNA, 64 nt, hsa; identical to SEQ ID NO: 325864

SEQ ID NO: 485557 - RNA, 64 nt, hsa; identical to SEQ ID NO: 325865

SEQ ID NO: 485558 - RNA, 64 nt, hsa; identical to SEQ ID NO: 325866

SEQ ID NO: 485559 - RNA, 64 nt, hsa; identical to SEQ ID NO: 325867

SEQ ID NO: 485560 - RNA, 64 nt, hsa; identical to SEQ ID NO: 325868

SEQ ID NO: 485561 - RNA, 64 nt, hsa; identical to SEQ ID NO: 325869

SEQ ID NO: 485562 - RNA, 64 nt, hsa; identical to SEQ ID NO: 325870

SEQ ID NO: 485563 - RNA, 64 nt, hsa; identical to SEQ ID NO: 325871

SEQ ID NO: 485564 - RNA, 64 nt, hsa; identical to SEQ ID NO: 325872

SEQ ID NO: 485565 - RNA, 64 nt, hsa; identical to SEQ ID NO: 325873

SEQ ID NO: 485566 - RNA, 64 nt, hsa; identical to SEQ ID NO: 325874

SEQ ID NO: 485567 - RNA, 64 nt, hsa; identical to SEQ ID NO: 325875

SEQ ID NO: 485568 - RNA, 64 nt, hsa
auaguauuucuagaaaaagagauauuuuuagauuguaugccacuuuuguuuaagaacugugcug

SEQ ID NO: 485569 - RNA, 64 nt, hsa
aggaagggagucccaucucaaaaaaaaaaugaauguaugccacugcaauuagaguauccaauaa

SEQ ID NO: 485570 - RNA, 64 nt, hsa; identical to SEQ ID NO: 217362

SEQ ID NO: 485571 - RNA, 64 nt, hsa; identical to SEQ ID NO: 217363

SEQ ID NO: 485572 - RNA, 64 nt, hsa; identical to SEQ ID NO: 217364

SEQ ID NO: 485573 - RNA, 64 nt, hsa; identical to SEQ ID NO: 217365

SEQ ID NO: 485574 - RNA, 64 nt, hsa; identical to SEQ ID NO: 217366

SEQ ID NO: 485575 - RNA, 64 nt, hsa; identical to SEQ ID NO: 217367

SEQ ID NO: 485576 - RNA, 64 nt, hsa; identical to SEQ ID NO: 217368

SEQ ID NO: 485577 - RNA, 64 nt, hsa; identical to SEQ ID NO: 217369

SEQ ID NO: 485578 - RNA, 64 nt, hsa; identical to SEQ ID NO: 217370

SEQ ID NO: 485579 - RNA, 64 nt, hsa; identical to SEQ ID NO: 217371

SEQ ID NO: 485580 - RNA, 64 nt, hsa; identical to SEQ ID NO: 217372

SEQ ID NO: 485581 - RNA, 64 nt, hsa; identical to SEQ ID NO: 217373

SEQ ID NO: 485582 - RNA, 64 nt, hsa; identical to SEQ ID NO: 217374

SEQ ID NO: 485583 - RNA, 64 nt, hsa; identical to SEQ ID NO: 217375

SEQ ID NO: 485584 - RNA, 64 nt, hsa; identical to SEQ ID NO: 217376

SEQ ID NO: 485585 - RNA, 64 nt, hsa; identical to SEQ ID NO: 217377

SEQ ID NO: 485586 - RNA, 64 nt, hsa; identical to SEQ ID NO: 217378

SEQ ID NO: 485587 - RNA, 64 nt, hsa; identical to SEQ ID NO: 217379

SEQ ID NO: 485588 - RNA, 64 nt, hsa; identical to SEQ ID NO: 217380

SEQ ID NO: 485589 - RNA, 64 nt, hsa; identical to SEQ ID NO: 217381

SEQ ID NO: 485590 - RNA, 64 nt, hsa; identical to SEQ ID NO: 217382

SEQ ID NO: 485591 - RNA, 64 nt, hsa; identical to SEQ ID NO: 217383

SEQ ID NO: 485592 - RNA, 64 nt, hsa; identical to SEQ ID NO: 217384

SEQ ID NO: 485593 - RNA, 64 nt, hsa; identical to SEQ ID NO: 217385

SEQ ID NO: 485594 - RNA, 55 nt, hsa; identical to SEQ ID NO: 217386

SEQ ID NO: 485595 - RNA, 64 nt, hsa; identical to SEQ ID NO: 217387

SEQ ID NO: 485596 - RNA, 64 nt, hsa; identical to SEQ ID NO: 217388

SEQ ID NO: 485597 - RNA, 64 nt, hsa; identical to SEQ ID NO: 217389

SEQ ID NO: 485598 - RNA, 64 nt, hsa; identical to SEQ ID NO: 217390

SEQ ID NO: 485599 - RNA, 64 nt, hsa; identical to SEQ ID NO: 217391

SEQ ID NO: 485600 - RNA, 64 nt, hsa; identical to SEQ ID NO: 217392

SEQ ID NO: 485601 - RNA, 64 nt, hsa; identical to SEQ ID NO: 217393

SEQ ID NO: 485602 - RNA, 64 nt, hsa; identical to SEQ ID NO: 217394

SEQ ID NO: 485603 - RNA, 64 nt, hsa; identical to SEQ ID NO: 138909

SEQ ID NO: 485604 - RNA, 64 nt, hsa; identical to SEQ ID NO: 138910

SEQ ID NO: 485605 - RNA, 64 nt, hsa; identical to SEQ ID NO: 138911

SEQ ID NO: 485606 - RNA, 64 nt, hsa; identical to SEQ ID NO: 138912

SEQ ID NO: 485607 - RNA, 64 nt, hsa; identical to SEQ ID NO: 138913

SEQ ID NO: 485608 - RNA, 64 nt, hsa; identical to SEQ ID NO: 138914

SEQ ID NO: 485609 - RNA, 64 nt, hsa; identical to SEQ ID NO: 138915

SEQ ID NO: 485610 - RNA, 64 nt, hsa; identical to SEQ ID NO: 138916

SEQ ID NO: 485611 - RNA, 64 nt, hsa; identical to SEQ ID NO: 138917

SEQ ID NO: 485612 - RNA, 64 nt, hsa; identical to SEQ ID NO: 138918

SEQ ID NO: 485613 - RNA, 64 nt, hsa; identical to SEQ ID NO: 138919

SEQ ID NO: 485614 - RNA, 64 nt, hsa; identical to SEQ ID NO: 138920

SEQ ID NO: 485615 - RNA, 64 nt, hsa; identical to SEQ ID NO: 138921

SEQ ID NO: 485616 - RNA, 64 nt, hsa; identical to SEQ ID NO: 138922

SEQ ID NO: 485617 - RNA, 64 nt, hsa; identical to SEQ ID NO: 138923

SEQ ID NO: 485618 - RNA, 64 nt, hsa; identical to SEQ ID NO: 138924

SEQ ID NO: 485619 - RNA, 64 nt, hsa; identical to SEQ ID NO: 138925

SEQ ID NO: 485620 - RNA, 64 nt, hsa; identical to SEQ ID NO: 138926

SEQ ID NO: 485621 - RNA, 64 nt, hsa; identical to SEQ ID NO: 138927

SEQ ID NO: 485622 - RNA, 64 nt, hsa; identical to SEQ ID NO: 138928

SEQ ID NO: 485623 - RNA, 64 nt, hsa; identical to SEQ ID NO: 138929

SEQ ID NO: 485624 - RNA, 64 nt, hsa; identical to SEQ ID NO: 138930

SEQ ID NO: 485625 - RNA, 64 nt, hsa; identical to SEQ ID NO: 138931

SEQ ID NO: 485626 - RNA, 64 nt, hsa; identical to SEQ ID NO: 138932

SEQ ID NO: 485627 - RNA, 64 nt, hsa; identical to SEQ ID NO: 138933

SEQ ID NO: 485628 - RNA, 64 nt, hsa; identical to SEQ ID NO: 138934

SEQ ID NO: 485629 - RNA, 64 nt, hsa; identical to SEQ ID NO: 138935

SEQ ID NO: 485630 - RNA, 64 nt, hsa; identical to SEQ ID NO: 138936

SEQ ID NO: 485631 - RNA, 64 nt, hsa; identical to SEQ ID NO: 138937

SEQ ID NO: 485632 - RNA, 64 nt, hsa; identical to SEQ ID NO: 138938

SEQ ID NO: 485633 - RNA, 64 nt, hsa; identical to SEQ ID NO: 138939

SEQ ID NO: 485634 - RNA, 64 nt, hsa; identical to SEQ ID NO: 138940

SEQ ID NO: 485635 - RNA, 64 nt, hsa
gccauggaggugccccacccccacaccugacaaucacccacacuccuggggcucuuccuggguc

SEQ ID NO: 485636 - RNA, 64 nt, hsa
gaccucugcuuccacccacauauguccacuuagucacccacacuugacacaguuccuggaguac

SEQ ID NO: 485637 - RNA, 64 nt, hsa
ugccaaggucucucccuccagggaccucugcuuccacccacauauguccacuuagucacccaca

SEQ ID NO: 485638 - RNA, 64 nt, hsa
gugcaauaacgguaacuugacucuuccaucuuuucacccacagcaggcaccuaagucugccuuu

SEQ ID NO: 485639 - RNA, 64 nt, hsa
uacgcaacucuuuggcugcucugauuggauaucccacccacaagaucguauacccauaauauaa

SEQ ID NO: 485640 - RNA, 64 nt, hsa
aggccuagggagguuuuagggcccuccccacccacacccacaggucgauuuggucucuuuuuag

SEQ ID NO: 485641 - RNA, 64 nt, hsa
guccagaggccuagggagguuuuagggcccuccccacccacacccacaggucgauuuggucucu

SEQ ID NO: 485642 - RNA, 64 nt, hsa
agggggcuuccccuuucagcugcccggccccccacacccacagcuugcucuucuaucuccacaa

SEQ ID NO: 485643 - RNA, 64 nt, hsa
cagagucugcguaacagucucccacuggcuggcucacccacaggugccaugugcacacuccugg

SEQ ID NO: 485644 - RNA, 64 nt, hsa
agccgcccccaugggaagaggccugguaccgccucacccacagaggucugugccaggugcgcuu

SEQ ID NO: 485645 - RNA, 64 nt, hsa
gcccaggggaaggccaggcuggaccccggcuccacacccacauccagccugcaggccucucugc

SEQ ID NO: 485646 - RNA, 64 nt, hsa
caagggagggggaugugggcacuugaagcagggacacccacagaauggucccucuucuccccaa

SEQ ID NO: 485647 - RNA, 64 nt, hsa
acaaccuggggaugccuguccccuaccugcuccucacccacagcuaccugaggcugcucugaga

SEQ ID NO: 485648 - RNA, 64 nt, hsa
acaacgugaccacaccacacaugccuccaacacacacccacagucuaaacaucucuccuucuca

SEQ ID NO: 485649 - RNA, 64 nt, hsa
cagugagcccuucucccauuccagaucaucagcacacccacacccaccauaggucucucuccuc

SEQ ID NO: 485650 - RNA, 64 nt, hsa
gagaccccaucgcagacgucaguggucucuggggcacccacacgcgccuccgugauacccucgg

SEQ ID NO: 485651 - RNA, 64 nt, hsa
gcagcagcggaguucgcuccaggagaaggcugcgcacccacacccgccagagcccuacacggug

SEQ ID NO: 485652 - RNA, 64 nt, hsa
gcccuccccagacuccaccgucagcuguaacccucacccacagccccugcugggcccaccaccu

SEQ ID NO: 485653 - RNA, 64 nt, hsa
cuugccaauggcggacucaaacgccgcugacugccacccacacgcccuccccagacuccaccgu

SEQ ID NO: 485654 - RNA, 64 nt, hsa
ccaugggcagccccagcccccguccguccaggcucacccacaguagugaugcagacgugacgug

SEQ ID NO: 485655 - RNA, 64 nt, hsa
gcauguguguucagggacugagccuggggacgcccacccacacccacugcuuccucucggcgca

SEQ ID NO: 485656 - RNA, 64 nt, hsa
ccuccaggcuugggcagggagacucgcagaugcacacccacaaguauucaguucucaaacucua

SEQ ID NO: 485657 - RNA, 64 nt, hsa
ccagccuggggccugggggcugccccucuugaaccacccacaugcuuagccccagcuuuuugga

SEQ ID NO: 485658 - RNA, 64 nt, hsa
ccgccugcuccccacacggacuccaggcgguccccacccacagaagcagaccuucagcucaggu

SEQ ID NO: 485659 - RNA, 64 nt, hsa
cccgggguggcccuggaggccccugaccccaccccacccacagagcacgagggccccgucagcu

SEQ ID NO: 485660 - RNA, 64 nt, hsa
gugucccucccaguggcuguggcagugacagugacacccacacccacaguaaagaggagacuga

SEQ ID NO: 485661 - RNA, 64 nt, hsa
cucccaguggcuguggcagugacagugacacccacacccacaguaaagaggagacugaaugaga

SEQ ID NO: 485662 - RNA, 64 nt, hsa
ucagggaacagccugcuucccaccagcagcuugacacccacagugugcucuggcugcugggagc

SEQ ID NO: 485663 - RNA, 64 nt, hsa
ccugucugugucacacacuccugucgcccaccugcacccacacaaguggagcucacaggguagc

SEQ ID NO: 485664 - RNA, 64 nt, hsa
cuacaccguggcuuggucauagggugaguguaaacacccacaggacacugggggcugucacccu

SEQ ID NO: 485665 - RNA, 64 nt, hsa
cuccccuggggacagccccaccuccgggucccuccacccacaucccccugguccuaccccuggc

SEQ ID NO: 485666 - RNA, 64 nt, hsa
accuacaacugaagacaaugcacuuuacagauaucacccacacacaccucgcuggggcaggggc

SEQ ID NO: 485667 - RNA, 64 nt, hsa
caaacagggcccuaagcacuucaucuucagccaccacccacagaugaugccagcagcaggcgcg

SEQ ID NO: 485668 - RNA, 64 nt, hsa; identical to SEQ ID NO: 137985

SEQ ID NO: 485669 - RNA, 64 nt, hsa; identical to SEQ ID NO: 137986

SEQ ID NO: 485670 - RNA, 64 nt, hsa; identical to SEQ ID NO: 137987

SEQ ID NO: 485671 - RNA, 64 nt, hsa; identical to SEQ ID NO: 137988

SEQ ID NO: 485672 - RNA, 64 nt, hsa; identical to SEQ ID NO: 137989

SEQ ID NO: 485673 - RNA, 64 nt, hsa; identical to SEQ ID NO: 137990

SEQ ID NO: 485674 - RNA, 64 nt, hsa; identical to SEQ ID NO: 137991

SEQ ID NO: 485675 - RNA, 64 nt, hsa; identical to SEQ ID NO: 137992

SEQ ID NO: 485676 - RNA, 64 nt, hsa; identical to SEQ ID NO: 137993

SEQ ID NO: 485677 - RNA, 64 nt, hsa; identical to SEQ ID NO: 137994

SEQ ID NO: 485678 - RNA, 64 nt, hsa; identical to SEQ ID NO: 137995

SEQ ID NO: 485679 - RNA, 64 nt, hsa; identical to SEQ ID NO: 137996

SEQ ID NO: 485680 - RNA, 64 nt, hsa; identical to SEQ ID NO: 137997

SEQ ID NO: 485681 - RNA, 64 nt, hsa; identical to SEQ ID NO: 137998

SEQ ID NO: 485682 - RNA, 64 nt, hsa; identical to SEQ ID NO: 137999

SEQ ID NO: 485683 - RNA, 64 nt, hsa; identical to SEQ ID NO: 138000

SEQ ID NO: 485684 - RNA, 64 nt, hsa; identical to SEQ ID NO: 138001

SEQ ID NO: 485685 - RNA, 64 nt, hsa; identical to SEQ ID NO: 138002

SEQ ID NO: 485686 - RNA, 64 nt, hsa; identical to SEQ ID NO: 138003

SEQ ID NO: 485687 - RNA, 64 nt, hsa; identical to SEQ ID NO: 138004

SEQ ID NO: 485688 - RNA, 64 nt, hsa; identical to SEQ ID NO: 138005

SEQ ID NO: 485689 - RNA, 64 nt, hsa; identical to SEQ ID NO: 138006

SEQ ID NO: 485690 - RNA, 64 nt, hsa; identical to SEQ ID NO: 138007

SEQ ID NO: 485691 - RNA, 64 nt, hsa; identical to SEQ ID NO: 138008

SEQ ID NO: 485692 - RNA, 64 nt, hsa; identical to SEQ ID NO: 138009

SEQ ID NO: 485693 - RNA, 64 nt, hsa; identical to SEQ ID NO: 138010

SEQ ID NO: 485694 - RNA, 64 nt, hsa; identical to SEQ ID NO: 86125

SEQ ID NO: 485695 - RNA, 64 nt, hsa; identical to SEQ ID NO: 86126

SEQ ID NO: 485696 - RNA, 64 nt, hsa; identical to SEQ ID NO: 86127

SEQ ID NO: 485697 - RNA, 64 nt, hsa; identical to SEQ ID NO: 86128

SEQ ID NO: 485698 - RNA, 58 nt, hsa; identical to SEQ ID NO: 86129

SEQ ID NO: 485699 - RNA, 64 nt, hsa; identical to SEQ ID NO: 86130

SEQ ID NO: 485700 - RNA, 64 nt, hsa; identical to SEQ ID NO: 86131

SEQ ID NO: 485701 - RNA, 64 nt, hsa; identical to SEQ ID NO: 86132

SEQ ID NO: 485702 - RNA, 64 nt, hsa; identical to SEQ ID NO: 86133

SEQ ID NO: 485703 - RNA, 64 nt, hsa; identical to SEQ ID NO: 86134

SEQ ID NO: 485704 - RNA, 64 nt, hsa; identical to SEQ ID NO: 86135

SEQ ID NO: 485705 - RNA, 64 nt, hsa; identical to SEQ ID NO: 86136

SEQ ID NO: 485706 - RNA, 64 nt, hsa; identical to SEQ ID NO: 86137

SEQ ID NO: 485707 - RNA, 64 nt, hsa; identical to SEQ ID NO: 86138

SEQ ID NO: 485708 - RNA, 64 nt, hsa; identical to SEQ ID NO: 86139

SEQ ID NO: 485709 - RNA, 64 nt, hsa; identical to SEQ ID NO: 86140

SEQ ID NO: 485710 - RNA, 64 nt, hsa; identical to SEQ ID NO: 86141

SEQ ID NO: 485711 - RNA, 64 nt, hsa; identical to SEQ ID NO: 86142

SEQ ID NO: 485712 - RNA, 64 nt, hsa; identical to SEQ ID NO: 86143

SEQ ID NO: 485713 - RNA, 64 nt, hsa; identical to SEQ ID NO: 86144

SEQ ID NO: 485714 - RNA, 64 nt, hsa; identical to SEQ ID NO: 86145

SEQ ID NO: 485715 - RNA, 64 nt, hsa; identical to SEQ ID NO: 86146

SEQ ID NO: 485716 - RNA, 64 nt, hsa; identical to SEQ ID NO: 86147

SEQ ID NO: 485717 - RNA, 64 nt, hsa; identical to SEQ ID NO: 86148

SEQ ID NO: 485718 - RNA, 64 nt, hsa; identical to SEQ ID NO: 86149

SEQ ID NO: 485719 - RNA, 64 nt, hsa; identical to SEQ ID NO: 86150

SEQ ID NO: 485720 - RNA, 64 nt, hsa; identical to SEQ ID NO: 86151

SEQ ID NO: 485721 - RNA, 64 nt, hsa; identical to SEQ ID NO: 86152

SEQ ID NO: 485722 - RNA, 64 nt, hsa; identical to SEQ ID NO: 86153

SEQ ID NO: 485723 - RNA, 64 nt, hsa; identical to SEQ ID NO: 86154

SEQ ID NO: 485724 - RNA, 64 nt, hsa; identical to SEQ ID NO: 86155

SEQ ID NO: 485725 - RNA, 64 nt, hsa; identical to SEQ ID NO: 86156

SEQ ID NO: 485726 - RNA, 64 nt, hsa; identical to SEQ ID NO: 86157

SEQ ID NO: 485727 - RNA, 64 nt, hsa; identical to SEQ ID NO: 86158

SEQ ID NO: 485728 - RNA, 64 nt, hsa; identical to SEQ ID NO: 86159

SEQ ID NO: 485729 - RNA, 64 nt, hsa; identical to SEQ ID NO: 86160

SEQ ID NO: 485730 - RNA, 64 nt, hsa; identical to SEQ ID NO: 86161

SEQ ID NO: 485731 - RNA, 64 nt, hsa; identical to SEQ ID NO: 86162

SEQ ID NO: 485732 - RNA, 64 nt, hsa; identical to SEQ ID NO: 86163

SEQ ID NO: 485733 - RNA, 60 nt, hsa; identical to SEQ ID NO: 86164

SEQ ID NO: 485734 - RNA, 64 nt, hsa; identical to SEQ ID NO: 86165

SEQ ID NO: 485735 - RNA, 64 nt, hsa; identical to SEQ ID NO: 86166

SEQ ID NO: 485736 - RNA, 64 nt, hsa; identical to SEQ ID NO: 86167

SEQ ID NO: 485737 - RNA, 64 nt, hsa; identical to SEQ ID NO: 86168

SEQ ID NO: 485738 - RNA, 64 nt, hsa; identical to SEQ ID NO: 86169

SEQ ID NO: 485739 - RNA, 64 nt, hsa; identical to SEQ ID NO: 86170

SEQ ID NO: 485740 - RNA, 64 nt, hsa; identical to SEQ ID NO: 86171

SEQ ID NO: 485741 - RNA, 64 nt, hsa; identical to SEQ ID NO: 86172

SEQ ID NO: 485742 - RNA, 64 nt, hsa; identical to SEQ ID NO: 86173

SEQ ID NO: 485743 - RNA, 64 nt, hsa; identical to SEQ ID NO: 86174

SEQ ID NO: 485744 - RNA, 64 nt, hsa; identical to SEQ ID NO: 86175

SEQ ID NO: 485745 - RNA, 64 nt, hsa; identical to SEQ ID NO: 86176

SEQ ID NO: 485746 - RNA, 64 nt, hsa; identical to SEQ ID NO: 86177

SEQ ID NO: 485747 - RNA, 64 nt, hsa; identical to SEQ ID NO: 86178

SEQ ID NO: 485748 - RNA, 64 nt, hsa; identical to SEQ ID NO: 86179

SEQ ID NO: 485749 - RNA, 64 nt, hsa; identical to SEQ ID NO: 86180

SEQ ID NO: 485750 - RNA, 64 nt, hsa; identical to SEQ ID NO: 86181

SEQ ID NO: 485751 - RNA, 64 nt, hsa; identical to SEQ ID NO: 86182

SEQ ID NO: 485752 - RNA, 64 nt, hsa; identical to SEQ ID NO: 86183

SEQ ID NO: 485753 - RNA, 64 nt, hsa; identical to SEQ ID NO: 86184

SEQ ID NO: 485754 - RNA, 64 nt, hsa; identical to SEQ ID NO: 86185

SEQ ID NO: 485755 - RNA, 64 nt, hsa; identical to SEQ ID NO: 86186

SEQ ID NO: 485756 - RNA, 64 nt, hsa; identical to SEQ ID NO: 72110

SEQ ID NO: 485757 - RNA, 64 nt, hsa; identical to SEQ ID NO: 72111

SEQ ID NO: 485758 - RNA, 64 nt, hsa; identical to SEQ ID NO: 72112

SEQ ID NO: 485759 - RNA, 64 nt, hsa; identical to SEQ ID NO: 72113

SEQ ID NO: 485760 - RNA, 64 nt, hsa; identical to SEQ ID NO: 72114

SEQ ID NO: 485761 - RNA, 64 nt, hsa; identical to SEQ ID NO: 72115

SEQ ID NO: 485762 - RNA, 64 nt, hsa; identical to SEQ ID NO: 72116

SEQ ID NO: 485763 - RNA, 64 nt, hsa; identical to SEQ ID NO: 72117

SEQ ID NO: 485764 - RNA, 64 nt, hsa; identical to SEQ ID NO: 72118

SEQ ID NO: 485765 - RNA, 64 nt, hsa; identical to SEQ ID NO: 72119

SEQ ID NO: 485766 - RNA, 64 nt, hsa; identical to SEQ ID NO: 72120

SEQ ID NO: 485767 - RNA, 64 nt, hsa; identical to SEQ ID NO: 72121

SEQ ID NO: 485768 - RNA, 64 nt, hsa; identical to SEQ ID NO: 72122

SEQ ID NO: 485769 - RNA, 64 nt, hsa; identical to SEQ ID NO: 72123

SEQ ID NO: 485770 - RNA, 64 nt, hsa; identical to SEQ ID NO: 72124

SEQ ID NO: 485771 - RNA, 64 nt, hsa; identical to SEQ ID NO: 72125

SEQ ID NO: 485772 - RNA, 64 nt, hsa; identical to SEQ ID NO: 72126

SEQ ID NO: 485773 - RNA, 64 nt, hsa; identical to SEQ ID NO: 72127

SEQ ID NO: 485774 - RNA, 64 nt, hsa; identical to SEQ ID NO: 72128

SEQ ID NO: 485775 - RNA, 64 nt, hsa; identical to SEQ ID NO: 72129

SEQ ID NO: 485776 - RNA, 64 nt, hsa; identical to SEQ ID NO: 72130

SEQ ID NO: 485777 - RNA, 64 nt, hsa; identical to SEQ ID NO: 72131

SEQ ID NO: 485778 - RNA, 64 nt, hsa; identical to SEQ ID NO: 72132

SEQ ID NO: 485779 - RNA, 64 nt, hsa; identical to SEQ ID NO: 72133

SEQ ID NO: 485780 - RNA, 64 nt, hsa; identical to SEQ ID NO: 72134

SEQ ID NO: 485781 - RNA, 64 nt, hsa; identical to SEQ ID NO: 72135

SEQ ID NO: 485782 - RNA, 64 nt, hsa; identical to SEQ ID NO: 72136

SEQ ID NO: 485783 - RNA, 64 nt, hsa; identical to SEQ ID NO: 72137

SEQ ID NO: 485784 - RNA, 64 nt, hsa; identical to SEQ ID NO: 72138

SEQ ID NO: 485785 - RNA, 64 nt, hsa; identical to SEQ ID NO: 72139

SEQ ID NO: 485786 - RNA, 64 nt, hsa; identical to SEQ ID NO: 72140

SEQ ID NO: 485787 - RNA, 64 nt, hsa; identical to SEQ ID NO: 72141

SEQ ID NO: 485788 - RNA, 64 nt, hsa; identical to SEQ ID NO: 72142

SEQ ID NO: 485789 - RNA, 64 nt, hsa; identical to SEQ ID NO: 72143

SEQ ID NO: 485790 - RNA, 64 nt, hsa; identical to SEQ ID NO: 72144

SEQ ID NO: 485791 - RNA, 64 nt, hsa; identical to SEQ ID NO: 72145

SEQ ID NO: 485792 - RNA, 64 nt, hsa; identical to SEQ ID NO: 72146

SEQ ID NO: 485793 - RNA, 64 nt, hsa; identical to SEQ ID NO: 72147

SEQ ID NO: 485794 - RNA, 64 nt, hsa; identical to SEQ ID NO: 72148

SEQ ID NO: 485795 - RNA, 64 nt, hsa; identical to SEQ ID NO: 72149

SEQ ID NO: 485796 - RNA, 64 nt, hsa; identical to SEQ ID NO: 72150

SEQ ID NO: 485797 - RNA, 64 nt, hsa; identical to SEQ ID NO: 72151

SEQ ID NO: 485798 - RNA, 64 nt, hsa; identical to SEQ ID NO: 72152

SEQ ID NO: 485799 - RNA, 50 nt, hsa; identical to SEQ ID NO: 72153

SEQ ID NO: 485800 - RNA, 64 nt, hsa; identical to SEQ ID NO: 72154

SEQ ID NO: 485801 - RNA, 64 nt, hsa; identical to SEQ ID NO: 72155

SEQ ID NO: 485802 - RNA, 64 nt, hsa; identical to SEQ ID NO: 72156

SEQ ID NO: 485803 - RNA, 64 nt, hsa; identical to SEQ ID NO: 72157

SEQ ID NO: 485804 - RNA, 64 nt, hsa; identical to SEQ ID NO: 72158

SEQ ID NO: 485805 - RNA, 64 nt, hsa; identical to SEQ ID NO: 72159

SEQ ID NO: 485806 - RNA, 64 nt, hsa; identical to SEQ ID NO: 72160

SEQ ID NO: 485807 - RNA, 64 nt, hsa; identical to SEQ ID NO: 72161

SEQ ID NO: 485808 - RNA, 64 nt, hsa; identical to SEQ ID NO: 72162

SEQ ID NO: 485809 - RNA, 64 nt, hsa; identical to SEQ ID NO: 72163

SEQ ID NO: 485810 - RNA, 64 nt, hsa; identical to SEQ ID NO: 72164

SEQ ID NO: 485811 - RNA, 64 nt, hsa; identical to SEQ ID NO: 72165

SEQ ID NO: 485812 - RNA, 64 nt, hsa; identical to SEQ ID NO: 72166

SEQ ID NO: 485813 - RNA, 64 nt, hsa; identical to SEQ ID NO: 72167

SEQ ID NO: 485814 - RNA, 64 nt, hsa; identical to SEQ ID NO: 72168

SEQ ID NO: 485815 - RNA, 64 nt, hsa; identical to SEQ ID NO: 72169

SEQ ID NO: 485816 - RNA, 64 nt, hsa; identical to SEQ ID NO: 72170

SEQ ID NO: 485817 - RNA, 64 nt, hsa; identical to SEQ ID NO: 72171

SEQ ID NO: 485818 - RNA, 64 nt, hsa; identical to SEQ ID NO: 72172

SEQ ID NO: 485819 - RNA, 64 nt, hsa; identical to SEQ ID NO: 72173

SEQ ID NO: 485820 - RNA, 64 nt, hsa; identical to SEQ ID NO: 72174

SEQ ID NO: 485821 - RNA, 64 nt, hsa; identical to SEQ ID NO: 72175

SEQ ID NO: 485822 - RNA, 64 nt, hsa; identical to SEQ ID NO: 72176

SEQ ID NO: 485823 - RNA, 64 nt, hsa; identical to SEQ ID NO: 72177

SEQ ID NO: 485824 - RNA, 64 nt, hsa; identical to SEQ ID NO: 72178

SEQ ID NO: 485825 - RNA, 64 nt, hsa; identical to SEQ ID NO: 72179

SEQ ID NO: 485826 - RNA, 64 nt, hsa; identical to SEQ ID NO: 72180

SEQ ID NO: 485827 - RNA, 64 nt, hsa; identical to SEQ ID NO: 72181

SEQ ID NO: 485828 - RNA, 64 nt, hsa; identical to SEQ ID NO: 72182

SEQ ID NO: 485829 - RNA, 64 nt, hsa
gggacagggccugcaugcagucaggcuggcaguggcgcgguacagggagggaacuggugcauau

SEQ ID NO: 485830 - RNA, 64 nt, hsa
gggccccggaggcccacuccgcggagggcacgcggcgcgguaggcgagcgccgaggcccagcgg

SEQ ID NO: 485831 - RNA, 64 nt, hsa
ccaguucgccuaauaaauccccucuccuggccgggcgcgguagcucuccccuguaaucucagca

SEQ ID NO: 485832 - RNA, 64 nt, hsa
ccaguagguucuucuccccugcacucugcucccugcgcgguaaccccaccacuccugaagccug

SEQ ID NO: 485833 - RNA, 64 nt, hsa
agucacagagagcaccuaagcagagguggagacggcgcgguaagaggagggggagccaggcuca

SEQ ID NO: 485834 - RNA, 64 nt, hsa
ccucagugguaccugaagccuuugcuuccggaaagcgcgguaggguucguagguagggcuagua

SEQ ID NO: 485835 - RNA, 64 nt, hsa
uguacuuguuuuuuaauuacuuccuuucacugccaaccucgaauuacuguacaguauaugucuu

SEQ ID NO: 485836 - RNA, 64 nt, hsa
gguuccagaggcccuaggcgggaugggcucgcugaaccucgaggaacuccaggacgaggaggac

SEQ ID NO: 485837 - RNA, 64 nt, hsa
gcugggcgucuggaucaaaacugcuuugggauggaaccucgagcccuagcagugaagaagauuc

SEQ ID NO: 485838 - RNA, 64 nt, hsa
augccucccccaggagggcagugagggaugccgcaaccucgacuucucagccuccugggguucc

SEQ ID NO: 485839 - RNA, 61 nt, hsa
ugcaucccuaccagcggugaguguggcuggcaaccucgacucccuggugcucuuugcagag

SEQ ID NO: 485840 - RNA, 64 nt, hsa
auagcucaugaaacuuuugcuuaagcaaaaagaaaaccucgaauugaaaugugugaggcaaacu

SEQ ID NO: 485841 - RNA, 64 nt, hsa
cucuccuaugggcaaagccauuagaaaugcauaaaaccucgagacaugguuuuuggcaaaaacu

SEQ ID NO: 485842 - RNA, 64 nt, hsa
gagccacuuggaucccgaagugggcuucccgggaaaccucgagcagagcaggcuacacaauccc

SEQ ID NO: 485843 - RNA, 64 nt, hsa
gggucuccacagacuaacauugaagucuuccagaaaccucgaggagcugggcuagauacuucga

SEQ ID NO: 485844 - RNA, 64 nt, hsa
cuguuggugcggugccaugaucauaguucacuauaaccucgaacuccuggcucaagugaucucc

SEQ ID NO: 485845 - RNA, 64 nt, hsa
aaacuugaauauaacacauuuuggaaggcugacuaaccucgauucuguguugugaugugcaaua

SEQ ID NO: 485846 - RNA, 64 nt, hsa
aaguuugugcaagugaaaauguugaaaagugaguaaccucgauauuaaaaucauccuugacaug

SEQ ID NO: 485847 - RNA, 64 nt, hsa
gaggucccccucugccacuugacagggaccuucaaaccucgacagugaugcaaggacacagaga

SEQ ID NO: 485848 - RNA, 64 nt, hsa
gggcagccccagagcaccccgcccgacucccauuaaccucgagaaccuuuuuuuuuuuaaccaa

SEQ ID NO: 485849 - RNA, 64 nt, hsa
ggacugcgggaaugagggagucagauaaagaacaaaccucgaaacgaacaguuaaauugaaaug

SEQ ID NO: 485850 - RNA, 64 nt, hsa
gccagaguguaguggcacaaucauugcucacuguaaccucgaauuccugggcucaagcaacccu

SEQ ID NO: 485851 - RNA, 64 nt, hsa
aauagucagguugauuggacuuacgacccaaaugaaccucgauacugcauuuguaaucagguaa

SEQ ID NO: 485852 - RNA, 64 nt, hsa
cugagagugguuggugacagcagccggggcuagaaaccucgaggcgacugugcuugaguccucu

SEQ ID NO: 485853 - RNA, 64 nt, hsa
gugugaacucgcuuaaaagcaauggugaaaggauaaccucgaugauguaaauccacccaaagau

SEQ ID NO: 485854 - RNA, 64 nt, hsa
cccccuccucugaaacagcugccuuagcuucaggaaccucgaguacugugggcaauuuagaaaa

SEQ ID NO: 485855 - RNA, 64 nt, hsa
aucauucuuuauuaacccuccuuggaauuuugaaaaccucgauuaaaguugccaaauugauuac

SEQ ID NO: 485856 - RNA, 64 nt, hsa
ccggggaaggaggccguccaucccgucgacguagaaccucgagguuucucaaagaaauuuccac

SEQ ID NO: 485857 - RNA, 64 nt, hsa
ugauuaaggagaauagccuccuuucuagcauaccaaccucgauacucuuauuuuauuccacaac

SEQ ID NO: 485858 - RNA, 64 nt, hsa
cuugaacuagucgauuuuuugaaggcuauaaccuaaccucgacuauuuguuguuaugugcaaua

SEQ ID NO: 485859 - RNA, 64 nt, hsa
guauucuggaaucuuuuuacuuagauauaaaauaaaccucgaauauuaaaaaguuguagccauc

SEQ ID NO: 485860 - RNA, 64 nt, hsa
agaggcccuaugaagguggcgggaacucagcuucaaccucgaugucuucagggucuuguccaga

SEQ ID NO: 485861 - RNA, 64 nt, hsa
cuaaaaagagaaaguccaaaagacucuaaacaaaaaccucgacgccguugaggauguguuucau

SEQ ID NO: 485862 - RNA, 64 nt, hsa
gaaaagacccaauaggauaacucaaguuacuggaaaccucgaccugucucccaguugguugcac

SEQ ID NO: 485863 - RNA, 64 nt, hsa
gaggagcuacugggcugagcgucccaggcauagaaaccucgaagcgcccgaggaaacgagggcc

SEQ ID NO: 485864 - RNA, 64 nt, hsa
gcuggagugcaguggugugaucacagcucacugcaaccucgaccucccgaagcucagauggucc

SEQ ID NO: 485865 - RNA, 64 nt, hsa
ccacagauaccugcuguucucagcuccagcuucaaaccucgagucucgagagggccacggggug

SEQ ID NO: 485866 - RNA, 64 nt, hsa
ccugggcccuuuccucccucaagcccaucuccacaaccucgagccugggcucugguccacuacu

SEQ ID NO: 485867 - RNA, 64 nt, hsa
caggaguuugagaccagccugaccaacaugaugaaaccucgauucuacuaaaaauacaaaaauu

SEQ ID NO: 485868 - RNA, 64 nt, hsa
caggaggaggacacggccgccgagagcaaggcacaaccucgaguucuuggggcgcagagaacuu

SEQ ID NO: 485869 - RNA, 64 nt, hsa
gcuggagugcaguggcgugaucucggcucacuacaaccucgaccuccuggguucaagcgauucu

SEQ ID NO: 485870 - RNA, 64 nt, hsa
gauggccacuugagaaguuuugccaacuccugggaaccucgauauucugacauuuggaaaaaca

SEQ ID NO: 485871 - RNA, 64 nt, hsa
gccaaggacucuaggucaaaugucaauaaauaugaaccucgagaaaguucugaaggccaugaca

SEQ ID NO: 485872 - RNA, 64 nt, hsa
gaugaccgcacugggggaggggccucaguccagaaaccucgaccgcuagcuccaccugccuugg

SEQ ID NO: 485873 - RNA, 64 nt, hsa
uccugcauugguuuuugguuuuuuguuuuuuuuuaaccucgacacugggucucagauccuucug

SEQ ID NO: 485874 - RNA, 64 nt, hsa
gcccucagagaccugagcucuucuggccacguggaaccucgaacccgagcuccugcagaagugg

SEQ ID NO: 485875 - RNA, 64 nt, hsa
gcuuuccuugaacagaaauucuacaugaccauaaaaccucgaagauggguauggcacaguucau

SEQ ID NO: 485876 - RNA, 64 nt, hsa
uccacgcagccaaucgcuuuccuggaggagcgccaaccucgaagacaacucagcacugggcggg

SEQ ID NO: 485877 - RNA, 64 nt, hsa
gcuucauucagcccuagcucuguagagaaaugcaaaccucgacucucaaggaugugaggaacac

SEQ ID NO: 485878 - RNA, 64 nt, hsa
cucucugcccccaaaagugucaaggggcccuaggaaccucgaagcuguucucugcuuuuccauu

SEQ ID NO: 485879 - RNA, 64 nt, hsa
cccauacuacuaccucauugacaccauaccugcuaaccucgaggcuuuagucauacaaagaaaa

SEQ ID NO: 485880 - RNA, 64 nt, hsa
aaauaaagaauggaauugcugaauguaaucauugaaccucgagucacuguaaaaguucaguaau

SEQ ID NO: 485881 - RNA, 64 nt, hsa
guguauguguacacacauguauaauauauacagaaaccucgauauauaauuguauagauuuuaa

SEQ ID NO: 485882 - RNA, 64 nt, hsa
gggauugaucauucucaugaaggaaucacaguuauauggcaacugcagaaggcugagccuccuc

SEQ ID NO: 485883 - RNA, 64 nt, hsa
aaaaccugagcuccccacucacugcccuagaauuuauggcaaggagcaaaucuacagcauucuc

SEQ ID NO: 485884 - RNA, 64 nt, hsa
cucacuaaacuuuacccaaaaacuaaaucucuaauauggcaaaaauggcuagacacccauuuuc

SEQ ID NO: 485885 - RNA, 64 nt, hsa
gucuguaccuaacgcccuauuuuugcaauggcuauauggcaagaaagcugguaaacuauuuguc

SEQ ID NO: 485886 - RNA, 64 nt, hsa
uauguuucccucagucauuugguuuauguuugguuauggcaagauguuacagcauuuauaguua

SEQ ID NO: 485887 - RNA, 64 nt, hsa
cacuuuauuauauaauuuacaauucuaugccagauauggcaaauuucuucaauuucaguauuuu

SEQ ID NO: 485888 - RNA, 64 nt, hsa
cuguaauaccuccuccuaaccaagccggauaugguauggcaaguuaccaaacacagugagccgg

SEQ ID NO: 485889 - RNA, 64 nt, hsa
aaguguauggaaacccacaacaguauggacaguauauggcaaauggguggcaaguaccgccuua

SEQ ID NO: 485890 - RNA, 64 nt, hsa
acuauaaauuuggggauccuagagugaucuuaaauauggcaagauacagcucauuuagaauaaa

SEQ ID NO: 485891 - RNA, 64 nt, hsa
aguuuuagcaaauuggaaauaauauauucauuuguauggcaagauaaaugcagucaucuuaaua

SEQ ID NO: 485892 - RNA, 54 nt, hsa
gagaaaaauuacaaauaugaaaauuauggcaaagcuuuaaucaauuuacaaguc

SEQ ID NO: 485893 - RNA, 64 nt, hsa
ucauacuggugagaaauucuaaaaaugugaagacuauggcaaagucuuuaaaugguugucacac

SEQ ID NO: 485894 - RNA, 64 nt, hsa
acaaacagaaacccguguaucugggauauuuccauauggcaauaggugugaacagggaacucag

SEQ ID NO: 485895 - RNA, 64 nt, hsa
gaaagauucucgcuuaaaaaaaauguauuuauuuuauggcaaguuggaaaauauguaacuggaa

SEQ ID NO: 485896 - RNA, 64 nt, hsa
ggggguccagaagaucauucccuugcauagauuucucuuuuaccaauuugagugccuccuacau

SEQ ID NO: 485897 - RNA, 64 nt, hsa
aguauauaaucuuuucugaacagaugcuauagaacucuuuuaauauguuuaauucaccuaucac

SEQ ID NO: 485898 - RNA, 64 nt, hsa
guuauuuuuaaaaacaacuuaauaaaaacuuacacucuuuuauacaagaguguauuuccccuua

SEQ ID NO: 485899 - RNA, 64 nt, hsa
uagacagauacuauccagcucuaagucucaacugcucuuuuauacuguacuuuuuuuuuugaga

SEQ ID NO: 485900 - RNA, 64 nt, hsa
ugguauaugaauuuuugcauucauuauugaauaacucuuuuaauauuuuugagcaaugauuaua

SEQ ID NO: 485901 - RNA, 64 nt, hsa
ucugccuggaaaccagcuuccuccucagcuccagcucuuuuaaugggcauaucaaaacugauga

SEQ ID NO: 485902 - RNA, 64 nt, hsa
guuguauauucugguauuugaggugagauggcugcucuuuuauuaaugagacaugaauuguguc

SEQ ID NO: 485903 - RNA, 64 nt, hsa
guuucacauuuguauuaauaauuguuuaaaaugccucuuuuaaaagcuuauauaaauuuuuuuc

SEQ ID NO: 485904 - RNA, 64 nt, hsa
gauucuaauuggaauguucauuugccucuuuuuacucuuuuaaaugcuuguagguggcuugggg

SEQ ID NO: 485905 - RNA, 64 nt, hsa
aauugauguuaaguguuugauucagagaugucugcucuuuuaaauuauauauaaggaaaaaaaa

SEQ ID NO: 485906 - RNA, 64 nt, hsa
uagaauugugcaggcuggaugagauaaugacauacucuuuuacacuguaacagcagcauuauug

SEQ ID NO: 485907 - RNA, 64 nt, hsa
cucacucacagauuugcuaaugccacagaaagggcucuuuuaacuuaagauaagugaaaaguac

SEQ ID NO: 485908 - RNA, 64 nt, hsa
aauauccacaaagcuucgccuuugcuuuugcacucucuuuuacauuuuuuuacuucuuuccuuu

SEQ ID NO: 485909 - RNA, 64 nt, hsa
cauuuuauggaaauuagcuuagcaauuuuuuuuucucuuuuaagaaucaaaauauggauuugau

SEQ ID NO: 485910 - RNA, 64 nt, hsa
cccagugggucuuggcauaaguagauuaauccugcucuuuuaagaaaaggcaacuuauucaggc

SEQ ID NO: 485911 - RNA, 64 nt, hsa
augccauuuucaugaauuccuggaauuucugugccucuuuuaugugggaaagggcaggcucugg

SEQ ID NO: 485912 - RNA, 64 nt, hsa
ccuuuuaagggggcuccaagaaccaacaucacugcucuuuuagauaaaccucugcccuccacuc

SEQ ID NO: 485913 - RNA, 64 nt, hsa
ucugguaaccaugggccuccacugacccaucccucucuuuuaaacugucaggucauuaucaggc

SEQ ID NO: 485914 - RNA, 64 nt, hsa
aaauagccuuucuuaucugcuccuugugacuucucucuuuuaaaucagauaccuuugaaacaua

SEQ ID NO: 485915 - RNA, 64 nt, hsa
ccucacacauggaagacacuuguguuggcugugccucuuuuaaugucaucucuugaugaaacaa

SEQ ID NO: 485916 - RNA, 64 nt, hsa
uggaccaagugaggguguacucugauccacaaagcucuuuuauaaaccagguuugagguugugu

SEQ ID NO: 485917 - RNA, 64 nt, hsa
caggaauggggaauauauaacaccugugccaccgcucuuuuaaggaggcauuaugaaugagugc

SEQ ID NO: 485918 - RNA, 64 nt, hsa
aaauggcaccacauauucaccugaaaacuccaaacucuuuuagaaaaauaaauaaauauuuaua

SEQ ID NO: 485919 - RNA, 64 nt, hsa
acucuuuuagaaaaauaaauaaauauuuauagaccucuuuuagauauuuuaauaaaggauccuu

SEQ ID NO: 485920 - RNA, 64 nt, hsa
aaaaugcuuauucuuccucccuuuuauuuuuugucucuuuuaagaugguaaaaugguucucagg

SEQ ID NO: 485921 - RNA, 64 nt, hsa
aaauugcauguucuaauuccacguaucuuccagucucuuuuauaaagucucagacuauaauaaa

SEQ ID NO: 485922 - RNA, 64 nt, hsa
uauuuaacacuccccuuaacugucuuugaacuuucucuuuuaacaaaaaugucaagucuuuaua

SEQ ID NO: 485923 - RNA, 64 nt, hsa
aaauauuuuuuaaaacaaaaacauuauuugugcccucuuuuauauaugucaaagggacacuguc

SEQ ID NO: 485924 - RNA, 64 nt, hsa
uguuuuauauguuuuccgaaaauacaauaagccucucuuuuauucaguguucuuccucuuuucu

SEQ ID NO: 485925 - RNA, 64 nt, hsa
cauuauugcagccuuuuuguucacuuauaaauuucucuuuuaaauagauggagacaaaggacaa

SEQ ID NO: 485926 - RNA, 64 nt, hsa
agugcaaucuucaguuuugugauuaaguucauuucucuuuuacacuuuuguacuccucagagca

SEQ ID NO: 485927 - RNA, 64 nt, hsa
uguucucuagaaaucaagguuuuguuuguuaauucucuuuuauaugcauguauauauugcccuu

SEQ ID NO: 485928 - RNA, 64 nt, hsa
augggguccuucaggaaguuggaauuuuugccuucucuuuuaauugcagugaaguucucuuuau

SEQ ID NO: 485929 - RNA, 64 nt, hsa
gaauuacuagugauuguuuuauuuuauccauguacucuuuuaguauuuaauaauuaaauaccua

SEQ ID NO: 485930 - RNA, 64 nt, hsa
cgugccuggccucauuugaguauuuuuauaaugucucuuuuaaagucuuugucagauaauuuca

SEQ ID NO: 485931 - RNA, 64 nt, hsa
uuuuuaugguguauuuugaacccauucugauagucucuuuuaacuggaagauuucaauuacuua

SEQ ID NO: 485932 - RNA, 64 nt, hsa
cagauaucaggcccccaguucagccccagucacccucuuuuacacaugugggucaaccacugug

SEQ ID NO: 485933 - RNA, 64 nt, hsa
ccuuggaccuucucccuugcuuagaagugccagccucuuuuaggcugugguuaguggccauugu

SEQ ID NO: 485934 - RNA, 64 nt, hsa
cugaccaaacaaauucccacuaauguaacugguaguaucuuagaggugaacucuccugugggca

SEQ ID NO: 485935 - RNA, 64 nt, hsa
cuuagaggugaacucuccugugggcauuuuauuuguaucuuagaagaauuuuuguuuuaaaucu

SEQ ID NO: 485936 - RNA, 64 nt, hsa; identical to SEQ ID NO: 323034

SEQ ID NO: 485937 - RNA, 64 nt, hsa; identical to SEQ ID NO: 323035

SEQ ID NO: 485938 - RNA, 64 nt, hsa; identical to SEQ ID NO: 323036

SEQ ID NO: 485939 - RNA, 64 nt, hsa; identical to SEQ ID NO: 323037

SEQ ID NO: 485940 - RNA, 64 nt, hsa; identical to SEQ ID NO: 323038

SEQ ID NO: 485941 - RNA, 64 nt, hsa; identical to SEQ ID NO: 323039

SEQ ID NO: 485942 - RNA, 64 nt, hsa; identical to SEQ ID NO: 323040

SEQ ID NO: 485943 - RNA, 64 nt, hsa; identical to SEQ ID NO: 323041

SEQ ID NO: 485944 - RNA, 64 nt, hsa; identical to SEQ ID NO: 323042

SEQ ID NO: 485945 - RNA, 64 nt, hsa; identical to SEQ ID NO: 323043

SEQ ID NO: 485946 - RNA, 64 nt, hsa; identical to SEQ ID NO: 323044

SEQ ID NO: 485947 - RNA, 64 nt, hsa; identical to SEQ ID NO: 323045

SEQ ID NO: 485948 - RNA, 64 nt, hsa; identical to SEQ ID NO: 323046

SEQ ID NO: 485949 - RNA, 64 nt, hsa; identical to SEQ ID NO: 323047

SEQ ID NO: 485950 - RNA, 64 nt, hsa; identical to SEQ ID NO: 323048

SEQ ID NO: 485951 - RNA, 64 nt, hsa; identical to SEQ ID NO: 323049

SEQ ID NO: 485952 - RNA, 64 nt, hsa; identical to SEQ ID NO: 323050

SEQ ID NO: 485953 - RNA, 64 nt, hsa; identical to SEQ ID NO: 323051

SEQ ID NO: 485954 - RNA, 64 nt, hsa; identical to SEQ ID NO: 323052

SEQ ID NO: 485955 - RNA, 64 nt, hsa; identical to SEQ ID NO: 323053

SEQ ID NO: 485956 - RNA, 64 nt, hsa; identical to SEQ ID NO: 323054

SEQ ID NO: 485957 - RNA, 64 nt, hsa; identical to SEQ ID NO: 323055

SEQ ID NO: 485958 - RNA, 64 nt, hsa; identical to SEQ ID NO: 323056

SEQ ID NO: 485959 - RNA, 64 nt, hsa; identical to SEQ ID NO: 323057

SEQ ID NO: 485960 - RNA, 64 nt, hsa; identical to SEQ ID NO: 323058

SEQ ID NO: 485961 - RNA, 64 nt, hsa; identical to SEQ ID NO: 323059

SEQ ID NO: 485962 - RNA, 64 nt, hsa; identical to SEQ ID NO: 323060

SEQ ID NO: 485963 - RNA, 64 nt, hsa
aggggaagggugggucucaguuagcagggguccccagggcaagucagccuccucccuccaugcc

SEQ ID NO: 485964 - RNA, 64 nt, hsa
agacagacaaacccucugaucuaugaagucucugcagggcaaggggaccagggaccuggaaccc

SEQ ID NO: 485965 - RNA, 64 nt, hsa
uguguagggagggauguauguggaagguaagauucagggcaagcuaaaaauccgauacugcaac

SEQ ID NO: 485966 - RNA, 64 nt, hsa
uugugagaaauguuuugaaugugugacaauuucgcagggcaauuuccuccugugacgguugcug

SEQ ID NO: 485967 - RNA, 64 nt, hsa
cugggcuggauucauguucaaaccacuggacuggcagggcaacgacuucuucccaccucaagau

SEQ ID NO: 485968 - RNA, 64 nt, hsa
uuguggccuucuucauccucuccuacuucuuguccagggcaaggacgugagccagugggagcug

SEQ ID NO: 485969 - RNA, 64 nt, hsa
gauuccuuucuccugcuucauauaggccaaaccucagggcaagggaacauggggguagaguggu

SEQ ID NO: 485970 - RNA, 64 nt, hsa
uugacaugccuuuuccacaaaucucuugccuuuucagggcaaaguguauuugaucagaaguggc

SEQ ID NO: 485971 - RNA, 64 nt, hsa; identical to SEQ ID NO: 289049

SEQ ID NO: 485972 - RNA, 64 nt, hsa; identical to SEQ ID NO: 289050

SEQ ID NO: 485973 - RNA, 64 nt, hsa; identical to SEQ ID NO: 289051

SEQ ID NO: 485974 - RNA, 64 nt, hsa; identical to SEQ ID NO: 289052

SEQ ID NO: 485975 - RNA, 50 nt, hsa; identical to SEQ ID NO: 289053

SEQ ID NO: 485976 - RNA, 64 nt, hsa; identical to SEQ ID NO: 289054

SEQ ID NO: 485977 - RNA, 64 nt, hsa; identical to SEQ ID NO: 289055

SEQ ID NO: 485978 - RNA, 64 nt, hsa; identical to SEQ ID NO: 289056

SEQ ID NO: 485979 - RNA, 64 nt, hsa; identical to SEQ ID NO: 289057

SEQ ID NO: 485980 - RNA, 64 nt, hsa; identical to SEQ ID NO: 289058

SEQ ID NO: 485981 - RNA, 64 nt, hsa; identical to SEQ ID NO: 289059

SEQ ID NO: 485982 - RNA, 64 nt, hsa; identical to SEQ ID NO: 289060

SEQ ID NO: 485983 - RNA, 64 nt, hsa; identical to SEQ ID NO: 289061

SEQ ID NO: 485984 - RNA, 64 nt, hsa; identical to SEQ ID NO: 289062

SEQ ID NO: 485985 - RNA, 64 nt, hsa; identical to SEQ ID NO: 289063

SEQ ID NO: 485986 - RNA, 64 nt, hsa; identical to SEQ ID NO: 289064

SEQ ID NO: 485987 - RNA, 64 nt, hsa; identical to SEQ ID NO: 289065

SEQ ID NO: 485988 - RNA, 64 nt, hsa; identical to SEQ ID NO: 289066

SEQ ID NO: 485989 - RNA, 64 nt, hsa; identical to SEQ ID NO: 289067

SEQ ID NO: 485990 - RNA, 64 nt, hsa; identical to SEQ ID NO: 289068

SEQ ID NO: 485991 - RNA, 64 nt, hsa; identical to SEQ ID NO: 289069

SEQ ID NO: 485992 - RNA, 64 nt, hsa; identical to SEQ ID NO: 289070

SEQ ID NO: 485993 - RNA, 64 nt, hsa; identical to SEQ ID NO: 289071

SEQ ID NO: 485994 - RNA, 64 nt, hsa; identical to SEQ ID NO: 289072

SEQ ID NO: 485995 - RNA, 64 nt, hsa; identical to SEQ ID NO: 289073

SEQ ID NO: 485996 - RNA, 64 nt, hsa; identical to SEQ ID NO: 289074

SEQ ID NO: 485997 - RNA, 64 nt, hsa; identical to SEQ ID NO: 289075

SEQ ID NO: 485998 - RNA, 64 nt, hsa; identical to SEQ ID NO: 289076

SEQ ID NO: 485999 - RNA, 64 nt, hsa; identical to SEQ ID NO: 289077

SEQ ID NO: 486000 - RNA, 64 nt, hsa; identical to SEQ ID NO: 289078

SEQ ID NO: 486001 - RNA, 64 nt, hsa; identical to SEQ ID NO: 289079

SEQ ID NO: 486002 - RNA, 64 nt, hsa; identical to SEQ ID NO: 289080

SEQ ID NO: 486003 - RNA, 64 nt, hsa; identical to SEQ ID NO: 289081

SEQ ID NO: 486004 - RNA, 64 nt, hsa; identical to SEQ ID NO: 289082

SEQ ID NO: 486005 - RNA, 64 nt, hsa; identical to SEQ ID NO: 289083

SEQ ID NO: 486006 - RNA, 64 nt, hsa; identical to SEQ ID NO: 289084

SEQ ID NO: 486007 - RNA, 64 nt, hsa; identical to SEQ ID NO: 289085

SEQ ID NO: 486008 - RNA, 64 nt, hsa; identical to SEQ ID NO: 289086

SEQ ID NO: 486009 - RNA, 64 nt, hsa; identical to SEQ ID NO: 289087

SEQ ID NO: 486010 - RNA, 64 nt, hsa; identical to SEQ ID NO: 289088

SEQ ID NO: 486011 - RNA, 64 nt, hsa; identical to SEQ ID NO: 289089

SEQ ID NO: 486012 - RNA, 64 nt, hsa; identical to SEQ ID NO: 289090

SEQ ID NO: 486013 - RNA, 64 nt, hsa; identical to SEQ ID NO: 289091

SEQ ID NO: 486014 - RNA, 64 nt, hsa; identical to SEQ ID NO: 289092

SEQ ID NO: 486015 - RNA, 64 nt, hsa; identical to SEQ ID NO: 289093

SEQ ID NO: 486016 - RNA, 64 nt, hsa; identical to SEQ ID NO: 289094

SEQ ID NO: 486017 - RNA, 64 nt, hsa; identical to SEQ ID NO: 289095

SEQ ID NO: 486018 - RNA, 64 nt, hsa; identical to SEQ ID NO: 289096

SEQ ID NO: 486019 - RNA, 64 nt, hsa; identical to SEQ ID NO: 289097

SEQ ID NO: 486020 - RNA, 64 nt, hsa; identical to SEQ ID NO: 289098

SEQ ID NO: 486021 - RNA, 64 nt, hsa; identical to SEQ ID NO: 289099

SEQ ID NO: 486022 - RNA, 64 nt, hsa; identical to SEQ ID NO: 289100

SEQ ID NO: 486023 - RNA, 64 nt, hsa; identical to SEQ ID NO: 289101

SEQ ID NO: 486024 - RNA, 64 nt, hsa; identical to SEQ ID NO: 289102

SEQ ID NO: 486025 - RNA, 64 nt, hsa; identical to SEQ ID NO: 289103

SEQ ID NO: 486026 - RNA, 64 nt, hsa; identical to SEQ ID NO: 289104

SEQ ID NO: 486027 - RNA, 64 nt, hsa; identical to SEQ ID NO: 289105

SEQ ID NO: 486028 - RNA, 64 nt, hsa; identical to SEQ ID NO: 289106

SEQ ID NO: 486029 - RNA, 64 nt, hsa; identical to SEQ ID NO: 289107

SEQ ID NO: 486030 - RNA, 64 nt, hsa; identical to SEQ ID NO: 289108

SEQ ID NO: 486031 - RNA, 64 nt, hsa; identical to SEQ ID NO: 289109

SEQ ID NO: 486032 - RNA, 64 nt, hsa; identical to SEQ ID NO: 289110

SEQ ID NO: 486033 - RNA, 64 nt, hsa; identical to SEQ ID NO: 289111

SEQ ID NO: 486034 - RNA, 64 nt, hsa; identical to SEQ ID NO: 289112

SEQ ID NO: 486035 - RNA, 64 nt, hsa; identical to SEQ ID NO: 289113

SEQ ID NO: 486036 - RNA, 64 nt, hsa; identical to SEQ ID NO: 289114

SEQ ID NO: 486037 - RNA, 64 nt, hsa; identical to SEQ ID NO: 289115

SEQ ID NO: 486038 - RNA, 64 nt, hsa; identical to SEQ ID NO: 289116

SEQ ID NO: 486039 - RNA, 64 nt, hsa; identical to SEQ ID NO: 289117

SEQ ID NO: 486040 - RNA, 64 nt, hsa; identical to SEQ ID NO: 289118

SEQ ID NO: 486041 - RNA, 64 nt, hsa; identical to SEQ ID NO: 289119

SEQ ID NO: 486042 - RNA, 64 nt, hsa; identical to SEQ ID NO: 289120

SEQ ID NO: 486043 - RNA, 64 nt, hsa; identical to SEQ ID NO: 289121

SEQ ID NO: 486044 - RNA, 64 nt, hsa; identical to SEQ ID NO: 289122

SEQ ID NO: 486045 - RNA, 64 nt, hsa; identical to SEQ ID NO: 289123

SEQ ID NO: 486046 - RNA, 64 nt, hsa; identical to SEQ ID NO: 289124

SEQ ID NO: 486047 - RNA, 64 nt, hsa; identical to SEQ ID NO: 289125

SEQ ID NO: 486048 - RNA, 64 nt, hsa; identical to SEQ ID NO: 289126

SEQ ID NO: 486049 - RNA, 64 nt, hsa; identical to SEQ ID NO: 289127

SEQ ID NO: 486050 - RNA, 64 nt, hsa; identical to SEQ ID NO: 289128

SEQ ID NO: 486051 - RNA, 64 nt, hsa; identical to SEQ ID NO: 289129

SEQ ID NO: 486052 - RNA, 64 nt, hsa; identical to SEQ ID NO: 289130

SEQ ID NO: 486053 - RNA, 64 nt, hsa; identical to SEQ ID NO: 289131

SEQ ID NO: 486054 - RNA, 64 nt, hsa; identical to SEQ ID NO: 289132

SEQ ID NO: 486055 - RNA, 64 nt, hsa; identical to SEQ ID NO: 289133

SEQ ID NO: 486056 - RNA, 64 nt, hsa; identical to SEQ ID NO: 289134

SEQ ID NO: 486057 - RNA, 64 nt, hsa; identical to SEQ ID NO: 289135

SEQ ID NO: 486058 - RNA, 64 nt, hsa; identical to SEQ ID NO: 289136

SEQ ID NO: 486059 - RNA, 64 nt, hsa; identical to SEQ ID NO: 289137

SEQ ID NO: 486060 - RNA, 64 nt, hsa; identical to SEQ ID NO: 289138

SEQ ID NO: 486061 - RNA, 64 nt, hsa; identical to SEQ ID NO: 289139

SEQ ID NO: 486062 - RNA, 64 nt, hsa; identical to SEQ ID NO: 289140

SEQ ID NO: 486063 - RNA, 64 nt, hsa; identical to SEQ ID NO: 289141

SEQ ID NO: 486064 - RNA, 64 nt, hsa; identical to SEQ ID NO: 289142

SEQ ID NO: 486065 - RNA, 64 nt, hsa; identical to SEQ ID NO: 289143

SEQ ID NO: 486066 - RNA, 64 nt, hsa; identical to SEQ ID NO: 289144

SEQ ID NO: 486067 - RNA, 64 nt, hsa; identical to SEQ ID NO: 289145

SEQ ID NO: 486068 - RNA, 64 nt, hsa; identical to SEQ ID NO: 289146

SEQ ID NO: 486069 - RNA, 64 nt, hsa; identical to SEQ ID NO: 289147

SEQ ID NO: 486070 - RNA, 64 nt, hsa; identical to SEQ ID NO: 289148

SEQ ID NO: 486071 - RNA, 64 nt, hsa; identical to SEQ ID NO: 289149

SEQ ID NO: 486072 - RNA, 64 nt, hsa; identical to SEQ ID NO: 289150

SEQ ID NO: 486073 - RNA, 64 nt, hsa; identical to SEQ ID NO: 289151

SEQ ID NO: 486074 - RNA, 64 nt, hsa; identical to SEQ ID NO: 289152

SEQ ID NO: 486075 - RNA, 64 nt, hsa; identical to SEQ ID NO: 289153

SEQ ID NO: 486076 - RNA, 64 nt, hsa; identical to SEQ ID NO: 289154

SEQ ID NO: 486077 - RNA, 64 nt, hsa; identical to SEQ ID NO: 289155

SEQ ID NO: 486078 - RNA, 64 nt, hsa; identical to SEQ ID NO: 289156

SEQ ID NO: 486079 - RNA, 64 nt, hsa; identical to SEQ ID NO: 289157

SEQ ID NO: 486080 - RNA, 64 nt, hsa; identical to SEQ ID NO: 289158

SEQ ID NO: 486081 - RNA, 64 nt, hsa; identical to SEQ ID NO: 289159

SEQ ID NO: 486082 - RNA, 64 nt, hsa; identical to SEQ ID NO: 289160

SEQ ID NO: 486083 - RNA, 64 nt, hsa; identical to SEQ ID NO: 289161

SEQ ID NO: 486084 - RNA, 64 nt, hsa; identical to SEQ ID NO: 289162

SEQ ID NO: 486085 - RNA, 64 nt, hsa; identical to SEQ ID NO: 289163

SEQ ID NO: 486086 - RNA, 64 nt, hsa; identical to SEQ ID NO: 289164

SEQ ID NO: 486087 - RNA, 64 nt, hsa; identical to SEQ ID NO: 289165

SEQ ID NO: 486088 - RNA, 64 nt, hsa; identical to SEQ ID NO: 289166

SEQ ID NO: 486089 - RNA, 64 nt, hsa; identical to SEQ ID NO: 289167

SEQ ID NO: 486090 - RNA, 64 nt, hsa; identical to SEQ ID NO: 289168

SEQ ID NO: 486091 - RNA, 64 nt, hsa; identical to SEQ ID NO: 289169

SEQ ID NO: 486092 - RNA, 64 nt, hsa; identical to SEQ ID NO: 289170

SEQ ID NO: 486093 - RNA, 64 nt, hsa; identical to SEQ ID NO: 289171

SEQ ID NO: 486094 - RNA, 64 nt, hsa; identical to SEQ ID NO: 289172

SEQ ID NO: 486095 - RNA, 64 nt, hsa; identical to SEQ ID NO: 289173

SEQ ID NO: 486096 - RNA, 64 nt, hsa; identical to SEQ ID NO: 289174

SEQ ID NO: 486097 - RNA, 64 nt, hsa; identical to SEQ ID NO: 289175

SEQ ID NO: 486098 - RNA, 64 nt, hsa; identical to SEQ ID NO: 289176

SEQ ID NO: 486099 - RNA, 64 nt, hsa; identical to SEQ ID NO: 289177

SEQ ID NO: 486100 - RNA, 64 nt, hsa; identical to SEQ ID NO: 289178

SEQ ID NO: 486101 - RNA, 64 nt, hsa; identical to SEQ ID NO: 289179

SEQ ID NO: 486102 - RNA, 64 nt, hsa; identical to SEQ ID NO: 289180

SEQ ID NO: 486103 - RNA, 64 nt, hsa; identical to SEQ ID NO: 289181

SEQ ID NO: 486104 - RNA, 64 nt, hsa; identical to SEQ ID NO: 289182

SEQ ID NO: 486105 - RNA, 64 nt, hsa; identical to SEQ ID NO: 289183

SEQ ID NO: 486106 - RNA, 64 nt, hsa; identical to SEQ ID NO: 289184

SEQ ID NO: 486107 - RNA, 64 nt, hsa; identical to SEQ ID NO: 289185

SEQ ID NO: 486108 - RNA, 64 nt, hsa; identical to SEQ ID NO: 289186

SEQ ID NO: 486109 - RNA, 64 nt, hsa; identical to SEQ ID NO: 289187

SEQ ID NO: 486110 - RNA, 64 nt, hsa; identical to SEQ ID NO: 289188

SEQ ID NO: 486111 - RNA, 64 nt, hsa; identical to SEQ ID NO: 289189

SEQ ID NO: 486112 - RNA, 64 nt, hsa; identical to SEQ ID NO: 289190

SEQ ID NO: 486113 - RNA, 64 nt, hsa; identical to SEQ ID NO: 289191

SEQ ID NO: 486114 - RNA, 64 nt, hsa; identical to SEQ ID NO: 289192

SEQ ID NO: 486115 - RNA, 64 nt, hsa; identical to SEQ ID NO: 289193

SEQ ID NO: 486116 - RNA, 64 nt, hsa; identical to SEQ ID NO: 289194

SEQ ID NO: 486117 - RNA, 64 nt, hsa; identical to SEQ ID NO: 289195

SEQ ID NO: 486118 - RNA, 64 nt, hsa; identical to SEQ ID NO: 289196

SEQ ID NO: 486119 - RNA, 64 nt, hsa; identical to SEQ ID NO: 289197

SEQ ID NO: 486120 - RNA, 64 nt, hsa; identical to SEQ ID NO: 289198

SEQ ID NO: 486121 - RNA, 64 nt, hsa; identical to SEQ ID NO: 289199

SEQ ID NO: 486122 - RNA, 64 nt, hsa; identical to SEQ ID NO: 289200

SEQ ID NO: 486123 - RNA, 64 nt, hsa; identical to SEQ ID NO: 289201

SEQ ID NO: 486124 - RNA, 64 nt, hsa; identical to SEQ ID NO: 289202

SEQ ID NO: 486125 - RNA, 64 nt, hsa; identical to SEQ ID NO: 289203

SEQ ID NO: 486126 - RNA, 64 nt, hsa; identical to SEQ ID NO: 289204

SEQ ID NO: 486127 - RNA, 64 nt, hsa; identical to SEQ ID NO: 289205

SEQ ID NO: 486128 - RNA, 64 nt, hsa; identical to SEQ ID NO: 289206

SEQ ID NO: 486129 - RNA, 64 nt, hsa; identical to SEQ ID NO: 289207

SEQ ID NO: 486130 - RNA, 64 nt, hsa; identical to SEQ ID NO: 289208

SEQ ID NO: 486131 - RNA, 64 nt, hsa; identical to SEQ ID NO: 289209

SEQ ID NO: 486132 - RNA, 64 nt, hsa; identical to SEQ ID NO: 289210

SEQ ID NO: 486133 - RNA, 64 nt, hsa; identical to SEQ ID NO: 289211

SEQ ID NO: 486134 - RNA, 64 nt, hsa; identical to SEQ ID NO: 289212

SEQ ID NO: 486135 - RNA, 64 nt, hsa; identical to SEQ ID NO: 289213

SEQ ID NO: 486136 - RNA, 64 nt, hsa; identical to SEQ ID NO: 289214

SEQ ID NO: 486137 - RNA, 64 nt, hsa; identical to SEQ ID NO: 289215

SEQ ID NO: 486138 - RNA, 64 nt, hsa; identical to SEQ ID NO: 289216

SEQ ID NO: 486139 - RNA, 64 nt, hsa; identical to SEQ ID NO: 289217

SEQ ID NO: 486140 - RNA, 64 nt, hsa; identical to SEQ ID NO: 289218

SEQ ID NO: 486141 - RNA, 64 nt, hsa; identical to SEQ ID NO: 289219

SEQ ID NO: 486142 - RNA, 64 nt, hsa; identical to SEQ ID NO: 289220

SEQ ID NO: 486143 - RNA, 64 nt, hsa; identical to SEQ ID NO: 289221

SEQ ID NO: 486144 - RNA, 64 nt, hsa; identical to SEQ ID NO: 289222

SEQ ID NO: 486145 - RNA, 64 nt, hsa; identical to SEQ ID NO: 289223

SEQ ID NO: 486146 - RNA, 64 nt, hsa; identical to SEQ ID NO: 289224

SEQ ID NO: 486147 - RNA, 64 nt, hsa; identical to SEQ ID NO: 289225

SEQ ID NO: 486148 - RNA, 64 nt, hsa; identical to SEQ ID NO: 289226

SEQ ID NO: 486149 - RNA, 64 nt, hsa; identical to SEQ ID NO: 289227

SEQ ID NO: 486150 - RNA, 64 nt, hsa; identical to SEQ ID NO: 289228

SEQ ID NO: 486151 - RNA, 64 nt, hsa; identical to SEQ ID NO: 289229

SEQ ID NO: 486152 - RNA, 64 nt, hsa; identical to SEQ ID NO: 289230

SEQ ID NO: 486153 - RNA, 64 nt, hsa; identical to SEQ ID NO: 289231

SEQ ID NO: 486154 - RNA, 64 nt, hsa; identical to SEQ ID NO: 289232

SEQ ID NO: 486155 - RNA, 64 nt, hsa; identical to SEQ ID NO: 289233

SEQ ID NO: 486156 - RNA, 64 nt, hsa; identical to SEQ ID NO: 289234

SEQ ID NO: 486157 - RNA, 64 nt, hsa; identical to SEQ ID NO: 289235

SEQ ID NO: 486158 - RNA, 64 nt, hsa; identical to SEQ ID NO: 289236

SEQ ID NO: 486159 - RNA, 64 nt, hsa; identical to SEQ ID NO: 289237

SEQ ID NO: 486160 - RNA, 64 nt, hsa; identical to SEQ ID NO: 289238

SEQ ID NO: 486161 - RNA, 64 nt, hsa; identical to SEQ ID NO: 289239

SEQ ID NO: 486162 - RNA, 64 nt, hsa; identical to SEQ ID NO: 289240

SEQ ID NO: 486163 - RNA, 64 nt, hsa; identical to SEQ ID NO: 289241

SEQ ID NO: 486164 - RNA, 64 nt, hsa; identical to SEQ ID NO: 289242

SEQ ID NO: 486165 - RNA, 64 nt, hsa; identical to SEQ ID NO: 289243

SEQ ID NO: 486166 - RNA, 64 nt, hsa; identical to SEQ ID NO: 373477

SEQ ID NO: 486167 - RNA, 64 nt, hsa; identical to SEQ ID NO: 373478

SEQ ID NO: 486168 - RNA, 64 nt, hsa; identical to SEQ ID NO: 373479

SEQ ID NO: 486169 - RNA, 64 nt, hsa; identical to SEQ ID NO: 373480

SEQ ID NO: 486170 - RNA, 64 nt, hsa; identical to SEQ ID NO: 373481

SEQ ID NO: 486171 - RNA, 64 nt, hsa; identical to SEQ ID NO: 373482

SEQ ID NO: 486172 - RNA, 64 nt, hsa; identical to SEQ ID NO: 373483

SEQ ID NO: 486173 - RNA, 64 nt, hsa; identical to SEQ ID NO: 373484

SEQ ID NO: 486174 - RNA, 64 nt, hsa; identical to SEQ ID NO: 373485

SEQ ID NO: 486175 - RNA, 64 nt, hsa; identical to SEQ ID NO: 373486

SEQ ID NO: 486176 - RNA, 64 nt, hsa; identical to SEQ ID NO: 373487

SEQ ID NO: 486177 - RNA, 64 nt, hsa; identical to SEQ ID NO: 373488

SEQ ID NO: 486178 - RNA, 64 nt, hsa; identical to SEQ ID NO: 373489

SEQ ID NO: 486179 - RNA, 64 nt, hsa; identical to SEQ ID NO: 373490

SEQ ID NO: 486180 - RNA, 64 nt, hsa; identical to SEQ ID NO: 373491

SEQ ID NO: 486181 - RNA, 64 nt, hsa; identical to SEQ ID NO: 373492

SEQ ID NO: 486182 - RNA, 64 nt, hsa; identical to SEQ ID NO: 373493

SEQ ID NO: 486183 - RNA, 64 nt, hsa; identical to SEQ ID NO: 373494

SEQ ID NO: 486184 - RNA, 64 nt, hsa; identical to SEQ ID NO: 373495

SEQ ID NO: 486185 - RNA, 64 nt, hsa; identical to SEQ ID NO: 373496

SEQ ID NO: 486186 - RNA, 64 nt, hsa; identical to SEQ ID NO: 373497

SEQ ID NO: 486187 - RNA, 64 nt, hsa; identical to SEQ ID NO: 373498

SEQ ID NO: 486188 - RNA, 64 nt, hsa; identical to SEQ ID NO: 373499

SEQ ID NO: 486189 - RNA, 64 nt, hsa; identical to SEQ ID NO: 373500

SEQ ID NO: 486190 - RNA, 64 nt, hsa; identical to SEQ ID NO: 373501

SEQ ID NO: 486191 - RNA, 64 nt, hsa; identical to SEQ ID NO: 373502

SEQ ID NO: 486192 - RNA, 64 nt, hsa; identical to SEQ ID NO: 373503

SEQ ID NO: 486193 - RNA, 64 nt, hsa; identical to SEQ ID NO: 373504

SEQ ID NO: 486194 - RNA, 64 nt, hsa; identical to SEQ ID NO: 373505

SEQ ID NO: 486195 - RNA, 64 nt, hsa; identical to SEQ ID NO: 373506

SEQ ID NO: 486196 - RNA, 64 nt, hsa; identical to SEQ ID NO: 373507

SEQ ID NO: 486197 - RNA, 64 nt, hsa; identical to SEQ ID NO: 373508

SEQ ID NO: 486198 - RNA, 64 nt, hsa; identical to SEQ ID NO: 373509

SEQ ID NO: 486199 - RNA, 64 nt, hsa; identical to SEQ ID NO: 373510

SEQ ID NO: 486200 - RNA, 64 nt, hsa; identical to SEQ ID NO: 373511

SEQ ID NO: 486201 - RNA, 64 nt, hsa; identical to SEQ ID NO: 373512

SEQ ID NO: 486202 - RNA, 64 nt, hsa; identical to SEQ ID NO: 373513

SEQ ID NO: 486203 - RNA, 64 nt, hsa; identical to SEQ ID NO: 373514

SEQ ID NO: 486204 - RNA, 64 nt, hsa; identical to SEQ ID NO: 373515

SEQ ID NO: 486205 - RNA, 64 nt, hsa; identical to SEQ ID NO: 373516

SEQ ID NO: 486206 - RNA, 64 nt, hsa; identical to SEQ ID NO: 373517

SEQ ID NO: 486207 - RNA, 64 nt, hsa; identical to SEQ ID NO: 373518

SEQ ID NO: 486208 - RNA, 64 nt, hsa; identical to SEQ ID NO: 373519

SEQ ID NO: 486209 - RNA, 64 nt, hsa; identical to SEQ ID NO: 373520

SEQ ID NO: 486210 - RNA, 64 nt, hsa; identical to SEQ ID NO: 373521

SEQ ID NO: 486211 - RNA, 64 nt, hsa; identical to SEQ ID NO: 373522

SEQ ID NO: 486212 - RNA, 64 nt, hsa; identical to SEQ ID NO: 373523

SEQ ID NO: 486213 - RNA, 64 nt, hsa; identical to SEQ ID NO: 373524

SEQ ID NO: 486214 - RNA, 64 nt, hsa; identical to SEQ ID NO: 373525

SEQ ID NO: 486215 - RNA, 64 nt, hsa; identical to SEQ ID NO: 373526

SEQ ID NO: 486216 - RNA, 64 nt, hsa; identical to SEQ ID NO: 373527

SEQ ID NO: 486217 - RNA, 64 nt, hsa; identical to SEQ ID NO: 373528

SEQ ID NO: 486218 - RNA, 64 nt, hsa; identical to SEQ ID NO: 373529

SEQ ID NO: 486219 - RNA, 64 nt, hsa; identical to SEQ ID NO: 373530

SEQ ID NO: 486220 - RNA, 64 nt, hsa; identical to SEQ ID NO: 373531

SEQ ID NO: 486221 - RNA, 64 nt, hsa; identical to SEQ ID NO: 373532

SEQ ID NO: 486222 - RNA, 64 nt, hsa; identical to SEQ ID NO: 373533

SEQ ID NO: 486223 - RNA, 64 nt, hsa; identical to SEQ ID NO: 373534

SEQ ID NO: 486224 - RNA, 64 nt, hsa; identical to SEQ ID NO: 373535

SEQ ID NO: 486225 - RNA, 64 nt, hsa; identical to SEQ ID NO: 373536

SEQ ID NO: 486226 - RNA, 64 nt, hsa; identical to SEQ ID NO: 373537

SEQ ID NO: 486227 - RNA, 64 nt, hsa; identical to SEQ ID NO: 373538

SEQ ID NO: 486228 - RNA, 64 nt, hsa; identical to SEQ ID NO: 373539

SEQ ID NO: 486229 - RNA, 64 nt, hsa; identical to SEQ ID NO: 373540

SEQ ID NO: 486230 - RNA, 64 nt, hsa; identical to SEQ ID NO: 373541

SEQ ID NO: 486231 - RNA, 64 nt, hsa; identical to SEQ ID NO: 373542

SEQ ID NO: 486232 - RNA, 64 nt, hsa; identical to SEQ ID NO: 373543

SEQ ID NO: 486233 - RNA, 64 nt, hsa; identical to SEQ ID NO: 373544

SEQ ID NO: 486234 - RNA, 64 nt, hsa; identical to SEQ ID NO: 373545

SEQ ID NO: 486235 - RNA, 64 nt, hsa; identical to SEQ ID NO: 373546

SEQ ID NO: 486236 - RNA, 64 nt, hsa; identical to SEQ ID NO: 373547

SEQ ID NO: 486237 - RNA, 64 nt, hsa; identical to SEQ ID NO: 373548

SEQ ID NO: 486238 - RNA, 64 nt, hsa; identical to SEQ ID NO: 373549

SEQ ID NO: 486239 - RNA, 64 nt, hsa; identical to SEQ ID NO: 373550

SEQ ID NO: 486240 - RNA, 64 nt, hsa; identical to SEQ ID NO: 373551

SEQ ID NO: 486241 - RNA, 64 nt, hsa; identical to SEQ ID NO: 373552

SEQ ID NO: 486242 - RNA, 64 nt, hsa; identical to SEQ ID NO: 373553

SEQ ID NO: 486243 - RNA, 64 nt, hsa; identical to SEQ ID NO: 373554

SEQ ID NO: 486244 - RNA, 64 nt, hsa; identical to SEQ ID NO: 373555

SEQ ID NO: 486245 - RNA, 64 nt, hsa; identical to SEQ ID NO: 373556

SEQ ID NO: 486246 - RNA, 64 nt, hsa; identical to SEQ ID NO: 373557

SEQ ID NO: 486247 - RNA, 64 nt, hsa; identical to SEQ ID NO: 373558

SEQ ID NO: 486248 - RNA, 64 nt, hsa; identical to SEQ ID NO: 373559

SEQ ID NO: 486249 - RNA, 64 nt, hsa; identical to SEQ ID NO: 373560

SEQ ID NO: 486250 - RNA, 64 nt, hsa; identical to SEQ ID NO: 373561

SEQ ID NO: 486251 - RNA, 64 nt, hsa; identical to SEQ ID NO: 373562

SEQ ID NO: 486252 - RNA, 64 nt, hsa; identical to SEQ ID NO: 373563

SEQ ID NO: 486253 - RNA, 64 nt, hsa; identical to SEQ ID NO: 373564

SEQ ID NO: 486254 - RNA, 64 nt, hsa; identical to SEQ ID NO: 373565

SEQ ID NO: 486255 - RNA, 64 nt, hsa; identical to SEQ ID NO: 373566

SEQ ID NO: 486256 - RNA, 64 nt, hsa; identical to SEQ ID NO: 373567

SEQ ID NO: 486257 - RNA, 64 nt, hsa; identical to SEQ ID NO: 373568

SEQ ID NO: 486258 - RNA, 64 nt, hsa; identical to SEQ ID NO: 373569

SEQ ID NO: 486259 - RNA, 64 nt, hsa; identical to SEQ ID NO: 373570

SEQ ID NO: 486260 - RNA, 64 nt, hsa; identical to SEQ ID NO: 373571

SEQ ID NO: 486261 - RNA, 64 nt, hsa; identical to SEQ ID NO: 373572

SEQ ID NO: 486262 - RNA, 64 nt, hsa; identical to SEQ ID NO: 373573

SEQ ID NO: 486263 - RNA, 64 nt, hsa; identical to SEQ ID NO: 373574

SEQ ID NO: 486264 - RNA, 64 nt, hsa; identical to SEQ ID NO: 373575

SEQ ID NO: 486265 - RNA, 64 nt, hsa; identical to SEQ ID NO: 373576

SEQ ID NO: 486266 - RNA, 64 nt, hsa; identical to SEQ ID NO: 373577

SEQ ID NO: 486267 - RNA, 64 nt, hsa; identical to SEQ ID NO: 373578

SEQ ID NO: 486268 - RNA, 64 nt, hsa; identical to SEQ ID NO: 373579

SEQ ID NO: 486269 - RNA, 64 nt, hsa; identical to SEQ ID NO: 373580

SEQ ID NO: 486270 - RNA, 64 nt, hsa; identical to SEQ ID NO: 373581

SEQ ID NO: 486271 - RNA, 64 nt, hsa; identical to SEQ ID NO: 373582

SEQ ID NO: 486272 - RNA, 64 nt, hsa; identical to SEQ ID NO: 373583

SEQ ID NO: 486273 - RNA, 64 nt, hsa; identical to SEQ ID NO: 373584

SEQ ID NO: 486274 - RNA, 64 nt, hsa; identical to SEQ ID NO: 373585

SEQ ID NO: 486275 - RNA, 64 nt, hsa; identical to SEQ ID NO: 373586

SEQ ID NO: 486276 - RNA, 64 nt, hsa; identical to SEQ ID NO: 373587

SEQ ID NO: 486277 - RNA, 64 nt, hsa; identical to SEQ ID NO: 373588

SEQ ID NO: 486278 - RNA, 64 nt, hsa; identical to SEQ ID NO: 373589

SEQ ID NO: 486279 - RNA, 64 nt, hsa; identical to SEQ ID NO: 373590

SEQ ID NO: 486280 - RNA, 64 nt, hsa; identical to SEQ ID NO: 373591

SEQ ID NO: 486281 - RNA, 64 nt, hsa; identical to SEQ ID NO: 373592

SEQ ID NO: 486282 - RNA, 64 nt, hsa; identical to SEQ ID NO: 373593

SEQ ID NO: 486283 - RNA, 64 nt, hsa; identical to SEQ ID NO: 373594

SEQ ID NO: 486284 - RNA, 64 nt, hsa; identical to SEQ ID NO: 373595

SEQ ID NO: 486285 - RNA, 64 nt, hsa; identical to SEQ ID NO: 373596

SEQ ID NO: 486286 - RNA, 64 nt, hsa; identical to SEQ ID NO: 373597

SEQ ID NO: 486287 - RNA, 64 nt, hsa; identical to SEQ ID NO: 373598

SEQ ID NO: 486288 - RNA, 64 nt, hsa; identical to SEQ ID NO: 373599

SEQ ID NO: 486289 - RNA, 64 nt, hsa; identical to SEQ ID NO: 373600

SEQ ID NO: 486290 - RNA, 64 nt, hsa; identical to SEQ ID NO: 373601

SEQ ID NO: 486291 - RNA, 64 nt, hsa; identical to SEQ ID NO: 373602

SEQ ID NO: 486292 - RNA, 64 nt, hsa; identical to SEQ ID NO: 373603

SEQ ID NO: 486293 - RNA, 64 nt, hsa; identical to SEQ ID NO: 373604

SEQ ID NO: 486294 - RNA, 64 nt, hsa; identical to SEQ ID NO: 373605

SEQ ID NO: 486295 - RNA, 64 nt, hsa; identical to SEQ ID NO: 373606

SEQ ID NO: 486296 - RNA, 64 nt, hsa; identical to SEQ ID NO: 373607

SEQ ID NO: 486297 - RNA, 64 nt, hsa; identical to SEQ ID NO: 373608

SEQ ID NO: 486298 - RNA, 64 nt, hsa; identical to SEQ ID NO: 373609

SEQ ID NO: 486299 - RNA, 64 nt, hsa; identical to SEQ ID NO: 373610

SEQ ID NO: 486300 - RNA, 64 nt, hsa; identical to SEQ ID NO: 373611

SEQ ID NO: 486301 - RNA, 64 nt, hsa; identical to SEQ ID NO: 373612

SEQ ID NO: 486302 - RNA, 64 nt, hsa; identical to SEQ ID NO: 373613

SEQ ID NO: 486303 - RNA, 64 nt, hsa; identical to SEQ ID NO: 373614

SEQ ID NO: 486304 - RNA, 64 nt, hsa; identical to SEQ ID NO: 373615

SEQ ID NO: 486305 - RNA, 64 nt, hsa; identical to SEQ ID NO: 373616

SEQ ID NO: 486306 - RNA, 64 nt, hsa; identical to SEQ ID NO: 373617

SEQ ID NO: 486307 - RNA, 64 nt, hsa; identical to SEQ ID NO: 373618

SEQ ID NO: 486308 - RNA, 64 nt, hsa; identical to SEQ ID NO: 373619

SEQ ID NO: 486309 - RNA, 64 nt, hsa; identical to SEQ ID NO: 373620

SEQ ID NO: 486310 - RNA, 64 nt, hsa; identical to SEQ ID NO: 373621

SEQ ID NO: 486311 - RNA, 64 nt, hsa; identical to SEQ ID NO: 373622

SEQ ID NO: 486312 - RNA, 64 nt, hsa; identical to SEQ ID NO: 373623

SEQ ID NO: 486313 - RNA, 64 nt, hsa; identical to SEQ ID NO: 373624

SEQ ID NO: 486314 - RNA, 64 nt, hsa; identical to SEQ ID NO: 373625

SEQ ID NO: 486315 - RNA, 64 nt, hsa; identical to SEQ ID NO: 373626

SEQ ID NO: 486316 - RNA, 64 nt, hsa; identical to SEQ ID NO: 373627

SEQ ID NO: 486317 - RNA, 64 nt, hsa; identical to SEQ ID NO: 373628

SEQ ID NO: 486318 - RNA, 64 nt, hsa; identical to SEQ ID NO: 373629

SEQ ID NO: 486319 - RNA, 64 nt, hsa; identical to SEQ ID NO: 373630

SEQ ID NO: 486320 - RNA, 64 nt, hsa; identical to SEQ ID NO: 373631

SEQ ID NO: 486321 - RNA, 64 nt, hsa; identical to SEQ ID NO: 373632

SEQ ID NO: 486322 - RNA, 64 nt, hsa; identical to SEQ ID NO: 373633

SEQ ID NO: 486323 - RNA, 64 nt, hsa; identical to SEQ ID NO: 373634

SEQ ID NO: 486324 - RNA, 64 nt, hsa; identical to SEQ ID NO: 373635

SEQ ID NO: 486325 - RNA, 64 nt, hsa; identical to SEQ ID NO: 373636

SEQ ID NO: 486326 - RNA, 64 nt, hsa; identical to SEQ ID NO: 373637

SEQ ID NO: 486327 - RNA, 64 nt, hsa; identical to SEQ ID NO: 373638

SEQ ID NO: 486328 - RNA, 64 nt, hsa; identical to SEQ ID NO: 373639

SEQ ID NO: 486329 - RNA, 64 nt, hsa; identical to SEQ ID NO: 373640

SEQ ID NO: 486330 - RNA, 64 nt, hsa; identical to SEQ ID NO: 373641

SEQ ID NO: 486331 - RNA, 64 nt, hsa; identical to SEQ ID NO: 373642

SEQ ID NO: 486332 - RNA, 64 nt, hsa; identical to SEQ ID NO: 373643

SEQ ID NO: 486333 - RNA, 64 nt, hsa; identical to SEQ ID NO: 373644

SEQ ID NO: 486334 - RNA, 64 nt, hsa; identical to SEQ ID NO: 373645

SEQ ID NO: 486335 - RNA, 64 nt, hsa; identical to SEQ ID NO: 373646

SEQ ID NO: 486336 - RNA, 64 nt, hsa; identical to SEQ ID NO: 373647

SEQ ID NO: 486337 - RNA, 64 nt, hsa; identical to SEQ ID NO: 373648

SEQ ID NO: 486338 - RNA, 64 nt, hsa; identical to SEQ ID NO: 373649

SEQ ID NO: 486339 - RNA, 64 nt, hsa; identical to SEQ ID NO: 373650

SEQ ID NO: 486340 - RNA, 64 nt, hsa; identical to SEQ ID NO: 373651

SEQ ID NO: 486341 - RNA, 64 nt, hsa; identical to SEQ ID NO: 373652

SEQ ID NO: 486342 - RNA, 64 nt, hsa; identical to SEQ ID NO: 373653

SEQ ID NO: 486343 - RNA, 64 nt, hsa; identical to SEQ ID NO: 373654

SEQ ID NO: 486344 - RNA, 64 nt, hsa; identical to SEQ ID NO: 373655

SEQ ID NO: 486345 - RNA, 64 nt, hsa; identical to SEQ ID NO: 373656

SEQ ID NO: 486346 - RNA, 64 nt, hsa; identical to SEQ ID NO: 373657

SEQ ID NO: 486347 - RNA, 64 nt, hsa; identical to SEQ ID NO: 373658

SEQ ID NO: 486348 - RNA, 64 nt, hsa; identical to SEQ ID NO: 373659

SEQ ID NO: 486349 - RNA, 64 nt, hsa; identical to SEQ ID NO: 373660

SEQ ID NO: 486350 - RNA, 64 nt, hsa; identical to SEQ ID NO: 373661

SEQ ID NO: 486351 - RNA, 64 nt, hsa; identical to SEQ ID NO: 363631

SEQ ID NO: 486352 - RNA, 64 nt, hsa; identical to SEQ ID NO: 363632

SEQ ID NO: 486353 - RNA, 64 nt, hsa; identical to SEQ ID NO: 363633

SEQ ID NO: 486354 - RNA, 64 nt, hsa; identical to SEQ ID NO: 363634

SEQ ID NO: 486355 - RNA, 64 nt, hsa; identical to SEQ ID NO: 363635

SEQ ID NO: 486356 - RNA, 64 nt, hsa; identical to SEQ ID NO: 363636

SEQ ID NO: 486357 - RNA, 64 nt, hsa; identical to SEQ ID NO: 363637

SEQ ID NO: 486358 - RNA, 64 nt, hsa; identical to SEQ ID NO: 363638

SEQ ID NO: 486359 - RNA, 64 nt, hsa; identical to SEQ ID NO: 363639

SEQ ID NO: 486360 - RNA, 64 nt, hsa; identical to SEQ ID NO: 363640

SEQ ID NO: 486361 - RNA, 64 nt, hsa; identical to SEQ ID NO: 363641

SEQ ID NO: 486362 - RNA, 64 nt, hsa; identical to SEQ ID NO: 363642

SEQ ID NO: 486363 - RNA, 63 nt, hsa; identical to SEQ ID NO: 363643

SEQ ID NO: 486364 - RNA, 64 nt, hsa; identical to SEQ ID NO: 363644

SEQ ID NO: 486365 - RNA, 64 nt, hsa; identical to SEQ ID NO: 363645

SEQ ID NO: 486366 - RNA, 64 nt, hsa; identical to SEQ ID NO: 363646

SEQ ID NO: 486367 - RNA, 64 nt, hsa; identical to SEQ ID NO: 363647

SEQ ID NO: 486368 - RNA, 64 nt, hsa; identical to SEQ ID NO: 363648

SEQ ID NO: 486369 - RNA, 64 nt, hsa; identical to SEQ ID NO: 363649

SEQ ID NO: 486370 - RNA, 64 nt, hsa; identical to SEQ ID NO: 363650

SEQ ID NO: 486371 - RNA, 64 nt, hsa; identical to SEQ ID NO: 363651

SEQ ID NO: 486372 - RNA, 64 nt, hsa; identical to SEQ ID NO: 363652

SEQ ID NO: 486373 - RNA, 64 nt, hsa; identical to SEQ ID NO: 363653

SEQ ID NO: 486374 - RNA, 64 nt, hsa; identical to SEQ ID NO: 363654

SEQ ID NO: 486375 - RNA, 64 nt, hsa; identical to SEQ ID NO: 363655

SEQ ID NO: 486376 - RNA, 64 nt, hsa; identical to SEQ ID NO: 363656

SEQ ID NO: 486377 - RNA, 64 nt, hsa; identical to SEQ ID NO: 363657

SEQ ID NO: 486378 - RNA, 64 nt, hsa; identical to SEQ ID NO: 363658

SEQ ID NO: 486379 - RNA, 64 nt, hsa; identical to SEQ ID NO: 363659

SEQ ID NO: 486380 - RNA, 64 nt, hsa; identical to SEQ ID NO: 363660

SEQ ID NO: 486381 - RNA, 64 nt, hsa; identical to SEQ ID NO: 363661

SEQ ID NO: 486382 - RNA, 64 nt, hsa; identical to SEQ ID NO: 363662

SEQ ID NO: 486383 - RNA, 64 nt, hsa; identical to SEQ ID NO: 363663

SEQ ID NO: 486384 - RNA, 64 nt, hsa; identical to SEQ ID NO: 363664

SEQ ID NO: 486385 - RNA, 64 nt, hsa; identical to SEQ ID NO: 363665

SEQ ID NO: 486386 - RNA, 57 nt, hsa; identical to SEQ ID NO: 262389

SEQ ID NO: 486387 - RNA, 64 nt, hsa; identical to SEQ ID NO: 363667

SEQ ID NO: 486388 - RNA, 64 nt, hsa; identical to SEQ ID NO: 363668

SEQ ID NO: 486389 - RNA, 64 nt, hsa; identical to SEQ ID NO: 363669

SEQ ID NO: 486390 - RNA, 64 nt, hsa; identical to SEQ ID NO: 363670

SEQ ID NO: 486391 - RNA, 64 nt, hsa; identical to SEQ ID NO: 363671

SEQ ID NO: 486392 - RNA, 64 nt, hsa; identical to SEQ ID NO: 363672

SEQ ID NO: 486393 - RNA, 64 nt, hsa; identical to SEQ ID NO: 363673

SEQ ID NO: 486394 - RNA, 64 nt, hsa; identical to SEQ ID NO: 363674

SEQ ID NO: 486395 - RNA, 64 nt, hsa; identical to SEQ ID NO: 363675

SEQ ID NO: 486396 - RNA, 64 nt, hsa; identical to SEQ ID NO: 363676

SEQ ID NO: 486397 - RNA, 64 nt, hsa; identical to SEQ ID NO: 363677

SEQ ID NO: 486398 - RNA, 64 nt, hsa; identical to SEQ ID NO: 363678

SEQ ID NO: 486399 - RNA, 64 nt, hsa; identical to SEQ ID NO: 363679

SEQ ID NO: 486400 - RNA, 64 nt, hsa; identical to SEQ ID NO: 363680

SEQ ID NO: 486401 - RNA, 64 nt, hsa; identical to SEQ ID NO: 78063

SEQ ID NO: 486402 - RNA, 64 nt, hsa; identical to SEQ ID NO: 78064

SEQ ID NO: 486403 - RNA, 64 nt, hsa; identical to SEQ ID NO: 78065

SEQ ID NO: 486404 - RNA, 64 nt, hsa; identical to SEQ ID NO: 78066

SEQ ID NO: 486405 - RNA, 64 nt, hsa; identical to SEQ ID NO: 78067

SEQ ID NO: 486406 - RNA, 64 nt, hsa; identical to SEQ ID NO: 78068

SEQ ID NO: 486407 - RNA, 64 nt, hsa; identical to SEQ ID NO: 78069

SEQ ID NO: 486408 - RNA, 64 nt, hsa; identical to SEQ ID NO: 78070

SEQ ID NO: 486409 - RNA, 64 nt, hsa; identical to SEQ ID NO: 78071

SEQ ID NO: 486410 - RNA, 64 nt, hsa; identical to SEQ ID NO: 78072

SEQ ID NO: 486411 - RNA, 64 nt, hsa
guuuugaauaagucugggugaccgcaccuaaaaugguaagcaguacccuccggcuuuuucuuag

SEQ ID NO: 486412 - RNA, 64 nt, hsa
auuuucuaauuuggcaccucuugaugccuaagcagguaagcagaugccuaagcuguauuucucc

SEQ ID NO: 486413 - RNA, 64 nt, hsa
uuuguucacucauagaaacauuauuaauugguaggguaagcagacacucugaaacaaugagaaa

SEQ ID NO: 486414 - RNA, 64 nt, hsa
cagaucaguguguuggcugguucucauuuuaagggguaagcaguuugcuauucugugacuuuag

SEQ ID NO: 486415 - RNA, 64 nt, hsa
uggccuaugccaauaaugaagagcaagccuuucagguaagcaaauuaaaguucaguuugcucau

SEQ ID NO: 486416 - RNA, 64 nt, hsa
uagacacuguugaaucaauacagugaaacagacagguaagcaggugguuuuaaugccucauucu

SEQ ID NO: 486417 - RNA, 64 nt, hsa
ucuacauguuugccaguuaauuagggaguuauuugguaagcaaaucaauauaaccagcaaagau

SEQ ID NO: 486418 - RNA, 64 nt, hsa
aguuuugcaaggcugcauaagaacuggugaaugggguaagcauuuucauucuuccugcugaagu

SEQ ID NO: 486419 - RNA, 64 nt, hsa
uuucuguuuuuagaccaauuuuuuacaguucuuugguaagcauugucguaucuggugauggauu

SEQ ID NO: 486420 - RNA, 64 nt, hsa
cuccaagcucacuccccaacccccaacuccgugugguaagcaacauggcuuugaugauaaacga

SEQ ID NO: 486421 - RNA, 64 nt, hsa
agccugugaaucaacugugucucuuuuuugacuugguaagcaaguauuaggcuuuggggugggg

SEQ ID NO: 486422 - RNA, 64 nt, hsa
acuuuucccuauuuuuguccuuuuucagucuuuugguaagcauuuauuaaguaccugcuguaug

SEQ ID NO: 486423 - RNA, 64 nt, hsa
uuugaugagguugguaaauguuuuuagaucuucugguaagcauuauguuuguuaauacauauuu

SEQ ID NO: 486424 - RNA, 64 nt, hsa
cuuguauaaaaauaagaaaagaaauuaaucuugagguaagcagaguagacaucaucucugauug

SEQ ID NO: 486425 - RNA, 64 nt, hsa
acaaaccuuaaaccaaaggaguaaaaaaaacaaugguaagcacugaaguauaauaaguaaccuu

SEQ ID NO: 486426 - RNA, 64 nt, hsa
cagagauacugaacuugcuggcacauuuacuucugguaagcauaaagcagagagaacccagguu

SEQ ID NO: 486427 - RNA, 64 nt, hsa
uaccuugugccucucagauugcugaagugcugcugguaagcaugugcaugcucugccuuucuug

SEQ ID NO: 486428 - RNA, 64 nt, hsa
cucucccgcucuggcuucuguggcggcagugguggguaagcacuccaguguucucuuaaugagg

SEQ ID NO: 486429 - RNA, 64 nt, hsa
cacucaggacagcuugguuuauuuuugagagugggguaagcaccccuaccugccuuacagagca

SEQ ID NO: 486430 - RNA, 64 nt, hsa
caaaaagucauuguaaucuuucauagccauaccugguaagcaaaaacuaguaaagacauaggaa

SEQ ID NO: 486431 - RNA, 64 nt, hsa
uauuuuauacaaaauuauaaagaaagcauagagagguaagcauuaguggcacagcugagaaaau

SEQ ID NO: 486432 - RNA, 64 nt, hsa
caguggggcaccaaggauucuguccucauugcuggguaagcagggagaagagaaguuuucccca

SEQ ID NO: 486433 - RNA, 64 nt, hsa
uuuauccucucauuaagugcuuuuucacccuauagguaagcauuuuugugccaacauguuguca

SEQ ID NO: 486434 - RNA, 64 nt, hsa
auuagaguauucaugauaaaacauuuugagaagggguaagcagugaguuauuacccacaauuua

SEQ ID NO: 486435 - RNA, 64 nt, hsa
aacauuucaaggaaaugaauauauuguuagaccagguaagcaaguuuauuuuuguuaaagagca

SEQ ID NO: 486436 - RNA, 64 nt, hsa
aauugggucaggaaguccaguguucuggacuugggguaagcagugggguugggaccucagaugg

SEQ ID NO: 486437 - RNA, 64 nt, hsa
aacaauuacugucaggugucaucacuguucaaaagguaagcacauuuagaauuuuguucuugac

SEQ ID NO: 486438 - RNA, 64 nt, hsa
caggguuguugugaggauccaaugaguugauuuagguaagcaccuagcacaugccguggcacca

SEQ ID NO: 486439 - RNA, 64 nt, hsa
uuuuaucuuuugaaacacguucugauuaaccaaggguaagcauguuuugguugcuaaagaaaaa

SEQ ID NO: 486440 - RNA, 64 nt, hsa
caguaggguuugagacuuacgugugauacugacagguaagcaacagugcuagcauucuagauuc

SEQ ID NO: 486441 - RNA, 64 nt, hsa
acuuggauacauaugugcauuuacuguauuucuugguaagcauauuuuugggggaaagugcugc

SEQ ID NO: 486442 - RNA, 64 nt, hsa
cagauaugcagagggacuuggggcuuugccaaaggguaagcacaaagaaggagucacggguucu

SEQ ID NO: 486443 - RNA, 64 nt, hsa
cccauuuuuguacagaauugaaugggauggaauagguaagcaaaaguagaagcccauuugaguu

SEQ ID NO: 486444 - RNA, 64 nt, hsa
gcuguuuuauacuucaacaauuuuuucccuaagugguaagcaauuacuuuaaaacauauuuuua

SEQ ID NO: 486445 - RNA, 64 nt, hsa
uuguuugaagguauccuuuacauaccugucuguagguaagcaaguguuaguaaaaacaauuuug

SEQ ID NO: 486446 - RNA, 64 nt, hsa
cuugacugcuuuuaaaugaccaaagaugaccugugguaagcaaccugggcaucuuaggaagcag

SEQ ID NO: 486447 - RNA, 64 nt, hsa
auuuuuacucaugccuuuuuguuuaggauaaauagguaagcacaaagagcucuucaaaaucaga

SEQ ID NO: 486448 - RNA, 64 nt, hsa
uggagagagcacuuccccguaacgaaagcaaagugguaagcacagggugagacccuuuuacaca

SEQ ID NO: 486449 - RNA, 64 nt, hsa
cauuuuuaaaaacagaaaaauugaaaaacuguuugguaagcacauguauaucuaccauuuagau

SEQ ID NO: 486450 - RNA, 64 nt, hsa
aagaaaguaaugccacacauugugcuuggccccugguaagcagaggcuuugggguccuagccca

SEQ ID NO: 486451 - RNA, 64 nt, hsa
uaagugaucaugagguccuuccauauuuagauuggguaagcaugaauguguauuuucuacaaaa

SEQ ID NO: 486452 - RNA, 64 nt, hsa
gcuuauaugccaaauauuaaauaugguuuauuuagguaagcauaaaaacauaggggcuaucauu

SEQ ID NO: 486453 - RNA, 64 nt, hsa
auaacauauguaacuccuuuguaaccaaaauuuagguaagcaggcuuccuuugcucugaagguu

SEQ ID NO: 486454 - RNA, 64 nt, hsa
ucuuucuagguuaugaagagauaauuauuugucugguaagcauuuuuauaaacccacucauuuu

SEQ ID NO: 486455 - RNA, 64 nt, hsa
aggguggggacugaugaugggggguuuuauuucagguaagcaguuuauaugacuuccaauaaga

SEQ ID NO: 486456 - RNA, 64 nt, hsa
auauucaccaucucuaauucauuggucacugguagguaagcaugaguuaaggaaagucaaaaau

SEQ ID NO: 486457 - RNA, 64 nt, hsa
gcaggccgccgucuccccacucacagccccagcagguaagcaguguagacaaacccuuggggcu

SEQ ID NO: 486458 - RNA, 64 nt, hsa
agaaaucauuggccccuucccagcacauugaauggguaagcagacaggccaugauuuaguuggc

SEQ ID NO: 486459 - RNA, 64 nt, hsa
agaacaugcaaaucagcaggaacuggucauacaggguaagcaccagggacaauaaggauuuuua

SEQ ID NO: 486460 - RNA, 64 nt, hsa
ucaaauggcacauagauaggcaggauauuacauagguaagcaggaauuuauacauuggguacca

SEQ ID NO: 486461 - RNA, 64 nt, hsa
acgcugaggccaguugucagacugaauuucuuuugguaagcaguuaaugccuuuggguucgagg

SEQ ID NO: 486462 - RNA, 64 nt, hsa
cuugaaaacaaaaaacaguuacuuauagucaauggguaagcagagucugaauuuauacuaauca

SEQ ID NO: 486463 - RNA, 64 nt, hsa
caggcacacgaccaagucagcgagagcuagcccugguaagcaaacauagcccauuacagguuca

SEQ ID NO: 486464 - RNA, 64 nt, hsa
aaucuaaauaucuugaaagcuauauugugggcuugguaagcauuuuguuuuuucuuucucuguu

SEQ ID NO: 486465 - RNA, 64 nt, hsa
aaaucccacucaucgaccccggguaaaauguuaugguaagcaugcacaguuugcagucuacagu

SEQ ID NO: 486466 - RNA, 64 nt, hsa
ucaaacuacuuuauacuagugauaguuugaguuagguaagcaucuuaaagcuguuuggugauaa

SEQ ID NO: 486467 - RNA, 64 nt, hsa
uauauauuaauaauguacaugguguuuaaagaaugguaagcauuguuaauuucuguaaugaaca

SEQ ID NO: 486468 - RNA, 64 nt, hsa
ugaugcuguugcucucguccgccucccuuccacagguaagcacgcaagacacagguaccgugug

SEQ ID NO: 486469 - RNA, 64 nt, hsa
acaugaccuugggauuacauuuuuauggggcagggguaagcaaguuuuuaaaucauuugugugc

SEQ ID NO: 486470 - RNA, 64 nt, hsa
uuuuccgcuuugacuuuaacgcuuucuaggauaggguaagcacccuuaauucaggcacugucca

SEQ ID NO: 486471 - RNA, 64 nt, hsa
ccggggaggagagagcagcuucugccacuucccagguaagcaggaggaggugccaacaguguua

SEQ ID NO: 486472 - RNA, 64 nt, hsa
ucuugaaaaggaaaauaaaaucacuuucuugcuugguaagcaagaagccauaucgauuuuuuuu

SEQ ID NO: 486473 - RNA, 64 nt, hsa
gaagcagauagaugguccagcaggcuugaagcaggguaagcaggcuggcccaggguaagggcug

SEQ ID NO: 486474 - RNA, 64 nt, hsa
uucuaaaggggggcgcugucuagcacuuaacuaggguaagcauucuuaacauguauuuccacuu

SEQ ID NO: 486475 - RNA, 64 nt, hsa
ggcaaacccaaagauggaaagugcuuguuggguggguaagcaccaccuggucucucagcaaaca

SEQ ID NO: 486476 - RNA, 64 nt, hsa
gaaacacuugcugaaucugcaucuggcuuccagugguaagcacauuccucagcaggaucaagcc

SEQ ID NO: 486477 - RNA, 64 nt, hsa
cuuucuuugcaguuaagacugaagcugucaaagagguaagcacauuuuauauagacguaaggaa

SEQ ID NO: 486478 - RNA, 64 nt, hsa
guauuguuucuuaaguaaauauugggacaaucaugguaagcaaacuuaguucuguaacugcauu

SEQ ID NO: 486479 - RNA, 64 nt, hsa
acacacggacgugugauacacacaugcauguacagguaagcacacauguacaagcuccuacagg

SEQ ID NO: 486480 - RNA, 64 nt, hsa
gauuuucuaaucgacuugcagaguaguugaaguggguaagcagcaggguaccuuguauaaugca

SEQ ID NO: 486481 - RNA, 64 nt, hsa
uaccuuuuuguguuuagagaauuaugggaaaccugguaagcaaaacuuuccucccagauaauug

SEQ ID NO: 486482 - RNA, 64 nt, hsa
cagcccugugugcuuugcacauuuaccuuacagugguaagcagagaccaucugugaccauagcc

SEQ ID NO: 486483 - RNA, 64 nt, hsa
cuguuuauuucauccucgaugggaauucuugcuagguaagcacuaauaacucggcaucuugacg

SEQ ID NO: 486484 - RNA, 64 nt, hsa
auauagaacagugcuugccacagagcggggacucgguaagcacuuaaugaaugaaugaauucua

SEQ ID NO: 486485 - RNA, 64 nt, hsa
auuaaccaaggccuuggauuccagaauguuucaugguaagcacuguggagaaccuacaugucag

SEQ ID NO: 486486 - RNA, 64 nt, hsa
ggagaauuuacccuuuccaaauuuaugguuccuugguaagcacgguauucuaaaccagcagagc

SEQ ID NO: 486487 - RNA, 64 nt, hsa
aaauauuucucauacauauguagaaagaaauauagguaagcagcuuaccucaguauuucagggc

SEQ ID NO: 486488 - RNA, 64 nt, hsa
cguaacucugugacugcauuguaagugcaguggggguaagcaguccugugaguggcgcaugaac

SEQ ID NO: 486489 - RNA, 64 nt, hsa
auuguaucuucaugggacauuagggguuuucuaugguaagcacaccuaugguuuugguaaaaac

SEQ ID NO: 486490 - RNA, 64 nt, hsa
ccccaaauaccugaaagcugucuuuaaaaaugcagguaagcaugugacuggccauuugugccga

SEQ ID NO: 486491 - RNA, 64 nt, hsa
aaaucuaccucagaguuguacccucagaaggacggguaagcaggaggccaggggguccccaggg

SEQ ID NO: 486492 - RNA, 64 nt, hsa
gaguaaaucaacaucuguauacccccuucccagggguaagcacuguuaccaauuuagcauaugu

SEQ ID NO: 486493 - RNA, 64 nt, hsa
uccagugagcuccagauucuuccaaggcaaaagagguaagcagaucacaccucuuucugccucu

SEQ ID NO: 486494 - RNA, 64 nt, hsa
gucaccccgcuguaagcuccuuuguggagugcuggguaagcaguuuccaauaaacgcaagcuga

SEQ ID NO: 486495 - RNA, 64 nt, hsa
accuuggugccucaguuuacccaucuguaaaauggguaagcauagccacuggugggauauuuug

SEQ ID NO: 486496 - RNA, 64 nt, hsa
aggaguucucccaccaccucaccaguuuccaggugguaagcaccaggacgcccucgagguugcu

SEQ ID NO: 486497 - RNA, 64 nt, hsa
cugugaccacccguguagcuacugaaaauggcuggguaagcaagucaaggguguuggaggaggu

SEQ ID NO: 486498 - RNA, 64 nt, hsa
auuuauccaugcuggcagaggcacucagguacuugguaagcaaauuucuaaaacuccaaguugc

SEQ ID NO: 486499 - RNA, 64 nt, hsa
cauucuauguuauucuagacuauacaaauuaagugguaagcaguuauaaagacggcaagaccau

SEQ ID NO: 486500 - RNA, 64 nt, hsa
cuuccccuaaauuaggaccuauuauuuaccuguagguaagcaagcuacuguagcucuucugagg

SEQ ID NO: 486501 - RNA, 64 nt, hsa
agcagaugacacugauuggccucacggggacuuggguaagcaacaggcggcauucaggacucuu

SEQ ID NO: 486502 - RNA, 64 nt, hsa
gaggcuuagccaucccugacccuggcagugcacugguaagcagacacugcacugaaccaacugc

SEQ ID NO: 486503 - RNA, 64 nt, hsa
gguggccuugaucucuccaugccccaccuuaagugguaagcauguuuaauuaucaaaggcccca

SEQ ID NO: 486504 - RNA, 64 nt, hsa
uuccuguccugaaauauuuuauucaugaaaauaagguaagcaaaaaccaacuccauuuugccag

SEQ ID NO: 486505 - RNA, 64 nt, hsa
uccucagggucccuucugccaucuaggccuuagggguaagcaggucucaguccuggcaccaugc

SEQ ID NO: 486506 - RNA, 64 nt, hsa
ggggcuggguggggggagaagaccgacuaacagcugaaguaaugacagauuguugcugggucau

SEQ ID NO: 486507 - RNA, 64 nt, hsa
gaggaaaaagaaaaacauuuccucuuauaacuucugaaguaauuuguaaaaaagauuuguagag

SEQ ID NO: 486508 - RNA, 64 nt, hsa
ucuauaugacagauguauuuuaaaaguuucaucuugaaguaaaaguacaacagcuugaaguguu

SEQ ID NO: 486509 - RNA, 64 nt, hsa
gcuuuguugguaaaagugacauguuaaggggcuaugaaguaaauaugcugcaguuaauuaugcu

SEQ ID NO: 486510 - RNA, 64 nt, hsa
aauuggccuaaguauucaugagcccauguuucugugaaguaauuauuaaaccaacuuaaugauu

SEQ ID NO: 486511 - RNA, 64 nt, hsa
uugaggaaucuuaaauuucauagacauguaaagcugaaguaacucuaaagagcagaugcuucag

SEQ ID NO: 486512 - RNA, 64 nt, hsa
cagaagaaaauccucagcaaagugaagaauugcuugaaguaagcaacugauggcauuugagaau

SEQ ID NO: 486513 - RNA, 64 nt, hsa
gacauuuauauuaugaaauauguaccuuuguuccugaaguaaccgccaguggucuuuaaacuaa

SEQ ID NO: 486514 - RNA, 64 nt, hsa
gcuuuguugguaaaagugacauguuaaggggcuaugaaguaaauaugcugcaguuaauugugcu

SEQ ID NO: 486515 - RNA, 64 nt, hsa
ucuguaugacagauguauuuuaaaaguuucaacuugaaguaaaaguacaacagcuugaaguguu

SEQ ID NO: 486516 - RNA, 64 nt, hsa
aagaucucuugggaucagaauuauauaauaucuuugaaguaaauuauuaaaauauccuauuuaa

SEQ ID NO: 486517 - RNA, 64 nt, hsa
aacaaauaaucucuagagagguccacuuuguugcugaaguaaacguuacuuguugcaacccgag

SEQ ID NO: 486518 - RNA, 64 nt, hsa
ugcauguagucuuuggacugguuauuucugguuuugaaguaaucgaacaaauugaaaaucugaa

SEQ ID NO: 486519 - RNA, 64 nt, hsa
gcaaaaauaaaguucggccugggucucucuuugaugaaguaagaaagacagcacgcuuaaaccg

SEQ ID NO: 486520 - RNA, 64 nt, hsa
agggccugaacccugggugggggcacuggaugccugaaguaaguaaguuuucucaguggggcag

SEQ ID NO: 486521 - RNA, 64 nt, hsa
ccuuaacagagagaagaggggacaaauuugguugugaaguaaacaagaaacacaagacggcuaa

SEQ ID NO: 486522 - RNA, 64 nt, hsa
ugaggcccuuauauaauuacucccauuuugcagaugaaguaacugaggcuuagaaagguuaaua

SEQ ID NO: 486523 - RNA, 64 nt, hsa
guugaaugucaaucauauuuaaagggaaugacuuugaaguaaaaccuuuuuucuugcuacugaa

SEQ ID NO: 486524 - RNA, 64 nt, hsa
uucucuuccuucccuguuugucaauguuuuauucugaaguaaacguuagcucuacauauaaauc

SEQ ID NO: 486525 - RNA, 56 nt, hsa
ucucucucuuuuaggaauaauaaauaugaaguaagauuacaacagagcagaacuug

SEQ ID NO: 486526 - RNA, 64 nt, hsa
cauaaacuaaauuuagaaauuuuuuagauucacuugaaguaaacauuacaaacauuggauacgg

SEQ ID NO: 486527 - RNA, 64 nt, hsa
uuuugauuuugaaauaucugauaauaauuuggaaugaaguaagguucuguuaaaauauauuuga

SEQ ID NO: 486528 - RNA, 64 nt, hsa
aguuaauaauuauauuagcaaaguguuaaucuaaugaaguaaaaaacuccuguguggcagaaag

SEQ ID NO: 486529 - RNA, 64 nt, hsa
acacaauagacuacuuacuacucagcaauaaaaaugaaguaacuuucaauaaaugcaauauuau

SEQ ID NO: 486530 - RNA, 64 nt, hsa
cagcugacuuuguuaguaucauguugaaauagcuugaaguaauaucuuuuauccccuugcaaau

SEQ ID NO: 486531 - RNA, 64 nt, hsa
uucuuuuaccauugaccauuauuauagggacccaugaaguaaaugucacaaucaucuuacuagc

SEQ ID NO: 486532 - RNA, 64 nt, hsa
ggcuaccgggcugggggcgaccuuuaccauaggaugaaguaaccuugcauucggcugcaaggug

SEQ ID NO: 486533 - RNA, 64 nt, hsa
auaaaccuccaagcucacauuuaauauaacagacugaaguaaacauuagaauccuguuuagagc

SEQ ID NO: 486534 - RNA, 64 nt, hsa
ugucaggauacaauacacacugauauauacauguugaaguaaugguaugcaguaagauuuuuuu

SEQ ID NO: 486535 - RNA, 64 nt, hsa
uuacuuucaucucaaguuauuaaaaacccacaacugaaguaaauuuuauuucaagaaucagcag

SEQ ID NO: 486536 - RNA, 64 nt, hsa
aucucccaccuguggccccuaaacccagagugacugagagcacuuaacauucagcuugucucau

SEQ ID NO: 486537 - RNA, 64 nt, hsa
aaauugaggacagcgaugcgggcagcuggggggcugagagcacccagaggaccgaggacagggg

SEQ ID NO: 486538 - RNA, 64 nt, hsa
caucugucagcucacuccagcuucacaaaugugcugagagcauuacuguguagccuuuucuuug

SEQ ID NO: 486539 - RNA, 64 nt, hsa
ugggcugcugauggucagcucugagacagugguuugagagcaggcagaacggucuugggacuug

SEQ ID NO: 486540 - RNA, 64 nt, hsa
caauucuguguaaucaagaauaccuccuuaauucugagagcaugaauauuugaccuuaaaucuc

SEQ ID NO: 486541 - RNA, 64 nt, hsa
cugauauguaaaugaugauuuauguuggcgagucugagagcaagcccaaauguguucuucaaag

SEQ ID NO: 486542 - RNA, 64 nt, hsa
gaaucuugucuuuccguauaaguuguaagcuccuugagagcaggauccaugucauuccuuuauu

SEQ ID NO: 486543 - RNA, 64 nt, hsa
uaggcuuaaugaaagaggucuuucuugcuuuggcugagagcagccucuuuuuaaagugugaugu

SEQ ID NO: 486544 - RNA, 64 nt, hsa
uuacaaauuaugugauuaucuggaagcucuaagaugagagcaaaugccugaucacucuggccaa

SEQ ID NO: 486545 - RNA, 64 nt, hsa
uauuuacaaauguccaugugggagagagagagcaugagagcacaguagcccagccugcugguca

SEQ ID NO: 486546 - RNA, 64 nt, hsa
cauuuguaaacaaauucuaaugggcaaaauaucuugagagcaguuuuuauauggauuauccaua

SEQ ID NO: 486547 - RNA, 64 nt, hsa
uuuuccuuuggcuggcagcucuucccagugauguugagagcaccugcagcaaucugguccccag

SEQ ID NO: 486548 - RNA, 64 nt, hsa
aaucagaauggaagcacuuugaguaucugaagagugagagcauucauguuugacagguccugcu

SEQ ID NO: 486549 - RNA, 64 nt, hsa
aggggcuagguguugaacuuaguuaauggaagacugagagcagaacagguuugucaucuccgca

SEQ ID NO: 486550 - RNA, 64 nt, hsa
uguaaauauaaagccuaaagaugaaguggcuucaggaguauaaauucagcuaauuauuucuaua

SEQ ID NO: 486551 - RNA, 64 nt, hsa
agaauucaguauuaaguacauagguauuuacuauggaguauaauucucacaauuguauuuucag

SEQ ID NO: 486552 - RNA, 64 nt, hsa
auagacuucagcccuuuguaaauauuguaacuggggaguauagaguagaaaaaaaguauaguua

SEQ ID NO: 486553 - RNA, 64 nt, hsa
gaaacuuggcccuuuccaauguugucuucacauuggaguauaagaauucucuauaggacucuuu

SEQ ID NO: 486554 - RNA, 64 nt, hsa
aagucuuagcauuauuuccuuugugaaguacuauguaacagaugauuguuugcuagauuuuguu

SEQ ID NO: 486555 - RNA, 64 nt, hsa
aaaaggauauaaaagcuuuggauauguauuuuuaguaacagaagcaucugguucugugaauaaa

SEQ ID NO: 486556 - RNA, 64 nt, hsa
uuauacaccaagaccuguuagcaagaucgauuuuguaacagaaauugcuuauaaguuuuuuauc

SEQ ID NO: 486557 - RNA, 64 nt, hsa
aguaucauuugugcuucucucuggaguacuuacuguaacagaugcacacguuaucuacuucaac

SEQ ID NO: 486558 - RNA, 64 nt, hsa
agacaugaauuucuaucaaaauguucuuugcacuguaacagagauuccuuuuuucaauaaucuu

SEQ ID NO: 486559 - RNA, 64 nt, hsa
uaaguguuucugucauuguucaaguguauuuucuguaacagaaacauauuuggaauguuuuucu

SEQ ID NO: 486560 - RNA, 64 nt, hsa
aauauguaaccaacaugucacaaacaagcagcauguaacagacuggcacaugugccagcugaau

SEQ ID NO: 486561 - RNA, 64 nt, hsa
cggacacuggaaacauuuaaaugaucaggagggaguaacagaaagagcaaggcuguuuuugaaa

SEQ ID NO: 486562 - RNA, 64 nt, hsa
agaguggcagcugccugccaaaaucuguuccgcuguaacagaacugaauuuggaccccagcaca

SEQ ID NO: 486563 - RNA, 64 nt, hsa
ggaccucugauugcaccacugcacuccaggcuggguaacagaaugagaccuuaucucaaaaaua

SEQ ID NO: 486564 - RNA, 64 nt, hsa
uaguaucuggcuuccuuaaggauguaacuuucauguaacagauuaauaacuuauaugaaaacca

SEQ ID NO: 486565 - RNA, 64 nt, hsa
aguuaugugaguuguucguuguggaacacauuguguaacagacuccuggguguuuuucuuucuc

SEQ ID NO: 486566 - RNA, 64 nt, hsa
auccacauaaaagugcucuccugccugggcagcaacaaccaagaacaaagccccgggacuguuu

SEQ ID NO: 486567 - RNA, 64 nt, hsa
gcucuuuaaauagcugcccaucuccugugauugcacaaccaagcacuuugacauuugcaccuua

SEQ ID NO: 486568 - RNA, 64 nt, hsa
cugcauugcucucccucgugcuccccaaaucaccacaaccaaccaauaccgcgauccaugaggg

SEQ ID NO: 486569 - RNA, 64 nt, hsa
guucagccugaccccgccucaccaauacacggacacaaccaaaucauaacauauagcagaccaa

SEQ ID NO: 486570 - RNA, 64 nt, hsa
agaaaauauggguccauuccuuucuagaaaggggacaaccaagugucucaguuugccuugcggg

SEQ ID NO: 486571 - RNA, 64 nt, hsa
uaccugggaugaagaauaaagagagcaaacuaccacaaccaaugguugagccccugucaagugc

SEQ ID NO: 486572 - RNA, 64 nt, hsa; identical to SEQ ID NO: 48356

SEQ ID NO: 486573 - RNA, 64 nt, hsa; identical to SEQ ID NO: 48357

SEQ ID NO: 486574 - RNA, 64 nt, hsa; identical to SEQ ID NO: 48358

SEQ ID NO: 486575 - RNA, 64 nt, hsa; identical to SEQ ID NO: 48359

SEQ ID NO: 486576 - RNA, 64 nt, hsa; identical to SEQ ID NO: 45399

SEQ ID NO: 486577 - RNA, 64 nt, hsa; identical to SEQ ID NO: 45400

SEQ ID NO: 486578 - RNA, 64 nt, hsa; identical to SEQ ID NO: 45401

SEQ ID NO: 486579 - RNA, 64 nt, hsa; identical to SEQ ID NO: 45402

SEQ ID NO: 486580 - RNA, 64 nt, hsa; identical to SEQ ID NO: 45403

SEQ ID NO: 486581 - RNA, 64 nt, hsa; identical to SEQ ID NO: 45404

SEQ ID NO: 486582 - RNA, 64 nt, hsa; identical to SEQ ID NO: 45405

SEQ ID NO: 486583 - RNA, 64 nt, hsa; identical to SEQ ID NO: 45406

SEQ ID NO: 486584 - RNA, 64 nt, hsa; identical to SEQ ID NO: 45407

SEQ ID NO: 486585 - RNA, 64 nt, hsa; identical to SEQ ID NO: 45408

SEQ ID NO: 486586 - RNA, 64 nt, hsa; identical to SEQ ID NO: 45409

SEQ ID NO: 486587 - RNA, 64 nt, hsa; identical to SEQ ID NO: 45410

SEQ ID NO: 486588 - RNA, 64 nt, hsa; identical to SEQ ID NO: 45411

SEQ ID NO: 486589 - RNA, 64 nt, hsa; identical to SEQ ID NO: 45412

SEQ ID NO: 486590 - RNA, 64 nt, hsa; identical to SEQ ID NO: 45413

SEQ ID NO: 486591 - RNA, 64 nt, hsa; identical to SEQ ID NO: 45414

SEQ ID NO: 486592 - RNA, 64 nt, hsa; identical to SEQ ID NO: 45415

SEQ ID NO: 486593 - RNA, 64 nt, hsa; identical to SEQ ID NO: 45416

SEQ ID NO: 486594 - RNA, 64 nt, hsa; identical to SEQ ID NO: 45417

SEQ ID NO: 486595 - RNA, 64 nt, hsa; identical to SEQ ID NO: 45418

SEQ ID NO: 486596 - RNA, 64 nt, hsa; identical to SEQ ID NO: 45419

SEQ ID NO: 486597 - RNA, 64 nt, hsa; identical to SEQ ID NO: 45420

SEQ ID NO: 486598 - RNA, 64 nt, hsa; identical to SEQ ID NO: 45421

SEQ ID NO: 486599 - RNA, 64 nt, hsa; identical to SEQ ID NO: 45422

SEQ ID NO: 486600 - RNA, 64 nt, hsa; identical to SEQ ID NO: 45423

SEQ ID NO: 486601 - RNA, 64 nt, hsa; identical to SEQ ID NO: 45424

SEQ ID NO: 486602 - RNA, 64 nt, hsa
cuuuuucuuggacuacuuuaauuuggauccuuuggguuuggagaaagggaaugugaaagcuguc

SEQ ID NO: 486603 - RNA, 64 nt, hsa
uaugacccuccccacuuuuuuaaaaccagaaaaagguuuggaauguuggaaugaccaagagaca

SEQ ID NO: 486604 - RNA, 64 nt, hsa
ugaggguuagacagguaggugaaugcaagcucaagguuuggaaaaaugacuuuucaguuauguc

SEQ ID NO: 486605 - RNA, 64 nt, hsa
aaaaccugggcgugguuuugguugccauuccauagguuuggagagcucuagaucucuuuugugc

SEQ ID NO: 486606 - RNA, 64 nt, hsa
guauggaauuuuaaauucucuuagccuacugauugguuuggaugagcacaccagcugcaggugu

SEQ ID NO: 486607 - RNA, 64 nt, hsa
ugcuuuucagccuggaaucagacaucuuccagaugguuuggacccuguccauguguaggucauu

SEQ ID NO: 486608 - RNA, 64 nt, hsa
uuuuuuuuuucugcugccuuucccaaagugguuagguuuggaaaagagaugaugaugguaauau

SEQ ID NO: 486609 - RNA, 64 nt, hsa
cuuguuuucaguauaccguggccugccucaugaugguuuggagauacugucuguggaugugagg

SEQ ID NO: 486610 - RNA, 64 nt, hsa
uaugaauuaaaaugaacuaaaccuuccacuucaggguuuggaugaaacuauuuaaaggacaaau

SEQ ID NO: 486611 - RNA, 64 nt, hsa
aaucaaaguguggaggagguggcccccacagcaggguuuggaaccuacagacccuggccccuga

SEQ ID NO: 486612 - RNA, 64 nt, hsa
uguuaggacuagaagaaaaugcacaauuuguagggguuuggaugaagcagcuguaacugcccua

SEQ ID NO: 486613 - RNA, 64 nt, hsa
aacaucaguauguucgaggguacuaugauauuuugguuuggaauugcccugcccaagucacugu

SEQ ID NO: 486614 - RNA, 64 nt, hsa
acacugccuguggggaccugcccugccccucuuagguuuggagcagaaguggaggugcccacag

SEQ ID NO: 486615 - RNA, 64 nt, hsa
uaccccuaguuccccugacaggaaguucuuggcggguuuggagccaggggauggcauggaguga

SEQ ID NO: 486616 - RNA, 64 nt, hsa
uuuaaacaagucauuuuucuugaucguuguggaagguuuggagccuuagagguaugucagaaaa

SEQ ID NO: 486617 - RNA, 64 nt, hsa
agggccacuuaccaaacucaggugauuccaggaugguuuggaaacuucuccugaaugcauccuu

SEQ ID NO: 486618 - RNA, 64 nt, hsa; identical to SEQ ID NO: 346181

SEQ ID NO: 486619 - RNA, 64 nt, hsa; identical to SEQ ID NO: 346182

SEQ ID NO: 486620 - RNA, 64 nt, hsa; identical to SEQ ID NO: 346183

SEQ ID NO: 486621 - RNA, 64 nt, hsa; identical to SEQ ID NO: 346184

SEQ ID NO: 486622 - RNA, 64 nt, hsa; identical to SEQ ID NO: 346185

SEQ ID NO: 486623 - RNA, 64 nt, hsa; identical to SEQ ID NO: 346186

SEQ ID NO: 486624 - RNA, 64 nt, hsa; identical to SEQ ID NO: 346187

SEQ ID NO: 486625 - RNA, 64 nt, hsa; identical to SEQ ID NO: 346188

SEQ ID NO: 486626 - RNA, 64 nt, hsa; identical to SEQ ID NO: 346189

SEQ ID NO: 486627 - RNA, 64 nt, hsa; identical to SEQ ID NO: 346190

SEQ ID NO: 486628 - RNA, 64 nt, hsa; identical to SEQ ID NO: 346191

SEQ ID NO: 486629 - RNA, 64 nt, hsa; identical to SEQ ID NO: 346192

SEQ ID NO: 486630 - RNA, 64 nt, hsa; identical to SEQ ID NO: 346193

SEQ ID NO: 486631 - RNA, 64 nt, hsa; identical to SEQ ID NO: 346194

SEQ ID NO: 486632 - RNA, 64 nt, hsa; identical to SEQ ID NO: 346195

SEQ ID NO: 486633 - RNA, 64 nt, hsa; identical to SEQ ID NO: 346196

SEQ ID NO: 486634 - RNA, 64 nt, hsa; identical to SEQ ID NO: 346197

SEQ ID NO: 486635 - RNA, 64 nt, hsa; identical to SEQ ID NO: 346198

SEQ ID NO: 486636 - RNA, 64 nt, hsa; identical to SEQ ID NO: 346199

SEQ ID NO: 486637 - RNA, 64 nt, hsa; identical to SEQ ID NO: 346200

SEQ ID NO: 486638 - RNA, 64 nt, hsa; identical to SEQ ID NO: 346201

SEQ ID NO: 486639 - RNA, 64 nt, hsa; identical to SEQ ID NO: 346202

SEQ ID NO: 486640 - RNA, 64 nt, hsa; identical to SEQ ID NO: 346203

SEQ ID NO: 486641 - RNA, 64 nt, hsa; identical to SEQ ID NO: 346204

SEQ ID NO: 486642 - RNA, 64 nt, hsa; identical to SEQ ID NO: 346205

SEQ ID NO: 486643 - RNA, 64 nt, hsa; identical to SEQ ID NO: 346206

SEQ ID NO: 486644 - RNA, 64 nt, hsa; identical to SEQ ID NO: 346207

SEQ ID NO: 486645 - RNA, 64 nt, hsa; identical to SEQ ID NO: 346208

SEQ ID NO: 486646 - RNA, 64 nt, hsa; identical to SEQ ID NO: 346209

SEQ ID NO: 486647 - RNA, 64 nt, hsa; identical to SEQ ID NO: 346210

SEQ ID NO: 486648 - RNA, 64 nt, hsa; identical to SEQ ID NO: 346211

SEQ ID NO: 486649 - RNA, 64 nt, hsa; identical to SEQ ID NO: 346212

SEQ ID NO: 486650 - RNA, 64 nt, hsa; identical to SEQ ID NO: 346213

SEQ ID NO: 486651 - RNA, 64 nt, hsa; identical to SEQ ID NO: 346214

SEQ ID NO: 486652 - RNA, 64 nt, hsa; identical to SEQ ID NO: 346215

SEQ ID NO: 486653 - RNA, 64 nt, hsa; identical to SEQ ID NO: 346216

SEQ ID NO: 486654 - RNA, 64 nt, hsa; identical to SEQ ID NO: 346217

SEQ ID NO: 486655 - RNA, 64 nt, hsa; identical to SEQ ID NO: 346218

SEQ ID NO: 486656 - RNA, 64 nt, hsa; identical to SEQ ID NO: 346219

SEQ ID NO: 486657 - RNA, 64 nt, hsa; identical to SEQ ID NO: 346220

SEQ ID NO: 486658 - RNA, 64 nt, hsa; identical to SEQ ID NO: 346221

SEQ ID NO: 486659 - RNA, 64 nt, hsa; identical to SEQ ID NO: 346222

SEQ ID NO: 486660 - RNA, 64 nt, hsa; identical to SEQ ID NO: 346223

SEQ ID NO: 486661 - RNA, 64 nt, hsa; identical to SEQ ID NO: 346224

SEQ ID NO: 486662 - RNA, 64 nt, hsa; identical to SEQ ID NO: 346225

SEQ ID NO: 486663 - RNA, 64 nt, hsa; identical to SEQ ID NO: 346226

SEQ ID NO: 486664 - RNA, 64 nt, hsa; identical to SEQ ID NO: 346227

SEQ ID NO: 486665 - RNA, 64 nt, hsa; identical to SEQ ID NO: 346228

SEQ ID NO: 486666 - RNA, 64 nt, hsa; identical to SEQ ID NO: 346229

SEQ ID NO: 486667 - RNA, 64 nt, hsa; identical to SEQ ID NO: 346230

SEQ ID NO: 486668 - RNA, 64 nt, hsa; identical to SEQ ID NO: 346231

SEQ ID NO: 486669 - RNA, 64 nt, hsa; identical to SEQ ID NO: 346232

SEQ ID NO: 486670 - RNA, 64 nt, hsa; identical to SEQ ID NO: 346233

SEQ ID NO: 486671 - RNA, 64 nt, hsa; identical to SEQ ID NO: 346234

SEQ ID NO: 486672 - RNA, 64 nt, hsa; identical to SEQ ID NO: 346235

SEQ ID NO: 486673 - RNA, 64 nt, hsa; identical to SEQ ID NO: 449012

SEQ ID NO: 486674 - RNA, 64 nt, hsa; identical to SEQ ID NO: 449013

SEQ ID NO: 486675 - RNA, 64 nt, hsa; identical to SEQ ID NO: 449014

SEQ ID NO: 486676 - RNA, 64 nt, hsa; identical to SEQ ID NO: 449015

SEQ ID NO: 486677 - RNA, 64 nt, hsa; identical to SEQ ID NO: 449035

SEQ ID NO: 486678 - RNA, 64 nt, hsa; identical to SEQ ID NO: 449036

SEQ ID NO: 486679 - RNA, 64 nt, hsa; identical to SEQ ID NO: 449044

SEQ ID NO: 486680 - RNA, 64 nt, hsa; identical to SEQ ID NO: 449045

SEQ ID NO: 486681 - RNA, 64 nt, hsa; identical to SEQ ID NO: 449070

SEQ ID NO: 486682 - RNA, 64 nt, hsa; identical to SEQ ID NO: 449071

SEQ ID NO: 486683 - RNA, 64 nt, hsa; identical to SEQ ID NO: 449081

SEQ ID NO: 486684 - RNA, 64 nt, hsa; identical to SEQ ID NO: 449082

SEQ ID NO: 486685 - RNA, 64 nt, hsa; identical to SEQ ID NO: 449091

SEQ ID NO: 486686 - RNA, 64 nt, hsa; identical to SEQ ID NO: 449092

SEQ ID NO: 486687 - RNA, 64 nt, hsa; identical to SEQ ID NO: 449151

SEQ ID NO: 486688 - RNA, 64 nt, hsa; identical to SEQ ID NO: 449152

SEQ ID NO: 486689 - RNA, 64 nt, hsa; identical to SEQ ID NO: 449155

SEQ ID NO: 486690 - RNA, 64 nt, hsa; identical to SEQ ID NO: 449156

SEQ ID NO: 486691 - RNA, 64 nt, hsa; identical to SEQ ID NO: 449209

SEQ ID NO: 486692 - RNA, 64 nt, hsa; identical to SEQ ID NO: 449210

SEQ ID NO: 486693 - RNA, 64 nt, hsa; identical to SEQ ID NO: 449236

SEQ ID NO: 486694 - RNA, 64 nt, hsa; identical to SEQ ID NO: 449237

SEQ ID NO: 486695 - RNA, 64 nt, hsa; identical to SEQ ID NO: 449256

SEQ ID NO: 486696 - RNA, 64 nt, hsa; identical to SEQ ID NO: 449257

SEQ ID NO: 486697 - RNA, 64 nt, hsa; identical to SEQ ID NO: 449258

SEQ ID NO: 486698 - RNA, 64 nt, hsa; identical to SEQ ID NO: 449259

SEQ ID NO: 486699 - RNA, 64 nt, hsa; identical to SEQ ID NO: 449265

SEQ ID NO: 486700 - RNA, 64 nt, hsa; identical to SEQ ID NO: 449266

SEQ ID NO: 486701 - RNA, 64 nt, hsa; identical to SEQ ID NO: 449324

SEQ ID NO: 486702 - RNA, 64 nt, hsa; identical to SEQ ID NO: 449325

SEQ ID NO: 486703 - RNA, 64 nt, hsa; identical to SEQ ID NO: 449328

SEQ ID NO: 486704 - RNA, 64 nt, hsa; identical to SEQ ID NO: 449329

SEQ ID NO: 486705 - RNA, 64 nt, hsa; identical to SEQ ID NO: 449400

SEQ ID NO: 486706 - RNA, 64 nt, hsa; identical to SEQ ID NO: 449401

SEQ ID NO: 486707 - RNA, 64 nt, hsa; identical to SEQ ID NO: 449423

SEQ ID NO: 486708 - RNA, 64 nt, hsa; identical to SEQ ID NO: 449424

SEQ ID NO: 486709 - RNA, 64 nt, hsa; identical to SEQ ID NO: 449449

SEQ ID NO: 486710 - RNA, 64 nt, hsa; identical to SEQ ID NO: 449450

SEQ ID NO: 486711 - RNA, 64 nt, hsa; identical to SEQ ID NO: 449474

SEQ ID NO: 486712 - RNA, 64 nt, hsa; identical to SEQ ID NO: 449475

SEQ ID NO: 486713 - RNA, 64 nt, hsa; identical to SEQ ID NO: 449477

SEQ ID NO: 486714 - RNA, 64 nt, hsa; identical to SEQ ID NO: 449478

SEQ ID NO: 486715 - RNA, 64 nt, hsa; identical to SEQ ID NO: 449488

SEQ ID NO: 486716 - RNA, 64 nt, hsa; identical to SEQ ID NO: 449489

SEQ ID NO: 486717 - RNA, 64 nt, hsa; identical to SEQ ID NO: 449560

SEQ ID NO: 486718 - RNA, 64 nt, hsa; identical to SEQ ID NO: 449561

SEQ ID NO: 486719 - RNA, 64 nt, hsa; identical to SEQ ID NO: 107849

SEQ ID NO: 486720 - RNA, 64 nt, hsa; identical to SEQ ID NO: 107850

SEQ ID NO: 486721 - RNA, 64 nt, hsa; identical to SEQ ID NO: 107851

SEQ ID NO: 486722 - RNA, 64 nt, hsa; identical to SEQ ID NO: 107852

SEQ ID NO: 486723 - RNA, 64 nt, hsa; identical to SEQ ID NO: 107853

SEQ ID NO: 486724 - RNA, 64 nt, hsa; identical to SEQ ID NO: 107854

SEQ ID NO: 486725 - RNA, 64 nt, hsa; identical to SEQ ID NO: 107855

SEQ ID NO: 486726 - RNA, 64 nt, hsa; identical to SEQ ID NO: 107856

SEQ ID NO: 486727 - RNA, 64 nt, hsa; identical to SEQ ID NO: 107857

SEQ ID NO: 486728 - RNA, 64 nt, hsa; identical to SEQ ID NO: 107858

SEQ ID NO: 486729 - RNA, 64 nt, hsa; identical to SEQ ID NO: 107859

SEQ ID NO: 486730 - RNA, 64 nt, hsa; identical to SEQ ID NO: 107860

SEQ ID NO: 486731 - RNA, 64 nt, hsa; identical to SEQ ID NO: 107861

SEQ ID NO: 486732 - RNA, 64 nt, hsa; identical to SEQ ID NO: 107862

SEQ ID NO: 486733 - RNA, 64 nt, hsa; identical to SEQ ID NO: 107863

SEQ ID NO: 486734 - RNA, 63 nt, hsa; identical to SEQ ID NO: 107864

SEQ ID NO: 486735 - RNA, 64 nt, hsa; identical to SEQ ID NO: 107865

SEQ ID NO: 486736 - RNA, 64 nt, hsa; identical to SEQ ID NO: 107866

SEQ ID NO: 486737 - RNA, 64 nt, hsa; identical to SEQ ID NO: 107867

SEQ ID NO: 486738 - RNA, 64 nt, hsa; identical to SEQ ID NO: 107868

SEQ ID NO: 486739 - RNA, 64 nt, hsa; identical to SEQ ID NO: 107869

SEQ ID NO: 486740 - RNA, 64 nt, hsa; identical to SEQ ID NO: 107870

SEQ ID NO: 486741 - RNA, 64 nt, hsa; identical to SEQ ID NO: 107871

SEQ ID NO: 486742 - RNA, 64 nt, hsa; identical to SEQ ID NO: 107872

SEQ ID NO: 486743 - RNA, 64 nt, hsa; identical to SEQ ID NO: 107873

SEQ ID NO: 486744 - RNA, 64 nt, hsa; identical to SEQ ID NO: 107874

SEQ ID NO: 486745 - RNA, 64 nt, hsa; identical to SEQ ID NO: 107875

SEQ ID NO: 486746 - RNA, 64 nt, hsa; identical to SEQ ID NO: 107876

SEQ ID NO: 486747 - RNA, 64 nt, hsa; identical to SEQ ID NO: 107877

SEQ ID NO: 486748 - RNA, 64 nt, hsa; identical to SEQ ID NO: 107878

SEQ ID NO: 486749 - RNA, 64 nt, hsa; identical to SEQ ID NO: 107879

SEQ ID NO: 486750 - RNA, 64 nt, hsa; identical to SEQ ID NO: 107880

SEQ ID NO: 486751 - RNA, 64 nt, hsa; identical to SEQ ID NO: 107881

SEQ ID NO: 486752 - RNA, 64 nt, hsa; identical to SEQ ID NO: 107882

SEQ ID NO: 486753 - RNA, 64 nt, hsa; identical to SEQ ID NO: 107883

SEQ ID NO: 486754 - RNA, 64 nt, hsa; identical to SEQ ID NO: 107884

SEQ ID NO: 486755 - RNA, 64 nt, hsa; identical to SEQ ID NO: 107885

SEQ ID NO: 486756 - RNA, 64 nt, hsa; identical to SEQ ID NO: 107886

SEQ ID NO: 486757 - RNA, 64 nt, hsa; identical to SEQ ID NO: 107887

SEQ ID NO: 486758 - RNA, 64 nt, hsa; identical to SEQ ID NO: 107888

SEQ ID NO: 486759 - RNA, 64 nt, hsa; identical to SEQ ID NO: 107889

SEQ ID NO: 486760 - RNA, 64 nt, hsa; identical to SEQ ID NO: 107890

SEQ ID NO: 486761 - RNA, 64 nt, hsa; identical to SEQ ID NO: 107891

SEQ ID NO: 486762 - RNA, 64 nt, hsa; identical to SEQ ID NO: 107892

SEQ ID NO: 486763 - RNA, 64 nt, hsa; identical to SEQ ID NO: 107893

SEQ ID NO: 486764 - RNA, 64 nt, hsa; identical to SEQ ID NO: 107894

SEQ ID NO: 486765 - RNA, 64 nt, hsa; identical to SEQ ID NO: 107895

SEQ ID NO: 486766 - RNA, 64 nt, hsa; identical to SEQ ID NO: 107896

SEQ ID NO: 486767 - RNA, 64 nt, hsa; identical to SEQ ID NO: 107897

SEQ ID NO: 486768 - RNA, 64 nt, hsa; identical to SEQ ID NO: 107898

SEQ ID NO: 486769 - RNA, 64 nt, hsa; identical to SEQ ID NO: 107899

SEQ ID NO: 486770 - RNA, 64 nt, hsa; identical to SEQ ID NO: 107900

SEQ ID NO: 486771 - RNA, 64 nt, hsa; identical to SEQ ID NO: 107901

SEQ ID NO: 486772 - RNA, 64 nt, hsa; identical to SEQ ID NO: 107902

SEQ ID NO: 486773 - RNA, 64 nt, hsa; identical to SEQ ID NO: 107903

SEQ ID NO: 486774 - RNA, 64 nt, hsa; identical to SEQ ID NO: 107904

SEQ ID NO: 486775 - RNA, 64 nt, hsa; identical to SEQ ID NO: 107905

SEQ ID NO: 486776 - RNA, 64 nt, hsa; identical to SEQ ID NO: 107906

SEQ ID NO: 486777 - RNA, 64 nt, hsa; identical to SEQ ID NO: 107907

SEQ ID NO: 486778 - RNA, 64 nt, hsa; identical to SEQ ID NO: 107908

SEQ ID NO: 486779 - RNA, 64 nt, hsa; identical to SEQ ID NO: 107909

SEQ ID NO: 486780 - RNA, 64 nt, hsa; identical to SEQ ID NO: 107910

SEQ ID NO: 486781 - RNA, 64 nt, hsa; identical to SEQ ID NO: 107911

SEQ ID NO: 486782 - RNA, 64 nt, hsa; identical to SEQ ID NO: 107912

SEQ ID NO: 486783 - RNA, 64 nt, hsa; identical to SEQ ID NO: 107913

SEQ ID NO: 486784 - RNA, 64 nt, hsa; identical to SEQ ID NO: 107914

SEQ ID NO: 486785 - RNA, 64 nt, hsa; identical to SEQ ID NO: 107915

SEQ ID NO: 486786 - RNA, 64 nt, hsa; identical to SEQ ID NO: 107916

SEQ ID NO: 486787 - RNA, 64 nt, hsa; identical to SEQ ID NO: 107917

SEQ ID NO: 486788 - RNA, 64 nt, hsa; identical to SEQ ID NO: 107918

SEQ ID NO: 486789 - RNA, 64 nt, hsa; identical to SEQ ID NO: 107919

SEQ ID NO: 486790 - RNA, 64 nt, hsa; identical to SEQ ID NO: 107920

SEQ ID NO: 486791 - RNA, 64 nt, hsa; identical to SEQ ID NO: 107921

SEQ ID NO: 486792 - RNA, 64 nt, hsa; identical to SEQ ID NO: 107922

SEQ ID NO: 486793 - RNA, 64 nt, hsa; identical to SEQ ID NO: 107923

SEQ ID NO: 486794 - RNA, 64 nt, hsa; identical to SEQ ID NO: 107924

SEQ ID NO: 486795 - RNA, 64 nt, hsa; identical to SEQ ID NO: 107925

SEQ ID NO: 486796 - RNA, 64 nt, hsa; identical to SEQ ID NO: 107926

SEQ ID NO: 486797 - RNA, 64 nt, hsa; identical to SEQ ID NO: 107927

SEQ ID NO: 486798 - RNA, 64 nt, hsa; identical to SEQ ID NO: 107928

SEQ ID NO: 486799 - RNA, 64 nt, hsa; identical to SEQ ID NO: 107929

SEQ ID NO: 486800 - RNA, 64 nt, hsa; identical to SEQ ID NO: 107930

SEQ ID NO: 486801 - RNA, 64 nt, hsa; identical to SEQ ID NO: 107931

SEQ ID NO: 486802 - RNA, 64 nt, hsa; identical to SEQ ID NO: 107932

SEQ ID NO: 486803 - RNA, 64 nt, hsa; identical to SEQ ID NO: 107933

SEQ ID NO: 486804 - RNA, 64 nt, hsa; identical to SEQ ID NO: 357423

SEQ ID NO: 486805 - RNA, 64 nt, hsa; identical to SEQ ID NO: 357424

SEQ ID NO: 486806 - RNA, 64 nt, hsa; identical to SEQ ID NO: 357425

SEQ ID NO: 486807 - RNA, 64 nt, hsa; identical to SEQ ID NO: 357426

SEQ ID NO: 486808 - RNA, 64 nt, hsa; identical to SEQ ID NO: 357427

SEQ ID NO: 486809 - RNA, 64 nt, hsa; identical to SEQ ID NO: 357428

SEQ ID NO: 486810 - RNA, 64 nt, hsa; identical to SEQ ID NO: 357429

SEQ ID NO: 486811 - RNA, 64 nt, hsa; identical to SEQ ID NO: 357430

SEQ ID NO: 486812 - RNA, 64 nt, hsa; identical to SEQ ID NO: 357431

SEQ ID NO: 486813 - RNA, 64 nt, hsa; identical to SEQ ID NO: 357432

SEQ ID NO: 486814 - RNA, 64 nt, hsa; identical to SEQ ID NO: 357433

SEQ ID NO: 486815 - RNA, 64 nt, hsa; identical to SEQ ID NO: 357434

SEQ ID NO: 486816 - RNA, 64 nt, hsa; identical to SEQ ID NO: 357435

SEQ ID NO: 486817 - RNA, 64 nt, hsa; identical to SEQ ID NO: 357436

SEQ ID NO: 486818 - RNA, 64 nt, hsa; identical to SEQ ID NO: 357437

SEQ ID NO: 486819 - RNA, 64 nt, hsa; identical to SEQ ID NO: 357438

SEQ ID NO: 486820 - RNA, 64 nt, hsa; identical to SEQ ID NO: 357439

SEQ ID NO: 486821 - RNA, 64 nt, hsa; identical to SEQ ID NO: 357440

SEQ ID NO: 486822 - RNA, 64 nt, hsa; identical to SEQ ID NO: 357441

SEQ ID NO: 486823 - RNA, 64 nt, hsa; identical to SEQ ID NO: 357442

SEQ ID NO: 486824 - RNA, 64 nt, hsa; identical to SEQ ID NO: 357443

SEQ ID NO: 486825 - RNA, 66 nt, hsa
cagaaugugagugugagagugauaaugcaggggugagugugagagggacugcguuugcauuuuuau

SEQ ID NO: 486826 - RNA, 66 nt, hsa
cgccugagggugggcaugagucuugccagaaugugagugugagagugauaaugcaggggugagugu

SEQ ID NO: 486827 - RNA, 66 nt, hsa
cucaucccgaucucuuccugucagaggaccggagaagugugagaaggugccccuucaggcaccuag

SEQ ID NO: 486828 - RNA, 66 nt, hsa
gaacuaguuguuacacagcucccagccaagaagaaagugugagaaguugaugggcagcaaaccugc

SEQ ID NO: 486829 - RNA, 66 nt, hsa
cugcauccuccagcaucucaacuccgucugucuacugugugagacuucggcggaccauuaggaaug

SEQ ID NO: 486830 - RNA, 66 nt, hsa
gauguguacguaauauuuauuuuaacuuaugcaagggugugagauguucccccugcuguaaaugca

SEQ ID NO: 486831 - RNA, 66 nt, hsa
uuugugcccaacuccagcacagcugcguucuggggugugugagaggcauguucgugucugugcgcu

SEQ ID NO: 486832 - RNA, 66 nt, hsa
uaguguuuuugugcacuugccagggguuuucucucugugugagaggggagugauuuaagcaauggu

SEQ ID NO: 486833 - RNA, 66 nt, hsa
aauaagaggguaugggggaaagguucauagacuuaggugugagaaugaggugggaggugucuggua

SEQ ID NO: 486834 - RNA, 66 nt, hsa
gagagaggagauaggcagauguggguauggggcccagugugagaaggaagacagagaaguucuuga

SEQ ID NO: 486835 - RNA, 66 nt, hsa
cucccgaccuuagcuuauugaucccacauuuccauggugugagauccucuuuacucugggcagaag

SEQ ID NO: 486836 - RNA, 66 nt, hsa
uuuuacaaucuguaucuuugacaauucugggugcgagugugagagugugagcagggcuugcuccug

SEQ ID NO: 486837 - RNA, 66 nt, hsa
gcuuggaccugccauggagggugcccagcagacguggugugagagggacagcucacgaggcuugga

SEQ ID NO: 486838 - RNA, 66 nt, hsa
acgaggcuuggaccugguggagggugcccggcagacgugugagagggacgguucacaaggcuugga

SEQ ID NO: 486839 - RNA, 66 nt, hsa
agacuuggaccugguggagggugcccagcagacguggugugagagggacggcucacagggcuugga

SEQ ID NO: 486840 - RNA, 66 nt, hsa
gcuuggaccugcuguggagggugcccagcagacguggugugagaggaacggcucacgagacuugga

SEQ ID NO: 486841 - RNA, 64 nt, hsa
aacaauuaugcacuguguaauuuuaguaauguauaacaugcaaugaugcacuuuaacugaagau

SEQ ID NO: 486842 - RNA, 64 nt, hsa
uagaucuugcaucauaacacuaaaaguuuacaagaacaugcaguucaaugaucaaaaucauguu

SEQ ID NO: 486843 - RNA, 64 nt, hsa
uucucccaaucaugucucuuuauguaaagacaguaacaugcaaacacuuuuaguuuacaucccu

SEQ ID NO: 486844 - RNA, 64 nt, hsa
aacauauuuuuguuaccuaaugcauccacugaugaacaugcaaacuuugggcauaaugugaacu

SEQ ID NO: 486845 - RNA, 64 nt, hsa
uuuuaaauaguaagucacagguccacacuguguaaacaugcaucugauaagauacugcugauau

SEQ ID NO: 486846 - RNA, 64 nt, hsa
gugguuucggggugagaauaaaacacccccacauaacaugcauuugcaugggcccgaaccugug

SEQ ID NO: 486847 - RNA, 64 nt, hsa
ugauuuuaccugucaauaccagcacuguauuacuaacaugcaaaauacugcagauuuauuuuga

SEQ ID NO: 486848 - RNA, 64 nt, hsa
cuaaccacuaacuagguaguguaugccccuucagaacaugcagaguguaucuuuuuuuaaauuu

SEQ ID NO: 486849 - RNA, 64 nt, hsa
agaacugugcaguagccguuugugguuuaaagcaaacaugcaagaugaaccugagggaugauag

SEQ ID NO: 486850 - RNA, 64 nt, hsa
agaggguaagaaacgauuccggugggaugauuuuaacaugcaaaaugucccuggggguuucuuc

SEQ ID NO: 486851 - RNA, 64 nt, hsa
gauccuccagccucaucuaaugccccccaaagacugauacaaguaaccuccccucugcuuaggu

SEQ ID NO: 486852 - RNA, 64 nt, hsa
aacacagaacgagguuaucuaggguuguagcuuuugauacaacuccccgaucuagauuuauucc

SEQ ID NO: 486853 - RNA, 64 nt, hsa
uugcaccgccuacuuaauucuuuuccauauauugugauacaaacuuuugaauauggaaucuuac

SEQ ID NO: 486854 - RNA, 64 nt, hsa
uguguauggggaaaauaguucugaaaggcuagaaugauacaagugagcaaaaguuggucagcuu

SEQ ID NO: 486855 - RNA, 64 nt, hsa
acacggguuguacagaaacugguauuuuuggugcugauacaagagaaauguauuuuuaaauauc

SEQ ID NO: 486856 - RNA, 64 nt, hsa
aacucagaacuuaauuuaaaagucuuaaauauucugauacaauucagcugucuucucuaccuua

SEQ ID NO: 486857 - RNA, 64 nt, hsa
aucauagguguuauuuuuaguugcauaggguauuugauacaaucauuaauggaucauacacaau

SEQ ID NO: 486858 - RNA, 64 nt, hsa
aagauuuguuaaacuggaaacguuuuacaugaucugauacaaccauuaaugaaucauacacaau

SEQ ID NO: 486859 - RNA, 64 nt, hsa
agguggcacucaguuaucuuaacaggggaaguacugauacaauuguugacuuuucuuuuacuau

SEQ ID NO: 486860 - RNA, 64 nt, hsa
auauuccaguuaccuagauauucccuugagauuuugauacaauuugagggaggcagaagucugc

SEQ ID NO: 486861 - RNA, 64 nt, hsa
gcgucagcccgaguucugaauuaaaacaugccucccacagaaucuauuucugaugaauaugaaa

SEQ ID NO: 486862 - RNA, 64 nt, hsa
cugaggccuccccagaagcagaagcauguaaagcccacagaaccgugaguugauuaaaucucuu

SEQ ID NO: 486863 - RNA, 64 nt, hsa
acaagugacgacaaagauucuguuucaaauauagccacagaaauaaaggagggaccaauaucug

SEQ ID NO: 486864 - RNA, 64 nt, hsa
acaagugacgagaaagauucuguuucaaauauagccacagaaauaaagaagggacaacaaucug

SEQ ID NO: 486865 - RNA, 64 nt, hsa
acaacugacgaggaagacucuguuucgaauauagccacagaaauaaaggauggagaaaaaucug

SEQ ID NO: 486866 - RNA, 64 nt, hsa
acaacugaugagaaagauucuguuucgaacauagccacagaaauaaaggauggagaaaaaucug

SEQ ID NO: 486867 - RNA, 64 nt, hsa
gucuaguaacuuaagugagagagaaagggcagcgccacagaagccccuaaacgccgccucguca

SEQ ID NO: 486868 - RNA, 64 nt, hsa
aggauccuuuuggggcuggagacugagucuugaaccacagaagggaauaaauuauacaccacug

SEQ ID NO: 486869 - RNA, 64 nt, hsa
aaaaaaaaaaaaaaucagaaaacccccaccuaauccacagaaaguaaugucuuuccccuccccu

SEQ ID NO: 486870 - RNA, 64 nt, hsa
cuucaggucacgcagcccuguacuguauccagcaccacagaaaccucaguguuuuuccucugcu

SEQ ID NO: 486871 - RNA, 64 nt, hsa
gaauucaguguauccguuauuuuaaugcacuacaccacagaaauguuaaguuggucaagggcuu

SEQ ID NO: 486872 - RNA, 64 nt, hsa
gaaacccuucccuccaggaggcccccgcugacucccacagaaacccaccuaccauaagaugucu

SEQ ID NO: 486873 - RNA, 64 nt, hsa
guggcagugagaccagcccacccaccaccacccaccacagaaaagcacaaaccucugggaaaga

SEQ ID NO: 486874 - RNA, 64 nt, hsa
uaaacacacccaccagugcagccugaaguaacucccacagaaaccaucaucgucuuuguacauc

SEQ ID NO: 486875 - RNA, 64 nt, hsa
ccaagacagcugaaggagaaugaaacacacacauccacagaaacagagaggcguagguggcccu

SEQ ID NO: 486876 - RNA, 64 nt, hsa
ccccacccacccugcaccccucgcccuccccccaccacagaaucuaagaccuuucagcuucgag

SEQ ID NO: 486877 - RNA, 64 nt, hsa
aaaaaaaaugccaugaaacauuugaacugaugagccacagaacuucaguugaaauuuuuuucac

SEQ ID NO: 486878 - RNA, 64 nt, hsa
ucaaauuuuccaauuugaaccaguggggaaaaucccacagaaaucaguaaguuuacauuucaau

SEQ ID NO: 486879 - RNA, 64 nt, hsa
uuaaucggguacuaccagucuugaaauuuugccaccacagaaagaaagauguuuuuaaaagcuu

SEQ ID NO: 486880 - RNA, 64 nt, hsa
uuagucuccauuucauagaugaaaauagugaagcccacagaaaauaaguagcuccuccacaggu

SEQ ID NO: 486881 - RNA, 64 nt, hsa
cagggaccacccuccccacaguaugcacucagccccacagaacccaccagucuuucugggaacu

SEQ ID NO: 486882 - RNA, 64 nt, hsa
cccauucccucccagccuccgcucugccucccuuccacagaagcccucuucgggcagccccccu

SEQ ID NO: 486883 - RNA, 64 nt, hsa
gcuuucaccauuuuauauacaaaggggaccagugccacagaaggguacccgaagaaaugagaag

SEQ ID NO: 486884 - RNA, 64 nt, hsa
auauacauccagauggccugaaguuacugaagauccacagaagugaaaauagccuuaacugaug

SEQ ID NO: 486885 - RNA, 64 nt, hsa
uuacuucaaagugucaggagagugaagaaauuggccacagaagagcaagaagcucucuuaagaa

SEQ ID NO: 486886 - RNA, 64 nt, hsa
uagaggcacugcccaucucuucuccaccuucucuccacagaauguuugcagagcugggcaguug

SEQ ID NO: 486887 - RNA, 64 nt, hsa
gcacacuuucuucugaauuagcaaacugaauaaacuacagaaauuuuuuagaaucaagaagucu

SEQ ID NO: 486888 - RNA, 64 nt, hsa
ucuggucuuuccuguuguuggccccucuggggcucuacagaaacaggcuggguuccaggagccc

SEQ ID NO: 486889 - RNA, 64 nt, hsa
caauguacuuugaacuaccugacucauuccagcacuacagaaguguguuuuacucauuugagga

SEQ ID NO: 486890 - RNA, 64 nt, hsa
cagguuaucuugaacugccugacuuaggccagcccuacagaagugcuguuuacucauuggagga

SEQ ID NO: 486891 - RNA, 64 nt, hsa
caguuuaucuuggacugacugacucaugccagcccuacagaagugccuuuuacguauuggagca

SEQ ID NO: 486892 - RNA, 64 nt, hsa
uugggaaagucacuccuaguaucuauuucaccaucuacagaagagaaauacuucacagaauuau

SEQ ID NO: 486893 - RNA, 64 nt, hsa
guauuugcuaaugaucuucagauuuuaucuuugucuacagaacaauuaguaauacccaaguaau

SEQ ID NO: 486894 - RNA, 64 nt, hsa
uucaagcuaguucucugaaaauuuugccauuuaucuacagaaauuugauuauaaauauguuccu

SEQ ID NO: 486895 - RNA, 64 nt, hsa
cuguuauguugaauaauaauuagcauauaauugucuacagaagcaagagcaaucuggaaggaac

SEQ ID NO: 486896 - RNA, 64 nt, hsa
cacuucucagagggcagaguggcagccgggcacccuacagaaacucagagggcagaguggcagc

SEQ ID NO: 486897 - RNA, 64 nt, hsa
uaucuggggcgaguguuggggguaaaagcccacccuacagaaaguggaacagcccggagccuga

SEQ ID NO: 486898 - RNA, 64 nt, hsa
gucagaauauuaauacaauuaauauuaauauuaacuacagaaaagacaaacaguagagaacagc

SEQ ID NO: 486899 - RNA, 64 nt, hsa
ugaguccugagcgaaaacaggagaguuagucgcccuacagaaaacccagcuagacuauugggua

SEQ ID NO: 486900 - RNA, 64 nt, hsa
uggguuauuuauuuucccaauaauuuugugugagcuacagaagaccccauaccaaauaaacaaa

SEQ ID NO: 486901 - RNA, 64 nt, hsa
uucuacgagccgcggcggccagaggacgaugacccuacagaacaggugggcccccagacacugc

SEQ ID NO: 486902 - RNA, 64 nt, hsa
gugguauuuuaacauagcagcugguuaaccgggacuacagaaguggaaggauaaugagauguaa

SEQ ID NO: 486903 - RNA, 64 nt, hsa
gguagaaacuuuggaaguuuuacuugauuaaggacuacagaauugggcccuuagaaugugaaaa

SEQ ID NO: 486904 - RNA, 64 nt, hsa; identical to SEQ ID NO: 180773

SEQ ID NO: 486905 - RNA, 64 nt, hsa; identical to SEQ ID NO: 180774

SEQ ID NO: 486906 - RNA, 64 nt, hsa; identical to SEQ ID NO: 180775

SEQ ID NO: 486907 - RNA, 64 nt, hsa; identical to SEQ ID NO: 180776

SEQ ID NO: 486908 - RNA, 64 nt, hsa; identical to SEQ ID NO: 180777

SEQ ID NO: 486909 - RNA, 64 nt, hsa; identical to SEQ ID NO: 180778

SEQ ID NO: 486910 - RNA, 64 nt, hsa; identical to SEQ ID NO: 180779

SEQ ID NO: 486911 - RNA, 64 nt, hsa; identical to SEQ ID NO: 180780

SEQ ID NO: 486912 - RNA, 64 nt, hsa; identical to SEQ ID NO: 180781

SEQ ID NO: 486913 - RNA, 64 nt, hsa; identical to SEQ ID NO: 180782

SEQ ID NO: 486914 - RNA, 64 nt, hsa; identical to SEQ ID NO: 180783

SEQ ID NO: 486915 - RNA, 64 nt, hsa; identical to SEQ ID NO: 180784

SEQ ID NO: 486916 - RNA, 64 nt, hsa; identical to SEQ ID NO: 180785

SEQ ID NO: 486917 - RNA, 64 nt, hsa; identical to SEQ ID NO: 180786

SEQ ID NO: 486918 - RNA, 64 nt, hsa; identical to SEQ ID NO: 180787

SEQ ID NO: 486919 - RNA, 64 nt, hsa; identical to SEQ ID NO: 180788

SEQ ID NO: 486920 - RNA, 64 nt, hsa; identical to SEQ ID NO: 180789

SEQ ID NO: 486921 - RNA, 64 nt, hsa; identical to SEQ ID NO: 180790

SEQ ID NO: 486922 - RNA, 64 nt, hsa; identical to SEQ ID NO: 180791

SEQ ID NO: 486923 - RNA, 64 nt, hsa; identical to SEQ ID NO: 180792

SEQ ID NO: 486924 - RNA, 64 nt, hsa; identical to SEQ ID NO: 180793

SEQ ID NO: 486925 - RNA, 64 nt, hsa; identical to SEQ ID NO: 180794

SEQ ID NO: 486926 - RNA, 64 nt, hsa; identical to SEQ ID NO: 180795

SEQ ID NO: 486927 - RNA, 64 nt, hsa; identical to SEQ ID NO: 180796

SEQ ID NO: 486928 - RNA, 64 nt, hsa; identical to SEQ ID NO: 180797

SEQ ID NO: 486929 - RNA, 64 nt, hsa; identical to SEQ ID NO: 180798

SEQ ID NO: 486930 - RNA, 64 nt, hsa
auugcaggaauuaaaaaggaccaagaagaggaagaagaccaaggcccaccgugccccagguaac

SEQ ID NO: 486931 - RNA, 64 nt, hsa
auugcagaaauugaaaaguaccaagaaguggaagaagaccaagacccaucaugccccagguaac

SEQ ID NO: 486932 - RNA, 64 nt, hsa
caaacuaugaagaaacagaagucccauuaccagaaagaccaaaauuaaacuccuggaucuucac

SEQ ID NO: 486933 - RNA, 64 nt, hsa
uguguccuuguuuuuccuuguuuuucucuuuuuaaagaccaacuucccuuugauggcuguguga

SEQ ID NO: 486934 - RNA, 64 nt, hsa
guugcugcugucaugaccuagcuuugauggcagcaagaccaaaaguagaaaucccugcacucau

SEQ ID NO: 486935 - RNA, 64 nt, hsa
ugccugagaccaucgaggaagccgaaaauaugcaaagaccaagaaaaaauaaagaaaagaugau

SEQ ID NO: 486936 - RNA, 64 nt, hsa
acaaaaccaaaacuaguucaaaugaugaagaccaaagaccaaguuaucaucucaccacaccaca

SEQ ID NO: 486937 - RNA, 64 nt, hsa
ggacaagacaaaaccaaaacuaguucaaaugaugaagaccaaagaccaaguuaucaucucacca

SEQ ID NO: 486938 - RNA, 64 nt, hsa
ugagcguguccaccuucucccucuccacucccagaagaccaaacugccuuccccucagggcuca

SEQ ID NO: 486939 - RNA, 64 nt, hsa
gcugcucugccugagcaucagggagggggcaggaaagaccaagcuggguuugcacaucugucug

SEQ ID NO: 486940 - RNA, 64 nt, hsa
aauuuuuuaucuagagaccagcauguucuccccaaagaccaagauauucugccaaaauaucagg

SEQ ID NO: 486941 - RNA, 64 nt, hsa
gauuuucuacccagagaccaagguguucuucccaaagaccaaaauauucuacccauaugucagg

SEQ ID NO: 486942 - RNA, 64 nt, hsa
gauuuucuacccagagaccaagguuaucuuccuaaagaccaaaauauucuacccauaugucagg

SEQ ID NO: 486943 - RNA, 64 nt, hsa; identical to SEQ ID NO: 243972

SEQ ID NO: 486944 - RNA, 64 nt, hsa; identical to SEQ ID NO: 243973

SEQ ID NO: 486945 - RNA, 64 nt, hsa; identical to SEQ ID NO: 243974

SEQ ID NO: 486946 - RNA, 64 nt, hsa; identical to SEQ ID NO: 243975

SEQ ID NO: 486947 - RNA, 64 nt, hsa; identical to SEQ ID NO: 243976

SEQ ID NO: 486948 - RNA, 64 nt, hsa; identical to SEQ ID NO: 243977

SEQ ID NO: 486949 - RNA, 64 nt, hsa; identical to SEQ ID NO: 243978

SEQ ID NO: 486950 - RNA, 64 nt, hsa; identical to SEQ ID NO: 243979

SEQ ID NO: 486951 - RNA, 64 nt, hsa; identical to SEQ ID NO: 243980

SEQ ID NO: 486952 - RNA, 64 nt, hsa; identical to SEQ ID NO: 243981

SEQ ID NO: 486953 - RNA, 64 nt, hsa; identical to SEQ ID NO: 243982

SEQ ID NO: 486954 - RNA, 64 nt, hsa; identical to SEQ ID NO: 243983

SEQ ID NO: 486955 - RNA, 64 nt, hsa; identical to SEQ ID NO: 243984

SEQ ID NO: 486956 - RNA, 64 nt, hsa; identical to SEQ ID NO: 243985

SEQ ID NO: 486957 - RNA, 64 nt, hsa; identical to SEQ ID NO: 243986

SEQ ID NO: 486958 - RNA, 64 nt, hsa; identical to SEQ ID NO: 243987

SEQ ID NO: 486959 - RNA, 64 nt, hsa; identical to SEQ ID NO: 243988

SEQ ID NO: 486960 - RNA, 64 nt, hsa; identical to SEQ ID NO: 243989

SEQ ID NO: 486961 - RNA, 64 nt, hsa
augaagagaaaaugaucugauuuucccuuauacuucauuuuacaauacauauucccuuuuaacu

SEQ ID NO: 486962 - RNA, 64 nt, hsa
uccauuccaaguuuaguuuuugucaaaauaugaaucauuuuauuugacuguacuaucaguacac

SEQ ID NO: 486963 - RNA, 64 nt, hsa
aggacuggcuuuagaagcaguguaguucuaccucucauuuuacagaugagaaaaccgaagccca

SEQ ID NO: 486964 - RNA, 64 nt, hsa
aaaaaagccauugaauuucaagaaaugccuugauucauuuuagaucucuggggaagaaaaagga

SEQ ID NO: 486965 - RNA, 64 nt, hsa
uuccucuuuucaaccugggaacaaauuuuaguuuucauuuuagguuucuguacuuucuguaguu

SEQ ID NO: 486966 - RNA, 64 nt, hsa
auuugaaauagacugugaaguaagcuguaacuugucauuuuaauuuuguuuaacacgguuacug

SEQ ID NO: 486967 - RNA, 64 nt, hsa
caguuucuuacaaauaaaguuuguaagaaaauguucauuuuaagugauagauaguggagaaaau

SEQ ID NO: 486968 - RNA, 64 nt, hsa
uccugacagcagguguacacaugccaacacuuaaucauuuuauggcaccuauuucuuucuugga

SEQ ID NO: 486969 - RNA, 64 nt, hsa
cagucaaaagauccuucauuuuagauuaagcuuuucauuuuaauauauaauuuaauguaaauaa

SEQ ID NO: 486970 - RNA, 64 nt, hsa
auuuuaauucaagaaaugacagucaaaagauccuucauuuuagauuaagcuuuucauuuuaaua

SEQ ID NO: 486971 - RNA, 64 nt, hsa
aaaugagucacggcacuaacucaugguucuauacucauuuuaagaaauuguaaagguugaggug

SEQ ID NO: 486972 - RNA, 64 nt, hsa
accuuccaaauaaaaagcuaaauauuccuccuugucauuuuaaugucauuauugaaauacuuuu

SEQ ID NO: 486973 - RNA, 64 nt, hsa
auuucccaagugcuauugcaauaacaguugauacucauuuuagguaccaaaccuuuugaguuca

SEQ ID NO: 486974 - RNA, 64 nt, hsa
gaaaauguuuaggauuauuccuugcuauuaguacucauuuuauguauguuacccuucaguaagu

SEQ ID NO: 486975 - RNA, 64 nt, hsa
uagcugcucuugugauuuuucucaggcuguuuugucauuuuaaaauccagugguagauguagcu

SEQ ID NO: 486976 - RNA, 64 nt, hsa
cuuaagauuuuuuuauaucuaauugcugcugccuucauuuuagguucagcaguuacuuuuaacu

SEQ ID NO: 486977 - RNA, 64 nt, hsa
uauuaauaccaaauauuuuagccuuaaauuuuugucauuuuaaaaucugauuuaauguuuucug

SEQ ID NO: 486978 - RNA, 64 nt, hsa
uuuuucuggaaauuuuguccauuuuaaaaaccaaucauuuuaagaagacaugacaaugcaauga

SEQ ID NO: 486979 - RNA, 64 nt, hsa
aguaauauugauucauucacauuccuguguuaagucauuuuauauggaaaggcuuacaaaucaa

SEQ ID NO: 486980 - RNA, 64 nt, hsa
ucucagaucacugucacguauauaaauugcuucuucauuuuaauuuguagaaguacuuuacagu

SEQ ID NO: 486981 - RNA, 64 nt, hsa
cgguaggauucugcauuccagcauuaaaucugcuucauuuuagaaccuuuauaaaagcaauagc

SEQ ID NO: 486982 - RNA, 64 nt, hsa
cuguuuuuuuuuuuucauugucaacaguggugugucauuuuauguauguuccuaaugcuuaugg

SEQ ID NO: 486983 - RNA, 64 nt, hsa
ugcuuuagcuuuccaauaugcuguauagccuuugucauuuuauaauuuuaauuccugauuaaaa

SEQ ID NO: 486984 - RNA, 64 nt, hsa
auacauuguuuucaauaccacuuuuaauuguuacucauuuuauucacuaagcucgauaaaucua

SEQ ID NO: 486985 - RNA, 64 nt, hsa
auuacugcuaaucugcuguuaagugaacgguuuuucauuuuacccuuuuguuuuucaguccagg

SEQ ID NO: 486986 - RNA, 64 nt, hsa
ucagccacaccuuccugcauccuauuggccuuauucauuuuaaaugaguuaaugaaucugccag

SEQ ID NO: 486987 - RNA, 64 nt, hsa
uauaucuauguaaaguuauuagaaugguaucuguucauuuuagugauaugaagaucacaacuaa

SEQ ID NO: 486988 - RNA, 64 nt, hsa
acugaaugauaagauuugcaccuuagaacaauaaucauuuuaaggauaacaaguaaaugucuga

SEQ ID NO: 486989 - RNA, 64 nt, hsa
uuuaacuucacuucaugcugaugauguaucaaauucauuuuauagaaagauuuaaaguuuuuuu

SEQ ID NO: 486990 - RNA, 64 nt, hsa
auuuuuuuuuaaccugccaaaaauaaaaaaaagcucauuuuauaauuuucuacuaaauuugagu

SEQ ID NO: 486991 - RNA, 64 nt, hsa
uuaaucacugagcuaaccuaaauaaggaaggauuucauuuuauggacugauauuuugcugugua

SEQ ID NO: 486992 - RNA, 64 nt, hsa
cuaaaauguguuuaauuuuccuuucugaaaacucucauuuuaaaaacguucauuuaauuaugua

SEQ ID NO: 486993 - RNA, 64 nt, hsa
cucugucuuccaggguaaaaauaauaagguugaaucauuuuauuaaaaauacuuuuuaagaaaa

SEQ ID NO: 486994 - RNA, 64 nt, hsa
aaugcuccaagucuaugaacuguuaaaucagcauucauuuuaagaaaagcaacuuuaguuucaa

SEQ ID NO: 486995 - RNA, 64 nt, hsa
uuuuauaucuguugccuaguuuuguacauggaucucauuuuacaagagaaucucucugcaaaaa

SEQ ID NO: 486996 - RNA, 64 nt, hsa
aguuucaacgcugaccuuuucuugcauuauuguuucauuuuaaugauaguguuacuugucccac

SEQ ID NO: 486997 - RNA, 64 nt, hsa
auaauugcuagauuaaaaauagacuagaacagguucauuuuaagauuuacuuggaagagcaaag

SEQ ID NO: 486998 - RNA, 64 nt, hsa
ucauuguauguuuuggguauggcuuuggaauaaaucauuuuauauuuuauuugaauaucagaac

SEQ ID NO: 486999 - RNA, 64 nt, hsa
aucugaaaaaaguuucaccguuugucuucuuaccucauuuuaagaagcaugugaaaaugggaua

SEQ ID NO: 487000 - RNA, 64 nt, hsa
ccucugacuaguagauuucuaugauccuuuuuugucauuuuaugaauaucauugauuuuauaau

SEQ ID NO: 487001 - RNA, 64 nt, hsa
uauagccaacugcuaaugcaaauuaaaacauauuucauuuuaacaugauuucaaaaucaguuuu

SEQ ID NO: 487002 - RNA, 64 nt, hsa
acaaauugucguuuuuauuccucuuauugggauaucauuuuaaaaacuuuauuggguuuuuauu

SEQ ID NO: 487003 - RNA, 64 nt, hsa
uccauuaacaguauauuguacugaucagcagcucucauuuuaacaucaguuaggcauaauauuu

SEQ ID NO: 487004 - RNA, 64 nt, hsa
guagcauccauacuggaaucuugccauauuuuuuucauuuuagaauagauuuuggcagucucau

SEQ ID NO: 487005 - RNA, 64 nt, hsa
uugaauggcaaacgcuauuuaugcauaaauauuuucauuuuaaguaauauaugaaguguaaaua

SEQ ID NO: 487006 - RNA, 64 nt, hsa
uuuccauucagugaauggagcugauguuugccugucauuuuaagaugauaccauaccuucuuug

SEQ ID NO: 487007 - RNA, 64 nt, hsa
agcaguuuguuauuaugcaggaaaaucaguuucaucauuuuaguuacacuaaacacuuuuggca

SEQ ID NO: 487008 - RNA, 64 nt, hsa
acuuuuauuauuuuaauuaauaugacauaagcaaucauuuuaugcuguuuaugaauuauaaaug

SEQ ID NO: 487009 - RNA, 64 nt, hsa
cuuaagaaaauuuacaaaauuuauucucagguaaucauuuuaauaaaguucugcaaaauacacg

SEQ ID NO: 487010 - RNA, 64 nt, hsa
gccacaaauauguaguucugaagauguugaauaaucauuuuacaaagcaguuuucugaaugggg

SEQ ID NO: 487011 - RNA, 64 nt, hsa
guuaaagaaugcagcuguauagauuauauagcuuucauuuuauugcuauuugaagcagauguuc

SEQ ID NO: 487012 - RNA, 64 nt, hsa
agauggaaaaguaauugacaguuucaccuuugucucauuuuauaugauuuauuacaguguaagu

SEQ ID NO: 487013 - RNA, 64 nt, hsa
cuaucaaugaggcucccaucaugccauuuuuuguucauuuuaaucuuuaaaaaauaaaaauuag

SEQ ID NO: 487014 - RNA, 64 nt, hsa
aaaugaguuacuuuuuauuauaucaauuauaauuucauuuuauuaacuggaauaagugcgaaag

SEQ ID NO: 487015 - RNA, 64 nt, hsa
aauauauaauuuuucuuaauagcugaguugugauucauuuuaccauuauauucagaauugaccu

SEQ ID NO: 487016 - RNA, 64 nt, hsa
ugggaucuuuuuauuuugauuguugguaaacuaaucauuuuauuauauauaaaaauauaaaugu

SEQ ID NO: 487017 - RNA, 64 nt, hsa
uaaguguauuaauuguuugguugcuuuauaauuuucauuuuauguaaugaaauaaacaauguug

SEQ ID NO: 487018 - RNA, 64 nt, hsa
uguacuuauuuauugaccugccucauguuucauuucauuuuaaacauccuaaauuuauauuuua

SEQ ID NO: 487019 - RNA, 64 nt, hsa
gaaaagagaacuuucucuuaagaaguuggaaacuucauuuuaccuucgugacccugguagacca

SEQ ID NO: 487020 - RNA, 64 nt, hsa
aaagugugagcuguguuaaaaggcauucuuagauucauuuuaaccacauuuuuaaaaacucaca

SEQ ID NO: 487021 - RNA, 64 nt, hsa
uguaaacuuugcuucucuuauaaguuauugugauucauuuuaguuacuguguuuuauuuugaaa

SEQ ID NO: 487022 - RNA, 64 nt, hsa
uaagucauaucagauaucagaccuaauuuaaauuucauuuuagcuuuacaaguccaaaaacaca

SEQ ID NO: 487023 - RNA, 64 nt, hsa
gggcuagaaaccuaacugauucuucucaguuuucucauuuuaaaacagcccaguauuccuuugu

SEQ ID NO: 487024 - RNA, 64 nt, hsa
gaaauauggauauuuguaccaggcugcguguuuuucauuuuaaacacacaagauuuaauugaaa

SEQ ID NO: 487025 - RNA, 64 nt, hsa
uuuucauuaauacuguaguuauacaccauaugccucauuuuaucauagccuauuguguaugaaa

SEQ ID NO: 487026 - RNA, 64 nt, hsa
aggcaaccgugguuacuguauuuuuuauauaacuucauuuuaaaauauauuaaaagaaaccuaa

SEQ ID NO: 487027 - RNA, 64 nt, hsa
caccccauggaaacacuaguccugauaauaaacaucauuuuaaaagaucaaaacaaacaaacaa

SEQ ID NO: 487028 - RNA, 64 nt, hsa
caaugaaauauucaaccccugcugugcaggggggucauuuuaauguaacaccacaccccaugga

SEQ ID NO: 487029 - RNA, 64 nt, hsa
uucacccugugacuauccugaaaagaaauaauaaucauuuuaugauugaugggccaaaaaaagc

SEQ ID NO: 487030 - RNA, 64 nt, hsa
uucaucaguacuuucuccucccauccuaagcuucucauuuuaggaacugacaugauaagguggu

SEQ ID NO: 487031 - RNA, 64 nt, hsa
uccuacuuaugcagaaaaauaggcaauaagaacuucauuuuacaauuuaguuuucaaaaaaaaa

SEQ ID NO: 487032 - RNA, 64 nt, hsa
uugccuguuugcuaauuuaaaaauauuuauuuuaucauuuuaauguuuucauggacuuuuuugc

SEQ ID NO: 487033 - RNA, 64 nt, hsa
uuuuaccauuucgacuuacauaaugaaaaccaauucauuuuaaauaucagauuauuauuuugua

SEQ ID NO: 487034 - RNA, 64 nt, hsa
uuugugagaauuucucauuaauauccugaaucauucauuuuagcuaaggcuucauguugacucg

SEQ ID NO: 487035 - RNA, 64 nt, hsa
ccucugguguuuauuauaaagcuuaaauuuuauaucauuuuaaaaugucuuggucuucuacugc

SEQ ID NO: 487036 - RNA, 64 nt, hsa
agagcucuuugaucgcuuuuaauaaacugcaaguucauuuuaaaugaagggccagcauauauac

SEQ ID NO: 487037 - RNA, 64 nt, hsa
aggaauuucuugcuuauagaggcaaaccacaguaucauuuuaacucuagaauugggcuuguaca

SEQ ID NO: 487038 - RNA, 64 nt, hsa
acuucuauuauuuguuuaguauguuguaaguagaucauuuuaaaaaacugaaucuauauuaugu

SEQ ID NO: 487039 - RNA, 64 nt, hsa
gauuuuauuguauugcguuauuagcugauuuuacucauuuuauauuugcaaaauaaauuucuaa

SEQ ID NO: 487040 - RNA, 64 nt, hsa
gaggcaauacuguuggaauuauguggauucuaacucauuuuaacaagguagccugaccugcaua

SEQ ID NO: 487041 - RNA, 64 nt, hsa
gccugucacuuugggagccggaaggaggugcuagucauuuuauuuuuacgugaaauagaugacc

SEQ ID NO: 487042 - RNA, 64 nt, hsa
auuucccaccuacauuucuguuuggugacauugcucauuuuaacaaauaugaccgagucuaguu

SEQ ID NO: 487043 - RNA, 64 nt, hsa
aaaaugcaaagugaaugauuaguaaaauuaugucucauuuuauuuuuucagcacccauaccaca

SEQ ID NO: 487044 - RNA, 64 nt, hsa
guucuucauuuccugucuccaacagaaaauucacucauuuuagaacuaguguaauucuugauaa

SEQ ID NO: 487045 - RNA, 64 nt, hsa
uacaggcaugagccaccacgccuggccaguuucuucauuuuacauauggucacauuggcgccua

SEQ ID NO: 487046 - RNA, 64 nt, hsa
ucacaacagugggaggucuguauccugaauguccucauuuuacagaugaggacauugaggagaa

SEQ ID NO: 487047 - RNA, 64 nt, hsa
ccauccagauugugacgguugcuaccuggauccaucauuuuacugguauggcaaaaaaucaccc

SEQ ID NO: 487048 - RNA, 64 nt, hsa
acacaggcugguaaucucuucaccagcaccaauuucauuuuacuccaggcacauaguccagauu

SEQ ID NO: 487049 - RNA, 64 nt, hsa
agagcagcaggagaaaauuaauacuaaauuauaaucauuuuagugauauuuuucaacuucacca

SEQ ID NO: 487050 - RNA, 64 nt, hsa
caaacuggacauggugaauaaaucauaaaacaaaucauuuuacuuauuauuuacaugacuuuuc

SEQ ID NO: 487051 - RNA, 64 nt, hsa
cuuaagguuugugaagaguauuugcauugugucuucauuuuaauguguuugcaaucgcuccgcu

SEQ ID NO: 487052 - RNA, 64 nt, hsa
caggauucccucacucuuuuuuuuuaguuacuaaucauuuuaugaaaauaauguauuuauaagu

SEQ ID NO: 487053 - RNA, 64 nt, hsa
ucacccagcauaaugacuuugagguucauccaugucauuuuaaauuuugaauuggcaauauaua

SEQ ID NO: 487054 - RNA, 64 nt, hsa
uucuuggauuccaaacuaaacaccaagauacuuuucauuuuaaaauguauaaaguaacaauuca

SEQ ID NO: 487055 - RNA, 64 nt, hsa
ccuuacugauccuaaccccagaggcucccugcucucauuuuagcuuucuuaggguaagucccac

SEQ ID NO: 487056 - RNA, 64 nt, hsa
auagggguuauaguuggcuugugcuacucuggaaucauuuuacuguuuguuuuuauuaucuuaa

SEQ ID NO: 487057 - RNA, 64 nt, hsa
ucaggguacauuacauaaaacaauggaggaugccucauuuuagcaaacuagguuucuuuguauu

SEQ ID NO: 487058 - RNA, 64 nt, hsa
uguaaauuuugucauuguaguguacauggagugaucauuuuacuaacauaaauauuuucuaugu

SEQ ID NO: 487059 - RNA, 64 nt, hsa
uauaaaagauacauuuuauggugguuucaguaggucauuuuaaaaaccaaugugcauuaguuuu

SEQ ID NO: 487060 - RNA, 64 nt, hsa
ccacccaacugccaaguuaguauuguuagagauuucauuuuacaacacaaaaauaagccugugu

SEQ ID NO: 487061 - RNA, 62 nt, hsa
agaaagaccuuagagaaccagccaaccaacucucucauuuuaaaagugaaggauucauagca

SEQ ID NO: 487062 - RNA, 64 nt, hsa
aacauuucauuuuacuagcgagaaaucuuugauuucauuuuauucuuuguaauucuagacacua

SEQ ID NO: 487063 - RNA, 64 nt, hsa
guaggaccuauauuuuaauacuguuccuaacauuucauuuuacuagcgagaaaucuuugauuuc

SEQ ID NO: 487064 - RNA, 64 nt, hsa
acauuuuuucagauauuuaacuguauaaaaauguucauuuuacacaauauuuaauuaaaguauu

SEQ ID NO: 487065 - RNA, 64 nt, hsa
uauuuuauuuuauuuuuuuguagaauguaaaaagucauuuuagaugccacccauugacuuugcc

SEQ ID NO: 487066 - RNA, 64 nt, hsa
aaaugcucgugcugcuaauggaauuagagugcguucauuuuacaggcuaguauuuuaaaaguag

SEQ ID NO: 487067 - RNA, 64 nt, hsa
acgucuaaugccuuauuauuucugauuuccuuuuucauuuuaagugguguggagauuccagcac

SEQ ID NO: 487068 - RNA, 64 nt, hsa
uaacacauguuaaaaggacauuguuuuuauagggucauuuuaggcccuuugacuaaguugauau

SEQ ID NO: 487069 - RNA, 64 nt, hsa
gguuuuaugcaaaagaaagugcuacaauuccuaaucauuuuagacacuuuaggagggggugaag

SEQ ID NO: 487070 - RNA, 64 nt, hsa
auuuaggcaacggguaucauauccaugaaaaaugucauuuuaagacacuaauaucaacaguaua

SEQ ID NO: 487071 - RNA, 64 nt, hsa
auuuaucuuccaaacccaaucuaguaggauguucucauuuuaaaaacgaggggaaaagaccaga

SEQ ID NO: 487072 - RNA, 64 nt, hsa
uucuuugaaaaugucagaaauauuuuuuucuuucucauuuuauguugaacuaaaaaggauuaaa

SEQ ID NO: 487073 - RNA, 64 nt, hsa
cagugcacuaugcuuucuauggcaucuuucauucucauuuuauauugugcuauaaaaaggauug

SEQ ID NO: 487074 - RNA, 64 nt, hsa
aaacuggaaaaaacuuuagucaauaucucguguuucauuuuaauuaagugacagguccaagugu

SEQ ID NO: 487075 - RNA, 64 nt, hsa
uccucucaaaauuucugugcaccaguauuauuccucauuuuacauacaggaggcaacuaagacu

SEQ ID NO: 487076 - RNA, 64 nt, hsa
aaggaaugcaaggagaaggauuucuguguuuuacucauuuuaggcuguucagaagaugcuucaa

SEQ ID NO: 487077 - RNA, 64 nt, hsa
uuucuuccaguauuuuuuaaaaaacuguccuaucucauuuuaaaagacuuucuuuugcuugauc

SEQ ID NO: 487078 - RNA, 64 nt, hsa
ugccuuuguuuguaaaaauaaaauaaugguacuuucauuuuauaacaagguguuuuuuucaaga

SEQ ID NO: 487079 - RNA, 64 nt, hsa
uuggaaaugcaccaaagugagcguuuaaaucuucucauuuuauugaaaacuaagagcagaaaau

SEQ ID NO: 487080 - RNA, 64 nt, hsa
uuuaaacuggauggguuaauuuauauaaacauuuucauuuuaaguuggcauuucugccugguuc

SEQ ID NO: 487081 - RNA, 64 nt, hsa
uuugcaaucacuauguucaaucuggauuugucuuucauuuuaacuuuuaauauaaaaagggguu

SEQ ID NO: 487082 - RNA, 64 nt, hsa
guucugaauuuccuuuucuuggcuuguuucuacuucauuuuacccugggucacuugcugccagc

SEQ ID NO: 487083 - RNA, 64 nt, hsa
gugaaauaauuaaagcuuaaacugaauuuguauuucauuuuauugucagauggugguguucacc

SEQ ID NO: 487084 - RNA, 64 nt, hsa
uccagacuuucuuuuucuacaugugagauaguuuucauuuuaacuggcaugucauuugcacaca

SEQ ID NO: 487085 - RNA, 64 nt, hsa
uaaggcuguccacguacuuaauuuacuuaaguguucauuuuaaguaacgugcucacuguguaua

SEQ ID NO: 487086 - RNA, 64 nt, hsa
gggagauggauggugggguagguuuucuagucuaucauuuuacauuuuucauggagucccugcu

SEQ ID NO: 487087 - RNA, 64 nt, hsa
ugacuauaauagcaggaagaauuauagcaaucugucauuuuaccugaaacagacaagccuaugu

SEQ ID NO: 487088 - RNA, 64 nt, hsa
uguaguacuauaguaccguaauauucaucucuccucauuuuaguugccuuucagauucuaaaug

SEQ ID NO: 487089 - RNA, 64 nt, hsa
augcacuuuauugguuaauuuuauaauauuuuggucauuuuacuguuucuggugcaugcagggu

SEQ ID NO: 487090 - RNA, 64 nt, hsa
cagcugacuguugagagagcagcacaucauuuuaucauuuuaucuucuuuggacuacagguggg

SEQ ID NO: 487091 - RNA, 64 nt, hsa
uucagacucagcugacuguugagagagcagcacaucauuuuaucauuuuaucuucuuuggacua

SEQ ID NO: 487092 - RNA, 64 nt, hsa
uuuucgcaaaaggagaaaaaacaguggccuuuggucauuuuacuucuuuuuuguaaguauauaa

SEQ ID NO: 487093 - RNA, 64 nt, hsa
uggugugggcaggcacuaguggacgucagcuucuucauuuuaauucuccuuuuaauguauuuaa

SEQ ID NO: 487094 - RNA, 64 nt, hsa
cugaugaguucuuaaaauuuugucagagccuucuucauuuuacaauauuuuguuauuuuuauuu

SEQ ID NO: 487095 - RNA, 64 nt, hsa
uuuacaauauuuuguuauuuuuauuuuaccuuuuucauuuuacaauauuucguuauuuuuauuu

SEQ ID NO: 487096 - RNA, 64 nt, hsa
uuuacaauauuucguuauuuuuauuuuaccuuuuucauuuuacaaguugcaauauauuguuucg

SEQ ID NO: 487097 - RNA, 64 nt, hsa
uaacuugauguguauauuaauaaaaguaauucagucauuuuaguuuuugauugaaaauaaaggu

SEQ ID NO: 487098 - RNA, 64 nt, hsa
ccauacaucuuaaugaacauacgccuuuguucugucauuuuaaagagugguguuuacuaugugu

SEQ ID NO: 487099 - RNA, 64 nt, hsa
cauauacauguaaguaacaugggaaagcuuucaaucauuuuaguuccuuucaaauacaugaaag

SEQ ID NO: 487100 - RNA, 64 nt, hsa
uugguaaauguaaagagugugggagagccuuuagucauuuuaguuccacuugaagccaugaaag

SEQ ID NO: 487101 - RNA, 64 nt, hsa
ugguaguuggauuucauuaucuuagugaauuuagucauuuuacaauauguuuguauuuggccau

SEQ ID NO: 487102 - RNA, 64 nt, hsa
augacauagccauguguuuuugguuuuuuauauuucauuuuaaaauuugaguaucaccauacau

SEQ ID NO: 487103 - RNA, 64 nt, hsa
agugggcaucuccacgcaccuguguaugugaaagucauuuuacauuucaaagcaguguguguuu

SEQ ID NO: 487104 - RNA, 64 nt, hsa
uagaucaaguauaaaauuuguaugacuucaagucucauuuuaucugaaagguuuuuuucucauu

SEQ ID NO: 487105 - RNA, 64 nt, hsa
gcaaaaacugcucaaagccauuuaaauuauauccucauuuuaaaaguuacauuugcaaauauuu

SEQ ID NO: 487106 - RNA, 64 nt, hsa
gaacgggagaugaugcacuguguuuugaaaguugucauuuuaaagcauuuuagcacaguucaua

SEQ ID NO: 487107 - RNA, 64 nt, hsa
guguauucauauagcuguauacauauucaguugaucauuuuauaaacauaugaaggcauaaaga

SEQ ID NO: 487108 - RNA, 64 nt, hsa
auaaagauauacagaagaaaaauuauuaaacaacucauuuuaagauucaaauuaacuaauuccu

SEQ ID NO: 487109 - RNA, 64 nt, hsa
ucauauuuuauucauuuucucccuuuagcaauuuucauuuuauuucucauaauuugaacagaga

SEQ ID NO: 487110 - RNA, 64 nt, hsa
gauuaccaugcuggaauaagaagaguugcauuucucauuuuaaugagcauauggaaagauggga

SEQ ID NO: 487111 - RNA, 64 nt, hsa
uaccauuuuaacuggcccaguucauuuucuccuuucauuuuacaaaagaaaucaugcagaagca

SEQ ID NO: 487112 - RNA, 64 nt, hsa
aaugcaaguucugggaccuuuuggggcacauguaucauuuuacaaaugagcuuucaagaccauu

SEQ ID NO: 487113 - RNA, 64 nt, hsa
aaauaucugucaccaaaccacaagaaauccaaaaucauuuuagguuuaccaaacauugguggaa

SEQ ID NO: 487114 - RNA, 64 nt, hsa
uaauguagauguuuuuauaacauacuauguacuuucauuuuagaccaaacuagagucagaacga

SEQ ID NO: 487115 - RNA, 64 nt, hsa
guuuuuagacauuucugauuugguuucuuaucuuucauuuuauaagaagguugguuuuaaacaa

SEQ ID NO: 487116 - RNA, 64 nt, hsa
ccuuuuacacaaugugagauguaugaaaaucaacucauuuuauucucggcaacaucuggagaag

SEQ ID NO: 487117 - RNA, 64 nt, hsa
cugugcugucaagcaucaugauuccgggcaguuuucauuuuacuguggauuuugcuauacuuau

SEQ ID NO: 487118 - RNA, 64 nt, hsa
acaauacuggaaucauuuuggcgcugcuucucauucauuuuaaggcuucucugaauugugcuca

SEQ ID NO: 487119 - RNA, 64 nt, hsa; identical to SEQ ID NO: 180891

SEQ ID NO: 487120 - RNA, 64 nt, hsa; identical to SEQ ID NO: 180892

SEQ ID NO: 487121 - RNA, 64 nt, hsa; identical to SEQ ID NO: 180893

SEQ ID NO: 487122 - RNA, 64 nt, hsa; identical to SEQ ID NO: 180894

SEQ ID NO: 487123 - RNA, 64 nt, hsa; identical to SEQ ID NO: 180895

SEQ ID NO: 487124 - RNA, 60 nt, hsa; identical to SEQ ID NO: 180896

SEQ ID NO: 487125 - RNA, 64 nt, hsa; identical to SEQ ID NO: 180897

SEQ ID NO: 487126 - RNA, 64 nt, hsa; identical to SEQ ID NO: 180898

SEQ ID NO: 487127 - RNA, 64 nt, hsa; identical to SEQ ID NO: 180899

SEQ ID NO: 487128 - RNA, 64 nt, hsa; identical to SEQ ID NO: 180900

SEQ ID NO: 487129 - RNA, 64 nt, hsa; identical to SEQ ID NO: 180901

SEQ ID NO: 487130 - RNA, 64 nt, hsa; identical to SEQ ID NO: 180902

SEQ ID NO: 487131 - RNA, 64 nt, hsa; identical to SEQ ID NO: 180903

SEQ ID NO: 487132 - RNA, 64 nt, hsa; identical to SEQ ID NO: 180904

SEQ ID NO: 487133 - RNA, 64 nt, hsa; identical to SEQ ID NO: 180905

SEQ ID NO: 487134 - RNA, 64 nt, hsa; identical to SEQ ID NO: 180906

SEQ ID NO: 487135 - RNA, 64 nt, hsa; identical to SEQ ID NO: 180907

SEQ ID NO: 487136 - RNA, 64 nt, hsa; identical to SEQ ID NO: 180908

SEQ ID NO: 487137 - RNA, 64 nt, hsa; identical to SEQ ID NO: 180909

SEQ ID NO: 487138 - RNA, 64 nt, hsa; identical to SEQ ID NO: 180910

SEQ ID NO: 487139 - RNA, 64 nt, hsa; identical to SEQ ID NO: 180911

SEQ ID NO: 487140 - RNA, 64 nt, hsa; identical to SEQ ID NO: 180912

SEQ ID NO: 487141 - RNA, 64 nt, hsa; identical to SEQ ID NO: 180913

SEQ ID NO: 487142 - RNA, 64 nt, hsa; identical to SEQ ID NO: 182142

SEQ ID NO: 487143 - RNA, 64 nt, hsa; identical to SEQ ID NO: 182143

SEQ ID NO: 487144 - RNA, 64 nt, hsa; identical to SEQ ID NO: 182144

SEQ ID NO: 487145 - RNA, 64 nt, hsa; identical to SEQ ID NO: 182145

SEQ ID NO: 487146 - RNA, 64 nt, hsa; identical to SEQ ID NO: 182146

SEQ ID NO: 487147 - RNA, 64 nt, hsa; identical to SEQ ID NO: 182147

SEQ ID NO: 487148 - RNA, 64 nt, hsa; identical to SEQ ID NO: 182148

SEQ ID NO: 487149 - RNA, 64 nt, hsa; identical to SEQ ID NO: 182149

SEQ ID NO: 487150 - RNA, 64 nt, hsa; identical to SEQ ID NO: 182150

SEQ ID NO: 487151 - RNA, 64 nt, hsa; identical to SEQ ID NO: 182151

SEQ ID NO: 487152 - RNA, 64 nt, hsa; identical to SEQ ID NO: 182152

SEQ ID NO: 487153 - RNA, 64 nt, hsa; identical to SEQ ID NO: 182153

SEQ ID NO: 487154 - RNA, 64 nt, hsa; identical to SEQ ID NO: 182154

SEQ ID NO: 487155 - RNA, 64 nt, hsa; identical to SEQ ID NO: 182155

SEQ ID NO: 487156 - RNA, 64 nt, hsa; identical to SEQ ID NO: 182156

SEQ ID NO: 487157 - RNA, 64 nt, hsa; identical to SEQ ID NO: 182157

SEQ ID NO: 487158 - RNA, 64 nt, hsa; identical to SEQ ID NO: 182158

SEQ ID NO: 487159 - RNA, 64 nt, hsa; identical to SEQ ID NO: 182159

SEQ ID NO: 487160 - RNA, 64 nt, hsa; identical to SEQ ID NO: 182160

SEQ ID NO: 487161 - RNA, 64 nt, hsa; identical to SEQ ID NO: 182161

SEQ ID NO: 487162 - RNA, 57 nt, hsa; identical to SEQ ID NO: 182162

SEQ ID NO: 487163 - RNA, 64 nt, hsa; identical to SEQ ID NO: 182163

SEQ ID NO: 487164 - RNA, 64 nt, hsa; identical to SEQ ID NO: 182164

SEQ ID NO: 487165 - RNA, 64 nt, hsa; identical to SEQ ID NO: 182165

SEQ ID NO: 487166 - RNA, 64 nt, hsa; identical to SEQ ID NO: 182166

SEQ ID NO: 487167 - RNA, 64 nt, hsa; identical to SEQ ID NO: 182167

SEQ ID NO: 487168 - RNA, 62 nt, hsa; identical to SEQ ID NO: 182168

SEQ ID NO: 487169 - RNA, 64 nt, hsa; identical to SEQ ID NO: 182169

SEQ ID NO: 487170 - RNA, 64 nt, hsa; identical to SEQ ID NO: 182170

SEQ ID NO: 487171 - RNA, 64 nt, hsa; identical to SEQ ID NO: 182171

SEQ ID NO: 487172 - RNA, 64 nt, hsa; identical to SEQ ID NO: 182172

SEQ ID NO: 487173 - RNA, 64 nt, hsa; identical to SEQ ID NO: 182173

SEQ ID NO: 487174 - RNA, 64 nt, hsa; identical to SEQ ID NO: 182174

SEQ ID NO: 487175 - RNA, 64 nt, hsa; identical to SEQ ID NO: 182175

SEQ ID NO: 487176 - RNA, 64 nt, hsa; identical to SEQ ID NO: 182176

SEQ ID NO: 487177 - RNA, 64 nt, hsa; identical to SEQ ID NO: 182177

SEQ ID NO: 487178 - RNA, 64 nt, hsa; identical to SEQ ID NO: 182178

SEQ ID NO: 487179 - RNA, 64 nt, hsa; identical to SEQ ID NO: 182179

SEQ ID NO: 487180 - RNA, 64 nt, hsa; identical to SEQ ID NO: 182180

SEQ ID NO: 487181 - RNA, 64 nt, hsa; identical to SEQ ID NO: 182181

SEQ ID NO: 487182 - RNA, 64 nt, hsa; identical to SEQ ID NO: 182182

SEQ ID NO: 487183 - RNA, 64 nt, hsa; identical to SEQ ID NO: 182183

SEQ ID NO: 487184 - RNA, 64 nt, hsa; identical to SEQ ID NO: 182184

SEQ ID NO: 487185 - RNA, 64 nt, hsa; identical to SEQ ID NO: 182185

SEQ ID NO: 487186 - RNA, 64 nt, hsa; identical to SEQ ID NO: 182186

SEQ ID NO: 487187 - RNA, 64 nt, hsa; identical to SEQ ID NO: 182187

SEQ ID NO: 487188 - RNA, 64 nt, hsa; identical to SEQ ID NO: 182188

SEQ ID NO: 487189 - RNA, 64 nt, hsa; identical to SEQ ID NO: 182189

SEQ ID NO: 487190 - RNA, 64 nt, hsa; identical to SEQ ID NO: 182190

SEQ ID NO: 487191 - RNA, 64 nt, hsa; identical to SEQ ID NO: 182191

SEQ ID NO: 487192 - RNA, 64 nt, hsa; identical to SEQ ID NO: 182192

SEQ ID NO: 487193 - RNA, 64 nt, hsa; identical to SEQ ID NO: 182193

SEQ ID NO: 487194 - RNA, 64 nt, hsa; identical to SEQ ID NO: 182194

SEQ ID NO: 487195 - RNA, 64 nt, hsa; identical to SEQ ID NO: 182195

SEQ ID NO: 487196 - RNA, 64 nt, hsa; identical to SEQ ID NO: 182196

SEQ ID NO: 487197 - RNA, 64 nt, hsa; identical to SEQ ID NO: 182197

SEQ ID NO: 487198 - RNA, 64 nt, hsa; identical to SEQ ID NO: 182198

SEQ ID NO: 487199 - RNA, 64 nt, hsa; identical to SEQ ID NO: 182199

SEQ ID NO: 487200 - RNA, 64 nt, hsa; identical to SEQ ID NO: 182200

SEQ ID NO: 487201 - RNA, 64 nt, hsa; identical to SEQ ID NO: 182201

SEQ ID NO: 487202 - RNA, 64 nt, hsa; identical to SEQ ID NO: 182202

SEQ ID NO: 487203 - RNA, 64 nt, hsa; identical to SEQ ID NO: 182203

SEQ ID NO: 487204 - RNA, 64 nt, hsa; identical to SEQ ID NO: 182204

SEQ ID NO: 487205 - RNA, 64 nt, hsa; identical to SEQ ID NO: 182205

SEQ ID NO: 487206 - RNA, 64 nt, hsa; identical to SEQ ID NO: 182206

SEQ ID NO: 487207 - RNA, 64 nt, hsa; identical to SEQ ID NO: 182207

SEQ ID NO: 487208 - RNA, 64 nt, hsa; identical to SEQ ID NO: 182208

SEQ ID NO: 487209 - RNA, 64 nt, hsa; identical to SEQ ID NO: 182209

SEQ ID NO: 487210 - RNA, 64 nt, hsa; identical to SEQ ID NO: 182210

SEQ ID NO: 487211 - RNA, 64 nt, hsa; identical to SEQ ID NO: 182211

SEQ ID NO: 487212 - RNA, 64 nt, hsa; identical to SEQ ID NO: 182212

SEQ ID NO: 487213 - RNA, 64 nt, hsa; identical to SEQ ID NO: 182213

SEQ ID NO: 487214 - RNA, 64 nt, hsa; identical to SEQ ID NO: 182214

SEQ ID NO: 487215 - RNA, 64 nt, hsa; identical to SEQ ID NO: 182215

SEQ ID NO: 487216 - RNA, 64 nt, hsa; identical to SEQ ID NO: 182216

SEQ ID NO: 487217 - RNA, 64 nt, hsa; identical to SEQ ID NO: 182217

SEQ ID NO: 487218 - RNA, 64 nt, hsa; identical to SEQ ID NO: 182218

SEQ ID NO: 487219 - RNA, 64 nt, hsa; identical to SEQ ID NO: 182219

SEQ ID NO: 487220 - RNA, 64 nt, hsa; identical to SEQ ID NO: 182220

SEQ ID NO: 487221 - RNA, 64 nt, hsa; identical to SEQ ID NO: 182221

SEQ ID NO: 487222 - RNA, 64 nt, hsa; identical to SEQ ID NO: 182222

SEQ ID NO: 487223 - RNA, 64 nt, hsa; identical to SEQ ID NO: 182223

SEQ ID NO: 487224 - RNA, 64 nt, hsa; identical to SEQ ID NO: 182224

SEQ ID NO: 487225 - RNA, 64 nt, hsa; identical to SEQ ID NO: 182225

SEQ ID NO: 487226 - RNA, 64 nt, hsa; identical to SEQ ID NO: 182226

SEQ ID NO: 487227 - RNA, 64 nt, hsa; identical to SEQ ID NO: 106040

SEQ ID NO: 487228 - RNA, 64 nt, hsa; identical to SEQ ID NO: 106041

SEQ ID NO: 487229 - RNA, 64 nt, hsa; identical to SEQ ID NO: 106042

SEQ ID NO: 487230 - RNA, 64 nt, hsa; identical to SEQ ID NO: 106043

SEQ ID NO: 487231 - RNA, 64 nt, hsa; identical to SEQ ID NO: 106044

SEQ ID NO: 487232 - RNA, 64 nt, hsa; identical to SEQ ID NO: 106045

SEQ ID NO: 487233 - RNA, 64 nt, hsa; identical to SEQ ID NO: 106046

SEQ ID NO: 487234 - RNA, 64 nt, hsa; identical to SEQ ID NO: 106047

SEQ ID NO: 487235 - RNA, 64 nt, hsa; identical to SEQ ID NO: 106048

SEQ ID NO: 487236 - RNA, 64 nt, hsa; identical to SEQ ID NO: 106049

SEQ ID NO: 487237 - RNA, 64 nt, hsa; identical to SEQ ID NO: 106050

SEQ ID NO: 487238 - RNA, 64 nt, hsa; identical to SEQ ID NO: 106051

SEQ ID NO: 487239 - RNA, 64 nt, hsa; identical to SEQ ID NO: 106052

SEQ ID NO: 487240 - RNA, 64 nt, hsa; identical to SEQ ID NO: 106053

SEQ ID NO: 487241 - RNA, 64 nt, hsa; identical to SEQ ID NO: 106054

SEQ ID NO: 487242 - RNA, 64 nt, hsa; identical to SEQ ID NO: 106055

SEQ ID NO: 487243 - RNA, 64 nt, hsa; identical to SEQ ID NO: 106056

SEQ ID NO: 487244 - RNA, 64 nt, hsa; identical to SEQ ID NO: 106057

SEQ ID NO: 487245 - RNA, 64 nt, hsa; identical to SEQ ID NO: 106058

SEQ ID NO: 487246 - RNA, 64 nt, hsa; identical to SEQ ID NO: 106059

SEQ ID NO: 487247 - RNA, 64 nt, hsa; identical to SEQ ID NO: 106060

SEQ ID NO: 487248 - RNA, 64 nt, hsa; identical to SEQ ID NO: 106061

SEQ ID NO: 487249 - RNA, 64 nt, hsa; identical to SEQ ID NO: 106062

SEQ ID NO: 487250 - RNA, 64 nt, hsa; identical to SEQ ID NO: 106063

SEQ ID NO: 487251 - RNA, 64 nt, hsa; identical to SEQ ID NO: 106064

SEQ ID NO: 487252 - RNA, 64 nt, hsa; identical to SEQ ID NO: 106065

SEQ ID NO: 487253 - RNA, 64 nt, hsa; identical to SEQ ID NO: 106066

SEQ ID NO: 487254 - RNA, 64 nt, hsa; identical to SEQ ID NO: 106067

SEQ ID NO: 487255 - RNA, 64 nt, hsa; identical to SEQ ID NO: 106068

SEQ ID NO: 487256 - RNA, 64 nt, hsa; identical to SEQ ID NO: 106069

SEQ ID NO: 487257 - RNA, 64 nt, hsa; identical to SEQ ID NO: 106070

SEQ ID NO: 487258 - RNA, 64 nt, hsa; identical to SEQ ID NO: 106071

SEQ ID NO: 487259 - RNA, 64 nt, hsa; identical to SEQ ID NO: 106072

SEQ ID NO: 487260 - RNA, 64 nt, hsa; identical to SEQ ID NO: 106073

SEQ ID NO: 487261 - RNA, 64 nt, hsa; identical to SEQ ID NO: 106074

SEQ ID NO: 487262 - RNA, 64 nt, hsa; identical to SEQ ID NO: 106075

SEQ ID NO: 487263 - RNA, 64 nt, hsa; identical to SEQ ID NO: 106076

SEQ ID NO: 487264 - RNA, 64 nt, hsa; identical to SEQ ID NO: 106077

SEQ ID NO: 487265 - RNA, 64 nt, hsa; identical to SEQ ID NO: 106078

SEQ ID NO: 487266 - RNA, 64 nt, hsa; identical to SEQ ID NO: 106079

SEQ ID NO: 487267 - RNA, 64 nt, hsa; identical to SEQ ID NO: 106080

SEQ ID NO: 487268 - RNA, 64 nt, hsa; identical to SEQ ID NO: 106081

SEQ ID NO: 487269 - RNA, 64 nt, hsa; identical to SEQ ID NO: 106082

SEQ ID NO: 487270 - RNA, 64 nt, hsa; identical to SEQ ID NO: 106083

SEQ ID NO: 487271 - RNA, 64 nt, hsa; identical to SEQ ID NO: 106084

SEQ ID NO: 487272 - RNA, 64 nt, hsa; identical to SEQ ID NO: 106085

SEQ ID NO: 487273 - RNA, 64 nt, hsa; identical to SEQ ID NO: 106086

SEQ ID NO: 487274 - RNA, 64 nt, hsa; identical to SEQ ID NO: 106087

SEQ ID NO: 487275 - RNA, 64 nt, hsa; identical to SEQ ID NO: 106088

SEQ ID NO: 487276 - RNA, 64 nt, hsa; identical to SEQ ID NO: 288178

SEQ ID NO: 487277 - RNA, 64 nt, hsa; identical to SEQ ID NO: 288179

SEQ ID NO: 487278 - RNA, 64 nt, hsa; identical to SEQ ID NO: 288180

SEQ ID NO: 487279 - RNA, 64 nt, hsa; identical to SEQ ID NO: 288181

SEQ ID NO: 487280 - RNA, 64 nt, hsa; identical to SEQ ID NO: 288182

SEQ ID NO: 487281 - RNA, 64 nt, hsa; identical to SEQ ID NO: 288183

SEQ ID NO: 487282 - RNA, 64 nt, hsa; identical to SEQ ID NO: 288184

SEQ ID NO: 487283 - RNA, 64 nt, hsa; identical to SEQ ID NO: 288185

SEQ ID NO: 487284 - RNA, 64 nt, hsa; identical to SEQ ID NO: 288186

SEQ ID NO: 487285 - RNA, 64 nt, hsa; identical to SEQ ID NO: 288187

SEQ ID NO: 487286 - RNA, 64 nt, hsa; identical to SEQ ID NO: 288188

SEQ ID NO: 487287 - RNA, 64 nt, hsa; identical to SEQ ID NO: 288189

SEQ ID NO: 487288 - RNA, 64 nt, hsa; identical to SEQ ID NO: 288190

SEQ ID NO: 487289 - RNA, 64 nt, hsa; identical to SEQ ID NO: 288191

SEQ ID NO: 487290 - RNA, 64 nt, hsa; identical to SEQ ID NO: 288192

SEQ ID NO: 487291 - RNA, 64 nt, hsa; identical to SEQ ID NO: 288193

SEQ ID NO: 487292 - RNA, 64 nt, hsa; identical to SEQ ID NO: 288194

SEQ ID NO: 487293 - RNA, 64 nt, hsa; identical to SEQ ID NO: 288195

SEQ ID NO: 487294 - RNA, 64 nt, hsa
uuuagaagaaaaauuaaguacagaaaagcccagauuuaaauacauuuaauaugucauuuuaaaa

SEQ ID NO: 487295 - RNA, 64 nt, hsa
caugcuguuaugauuucaccuggugaaucaguguuuuaaauaagaaagguaauaguugguaagg

SEQ ID NO: 487296 - RNA, 64 nt, hsa
gaguuauucuuuacauacaauauaguucauaaauuuuaaauauauuguuuaauaaauuuugaua

SEQ ID NO: 487297 - RNA, 64 nt, hsa
cuagucuuucucuugcugcccuguauccuuugccuuuaaauaaaaaucuuaagugauuaugcuc

SEQ ID NO: 487298 - RNA, 64 nt, hsa
uccauuggaaauggaauucauugccuuaggucuuuuuaaauaguguauuauuaucguuggggcu

SEQ ID NO: 487299 - RNA, 64 nt, hsa
guuaauauggugauaauggaaagucaaguuaaauuuuaaauauuaagaauucugauuuauugag

SEQ ID NO: 487300 - RNA, 64 nt, hsa
cugacaaugugaaacucgaagaaaauguucucuuuuuaaauauacagucauaaacuguucaagg

SEQ ID NO: 487301 - RNA, 64 nt, hsa
uaauauaugcagaccaacaggucuuugcauuccuuuuaaauaacugguugugacaaagcuuguu

SEQ ID NO: 487302 - RNA, 64 nt, hsa
gugaaguucuugcaaacucuuacuacagaaauguuuuaaauacauucucaggcauguuugcaaa

SEQ ID NO: 487303 - RNA, 64 nt, hsa
guuuguugagcuuuaaaauguauuugaaguaauauuuaaauaggcauuuaaaauuucaaauuag

SEQ ID NO: 487304 - RNA, 64 nt, hsa
uuaugauuauuacuggauuugucauuuuugauaauuuaaauauugcugcugcuuuguagaugau

SEQ ID NO: 487305 - RNA, 64 nt, hsa
ucaugcugaaguauaguuuuugggaaagaaugauuuuaaauaaagagauuguaaaaguaaaaaa

SEQ ID NO: 487306 - RNA, 64 nt, hsa
aaaaacaaaaaaacaagaaaaggcaacaucucauuuuaaauaguacaauucagaagggauacua

SEQ ID NO: 487307 - RNA, 64 nt, hsa
aucauuuaugcuuuuuucuagcauguauaacuuuuuuaaauaaagguaguauuuaccauuaaaa

SEQ ID NO: 487308 - RNA, 64 nt, hsa
gcaaugaauucuccauuuccuacuggaggauuuauuuaaauaaaauaugcuuauuaaacacucc

SEQ ID NO: 487309 - RNA, 64 nt, hsa
ugcacuaauucaaucacagguguuucuaucuagauuuaaauauauuugucaaugaauguggaau

SEQ ID NO: 487310 - RNA, 64 nt, hsa
auuaaaauuaaauaauuuaaaucuagcauuuaaauuuaaauaauuuaagucuagcauuuacuuu

SEQ ID NO: 487311 - RNA, 64 nt, hsa
uuuaaauuuaaauaauuuaagucuagcauuuacuuuuaaauaauuauaaugaaguuuugaaaua

SEQ ID NO: 487312 - RNA, 64 nt, hsa
uaucugcgaaacuauacuuguauuaaaugugcuuuuuaaauaaaagcucguaacacaacuaauu

SEQ ID NO: 487313 - RNA, 64 nt, hsa
cauuagcugcuuaaaaaagcauugaguuaauuuuuuuaaauaucaacuaaaauaucauaguucu

SEQ ID NO: 487314 - RNA, 64 nt, hsa
cugugacuuuaguucaggaaguuuuguuuuguguuuuaaauaaaaggaaagagcaaguuugcuc

SEQ ID NO: 487315 - RNA, 64 nt, hsa
uuucaugacuccgaaguauuuuacagaaacauuuuuuaaauaagggaaauauuuuauauaccag

SEQ ID NO: 487316 - RNA, 64 nt, hsa
cuaaucugauuuucacucugauuuuuaacguuucuuuaaauauuuauaauguagcuucuuucaa

SEQ ID NO: 487317 - RNA, 64 nt, hsa
uagcaauaacauggucaaaaaggcaaucagaaauuuuaaauacaguuaauggauacauuuggca

SEQ ID NO: 487318 - RNA, 64 nt, hsa
uuuagugugguuugaaauuaccucuuucauauguuuuaaauaaagugaaauuuauguauguuuu

SEQ ID NO: 487319 - RNA, 64 nt, hsa
uaaaguuuuauuggggcacacccaugcucacccuuuuaaauauuguguauggccgcuuugugcu

SEQ ID NO: 487320 - RNA, 64 nt, hsa
caagcuauugcagucagcugccaguuuuuacuuuuuuaaauaguugggaaaaaaauuccaaaga

SEQ ID NO: 487321 - RNA, 64 nt, hsa
auuaauugaaguuaugcuucuauacugggacauauuuaaauacugaguauaguacugcugcuac

SEQ ID NO: 487322 - RNA, 64 nt, hsa
uuauaccucaacuaccuuucaguccugucuggguuuuaaauaagugaaguagaagaaauugagu

SEQ ID NO: 487323 - RNA, 64 nt, hsa
cauagcugugauuuuugguauuugaaacacugguuuuaaauauuuugacuuguugaggguaugu

SEQ ID NO: 487324 - RNA, 64 nt, hsa
aauaacuggaacacucuauaacaaaggauacuuauuuaaauagaugacauugacuauuuuuguu

SEQ ID NO: 487325 - RNA, 64 nt, hsa
guuaaaauguuccuguaaaagaaacauugguaaauuuaaauacauacuguucuaauuuuguauu

SEQ ID NO: 487326 - RNA, 64 nt, hsa
auuaaugcaaaucaugcagaauuugaguuauaaauuuaaauauaaauugaccauugaugauauc

SEQ ID NO: 487327 - RNA, 64 nt, hsa
gccaaaguccacauauggauauuuggggauguuauuuaaauacucagcaggcugagugcaggua

SEQ ID NO: 487328 - RNA, 64 nt, hsa
uuuucuaggguugucuaugacagaaugaccaucuuuuaaauauuaauggaguauaaauggaguc

SEQ ID NO: 487329 - RNA, 64 nt, hsa
gaaauucugauucuaggcagaggaaggggaacaauuuaaauauuggugcaucucagaugcacuu

SEQ ID NO: 487330 - RNA, 64 nt, hsa
gugacaaaugccaauagauaugugaguuaauuuuuuuaaauaucuccgugaguuguaaauagau

SEQ ID NO: 487331 - RNA, 64 nt, hsa
gcuauaaaacaaaaaaagguugcuguuuucuauuuuuaaauaaaccaaaaaaaaacagaaaaga

SEQ ID NO: 487332 - RNA, 64 nt, hsa
aagauuugucuaguaaaaauuguaauugaauauguuuaaauauuuaauuucucauuuugggggg

SEQ ID NO: 487333 - RNA, 64 nt, hsa
uauauucuaaauccuaguaaaauugacagugauuuuuaaauauaaugcaucuuccuuugucugc

SEQ ID NO: 487334 - RNA, 64 nt, hsa
auuggguggggggauaaaaaagggauucccuaacuuuaaauaaucagaauauccugcaauugaa

SEQ ID NO: 487335 - RNA, 64 nt, hsa
ccgaucuugaagaaauucaagauucaaaaagaauuuuaaauacaccaacaugagacaucaguag

SEQ ID NO: 487336 - RNA, 64 nt, hsa
uuauguuauuuuguuaugcauuuacaacuccauuuuuaaauaaaguguuucuggaacuuuauac

SEQ ID NO: 487337 - RNA, 64 nt, hsa
uaaaaacaaaacuauaauggaucuccuauuuuucuuuaaauacaaaaaaaaaaagguaaaugaa

SEQ ID NO: 487338 - RNA, 64 nt, hsa
acaauuucucuuguaaauggaaugguuugggguuuuuaaauaagcauuaacuaacaaccuuucu

SEQ ID NO: 487339 - RNA, 64 nt, hsa
uaaauuugaguguuaacggucuuuuuaaagugcauuuaaauacaaaccaggaauuucuuuagaa

SEQ ID NO: 487340 - RNA, 64 nt, hsa
aaucauuuaguggcauagaugcagccacuuguuuuuuaaauagaaguggcugucauacgugaaa

SEQ ID NO: 487341 - RNA, 64 nt, hsa
uuaaaaccuuuauugucucuccuuagucuaauuuuuuaaauauggauuaugcuugaauuacuau

SEQ ID NO: 487342 - RNA, 64 nt, hsa
uuagagcugaauuaccuacagaaacuguuucugguuuaaauaauuagcacaaauuggccuaagu

SEQ ID NO: 487343 - RNA, 64 nt, hsa
aucuuggagucuagguugccuugucucuccuauuuuuaaauaagugaaauuugggagauuguaa

SEQ ID NO: 487344 - RNA, 64 nt, hsa
aauuuuuaaaauuugauuuuaaauuucaaauaaauuuaaauaaauuuuaaauaaauuuuaaaua

SEQ ID NO: 487345 - RNA, 64 nt, hsa
uuugauuuuaaauuucaaauaaauuuaaauaaauuuuaaauaaauuuuaaauaaaauuuuacag

SEQ ID NO: 487346 - RNA, 64 nt, hsa
auuucaaauaaauuuaaauaaauuuuaaauaaauuuuaaauaaaauuuuacagagacguggucu

SEQ ID NO: 487347 - RNA, 64 nt, hsa
aguuugaaaaagaaaaucuccagcaagcaucucauuuaaauaaagguuugucaucuuuaaaaau

SEQ ID NO: 487348 - RNA, 64 nt, hsa
uaugcguauauaagcaaauauguaaucuuuauuuuuuaaauaaaugggaucauauuauauauuc

SEQ ID NO: 487349 - RNA, 64 nt, hsa
agaaucuacaaccuggagcauuucagguuugcucuuuaaauauagacaccccucaccaugagcu

SEQ ID NO: 487350 - RNA, 64 nt, hsa
caucaaagcugaacuugaaacguuuuagcagaauuuuaaauaugugaaaguucauuguggucau

SEQ ID NO: 487351 - RNA, 64 nt, hsa
uaaauagcuguccuuuccaacacauugcuacuuuuuuaaauacuguaucauaaguucagccugu

SEQ ID NO: 487352 - RNA, 64 nt, hsa
aauguacuggugugauaucuuguaugaaugaucauuuaaauacaguacauuacuguagaagcua

SEQ ID NO: 487353 - RNA, 64 nt, hsa
uuuaggggagaaggguuaugguuuuguaagaaacuuuaaauauacuuuuaggagacccacaauc

SEQ ID NO: 487354 - RNA, 64 nt, hsa
ggauaagccuucuccuuucauaagaaaggauguauuuaaauacauuuuauuuugcuaaauccug

SEQ ID NO: 487355 - RNA, 64 nt, hsa
cgcuaaaggaaauguaagagguuuuguugucuguuuuaaauaaauuuaauucggaacacaugau

SEQ ID NO: 487356 - RNA, 63 nt, hsa
acuuuaucacauguacagaucacaaauaaauuuuuuuaaauacaaaaugaacauuuauuuagu

SEQ ID NO: 487357 - RNA, 64 nt, hsa
agcacccccucccaccccugcaacaaagacuugcuuuaaauagauuucagcuaugcagaaaaau

SEQ ID NO: 487358 - RNA, 64 nt, hsa
auaaucuccucuaaaacaaccucugcauguuuuuuuuaaauaaagcacuuucugucaaauaaug

SEQ ID NO: 487359 - RNA, 64 nt, hsa
aguaaaccaaucccuugaguuauauaacaagauuuuuaaauaaauguuauuguccucaccuuca

SEQ ID NO: 487360 - RNA, 64 nt, hsa
guuuaugaaauguuacauguagaaaaauacugauuuuaaauauuuuccauauuaacaauuuaac

SEQ ID NO: 487361 - RNA, 64 nt, hsa
aaaaagucucuccccaagggcagccuuuguuacuuuuaaauauuuucuguuauuacaagugcuc

SEQ ID NO: 487362 - RNA, 64 nt, hsa
uuuucuguuauuacaagugcucuaauugugaacuuuuaaauaaaauacuauuaagagguaaugc

SEQ ID NO: 487363 - RNA, 64 nt, hsa
caccuuaaaccauggauauuuuuuccucaggggcuuuaaauaguuuccuaugcaacgugucuug

SEQ ID NO: 487364 - RNA, 64 nt, hsa
uaaguguguguguguuuucuguacccaaccagacuuuaaauaaaacaaacaugaaaccuaaugu

SEQ ID NO: 487365 - RNA, 64 nt, hsa
cucuuuauauaaauacacagaguuugguaugauauuuaaauacaucaucuggccaggcauggug

SEQ ID NO: 487366 - RNA, 64 nt, hsa
aaaacuaagacagacuguagaugcauuuuaaauauuuaaauaugauccucagacaugcagcugu

SEQ ID NO: 487367 - RNA, 64 nt, hsa
auauaaagaaaacuaagacagacuguagaugcauuuuaaauauuuaaauaugauccucagacau

SEQ ID NO: 487368 - RNA, 64 nt, hsa
cucucucucccccuaccuaccaaacuauccacaauuuaaauaaagaacugcugugucugacuua

SEQ ID NO: 487369 - RNA, 64 nt, hsa
aaaaauucagucugauaaccucaaaucaaaaagcuuuaaauaaauucuugggcauuuaucuuuu

SEQ ID NO: 487370 - RNA, 64 nt, hsa
accaaugaauguuuuguaccaucuaguuaaauuuuuuaaauaaaguuuuauggguuaagcagaa

SEQ ID NO: 487371 - RNA, 64 nt, hsa
auuuacaugauaaucugaagcuaauaugacaauauuuaaauacuaagugguacuagggaacuac

SEQ ID NO: 487372 - RNA, 64 nt, hsa
uggggaauaagugauuuuaaguacaucccauacauuuaaauaucuuugauaauuguuauuuuuu

SEQ ID NO: 487373 - RNA, 64 nt, hsa
aaaaaaaacguuucucacugucuuaaauagaauuuuuaaauaguauauauucaguggcauuuug

SEQ ID NO: 487374 - RNA, 64 nt, hsa
uuauuuuacuuacaauccucaaguuuuaauugauuuuaaauauuuuucaauacaacaguuuagg

SEQ ID NO: 487375 - RNA, 64 nt, hsa
agucagauuguauauucaaauuguaauuaagagauuuaaauauuagaacgguauguaagguagu

SEQ ID NO: 487376 - RNA, 64 nt, hsa
agaacgguauguaagguaguauaauuaccacuauuuuaaauaauucaguuaaacacugcugcaa

SEQ ID NO: 487377 - RNA, 64 nt, hsa
guaaaccagucauucugaauuauagugaugagaauuuaaauauaugcuuuucuagaauuugaug

SEQ ID NO: 487378 - RNA, 64 nt, hsa
cuguaaaaauguaaacacauuauuagcauggacuuuuaaauaaagauuuaaagaaagcaagauc

SEQ ID NO: 487379 - RNA, 64 nt, hsa
ggggugccaaauauagcauccuucuguuguuuauuuuaaauauauuuuuaaugaaaagggacuu

SEQ ID NO: 487380 - RNA, 64 nt, hsa
cuguaccuuuuuuuuuuuuuuuuacuuugaagucuuuaaauaaaauguauaauacccauugaga

SEQ ID NO: 487381 - RNA, 64 nt, hsa
aaaucuuaacauauggagcagccuuuccuaugaauuuaaauaugccuuuaaaauaagucacugu

SEQ ID NO: 487382 - RNA, 64 nt, hsa
auaauuuguguguguguauguguauguauaugacuuuaaauagcuauggguacaauauuaaaaa

SEQ ID NO: 487383 - RNA, 64 nt, hsa
caugucucaaauuuuuuuaaaaaaaauuaaugguuuuaaauauaugcuauagggacguuccaug

SEQ ID NO: 487384 - RNA, 64 nt, hsa
gguaucagaaaaaggcuuucuuucauaagacuauuuuaaauagaaauuauuucaacaauuaaag

SEQ ID NO: 487385 - RNA, 64 nt, hsa
auuacaauacuaccuucacaacauuuucauguguuuuaaauaaauauuuuuuaauuggcuaaag

SEQ ID NO: 487386 - RNA, 64 nt, hsa
aagaauaaaauaauuuggaugaaaaucauguuuauuuaaauaguaaugucaugagacuauuaaa

SEQ ID NO: 487387 - RNA, 64 nt, hsa
cagaguaugucaggaagacaacucagauugccauuuuaaauaaaguuguacaugaacaauaauu

SEQ ID NO: 487388 - RNA, 64 nt, hsa
caugggggagauugucuuccaauguuuaacuacguuuaaauaaauaaaaauugaauuuuauugu

SEQ ID NO: 487389 - RNA, 64 nt, hsa
cagugacagauauaauuuacuacauauauugauuuuuaaauaaaguugccuuaaauaaguguau

SEQ ID NO: 487390 - RNA, 64 nt, hsa
uuuuaucucucuugaugucagauuuuauagucuuuuuaaauaaauccauuuaauuaaaacguuc

SEQ ID NO: 487391 - RNA, 64 nt, hsa
caaaguaggccagauaaguuaaaaaaaauuuuuuuuuaaauaauaauugaaacuuaucucaaau

SEQ ID NO: 487392 - RNA, 64 nt, hsa
acuuuuuagguggcauuuuauucauuuccugugcuuuaaauaaacaaauguaccaaaaaacaag

SEQ ID NO: 487393 - RNA, 64 nt, hsa
gaaauuuagagaauauucucauccucuaaaaauguuuaaauauauaccaaacaguggcccccug

SEQ ID NO: 487394 - RNA, 64 nt, hsa
uuuuggcccaauguugaagauguagaacuuuguuuuuaaauaauguuuuuauaauuucauucgu

SEQ ID NO: 487395 - RNA, 64 nt, hsa
uuuuaucauuugauucauucucacauuuuuuuccuuuaaauauuuuuaguugaccuuuuuccuu

SEQ ID NO: 487396 - RNA, 64 nt, hsa
aaccuguauucuauuccuuacugagugucccuucuuuaaauaguguuugcugaauuaagccgau

SEQ ID NO: 487397 - RNA, 64 nt, hsa
ugugaaguagacccuagaaaauugucucguuuauuuuaaauagaaucuaugcuuccaccaauaa

SEQ ID NO: 487398 - RNA, 64 nt, hsa
augagaacacuacaacuguagucagcucacaauuuuuaaauaaaggauaccacagugcaugcug

SEQ ID NO: 487399 - RNA, 64 nt, hsa
uuaaaugugcaucaaucaugccuugcccccaaccuuuaaauauauucuuagaccugguaaaugc

SEQ ID NO: 487400 - RNA, 64 nt, hsa
ugugcguucaugcuuuuucguauucuuuauggcuuuuaaauaaauauacaaugguuaauaguaa

SEQ ID NO: 487401 - RNA, 64 nt, hsa
guagacuauguauuuccuauaaugaugucugauauuuaaauaggaaaucagacaaacaauauuc

SEQ ID NO: 487402 - RNA, 64 nt, hsa
ggcccaauuucacucaaauguuuugagaacuguguuuaaauaaacgcaaaugaaaagaaaaaug

SEQ ID NO: 487403 - RNA, 64 nt, hsa
ucauggaugaacugaagacuuugccuguucauuuuuuaaauauuauuuucagguccuuugcuua

SEQ ID NO: 487404 - RNA, 64 nt, hsa
ucacuugacuuugcaauggugcuaagcugauagauuuaaauacacagacgggcgaguggcgccc

SEQ ID NO: 487405 - RNA, 64 nt, hsa
cuuaacaugaucaauguauuucucugccuugacauuuaaauacauaaauugagauaaguagauu

SEQ ID NO: 487406 - RNA, 64 nt, hsa
auuuauuugaaucuacaaaaaacaacaaauaauuuuuaaauauaaggauuuuccuagauauugc

SEQ ID NO: 487407 - RNA, 64 nt, hsa
uagauucuuauaauauuauuuaaaugacugcauuuuuaaauacaaggcuuuauauuuuuaacuu

SEQ ID NO: 487408 - RNA, 64 nt, hsa
aauacagcugaagucaaaauauguaagaacacauuuuaaauacucuacuuacaguuggcccucu

SEQ ID NO: 487409 - RNA, 64 nt, hsa
guauauuuuaauguuuuuaaaaagaguaauuucauuuaaauaucuguuauucaaauuugaugau

SEQ ID NO: 487410 - RNA, 64 nt, hsa
acuggaccaacauucuuguuuuugcuuuuguuuuuuuaaauaauucuagucuggagcuaacugu

SEQ ID NO: 487411 - RNA, 64 nt, hsa
aagucuaguuuguauguagguaugaagggaauuuuuuaaauaaauugaaaagcugugaacagca

SEQ ID NO: 487412 - RNA, 64 nt, hsa
aaacugaagauaaugaaauaguuauuuuaauaccuuuaaauaucauucuuuguaucuuaaaucu

SEQ ID NO: 487413 - RNA, 64 nt, hsa
ccacuuaaucuucucucuugauugauuuuuaaaguuuaaauaccaguacuugagggaccaauau

SEQ ID NO: 487414 - RNA, 64 nt, hsa
guuuuguuuuuauuuuugcugaugaagagauauguuuaaauauguuguauuguuuuguuuaguu

SEQ ID NO: 487415 - RNA, 64 nt, hsa
cuaaaguacauugcauguuuuccuaaauacagaguuuaaauaauuucaguaauucuuagaugau

SEQ ID NO: 487416 - RNA, 64 nt, hsa
uacacaaaacacuuugauuuuacaagagaggagcuuuaaauaagaugauuuuaguagauugaaa

SEQ ID NO: 487417 - RNA, 64 nt, hsa
uuuuaaagauggaauaauuuuaauacauauuuuguuuaaauauaaucuauaauuguuuuguaau

SEQ ID NO: 487418 - RNA, 64 nt, hsa
ugcaaaagauuuaugaugaacagaauauacaaauuuuaaauaaauuaauagaaucaguaguaau

SEQ ID NO: 487419 - RNA, 64 nt, hsa
gaugaugaaaaugcagaaugucuuuuuaaauguuuuuaaauauaaacaaauauucuuuacuaaa

SEQ ID NO: 487420 - RNA, 64 nt, hsa
uacccaaguuucuucaugaguugacaugagcuguuuuaaauacugguguauuuucagaacagua

SEQ ID NO: 487421 - RNA, 64 nt, hsa
auagugauuuuaaauaaucacuaaaaucacuagauuuaaauaaucacuaaaaugauuugugaga

SEQ ID NO: 487422 - RNA, 64 nt, hsa
ucagccuaugcuuaaugcaagcuaggauagugauuuuaaauaaucacuaaaaucacuagauuua

SEQ ID NO: 487423 - RNA, 64 nt, hsa
auuccuuuguguacuugguuuuucaccacugagcuuuaaauaagaauggaaauacaagggaaaa

SEQ ID NO: 487424 - RNA, 64 nt, hsa
accuaauacccacaaaacuuaaaauauaaaauguuuuaaauaaaaauaaagaaaagauuuccca

SEQ ID NO: 487425 - RNA, 64 nt, hsa
aauauuuacauuuaauaugggaacauaaaagagcuuuaaauauuauagacuuuguaccuguuau

SEQ ID NO: 487426 - RNA, 64 nt, hsa
uuacuauguauauuaugcuuagcuuuuaaggcauuuuaaauaaccaugaauguugauuucauua

SEQ ID NO: 487427 - RNA, 64 nt, hsa
uucuugcacugagguuuuuuugcuuggggauuauuuuaaauaauugguuuuuguguuuucugaa

SEQ ID NO: 487428 - RNA, 64 nt, hsa
cuccauuuacuuaagguaauccaauaaggucuuuuuuaaauauacaaauuuuacucaaguuuaa

SEQ ID NO: 487429 - RNA, 64 nt, hsa
uaaguaaaaauguaguacuccauuguuuuugcuauuuaaauauaauguaucaaaaaccuuuauu

SEQ ID NO: 487430 - RNA, 64 nt, hsa
ccauaugacacugguuccgauuuuaaaaauuauuuuuaaauaaccgauuauugauuacuguauu

SEQ ID NO: 487431 - RNA, 64 nt, hsa
uaaacacaaaagcuuuauacaaaauauuguugaauuuaaauaagguaaaucuuuuuuaguuuau

SEQ ID NO: 487432 - RNA, 64 nt, hsa
ucuccccaccuccacacacuacauuuuuuuuagauuuaaauaguuuuacuauuuuaaaugauug

SEQ ID NO: 487433 - RNA, 64 nt, hsa
gauugccguacaauuaguagacuugaagacaaguuuuaaauauuuuucuucaaaggcuuguuaa

SEQ ID NO: 487434 - RNA, 64 nt, hsa
ucuccgcaggcuauuuguucagagaggccuuuuguuuaaauauaaauguuuaaauauaaauguu

SEQ ID NO: 487435 - RNA, 64 nt, hsa
uuguucagagaggccuuuuguuuaaauauaaauguuuaaauauaaauguuugucuggauuggcu

SEQ ID NO: 487436 - RNA, 64 nt, hsa
ugacaucaguauaaaagugccaaaccugcccucuuuuaaauaaaaauguaaaaaggccacuccc

SEQ ID NO: 487437 - RNA, 64 nt, hsa
auugcaugaaaacauuaugacuuuuuucucuuaguuuaaauaaacuccaagguaacuggacuuc

SEQ ID NO: 487438 - RNA, 64 nt, hsa
ugaagauuuuuuaaauucuaucuugcugauuuuuuuuaaauauaagaaacugguacuugguaaa

SEQ ID NO: 487439 - RNA, 64 nt, hsa
acuguauauuucuuaaaugaagagacuuucauucuuuaaauauuauugacuuacaguuuaaaaa

SEQ ID NO: 487440 - RNA, 64 nt, hsa
uguagagcacauuuaguccaaugaagauaaaugcuuuaaauaguuuacuucacuuucaucugag

SEQ ID NO: 487441 - RNA, 64 nt, hsa
uagcaauauauuuguagguauacuauguaagggcuuuaaauaaaagagguccauuaauacuucc

SEQ ID NO: 487442 - RNA, 64 nt, hsa
ugcaucaguaaagcagcauauucaaauguggauuuuuaaauauuuuaauuacuauuuaaauauc

SEQ ID NO: 487443 - RNA, 64 nt, hsa
uucaaauguggauuuuuaaauauuuuaauuacuauuuaaauaucucuuuacuuuguaauccuau

SEQ ID NO: 487444 - RNA, 64 nt, hsa
uucauuuuaguuacuguguuuuauuuugaaaauauuuaaauauugcacuucuauaaauaguaug

SEQ ID NO: 487445 - RNA, 64 nt, hsa
aauuugaaagcuguacaaaguaauagaaguuccauuuaaauaugaguucaaaacuguauuuacu

SEQ ID NO: 487446 - RNA, 64 nt, hsa
uauauguguuggccuauuauugauguaaaaguuauuuaaauaaguuaauguuagaaacauuauu

SEQ ID NO: 487447 - RNA, 64 nt, hsa
aguuauaccagggagagagugacuaaccacauucuuuaaauaucaauagcuuagucagauugau

SEQ ID NO: 487448 - RNA, 64 nt, hsa
cauuaacaaaacaaucacugaaaaacagcagauguuuaaauagauuauuuuauagcuuauuuug

SEQ ID NO: 487449 - RNA, 64 nt, hsa
cacuggucuagcuuuagauaggauauugagccaauuuaaauaaagcaauauacuggucuagcug

SEQ ID NO: 487450 - RNA, 64 nt, hsa
cucuuacagccuuuggaauacauuguuuccauuuuuuaaauaucuucuauauccauauaguauu

SEQ ID NO: 487451 - RNA, 64 nt, hsa
aaacuuauucugaaauaaaguaaaauucuaauuguuuaaauacugugaugaauucuggauguua

SEQ ID NO: 487452 - RNA, 64 nt, hsa
uuaucuacauauauagguacaugccauccauuauuuuaaauaaacuaauagguuuucagaauua

SEQ ID NO: 487453 - RNA, 64 nt, hsa
gagaauuauuuuuaacugaacguuuuuguuguuuuuuaaauaaaguagccauauguaacgggau

SEQ ID NO: 487454 - RNA, 64 nt, hsa
gcugaucugcaucuguuuauccauuuuaguagcuuuuaaauaugauuuuaugugaagugccauu

SEQ ID NO: 487455 - RNA, 64 nt, hsa
gauccuaguguuuuaauuaccugugugcagcuauuuuaaauagcauuuuacuugaauaauaugu

SEQ ID NO: 487456 - RNA, 64 nt, hsa
aaugaaaaauuuuuaaaaaaagaaggaaaaauguuuuaaauacaaaaggaaaaacagacaaaaa

SEQ ID NO: 487457 - RNA, 64 nt, hsa
gagcugguugacugagacgcacgaacuuuuuaauuuuaaauauauuuuuaggaaacucucgcag

SEQ ID NO: 487458 - RNA, 64 nt, hsa
guauguaacagaacacauuucagauuguauuuaauuuaaauauuuguauauaagagcaaauguc

SEQ ID NO: 487459 - RNA, 64 nt, hsa
uaagagcaaaugucugaauguggccugaaucaaguuuaaauauuguuggcucauacugauuaug

SEQ ID NO: 487460 - RNA, 64 nt, hsa
uauucuuagggcuuuuguguaugucugacuuguuuuuaaauaacuuccucagcaaugcagaccu

SEQ ID NO: 487461 - RNA, 64 nt, hsa
ucaaugauauugguagaaauaguaaaauacauccuuuaaauauauaucuaagcauauauuuuaa

SEQ ID NO: 487462 - RNA, 64 nt, hsa
aaaauacagccuuugguucaguagauuuuaaugcuuuaaauagacugacgucgcauacccuuau

SEQ ID NO: 487463 - RNA, 64 nt, hsa
guccucguaauaccauuuggauuuuauuucugaauuuaaauaguaaaauauuuaugaugcugau

SEQ ID NO: 487464 - RNA, 64 nt, hsa
aggggucugagguuguuuuuacuuuauuguguuguuuaaauauuuuaaaaauaucuuuagcguu

SEQ ID NO: 487465 - RNA, 64 nt, hsa
aacaacauugcacuuucuguauaugaaaucaauauuuaaauaacuuauuuuucuccauugcugu

SEQ ID NO: 487466 - RNA, 64 nt, hsa
uuuuuaagcuugacaaaugcacugauuguuauacuuuaaauaacuaaaaaucugagaauccaca

SEQ ID NO: 487467 - RNA, 64 nt, hsa
ugggaaauuuauuuucuacgcuauucaaagauauuuuaaauaauauuuuaaaaacaugaaauuu

SEQ ID NO: 487468 - RNA, 64 nt, hsa
acgugacaguucuucacaauuccuuucaucauuuuuuaaauauuuuuuuuacugccuaugggcu

SEQ ID NO: 487469 - RNA, 64 nt, hsa
uuucaugaugugguaacuacgaagugaugguagauuuaaauaauuuuuuauuuuuauuuuauau

SEQ ID NO: 487470 - RNA, 64 nt, hsa
ugaagucacuucaucuucucuccugccuuauuuuuuuaaauaaguuuuuagguccugacacuga

SEQ ID NO: 487471 - RNA, 64 nt, hsa
aauuuagugauaugguaaugaaauugguauuuauuuuaaauauuaguuauucuaaggagaaaaa

SEQ ID NO: 487472 - RNA, 64 nt, hsa
aguuacuguaaugcaauucaacuuugaguuaucuuuuaaauaugucuuguauaguucauauuca

SEQ ID NO: 487473 - RNA, 64 nt, hsa
ugaguucuuucuccuucucucucucucuuuuuuuuuuaaauaacucuucugggaaguugguuua

SEQ ID NO: 487474 - RNA, 64 nt, hsa
aggaaauaaggaaauuguaagcuuuauuuggauuuuuaaauacauuuuuaaaauuucagaugua

SEQ ID NO: 487475 - RNA, 64 nt, hsa
agcucuuaagaaauacaaggacuucagauccauuuuuaaauaagaauuuucgauuuuucuuucc

SEQ ID NO: 487476 - RNA, 64 nt, hsa
aaacuaagguuauuugaauguucuguuuucucuuuuuaaauauuuuauaacuuuuaaauggaaa

SEQ ID NO: 487477 - RNA, 64 nt, hsa
uaaaauaauaccauugauauucuuguuuauucuuuuuaaauaaaaaugucacaaguuuaauaga

SEQ ID NO: 487478 - RNA, 64 nt, hsa
cccuuaacauggcucaauaacuuaaaaacguucauuuaaauaaaauuuuaauacuuguuugaca

SEQ ID NO: 487479 - RNA, 64 nt, hsa
aaagacuaaucaauuguuuugccucaccagucauuuuaaauaguagaauacuuauuucucagug

SEQ ID NO: 487480 - RNA, 64 nt, hsa
gguugcaauugaacauauuaggaauacaggugguuuuaaauauauagaugcaaauugcagcacu

SEQ ID NO: 487481 - RNA, 64 nt, hsa
guuuuaaauauauagaugcaaauugcagcacuacuuuaaauauuagauuaugucucacauagca

SEQ ID NO: 487482 - RNA, 64 nt, hsa
aagaagggaaguuuucuaguauuguaugaaaauguuuaaauauuuucaaggaagcuaguacauu

SEQ ID NO: 487483 - RNA, 64 nt, hsa
uucaaguucgaauuacaguugugagauugauuuauuuaaauaaaaauaugccuuugccaguuuu

SEQ ID NO: 487484 - RNA, 64 nt, hsa
uugguuuauuuugaaaaacauggguauagaauuauuuaaauauuauuuuauuuauuuaaauauu

SEQ ID NO: 487485 - RNA, 64 nt, hsa
uggguauagaauuauuuaaauauuauuuuauuuauuuaaauauuuauuaaauauauuuauuuau

SEQ ID NO: 487486 - RNA, 64 nt, hsa
uaaauauauuuauuuauuuaaauguuauuauuacuuuaaauauuauuuuaaauauuuuggaaau

SEQ ID NO: 487487 - RNA, 64 nt, hsa
uuuauuuaaauguuauuauuacuuuaaauauuauuuuaaauauuuuggaaauacugguauuuuu

SEQ ID NO: 487488 - RNA, 64 nt, hsa
uaugucuccucuauuaagaguauuuaaaaucauauuuaaauaugaaucuauucaugcuaacauu

SEQ ID NO: 487489 - RNA, 64 nt, hsa
cuuguguaaaagggcuucaagaauauauccaauuuuuaaauauuuuaauauaucuccuaucuga

SEQ ID NO: 487490 - RNA, 64 nt, hsa
auuuaugaaauauuuaaaguuucuaaugugguauuuuaaauaaaguaucauaaauguaauaagu

SEQ ID NO: 487491 - RNA, 64 nt, hsa
accaagacccccgucucuuuaaaaauauauauauuuuaaauauacuuaaauauauauuucuaau

SEQ ID NO: 487492 - RNA, 64 nt, hsa
uuuuaaauauacuuaaauauauauuucuaauaucuuuaaauauauauauauauuuuaaagacca

SEQ ID NO: 487493 - RNA, 64 nt, hsa
aagacaggaucauacacaugacuuauaccucucauuuaaauauuuuauaguauaaaguauuuau

SEQ ID NO: 487494 - RNA, 64 nt, hsa
gagauguauuuuuaucauaguaaaugaucacaauuuuaaauaauucaucuuacaagucagguaa

SEQ ID NO: 487495 - RNA, 64 nt, hsa
auaccuacucauuuuugugggaaugguuaagcaguuuaaauaauuccuguuguauaugucuauu

SEQ ID NO: 487496 - RNA, 64 nt, hsa
uauuguagauaacuucugcuuuaaaaaaguuuucuuuaaauauaccuacucauuuuugugggaa

SEQ ID NO: 487497 - RNA, 64 nt, hsa
uuucuaaauuauuucuucacugugacagcaaagauuuaaauaagaugaauguaaaagagaaagc

SEQ ID NO: 487498 - RNA, 64 nt, hsa
agcuuggcacaaaguggagucaaucuuuuaauguuuuaaauaugcauuuucagacucaaauaau

SEQ ID NO: 487499 - RNA, 64 nt, hsa
gaauuuauccauuuauaggcuucaaaaguaaauuuuuaaauaaaauauauuagucgacuguguu

SEQ ID NO: 487500 - RNA, 64 nt, hsa
accccucauuucuuucugcccaaagaccucauucuuuaaauaaaacuuguuauuuuggcauauu

SEQ ID NO: 487501 - RNA, 64 nt, hsa
accuacuuuaaauuuuagguagaaaauuaucugauuuaaauacaaacauauuuuucucacauug

SEQ ID NO: 487502 - RNA, 64 nt, hsa
uuugugaauauuuuucauuccaucaacaagggaguuuaaauacuauaugugagacugacaaaaa

SEQ ID NO: 487503 - RNA, 64 nt, hsa
aucuauaguaugcuuuuugugguguccugcugaauuuaaauauuuauguguuuuuccuguuagg

SEQ ID NO: 487504 - RNA, 64 nt, hsa
gaaagaaaacuuuugaugaugaaacaauaaagauuuuaaauaucuauuuuaguuuguggguguu

SEQ ID NO: 487505 - RNA, 64 nt, hsa
uuuuuuuuuagauguuugauacauuuuaaguauuuuuaaauagaugaaaauucuaaaugauuuu

SEQ ID NO: 487506 - RNA, 64 nt, hsa
aguccucaaaggcauuuaaguccaauagucaugcuuuaaauauggcuuuaaauuaugccaccaa

SEQ ID NO: 487507 - RNA, 64 nt, hsa
gaauguggcuucuuauuuuggaggagcucuugcauuuaaauaccccagccaagaaaaauugcac

SEQ ID NO: 487508 - RNA, 64 nt, hsa
uucugaagacaggugcuugaacuugucaguuuguuuuaaauaaauacaauaguugaaaauuuuu

SEQ ID NO: 487509 - RNA, 64 nt, hsa
caguugucaauauuaauuuguugcaaauauuuaauuuaaauaaacauuuuuguaccaugacugu

SEQ ID NO: 487510 - RNA, 64 nt, hsa
cacagaaaaugggauugaguuaaaacuauuuuauuuuaaauauacauuuuaaagcaguucuuuu

SEQ ID NO: 487511 - RNA, 64 nt, hsa
agguuuauaaauagcuuuagugaugccuccccucuuuaaauaccugucacaccguaugaauaug

SEQ ID NO: 487512 - RNA, 64 nt, hsa
uuuaugaccaggcauaguaucuauuauauuugcuuuuaaauaggcaugauguggaaauaccauc

SEQ ID NO: 487513 - RNA, 64 nt, hsa
ccagcaguuguugacaauuguuagagguuugacuuuuaaauaauuacuuauuuuuucugauugu

SEQ ID NO: 487514 - RNA, 64 nt, hsa
gaaggaaucugaaacacuuguacuuccaauuuucuuuaaauaaucccaaauagaccagaauugg

SEQ ID NO: 487515 - RNA, 64 nt, hsa
uuuaauuucuucauaaaaauaaguuaaauauuuuuuuaaauauguauaucuaauaguacaaaau

SEQ ID NO: 487516 - RNA, 64 nt, hsa
agauauucauugcacauuaaccauuuagaggucauuuaaauaacaaaauauuguauuguaaaag

SEQ ID NO: 487517 - RNA, 64 nt, hsa
caaagaaguuuuagaauaggguuucuuuuaaguuuuuaaauaucauccuuugucuuuccauaug

SEQ ID NO: 487518 - RNA, 64 nt, hsa
gcuuuuucagccacuggaacuuuuuuuggggggauuuaaauacaggaaaacuguuuaagcaaaa

SEQ ID NO: 487519 - RNA, 64 nt, hsa
uaacugaauccacuucuuaaacaaacuacucuauuuuaaauaaggaaagaauggagaaucuaga

SEQ ID NO: 487520 - RNA, 64 nt, hsa
gagaagaggagguacuguguguuacaaaaauuuuuuuaaauaaagaauucagugucacuaguuc

SEQ ID NO: 487521 - RNA, 64 nt, hsa
cuagaauaguuuauuaccuuuucccucaugaaauuuuaaauauaugcaaauauauauaucauua

SEQ ID NO: 487522 - RNA, 64 nt, hsa
augaaggacuccaacuagaagacagauauuuacauuuaaauagauuagugggaaaacuuuaaga

SEQ ID NO: 487523 - RNA, 64 nt, hsa
acauaucaauauaauuacaguguuugggggugucuuuaaauauauuagguuauacauuagucag

SEQ ID NO: 487524 - RNA, 64 nt, hsa
gcauauuuaaaaauuaaucauuuugcauuuuacauuuaaauaugcuaacaucacugucauagaa

SEQ ID NO: 487525 - RNA, 64 nt, hsa
ugcuuuugucuauuuccucauuaauugaauauacuuuaaauauauauauuaaaguaucaaaaua

SEQ ID NO: 487526 - RNA, 64 nt, hsa
caguugauauuugguguuuaagauagcaccauuguuuaaauaccgccuauguacucccaaauga

SEQ ID NO: 487527 - RNA, 64 nt, hsa
uguuguaaauaaaaguguuguuuucaaagccaucuuuaaauaguucuuuaaaaauaggucuuuu

SEQ ID NO: 487528 - RNA, 64 nt, hsa
uaguaccuuguauuuuuguugauuuuuaucauguuuuaaauaggaauuuauaaaauauuuauga

SEQ ID NO: 487529 - RNA, 64 nt, hsa
guauuguuguaaaacuucaugaaacaaaagaccauuuaaauagugaauuauuaaaaaucuuuau

SEQ ID NO: 487530 - RNA, 64 nt, hsa
auaugucuaaauacauauguuaucccuugauuuuuuuaaauaacugagagcucuauuuauuuau

SEQ ID NO: 487531 - RNA, 64 nt, hsa
ucuuauucugcaaacauuagaccacuugauauucuuuaaauaugucauguacuuuucuuguguc

SEQ ID NO: 487532 - RNA, 64 nt, hsa
gugugaacuucuucucugaccuuuucaauaauauuuuaaauacaguuuuucuuccucaggaaau

SEQ ID NO: 487533 - RNA, 64 nt, hsa
uguauaugcuggguaguaugaacuccaaggcaauuuuaaauaggcagagagaaguuuauaguuu

SEQ ID NO: 487534 - RNA, 64 nt, hsa
guuuuggacuguuuaguagucuuuguuuuauguuuuuaaauacagaaauugcuuucacaaauuu

SEQ ID NO: 487535 - RNA, 64 nt, hsa
cuuuucuuacaaaaaaaaucuagaagacacuguguuuaaauagauauuuaaauguuuuugagau

SEQ ID NO: 487536 - RNA, 64 nt, hsa
aacuugaauuuccuauguauuuuuauugugguguuuuaaauauggggagggguauugagcauuu

SEQ ID NO: 487537 - RNA, 64 nt, hsa
ucugauuucugaauguaaaguuguuguguuuuuuuuuaaauaguaguuuguaguauuuuaaaga

SEQ ID NO: 487538 - RNA, 64 nt, hsa
uuuuuauagacauguuuuuuaaaaauccuaaguuuuuaaauaacuauggauuuguguauuuuuu

SEQ ID NO: 487539 - RNA, 64 nt, hsa
gucauuuuuguucuuuacaucaagaaauuuuauguuuaaauaugcggagaauguauauugccuc

SEQ ID NO: 487540 - RNA, 64 nt, hsa
uaucuguauuggaaauauguuccuggaaaaugcauuuaaauaauaguaaauucucuugcauguu

SEQ ID NO: 487541 - RNA, 64 nt, hsa
cugugaggaguauaacuucuuucagcccucagauuuuaaauacaagcaaauaaacucacuauuu

SEQ ID NO: 487542 - RNA, 64 nt, hsa
uuuguauuuugcauacucaaggugagaauuaaguuuuaaauaaaccuauaauauuuuaucugaa

SEQ ID NO: 487543 - RNA, 64 nt, hsa
aagaagaggaagaaauucagguacagaaaacauguuuaaauagccuaaaugauggugcuuggug

SEQ ID NO: 487544 - RNA, 64 nt, hsa
augcauauugaucacuauaauucuaaaacaauuuuuuaaauaaaccagcagguugcuaaaagaa

SEQ ID NO: 487545 - RNA, 64 nt, hsa
uagaagcuauuuauuaugagcuucuacagguauuuuuaaauagagcaagcauguugaauuuaaa

SEQ ID NO: 487546 - RNA, 64 nt, hsa
cucucuaagacauucuccaaauugauuuuaucucuuuaaauaaaaacuuuaaauaaaaguauua

SEQ ID NO: 487547 - RNA, 63 nt, hsa
ucuccaaauugauuuuaucucuuuaaauaaaaacuuuaaauaaaaguauuagaaauguuuucu

SEQ ID NO: 487548 - RNA, 64 nt, hsa
cccucuguuuuuauaaguugccaucgaaaagugauuuaaauaagcagguuaucuuuauagauuu

SEQ ID NO: 487549 - RNA, 64 nt, hsa
uuugcccugaauuugaacacucaacaucacuagauuuaaauauuuaguauauuuugauaguaaa

SEQ ID NO: 487550 - RNA, 64 nt, hsa
uauuuauguaaaguauauguauuugagugcagaauuuaaauaaggcucuaccucaaagaccuuu

SEQ ID NO: 487551 - RNA, 64 nt, hsa
uaagauuuaagauucuccuuacuacuauccuacguuuaaauaucuuugaaaguuuguauuaaau

SEQ ID NO: 487552 - RNA, 64 nt, hsa
aaagaaacauguauaagaaaccagauuuaaguguuuuaaauaaaauguaaacaguuuuuauuug

SEQ ID NO: 487553 - RNA, 64 nt, hsa
augaugugcuuguauaucgauuagcugugucacuuuuaaauaagaaguccacacaagcaagcca

SEQ ID NO: 487554 - RNA, 64 nt, hsa
aaacaaacagacaaacaaaaaaaaacacuacuauuuuaaauaguggaacuuucagcccagcguu

SEQ ID NO: 487555 - RNA, 64 nt, hsa
gcauuuaugaaggcuuaauaaauuguaaauaauuuuuaaauaaaaugaaaaugccuuuccugga

SEQ ID NO: 487556 - RNA, 64 nt, hsa
auuuacaauucaauauauaauuacacaaauaauuuuuaaauauaaucaauaguaaagacuguuc

SEQ ID NO: 487557 - RNA, 64 nt, hsa
uuaaucuagacagaaauagcuguuugguuuuguuuuuaaauagaucuauuucccuuaucacuuc

SEQ ID NO: 487558 - RNA, 64 nt, hsa
ucaggggauuuuauaaaccaauagccaaguguucuuuaaauaggaggcacccuucccauugugc

SEQ ID NO: 487559 - RNA, 64 nt, hsa
uuuauaagauuggcaauggaaaaacauuuauucuuuuaaauaauaauuuuuuuaaaacccaaga

SEQ ID NO: 487560 - RNA, 64 nt, hsa
gaaauccauuaaaaagcaaucucuguacaguguauuuaaauauuucauugacauacugugaucu

SEQ ID NO: 487561 - RNA, 64 nt, hsa
uuccuccauccuugaaucaguucucauaaugcuuuuuaaauaagaaaaauucagaagaugaauu

SEQ ID NO: 487562 - RNA, 64 nt, hsa
uaugauguacuuuguaaaaaaauugauugaagauuuuaaauaaacaggaaauuagaaguguuag

SEQ ID NO: 487563 - RNA, 64 nt, hsa
ccaaaaaaaccaaauugguaaaaauucauuuucuuuuaaauagagcaauaaguucauacugugu

SEQ ID NO: 487564 - RNA, 64 nt, hsa
ucaguguuuaacaguuuuuuguuuuguuuuguuuuuuaaauaauaacuaauugucgagcacuga

SEQ ID NO: 487565 - RNA, 64 nt, hsa
uacaggcuuucuagagaucuuuuucauuaauacuuuuaaauaccuuucagguaguuacaucaug

SEQ ID NO: 487566 - RNA, 64 nt, hsa
aaaagguucaggcuguuaacaauuccaugcaguauuuaaauacauuuacuuuggcagaguuuau

SEQ ID NO: 487567 - RNA, 64 nt, hsa
aaaguuucauaucacucaugaauugcucagcugauuuaaauaauuuguaaaauccugcuaacua

SEQ ID NO: 487568 - RNA, 64 nt, hsa
uuagcuuuaaaagaguauuuauguuggaauaauuuuuaaauaauguuuacauaacuguaagucc

SEQ ID NO: 487569 - RNA, 64 nt, hsa
cuuuccaguccaaggcaggccugaaucaacugucuuuaaauaaaauuuuaagugaugcuguauu

SEQ ID NO: 487570 - RNA, 64 nt, hsa
uuuugaaguugucaucaauugcuuuacuaagauuuuuaaauagugaaaaccuccuguuuagacu

SEQ ID NO: 487571 - RNA, 64 nt, hsa
ugcuugggguaaauuuucauugucauauguggaauuuaaauauaccaucaucuacaaagaauuc

SEQ ID NO: 487572 - RNA, 64 nt, hsa
uuuucuuaauguuguagagcauuuuguagagugguuuaaauaguugaaaauaaaguucagaaca

SEQ ID NO: 487573 - RNA, 64 nt, hsa
cuaauuacauaaugaccgauuugagauagaggccuuuaaauacauuccaugcccuccccagaaa

SEQ ID NO: 487574 - RNA, 64 nt, hsa
uucauuuugagguaacguucaguuuugcauuuuguuuaaauauugaaggccuagacaaagaacu

SEQ ID NO: 487575 - RNA, 64 nt, hsa
agacauucuuacuagcucaauuuaaauaauugauuuuaaauaggaagaaaagaggauauauuua

SEQ ID NO: 487576 - RNA, 64 nt, hsa
cuagcuucaagaguagacauucuuacuagcucaauuuaaauaauugauuuuaaauaggaagaaa

SEQ ID NO: 487577 - RNA, 64 nt, hsa
aaaacagguucagauuucaucuuuugugauuucuuuuaaauacuauucauuuuuauuuaaaugc

SEQ ID NO: 487578 - RNA, 64 nt, hsa
uaauauauguuuuaaauauagaauuuuuaauguuuuuaaauauauuuucaaaguacauaaaauc

SEQ ID NO: 487579 - RNA, 64 nt, hsa
uauuuaaguguacuaauuaacauauaauauauguuuuaaauauagaauuuuuaauguuuuuaaa

SEQ ID NO: 487580 - RNA, 64 nt, hsa
uauugauuuucccauuaacaauuuuuuuuuguuuuuuaaauacuaauauguuucacacuauagu

SEQ ID NO: 487581 - RNA, 64 nt, hsa
agguuuuaagaucaacuuuuguuacauacuguaauuuaaauaaacugcauuuacaugccuaguu

SEQ ID NO: 487582 - RNA, 64 nt, hsa
aauuuagcaauuuaaaaucuuucuuuacugcaaguuuaaauaguuguacagauaguuuauaagc

SEQ ID NO: 487583 - RNA, 64 nt, hsa
uaaauuguauuagaaaauuagcgugacuucucauuuuaaauaaaauauuuuaggaauucuaaac

SEQ ID NO: 487584 - RNA, 64 nt, hsa
ugcaugugcuucuuugauuacaaggcccaagggauuuaaauauaacaaaauguguaauuuguga

SEQ ID NO: 487585 - RNA, 64 nt, hsa
gauuugaaggaaaaaaauuuugauguaacaauuuuuuaaauaaaauuuuguuuuucuguaaugu

SEQ ID NO: 487586 - RNA, 64 nt, hsa
auuuuauaaaaauccuagguagccuauuuuaauauuuaaauauauauauuugugaaagaacuuu

SEQ ID NO: 487587 - RNA, 64 nt, hsa
acaaagaaauuaauguaaauaagauuucuaacuguuuaaauaagacuuuauauaaauguuuaaa

SEQ ID NO: 487588 - RNA, 64 nt, hsa
accucacuuuacagggauaagagugguguggcauuuuaaauacaaugguauguuauugccaggg

SEQ ID NO: 487589 - RNA, 64 nt, hsa
uaacuacauuuaaaugaaacaacuguauuaauauuuuaaauauaauaguauuuuucuauuagau

SEQ ID NO: 487590 - RNA, 64 nt, hsa
aagaucaaauaaguggaauugggauaucgaucacuuuaaauauuuaucuuuucuuuaugcuagg

SEQ ID NO: 487591 - RNA, 64 nt, hsa
uuucuauuuuuauaauccauaaggauaugccuguuuuaaauaacauacauauuaacaauaucua

SEQ ID NO: 487592 - RNA, 64 nt, hsa
uuuguugauauucaggccuucagaauuuaaggguuuuaaauauagcauucagauuguaauuggu

SEQ ID NO: 487593 - RNA, 64 nt, hsa
agaaaacuguuaaauagggaagaacuacauuaaauuuaaauauucacauuaugccuguguuuga

SEQ ID NO: 487594 - RNA, 64 nt, hsa
agcuuggacagaauuuuuuguauuuguaaauugguuuaaauacauggaauuuuauacagguuuu

SEQ ID NO: 487595 - RNA, 64 nt, hsa
auggcuuuauuuacuuuggugacuguuuauaguuuuuaaauaaaagacugaacauuuucuugag

SEQ ID NO: 487596 - RNA, 64 nt, hsa
agugaaaaagccucaguuuccauauuaaaaauguuuuaaauauuuugauugaauuaguaccaau

SEQ ID NO: 487597 - RNA, 64 nt, hsa
uuuucagcacuucauucaauuaaaauacaugaauuuuaaauauuuuacaugaugugaauaggca

SEQ ID NO: 487598 - RNA, 64 nt, hsa
aaauuauaucaggcuuuaccgguuuuuuuaguuguuuaaauaaguaauauuuucaaaagaauaa

SEQ ID NO: 487599 - RNA, 64 nt, hsa
uuccuggaaguggacacauuuuacaaaaacguuuuuuaaauacacgccagcucuucgagaagca

SEQ ID NO: 487600 - RNA, 64 nt, hsa
agggaacacacuuucagaaccacugcuuuaauauuuuaaauaagauaauaugugaggugucaua

SEQ ID NO: 487601 - RNA, 64 nt, hsa
gguaccaccaucuuacuguaacauuuuucuauuguuuaaauagaaagccuuuuuaaaauuuggu

SEQ ID NO: 487602 - RNA, 64 nt, hsa
ugaucuuacccaugaaugugcacuaccuacauuuuuuaaauagcuagguuuuuacugauuauuu

SEQ ID NO: 487603 - RNA, 64 nt, hsa
caauacuuuuauaacuguucuuaaaaauaagaguuuuaaauacugaauccuuugucuucuaaau

SEQ ID NO: 487604 - RNA, 64 nt, hsa
guuucagcaguuaaugugcuuucuuggauccaaauuuaaauaucuuccuaaaccaaaacuguaa

SEQ ID NO: 487605 - RNA, 64 nt, hsa
ccacaaguuacaauuugaaaagaaaacuauuuuuuuuaaauauuccauuguuaacugaauguua

SEQ ID NO: 487606 - RNA, 64 nt, hsa
ggaugaaugcagaucuaguuuggucuguggcuaguuuaaauauguuucuaaccacagagaauuu

SEQ ID NO: 487607 - RNA, 64 nt, hsa
aagcauuuuaaauaauaccugccuuguaccauuuuuuaaauagaaguuacuucauuauauuuug

SEQ ID NO: 487608 - RNA, 64 nt, hsa
auuucuuuuuauggaaaaugaguuacuaaagcauuuuaaauaauaccugccuuguaccauuuuu

SEQ ID NO: 487609 - RNA, 64 nt, hsa
ucucaauuccuuuuuguaaggugcuauuucuguauuuaaauaacuuucuuuuaacguaaagcug

SEQ ID NO: 487610 - RNA, 64 nt, hsa
ccaguuuccuucacuacaugcccugcauuuuuuauuuaaauauuuagcuguagcgccaucagau

SEQ ID NO: 487611 - RNA, 64 nt, hsa
cacuauauaguauaguuguuccagaaaucuucauuuuaaauagaaguguuuacaaugccuuuuu

SEQ ID NO: 487612 - RNA, 64 nt, hsa
uaaauuauuugugcaaaauuugaaauguuuuuuauuuaaauauuagaaauagcacaaagucaug

SEQ ID NO: 487613 - RNA, 64 nt, hsa
agcaaauuucaugcacugauuaaaauaggauuauuuuaaauacaaaaggcauuuuauaugaauu

SEQ ID NO: 487614 - RNA, 64 nt, hsa
uaguuaaucuauuaauacugacucagugucugccuuuaaauauaaaugauauguugaaaacuua

SEQ ID NO: 487615 - RNA, 64 nt, hsa
uaaucauguuaaaguuaagacuuagacugcaacuuuuaaauaaaaauuaugaagaauaugaguc

SEQ ID NO: 487616 - RNA, 64 nt, hsa
aauaugaauuuuagacuuccuuauaaaccuuuuauuuaaauacaaaguaccuuggccuauagug

SEQ ID NO: 487617 - RNA, 64 nt, hsa
auaugccuuuuuuccccagccaucuaugaauuaauuuaaauauauuuuuaaucuacuacuucag

SEQ ID NO: 487618 - RNA, 64 nt, hsa
acuaucacucuguucauuuuuuuugaacaaagaguuuaaauaaagccugaaccagggaaaagaa

SEQ ID NO: 487619 - RNA, 64 nt, hsa
auuuuggcuuuauguaauauaaaguuuuuaaaauuuuaaauaugguuuuaaccuuuauguguaa

SEQ ID NO: 487620 - RNA, 64 nt, hsa
gaacaaauguaugugauuuuguuauacuucuuaauuuaaauaaaauauuuaaugcacuauuaaa

SEQ ID NO: 487621 - RNA, 64 nt, hsa
auaugucuuuuuacucaggguuuaaaaugucccauuuaaauaugaaauguaaacaaauuuguuu

SEQ ID NO: 487622 - RNA, 64 nt, hsa
aaguuuacagcaugauaguccaaguggugauaacuuuaaauaaaacucaaauuuuuacuguuug

SEQ ID NO: 487623 - RNA, 64 nt, hsa
gacuucagaaucccaacuacaauacaaauguuuauuuaaauaaagaagaaagcuauuguacaaa

SEQ ID NO: 487624 - RNA, 64 nt, hsa
uucuaaugaauauuuguagaaucucauaaaacaguuuaaauacaagcuuaaguggcuuaugaau

SEQ ID NO: 487625 - RNA, 64 nt, hsa
uaacaaaaccaagucaaacuugguguauuuuuauuuuaaauauuaacucuaaagcaggauuacu

SEQ ID NO: 487626 - RNA, 64 nt, hsa
uugauaagauuuucuguuucugugaaacaauuauuuuaaauauuuuucuuuuaaaaauaacuuu

SEQ ID NO: 487627 - RNA, 64 nt, hsa
uucucucagaagaucauguugugggaaucuuuuuuuuaaauagugaaauauugaggcagcaauu

SEQ ID NO: 487628 - RNA, 64 nt, hsa
ggaaguuccaaauuuguagccaguuccaaacaaauuuaaauauugaguugagaccuguauggaa

SEQ ID NO: 487629 - RNA, 64 nt, hsa
uacugaagauaauuuuugaaauguaaaaauuagauuuaaauaguauauuuuaaaugacagaacu

SEQ ID NO: 487630 - RNA, 64 nt, hsa
uugcaucucugcagaagaaauuuauuuuaaauuguuuaaauaucuggaaauacuuuuagcuauc

SEQ ID NO: 487631 - RNA, 64 nt, hsa
acauuuauuugagaaaacacuggauuuaaauaauuuuaaauaauuuguagcuuaauauuaaaga

SEQ ID NO: 487632 - RNA, 64 nt, hsa
uucuuccuguacauuuauuugagaaaacacuggauuuaaauaauuuuaaauaauuuguagcuua

SEQ ID NO: 487633 - RNA, 64 nt, hsa
uggaaaauguucuugaucauuugcaguuaaggacuuuaaauaaaucaaauguuaacaaaagagc

SEQ ID NO: 487634 - RNA, 64 nt, hsa
uuuaucaaugugauuguaauuaaaaauauuuugauuuaaauaacaaaaauaauaccagauuuua

SEQ ID NO: 487635 - RNA, 64 nt, hsa
uucaauguauggucauacuuuuuaaauuugauuuuuuaaauauuauaaguggucaugaaauuuu

SEQ ID NO: 487636 - RNA, 64 nt, hsa
uuaauuugaugacauaauaaaucacuuauaaaauuuuaaauaucaagugaaaauuuagaaaggc

SEQ ID NO: 487637 - RNA, 64 nt, hsa
acauccuuguucuuuauuuagcaacucugauucauuuaaauauguuuuuuauagaauucuaugu

SEQ ID NO: 487638 - RNA, 64 nt, hsa
auugcagccuuuuuguucacuuauaaauuucucuuuuaaauagauggagacaaaggacaaggug

SEQ ID NO: 487639 - RNA, 64 nt, hsa
uuaugaccaauacagucacuagguuguaguuuuuuuuaaauaaaggaaaagcaguauuguccug

SEQ ID NO: 487640 - RNA, 64 nt, hsa
agccaaaaucuuuauuuuuaugcauuuagaauauuuuaaauaguucucagauauuaagaaguug

SEQ ID NO: 487641 - RNA, 64 nt, hsa
gagguguaauuuauuuacaauaaaauguuccuacuuuaaauauacaauucagugaguuuugaua

SEQ ID NO: 487642 - RNA, 64 nt, hsa
uguacuuacuuuuuaaaguccaaauauguuuauauuuaaauauacgugagcguguucaucaugu

SEQ ID NO: 487643 - RNA, 64 nt, hsa
gaguauguuagauuugauuaucugauaaugauuauuuaaauauuccuaucugcuuauaaaaugg

SEQ ID NO: 487644 - RNA, 64 nt, hsa
cauuuuaaaaggguaaaacaugacuauacagaaauuuaaauagaaauaguguauauacauauaa

SEQ ID NO: 487645 - RNA, 64 nt, hsa
uuuuuucaauaagcuauuuuuuuucuuuucuuauuuuaaauagagagagagucuugcuauguuu

SEQ ID NO: 487646 - RNA, 64 nt, hsa
agaacugggccagagccaguccauugccuguuuuuuuaaauaagguuuuacugagcacagccac

SEQ ID NO: 487647 - RNA, 64 nt, hsa
aauauaagaaaauaaaacuuaggggauauacagauuuaaauauucaaaucucccugcuccccug

SEQ ID NO: 487648 - RNA, 64 nt, hsa
uaugucuaauaagugcugguguccuuuuaaaguauuuaaauauauauguugcuguugcugaaua

SEQ ID NO: 487649 - RNA, 64 nt, hsa
aaggcuguguauaguccauuucccaggucugagauuuaaauauauuuguaauucuugugucacu

SEQ ID NO: 487650 - RNA, 64 nt, hsa
ucuuuuaguauguaaaaugaaauaguaccuugaguuuaaauagaaugcauuuaggcauuguaga

SEQ ID NO: 487651 - RNA, 64 nt, hsa
cauagauacagacaaggcaagagaugauaagcuguuuaaauaguguuuaauauugauugggggu

SEQ ID NO: 487652 - RNA, 64 nt, hsa
ggcuccauauuuaaagauagagccaguuuuuuuuuuuaaauagaacccaaauuguguaaaaaug

SEQ ID NO: 487653 - RNA, 64 nt, hsa
uuauuuuuguuaaaacaggauuuugccacaauuauuuaaauauuauguuugugaacuaucuaag

SEQ ID NO: 487654 - RNA, 64 nt, hsa
gaagaaauaguacgacaacuuauuuuuaaucacuuuuaaauaauguguugcauuuacacaguug

SEQ ID NO: 487655 - RNA, 64 nt, hsa
gaaccuuuugagaugaauuaauguaagaauauuuuuuaaauaggcuuacugucaaauugcaacu

SEQ ID NO: 487656 - RNA, 64 nt, hsa
gcuccuugguuuuuuacuucugcacuuaaauuuuuuuaaauaacaugaugaugguacauuuucc

SEQ ID NO: 487657 - RNA, 64 nt, hsa
gaguuugauacuauuaaaauaagccgcuuuguuuuuuaaauaugcaggcauggguucagcuuaa

SEQ ID NO: 487658 - RNA, 64 nt, hsa
gagaaauauuguacaauaauaugaaggcuuauauuuuaaauaauuauuuuuucucaacuaauuu

SEQ ID NO: 487659 - RNA, 64 nt, hsa
caacaugcaguuaaaaugcaacuagaaaacuaauuuuaaauauuguuaguuuuaauauuccuga

SEQ ID NO: 487660 - RNA, 64 nt, hsa
auacguuugcuuuuucagaaacucuagcauucucuuuaaauacugacgcaauccuuaauggaaa

SEQ ID NO: 487661 - RNA, 64 nt, hsa
cuuacuugcugccuuuuuuuuuucuugguacacauuuaaauaaaguaauccuuaaccugugcug

SEQ ID NO: 487662 - RNA, 64 nt, hsa
aacaugucagcagagcauaggcagaauaaaaugguuuaaauaccccacagcaaauagaguaacu

SEQ ID NO: 487663 - RNA, 64 nt, hsa
uacauaauggacgcaaaugacagauaaaaacagcuuuaaauaauuugaacuuguuaauuagaau

SEQ ID NO: 487664 - RNA, 64 nt, hsa
uuugguuuguauuauuuuuauuuggccccauuauuuuaaauaggaaaaacaguauguuuucagu

SEQ ID NO: 487665 - RNA, 64 nt, hsa
acaaacacauacacacaacacuaagugccuagacuuuaaauagaucuagcaauuggaaaguuag

SEQ ID NO: 487666 - RNA, 64 nt, hsa
uuuuacauaauugcauuccuacauucuuguaaaauuuaaauagcuaccauuggcaaucugcuuu

SEQ ID NO: 487667 - RNA, 64 nt, hsa
uuuaugggaaaauucaauauuaucuuuguuuuuguuuaaauauauuuuuaagauaaaggcacaa

SEQ ID NO: 487668 - RNA, 64 nt, hsa
aaacaaucuagcagagaauuaaugucagaaccuuuuuaaauaauagucugauugauacaguuug

SEQ ID NO: 487669 - RNA, 64 nt, hsa
uggccaaguguaauuucuuaaaauuuagcauuacuuuaaauagccagcauguaauacaaguaac

SEQ ID NO: 487670 - RNA, 64 nt, hsa
uuaacaguuugcuauagcuuacugcuuaacuaauuuuaaauaaggaaauaaguauguuagaugc

SEQ ID NO: 487671 - RNA, 64 nt, hsa
uggaaauguuaccuuugauuuucuuauaaaggaguuuaaauaggauuuuuaaauaauguaguaa

SEQ ID NO: 487672 - RNA, 64 nt, hsa
uuugauuuucuuauaaaggaguuuaaauaggauuuuuaaauaauguaguaacacuccugauaca

SEQ ID NO: 487673 - RNA, 64 nt, hsa
ggcaggcagcucaucucauguccugaaguuggaauuuaaauaauuccuauuugcaaauuagaau

SEQ ID NO: 487674 - RNA, 64 nt, hsa
uauaaaagcuguguuauuguuuucuauuauuauuuuuaaauaaucacacuuggacucuuuucaa

SEQ ID NO: 487675 - RNA, 63 nt, hsa
ucuaaaauuuaaauauguauaauaaaauaaauguuuuaaauauaauguuugugugugcuuaua

SEQ ID NO: 487676 - RNA, 64 nt, hsa
gaggaauguacaucuaccuaauaacuuucuaaaauuuaaauauguauaauaaaauaaauguuuu

SEQ ID NO: 487677 - RNA, 64 nt, hsa
uucacauacuauuuugccauauuugcuucugauuuuuaaauaaauaaaauguuacucuuuugua

SEQ ID NO: 487678 - RNA, 64 nt, hsa
aaguguggauguggggaagccagugagcauuacuuuuaaauaggaccuucucuggaaaauuauu

SEQ ID NO: 487679 - RNA, 64 nt, hsa
uacaaauagaauuauuacuucuaguugacuuuuuuuuaaauauacauuuugcucaguagugugu

SEQ ID NO: 487680 - RNA, 64 nt, hsa
uaccgaaguuuuauaucuuagaauuuuauauuuauuuaaauauuuaccuugcuuaccuugaugg

SEQ ID NO: 487681 - RNA, 64 nt, hsa
guuauuuguguuagcauguaauggguuuacuauguuuaaauaaguuaauacuuuaaaaauuuuc

SEQ ID NO: 487682 - RNA, 64 nt, hsa
uaaggaguaacugaauugaaucaaccaguuugcauuuaaauaaaagaacaggcucaguggucuu

SEQ ID NO: 487683 - RNA, 64 nt, hsa
uaaaugcuuaaaacgucaaucaacaaaacuuuguuuuaaauauuguaauuguggagaaaaguaa

SEQ ID NO: 487684 - RNA, 64 nt, hsa
cagcuuauuagagugugggaauagggaucuaaauuuuaaauaaaauuauauauauauauaaauu

SEQ ID NO: 487685 - RNA, 64 nt, hsa
aaaaauaaaacaccuuguacuuuauuuucuauaauuuaaauauaugcuaagucuuauauauugu

SEQ ID NO: 487686 - RNA, 64 nt, hsa
aaaaagcuuuuuuugaaucaucaagucuuucacauuuaaauaaaguguuugaaagcuuuauuua

SEQ ID NO: 487687 - RNA, 64 nt, hsa
cuaaaaggcucauuuuuauauuuguuuuagauguuuuaaauaguugcaauggauuaaaaaugau

SEQ ID NO: 487688 - RNA, 64 nt, hsa
gccaaucuuccauauuaguuuuacuuuuuuuuuuuuuaaauagggcauaccauuucuuccugac

SEQ ID NO: 487689 - RNA, 64 nt, hsa
uaaguagacucuucauuuacuuuucugguaaugguuuaaauaucauuuguuaugcauuuuuaag

SEQ ID NO: 487690 - RNA, 64 nt, hsa
uguauauuuuguauuaccucuuuuuuucaagugauuuaaauaguuaaucauuuaaccaaagaag

SEQ ID NO: 487691 - RNA, 64 nt, hsa
ucaagggaaacuuuccauuuacaguuauuucuuguuuaaauaaacuaaauuaauuuuuagggga

SEQ ID NO: 487692 - RNA, 64 nt, hsa
uguaacuuccuccccuuucugucaauugguugucuuuaaauauugcaaaaguccugaugcuaaa

SEQ ID NO: 487693 - RNA, 64 nt, hsa; identical to SEQ ID NO: 293419

SEQ ID NO: 487694 - RNA, 64 nt, hsa; identical to SEQ ID NO: 293420

SEQ ID NO: 487695 - RNA, 64 nt, hsa; identical to SEQ ID NO: 293421

SEQ ID NO: 487696 - RNA, 64 nt, hsa; identical to SEQ ID NO: 293422

SEQ ID NO: 487697 - RNA, 64 nt, hsa; identical to SEQ ID NO: 293423

SEQ ID NO: 487698 - RNA, 64 nt, hsa; identical to SEQ ID NO: 293424

SEQ ID NO: 487699 - RNA, 64 nt, hsa; identical to SEQ ID NO: 293425

SEQ ID NO: 487700 - RNA, 64 nt, hsa; identical to SEQ ID NO: 293426

SEQ ID NO: 487701 - RNA, 64 nt, hsa; identical to SEQ ID NO: 293427

SEQ ID NO: 487702 - RNA, 64 nt, hsa; identical to SEQ ID NO: 293428

SEQ ID NO: 487703 - RNA, 64 nt, hsa; identical to SEQ ID NO: 293429

SEQ ID NO: 487704 - RNA, 64 nt, hsa; identical to SEQ ID NO: 293430

SEQ ID NO: 487705 - RNA, 64 nt, hsa; identical to SEQ ID NO: 293431

SEQ ID NO: 487706 - RNA, 64 nt, hsa; identical to SEQ ID NO: 293432

SEQ ID NO: 487707 - RNA, 64 nt, hsa; identical to SEQ ID NO: 293433

SEQ ID NO: 487708 - RNA, 64 nt, hsa; identical to SEQ ID NO: 293434

SEQ ID NO: 487709 - RNA, 64 nt, hsa; identical to SEQ ID NO: 293435

SEQ ID NO: 487710 - RNA, 64 nt, hsa; identical to SEQ ID NO: 293436

SEQ ID NO: 487711 - RNA, 64 nt, hsa; identical to SEQ ID NO: 293437

SEQ ID NO: 487712 - RNA, 64 nt, hsa; identical to SEQ ID NO: 293438

SEQ ID NO: 487713 - RNA, 64 nt, hsa; identical to SEQ ID NO: 293439

SEQ ID NO: 487714 - RNA, 64 nt, hsa; identical to SEQ ID NO: 293440

SEQ ID NO: 487715 - RNA, 64 nt, hsa; identical to SEQ ID NO: 293441

SEQ ID NO: 487716 - RNA, 64 nt, hsa; identical to SEQ ID NO: 293442

SEQ ID NO: 487717 - RNA, 64 nt, hsa; identical to SEQ ID NO: 293443

SEQ ID NO: 487718 - RNA, 64 nt, hsa; identical to SEQ ID NO: 293444

SEQ ID NO: 487719 - RNA, 64 nt, hsa; identical to SEQ ID NO: 293445

SEQ ID NO: 487720 - RNA, 64 nt, hsa; identical to SEQ ID NO: 293446

SEQ ID NO: 487721 - RNA, 64 nt, hsa; identical to SEQ ID NO: 293447

SEQ ID NO: 487722 - RNA, 64 nt, hsa; identical to SEQ ID NO: 293448

SEQ ID NO: 487723 - RNA, 64 nt, hsa; identical to SEQ ID NO: 293449

SEQ ID NO: 487724 - RNA, 64 nt, hsa; identical to SEQ ID NO: 293450

SEQ ID NO: 487725 - RNA, 64 nt, hsa; identical to SEQ ID NO: 293451

SEQ ID NO: 487726 - RNA, 64 nt, hsa; identical to SEQ ID NO: 293452

SEQ ID NO: 487727 - RNA, 64 nt, hsa; identical to SEQ ID NO: 293453

SEQ ID NO: 487728 - RNA, 64 nt, hsa; identical to SEQ ID NO: 293454

SEQ ID NO: 487729 - RNA, 64 nt, hsa; identical to SEQ ID NO: 293455

SEQ ID NO: 487730 - RNA, 64 nt, hsa; identical to SEQ ID NO: 293456

SEQ ID NO: 487731 - RNA, 64 nt, hsa; identical to SEQ ID NO: 293457

SEQ ID NO: 487732 - RNA, 64 nt, hsa; identical to SEQ ID NO: 293458

SEQ ID NO: 487733 - RNA, 64 nt, hsa; identical to SEQ ID NO: 293459

SEQ ID NO: 487734 - RNA, 64 nt, hsa; identical to SEQ ID NO: 293460

SEQ ID NO: 487735 - RNA, 64 nt, hsa; identical to SEQ ID NO: 288961

SEQ ID NO: 487736 - RNA, 64 nt, hsa; identical to SEQ ID NO: 288962

SEQ ID NO: 487737 - RNA, 64 nt, hsa; identical to SEQ ID NO: 288963

SEQ ID NO: 487738 - RNA, 64 nt, hsa; identical to SEQ ID NO: 288964

SEQ ID NO: 487739 - RNA, 64 nt, hsa; identical to SEQ ID NO: 288965

SEQ ID NO: 487740 - RNA, 64 nt, hsa; identical to SEQ ID NO: 288966

SEQ ID NO: 487741 - RNA, 64 nt, hsa; identical to SEQ ID NO: 288967

SEQ ID NO: 487742 - RNA, 64 nt, hsa; identical to SEQ ID NO: 288968

SEQ ID NO: 487743 - RNA, 64 nt, hsa; identical to SEQ ID NO: 288969

SEQ ID NO: 487744 - RNA, 64 nt, hsa; identical to SEQ ID NO: 288970

SEQ ID NO: 487745 - RNA, 64 nt, hsa; identical to SEQ ID NO: 288971

SEQ ID NO: 487746 - RNA, 64 nt, hsa; identical to SEQ ID NO: 288972

SEQ ID NO: 487747 - RNA, 64 nt, hsa; identical to SEQ ID NO: 288973

SEQ ID NO: 487748 - RNA, 64 nt, hsa; identical to SEQ ID NO: 288974

SEQ ID NO: 487749 - RNA, 64 nt, hsa; identical to SEQ ID NO: 288975

SEQ ID NO: 487750 - RNA, 64 nt, hsa; identical to SEQ ID NO: 288976

SEQ ID NO: 487751 - RNA, 64 nt, hsa; identical to SEQ ID NO: 288977

SEQ ID NO: 487752 - RNA, 64 nt, hsa; identical to SEQ ID NO: 288978

SEQ ID NO: 487753 - RNA, 64 nt, hsa; identical to SEQ ID NO: 288979

SEQ ID NO: 487754 - RNA, 52 nt, hsa; identical to SEQ ID NO: 69449

SEQ ID NO: 487755 - RNA, 64 nt, hsa; identical to SEQ ID NO: 288981

SEQ ID NO: 487756 - RNA, 64 nt, hsa; identical to SEQ ID NO: 288982

SEQ ID NO: 487757 - RNA, 64 nt, hsa; identical to SEQ ID NO: 288983

SEQ ID NO: 487758 - RNA, 64 nt, hsa; identical to SEQ ID NO: 288984

SEQ ID NO: 487759 - RNA, 64 nt, hsa; identical to SEQ ID NO: 288985

SEQ ID NO: 487760 - RNA, 64 nt, hsa; identical to SEQ ID NO: 288986

SEQ ID NO: 487761 - RNA, 64 nt, hsa; identical to SEQ ID NO: 288987

SEQ ID NO: 487762 - RNA, 64 nt, hsa; identical to SEQ ID NO: 288988

SEQ ID NO: 487763 - RNA, 64 nt, hsa; identical to SEQ ID NO: 288989

SEQ ID NO: 487764 - RNA, 64 nt, hsa; identical to SEQ ID NO: 288990

SEQ ID NO: 487765 - RNA, 64 nt, hsa; identical to SEQ ID NO: 288991

SEQ ID NO: 487766 - RNA, 64 nt, hsa; identical to SEQ ID NO: 288992

SEQ ID NO: 487767 - RNA, 64 nt, hsa; identical to SEQ ID NO: 288993

SEQ ID NO: 487768 - RNA, 64 nt, hsa; identical to SEQ ID NO: 288994

SEQ ID NO: 487769 - RNA, 64 nt, hsa; identical to SEQ ID NO: 288995

SEQ ID NO: 487770 - RNA, 64 nt, hsa; identical to SEQ ID NO: 288996

SEQ ID NO: 487771 - RNA, 64 nt, hsa; identical to SEQ ID NO: 288997

SEQ ID NO: 487772 - RNA, 64 nt, hsa; identical to SEQ ID NO: 288998

SEQ ID NO: 487773 - RNA, 64 nt, hsa; identical to SEQ ID NO: 288999

SEQ ID NO: 487774 - RNA, 64 nt, hsa; identical to SEQ ID NO: 289000

SEQ ID NO: 487775 - RNA, 64 nt, hsa; identical to SEQ ID NO: 289001

SEQ ID NO: 487776 - RNA, 64 nt, hsa; identical to SEQ ID NO: 289002

SEQ ID NO: 487777 - RNA, 64 nt, hsa; identical to SEQ ID NO: 289003

SEQ ID NO: 487778 - RNA, 64 nt, hsa; identical to SEQ ID NO: 289004

SEQ ID NO: 487779 - RNA, 64 nt, hsa; identical to SEQ ID NO: 289005

SEQ ID NO: 487780 - RNA, 64 nt, hsa; identical to SEQ ID NO: 289006

SEQ ID NO: 487781 - RNA, 64 nt, hsa; identical to SEQ ID NO: 289007

SEQ ID NO: 487782 - RNA, 64 nt, hsa; identical to SEQ ID NO: 289008

SEQ ID NO: 487783 - RNA, 64 nt, hsa; identical to SEQ ID NO: 225411

SEQ ID NO: 487784 - RNA, 64 nt, hsa; identical to SEQ ID NO: 225412

SEQ ID NO: 487785 - RNA, 64 nt, hsa; identical to SEQ ID NO: 225413

SEQ ID NO: 487786 - RNA, 64 nt, hsa; identical to SEQ ID NO: 225414

SEQ ID NO: 487787 - RNA, 64 nt, hsa; identical to SEQ ID NO: 225415

SEQ ID NO: 487788 - RNA, 64 nt, hsa; identical to SEQ ID NO: 225416

SEQ ID NO: 487789 - RNA, 64 nt, hsa; identical to SEQ ID NO: 225417

SEQ ID NO: 487790 - RNA, 64 nt, hsa; identical to SEQ ID NO: 225418

SEQ ID NO: 487791 - RNA, 64 nt, hsa; identical to SEQ ID NO: 225419

SEQ ID NO: 487792 - RNA, 64 nt, hsa; identical to SEQ ID NO: 225420

SEQ ID NO: 487793 - RNA, 64 nt, hsa; identical to SEQ ID NO: 225421

SEQ ID NO: 487794 - RNA, 64 nt, hsa; identical to SEQ ID NO: 225422

SEQ ID NO: 487795 - RNA, 64 nt, hsa; identical to SEQ ID NO: 225423

SEQ ID NO: 487796 - RNA, 64 nt, hsa; identical to SEQ ID NO: 225424

SEQ ID NO: 487797 - RNA, 64 nt, hsa; identical to SEQ ID NO: 225425

SEQ ID NO: 487798 - RNA, 64 nt, hsa; identical to SEQ ID NO: 225426

SEQ ID NO: 487799 - RNA, 64 nt, hsa; identical to SEQ ID NO: 225427

SEQ ID NO: 487800 - RNA, 64 nt, hsa; identical to SEQ ID NO: 297865

SEQ ID NO: 487801 - RNA, 64 nt, hsa; identical to SEQ ID NO: 297866

SEQ ID NO: 487802 - RNA, 64 nt, hsa; identical to SEQ ID NO: 297867

SEQ ID NO: 487803 - RNA, 64 nt, hsa; identical to SEQ ID NO: 297868

SEQ ID NO: 487804 - RNA, 64 nt, hsa; identical to SEQ ID NO: 297869

SEQ ID NO: 487805 - RNA, 64 nt, hsa; identical to SEQ ID NO: 297870

SEQ ID NO: 487806 - RNA, 64 nt, hsa; identical to SEQ ID NO: 297871

SEQ ID NO: 487807 - RNA, 64 nt, hsa; identical to SEQ ID NO: 297872

SEQ ID NO: 487808 - RNA, 64 nt, hsa; identical to SEQ ID NO: 297873

SEQ ID NO: 487809 - RNA, 64 nt, hsa; identical to SEQ ID NO: 297874

SEQ ID NO: 487810 - RNA, 64 nt, hsa; identical to SEQ ID NO: 297875

SEQ ID NO: 487811 - RNA, 64 nt, hsa; identical to SEQ ID NO: 297876

SEQ ID NO: 487812 - RNA, 64 nt, hsa; identical to SEQ ID NO: 297877

SEQ ID NO: 487813 - RNA, 64 nt, hsa; identical to SEQ ID NO: 297878

SEQ ID NO: 487814 - RNA, 64 nt, hsa; identical to SEQ ID NO: 297879

SEQ ID NO: 487815 - RNA, 64 nt, hsa; identical to SEQ ID NO: 297880

SEQ ID NO: 487816 - RNA, 64 nt, hsa; identical to SEQ ID NO: 297881

SEQ ID NO: 487817 - RNA, 64 nt, hsa; identical to SEQ ID NO: 297882

SEQ ID NO: 487818 - RNA, 64 nt, hsa; identical to SEQ ID NO: 297883

SEQ ID NO: 487819 - RNA, 64 nt, hsa; identical to SEQ ID NO: 297884

SEQ ID NO: 487820 - RNA, 64 nt, hsa; identical to SEQ ID NO: 297885

SEQ ID NO: 487821 - RNA, 64 nt, hsa; identical to SEQ ID NO: 297886

SEQ ID NO: 487822 - RNA, 64 nt, hsa; identical to SEQ ID NO: 297887

SEQ ID NO: 487823 - RNA, 64 nt, hsa; identical to SEQ ID NO: 297888

SEQ ID NO: 487824 - RNA, 64 nt, hsa
aaaaugcaguccaugucccauccauagccaucuacaauaguaacugcccacaggcucuccagaa

SEQ ID NO: 487825 - RNA, 64 nt, hsa
uaaaaugaggggagaauauucccuaagcaacuggcaauaguauuccugaaauaccuagaaauuu

SEQ ID NO: 487826 - RNA, 64 nt, hsa
gcaggaauggcaauaguaguaguaguagcagcagcaauaguagaaguagucauaauaacaauaa

SEQ ID NO: 487827 - RNA, 64 nt, hsa
auuaccacucaucaucauauacuagcaggaauggcaauaguaguaguaguagcagcagcaauag

SEQ ID NO: 487828 - RNA, 64 nt, hsa
ggaagaccuggcaaggacacagaugaaacacaaacaauaguaauucucaggccaucaucagugg

SEQ ID NO: 487829 - RNA, 64 nt, hsa
aggcugagaacacugugaaaacauuuugcgcgcacaauaguaaccuggguaaaugcagcgugaa

SEQ ID NO: 487830 - RNA, 64 nt, hsa
aaacaccaguuguuuauauuuugugcuuauucauacaagacaggaagcacggucuuaggcggau

SEQ ID NO: 487831 - RNA, 64 nt, hsa
augagcacgguuacccccaaguggagggguuuguacaagacaugcgccucaucuuccagaacca

SEQ ID NO: 487832 - RNA, 64 nt, hsa
caaucccgaucggcucuuauuagcuccccgcuccacaagacaccugugacauccuccagggcca

SEQ ID NO: 487833 - RNA, 64 nt, hsa
caaucccgaucggcucuuauuagcuccccgcuccacaagacaccugugaucuggaaaucuacca

SEQ ID NO: 487834 - RNA, 64 nt, hsa
caaucccgaucggcucuuauuagcuccccgcuccacaagacaccugugcuuuggaaauccacca

SEQ ID NO: 487835 - RNA, 64 nt, hsa
ucgggccgguggggcguaaggguuaucguuaagcacaagacacagaauaguuuacacacugugu

SEQ ID NO: 487836 - RNA, 64 nt, hsa
ggcgcuccgggaacagugcaugugcaugcauaccacaagacauuucuuucuguuuuguuuuuuu

SEQ ID NO: 487837 - RNA, 64 nt, hsa
ugaaauauauuuuuggguuacuucaguguguuugacaagacagcuugauauuucuaucaaacaa

SEQ ID NO: 487838 - RNA, 64 nt, hsa
caguuucugaaauacacauuuaguguauggaaauacaagacagcuaaagggcuguuugguuagc

SEQ ID NO: 487839 - RNA, 62 nt, hsa
acagcccuccucucccaagaaauccaggcuccucucccaagaaauccaggugcuuuccagac

SEQ ID NO: 487840 - RNA, 62 nt, hsa
agaagaacugauuggggcuuccacagcccuccucucccaagaaauccaggcuccucucccaa

SEQ ID NO: 487841 - RNA, 62 nt, hsa
aucuuuuuaagauuaaaaaugaauaccuuaaaucucccaaaagagauaaccaguaucugaag

SEQ ID NO: 487842 - RNA, 62 nt, hsa
acuccugaccgcaagugauccacacgccuuggucucccaaagugcugggauuacgguguuag

SEQ ID NO: 487843 - RNA, 62 nt, hsa
gaaacugcagccccacuucuguuucccuggagucucccaauggaucauucaggaguguccua

SEQ ID NO: 487844 - RNA, 62 nt, hsa
cugaaggggaagagggugaccucagcggcuuuucucccaaaaaucggcugaaggcugguugu

SEQ ID NO: 487845 - RNA, 62 nt, hsa
guacuacccucagucuacacucacaaucaucuucucccaagacugcucccuuuuguuuugug

SEQ ID NO: 487846 - RNA, 62 nt, hsa
ugccuuugugcucuguuccuguccagcaggggucucccaacaagugcucuuuccaccccaaa

SEQ ID NO: 487847 - RNA, 62 nt, hsa
uggcagccccccaugugggagaaauaccugauucucccaaucugcagugggagagcuuugcu

SEQ ID NO: 487848 - RNA, 62 nt, hsa
ucacugcgccagccuccccgcccgcucucuuuucucccaagcgaaaccaaaugcgccccuuc

SEQ ID NO: 487849 - RNA, 62 nt, hsa
gugagacaguccacccagagcucucccaagucucucccaaauaccuuagaguagggacacug

SEQ ID NO: 487850 - RNA, 62 nt, hsa
auuugaacagggugagacaguccacccagagcucucccaagucucucccaaauaccuuagag

SEQ ID NO: 487851 - RNA, 62 nt, hsa
ccgaacguggaacaguaucacaaaagauuccaucucccaacgauuucagaacucugagcuca

SEQ ID NO: 487852 - RNA, 62 nt, hsa
agagaagaaagauaaggaggcucccacccaccucucccaagagcagacauuaaacaucuuug

SEQ ID NO: 487853 - RNA, 62 nt, hsa
aaggggaaagaaacuacuuuagagccucuuuuucucccaacucauauuuuugauaggaaaaa

SEQ ID NO: 487854 - RNA, 62 nt, hsa
guguaugcuuccagguggaggagaaaggggaaucucccaaaauuuaaaaacaaauuggaaga

SEQ ID NO: 487855 - RNA, 62 nt, hsa
acucaaucugccaaaugugcugcagcucguuuucucccaauuacagcaagacugucagccuc

SEQ ID NO: 487856 - RNA, 62 nt, hsa
cacuaggagauuuuuauaaacccucuccagccucucccaaaggaagcguuggcagcaaaggg

SEQ ID NO: 487857 - RNA, 62 nt, hsa
cugcccugggccauaugugcuauggagaggacucucccaaacccccaauagcuagugacagc

SEQ ID NO: 487858 - RNA, 62 nt, hsa
ccaaagcuuccccuuaucguccccugugauuaucucccaaccccgugacaaagguagagcaa

SEQ ID NO: 487859 - RNA, 62 nt, hsa
cacguuugucacugccguuuauuacauugacuucucccaagaugaaucuuccuuccaaaugu

SEQ ID NO: 487860 - RNA, 62 nt, hsa
cccugaagauaaucaaggccaguuacucaucaucucccaaccacuguuuccucaacugcccu

SEQ ID NO: 487861 - RNA, 64 nt, hsa
gaugaucagaacuugcguucuguuaauggugccgaaauaacaaugugaaccugagacuggccug

SEQ ID NO: 487862 - RNA, 64 nt, hsa
ucccaucauggcccaccugguuuccugauguuguaaauaacaucaaugcaucugcugugggucc

SEQ ID NO: 487863 - RNA, 64 nt, hsa
ccaagauucuuaaauuugccagcguuaaaguagaaaauaacauuucagaagagcacaauaugca

SEQ ID NO: 487864 - RNA, 64 nt, hsa
auguguaggaauuguauguauguauaucuucuguaaauaacaucuaguaucuucacuaaauaua

SEQ ID NO: 487865 - RNA, 64 nt, hsa
aacuuuaacuucuguuuuaccagcauacccacacaaauaacaagaauacuacuuaugaaaugug

SEQ ID NO: 487866 - RNA, 64 nt, hsa
uggggcuucaacuuuggaauuucacagcgugcuaaaauaacagauuucucagaagucuuucagc

SEQ ID NO: 487867 - RNA, 64 nt, hsa
ccuaugcuuuuagcugcguuacuaagcaagggaaaaauaacaguuucucugagccagagaagac

SEQ ID NO: 487868 - RNA, 64 nt, hsa
gcaacugauuuugcaaaaaaaaauuguagcuuuaaaauaacagggucuaaguauuuuaaaugug

SEQ ID NO: 487869 - RNA, 64 nt, hsa
augaaggaaaugaaccacauagacuuuaugcaauaaauaacagugcaagugaguauaacucuaa

SEQ ID NO: 487870 - RNA, 64 nt, hsa
ugcauuuuauucuugaagugaaaucugugcaauaaaauaacagacugucugcaaaacuggccuu

SEQ ID NO: 487871 - RNA, 64 nt, hsa
auuuguguuucaaauugauaaaauauuuagguacaaauaacaagacuaauaauauuuucuuauu

SEQ ID NO: 487872 - RNA, 64 nt, hsa
ugaaguuguggcugagaagaugagaggaauauuuaaauaacaucaacagaacaacuucacuuug

SEQ ID NO: 487873 - RNA, 64 nt, hsa
accacaaccaaguuccagcuggcaagaagaggaaaaauaacacagaggaguuaugaccaguguu

SEQ ID NO: 487874 - RNA, 64 nt, hsa
aaugaacauguuuuauuuuuacuuuuguuaaaauaaauaacauuuaauuugacggaaaauucua

SEQ ID NO: 487875 - RNA, 64 nt, hsa
uaguaaaauauguaaccauugucccaguaaagaaaaauaacaaaaguuguaaaauguauauucu

SEQ ID NO: 487876 - RNA, 64 nt, hsa
uuuuuauuauuuuaauauacuguaagccaaacugaaauaacauuugcuguuuuauagguuugaa

SEQ ID NO: 487877 - RNA, 64 nt, hsa
aacugauaauucuuacuucuggauuuaaaaucaaaaauaacacacuuguacagauacaaucuaa

SEQ ID NO: 487878 - RNA, 64 nt, hsa
uagucuguggaguuuguggcaauuaauugccauaaaauaacaauguuuccaaaugcaacuaaga

SEQ ID NO: 487879 - RNA, 64 nt, hsa
cuauaguuuauuuggauuauuuuugaaaaaaguaaaauaacaauacccuuacgaauuuuuuggu

SEQ ID NO: 487880 - RNA, 64 nt, hsa
ugagguuuagagguuaaaaugacacauuggggguaaauaacagacacuauauguuggaguuggg

SEQ ID NO: 487881 - RNA, 64 nt, hsa
uggaaagggaaugcuacuauaccuacuucauuuaaaauaacaugaguuaaacacuuagcugagu

SEQ ID NO: 487882 - RNA, 64 nt, hsa
aaugaaugaauuacaaugaacaaagaaaagugcaaaauaacacuaacaaguaaauauuacaaga

SEQ ID NO: 487883 - RNA, 64 nt, hsa
guacguauguuuaucuuacucuuccuauaaacuaaaauaacauuacaguuuccgaauuuagcau

SEQ ID NO: 487884 - RNA, 64 nt, hsa
ccuacucaguaaacaggugugaugaguuaacaagaaauaacacuguuugagaacuagcuuugaa

SEQ ID NO: 487885 - RNA, 64 nt, hsa
aaaaauuaaaugcauaagcauaagguagaaauuaaaauaacaaaauugucuacagcuucuuacu

SEQ ID NO: 487886 - RNA, 64 nt, hsa
uaaugcaccuugagaaaaaucuggcauacugaauaaauaacauuaacuugggagccaagagcug

SEQ ID NO: 487887 - RNA, 64 nt, hsa
auuaaaacaggcaguuguuucuuugaauaugccuaaauaacaguauucuuaaaaucugacagac

SEQ ID NO: 487888 - RNA, 64 nt, hsa
cuaucacaagcuacacauaaauugggugguuuauaaauaacaaacauuucuuucuuacaguucu

SEQ ID NO: 487889 - RNA, 64 nt, hsa
caaauguauaugguucuggccacauuaaaguugcaaauaacacuuuuuuugagacugaaauaaa

SEQ ID NO: 487890 - RNA, 64 nt, hsa
uuagacacacuuuaaaccuucaaacagguauuauaaauaacaugugacuccuuaauggacuuau

SEQ ID NO: 487891 - RNA, 64 nt, hsa
uaaacaaaacuaauaacuguuuuacugcuuuaagaaauaacaauuacaauguguauuauuuaaa

SEQ ID NO: 487892 - RNA, 64 nt, hsa
agaguauugaaggaacaacaaauaacaauagcagaaauaacagugugacauaaagugcccuucc

SEQ ID NO: 487893 - RNA, 64 nt, hsa
ggauuggcaauguaaagaguauugaaggaacaacaaauaacaauagcagaaauaacagugugac

SEQ ID NO: 487894 - RNA, 64 nt, hsa
auaaugacaugggcauauaccguaacauucuggcaaauaacaauuagaaaagauagguuuaaca

SEQ ID NO: 487895 - RNA, 64 nt, hsa
aagggcacucuaugaauugauuuauugucuaagaaaauaacaccacaaguagggaaauuguuac

SEQ ID NO: 487896 - RNA, 64 nt, hsa
cugaaacaagaauuagaaugacuugagaacgggcaaauaacaaagcaaaccaauauaauuauau

SEQ ID NO: 487897 - RNA, 64 nt, hsa
uaccauagaaacuauuaaaguaacuagaacugucaaauaacaaaacggcucauguuuuuaaaau

SEQ ID NO: 487898 - RNA, 64 nt, hsa
uacaccucuuugccuguucccacccccagacuugaaauaacacuucagaguaagagggaauuca

SEQ ID NO: 487899 - RNA, 64 nt, hsa
guaaaguaaaacaaaccuaucuugguuaacaugaaaauaacaauugagaauauauuauauucac

SEQ ID NO: 487900 - RNA, 64 nt, hsa
caaauuuuaaaagccacagguguugauuguuauaaaauaacaugcugccauucuugauugcuag

SEQ ID NO: 487901 - RNA, 64 nt, hsa
uauuuuucaccagguuaaaauuuuaauuucuacaaaauaacauucugaaucaagcacacuguau

SEQ ID NO: 487902 - RNA, 64 nt, hsa
uucuaucugcaaauaguuucaaaugaguuuaaaaaaauaacaucugaaaagaaaugcuaaugua

SEQ ID NO: 487903 - RNA, 64 nt, hsa
uaugcuuaggccagucaguacacccaauuuuaaaaaauaacauauucuugcuuucacaaauaua

SEQ ID NO: 487904 - RNA, 64 nt, hsa
uuucuaagaucuguuuuucauuagaaauauugacaaauaacacauugucaaccuggauccuuug

SEQ ID NO: 487905 - RNA, 64 nt, hsa
auuaagcuaaacacugguaucacugauuaacuguaaauaacaauuaaaaacacauuuucagugu

SEQ ID NO: 487906 - RNA, 64 nt, hsa
cucaaauaacaugauugucuuuguagaaaauucuaaauaacaaaaaccugcugacauuaauaag

SEQ ID NO: 487907 - RNA, 64 nt, hsa
uuuggaaggaggaaauacaacugucuuuguucucaaauaacaugauugucuuuguagaaaauuc

SEQ ID NO: 487908 - RNA, 64 nt, hsa
agcuaauguuuauccauuuaaaaguuauaaaucaaaauaacagauuaucugaaaaaaaaucuau

SEQ ID NO: 487909 - RNA, 64 nt, hsa
uagauuguguugcuauuuuuuucuuucucuauaaaaauaacacauuauuuuauccguuauuuga

SEQ ID NO: 487910 - RNA, 64 nt, hsa
uauuuuuaaaaaugucuaauauuuuaucaaaucuaaauaacauagcuaggacacuuguuaggga

SEQ ID NO: 487911 - RNA, 64 nt, hsa
caauaaaauuguaaagauugacaauagacuuaagaaauaacauuuuaaaaucuauuuuauacuu

SEQ ID NO: 487912 - RNA, 64 nt, hsa
cauagcaaggccuaauguuagcuuuagcuuuagaaaauaacaguuugugaacuuacuucccuau

SEQ ID NO: 487913 - RNA, 64 nt, hsa
aagagcucuguaauaacaguaauaaauagcucugaaauaacaguccuaagaacuccuaaagucc

SEQ ID NO: 487914 - RNA, 64 nt, hsa
cuguugguugugcccaagggcuacaguagcucugaaauaacaagagcucuguaauaacaguaau

SEQ ID NO: 487915 - RNA, 64 nt, hsa
ucuuugauacauuuauuuuaauucuuaaguggccaaauaacagauuagguaaaaugagauuaca

SEQ ID NO: 487916 - RNA, 64 nt, hsa
aacguaacuccaguccuccacccucucccaacaaaaauaacaaugcuguugacaguggaauuca

SEQ ID NO: 487917 - RNA, 64 nt, hsa
uuauaaauguacauauauauucucacauucugaaaaauaacauucucagaauccacagaaaaua

SEQ ID NO: 487918 - RNA, 64 nt, hsa
uguuaaggcaagaagugucaaaugcuuuagaguuaaauaacagaucacugauuucaaagacuug

SEQ ID NO: 487919 - RNA, 64 nt, hsa
auacuucuuauagaaaaacaaauguuuaugcuaaaaauaacaccaaaauguggugaacucuuaa

SEQ ID NO: 487920 - RNA, 64 nt, hsa
cucuguaggugacuuuuaaaugauuauacaauggaaauaacauucauugacauuucugugguuu

SEQ ID NO: 487921 - RNA, 64 nt, hsa
gugaaagaaaauaacgauaaaagacagugaaagaaaauaacaauaaaagacaaggaaaaaauaa

SEQ ID NO: 487922 - RNA, 64 nt, hsa
cagugaaagaaaauaacaauaaaagacaaggaaaaaauaacaaugaaaguugauaaguacauga

SEQ ID NO: 487923 - RNA, 64 nt, hsa
uguuccagauuuaacauaaguaguaaauaacauaaaauaacauaaaacaguauuuuuaggauuc

SEQ ID NO: 487924 - RNA, 64 nt, hsa
uugaauguguuguuccagauuuaacauaaguaguaaauaacauaaaauaacauaaaacaguauu

SEQ ID NO: 487925 - RNA, 64 nt, hsa
aguuuacucucucccucuacuaauuuccugcugaaaauaacacaacaaaaauguaacaggggaa

SEQ ID NO: 487926 - RNA, 64 nt, hsa
ucaggaggaugcaauuguugaaagcuuugaaauaaaauaacaaugucuucuugaaauuugugau

SEQ ID NO: 487927 - RNA, 64 nt, hsa
uuaauaaauuagcccauuauauuuucaucuguauuugccauaaaaaauuuauuugcauuuaugc

SEQ ID NO: 487928 - RNA, 64 nt, hsa
auucacuucccuuaauuuuaucuugccuugucucuugccauauuugcuguuuuuauggauaaau

SEQ ID NO: 487929 - RNA, 64 nt, hsa
caagaagucuauugauauuggucauguuuauuucuugccauauuuauaacacagcaagaguauu

SEQ ID NO: 487930 - RNA, 64 nt, hsa
gcugauuucuauuucuagcuaauuuggucauucuuugccauagcuuacucuauucaaauaaaca

SEQ ID NO: 487931 - RNA, 64 nt, hsa
uacaaaguagccagucccauaaugaaaugcuguauugccauaguggucacacccaaguggucca

SEQ ID NO: 487932 - RNA, 64 nt, hsa
ucuucuuagcaguugauaaaauauuaaaacucucuugccauagagaauacaccaucaaagaaaa

SEQ ID NO: 487933 - RNA, 64 nt, hsa
uguauacuuguauuuucaggauauuuuauuuuuuuugccauacagauaaaauuuguaagguugc

SEQ ID NO: 487934 - RNA, 64 nt, hsa
cugaauaacauuuagcaguauugugauugaaaaauugccauauuuugauguauaggacaaguca

SEQ ID NO: 487935 - RNA, 64 nt, hsa
aacauaucccuucauugccauaauggcugccauuuugccauagauuuccauauaacugaaaaac

SEQ ID NO: 487936 - RNA, 64 nt, hsa
aauaucaucuaacagucuaaaacauaucccuucauugccauaauggcugccauuuugccauaga

SEQ ID NO: 487937 - RNA, 64 nt, hsa
ugugauugccauagguggaauaauccaacauaaauugccauagauagaagguaucuguaauaua

SEQ ID NO: 487938 - RNA, 64 nt, hsa
cucuuaaaaaaaaaggaaagaaaacuugaugugauugccauagguggaauaauccaacauaaau

SEQ ID NO: 487939 - RNA, 64 nt, hsa; identical to SEQ ID NO: 322895

SEQ ID NO: 487940 - RNA, 64 nt, hsa; identical to SEQ ID NO: 322896

SEQ ID NO: 487941 - RNA, 64 nt, hsa; identical to SEQ ID NO: 322897

SEQ ID NO: 487942 - RNA, 64 nt, hsa; identical to SEQ ID NO: 322898

SEQ ID NO: 487943 - RNA, 64 nt, hsa; identical to SEQ ID NO: 322899

SEQ ID NO: 487944 - RNA, 64 nt, hsa; identical to SEQ ID NO: 322900

SEQ ID NO: 487945 - RNA, 64 nt, hsa; identical to SEQ ID NO: 322901

SEQ ID NO: 487946 - RNA, 64 nt, hsa; identical to SEQ ID NO: 322902

SEQ ID NO: 487947 - RNA, 64 nt, hsa; identical to SEQ ID NO: 322903

SEQ ID NO: 487948 - RNA, 64 nt, hsa; identical to SEQ ID NO: 322904

SEQ ID NO: 487949 - RNA, 64 nt, hsa; identical to SEQ ID NO: 322905

SEQ ID NO: 487950 - RNA, 64 nt, hsa; identical to SEQ ID NO: 322906

SEQ ID NO: 487951 - RNA, 64 nt, hsa; identical to SEQ ID NO: 322907

SEQ ID NO: 487952 - RNA, 64 nt, hsa; identical to SEQ ID NO: 322908

SEQ ID NO: 487953 - RNA, 64 nt, hsa; identical to SEQ ID NO: 322909

SEQ ID NO: 487954 - RNA, 64 nt, hsa; identical to SEQ ID NO: 322910

SEQ ID NO: 487955 - RNA, 64 nt, hsa; identical to SEQ ID NO: 322911

SEQ ID NO: 487956 - RNA, 64 nt, hsa; identical to SEQ ID NO: 322912

SEQ ID NO: 487957 - RNA, 64 nt, hsa; identical to SEQ ID NO: 322913

SEQ ID NO: 487958 - RNA, 64 nt, hsa; identical to SEQ ID NO: 322914

SEQ ID NO: 487959 - RNA, 64 nt, hsa; identical to SEQ ID NO: 322915

SEQ ID NO: 487960 - RNA, 64 nt, hsa; identical to SEQ ID NO: 322916

SEQ ID NO: 487961 - RNA, 64 nt, hsa; identical to SEQ ID NO: 322917

SEQ ID NO: 487962 - RNA, 64 nt, hsa; identical to SEQ ID NO: 322918

SEQ ID NO: 487963 - RNA, 64 nt, hsa; identical to SEQ ID NO: 322919

SEQ ID NO: 487964 - RNA, 64 nt, hsa; identical to SEQ ID NO: 322920

SEQ ID NO: 487965 - RNA, 64 nt, hsa; identical to SEQ ID NO: 322921

SEQ ID NO: 487966 - RNA, 64 nt, hsa; identical to SEQ ID NO: 322922

SEQ ID NO: 487967 - RNA, 64 nt, hsa; identical to SEQ ID NO: 322923

SEQ ID NO: 487968 - RNA, 64 nt, hsa; identical to SEQ ID NO: 322924

SEQ ID NO: 487969 - RNA, 64 nt, hsa; identical to SEQ ID NO: 322925

SEQ ID NO: 487970 - RNA, 64 nt, hsa; identical to SEQ ID NO: 322926

SEQ ID NO: 487971 - RNA, 64 nt, hsa; identical to SEQ ID NO: 322927

SEQ ID NO: 487972 - RNA, 64 nt, hsa; identical to SEQ ID NO: 322928

SEQ ID NO: 487973 - RNA, 64 nt, hsa; identical to SEQ ID NO: 322929

SEQ ID NO: 487974 - RNA, 64 nt, hsa; identical to SEQ ID NO: 322930

SEQ ID NO: 487975 - RNA, 64 nt, hsa; identical to SEQ ID NO: 322931

SEQ ID NO: 487976 - RNA, 64 nt, hsa; identical to SEQ ID NO: 322932

SEQ ID NO: 487977 - RNA, 51 nt, hsa; identical to SEQ ID NO: 201885

SEQ ID NO: 487978 - RNA, 64 nt, hsa; identical to SEQ ID NO: 322934

SEQ ID NO: 487979 - RNA, 64 nt, hsa; identical to SEQ ID NO: 322935

SEQ ID NO: 487980 - RNA, 64 nt, hsa; identical to SEQ ID NO: 322936

SEQ ID NO: 487981 - RNA, 64 nt, hsa; identical to SEQ ID NO: 322937

SEQ ID NO: 487982 - RNA, 64 nt, hsa; identical to SEQ ID NO: 322938

SEQ ID NO: 487983 - RNA, 64 nt, hsa; identical to SEQ ID NO: 322939

SEQ ID NO: 487984 - RNA, 64 nt, hsa; identical to SEQ ID NO: 322940

SEQ ID NO: 487985 - RNA, 64 nt, hsa; identical to SEQ ID NO: 322941

SEQ ID NO: 487986 - RNA, 64 nt, hsa; identical to SEQ ID NO: 322942

SEQ ID NO: 487987 - RNA, 64 nt, hsa; identical to SEQ ID NO: 322943

SEQ ID NO: 487988 - RNA, 64 nt, hsa; identical to SEQ ID NO: 322944

SEQ ID NO: 487989 - RNA, 64 nt, hsa; identical to SEQ ID NO: 322945

SEQ ID NO: 487990 - RNA, 64 nt, hsa; identical to SEQ ID NO: 322946

SEQ ID NO: 487991 - RNA, 64 nt, hsa; identical to SEQ ID NO: 322947

SEQ ID NO: 487992 - RNA, 64 nt, hsa; identical to SEQ ID NO: 322948

SEQ ID NO: 487993 - RNA, 64 nt, hsa; identical to SEQ ID NO: 322949

SEQ ID NO: 487994 - RNA, 64 nt, hsa; identical to SEQ ID NO: 322950

SEQ ID NO: 487995 - RNA, 64 nt, hsa; identical to SEQ ID NO: 322951

SEQ ID NO: 487996 - RNA, 64 nt, hsa; identical to SEQ ID NO: 322952

SEQ ID NO: 487997 - RNA, 64 nt, hsa; identical to SEQ ID NO: 322953

SEQ ID NO: 487998 - RNA, 64 nt, hsa; identical to SEQ ID NO: 322954

SEQ ID NO: 487999 - RNA, 64 nt, hsa; identical to SEQ ID NO: 322955

SEQ ID NO: 488000 - RNA, 64 nt, hsa; identical to SEQ ID NO: 322956

SEQ ID NO: 488001 - RNA, 64 nt, hsa; identical to SEQ ID NO: 322957

SEQ ID NO: 488002 - RNA, 64 nt, hsa; identical to SEQ ID NO: 322958

SEQ ID NO: 488003 - RNA, 64 nt, hsa; identical to SEQ ID NO: 322959

SEQ ID NO: 488004 - RNA, 64 nt, hsa; identical to SEQ ID NO: 322960

SEQ ID NO: 488005 - RNA, 64 nt, hsa; identical to SEQ ID NO: 322961

SEQ ID NO: 488006 - RNA, 64 nt, hsa; identical to SEQ ID NO: 322962

SEQ ID NO: 488007 - RNA, 64 nt, hsa; identical to SEQ ID NO: 322963

SEQ ID NO: 488008 - RNA, 64 nt, hsa; identical to SEQ ID NO: 322964

SEQ ID NO: 488009 - RNA, 64 nt, hsa; identical to SEQ ID NO: 322965

SEQ ID NO: 488010 - RNA, 64 nt, hsa; identical to SEQ ID NO: 322966

SEQ ID NO: 488011 - RNA, 64 nt, hsa; identical to SEQ ID NO: 322967

SEQ ID NO: 488012 - RNA, 64 nt, hsa; identical to SEQ ID NO: 322968

SEQ ID NO: 488013 - RNA, 64 nt, hsa; identical to SEQ ID NO: 322969

SEQ ID NO: 488014 - RNA, 64 nt, hsa; identical to SEQ ID NO: 322970

SEQ ID NO: 488015 - RNA, 64 nt, hsa; identical to SEQ ID NO: 322971

SEQ ID NO: 488016 - RNA, 54 nt, hsa; identical to SEQ ID NO: 201924

SEQ ID NO: 488017 - RNA, 64 nt, hsa; identical to SEQ ID NO: 322973

SEQ ID NO: 488018 - RNA, 64 nt, hsa; identical to SEQ ID NO: 322974

SEQ ID NO: 488019 - RNA, 64 nt, hsa; identical to SEQ ID NO: 322975

SEQ ID NO: 488020 - RNA, 64 nt, hsa; identical to SEQ ID NO: 322976

SEQ ID NO: 488021 - RNA, 64 nt, hsa; identical to SEQ ID NO: 322977

SEQ ID NO: 488022 - RNA, 64 nt, hsa; identical to SEQ ID NO: 322978

SEQ ID NO: 488023 - RNA, 64 nt, hsa; identical to SEQ ID NO: 322979

SEQ ID NO: 488024 - RNA, 64 nt, hsa; identical to SEQ ID NO: 322980

SEQ ID NO: 488025 - RNA, 64 nt, hsa; identical to SEQ ID NO: 322981

SEQ ID NO: 488026 - RNA, 64 nt, hsa; identical to SEQ ID NO: 322982

SEQ ID NO: 488027 - RNA, 64 nt, hsa; identical to SEQ ID NO: 322983

SEQ ID NO: 488028 - RNA, 64 nt, hsa; identical to SEQ ID NO: 322984

SEQ ID NO: 488029 - RNA, 64 nt, hsa; identical to SEQ ID NO: 322985

SEQ ID NO: 488030 - RNA, 64 nt, hsa; identical to SEQ ID NO: 322986

SEQ ID NO: 488031 - RNA, 64 nt, hsa; identical to SEQ ID NO: 322987

SEQ ID NO: 488032 - RNA, 64 nt, hsa; identical to SEQ ID NO: 322988

SEQ ID NO: 488033 - RNA, 64 nt, hsa; identical to SEQ ID NO: 322989

SEQ ID NO: 488034 - RNA, 64 nt, hsa; identical to SEQ ID NO: 322990

SEQ ID NO: 488035 - RNA, 64 nt, hsa; identical to SEQ ID NO: 322991

SEQ ID NO: 488036 - RNA, 64 nt, hsa; identical to SEQ ID NO: 322992

SEQ ID NO: 488037 - RNA, 64 nt, hsa; identical to SEQ ID NO: 322993

SEQ ID NO: 488038 - RNA, 64 nt, hsa; identical to SEQ ID NO: 322994

SEQ ID NO: 488039 - RNA, 58 nt, hsa
gcgagcccagcugcccagcccugcccccccuccccauagccagcacagcuaucccgcg

SEQ ID NO: 488040 - RNA, 58 nt, hsa
acacgaucugggggggggauccugucuuccuccccaccccaccccacucuuacccaau

SEQ ID NO: 488041 - RNA, 58 nt, hsa
ugaauagccaguggggcacacugacuguccuccccaggggaacugcagcgcccuccuc

SEQ ID NO: 488042 - RNA, 58 nt, hsa
guccuccccaggggaacugcagcgcccuccuccccacugcccccugcagccccugaga

SEQ ID NO: 488043 - RNA, 58 nt, hsa
cagccccugagauauuuugcucacuaucccuccccacuugcuucccugauaugugcuc

SEQ ID NO: 488044 - RNA, 58 nt, hsa
uucccugaagcccccaaucuggccccccccuccccagacuuccuccccaaaacacccc

SEQ ID NO: 488045 - RNA, 58 nt, hsa
ccaaucuggccccccccuccccagacuuccuccccaaaacaccccagcuuucuggcuu

SEQ ID NO: 488046 - RNA, 58 nt, hsa
gcuuagccaucucccuguccccagcaccccuccccagcccacagugguggccucugcc

SEQ ID NO: 488047 - RNA, 58 nt, hsa
gacaguguuugaaaagggccgccugcccccuccccacugugcuuuugaugccuuugga

SEQ ID NO: 488048 - RNA, 58 nt, hsa
gguuuuggcaaacgcuaaagagcccuugccuccccauuucccaucugcaccccuucuc

SEQ ID NO: 488049 - RNA, 58 nt, hsa
ccccauuucccaucugcaccccuucucuccuccccaaaucaauacacuaguuguuucu

SEQ ID NO: 488050 - RNA, 58 nt, hsa
guccugggacucggagacuauggccucgccuccccacccuccucuuggaauuacaagc

SEQ ID NO: 488051 - RNA, 58 nt, hsa
uagagaucuauuuuuucuaaaacauuccccuccccacuccucucccacagagugcugg

SEQ ID NO: 488052 - RNA, 58 nt, hsa
auccuucaagggagcugcuuggaaguggccuccccaggugccuuuggagagaacuguu

SEQ ID NO: 488053 - RNA, 58 nt, hsa
caccccacuuccucuacccccagguucuccuccccacagccaguccccuuuccuggau

SEQ ID NO: 488054 - RNA, 58 nt, hsa
gcuguuucuucuuugugcuucccgugugccuccccaguagcccucaccugcauaccaa

SEQ ID NO: 488055 - RNA, 58 nt, hsa
ugaccucagcucccgaaggcucgcacagccuccccauccuuccuucccagcccuugug

SEQ ID NO: 488056 - RNA, 58 nt, hsa
ugcccaccucaggcccccacccuccacuccuccccacgguacugugaacgucguguga

SEQ ID NO: 488057 - RNA, 58 nt, hsa
uuuggagaggcugagcuggagccauuggccuccccaggggcuuuccacccacacugca

SEQ ID NO: 488058 - RNA, 58 nt, hsa
ugggcuccgcguccuaggaccgccggcgccuccccacggacgccaggcaggccaggcc

SEQ ID NO: 488059 - RNA, 58 nt, hsa
uuccaaaacagccuguucucuccucucuccuccccagagcacccccugccaucagggg

SEQ ID NO: 488060 - RNA, 58 nt, hsa
gagcacgggcucuucccgccggguccucccuccccagaccccagagggagaggcccac

SEQ ID NO: 488061 - RNA, 58 nt, hsa
gcccgugggcugcccccugccuccccacccuccccauggcccacccaucugggcuguc

SEQ ID NO: 488062 - RNA, 58 nt, hsa
ccaacaccagcccgugggcugcccccugccuccccacccuccccauggcccacccauc

SEQ ID NO: 488063 - RNA, 58 nt, hsa
ccgggaagcauccuccccaccagagcugccuccccaauccauuuggcagaacugcugg

SEQ ID NO: 488064 - RNA, 58 nt, hsa
uccuccccugccgccucccgggaagcauccuccccaccagagcugccuccccaaucca

SEQ ID NO: 488065 - RNA, 58 nt, hsa
ucccaccuccucccuuugauggaaccacccuccccagaggcugcauugaggagacucc

SEQ ID NO: 488066 - RNA, 58 nt, hsa
acagucgccauccuccaggcguguggucccuccccauugggugcacagugcagagggg

SEQ ID NO: 488067 - RNA, 58 nt, hsa
auuccaccucucuaaaagaagguaauuuccuccccaaauugaccuuggggaauuauuc

SEQ ID NO: 488068 - RNA, 58 nt, hsa
uuuguucuucaucuccugucucuucaagccuccccacuccaccgugccgaaggagcuc

SEQ ID NO: 488069 - RNA, 58 nt, hsa
ccacucaaugugaacucuacuaccacgaccuccccauauuccucacuucuccaucacc

SEQ ID NO: 488070 - RNA, 58 nt, hsa
cauaaaacacuggagguuaguggaggccccuccccaagcagggagccugggaugggca

SEQ ID NO: 488071 - RNA, 58 nt, hsa
aggaguggacucuccacugaugggucucccuccccauccugguuuccaccccgggcug

SEQ ID NO: 488072 - RNA, 58 nt, hsa
agaaugugagcagauggcuaaguucucuccuccccagaauggauuaacagcugcgugg

SEQ ID NO: 488073 - RNA, 58 nt, hsa
cugcuggcucuguaacccagugcaccucccuccccagcuccggaggggguccuccucg

SEQ ID NO: 488074 - RNA, 58 nt, hsa
gaccuuccccagaugcugccaggcagccccuccccaagccucaaagaagcauuugcug

SEQ ID NO: 488075 - RNA, 58 nt, hsa
cugcagggccaggacugagccccgcagaccuccccagccccuagcccaggagagagaa

SEQ ID NO: 488076 - RNA, 58 nt, hsa
ggucucaggcuggugggaggggcgcccaccuccccacgcccuccccuccccugcugca

SEQ ID NO: 488077 - RNA, 58 nt, hsa
cugccggcccggacccgucccagccuccccuccccaccccaugcagcccccaggggga

SEQ ID NO: 488078 - RNA, 58 nt, hsa
gauagcccaugggccccuguggacccucccuccccaaguggacacauggcugugcagg

SEQ ID NO: 488079 - RNA, 58 nt, hsa
gcaggacacuggucgagagccaaaggucccuccccagacaucuggacacugggcauag

SEQ ID NO: 488080 - RNA, 58 nt, hsa
agauuucucaagaaggaagacuccccugccuccccagggccucugcucuccugggaga

SEQ ID NO: 488081 - RNA, 58 nt, hsa
ggcccucagcacccgaacacaucuuccuccuccccacccgagccuggagcacucuaac

SEQ ID NO: 488082 - RNA, 58 nt, hsa
uuuccuggagccccgagccagcccugucccuccccagugcagcauggcacucaggaga

SEQ ID NO: 488083 - RNA, 58 nt, hsa
ccccacuuccucccugaccuccccaugcccuccccagccucucccagcacaagugggg

SEQ ID NO: 488084 - RNA, 58 nt, hsa
ucaaccccaagccccacuuccucccugaccuccccaugcccuccccagccucucccag

SEQ ID NO: 488085 - RNA, 58 nt, hsa
acaggucccuccacucauauggccucucccuccccagcuaguggaggggaagcagucu

SEQ ID NO: 488086 - RNA, 58 nt, hsa
aucuauuuaagccucucucucuuucucuccuccccaacuuuuuucugaaagccuugau

SEQ ID NO: 488087 - RNA, 58 nt, hsa
cuauccauccgguggacugggcagcauuccuccccagggcucuucccuugggggccuc

SEQ ID NO: 488088 - RNA, 58 nt, hsa
ggauagauacacucauaaaacccccaccccuccccaccccaccccugcucccauugug

SEQ ID NO: 488089 - RNA, 58 nt, hsa
gacgguggccuggccagcccucgggaccccuccccaccuaacugcacugaaaccauuu

SEQ ID NO: 488090 - RNA, 58 nt, hsa
uucagacaguauggguuaaguucucugcccuccccaggggucugaggaggcucugggu

SEQ ID NO: 488091 - RNA, 58 nt, hsa
aagcugggacuucuccaggccuguguucccuccccaggaagugcgccccaaaccucuu

SEQ ID NO: 488092 - RNA, 58 nt, hsa
agauggauuaggagagggggugaugaccccuccccaagccccucagggcccagaccuu

SEQ ID NO: 488093 - RNA, 58 nt, hsa
ccggguucaagcgauuuuccugccucagccuccccaguagcugggacuacagacgugu

SEQ ID NO: 488094 - RNA, 58 nt, hsa
uccugaccucaucguccaccugccucggccuccccaaagugcugagauuaggcguuag

SEQ ID NO: 488095 - RNA, 58 nt, hsa
gcugagccccgcccugccaugagguuuuccuccccaggcaggcaggaggccgcgggga

SEQ ID NO: 488096 - RNA, 58 nt, hsa
aaguuggcugcugccuggggaagcuucuccuccccaaggcggccauggggcagccugc

SEQ ID NO: 488097 - RNA, 58 nt, hsa
ccucccucugucagggaaccugggacccccuccccacugccugcacagaggacccuga

SEQ ID NO: 488098 - RNA, 58 nt, hsa
ggggcugugaccugguccccaguguugcccuccccaguggcuggcaggggccugcuug

SEQ ID NO: 488099 - RNA, 58 nt, hsa
ccaucucccccaucccccacugccacacccuccccauucagacacuucauggaccaag

SEQ ID NO: 488100 - RNA, 58 nt, hsa
aagucauggcccaaauccagugugcaccccuccccauucacagagccuuuuucacaau

SEQ ID NO: 488101 - RNA, 58 nt, hsa
ucuccuucuaccacucuuaaauuuacucccuccccacccagaacccagauggggugga

SEQ ID NO: 488102 - RNA, 58 nt, hsa
uuccccaccucaggcccuaccccuggacccuccccaaccuuccuucucucuucuuugg

SEQ ID NO: 488103 - RNA, 58 nt, hsa
gcccccuccccccccgccccucugcuucccuccccacccaccaccucaaggguaggga

SEQ ID NO: 488104 - RNA, 58 nt, hsa
accuguuuuauuuuguuuucucguucucccuccccaccccacucccagccuuaucuau

SEQ ID NO: 488105 - RNA, 58 nt, hsa
ugggccggcuucaugccagcuacuuccuccuccccacuuguccgcugggugguacccu

SEQ ID NO: 488106 - RNA, 58 nt, hsa
uccagcgaccuuccucauccaccccaucccuccccaguucauugcacuuugauuagca

SEQ ID NO: 488107 - RNA, 58 nt, hsa
cacacacacacacauacauccugcuuucccuccccaaacccaucagacagguaaaugg

SEQ ID NO: 488108 - RNA, 58 nt, hsa
cucucucucccuuuuaaauggugggaacccuccccaaaaccuuuccccagacacauuc

SEQ ID NO: 488109 - RNA, 58 nt, hsa
cacggaggguucagaccccuccucagacccuccccacaucugaaacugccucccccca

SEQ ID NO: 488110 - RNA, 58 nt, hsa
aacuuuuuguuggcuuuuuccuuugucgccuccccagcaccugcccucccagucuccc

SEQ ID NO: 488111 - RNA, 58 nt, hsa
cuccugagaggcagggggcccuccgcccccuccccauguauuccccaccuguguuccg

SEQ ID NO: 488112 - RNA, 58 nt, hsa
gucauggguagcccacgccguccuuuccccuccccaaguguuucucuccugacccagg

SEQ ID NO: 488113 - RNA, 58 nt, hsa
ccggagaccaaacucaccaucccucaguccuccccaacaggguacuaggacugcagcc

SEQ ID NO: 488114 - RNA, 58 nt, hsa
gggucugcucaccccaacacaugccuucccuccccagccacaccgugcacgaaggggg

SEQ ID NO: 488115 - RNA, 58 nt, hsa
guuuacaugccaaacagaauguaacaccccuccccaagcccuucccagucacugcaug

SEQ ID NO: 488116 - RNA, 58 nt, hsa
uaauaauuuauuagaucuaaagccccuuccuccccagccccugcuuucauuaagguau

SEQ ID NO: 488117 - RNA, 58 nt, hsa
gaguucccccagaucaguaccccccaccccuccccagcuaguagcaugaccaggagag

SEQ ID NO: 488118 - RNA, 58 nt, hsa
uggugggaaaugggcaugagaauaaauaccuccccaaauucaaucugagcccagcagg

SEQ ID NO: 488119 - RNA, 58 nt, hsa
gaaaagcuugugugaaauucccucuucaccuccccaccccccaaaaaauaaaaggggg

SEQ ID NO: 488120 - RNA, 58 nt, hsa
cgacaggcagcccaagggccuggacaccccuccccaggcaggugcugccccaggagga

SEQ ID NO: 488121 - RNA, 58 nt, hsa
uggacugaggucccuguggccucggucuccuccccaugaagugggagcgaggcucccc

SEQ ID NO: 488122 - RNA, 58 nt, hsa
uuggggaggggucagcucuggccacaauccuccccaccagucucacccacuaggauag

SEQ ID NO: 488123 - RNA, 58 nt, hsa
uuaacccuccaccuccucucuuggacucccuccccaccccaaccacucuuucuuucuc

SEQ ID NO: 488124 - RNA, 58 nt, hsa
ucacuuuucuguuaagaaaacugagcccccuccccacagguuaaaaaacuuuaguaac

SEQ ID NO: 488125 - RNA, 58 nt, hsa
cuggguucacgccauucuccugccucagccuccccagcagcugggacuacaggcacac

SEQ ID NO: 488126 - RNA, 58 nt, hsa
aaucucauccaaauaacauuguucccauccuccccacccaccacaucaaaacauaaca

SEQ ID NO: 488127 - RNA, 58 nt, hsa
cacaucacagcacucaguagagguccugccuccccauuucucaagggaagccaguagg

SEQ ID NO: 488128 - RNA, 58 nt, hsa
gccgcccggguguggcucagccauguccccuccccagguccuucauucaccccucccc

SEQ ID NO: 488129 - RNA, 58 nt, hsa
ccuccccagguccuucauucaccccuccccuccccacaguggaauuguugaagugugg

SEQ ID NO: 488130 - RNA, 58 nt, hsa
cucagaguccacuguggcacuggccaccccuccccaguacaggggugcugcagguggc

SEQ ID NO: 488131 - RNA, 58 nt, hsa
ggcccaacucuccuggccuggccaucucccuccccagaaacagugugcauggguuauu

SEQ ID NO: 488132 - RNA, 58 nt, hsa
agucaaggucccuugaaucccaaaagugccuccccagccucagcccccaccuccagcc

SEQ ID NO: 488133 - RNA, 58 nt, hsa
cugccuugggggugaagugaaggcccagccuccccaccccaccgcgccccagggguug

SEQ ID NO: 488134 - RNA, 58 nt, hsa
ggaaaaggaagugcccaacaucucccagccuccccaggugccccccucaccuugaugg

SEQ ID NO: 488135 - RNA, 58 nt, hsa
gcaggaacuccccaccccagggacaccgccuccccauuuuccggggcagaguggggac

SEQ ID NO: 488136 - RNA, 58 nt, hsa
cauccauaguucugccuccccagcuucuccuccccaguuguaaauaguauuuauuagc

SEQ ID NO: 488137 - RNA, 58 nt, hsa
ccugguuccccacacauccauaguucugccuccccagcuucuccuccccaguuguaaa

SEQ ID NO: 488138 - RNA, 58 nt, hsa
aacaacauauaaaacuguuucaagcccuccuccccagagcuggcgcucagcagcccua

SEQ ID NO: 488139 - RNA, 58 nt, hsa
ccccacccaacuccacagggcuguuuugccuccccacggaaggcgggcugaggagaca

SEQ ID NO: 488140 - RNA, 58 nt, hsa
aacaucuccucuuggugccuuccugggcccuccccagcuccagcucucccagaccuac

SEQ ID NO: 488141 - RNA, 58 nt, hsa
augagcacuucccugaguccucaccagcccuccccauuuguccuccaagacuccacuc

SEQ ID NO: 488142 - RNA, 58 nt, hsa
acggagacagaggaaagggcuggcucccccuccccaggcuggagacccccccccaacu

SEQ ID NO: 488143 - RNA, 58 nt, hsa
ggccggcggcuacucuggaauguuuuucccuccccagaaucaagcuuuugcuugaucc

SEQ ID NO: 488144 - RNA, 58 nt, hsa
guguggcuuuccaggcacccucagggagccuccccaucuguccagcuggggccagagg

SEQ ID NO: 488145 - RNA, 58 nt, hsa
ggggugggggaugcuucugggggcccugccuccccauugugugcccagaacaucccug

SEQ ID NO: 488146 - RNA, 58 nt, hsa
cuaaaccauaauuguaaccagugccuuuccuccccacuggagggcaagcccccccacc

SEQ ID NO: 488147 - RNA, 58 nt, hsa
aaauuguugcuguguucugugaaaauaaccuccccaaaauaauuaguaacugguuguu

SEQ ID NO: 488148 - RNA, 58 nt, hsa
ccuaccagugcaugagacacacaccuacccuccccagcuuuccaggaacccuacuggc

SEQ ID NO: 488149 - RNA, 58 nt, hsa
ugggcuguggucucugacccccuggaggccuccccacgccucacagaacacagugcag

SEQ ID NO: 488150 - RNA, 58 nt, hsa
cccagcccugcaggugggacuggcucucccuccccagccacgaguaugccacaggggg

SEQ ID NO: 488151 - RNA, 58 nt, hsa
cucucccucucucucccucucucuuuacccuccccagggcuccaucuccgccucaggg

SEQ ID NO: 488152 - RNA, 58 nt, hsa
gcccgccucaguuccuuugcgucuguugccuccccagcccugcacgcccuggcuggca

SEQ ID NO: 488153 - RNA, 58 nt, hsa
cguccuccuccacagccugucacugcccccuccccagccuguguccacagugcuguga

SEQ ID NO: 488154 - RNA, 58 nt, hsa
caagaacuagcgugagcccagccaggcgccuccccaccgggcucucaggacacccugc

SEQ ID NO: 488155 - RNA, 58 nt, hsa
uccccguucagaccagagugccccggccccuccccagccugagucuucuccuugcucu

SEQ ID NO: 488156 - RNA, 58 nt, hsa
cagucagguuguuuaccagcccuuugcaccuccccaggcagagggagccucuguucug

SEQ ID NO: 488157 - RNA, 58 nt, hsa
acugugcagaacucuccacuuccccaacccuccccaggugggcagggcggagggagcc

SEQ ID NO: 488158 - RNA, 58 nt, hsa
augcccuagggccccccaagugccugccccuccccagaguauuaacgcuccaagagua

SEQ ID NO: 488159 - RNA, 58 nt, hsa
gcccagucccgcaguacauccccuguccccuccccaaccccaagugccuucaugcccu

SEQ ID NO: 488160 - RNA, 58 nt, hsa
aucccccaugguguuuauuauuuauuucccuccccaugccccuggggaccccaaggcc

SEQ ID NO: 488161 - RNA, 58 nt, hsa
cuuuagugccacaaauaagcaucgagcaccuccccauucacacccccauuccuccugg

SEQ ID NO: 488162 - RNA, 58 nt, hsa
ccaccggccaugaggagcccacgccuguccuccccaucacuuuccugucccugagaac

SEQ ID NO: 488163 - RNA, 58 nt, hsa
auggcucgggucaguccucaucgcucccccuccccaccccgcgcaggccacugagacg

SEQ ID NO: 488164 - RNA, 58 nt, hsa
ugcagaaucucaguggcaucuggguucaccuccccacucugaugaucuccagccucca

SEQ ID NO: 488165 - RNA, 58 nt, hsa
cccucccuuuccuuuuccccucuucuacccuccccaagaaaaagggccuucaaggcag

SEQ ID NO: 488166 - RNA, 58 nt, hsa
cgaaggugcuuggcggucuugccuucccccuccccacaggcucuccuugugggguccc

SEQ ID NO: 488167 - RNA, 58 nt, hsa
agucccgccuggugggcauuugccgccgccuccccaccaccagucacugccucgcaga

SEQ ID NO: 488168 - RNA, 58 nt, hsa
ugaaugccgagcuaacuguugccacucuccuccccagacuaugaaaucccuggagaau

SEQ ID NO: 488169 - RNA, 58 nt, hsa
gucgguuuccgcccucuagcgaugcuguccuccccacuccuccgcucugcucccuggc

SEQ ID NO: 488170 - RNA, 58 nt, hsa
agcuguggagcuggcugagucacagccaccuccccaccuccccgcaagcuggucccau

SEQ ID NO: 488171 - RNA, 58 nt, hsa
gugaccugcccucaaaccuugccugccaccuccccauucaggccugguggcaggaagg

SEQ ID NO: 488172 - RNA, 58 nt, hsa
agaugaccucuuuuaaaagcaaagccccccuccccauacaccccaagccugagcccug

SEQ ID NO: 488173 - RNA, 58 nt, hsa
uggcugugcuuccuggggaaaugaacccccuccccacagacaccacccuggguggauc

SEQ ID NO: 488174 - RNA, 58 nt, hsa
gagcugcuucucucuucucccaguucuaccuccccagaagccuuccuccccagguggg

SEQ ID NO: 488175 - RNA, 58 nt, hsa
cucccaguucuaccuccccagaagccuuccuccccagguggggcugauggagcaaggg

SEQ ID NO: 488176 - RNA, 58 nt, hsa
cugggcuuucacgggccccauuccaccgccuccccaacuugagccugugaccuuggga

SEQ ID NO: 488177 - RNA, 58 nt, hsa
cacuggagcugggaggucucgucccagcccuccccaucucggggcugcuguguggacg

SEQ ID NO: 488178 - RNA, 58 nt, hsa
ccugggcucugggagugggggcuccagcccuccccacuaugcccaggagucuucccaa

SEQ ID NO: 488179 - RNA, 58 nt, hsa
ggccuggggcugugggaugccccaucccccuccccaucaccuuuggugggggcagggc

SEQ ID NO: 488180 - RNA, 58 nt, hsa
ccuaccaugcaccauguuccuugccaggccuccccaaccccuggccucaauuucccuu

SEQ ID NO: 488181 - RNA, 58 nt, hsa
cgagcccagcuuccuaacccaagacacaccuccccaaccucagucuucccaucugaac

SEQ ID NO: 488182 - RNA, 58 nt, hsa
gggagaagaagggcaccauccucucuuuccuccccagggucuacugcugauuucuaga

SEQ ID NO: 488183 - RNA, 58 nt, hsa
ggugcuggugaggguucgccagcccuccccuccccagggucauagagggggccaugag

SEQ ID NO: 488184 - RNA, 58 nt, hsa
gaaagaacagugugccucaaacuccugcccuccccaggccucuggggcccacuggaaa

SEQ ID NO: 488185 - RNA, 58 nt, hsa
accccacggccccacuguccacacacugccuccccaccgcccaccucggcugcuaggc

SEQ ID NO: 488186 - RNA, 58 nt, hsa
gcaccagccaagcuggugcuccagcgcaccuccccagagcuccccgcacugacggggc

SEQ ID NO: 488187 - RNA, 58 nt, hsa
aacugccccaucuccucccauggccuucccuccccacaguccucacagccucucccuu

SEQ ID NO: 488188 - RNA, 58 nt, hsa
cucccuuaaugagcaaggacaaccugccccuccccagcccuuugcaggcccagcagac

SEQ ID NO: 488189 - RNA, 58 nt, hsa
aggagaagauggccuacuuggaucaaacccuccccagagcccccggccaggcaccccc

SEQ ID NO: 488190 - RNA, 58 nt, hsa
gucaguccuaccuuuuucuuucugagagccuccccaccccgagaucacauuucucacu

SEQ ID NO: 488191 - RNA, 58 nt, hsa
cuucccgguuccuaguucuuugccagcuccuccccacucugugcgaccuuuccaagcc

SEQ ID NO: 488192 - RNA, 58 nt, hsa
aggucuggguacugaguguccagagcugccuccccaggagguuaaggugggggcaaag

SEQ ID NO: 488193 - RNA, 58 nt, hsa
cguaucuuuucuccuccucccuaguguuccuccccauuuuuucagaaaacacuucuga

SEQ ID NO: 488194 - RNA, 58 nt, hsa
uagucccuccauccuuaauccccccaucccuccccaucaugcaaccagugguuuaauc

SEQ ID NO: 488195 - RNA, 58 nt, hsa
uccagacucuuccuggacuggcuugccuccuccccaccuccccacccuggaaccccug

SEQ ID NO: 488196 - RNA, 58 nt, hsa
cuuccuggacuggcuugccuccuccccaccuccccacccuggaaccccugagggccaa

SEQ ID NO: 488197 - RNA, 58 nt, hsa
gcaggaucuggcccgagcucuccucagaccuccccagaccugucuucucaucagccac

SEQ ID NO: 488198 - RNA, 58 nt, hsa
aggugugcuguuccuucccagccccaucccuccccacccuuccuacucccagcuuuca

SEQ ID NO: 488199 - RNA, 58 nt, hsa
uuuccaauccuuuauagcuuuggagacgccuccccaauuccccagggaaggaaacugu

SEQ ID NO: 488200 - RNA, 58 nt, hsa
gaacccauccaauggauugugcaaauccccuccccaaacccacccauaccagcuagaa

SEQ ID NO: 488201 - RNA, 58 nt, hsa
uacucaggaaaaugucaccaagcacccuccuccccaguucacaaaaggaagaagauga

SEQ ID NO: 488202 - RNA, 58 nt, hsa
aagaugaagauucugucucccuguucccccuccccaguuuuccaaagugucugagcau

SEQ ID NO: 488203 - RNA, 58 nt, hsa
ccucugcaagugggagagacccgagcauccuccccacccccauagcuccagugcacgc

SEQ ID NO: 488204 - RNA, 58 nt, hsa
gcccccagaggaccgggaggcaccccacccuccccaccagugcaacagaaaccaccug

SEQ ID NO: 488205 - RNA, 58 nt, hsa
uagaaauaugcauagguagaauguacccccuccccaagcaugaaaaucaucucacuga

SEQ ID NO: 488206 - RNA, 58 nt, hsa
cucaaucucccaccccauguaggcacuaccuccccaauuacccuuagaaaaugaucac

SEQ ID NO: 488207 - RNA, 58 nt, hsa
cuucaugagaguacuagccuccuccacuccuccccacagcgcagaggaaacaggccag

SEQ ID NO: 488208 - RNA, 58 nt, hsa
gaugagcuggcgcagccccgcccuccauccuccccacaucccugcagccaccucccag

SEQ ID NO: 488209 - RNA, 58 nt, hsa
uagggauauuuuuauaaaacaauuguguccuccccacauuuugcuauguuaauauuug

SEQ ID NO: 488210 - RNA, 58 nt, hsa
gugauaaacaccuccagcuuucuaacauccuccccacaccaucucaccauauccaucu

SEQ ID NO: 488211 - RNA, 58 nt, hsa
agcucacccacuuuggagcagcauuucuccuccccagaggaccucgaaggcugcaacg

SEQ ID NO: 488212 - RNA, 58 nt, hsa
uguguccuccccuccccucccuuccucuccuccccacaggcggaauugcuuucuucug

SEQ ID NO: 488213 - RNA, 58 nt, hsa
aagaagcucagagcugccccuuccacuuccuccccaaaagggaugaagaaaacccugu

SEQ ID NO: 488214 - RNA, 58 nt, hsa
gugccucacugacccccaggggccucauccuccccauggaaugggcuguauguccugc

SEQ ID NO: 488215 - RNA, 58 nt, hsa
ggagggagggcagacggaggcccgagagccuccccaggccucuucgugggaaggcccc

SEQ ID NO: 488216 - RNA, 58 nt, hsa
ugggcugggcuaaaugggagggguugucccuccccaucauccauuccugugagguguc

SEQ ID NO: 488217 - RNA, 58 nt, hsa
cacccuccccgugcugcuguguucugcuccuccccacgcuucccugcuauaguuccca

SEQ ID NO: 488218 - RNA, 58 nt, hsa
acucauccuuuccccagcccucuucagcccuccccaguccuccccagccuucuucagc

SEQ ID NO: 488219 - RNA, 58 nt, hsa
uccccagcccucuucagcccuccccaguccuccccagccuucuucagccuucuucagc

SEQ ID NO: 488220 - RNA, 58 nt, hsa
ccccagcugaccagggaggcagaggacaccuccccaucacucagcauucccagcucag

SEQ ID NO: 488221 - RNA, 58 nt, hsa
ucuggaggaccaagcccuccccuaaugcccuccccauggauuccuuagugaucugugc

SEQ ID NO: 488222 - RNA, 58 nt, hsa
gcugugaccuguuuggcucccaucuauaccuccccaugacaccuaggcugucagucuc

SEQ ID NO: 488223 - RNA, 58 nt, hsa
gcgacuaggagcagggcugccucuucucccuccccaaggucugcuugugggcacgcuc

SEQ ID NO: 488224 - RNA, 58 nt, hsa
ccggguucaagcauuucuccugucucagccuccccaguagcugggauuacaggcaccc

SEQ ID NO: 488225 - RNA, 58 nt, hsa
cgggaaucuuggucggaaacaagccgggccuccccagcugccugggcuugaccggcgg

SEQ ID NO: 488226 - RNA, 58 nt, hsa
agcccacauuuuuguugcuccccaaaucccuccccacguggggaugagaaccuuccug

SEQ ID NO: 488227 - RNA, 58 nt, hsa
ccucgcucaguugugauccagcagccccccuccccacugccuccccagcucucaguga

SEQ ID NO: 488228 - RNA, 58 nt, hsa
ugugauccagcagccccccuccccacugccuccccagcucucagugaccccgacuguc

SEQ ID NO: 488229 - RNA, 58 nt, hsa
uggucaggagccaguuucuccagccccuccuccccacaaccccuaguggggaggggca

SEQ ID NO: 488230 - RNA, 58 nt, hsa
uagccugcccccccacccccacuucaccccuccccagcuucccaaacuucugucugcc

SEQ ID NO: 488231 - RNA, 58 nt, hsa
caccgcaucaguccccaucaucacuacuccuccccagagacauacagauugcccuccc

SEQ ID NO: 488232 - RNA, 58 nt, hsa
uguuuuggccaccuggggccgcccccaaccuccccaccccaagaggggucugaguggg

SEQ ID NO: 488233 - RNA, 58 nt, hsa
aggccaaggccuucuccuccccacccgcccuccccacggggccucgggaccucaggug

SEQ ID NO: 488234 - RNA, 58 nt, hsa
uccagcuucaggcaggccaaggccuucuccuccccacccgcccuccccacggggccuc

SEQ ID NO: 488235 - RNA, 58 nt, hsa
cauaagucuguucauccugcugaaguccccuccccauugcuccuucaagccaaaacua

SEQ ID NO: 488236 - RNA, 58 nt, hsa
gucccucucucuuugacucucccuuuguccuccccauagagcuggggugggguggauc

SEQ ID NO: 488237 - RNA, 58 nt, hsa
cuguccagagagagaagugccccugcugccuccccaacccugccccugccccgucacc

SEQ ID NO: 488238 - RNA, 58 nt, hsa
ugggacagagucuggguguauuuauuuuccuccccagcagguggggaggggguuuggg

SEQ ID NO: 488239 - RNA, 58 nt, hsa
gagucugggcccuaggccuagccccaucccuccccaugaggggccaagacacugccua

SEQ ID NO: 488240 - RNA, 58 nt, hsa
ggcuccaguucugggcugggagcugugaccuccccaacgcucaccccucaaccccaag

SEQ ID NO: 488241 - RNA, 58 nt, hsa
cagcugccuguuuccuccccaucagccuccuccccacauccccagcugccuggcuggg

SEQ ID NO: 488242 - RNA, 58 nt, hsa
gcucuaccgggaggacagcugccuguuuccuccccaucagccuccuccccacaucccc

SEQ ID NO: 488243 - RNA, 58 nt, hsa
agguucucaagacacgaguccccuuguuccuccccauuaaaggggguuugucagaagc

SEQ ID NO: 488244 - RNA, 58 nt, hsa
agauuuuucuaaauugaaaacacgccccccuccccacaccuccaggaacuccacuccc

SEQ ID NO: 488245 - RNA, 58 nt, hsa
cuuguucugguggagcugggguuucucuccuccccagucccacaacacugccaaaaau

SEQ ID NO: 488246 - RNA, 58 nt, hsa
caucuuuccucccgucccugccccgccaccuccccaaagaauugaaacgucagcucag

SEQ ID NO: 488247 - RNA, 58 nt, hsa
gcagagauuggcuuggggccagaaggacccuccccaacccuggagacacccugaaggu

SEQ ID NO: 488248 - RNA, 58 nt, hsa
uacagaagcuugacaagcauguccucacccuccccaccacauaaacacauggacacac

SEQ ID NO: 488249 - RNA, 58 nt, hsa
ccugaucugugcggcuccagccucgcccccuccccacgugcaccauaccuggggaguu

SEQ ID NO: 488250 - RNA, 58 nt, hsa
acaacuuuggacaccccaggcugccaccccuccccacccguucacccccaggaugcug

SEQ ID NO: 488251 - RNA, 58 nt, hsa
ugcuguaggacgccugcugcccuggagcccuccccaggaugugagccaguccccucgc

SEQ ID NO: 488252 - RNA, 58 nt, hsa
ggcugccacaagcucucugcggguccauccuccccaccgggguccguccucgcaggcc

SEQ ID NO: 488253 - RNA, 58 nt, hsa
ccagcugcuucggccuucaggugaccucccuccccacggcauccugcucuccgggugg

SEQ ID NO: 488254 - RNA, 58 nt, hsa
cagaggugccuggccaugccugcacacuccuccccauuuuaauaaauggucgcaacuu

SEQ ID NO: 488255 - RNA, 58 nt, hsa
ggugacguauguagaaugcuuaggguguccuccccacagagcagauacuugaaccgac

SEQ ID NO: 488256 - RNA, 58 nt, hsa
uaaagagcacuuuguccugcuucacggaccuccccaaagugugcagaguucuauauag

SEQ ID NO: 488257 - RNA, 58 nt, hsa
ccgggccagacagcuguccccccguccuccuccccagcccagccugcucagagaagcu

SEQ ID NO: 488258 - RNA, 58 nt, hsa
agggcaaguccugaaaggcccaaggcccccuccccagucuggccuuggccuccagccu

SEQ ID NO: 488259 - RNA, 58 nt, hsa
ccaucuuggucaugagcuacugucugucccuccccaggacccgcggugggugcugcau

SEQ ID NO: 488260 - RNA, 58 nt, hsa
gggcuggccugggggucuugggaaggccccuccccaggcccuaggccaccucgcggaa

SEQ ID NO: 488261 - RNA, 58 nt, hsa
ggcccucguccucccugccucucaucugccuccccaacccccaccuacccacugcucc

SEQ ID NO: 488262 - RNA, 58 nt, hsa
ccacccuguccacgugaagugccaacgcccuccccacccugggccgagcccccacccc

SEQ ID NO: 488263 - RNA, 58 nt, hsa
gccaccagaaggugacacccccagaaucccuccccagagacugcaccagcgcagccag

SEQ ID NO: 488264 - RNA, 58 nt, hsa
ccccaucucccugccagccccuaacuacccuccccagccuccaggaacuauccaucca

SEQ ID NO: 488265 - RNA, 58 nt, hsa
aaggccugaugcauucauaaguugaagcccuccccagauccccuuggggagccucugc

SEQ ID NO: 488266 - RNA, 58 nt, hsa
uguucauuucaucuggcuccccccaccaccuccccaccccaccccccacccccugcuu

SEQ ID NO: 488267 - RNA, 58 nt, hsa
cccacagggagccccggccauuugcugcccuccccaccccugccccagccucaggacu

SEQ ID NO: 488268 - RNA, 58 nt, hsa
aggagccauccgccccccucagccccuuccuccccagggagcaaagccauaaggggca

SEQ ID NO: 488269 - RNA, 58 nt, hsa
cccaggagauccuggacugccugacuccccuccccagacuggcuugggagccugggcc

SEQ ID NO: 488270 - RNA, 58 nt, hsa
uggcccccagggcuacccuacacaacgcccuccccaggccccccuaagcugcucuccc

SEQ ID NO: 488271 - RNA, 58 nt, hsa
ucugcccugugacuccuggaaccugcguccuccccaaagccaugggagggguguccuc

SEQ ID NO: 488272 - RNA, 58 nt, hsa
gccacccccaggugcugggggcacagccccuccccacuccggccacgcccccacccac

SEQ ID NO: 488273 - RNA, 58 nt, hsa
ccagauucacgccauucuccugccucagccuccccagcagcugggacuacaggcaccc

SEQ ID NO: 488274 - RNA, 58 nt, hsa
aaccuggacccaggcagccucuuuccucccuccccaaucucuuccauuuuucuacaga

SEQ ID NO: 488275 - RNA, 58 nt, hsa
ccucucuggaguuugccucccccagcccccuccccaucaauaaaacucuguuuacaac

SEQ ID NO: 488276 - RNA, 58 nt, hsa
uaagcccucccccaccccuggaaaggucccuccccaacccaggccccuggcgugugug

SEQ ID NO: 488277 - RNA, 58 nt, hsa
acgcucugcuggucaguggcggcuguccccuccccagcccagccgcccagccacaugu

SEQ ID NO: 488278 - RNA, 58 nt, hsa
caugcaauugccugucccccccggccagccuccccaacuugauguuuguguuuuguuu

SEQ ID NO: 488279 - RNA, 58 nt, hsa
gucccucccccauccccccuccccacccccuccccaauacagcuacguuuguacauca

SEQ ID NO: 488280 - RNA, 58 nt, hsa
aagacugacccgucccucccccauccccccuccccacccccuccccaauacagcuacg

SEQ ID NO: 488281 - RNA, 58 nt, hsa
ucugcaaauccccucccccugccccccaccuccccaggcucaccuugccaugccaggu

SEQ ID NO: 488282 - RNA, 58 nt, hsa
gcugcccuucacaccuuuuggugcuaccccuccccagaguuaagcacuggaugucucc

SEQ ID NO: 488283 - RNA, 58 nt, hsa
ucuccccucccuccccacccaagccucaccuccccaccccuugaacccccaugcaaug

SEQ ID NO: 488284 - RNA, 58 nt, hsa
auacugcagucuggcucuuucuccccucccuccccacccaagccucaccuccccaccc

SEQ ID NO: 488285 - RNA, 58 nt, hsa
gggggggccaggcuccagagagggggcaccuccccacacaccccccccccaccgaggc

SEQ ID NO: 488286 - RNA, 58 nt, hsa
ggugcccucccagacccccuugcccaggccuccccagcaccuagguggggccuggggu

SEQ ID NO: 488287 - RNA, 58 nt, hsa
auccucaacuuucuguccauucgggccuccuccccaccucccacgccccagccccucc

SEQ ID NO: 488288 - RNA, 58 nt, hsa
cccccuccucuccagccugucaggccagccuccccagcccccuucccucaacucuagg

SEQ ID NO: 488289 - RNA, 58 nt, hsa
ccaggaccagaggccugucucccccuucccuccccaccggcccgggggagaccucuuc

SEQ ID NO: 488290 - RNA, 58 nt, hsa
ccagacucugcacggauguccuaggcccccuccccaacucuaaccagaccccaucccc

SEQ ID NO: 488291 - RNA, 58 nt, hsa
ccaaacuguacagacucucccaccccaaccuccccagacucugcacggauguccuagg

SEQ ID NO: 488292 - RNA, 58 nt, hsa
gcagccccgcgccccugagacuggagacccuccccaguguggcauuuccugccagggg

SEQ ID NO: 488293 - RNA, 58 nt, hsa
uuuggaugggaggccucucuguuacagcccuccccaugcugugcccugccauauacgu

SEQ ID NO: 488294 - RNA, 58 nt, hsa
cccccaccccuuccccgacacccaagccccuccccacgucgcccccuccugcacagcc

SEQ ID NO: 488295 - RNA, 58 nt, hsa
aucucucugccccgccccgccccuccggccuccccacaccccccuugcccucacuacc

SEQ ID NO: 488296 - RNA, 58 nt, hsa
gacaccucacuucccuagagaaggccugccuccccauagggaaucuggggguuucuuc

SEQ ID NO: 488297 - RNA, 58 nt, hsa
uaaugagccccuuauuuucuuuuuuuucccuccccaggucuaguagcucuaacuaaaa

SEQ ID NO: 488298 - RNA, 58 nt, hsa
aguguggccuggauccauccugcuagcaccuccccagacagggcuccagccugucggc

SEQ ID NO: 488299 - RNA, 58 nt, hsa
aggcccccguugaagccgcucccgguucccuccccagcuccucgucuuugaacugccg

SEQ ID NO: 488300 - RNA, 58 nt, hsa
gugagagaggaccuccaugcccccgccaccuccccacuccagcagauaaggccgagcc

SEQ ID NO: 488301 - RNA, 58 nt, hsa
uccugcagggagccuucugccaccagccccuccccagacucucagguggaggcaacag

SEQ ID NO: 488302 - RNA, 58 nt, hsa
aaguuccacuuccaggucugccugguucccuccccaaggccacagggagcuccgucag

SEQ ID NO: 488303 - RNA, 58 nt, hsa
uccugagccugcuucugccugcuuuccaccuccccagucccuuucucuggcccugucc

SEQ ID NO: 488304 - RNA, 58 nt, hsa
uuauugccucuuucucagaauccucuuuccuccccauuuggcccugggcucaggggac

SEQ ID NO: 488305 - RNA, 58 nt, hsa
ugagggcagaugccacaagauucccgaaccuccccaaaccccgcccuacugucucuuc

SEQ ID NO: 488306 - RNA, 58 nt, hsa
uggccuucagaaccuucucucuggucuuccuccccacuucuucccugccuucuagaga

SEQ ID NO: 488307 - RNA, 58 nt, hsa
cuguguccggagccuggcggggaggcggccuccccaguaugugagugcagggaucugc

SEQ ID NO: 488308 - RNA, 58 nt, hsa
cagccucuacgggcagaguccggcauccccuccccagacugccugcugucaaaccacg

SEQ ID NO: 488309 - RNA, 58 nt, hsa
aagccugggcauggccugggucgcacccccuccccacggccccacccacagggaccuc

SEQ ID NO: 488310 - RNA, 58 nt, hsa
ccucaccacggacacggacagaggaccaccuccccauacagagagaggcuucccuccc

SEQ ID NO: 488311 - RNA, 58 nt, hsa
ucagcagccacucauagcacagauuccuccuccccaggccuucccuacucaacgguca

SEQ ID NO: 488312 - RNA, 58 nt, hsa
cugccccccacgggcauccuacccacugccuccccauccccgcuggccccagacccgc

SEQ ID NO: 488313 - RNA, 58 nt, hsa
ggggaccaggaccccacagcgcacccccccuccccaccaacuucucugccccagggac

SEQ ID NO: 488314 - RNA, 58 nt, hsa
cacagggggcuggugacacccagagcccccuccccagcccucaggcccucccugccaa

SEQ ID NO: 488315 - RNA, 58 nt, hsa
cucagccacgccccuccggccucagcucccuccccaaagugccugagcgccgccucug

SEQ ID NO: 488316 - RNA, 58 nt, hsa
ucccucccccaacacuguccacacugccccuccccacuguuuauuuauugcacggauc

SEQ ID NO: 488317 - RNA, 58 nt, hsa
ugagccacagugaccgccugcccccgccccuccccaucuguccccucucuccacaccc

SEQ ID NO: 488318 - RNA, 58 nt, hsa
gcagcuggacccugcaggguggcucccuccuccccaucaagcacaagagagggcccag

SEQ ID NO: 488319 - RNA, 58 nt, hsa
accgcagugggccugcaagccgcccgagccuccccagcagccuccuacagagcaggaa

SEQ ID NO: 488320 - RNA, 58 nt, hsa
uauccaggaccccccggauucuccacgcccuccccaucucccagucucccugcccccc

SEQ ID NO: 488321 - RNA, 58 nt, hsa
uacugcuuuaaaacacaacuccagagccccuccccaagcuccccuccccaagcuccug

SEQ ID NO: 488322 - RNA, 58 nt, hsa
acaacuccagagccccuccccaagcuccccuccccaagcuccugaagacccgguuucu

SEQ ID NO: 488323 - RNA, 58 nt, hsa
aaucacacccuuggaauagaaauuuccaccuccccaaccuuucucucagacagcuuau

SEQ ID NO: 488324 - RNA, 58 nt, hsa
uuuuagggugguuaggacaucucccccaccuccccacuuuuuuccccaagacaagaca

SEQ ID NO: 488325 - RNA, 58 nt, hsa
aacccuucgguauuguucaaagaaccccccuccccaaggaagaacaaauaugauucuc

SEQ ID NO: 488326 - RNA, 58 nt, hsa
uuccauggugguuucagaaagggcagccccuccccauggugcagugaagaaaauguuu

SEQ ID NO: 488327 - RNA, 58 nt, hsa
caacugcucaauaaaccuccugcccuccccuccccagcaggaggcaggcauggaccac

SEQ ID NO: 488328 - RNA, 58 nt, hsa
cugcguccacgcccucugaauucccaccccuccccaacugcucaauaaaccuccugcc

SEQ ID NO: 488329 - RNA, 58 nt, hsa
aaaauauauauacacauagcaauguccuccuccccauguccucccugccuugggaccc

SEQ ID NO: 488330 - RNA, 58 nt, hsa
cccaccccagcagcccucucuucccccaccuccccagcagcccccacccuugccccag

SEQ ID NO: 488331 - RNA, 64 nt, hsa; identical to SEQ ID NO: 53335

SEQ ID NO: 488332 - RNA, 64 nt, hsa; identical to SEQ ID NO: 53336

SEQ ID NO: 488333 - RNA, 64 nt, hsa; identical to SEQ ID NO: 53337

SEQ ID NO: 488334 - RNA, 64 nt, hsa; identical to SEQ ID NO: 53338

SEQ ID NO: 488335 - RNA, 64 nt, hsa; identical to SEQ ID NO: 53339

SEQ ID NO: 488336 - RNA, 64 nt, hsa; identical to SEQ ID NO: 53340

SEQ ID NO: 488337 - RNA, 64 nt, hsa; identical to SEQ ID NO: 53341

SEQ ID NO: 488338 - RNA, 64 nt, hsa; identical to SEQ ID NO: 53342

SEQ ID NO: 488339 - RNA, 51 nt, hsa; identical to SEQ ID NO: 53343

SEQ ID NO: 488340 - RNA, 64 nt, hsa; identical to SEQ ID NO: 53344

SEQ ID NO: 488341 - RNA, 64 nt, hsa; identical to SEQ ID NO: 53345

SEQ ID NO: 488342 - RNA, 64 nt, hsa; identical to SEQ ID NO: 53346

SEQ ID NO: 488343 - RNA, 64 nt, hsa; identical to SEQ ID NO: 53347

SEQ ID NO: 488344 - RNA, 64 nt, hsa; identical to SEQ ID NO: 53348

SEQ ID NO: 488345 - RNA, 64 nt, hsa; identical to SEQ ID NO: 53349

SEQ ID NO: 488346 - RNA, 64 nt, hsa; identical to SEQ ID NO: 53350

SEQ ID NO: 488347 - RNA, 64 nt, hsa; identical to SEQ ID NO: 53351

SEQ ID NO: 488348 - RNA, 64 nt, hsa; identical to SEQ ID NO: 53352

SEQ ID NO: 488349 - RNA, 64 nt, hsa; identical to SEQ ID NO: 53353

SEQ ID NO: 488350 - RNA, 64 nt, hsa; identical to SEQ ID NO: 53354

SEQ ID NO: 488351 - RNA, 64 nt, hsa; identical to SEQ ID NO: 53355

SEQ ID NO: 488352 - RNA, 64 nt, hsa; identical to SEQ ID NO: 53356

SEQ ID NO: 488353 - RNA, 64 nt, hsa; identical to SEQ ID NO: 53357

SEQ ID NO: 488354 - RNA, 64 nt, hsa; identical to SEQ ID NO: 53358

SEQ ID NO: 488355 - RNA, 64 nt, hsa; identical to SEQ ID NO: 53359

SEQ ID NO: 488356 - RNA, 64 nt, hsa; identical to SEQ ID NO: 53360

SEQ ID NO: 488357 - RNA, 64 nt, hsa; identical to SEQ ID NO: 53361

SEQ ID NO: 488358 - RNA, 64 nt, hsa; identical to SEQ ID NO: 53362

SEQ ID NO: 488359 - RNA, 64 nt, hsa; identical to SEQ ID NO: 53363

SEQ ID NO: 488360 - RNA, 64 nt, hsa; identical to SEQ ID NO: 53364

SEQ ID NO: 488361 - RNA, 64 nt, hsa; identical to SEQ ID NO: 53365

SEQ ID NO: 488362 - RNA, 64 nt, hsa; identical to SEQ ID NO: 53366

SEQ ID NO: 488363 - RNA, 64 nt, hsa; identical to SEQ ID NO: 53367

SEQ ID NO: 488364 - RNA, 64 nt, hsa; identical to SEQ ID NO: 53368

SEQ ID NO: 488365 - RNA, 64 nt, hsa; identical to SEQ ID NO: 53369

SEQ ID NO: 488366 - RNA, 64 nt, hsa; identical to SEQ ID NO: 53370

SEQ ID NO: 488367 - RNA, 64 nt, hsa; identical to SEQ ID NO: 53371

SEQ ID NO: 488368 - RNA, 64 nt, hsa; identical to SEQ ID NO: 53372

SEQ ID NO: 488369 - RNA, 64 nt, hsa; identical to SEQ ID NO: 277176

SEQ ID NO: 488370 - RNA, 64 nt, hsa; identical to SEQ ID NO: 277177

SEQ ID NO: 488371 - RNA, 64 nt, hsa; identical to SEQ ID NO: 277178

SEQ ID NO: 488372 - RNA, 64 nt, hsa; identical to SEQ ID NO: 277179

SEQ ID NO: 488373 - RNA, 64 nt, hsa; identical to SEQ ID NO: 277180

SEQ ID NO: 488374 - RNA, 64 nt, hsa; identical to SEQ ID NO: 277181

SEQ ID NO: 488375 - RNA, 64 nt, hsa; identical to SEQ ID NO: 277182

SEQ ID NO: 488376 - RNA, 64 nt, hsa; identical to SEQ ID NO: 277183

SEQ ID NO: 488377 - RNA, 64 nt, hsa; identical to SEQ ID NO: 277184

SEQ ID NO: 488378 - RNA, 64 nt, hsa; identical to SEQ ID NO: 277185

SEQ ID NO: 488379 - RNA, 52 nt, hsa; identical to SEQ ID NO: 277186

SEQ ID NO: 488380 - RNA, 64 nt, hsa; identical to SEQ ID NO: 277187

SEQ ID NO: 488381 - RNA, 64 nt, hsa; identical to SEQ ID NO: 277188

SEQ ID NO: 488382 - RNA, 64 nt, hsa; identical to SEQ ID NO: 277189

SEQ ID NO: 488383 - RNA, 64 nt, hsa; identical to SEQ ID NO: 277190

SEQ ID NO: 488384 - RNA, 64 nt, hsa; identical to SEQ ID NO: 277191

SEQ ID NO: 488385 - RNA, 64 nt, hsa; identical to SEQ ID NO: 277192

SEQ ID NO: 488386 - RNA, 64 nt, hsa; identical to SEQ ID NO: 277193

SEQ ID NO: 488387 - RNA, 64 nt, hsa; identical to SEQ ID NO: 277194

SEQ ID NO: 488388 - RNA, 64 nt, hsa; identical to SEQ ID NO: 277195

SEQ ID NO: 488389 - RNA, 64 nt, hsa; identical to SEQ ID NO: 277196

SEQ ID NO: 488390 - RNA, 64 nt, hsa; identical to SEQ ID NO: 277197

SEQ ID NO: 488391 - RNA, 64 nt, hsa; identical to SEQ ID NO: 277198

SEQ ID NO: 488392 - RNA, 64 nt, hsa; identical to SEQ ID NO: 277199

SEQ ID NO: 488393 - RNA, 64 nt, hsa; identical to SEQ ID NO: 53335

SEQ ID NO: 488394 - RNA, 64 nt, hsa; identical to SEQ ID NO: 53336

SEQ ID NO: 488395 - RNA, 64 nt, hsa; identical to SEQ ID NO: 53337

SEQ ID NO: 488396 - RNA, 64 nt, hsa; identical to SEQ ID NO: 53338

SEQ ID NO: 488397 - RNA, 64 nt, hsa; identical to SEQ ID NO: 53339

SEQ ID NO: 488398 - RNA, 64 nt, hsa; identical to SEQ ID NO: 53340

SEQ ID NO: 488399 - RNA, 64 nt, hsa; identical to SEQ ID NO: 53341

SEQ ID NO: 488400 - RNA, 64 nt, hsa; identical to SEQ ID NO: 53342

SEQ ID NO: 488401 - RNA, 51 nt, hsa; identical to SEQ ID NO: 53343

SEQ ID NO: 488402 - RNA, 64 nt, hsa; identical to SEQ ID NO: 53344

SEQ ID NO: 488403 - RNA, 64 nt, hsa; identical to SEQ ID NO: 53345

SEQ ID NO: 488404 - RNA, 64 nt, hsa; identical to SEQ ID NO: 53346

SEQ ID NO: 488405 - RNA, 64 nt, hsa; identical to SEQ ID NO: 53347

SEQ ID NO: 488406 - RNA, 64 nt, hsa; identical to SEQ ID NO: 53348

SEQ ID NO: 488407 - RNA, 64 nt, hsa; identical to SEQ ID NO: 53349

SEQ ID NO: 488408 - RNA, 64 nt, hsa; identical to SEQ ID NO: 53350

SEQ ID NO: 488409 - RNA, 64 nt, hsa; identical to SEQ ID NO: 53351

SEQ ID NO: 488410 - RNA, 64 nt, hsa; identical to SEQ ID NO: 53352

SEQ ID NO: 488411 - RNA, 64 nt, hsa; identical to SEQ ID NO: 53353

SEQ ID NO: 488412 - RNA, 64 nt, hsa; identical to SEQ ID NO: 53354

SEQ ID NO: 488413 - RNA, 64 nt, hsa; identical to SEQ ID NO: 53355

SEQ ID NO: 488414 - RNA, 64 nt, hsa; identical to SEQ ID NO: 53356

SEQ ID NO: 488415 - RNA, 64 nt, hsa; identical to SEQ ID NO: 53357

SEQ ID NO: 488416 - RNA, 64 nt, hsa; identical to SEQ ID NO: 53358

SEQ ID NO: 488417 - RNA, 64 nt, hsa; identical to SEQ ID NO: 53359

SEQ ID NO: 488418 - RNA, 64 nt, hsa; identical to SEQ ID NO: 53360

SEQ ID NO: 488419 - RNA, 64 nt, hsa; identical to SEQ ID NO: 53361

SEQ ID NO: 488420 - RNA, 64 nt, hsa; identical to SEQ ID NO: 53362

SEQ ID NO: 488421 - RNA, 64 nt, hsa; identical to SEQ ID NO: 53363

SEQ ID NO: 488422 - RNA, 64 nt, hsa; identical to SEQ ID NO: 53364

SEQ ID NO: 488423 - RNA, 64 nt, hsa; identical to SEQ ID NO: 53365

SEQ ID NO: 488424 - RNA, 64 nt, hsa; identical to SEQ ID NO: 53366

SEQ ID NO: 488425 - RNA, 64 nt, hsa; identical to SEQ ID NO: 53367

SEQ ID NO: 488426 - RNA, 64 nt, hsa; identical to SEQ ID NO: 53368

SEQ ID NO: 488427 - RNA, 64 nt, hsa; identical to SEQ ID NO: 53369

SEQ ID NO: 488428 - RNA, 64 nt, hsa; identical to SEQ ID NO: 53370

SEQ ID NO: 488429 - RNA, 64 nt, hsa; identical to SEQ ID NO: 53371

SEQ ID NO: 488430 - RNA, 64 nt, hsa; identical to SEQ ID NO: 53372

SEQ ID NO: 488431 - RNA, 64 nt, hsa; identical to SEQ ID NO: 265198

SEQ ID NO: 488432 - RNA, 64 nt, hsa; identical to SEQ ID NO: 265199

SEQ ID NO: 488433 - RNA, 64 nt, hsa; identical to SEQ ID NO: 265200

SEQ ID NO: 488434 - RNA, 64 nt, hsa; identical to SEQ ID NO: 265201

SEQ ID NO: 488435 - RNA, 64 nt, hsa; identical to SEQ ID NO: 265202

SEQ ID NO: 488436 - RNA, 64 nt, hsa; identical to SEQ ID NO: 265203

SEQ ID NO: 488437 - RNA, 64 nt, hsa; identical to SEQ ID NO: 265204

SEQ ID NO: 488438 - RNA, 64 nt, hsa; identical to SEQ ID NO: 265205

SEQ ID NO: 488439 - RNA, 64 nt, hsa; identical to SEQ ID NO: 83782

SEQ ID NO: 488440 - RNA, 64 nt, hsa; identical to SEQ ID NO: 83783

SEQ ID NO: 488441 - RNA, 64 nt, hsa; identical to SEQ ID NO: 83784

SEQ ID NO: 488442 - RNA, 64 nt, hsa; identical to SEQ ID NO: 83785

SEQ ID NO: 488443 - RNA, 64 nt, hsa; identical to SEQ ID NO: 83786

SEQ ID NO: 488444 - RNA, 64 nt, hsa; identical to SEQ ID NO: 83787

SEQ ID NO: 488445 - RNA, 64 nt, hsa; identical to SEQ ID NO: 83788

SEQ ID NO: 488446 - RNA, 64 nt, hsa; identical to SEQ ID NO: 83789

SEQ ID NO: 488447 - RNA, 64 nt, hsa; identical to SEQ ID NO: 83790

SEQ ID NO: 488448 - RNA, 64 nt, hsa; identical to SEQ ID NO: 83791

SEQ ID NO: 488449 - RNA, 64 nt, hsa; identical to SEQ ID NO: 83792

SEQ ID NO: 488450 - RNA, 64 nt, hsa; identical to SEQ ID NO: 83793

SEQ ID NO: 488451 - RNA, 64 nt, hsa; identical to SEQ ID NO: 83794

SEQ ID NO: 488452 - RNA, 64 nt, hsa; identical to SEQ ID NO: 83795

SEQ ID NO: 488453 - RNA, 64 nt, hsa; identical to SEQ ID NO: 83796

SEQ ID NO: 488454 - RNA, 64 nt, hsa; identical to SEQ ID NO: 83797

SEQ ID NO: 488455 - RNA, 64 nt, hsa; identical to SEQ ID NO: 83798

SEQ ID NO: 488456 - RNA, 64 nt, hsa; identical to SEQ ID NO: 83799

SEQ ID NO: 488457 - RNA, 64 nt, hsa; identical to SEQ ID NO: 83800

SEQ ID NO: 488458 - RNA, 64 nt, hsa; identical to SEQ ID NO: 83801

SEQ ID NO: 488459 - RNA, 64 nt, hsa; identical to SEQ ID NO: 83802

SEQ ID NO: 488460 - RNA, 64 nt, hsa; identical to SEQ ID NO: 83803

SEQ ID NO: 488461 - RNA, 64 nt, hsa; identical to SEQ ID NO: 83804

SEQ ID NO: 488462 - RNA, 64 nt, hsa; identical to SEQ ID NO: 83805

SEQ ID NO: 488463 - RNA, 64 nt, hsa; identical to SEQ ID NO: 83806

SEQ ID NO: 488464 - RNA, 64 nt, hsa; identical to SEQ ID NO: 83807

SEQ ID NO: 488465 - RNA, 64 nt, hsa; identical to SEQ ID NO: 83808

SEQ ID NO: 488466 - RNA, 64 nt, hsa; identical to SEQ ID NO: 83809

SEQ ID NO: 488467 - RNA, 64 nt, hsa; identical to SEQ ID NO: 83810

SEQ ID NO: 488468 - RNA, 64 nt, hsa; identical to SEQ ID NO: 83811

SEQ ID NO: 488469 - RNA, 64 nt, hsa; identical to SEQ ID NO: 83812

SEQ ID NO: 488470 - RNA, 64 nt, hsa; identical to SEQ ID NO: 83813

SEQ ID NO: 488471 - RNA, 64 nt, hsa; identical to SEQ ID NO: 101897

SEQ ID NO: 488472 - RNA, 64 nt, hsa; identical to SEQ ID NO: 101898

SEQ ID NO: 488473 - RNA, 64 nt, hsa; identical to SEQ ID NO: 101899

SEQ ID NO: 488474 - RNA, 64 nt, hsa; identical to SEQ ID NO: 101900

SEQ ID NO: 488475 - RNA, 64 nt, hsa; identical to SEQ ID NO: 101901

SEQ ID NO: 488476 - RNA, 64 nt, hsa; identical to SEQ ID NO: 101902

SEQ ID NO: 488477 - RNA, 64 nt, hsa; identical to SEQ ID NO: 334267

SEQ ID NO: 488478 - RNA, 64 nt, hsa; identical to SEQ ID NO: 334268

SEQ ID NO: 488479 - RNA, 64 nt, hsa; identical to SEQ ID NO: 334269

SEQ ID NO: 488480 - RNA, 64 nt, hsa; identical to SEQ ID NO: 334270

SEQ ID NO: 488481 - RNA, 64 nt, hsa; identical to SEQ ID NO: 334271

SEQ ID NO: 488482 - RNA, 64 nt, hsa; identical to SEQ ID NO: 334272

SEQ ID NO: 488483 - RNA, 64 nt, hsa; identical to SEQ ID NO: 334273

SEQ ID NO: 488484 - RNA, 64 nt, hsa; identical to SEQ ID NO: 334274

SEQ ID NO: 488485 - RNA, 64 nt, hsa; identical to SEQ ID NO: 334275

SEQ ID NO: 488486 - RNA, 64 nt, hsa; identical to SEQ ID NO: 334276

SEQ ID NO: 488487 - RNA, 64 nt, hsa
uguugguggugcagccccaggaccaagcuuaaggagaggagagcaucugcucugagacggaugg

SEQ ID NO: 488488 - RNA, 64 nt, hsa
gugaccccaucucugcugcuucugggccugauggagaggagaacacuagacaugccaacucggg

SEQ ID NO: 488489 - RNA, 64 nt, hsa
gccccugggguggguuuagcaggcugcagcaggcagaggagaguaccccccugagagcaugugg

SEQ ID NO: 488490 - RNA, 64 nt, hsa
ccccagucaccuaagcaaucacugggcccagaggagaggagacagacacacacuggcuccugga

SEQ ID NO: 488491 - RNA, 64 nt, hsa
ugucaccccagucaccuaagcaaucacugggcccagaggagaggagacagacacacacuggcuc

SEQ ID NO: 488492 - RNA, 64 nt, hsa
cugagugcuggacacugcguuccagaaaugaggaagaggagagagaagagauggacagaccuca

SEQ ID NO: 488493 - RNA, 64 nt, hsa
cuguacauaguugguguuuaaugaguguuuauggagaggagaguucuaaggucaccucuggcug

SEQ ID NO: 488494 - RNA, 64 nt, hsa
uuucuuuggucugugagcaacucaaagaggcagaagaggagaaugacuuuuccagaauagaagu

SEQ ID NO: 488495 - RNA, 64 nt, hsa
uuguaacuggucaccacuggacgggaaggagaacagaggagagggaaagagaagcccaaccucu

SEQ ID NO: 488496 - RNA, 64 nt, hsa
agaaggagagaaagugggugagaugcuggagaagagaggagaggagagaggcagagagcggucu

SEQ ID NO: 488497 - RNA, 64 nt, hsa
gagagaaagugggugagaugcuggagaagagaggagaggagagaggcagagagcggucucaggc

SEQ ID NO: 488498 - RNA, 64 nt, hsa
acuucuauuagcagugaugauggaaggcgagcuaagaggagacuuagauccagugggaaaaaaa

SEQ ID NO: 488499 - RNA, 64 nt, hsa
ucugcacuccugauaggaguuccccagcaaaaguagaggagacuuccccucuaggaaaugcacg

SEQ ID NO: 488500 - RNA, 64 nt, hsa
cgcgcaggcagggagaagggccgggggggguaggagaggagaaaaaaaaagugaaaaaaagaaa

SEQ ID NO: 488501 - RNA, 64 nt, hsa
aggugagacuucccagaccccggaggcguggaggagaggagacuguuugaugugguacaggggc

SEQ ID NO: 488502 - RNA, 64 nt, hsa
uuggaaugaggccuacaggguucaccaggauguaagaggagagaggaauccacaggaccaccag

SEQ ID NO: 488503 - RNA, 64 nt, hsa
uguaagaggagagaggaauccacaggaccaccagagaggagagggaaccagauaugcagaucag

SEQ ID NO: 488504 - RNA, 64 nt, hsa
uaucgcaaauuuucuaagccacguccuauaggacagaggagacuggccccacuucuaugggucu

SEQ ID NO: 488505 - RNA, 64 nt, hsa
gagcagggaugaagggucaggcagaaagcgugauagaggagagaauuuuugacaaaacucaaaa

SEQ ID NO: 488506 - RNA, 64 nt, hsa
uccccaccuggcacugaggagaaugguagagaggagaggagagagagagagaaugugauuuuug

SEQ ID NO: 488507 - RNA, 64 nt, hsa
aucuguccccaccuggcacugaggagaaugguagagaggagaggagagagagagagaaugugau

SEQ ID NO: 488508 - RNA, 64 nt, hsa
gcuucguccgagaaacgccaggacagacgauggcagaggagagggcuccugugacggcggcgag

SEQ ID NO: 488509 - RNA, 64 nt, hsa
uuguggaaaaggaacacgcaaagggagaagugugagaggagaaacaaaauaugagcguuuaaaa

SEQ ID NO: 488510 - RNA, 64 nt, hsa
cgaugauggcucaggcucagccugggcacgccccagaggagagagauggaguggggccucaaag

SEQ ID NO: 488511 - RNA, 64 nt, hsa
cuucucugcccucaagggaaccccacaguaucuuagaggagacaaucaugucggugagauggug

SEQ ID NO: 488512 - RNA, 64 nt, hsa
caugcauggacaccagaagacgauucagaacacaagaggagaaugagcuggagcgccagcacca

SEQ ID NO: 488513 - RNA, 64 nt, hsa
ccuucccagaagguugauucuuggccugggugguagaggagauauccugacccuaaagucuucc

SEQ ID NO: 488514 - RNA, 64 nt, hsa
ucuagaaacaggguugaaguucccagauucccugagaggagaauguguauaggaggguuuggcu

SEQ ID NO: 488515 - RNA, 64 nt, hsa
cuuugguaucguaucgccucuguguccuuuuaagagaggagaguucaguaccccgugcuuucuu

SEQ ID NO: 488516 - RNA, 64 nt, hsa
gagaauauguaugccugcaauaugggaacaaauuagaggagacuuuuuuuuuucauguuaugag

SEQ ID NO: 488517 - RNA, 64 nt, hsa
ggucaggggcacacauggcuuaagugacaaagccagaggagaagacaacccugacagcaucacg

SEQ ID NO: 488518 - RNA, 64 nt, hsa
uccuauaccuuguccuuccugcuugccuaggggaagaggagaagaggguaagggggcuucacuc

SEQ ID NO: 488519 - RNA, 64 nt, hsa
acguggauggacccccaugucugagaggggugaaagaggagaccaauggcaguucagguucaag

SEQ ID NO: 488520 - RNA, 64 nt, hsa
uuuaaagaucagaugccaucuuucuuccuggagaagaggagauuuucucuuuugagagugguug

SEQ ID NO: 488521 - RNA, 64 nt, hsa
caguaauucuacaauaaugcguuuuucuucugggagaggagaaugugcauuuuugaccucaaca

SEQ ID NO: 488522 - RNA, 64 nt, hsa
gggccgugccagcugugcccuagugauaaggguaagaggagagaugucaggcucacugcccuua

SEQ ID NO: 488523 - RNA, 64 nt, hsa
acauagaucucucccacuagagcccagagggaugagaggagagagcaacuguucuuucuuuuuu

SEQ ID NO: 488524 - RNA, 64 nt, hsa
gguugcuggagcaagaggagaggaugcuggagcaagaggagaggcugcuggagcuugaguggaa

SEQ ID NO: 488525 - RNA, 64 nt, hsa
ccugaaccaagagcaggaagagguugcuggagcaagaggagaggaugcuggagcaagaggagag

SEQ ID NO: 488526 - RNA, 64 nt, hsa
gguuguuggagcaagaggagagguugcuggagcaagaggagagguugcuggagcugcaggagag

SEQ ID NO: 488527 - RNA, 64 nt, hsa
gauuguuggaacaagacgagagguuguuggagcaagaggagagguugcuggagcaagaggagag

SEQ ID NO: 488528 - RNA, 64 nt, hsa
gguugcuggagcaagaggagagguugcuggagcaagaggagaggcuacuggagcugcaggagag

SEQ ID NO: 488529 - RNA, 64 nt, hsa
aguugcuggagcaagaggagagguugcuggagcaagaggagagguugcuggagcaagaggagag

SEQ ID NO: 488530 - RNA, 64 nt, hsa
gguuguuggagcaagaggagaaguugcuggagcaagaggagagguugcuggagcaagaggagag

SEQ ID NO: 488531 - RNA, 64 nt, hsa
agagcaggaagagguugcucagguuguuggagcaagaggagaaguugcuggagcaagaggagag

SEQ ID NO: 488532 - RNA, 64 nt, hsa
guagcaguagccacuugguucuuagggggccccaagaggagaggagaagugcugagguugaugu

SEQ ID NO: 488533 - RNA, 64 nt, hsa
aguagccacuugguucuuagggggccccaagaggagaggagaagugcugagguugauguuacga

SEQ ID NO: 488534 - RNA, 64 nt, hsa
uguucugcccacucuggggaauagggaggggaggagaggagaggagagggaggauccuggagga

SEQ ID NO: 488535 - RNA, 64 nt, hsa
ugcccacucuggggaauagggaggggaggagaggagaggagagggaggauccuggaggacuggg

SEQ ID NO: 488536 - RNA, 64 nt, hsa
ccucaagcuggacuguggguuccaaauuacucauagaggagaaaaccagagaaagaugaagagg

SEQ ID NO: 488537 - RNA, 64 nt, hsa
cgcuucaggguaggugggcacaggcuuggacuagagaggagaaagauugguguaaucugcuuuc

SEQ ID NO: 488538 - RNA, 64 nt, hsa
uacagcacaaauaaauaaugacugucauacauccagaggagaccgaaccugcccagcugaugua

SEQ ID NO: 488539 - RNA, 64 nt, hsa
ggaucccaguuggucucuggcagugggauccuggagaggagaaauccuggccucugcucaugcg

SEQ ID NO: 488540 - RNA, 64 nt, hsa
cuggaguacccuggggucagcagcaagagaaagaagaggagauuuucuguuuguuuuuccccuc

SEQ ID NO: 488541 - RNA, 64 nt, hsa
cgacugccugcucaccccugggcugagggaagggagaggagaggaacaagggccuccgaaaccc

SEQ ID NO: 488542 - RNA, 64 nt, hsa
ugcuccaggcaggucagagcagugcagggggaggagaggagaaagggaggaagcugggcugugu

SEQ ID NO: 488543 - RNA, 64 nt, hsa
cagccaguccuggucggccacaccagugucccaaagaggagagcgcagcagagccaggggucug

SEQ ID NO: 488544 - RNA, 64 nt, hsa
gaauggugaaagagaguggagauacggaagggggagaggagaggagaaauguggacagagggcu

SEQ ID NO: 488545 - RNA, 64 nt, hsa
gugaaagagaguggagauacggaagggggagaggagaggagaaauguggacagagggcuugaag

SEQ ID NO: 488546 - RNA, 64 nt, hsa
uucaaagcuucucucacccuagccaaagguccuaagaggagacagcugugaaguugggcgugcu

SEQ ID NO: 488547 - RNA, 64 nt, hsa
aaaagucuugauagcacaacacaaauuccauccaagaggagaaucuuccccaggguuuaguccu

SEQ ID NO: 488548 - RNA, 64 nt, hsa
aaaugccaugacagguguccuuccaagagacagaagaggagacacagacacagagcaggaggac

SEQ ID NO: 488549 - RNA, 64 nt, hsa
augggcccaauccagugucccuaugagagacggaagaggagacacagacacaaagcaggaggcc

SEQ ID NO: 488550 - RNA, 64 nt, hsa; identical to SEQ ID NO: 363148

SEQ ID NO: 488551 - RNA, 64 nt, hsa; identical to SEQ ID NO: 363149

SEQ ID NO: 488552 - RNA, 64 nt, hsa; identical to SEQ ID NO: 363150

SEQ ID NO: 488553 - RNA, 64 nt, hsa; identical to SEQ ID NO: 363151

SEQ ID NO: 488554 - RNA, 64 nt, hsa; identical to SEQ ID NO: 363152

SEQ ID NO: 488555 - RNA, 64 nt, hsa; identical to SEQ ID NO: 363153

SEQ ID NO: 488556 - RNA, 64 nt, hsa; identical to SEQ ID NO: 363154

SEQ ID NO: 488557 - RNA, 64 nt, hsa; identical to SEQ ID NO: 363155

SEQ ID NO: 488558 - RNA, 64 nt, hsa; identical to SEQ ID NO: 363156

SEQ ID NO: 488559 - RNA, 64 nt, hsa; identical to SEQ ID NO: 363157

SEQ ID NO: 488560 - RNA, 64 nt, hsa; identical to SEQ ID NO: 363158

SEQ ID NO: 488561 - RNA, 64 nt, hsa; identical to SEQ ID NO: 363159

SEQ ID NO: 488562 - RNA, 64 nt, hsa; identical to SEQ ID NO: 363160

SEQ ID NO: 488563 - RNA, 64 nt, hsa; identical to SEQ ID NO: 363161

SEQ ID NO: 488564 - RNA, 64 nt, hsa; identical to SEQ ID NO: 363162

SEQ ID NO: 488565 - RNA, 64 nt, hsa; identical to SEQ ID NO: 363163

SEQ ID NO: 488566 - RNA, 64 nt, hsa; identical to SEQ ID NO: 363164

SEQ ID NO: 488567 - RNA, 64 nt, hsa; identical to SEQ ID NO: 363165

SEQ ID NO: 488568 - RNA, 64 nt, hsa; identical to SEQ ID NO: 363166

SEQ ID NO: 488569 - RNA, 64 nt, hsa; identical to SEQ ID NO: 363167

SEQ ID NO: 488570 - RNA, 64 nt, hsa; identical to SEQ ID NO: 363168

SEQ ID NO: 488571 - RNA, 64 nt, hsa; identical to SEQ ID NO: 363169

SEQ ID NO: 488572 - RNA, 64 nt, hsa; identical to SEQ ID NO: 363170

SEQ ID NO: 488573 - RNA, 64 nt, hsa; identical to SEQ ID NO: 363171

SEQ ID NO: 488574 - RNA, 64 nt, hsa; identical to SEQ ID NO: 363172

SEQ ID NO: 488575 - RNA, 64 nt, hsa; identical to SEQ ID NO: 363173

SEQ ID NO: 488576 - RNA, 64 nt, hsa; identical to SEQ ID NO: 363174

SEQ ID NO: 488577 - RNA, 64 nt, hsa; identical to SEQ ID NO: 363175

SEQ ID NO: 488578 - RNA, 64 nt, hsa; identical to SEQ ID NO: 363176

SEQ ID NO: 488579 - RNA, 64 nt, hsa; identical to SEQ ID NO: 363177

SEQ ID NO: 488580 - RNA, 64 nt, hsa; identical to SEQ ID NO: 363178

SEQ ID NO: 488581 - RNA, 64 nt, hsa; identical to SEQ ID NO: 363179

SEQ ID NO: 488582 - RNA, 64 nt, hsa; identical to SEQ ID NO: 363180

SEQ ID NO: 488583 - RNA, 64 nt, hsa; identical to SEQ ID NO: 363181

SEQ ID NO: 488584 - RNA, 64 nt, hsa; identical to SEQ ID NO: 363182

SEQ ID NO: 488585 - RNA, 64 nt, hsa; identical to SEQ ID NO: 363183

SEQ ID NO: 488586 - RNA, 64 nt, hsa; identical to SEQ ID NO: 363184

SEQ ID NO: 488587 - RNA, 64 nt, hsa; identical to SEQ ID NO: 363185

SEQ ID NO: 488588 - RNA, 64 nt, hsa; identical to SEQ ID NO: 363186

SEQ ID NO: 488589 - RNA, 64 nt, hsa; identical to SEQ ID NO: 363187

SEQ ID NO: 488590 - RNA, 64 nt, hsa; identical to SEQ ID NO: 363188

SEQ ID NO: 488591 - RNA, 64 nt, hsa; identical to SEQ ID NO: 363189

SEQ ID NO: 488592 - RNA, 64 nt, hsa; identical to SEQ ID NO: 363190

SEQ ID NO: 488593 - RNA, 64 nt, hsa; identical to SEQ ID NO: 363191

SEQ ID NO: 488594 - RNA, 64 nt, hsa; identical to SEQ ID NO: 363192

SEQ ID NO: 488595 - RNA, 64 nt, hsa; identical to SEQ ID NO: 363193

SEQ ID NO: 488596 - RNA, 64 nt, hsa; identical to SEQ ID NO: 363194

SEQ ID NO: 488597 - RNA, 64 nt, hsa; identical to SEQ ID NO: 363195

SEQ ID NO: 488598 - RNA, 64 nt, hsa
gugguggcacgugccuguagucccagcuacuugggaggcugaggcaggagaaucacuugacccc

SEQ ID NO: 488599 - RNA, 64 nt, hsa
auggugccgcauaacuauaaucccagcuacuugggaggcugaggcaggagaaucgcuugaaccc

SEQ ID NO: 488600 - RNA, 64 nt, hsa
augguggugggcuccuguagucccagcuacuugggaggcugaggcaggagaaucgcuugaaccu

SEQ ID NO: 488601 - RNA, 64 nt, hsa
agucacccaugaagacaggacagugcuucagccugaggcugagacugcgggaugguccuggggc

SEQ ID NO: 488602 - RNA, 64 nt, hsa
gcaguggcucacgccuaugaucccagcacuuugggaggcugaggcggguggaucaccugagguu

SEQ ID NO: 488603 - RNA, 64 nt, hsa
cuggcuggcugcagugacgugcaccuguacucaggaggcugaggggaggaucacuggagcccag

SEQ ID NO: 488604 - RNA, 64 nt, hsa
gcaguggcucacaccucuaaucccagcacuuugggaggcugagguagguggaucacccaagguc

SEQ ID NO: 488605 - RNA, 64 nt, hsa
augguagcaggcgcuuguaaucccagcuacuugggaggcugaggcuggagaaucgcuugaaccc

SEQ ID NO: 488606 - RNA, 64 nt, hsa
auggugacaggcaccuaugguuccagcuacucaggaggcugaggugggaggaucgcuugugccu

SEQ ID NO: 488607 - RNA, 64 nt, hsa
auaguggcacacgccuguagucccaguuacuugggaggcugaggcaggagaauugcuugaaccu

SEQ ID NO: 488608 - RNA, 64 nt, hsa
gugguggcaccugccuguaaucccagcuacuugggaggcugaggcaggagaaucgcuugaaccc

SEQ ID NO: 488609 - RNA, 64 nt, hsa
augauggcucacacguauaauccuaaugcuuugagaggcugagguaggagcaucaccuggggcu

SEQ ID NO: 488610 - RNA, 64 nt, hsa
caugguggcaaucagcucuagucccaacuacuuggaggcugaagcaggaagaucacgugagccc

SEQ ID NO: 488611 - RNA, 64 nt, hsa
uacagguguuaacagaacugaaauccgacaaccagaggcugaaagaugaaaauggugcccucau

SEQ ID NO: 488612 - RNA, 64 nt, hsa
gugguggcaggcgccuguagucccagcuacucaggaggcugaggcaggagaauggcgugaaccc

SEQ ID NO: 488613 - RNA, 64 nt, hsa
cauaguggcgcgcgccuauaaucccagcuacugggaggcugaggcgggagaaucgcuugagccg

SEQ ID NO: 488614 - RNA, 64 nt, hsa
gcggugguacaugccuguagucccagcuacuugggaggcugaggcaggagaauugcuugaaccc

SEQ ID NO: 488615 - RNA, 64 nt, hsa
agugcuucaguggauucacugguuagauuaaaaagaggcugagaugagcagugaacuaagaggc

SEQ ID NO: 488616 - RNA, 64 nt, hsa
gugguggugugccccuguaaucccagcuacucaggaggcugaagcaggagaaucgcuugaaccc

SEQ ID NO: 488617 - RNA, 64 nt, hsa
gugguggcaggagccuguagucccagcuacucgggaggcugaggcaggagaauugcuugaaccg

SEQ ID NO: 488618 - RNA, 64 nt, hsa
augguggcgggcgccuguaaucccagcuacuugggaggcugaggcaggagaauggcaugaaccu

SEQ ID NO: 488619 - RNA, 64 nt, hsa
uaaaaauacaaaaauuagccuggcaugguggugggaggcugaagcaagagaaucacuugaaccc

SEQ ID NO: 488620 - RNA, 64 nt, hsa
gugguggcgugugccuguagucccagcuacuugcgaggcugaggcaggagaauugcuugaaccu

SEQ ID NO: 488621 - RNA, 64 nt, hsa
gcaguggcucacgccuguaaucccagcacuuugggaggcugaggcgggugaaaucaccugaggu

SEQ ID NO: 488622 - RNA, 64 nt, hsa
accuggauuuuaccccaugaggguaaaguugugugaggcugacacgucugugugaugcagugug

SEQ ID NO: 488623 - RNA, 64 nt, hsa
guggguagggcuguuugcuggaauaaggagggcugaggcugaguuguuccccgccacuguugag

SEQ ID NO: 488624 - RNA, 64 nt, hsa
cugguggcacacgccuguagucccagcuacuugggaggcugaggcaggagaauugcuugagccc

SEQ ID NO: 488625 - RNA, 64 nt, hsa
gugaugacuuguaacuguaaucccaguuauaggggaggcugaagcaggaggaucacuugaggcc

SEQ ID NO: 488626 - RNA, 64 nt, hsa
uuagccggguguggugguggguaccgcuacuugggaggcugaggcaggagaaucgcuugaaccu

SEQ ID NO: 488627 - RNA, 64 nt, hsa
gcgcaauugcucaugcauagucccagcuacccaggaggcugaggugggaggaucacuugagccc

SEQ ID NO: 488628 - RNA, 64 nt, hsa
gugguugcucacagcuguaauaacaacaccuucagaggcugaggugagaggaucaguugaggcc

SEQ ID NO: 488629 - RNA, 64 nt, hsa
augguggcaugugccuauagucccagcuacucaggaggcugaggcaggagaauugcuugaaccu

SEQ ID NO: 488630 - RNA, 64 nt, hsa
uugguggcucacgccuguaaucccagcacuuugggaggcugaggugggcagaucacgaggucaa

SEQ ID NO: 488631 - RNA, 64 nt, hsa
guaguggcucaugccuguaaucccaacacuuugggaggcugaaguaggaggaucgucuugagcc

SEQ ID NO: 488632 - RNA, 64 nt, hsa
acgguggugcaugccuguaaucccagcuacuugggaggcugaggcacgagauuccuugaaccca

SEQ ID NO: 488633 - RNA, 64 nt, hsa
augguggcguacgccuguagucccagcuacucaggaggcugaggcaggagaauugcuugaaccc

SEQ ID NO: 488634 - RNA, 64 nt, hsa
gugguggugggcgccuguaaucccagcuacucaggaggcugaggcaggagaaucgcuugaaccc

SEQ ID NO: 488635 - RNA, 64 nt, hsa
augcuggcacgcaccaguaaucccagcuacuugggaggcugaggcaggagaaucacuugaaccc

SEQ ID NO: 488636 - RNA, 64 nt, hsa
gugguggugcaugccuguaauccaagauacucaggaggcugaggcaggagaaucgcuugaaccu

SEQ ID NO: 488637 - RNA, 64 nt, hsa
augguggcucacgccuguaaucucagcacuuugggaggcugaggcgggcggaucacaaggucca

SEQ ID NO: 488638 - RNA, 64 nt, hsa
augguggcgcgcaccuguaaucccagcuacuugggaggcugaggcaagagaauugcuugaaccc

SEQ ID NO: 488639 - RNA, 64 nt, hsa
gcgguggcucacgccuguaaucccagcacuuugggaggcugaggcggguggaucacuugagguc

SEQ ID NO: 488640 - RNA, 64 nt, hsa
augguggcaggcgccuguagucccagcuacuugggaggcugaggcaggagaauggugugaaccu

SEQ ID NO: 488641 - RNA, 64 nt, hsa
gugguugcucacgccuguaaucccagcacuuugggaggcugaggugggcggcucacgaggagau

SEQ ID NO: 488642 - RNA, 64 nt, hsa
guggcggugcgcaacuguagucccagcuacucgggaggcugaggcaggagaaucucuugaaccu

SEQ ID NO: 488643 - RNA, 64 nt, hsa
gcaauggcucaugccuguaaucccagcacuuugggaggcugagaugggaggaucacuugaagcc

SEQ ID NO: 488644 - RNA, 64 nt, hsa
gcaguggcucacaccuguauucccaacacuuuuggaggcugagguuggaggauugcuugagccc

SEQ ID NO: 488645 - RNA, 64 nt, hsa
ugguggcacgugccugggagucccagcgacuugggaggcugaggugggaggauuguuugagccu

SEQ ID NO: 488646 - RNA, 64 nt, hsa
gugguggcucaugccuguaaucccagcacuuugggaggcugaggugggcauaucaccugagguc

SEQ ID NO: 488647 - RNA, 64 nt, hsa
auggugguacaugccuguaaucccagcuacucaggaggcugagacaggagaaucacuugaaccu

SEQ ID NO: 488648 - RNA, 64 nt, hsa
augguaaugcgcgccuguggucccagcugcucgggaggcugaggugggaggaucacuugagccu

SEQ ID NO: 488649 - RNA, 64 nt, hsa
uguaaucccagcuacuguaaucucagcuacuugggaggcugaggcaggagaauugccucaaccg

SEQ ID NO: 488650 - RNA, 64 nt, hsa
uuaggcuggguaugguggcucaccagcacuuugggaggcugaggcagguggaucucuugagguc

SEQ ID NO: 488651 - RNA, 64 nt, hsa
augguggcgugugccaguaaucccagcuacuugggaggcugaggcgcgagaaucgcuugaaccc

SEQ ID NO: 488652 - RNA, 64 nt, hsa
gcaguggcucaugccuguaaucccagcacuuugggaggcugaggcgggcggaucaccugagguc

SEQ ID NO: 488653 - RNA, 64 nt, hsa
augguggugcaugccuguaauuccagcuacucgggaggcugaggcaagagaaucgcuugaaucc

SEQ ID NO: 488654 - RNA, 64 nt, hsa
ugguggcagaucccuuguagucccagcuacucgggaggcugaggcaggagaauagcuugaaccc

SEQ ID NO: 488655 - RNA, 64 nt, hsa
augguggcucaugccuguaaucccagcacucugggaggcugaggugggcggaucacuugagcuc

SEQ ID NO: 488656 - RNA, 64 nt, hsa
gugguggcucacgccuauaaucccagcacuuugggaggcugaaguggguggaucaccagagguc

SEQ ID NO: 488657 - RNA, 64 nt, hsa
augguggcacacgccuguaaucccagcuacaccugaggcugaggcaggagaauugcuugaaccg

SEQ ID NO: 488658 - RNA, 64 nt, hsa
gcaguggcucaugccuguaaucccagcacuaugggaggcugaggcgggcagaucuccugagcuc

SEQ ID NO: 488659 - RNA, 64 nt, hsa
gugguggcauguggcuguagucccagcuacucgggaggcugaggcacgagaaucgcuugagccc

SEQ ID NO: 488660 - RNA, 64 nt, hsa
auggugcugugcaucuauagucccugcuauuugagaggcugaggugggaggaucauuugagugc

SEQ ID NO: 488661 - RNA, 64 nt, hsa
auaguggcacaccccuguagucccagcuacuugggaggcugaggugggaggauugcuugaaccc

SEQ ID NO: 488662 - RNA, 64 nt, hsa
gugguggcacaugccuguaguuccagcuacucaggaggcugaggugggagaaucuccugagccu

SEQ ID NO: 488663 - RNA, 64 nt, hsa
ggcacccacuucccugcaggacaguauuccugccgaggcugacuuccuacuuggucuggccacu

SEQ ID NO: 488664 - RNA, 64 nt, hsa
guggcggcgagcaccuguaaucccagcuacucgggaggcugagacaggagaaucucuugaaucc

SEQ ID NO: 488665 - RNA, 64 nt, hsa
cgugguggugggugccuguaauccaacuacccaggaggcugaggcaugagaaucgcuugggccc

SEQ ID NO: 488666 - RNA, 64 nt, hsa
gccguggcucacgccuguaaucccagcauuuugggaggcugaggugggcagaucacuugaggcc

SEQ ID NO: 488667 - RNA, 64 nt, hsa
uuaguggcucacgccuguaaucucagcacuuugggaggcugaggcgggcagaucgcuugagguc

SEQ ID NO: 488668 - RNA, 64 nt, hsa
gugguggcgggugccuguaaucccagcuacucaggaggcugaggcaggagaaucgcuugaaucu

SEQ ID NO: 488669 - RNA, 64 nt, hsa
guggagguacaugccuguaaucccagcuacucaggaggcugaggcagaagaauugcuugaaccc

SEQ ID NO: 488670 - RNA, 64 nt, hsa
gugguggcacgugccuguagucccagcuacuccggaggcugaggcaggagaauggcgugaaccc

SEQ ID NO: 488671 - RNA, 64 nt, hsa
gcgguggcucacgcuuguaaucccagcacuuugggaggcugaggcaggcggaucacgaggucag

SEQ ID NO: 488672 - RNA, 64 nt, hsa
gugauggugggcaccucuaaucccagcuacuugggaggcugagggcaggagaauugcuugaauc

SEQ ID NO: 488673 - RNA, 64 nt, hsa
augguggcucaugccuguaaucccagcacuuugggaggcugagacggguggauuaccugagguc

SEQ ID NO: 488674 - RNA, 64 nt, hsa
augguggugugggccugcagucccagcuaccugggaggcugagucaggaaaaucucuugaacca

SEQ ID NO: 488675 - RNA, 64 nt, hsa
gcuguggcucaugccuguaauccuagcacuuugggaggcugaggugggcagaucacuugaggcc

SEQ ID NO: 488676 - RNA, 64 nt, hsa
gcgguggcucgugccuguaaucccagcacuuugggaggcugaggcggguggaucaugaggucag

SEQ ID NO: 488677 - RNA, 64 nt, hsa
augguggcgcaugccuguaaucccagcuacuagagaggcugaggcaggagaaucacuugaaucc

SEQ ID NO: 488678 - RNA, 64 nt, hsa
augguggcucacgccuguaaucccaacacuuugggaggcugaggcaggcagaucacgaggucag

SEQ ID NO: 488679 - RNA, 64 nt, hsa
gugguggcacacaccaguaaucccagcuacucaggaggcugaagcaggagauuugcuugaaccu

SEQ ID NO: 488680 - RNA, 64 nt, hsa
augguggcacacaccuguaaucccagcuacucgggaggcugaggaaggagaauugcuugaaccu

SEQ ID NO: 488681 - RNA, 64 nt, hsa
augguggcacacaccuguagucccagcuacuugggaggcugaggcaggagaaucacaaggauug

SEQ ID NO: 488682 - RNA, 64 nt, hsa
augacggccagagcccauggucccagcuacucgagaggcugagguaagagcaucccuugagcca

SEQ ID NO: 488683 - RNA, 64 nt, hsa
acaguggcucacgccuguaauccuagcacuuugggaggcugaggaggaaggaucacuugagccc

SEQ ID NO: 488684 - RNA, 64 nt, hsa
augguggccuacaccuguagucccagcauuccgggaggcugaggugggaggaucacuugagccc

SEQ ID NO: 488685 - RNA, 64 nt, hsa
gcgguggcucacgucuguaaucccagcacuuugggaggcugagacagguggaucacuugagguc

SEQ ID NO: 488686 - RNA, 64 nt, hsa
guuuuggcaccugccuguaaucucagcuacucaggaggcugaggcacaagaaucgcuugaaucc

SEQ ID NO: 488687 - RNA, 64 nt, hsa
accuguaucaucugcuguggucccaguuacucaggaggcugaggcaggaggaucacuugagccc

SEQ ID NO: 488688 - RNA, 64 nt, hsa
gugguggcucaugccuguaaucccagcacuuugggaggcugaugugggcggauaguugagccca

SEQ ID NO: 488689 - RNA, 64 nt, hsa
ggcguggugggcacccguaaucccagcuacucaggaggcugaggcaggagaauugcuugaaccc

SEQ ID NO: 488690 - RNA, 64 nt, hsa
gugguggcaugugccuguggucccagcuacucaggaggcugaggugggaaaaucacuugagccc

SEQ ID NO: 488691 - RNA, 64 nt, hsa
acgguggcucacaccuauaaucccagcacuaugggaggcugaggcaagcagguuguuugagccc

SEQ ID NO: 488692 - RNA, 64 nt, hsa
augguggcaguugccuguaauccuagcuacucaggaggcugaggcaggagaaucgcuugaaccu

SEQ ID NO: 488693 - RNA, 64 nt, hsa
cuuacagcucacgccuguaaucucagcacuuugggaggcugagguggguggaucacaaggucag

SEQ ID NO: 488694 - RNA, 64 nt, hsa
augcaugagcauuuucaggauaagcgacuucugugaggcugagagaggaagaaaacacggagcc

SEQ ID NO: 488695 - RNA, 64 nt, hsa
acaguggcucacaccuacgaucacagcacuucgggaggcugaagcaagcagaucacuugagguc

SEQ ID NO: 488696 - RNA, 64 nt, hsa
gugaugacaggcaccuguaaucccagcuacucgggaggcugaggcaugagaauugcuugaaccc

SEQ ID NO: 488697 - RNA, 64 nt, hsa
gcaguggcacgcgccuguaaucccagcuacucaagaggcugaggcacgagaaucacuugaaccc

SEQ ID NO: 488698 - RNA, 64 nt, hsa
augguggggcgugccuguagucccauguacuugggaggcugaggcaggaaaauucuugaaccca

SEQ ID NO: 488699 - RNA, 64 nt, hsa
augguggcguguacauguggucucagauacuugggaggcugaggugggaggguugaucacuuga

SEQ ID NO: 488700 - RNA, 64 nt, hsa
acuugggaggcugaggugggaggguugaucacuugaggcugagaggucaagguugcagugagcc

SEQ ID NO: 488701 - RNA, 64 nt, hsa
augguggcacaugcugguaaucucagcuauugaggaggcugaggcaggagaauugcuugaaccc

SEQ ID NO: 488702 - RNA, 64 nt, hsa
augguggcuuacaucuguaaucccagcacuuugggaggcugaggggguggaucaccugaggucg

SEQ ID NO: 488703 - RNA, 64 nt, hsa
gugauggcggacgccuguagucccagcuacucgggaggcugagacagaagaacugcuugaaacc

SEQ ID NO: 488704 - RNA, 64 nt, hsa
gcaguggcucacgucuguaaucccagcacuuugggaggcugaggcgggcagaucaugaggucag

SEQ ID NO: 488705 - RNA, 64 nt, hsa
gcgguggcucacgccuguaaucccagcacuuugggaggcugaggcggguggaucacgaggucag

SEQ ID NO: 488706 - RNA, 64 nt, hsa
gugguggcaggcaccuguagucccagcuacucgggaggcugaggcaggagacuggcgugaaccc

SEQ ID NO: 488707 - RNA, 64 nt, hsa
gcggugccucaugccuguaauccuagcacuuugggaggcugaggcaggcaaucacuugagguca

SEQ ID NO: 488708 - RNA, 64 nt, hsa
uguguggugcacguuuguaaucccaguuacucaggaggcugaggcacaagaauugaguaucacu

SEQ ID NO: 488709 - RNA, 64 nt, hsa
gugguucuccaugccuauaaucccggcuacucgggaggcugaggcaggagaaucaccugaaccc

SEQ ID NO: 488710 - RNA, 64 nt, hsa
gcaguggcucauguguguaaucccagcacucugggaggcugagacagguagaucauuugagguc

SEQ ID NO: 488711 - RNA, 64 nt, hsa
gugguggcgcaugccuguagucccaacuacuagggaggcugaggcaggagaaucacuugaaccc

SEQ ID NO: 488712 - RNA, 64 nt, hsa
gugguggugcaugccuguaaucccagcuacuagggaggcugaggcaggagaauugcuugaaccu

SEQ ID NO: 488713 - RNA, 64 nt, hsa
gugguggcaugugccuguagucuuagcuacuugagaggcugaggcaggagaaucgcuugaaccu

SEQ ID NO: 488714 - RNA, 64 nt, hsa
augguggcucaugccuguaaucccagcacuuugggaggcugagguagguggaaaaccugagguc

SEQ ID NO: 488715 - RNA, 64 nt, hsa
uugauggugugcaccuguaaucucagcuacucgggaggcugaggcaagagaaucgcuugaaccc

SEQ ID NO: 488716 - RNA, 64 nt, hsa
uuauugaagggaagagggaccagcacaugaggcugaggcugaggggcagucaccagcaccagga

SEQ ID NO: 488717 - RNA, 64 nt, hsa
accuccuuauugaagggaagagggaccagcacaugaggcugaggcugaggggcagucaccagca

SEQ ID NO: 488718 - RNA, 64 nt, hsa
gugguggcaugcaccugucaucccagcuacucgggaggcugaggcaggagaaucgcuugaaccc

SEQ ID NO: 488719 - RNA, 64 nt, hsa
cgccguggcucacgccuguaauccaacacuuugagaggcugaggcgggcggaucaccugaguca

SEQ ID NO: 488720 - RNA, 64 nt, hsa
guaauggugugcaccugugauccuagcuacuugggaggcugaggugggagaauugcucaagccc

SEQ ID NO: 488721 - RNA, 64 nt, hsa
gugguggugggcacugguaaucccagguacucaagaggcugaggcaggagaaucgcuugaaccu

SEQ ID NO: 488722 - RNA, 64 nt, hsa
uugguggcucaugccuauaauccuggcauuuuaggaggcugagguuggagaaucgcuugaggcc

SEQ ID NO: 488723 - RNA, 64 nt, hsa
gugguggcacacgccuguagucccagcuacucgggaggcugaggcagaagaaucgcuugaaccu

SEQ ID NO: 488724 - RNA, 64 nt, hsa
auggugguaagugccuguaguccuagcuacuugggaggcugagaugggaggaugucuugagccc

SEQ ID NO: 488725 - RNA, 64 nt, hsa
acagugucucauaccuguauuugcagcacuuugggaggcugaagcagaucgcuggagcuuauga

SEQ ID NO: 488726 - RNA, 64 nt, hsa
uuuguagcauaugccuguggucccagcuacugaggaggcugaggugggaggauugcuugagccc

SEQ ID NO: 488727 - RNA, 64 nt, hsa
acgguagcucacccuuguaaucccagcacuuugggaggcugagguggguagauuacuugagccc

SEQ ID NO: 488728 - RNA, 64 nt, hsa
cuggccuuuccucaaggcaugguagucuuuccuugaggcugauagcuagggcuugaccaggaag

SEQ ID NO: 488729 - RNA, 64 nt, hsa
acucgagcacacaccuguaguaccagcuacucuggaggcugaggcaggaggaucacuugagccc

SEQ ID NO: 488730 - RNA, 64 nt, hsa
acaguggcucuugucuguaaucccagcgcucugggaggcugaggcaggaggaucacuugagguc

SEQ ID NO: 488731 - RNA, 64 nt, hsa
gccgugggucacgccuguaaucccagcacuuugggaggcugaggcagguggaucaccucaaguc

SEQ ID NO: 488732 - RNA, 64 nt, hsa
gugguugcacacgccuguaaucccagcuacucaggaggcugagggaggagaaucccuugaaccc

SEQ ID NO: 488733 - RNA, 64 nt, hsa
aaacgccagucaugggaggcagagcugggggagcgaggcugacaaugacuccuguuuucacgcu

SEQ ID NO: 488734 - RNA, 64 nt, hsa
augguggugcacgucuguagucccagcuacucaggaggcugaggcagaagaaucgcuugaaccc

SEQ ID NO: 488735 - RNA, 64 nt, hsa
acaguggcuuaugccuguaauugcagcacuuuuagaggcugaggcaggagaauugguugaaccc

SEQ ID NO: 488736 - RNA, 64 nt, hsa
guuauggugcaugccuguaaucccagcuacucgggaggcugaggcaggagaauugcuugaacuc

SEQ ID NO: 488737 - RNA, 64 nt, hsa
augguggcucacaccuguaaucccagcacuuugggaggcugaggcggauggaucacgaggucag

SEQ ID NO: 488738 - RNA, 64 nt, hsa
gugguggcacgcgccuguaaucccagcuacucaggaggcugaggcaggagaacugcuugaaccu

SEQ ID NO: 488739 - RNA, 64 nt, hsa
gcgguggcucaugccuguaauccuagcacuuugggaggcugagguggguggaucaccugagguc

SEQ ID NO: 488740 - RNA, 64 nt, hsa
gugguggcagaggccuguaaucccagcuccuugggaggcugaggcgggagaauugcuugaaccc

SEQ ID NO: 488741 - RNA, 64 nt, hsa
gugguggugcacaccuguagucccagcuacucgggaggcugagacaggagauuugcuugaaccc

SEQ ID NO: 488742 - RNA, 64 nt, hsa
augguggcucaugccuguaaucccagcacuuugggaggcugaggcgggcggaucaccugagguu

SEQ ID NO: 488743 - RNA, 64 nt, hsa
uaggaaccagugaccuuggcugcccaacuguguggaggcugagugauugacaaacacagguugg

SEQ ID NO: 488744 - RNA, 64 nt, hsa
gagacucucugcugaggucaacccucaguuccaagaggcugacuucaggguugccacagaagag

SEQ ID NO: 488745 - RNA, 64 nt, hsa
augguggcaggcgccuauaaucccagcuacuggggaggcugaggcaggagaaucacuugaaccc

SEQ ID NO: 488746 - RNA, 64 nt, hsa
guagugacgggugcccguaaucccagcuacucaggaggcugagacaggagaaucaccugaaccc

SEQ ID NO: 488747 - RNA, 64 nt, hsa
acaguggcucacgccuguaaucccagcacuuugagaggcugaggugguaggaucaccugagguc

SEQ ID NO: 488748 - RNA, 64 nt, hsa
gcaugguggacucgccuguaaucucacuacacaggaggcugaggcaggagaaucacuugaaccu

SEQ ID NO: 488749 - RNA, 64 nt, hsa
acaguggcucacgccuguaauccuagcaguuugggaggcugagccggguggaucgccugagguc

SEQ ID NO: 488750 - RNA, 64 nt, hsa
gaaauguuuguuuauucuguuacagcucaaaauggaggcugagaaucucuaccaccauucccuu

SEQ ID NO: 488751 - RNA, 64 nt, hsa
gugauggcgcaugccuguaaucccagcuacuugggaggcugaggcaggagaaucacuugaaccc

SEQ ID NO: 488752 - RNA, 64 nt, hsa
acgguggcucacaccuguaaucccagcccuuugggaggcugagguggguguaucacuugagguc

SEQ ID NO: 488753 - RNA, 64 nt, hsa
gcgguggcucacgccuguaaucccagcacuuugggaggcugaggcgggcagaucaccugagguc

SEQ ID NO: 488754 - RNA, 64 nt, hsa
augguggcacaugccuuuagucccagcuacucuggaggcugaaguuggaggauggcuugagccc

SEQ ID NO: 488755 - RNA, 64 nt, hsa
acgguaucucaugccuauaaucccagcacuuugggaggcugaggcaguugagaccaggaguucg

SEQ ID NO: 488756 - RNA, 64 nt, hsa
augguggcaggcaccuguaaucccagcuacuugggaggcugagucaggagaaucgcuugagccc

SEQ ID NO: 488757 - RNA, 64 nt, hsa
gugguggcacacaccuguagucccagcugcucgagaggcugaggcacgagaaucaguugaacug

SEQ ID NO: 488758 - RNA, 64 nt, hsa
gcaggggcucacaccgguaaucccagcacuuugagaggcugaggcgggaagaucacuugaggcc

SEQ ID NO: 488759 - RNA, 64 nt, hsa
ugugguggcaggcgccuguaauccagcuacucgggaggcugaggcaggagaaucacuugaaccc

SEQ ID NO: 488760 - RNA, 64 nt, hsa
gugguggcgggcgccuguagucccagcuacuugggaggcugaggcaggagaauggcgggaaccu

SEQ ID NO: 488761 - RNA, 64 nt, hsa
gugguggcagacagcuguaaucucagcugcucgggaggcugaggcacaagaaucgcuugagcca

SEQ ID NO: 488762 - RNA, 64 nt, hsa
gcgguggcucacgccuguaaucccagcacuuugggaggcugaggcgggugaaucacuugauuga

SEQ ID NO: 488763 - RNA, 64 nt, hsa
gugguggcgcaaaccuguagucguagcuacuugggaggcugaggcaggggaaucacuugaaccc

SEQ ID NO: 488764 - RNA, 64 nt, hsa
gcaguggcucacgccuguaaucccagcauuuugggaggcugagguaggcggaucacaaggucag

SEQ ID NO: 488765 - RNA, 64 nt, hsa
gugguggcaggcgccuguagucccagcuacucgggaggcugaggcagaagaauggcguaaaccc

SEQ ID NO: 488766 - RNA, 64 nt, hsa
gggguggcucacgccuguaauccuagcacuuugggaggcugaggcggguagaucacaaggucag

SEQ ID NO: 488767 - RNA, 64 nt, hsa
gugguggcgcauaccuguagucccagcuacuugggaggcugaggcaggagaaucacuugaacuc

SEQ ID NO: 488768 - RNA, 64 nt, hsa
gcaguggcucacgccuguaaucccagcacuuugggaggcugaggugaguggauuacaaggucag

SEQ ID NO: 488769 - RNA, 64 nt, hsa
augguggugcgugccuguagucucagcuacucaggaggcugaggcaggagaaucgccugaaccc

SEQ ID NO: 488770 - RNA, 64 nt, hsa
gcaguggcucacaccuguaaucccagcacuuugggaggcugaggcggguggaucaccugagguc

SEQ ID NO: 488771 - RNA, 64 nt, hsa
gcgauagcacgugccuguagucccagcuacucgggaggcugaggcuggagaguugcucaaaccc

SEQ ID NO: 488772 - RNA, 64 nt, hsa
augguggugcaugccuguaaucccagcuacucgggaggcugaggcaggagaaucacuugaacuc

SEQ ID NO: 488773 - RNA, 64 nt, hsa
gugguggcacaucccuauagucccagcuacuugggaggcugagguggaaggauugcuugagcga

SEQ ID NO: 488774 - RNA, 64 nt, hsa
augguggugcauaccuauaguccuggcuauuugggaggcugaggcaggaggauugcuuuagccc

SEQ ID NO: 488775 - RNA, 64 nt, hsa
gugguggugcaugccuguaaucccagcuacucgggaggcugaggcaggagaaucgcuugaaccc

SEQ ID NO: 488776 - RNA, 64 nt, hsa
augguggcacgugccuguaaucccagcuacucgggaggcugaggcaggagaaucgcuugaaccu

SEQ ID NO: 488777 - RNA, 64 nt, hsa
caguggcucacgccuguaaucccagcacuuuugggaggcugagguugggaguucaagaccagcc

SEQ ID NO: 488778 - RNA, 64 nt, hsa
gugguggugggcaccugugaucccagcuuccugggaggcugaggcaagagaaucgcuugaaucu

SEQ ID NO: 488779 - RNA, 64 nt, hsa
gugguggcaugcgcuuguagucucagcuacuccggaggcugaggcaggagaauugcuugaaccu

SEQ ID NO: 488780 - RNA, 64 nt, hsa
gcugcggcuugcgccuguaaucucagcacuuugggaggcugagauggguggaucaccugagguu

SEQ ID NO: 488781 - RNA, 64 nt, hsa
gugguggugggugucuguaaucccagcuauucgggaggcugaggcaggagaaucgcuugaaccc

SEQ ID NO: 488782 - RNA, 64 nt, hsa
gugguggcucacaccugugaucccagcacuuugggaggcugagguaggaggaucacgugagguc

SEQ ID NO: 488783 - RNA, 64 nt, hsa
gugguggcacacgccuguagucccagcuacucaggaggcugaggcaggagaaucacuugaauuc

SEQ ID NO: 488784 - RNA, 64 nt, hsa
gguucaugccuguaaucccagcacuucacuuugggaggcugaggcggguggaucacaaggucag

SEQ ID NO: 488785 - RNA, 64 nt, hsa
augguggcaugcguguguagucgaagcuacucaggaggcugaggcagaagaaucacuugaaccu

SEQ ID NO: 488786 - RNA, 64 nt, hsa
acaguggcucccaccuuuaaucccagcaccuggggaggcugaggugaguggaucacuagagguc

SEQ ID NO: 488787 - RNA, 64 nt, hsa
gugguggcacacacuuguaaucccagcuacucaggaggcugaggcaugagaaucgcuuaaaccc

SEQ ID NO: 488788 - RNA, 64 nt, hsa
gugguggcucacgccuguaaucccggcacuuugggaggcugaggcaggcggauugccugagauc

SEQ ID NO: 488789 - RNA, 64 nt, hsa
gugguggcgggcgccuguaaucccagcuacucaggaggcugaggcagcagaaucguuugaaccc

SEQ ID NO: 488790 - RNA, 64 nt, hsa
gcgguggcucaugccuguaaucccagcacuuugggaggcugaggcggguggauugcuugagccc

SEQ ID NO: 488791 - RNA, 64 nt, hsa
gugguggcacacuccuguaaucccagcuacuggggaggcugaggcacgagaaucacuugaaccc

SEQ ID NO: 488792 - RNA, 64 nt, hsa
uguggggugcaugccuggaaucccagcuacuugagaggcugaggcacgagaauugcuugaaccc

SEQ ID NO: 488793 - RNA, 64 nt, hsa
gccauggcucacaucuguaaucccagcacuuuuggaggcugaggcggguggauugcuugaggcc

SEQ ID NO: 488794 - RNA, 64 nt, hsa
uacccugcaggguaagcuguuguucccugaggcugaggcugaggcagagaaucuuccagaugau

SEQ ID NO: 488795 - RNA, 64 nt, hsa
ucuguauacccugcaggguaagcuguuguucccugaggcugaggcugaggcagagaaucuucca

SEQ ID NO: 488796 - RNA, 64 nt, hsa
uuucaacaaaggaguguguucagaaaaggagagagaggcugagaucauucaggaguuuguuggg

SEQ ID NO: 488797 - RNA, 64 nt, hsa
ugcauugugaggcaggucccaaaagggaaggcuggaggcugaggcuguuuucuuuucuuuguuc

SEQ ID NO: 488798 - RNA, 64 nt, hsa
gcagaggcagugagggagguggacggugccagcugaggcugaggcaugcagcagcccccagcua

SEQ ID NO: 488799 - RNA, 64 nt, hsa
aagacggacuugcuugccucuccuacagcauggagaggcugaccccauggcucugccaccguug

SEQ ID NO: 488800 - RNA, 64 nt, hsa
gucauggggcaugccuguagucccaccuacuugggaggcugaagcaggagaauugcucgaaccu

SEQ ID NO: 488801 - RNA, 64 nt, hsa
augauggcgggugccucuaaucccagcuacuggggaggcugaggugggagaaucgcuugaacuc

SEQ ID NO: 488802 - RNA, 64 nt, hsa
ccagagcccugcugaguuccugcuuucugaccuggaggcugagcaggccggaguggauggaugc

SEQ ID NO: 488803 - RNA, 64 nt, hsa
ugcgugugugguacguguguguguguguggcuaugaggcugauuccuguuuggauuuuuguccu

SEQ ID NO: 488804 - RNA, 64 nt, hsa
gcgguggcucacgccuguaaucccagcaccuugggaggcugaggcgggcagaucaugaggucag

SEQ ID NO: 488805 - RNA, 64 nt, hsa
acaguggcacaggccuuuaauuccagcuacuugggaggcugaggcaggagaauuacuugaaccc

SEQ ID NO: 488806 - RNA, 64 nt, hsa
gagguggcucacgccuguaaucccagcacuuugggaggcugaggaggucggaucaugaggucaa

SEQ ID NO: 488807 - RNA, 64 nt, hsa
auaguggcucgugccuguaaucucagcuauuugggaggcugaggcaggagaaucacuugaaccu

SEQ ID NO: 488808 - RNA, 64 nt, hsa
caugguggcacgcaccucuacucccagcuacuaggaggcugaggcaggagaaucguuugaaccc

SEQ ID NO: 488809 - RNA, 64 nt, hsa
uuggugguaugugccuguggucccagcuacuggggaggcugaggugggaggaucguuugagccu

SEQ ID NO: 488810 - RNA, 64 nt, hsa
gcgguggcucaugccuguaauccuagcacuuugggaggcugagguaggcagaucacuugagguc

SEQ ID NO: 488811 - RNA, 64 nt, hsa
guaguggugcgcaccuguagucucagauacuugggaggcugaggguggagaaucgcuugaaccu

SEQ ID NO: 488812 - RNA, 64 nt, hsa
acgguggcucacgccuguaaucccagcacuuugggaggcugaggcggguggaucaagaggucag

SEQ ID NO: 488813 - RNA, 64 nt, hsa
gugguggcacgcgccuguagucccagcuacucgggaggcugaggcaggaagaaucgcuugaacc

SEQ ID NO: 488814 - RNA, 64 nt, hsa
auggugguggguaccuguagucccagcuacuccggaggcugaggcaggagaauggcgugaaccc

SEQ ID NO: 488815 - RNA, 64 nt, hsa
gcgguggcucacgccuguaaucccagcacuuugggaggcugaggcgggcagaucacgaagucag

SEQ ID NO: 488816 - RNA, 64 nt, hsa
uuaguaaugcgaaccuauaguagcagcuacuccagaggcugaaaugggaggaucucuugagccc

SEQ ID NO: 488817 - RNA, 64 nt, hsa
uugguggcucacaucuguaauaccagcgcuuugggaggcugaggcaggaggauugcuugaggcc

SEQ ID NO: 488818 - RNA, 64 nt, hsa
gggaggcugaggcaggagaauugcuugaaccuaggaggcugagauugcagugagccgaaaucac

SEQ ID NO: 488819 - RNA, 64 nt, hsa
gugguggugggcaccuguagucccagcuacucgggaggcugaggcaggagaauugcuugaaccu

SEQ ID NO: 488820 - RNA, 64 nt, hsa
gcaguggcucacgccuguaaucccagcacuuugggaggcugaggcagguggaucacaaugucag

SEQ ID NO: 488821 - RNA, 64 nt, hsa
guagugacgcaugcccucaaucccagcuacucaagaggcugaggcaggagaaucacuugcacuc

SEQ ID NO: 488822 - RNA, 64 nt, hsa
gcaguggcucacgccuguaaucccagcccuuugggaggcugaggcgggcagaucaccagagguc

SEQ ID NO: 488823 - RNA, 64 nt, hsa
guuguggcucaugccuguaaucccagcacuuugggaggcugaggcggguggaucacuaggucag

SEQ ID NO: 488824 - RNA, 64 nt, hsa
augguggcgugugccuguaaucucagcuacucaggaggcugaggcaggagaaucgcuugaaccc

SEQ ID NO: 488825 - RNA, 64 nt, hsa
augguggcucaugccuguaaucucagcacuuugggaggcugaggcagaaggauuaccugaggca

SEQ ID NO: 488826 - RNA, 64 nt, hsa
uggcucaugccuguaaucccagccagcacuuugggaggcugagaugggaagaucacuugagccc

SEQ ID NO: 488827 - RNA, 64 nt, hsa
ugaccugguucagcauguaauccgagcacuuugggaggcugaggcaggcggaucacuugagguc

SEQ ID NO: 488828 - RNA, 64 nt, hsa
ugaaaauacaaaaauaagccaggcgugguggcgggaggcugaggcaaggagaaucacuugaaua

SEQ ID NO: 488829 - RNA, 64 nt, hsa
augguggcaugcaccugcaaucccagcuacucgggaggcugaggcacaagaaucacuugaaccc

SEQ ID NO: 488830 - RNA, 64 nt, hsa
gugacauugugucaguuucagauccugaucuuaagaggcugacagcuucuacuugcugucccuu

SEQ ID NO: 488831 - RNA, 64 nt, hsa
gcauggugcgggcaccuguaguccuagcuaucaagaggcugagacaggagaaacacuugaaccu

SEQ ID NO: 488832 - RNA, 64 nt, hsa
ggucccgcuuagcgacccgccgccgccgccaagcgaggcugaggacuccgaucgcgaugucuca

SEQ ID NO: 488833 - RNA, 64 nt, hsa
agaccguguaaaugagcuccaggaggaagcccaggaggcugaugccugccaggaggagcuggca

SEQ ID NO: 488834 - RNA, 64 nt, hsa
gcaaugaugcacacuuauacccccagccacucaggaggcugaugcaagaggaucgcuugagccc

SEQ ID NO: 488835 - RNA, 64 nt, hsa
guggugacacgugccuguagucccagcuacucgggaggcugaggcaggagaaucacuugaaccu

SEQ ID NO: 488836 - RNA, 64 nt, hsa
ggugguggcagggccuguaauuccagcuacucaggaggcugaagcaggagaaucguuuaaacac

SEQ ID NO: 488837 - RNA, 64 nt, hsa
aauuagccgggcgugguggcgggugccuguacaggaggcugaggcaggagaauggcgugaaccc

SEQ ID NO: 488838 - RNA, 64 nt, hsa
augguggcaugcgccuguaaucccagcuacucaggaggcugagacagaagaaucgcuugaaccu

SEQ ID NO: 488839 - RNA, 64 nt, hsa
augguggcucacgucuguaaucccaggacuuugggaggcugaggcagguggaucaccugagguc

SEQ ID NO: 488840 - RNA, 64 nt, hsa
ggaguuaugcacgcuuguagucccaacuaccugggaggcugaggcgggagaaucaccugagccu

SEQ ID NO: 488841 - RNA, 64 nt, hsa
gcgguggcucacgccuguaaucccagcacugugagaggcugaggcgggaugaucaccugagguc

SEQ ID NO: 488842 - RNA, 64 nt, hsa
gugguggcaggcaccuguaaucccagcuacuugggaggcugaggcaggagaaaucgccugaacc

SEQ ID NO: 488843 - RNA, 64 nt, hsa
acgguggcucaugccuguaaucccagcacuuugggaggcugaggcaggcggaucacuugagguc

SEQ ID NO: 488844 - RNA, 64 nt, hsa
gugguggugcaugccuguaaucccagcuacuggggaggcugaggcaggagaaucgcuugaaccu

SEQ ID NO: 488845 - RNA, 64 nt, hsa
gugguggcgggcaccuguaaucgcagccuuucaggaggcugagacaggagaaucgcuugaaccc

SEQ ID NO: 488846 - RNA, 64 nt, hsa
augguagcgcacgccuguaaucccaucuucuugggaggcugaggcaggagaaucgcuagaaacu

SEQ ID NO: 488847 - RNA, 64 nt, hsa
augguggcgcacgccuguaguuccagcuacucaggaggcugaggcaggagaaucgcuugaaccc

SEQ ID NO: 488848 - RNA, 64 nt, hsa
accguggcucacgccuguaaucccagcacuuugggaggcugaggcggguggaucaccugagguc

SEQ ID NO: 488849 - RNA, 64 nt, hsa
gggauggcucacgccuguaaucccagcacuuugggaggcugaggcgggcagaucacuugaggcc

SEQ ID NO: 488850 - RNA, 64 nt, hsa
ugcaguggugaggccuguaaucccagcuacucaggaggcugaggcaggagaaucgcuugcaccc

SEQ ID NO: 488851 - RNA, 64 nt, hsa
gugguggcacgugccuguaaucccagcuacucaggaggcugaggcaggagaaucgcuugaaccc

SEQ ID NO: 488852 - RNA, 64 nt, hsa
cacagagccagaagccagagggccagggauaugagaggcugacaaacaucaggggacaucuggg

SEQ ID NO: 488853 - RNA, 64 nt, hsa
acgguggcucacaccuauaauccuagcacuuggggaggcugaggcagacggauuaccugagguc

SEQ ID NO: 488854 - RNA, 64 nt, hsa
gcaguggcgugcaccuguaaucccagcuacucuggaggcugaggcaggagaaucaccugaaccu

SEQ ID NO: 488855 - RNA, 64 nt, hsa
cuuguggcacacaacuguggucccagcuacaggggaggcugagacgcaaggaucacuugagccc

SEQ ID NO: 488856 - RNA, 64 nt, hsa
acggaggcucgugcauguaauccuagcacuuugggaggcugagaugggaggaucacuugaggcc

SEQ ID NO: 488857 - RNA, 64 nt, hsa
ggugugguggcaagugccuuuaaucccaccucaggaggcugaggcaggagaaucgcuugaaccu

SEQ ID NO: 488858 - RNA, 64 nt, hsa
guaacggcggaugccuguaaucccagcuacuugggaggcugaggcaggagaaucgcuugaaccu

SEQ ID NO: 488859 - RNA, 64 nt, hsa
gcgguggcucacgccuguaaucccagcacuuugggaggcugaggcgggcagaucacaagaucag

SEQ ID NO: 488860 - RNA, 64 nt, hsa
gugguggggugcgcuuguaaucccagcuacucaggaggcugaggcaggagaaucgcuuaaacuc

SEQ ID NO: 488861 - RNA, 64 nt, hsa
augguggcgggugccuguaaucucagcuacuugagaggcugaggcaggagaaucgcuugaacuu

SEQ ID NO: 488862 - RNA, 64 nt, hsa
guggugacgcaugccuguaguccuagcuacucaggaggcugaggugggaggaucaccuaaggcc

SEQ ID NO: 488863 - RNA, 64 nt, hsa
gugggggcgugcgccuguagucccagcuacuugggaggcugaggcaggagaauugcuugaaccc

SEQ ID NO: 488864 - RNA, 64 nt, hsa
gugauggcucacaccuguaaucccagugcuuugggaggcugaggugggaagauucuuugagccc

SEQ ID NO: 488865 - RNA, 64 nt, hsa
guggugguaugugccuguagucucagcuacucaggaggcugagacaggagaaucacuugaaccc

SEQ ID NO: 488866 - RNA, 64 nt, hsa
ggcguggugggcgccuguaaucccagcugcucaggaggcugaggcaggagaaucgcuugaaccc

SEQ ID NO: 488867 - RNA, 64 nt, hsa
gugguggcucacgccuguaaucccagcacuuugggaggcugaggcaggcagaucaccugaggcu

SEQ ID NO: 488868 - RNA, 64 nt, hsa
agggcccuccgagguggagcagcagcuacaagcagaggcugaacaccugcggaaggagcuggag

SEQ ID NO: 488869 - RNA, 64 nt, hsa
agggcccuccgagguggaacagcagcuacaagcagaggcugaacaccugcggaaggagcuggag

SEQ ID NO: 488870 - RNA, 64 nt, hsa
augguggcaggugccuguagucccagguacucgggaggcugagacaggagaaucgcuugaaccu

SEQ ID NO: 488871 - RNA, 64 nt, hsa
gugguggcucaugccuguaaucccagcacuuugggaggcugagggagguagaucaccugagguc

SEQ ID NO: 488872 - RNA, 64 nt, hsa
acgauggcucacaccuguaaucccagcacuuugggaggcugaggcgggaagaucacuugaguuc

SEQ ID NO: 488873 - RNA, 64 nt, hsa
gugguggcacgcgccuguaaucccagcuacuuaggaggcugaggcaggagaaucgcuugaaccc

SEQ ID NO: 488874 - RNA, 64 nt, hsa
acaguagcucacaccugaaaucuuagcacuucgggaggcugaggcagguggaucacuugagguu

SEQ ID NO: 488875 - RNA, 64 nt, hsa
augauggugcaugccuuuaaacccagcuacugaggaggcugaggcaugagaauugcuugaacca

SEQ ID NO: 488876 - RNA, 64 nt, hsa
cugaagaaacgauagaugugcagguugugcggaagaggcugaguggaaaauggugugagcccca

SEQ ID NO: 488877 - RNA, 64 nt, hsa
gugguggcucaugccuauaaucccagcacguugggaggcugaggcgggcggaucgguugagcuc

SEQ ID NO: 488878 - RNA, 64 nt, hsa
cugguggcgcacgccuguagucccagcuacucgggaggcugagguaggaggaucgcuugagccu

SEQ ID NO: 488879 - RNA, 64 nt, hsa
ucggcggcucacaccuguaaccccagcacuuugggaggcugagguggguggaucacuugagguc

SEQ ID NO: 488880 - RNA, 64 nt, hsa
gugguggcgggcgccuguaaucccagcuacuugggaggcugaggcaggagaaucgcuugaaucu

SEQ ID NO: 488881 - RNA, 64 nt, hsa
augguggcgcacgccuguagucccagcugcuugggaggcugaggugggagaaucacuugagccc

SEQ ID NO: 488882 - RNA, 64 nt, hsa
gcaguggcucacaccuguaaucccagcauuuugggaggcugagugagaggaucacuugagcuca

SEQ ID NO: 488883 - RNA, 64 nt, hsa
augguggcaaacgccuguaaucccaacuacuugggaggcugaggcaggagaaucucuugaaccc

SEQ ID NO: 488884 - RNA, 64 nt, hsa
gugguggcucacgcauguaaucccagcacucugggaggcugaggcgggcagaucaccugaggcc

SEQ ID NO: 488885 - RNA, 64 nt, hsa
guaguggugugcaccuguagucccagcucuucaggaggcugagaaaagagaauuguuugaaccu

SEQ ID NO: 488886 - RNA, 64 nt, hsa
agcuacuuaggaggcugaggggcaaggauugcuugaggcugagagauugagccugcagugagcu

SEQ ID NO: 488887 - RNA, 64 nt, hsa
aaaauuagcuggacguguagucccagcuacuuaggaggcugaggggcaaggauugcuugaggcu

SEQ ID NO: 488888 - RNA, 64 nt, hsa
augguggaaugugccuguaaucccaccuacucgagaggcugaggcagcagaauugcuugaaccc

SEQ ID NO: 488889 - RNA, 64 nt, hsa
gugguggugcaugcauguaguuccagcuacucaggaggcugaggcuagaggauccuugagccca

SEQ ID NO: 488890 - RNA, 64 nt, hsa
gcgguggcucacgcuuguaaucgcagcacuuugggaggcugaggcaggaggaucacuugagccc

SEQ ID NO: 488891 - RNA, 64 nt, hsa
gugguggcacacuccuguaaucccagcuacuuaggaggcugaggugggagaaucacuuggacuc

SEQ ID NO: 488892 - RNA, 64 nt, hsa
gcgguggcucaugccuguaaucccagcauuuugagaggcugaggcggguggaucaccugagguc

SEQ ID NO: 488893 - RNA, 64 nt, hsa
aggguggugcaugccuguagucccagcuacuugggaggcugaggcaggagaauuuuuugagccc

SEQ ID NO: 488894 - RNA, 64 nt, hsa
aggguguguggauggcacaggaucaauaaugccugaggcugauugacgacaucuacauuucagu

SEQ ID NO: 488895 - RNA, 64 nt, hsa
guggugguacaugccuguaaucccagcuacuagggaggcugaggcaggagaaucacucgaaccc

SEQ ID NO: 488896 - RNA, 64 nt, hsa
auggucgcucaggccaguaaucccagugacuuaggaggcugaggugggaggauuacuugaaacc

SEQ ID NO: 488897 - RNA, 64 nt, hsa
augacggcucaugccuguaaucccagcacuuugggaggcugaggcagguggaucacuggagguc

SEQ ID NO: 488898 - RNA, 64 nt, hsa
uaaucccagcuggccuguaaucccagcuacuugggaggcugaggcagaacugcuugaacccagg

SEQ ID NO: 488899 - RNA, 64 nt, hsa
gcaguggcucacgccuguaaucccagcacuuugggaggcugaggcgggcggaucacgaggucag

SEQ ID NO: 488900 - RNA, 64 nt, hsa
gugguggcacgcgccuguagucccagcugcucaggaggcugaggcaggagaauggcguaaaccc

SEQ ID NO: 488901 - RNA, 64 nt, hsa
augguggcaggcaccuguagucccagcuacucgggaggcugaggcaggagaauggcgugaaccc

SEQ ID NO: 488902 - RNA, 64 nt, hsa
acaguggcucacgccuguaaucucagcacauugggaggcugaggugggcggaucaccugagguc

SEQ ID NO: 488903 - RNA, 64 nt, hsa
gggguagugcaugccuguaaucccagcuacucaggaggcugaggccggagaaucgcuugagccc

SEQ ID NO: 488904 - RNA, 64 nt, hsa
gugguggcucacgccuauaaucccagcacuuugggaggcugagguggguggaccacuugaggcc

SEQ ID NO: 488905 - RNA, 64 nt, hsa
cugguggugcgugccuguaaucccagcuacucaggaggcugaggcaggagaaucacuugaaccc

SEQ ID NO: 488906 - RNA, 64 nt, hsa
ggcguggugcaugccuguaaucccagccacucaggaggcugaggcggggaggauccauugagcc

SEQ ID NO: 488907 - RNA, 64 nt, hsa
gcggcagcucaugccuguaaucccaacacuuugggaggcugaggcaggcggaucacgaggucag

SEQ ID NO: 488908 - RNA, 64 nt, hsa
acaccuguaguccccuguagucccagcuacucgggaggcugaggcaggagaaucguuugaaccu

SEQ ID NO: 488909 - RNA, 64 nt, hsa
cccauagcacuggaagccagagaaaauguuggaagaggcugagacauucuucaccuccuuggcg

SEQ ID NO: 488910 - RNA, 64 nt, hsa
cuggaacuucuaccaggacgacgauuucagcuaggaggcugaggcaggagaaucacuggaaccu

SEQ ID NO: 488911 - RNA, 64 nt, hsa
gugguggcucacaccuguaaucccagcauuuugggaggcugagguggccagaucccaaggucag

SEQ ID NO: 488912 - RNA, 64 nt, hsa
gugguggcggguaccuguaguccuagcuacuugggaggcugaggcaggagaauggcgugaaccu

SEQ ID NO: 488913 - RNA, 64 nt, hsa
gugguggggugcaccuguagucccagcuacuagggaggcugagccaggaggaucacuugagccc

SEQ ID NO: 488914 - RNA, 64 nt, hsa
cugauggcucgugccuguacucccagcacuuugggaggcugaggugggaggguugcuugagccc

SEQ ID NO: 488915 - RNA, 64 nt, hsa
gcaguggcucacgccuguaaucccagcacuuugggaggcugaggcaggcggaucaccugaaguc

SEQ ID NO: 488916 - RNA, 64 nt, hsa
ugaugggggucugccuguaaugccagcuacuccagaggcugaggcaagagaaucacuugaaccc

SEQ ID NO: 488917 - RNA, 64 nt, hsa
gugguggcucaugccuguaaucccagcacuuugggaggcugaggugggcagaucaccugagguc

SEQ ID NO: 488918 - RNA, 64 nt, hsa
augguggcacgugccuguggucucagcuacuugggaggcugaggcgggaggaucgccagagccc

SEQ ID NO: 488919 - RNA, 64 nt, hsa
augguugcgcaugccuguaaucccagcuacuuuggaggcugagguggggagaauugcuugaacc

SEQ ID NO: 488920 - RNA, 64 nt, hsa
augguggcucauaccuguuauaccagcacuuugggaggcugaagugggaggaucgcuugagccu

SEQ ID NO: 488921 - RNA, 64 nt, hsa
ccagauauuugcuuccuaagaauaguucucauuggaggcugaggucgaagcagccucccaccag

SEQ ID NO: 488922 - RNA, 64 nt, hsa
ggggacguaaaucccuaaucuuuaagcccgacuugaggcugagagcagcuggaaguuuggguuu

SEQ ID NO: 488923 - RNA, 64 nt, hsa
caccagccccagcugccaucagauucaagcccaggaggcugaaaacgagggcccaggaccagaa

SEQ ID NO: 488924 - RNA, 64 nt, hsa
gccuucacuucaagggcccuccccagcuacucgggaggcugaggcaggagaaucgcuugaacuc

SEQ ID NO: 488925 - RNA, 64 nt, hsa
augguugcaggcgccuguagucccagcuacuugggaggcugaggcaggagaauggccugaaccc

SEQ ID NO: 488926 - RNA, 64 nt, hsa
acgguggcucacgccuguaaucccagcacuuugggaggcugaggcaggugguucacuggagguu

SEQ ID NO: 488927 - RNA, 64 nt, hsa
gugguggugcacaccugugaucccagcuacuugggaggcugaggugggagaauugcuugaaccu

SEQ ID NO: 488928 - RNA, 64 nt, hsa
gcgguggcuuacgcuuguaaucccagcacuuugggaggcugaagcaggcggaucacaaggucag

SEQ ID NO: 488929 - RNA, 64 nt, hsa
guguuggcgggcaucuguaauaccagcuacuugggaggcugaggcagaagaaucacuugaaccc

SEQ ID NO: 488930 - RNA, 64 nt, hsa
ccaagcaugguagcaagugccuauaauaccagcugaggcugaggcaggagaaucccuugagccc

SEQ ID NO: 488931 - RNA, 64 nt, hsa
acaguggcucacaccuguaaucccagcacuuugggaggcugaggcggguggaucacuugagguc

SEQ ID NO: 488932 - RNA, 64 nt, hsa
guguuggcacacaccuguaaucccagcuacucaggaggcugaggcaggagaauuacuuuaaccu

SEQ ID NO: 488933 - RNA, 64 nt, hsa
gugguagcccacgccucuaaucccagcacuuugggaggcugaggcggggagaucacaaggucag

SEQ ID NO: 488934 - RNA, 64 nt, hsa
ggagccccugccccacgcuaauaaaauguguugcgaggcugacgcugguguguaugcgagcgcc

SEQ ID NO: 488935 - RNA, 64 nt, hsa
gugguggcaggcgccuguaaucccagcuacucaggaggcugaggcaggagaauaacuugaaccc

SEQ ID NO: 488936 - RNA, 64 nt, hsa
auggaggugggugcuuguaguuccagcuacucaggaggcugaggugggaggaugacuugaacgc

SEQ ID NO: 488937 - RNA, 64 nt, hsa
aggaggcugaggugggaggaugacuugaacgcaggaggcugaggcugcagugaguugugauugc

SEQ ID NO: 488938 - RNA, 64 nt, hsa
gugguggcaggugccuguaaucccagcuacuugggaggcugaggcaugagaaucacuuaaaccu

SEQ ID NO: 488939 - RNA, 64 nt, hsa
acaguggcucaugccuguaaucccagcacucugggaggcugagguggguggaucaccugagguc

SEQ ID NO: 488940 - RNA, 64 nt, hsa
augguggugcaugccuguaaucccagcuacucgggaggcugaggcaggagaacugcuugaaccc

SEQ ID NO: 488941 - RNA, 64 nt, hsa
gugguggcgggcaccuguagucccagcuacucgggaggcugaggcaggagaauggugugaaccc

SEQ ID NO: 488942 - RNA, 64 nt, hsa
caucagcagcccauggccucuggccaggcauggcgaggcugaggugggaggaugguuugagcuc

SEQ ID NO: 488943 - RNA, 64 nt, hsa
caggugccucacgccuguaaucccagcacuuugggaggcugagcuggaucacuugaguucagga

SEQ ID NO: 488944 - RNA, 64 nt, hsa
acgguggcacgugccugugaucccagcuacuugggaggcugaggcaggaggaucgccugagccc

SEQ ID NO: 488945 - RNA, 64 nt, hsa
cccucuugauggaugaagacacugaggacucagagaggcugagucacuuaccugaggacaccca

SEQ ID NO: 488946 - RNA, 64 nt, hsa
augauggcacacaccuguaguccgagccacuugggaggcugaggugggaggaucgguugagccc

SEQ ID NO: 488947 - RNA, 64 nt, hsa
acgguggcucaugccucuaaucccagcacuuugggaggcugaggcugggggaucaccugagguc

SEQ ID NO: 488948 - RNA, 64 nt, hsa
uugguggcaugcaccuguaaucccagcuacuugggaggcugaggcaggagaauucuuugaaccc

SEQ ID NO: 488949 - RNA, 64 nt, hsa
ccuguacuggggaggugcccacccagcuacuggggaggcugagucaggagaaucgcuugaaccu

SEQ ID NO: 488950 - RNA, 64 nt, hsa
auucccuggagacucacugcaaguuccugcccaggaggcugagggcaccccauccucagugccc

SEQ ID NO: 488951 - RNA, 64 nt, hsa
gcgguggcucacaccuguaaucccagcacuuugggaggcugagacgggugaauuacaugagguu

SEQ ID NO: 488952 - RNA, 64 nt, hsa
guaguggugcaugccuguaaucccagcuacucgggaggcugaggcaggagaauugcuugaaccc

SEQ ID NO: 488953 - RNA, 64 nt, hsa
cgaacuaaacccaggcaacaggcgaggcaggacagaggcugaguggaaagguggucuggagccc

SEQ ID NO: 488954 - RNA, 64 nt, hsa
gaaugcacagcucagggaagcugguggaugccuagaggcugaaggacagggaacucuccauuau

SEQ ID NO: 488955 - RNA, 64 nt, hsa
uaaaauggaugcagcccuaacugcaaaagucagagaggcugacaaggaccaaugcuucuuuauc

SEQ ID NO: 488956 - RNA, 64 nt, hsa
gugguggcacacaccuguagucccagcuacucgggaggcugaggcaggagaaucguuugaaccu

SEQ ID NO: 488957 - RNA, 64 nt, hsa
ugugguggugcgugcccagguucccagguacucggaggcugagaggugggaggaugccuugagc

SEQ ID NO: 488958 - RNA, 64 nt, hsa
ugguggcgggcgccugugguggccagcuacucaggaggcugaggcaggagaauggcgugaaccc

SEQ ID NO: 488959 - RNA, 64 nt, hsa
cugguggcacaugccuguaauccgagugcuuugggaggcugaggcaggaggaucacucgagcuc

SEQ ID NO: 488960 - RNA, 64 nt, hsa
augguggugcacaccaguauucccagcuacucuggaggcugaggcggaggcaggauugcuugau

SEQ ID NO: 488961 - RNA, 64 nt, hsa
gugguggugcacaccuguaaucccagcuacucgggaggcugaggcaagagaaucacuugaaccc

SEQ ID NO: 488962 - RNA, 64 nt, hsa
acagucauggaguuggguauucccagcuaccagggaggcugaggugggaggauugcuugaugcc

SEQ ID NO: 488963 - RNA, 64 nt, hsa
gccuauagccugauuuaugucacugccaauuucugaggcugaagccauuucacauuucaccccu

SEQ ID NO: 488964 - RNA, 64 nt, hsa
guggcagcaugcgccuauagucccagccacuugggaggcugaggcaggagaaucgcuugaaccc

SEQ ID NO: 488965 - RNA, 64 nt, hsa
augguggcgcauaccuguaguccuagcuacucaggaggcugaggugggaggaucacuugagcuu

SEQ ID NO: 488966 - RNA, 64 nt, hsa
augguggcgggcuccuguagucccagcuacucaggaggcugaggcaggagaauggcgcgaacau

SEQ ID NO: 488967 - RNA, 64 nt, hsa
gugguggcgcgugccuauaaucccagcuacucgggaggcugaggcaggagaaucgcuugaaccc

SEQ ID NO: 488968 - RNA, 64 nt, hsa
gcgguggcucacgucuguaaucccagcacuuugggaggcugaggcgggcggaucaccugagguu

SEQ ID NO: 488969 - RNA, 64 nt, hsa
gggcaugguagcaggugucuguuaucccaguuaggaggcugaggcaagagaaucucuugaaccu

SEQ ID NO: 488970 - RNA, 64 nt, hsa
gcgguggcucacaccuguaaucccagcacuuugggaggcugaggcgggcggaacaccugagguc

SEQ ID NO: 488971 - RNA, 64 nt, hsa
gguguggugggcaccuguaaucccagcuacuugggaggcugaggcaagugaaucacuugaaccc

SEQ ID NO: 488972 - RNA, 64 nt, hsa
aaauuacuuaauuccuguaaucccagcauuuugagaggcugagguggguggaucacuugagguc

SEQ ID NO: 488973 - RNA, 64 nt, hsa
gugauggcacaugccuguaaucccagcuacucaggaggcugaggcaggauaaucacuugaaucc

SEQ ID NO: 488974 - RNA, 64 nt, hsa
guggugguaugccccuguagucccagcuacuugggaggcugaggugggaagaucucuugagccc

SEQ ID NO: 488975 - RNA, 64 nt, hsa
augguggcacgcgucugugguccuagcuccucgggaggcugaggcaggagaaucgcuugaacuc

SEQ ID NO: 488976 - RNA, 64 nt, hsa
gcaguggcucacaucuguaaccccagcacuuugggaggcugagaugggcagaucacuugagguc

SEQ ID NO: 488977 - RNA, 64 nt, hsa
augguggcaccugccuguaaucccagcuacuugggaggcugaggcaggagaaucacuugagccc

SEQ ID NO: 488978 - RNA, 64 nt, hsa
gugguggcucaugccuguaaucucagcacuuugggaggcugagguggguggaucacuggaguuu

SEQ ID NO: 488979 - RNA, 64 nt, hsa
augguggcgggugccuguaaucccagcuacuggggaggcugaggcaggagaaucacuugaauuc

SEQ ID NO: 488980 - RNA, 64 nt, hsa
acaguggcccaugccuauaaucccagcacuuugggaggcugaggcagguggaucaccugagguu

SEQ ID NO: 488981 - RNA, 64 nt, hsa
ugagacaaaggggaucgcuugagcccaggaguuggaggcugaagagagcuaugacugcaucacu

SEQ ID NO: 488982 - RNA, 64 nt, hsa
auaguggcuuaugccuguaaucccgguacuuugggaggcugaggugggaggacugcuuaagcuc

SEQ ID NO: 488983 - RNA, 64 nt, hsa
guaguggcgcaugccuguagucccagcuacuugggaggcugaugcaugagaauugcuugaaccc

SEQ ID NO: 488984 - RNA, 64 nt, hsa
gcggugacucacgccuauaaucccagcacuuugggaggcugaggcggguggaucaccugagguc

SEQ ID NO: 488985 - RNA, 64 nt, hsa
acaguaguacacaccuguaguccaagcuacuugggaggcugaagugggaggaucauuugugccc

SEQ ID NO: 488986 - RNA, 64 nt, hsa
uugguggugugcaccuguaauuccagcuacucgggaggcugaggcaggagaauugcuugagccc

SEQ ID NO: 488987 - RNA, 64 nt, hsa
acaguggcucaugccuguaaucccagcacuuugggaggcugaggcaggcggaucaccugagguc

SEQ ID NO: 488988 - RNA, 64 nt, hsa
aggcgggcgaggcggccacaggcgagggugggcugaggcugaaguugcccacacugggggccag

SEQ ID NO: 488989 - RNA, 64 nt, hsa
ugccaucucacuccccaaggcucgggugggggcugaggcugaggccaaaggggcuggggaggca

SEQ ID NO: 488990 - RNA, 64 nt, hsa
guuuggacucucggggccaaagguggcuaaggcagaggcugagggggcugggcgagcuaccaag

SEQ ID NO: 488991 - RNA, 64 nt, hsa
cgccgccgcuccuccccccaggaaagccaagguggaggcugagguggcugcaggagcucguuuc

SEQ ID NO: 488992 - RNA, 64 nt, hsa
acgguggugugugccuguagucccagcuacuggugaggcugaggcuggaggaucacuggaguuc

SEQ ID NO: 488993 - RNA, 64 nt, hsa
acgguggcucaugccuguaaucccaacacuuugggaggcugaggccggaggauugcuugagccc

SEQ ID NO: 488994 - RNA, 64 nt, hsa
gugguggugggugccuguaauccuagcuacuugggaggcugaggcaggagaauugcuugaacuu

SEQ ID NO: 488995 - RNA, 64 nt, hsa
gugguggggugcgcuuguaaucccagcuacucgggaggcugaggcaggagaauugcuugaaccc

SEQ ID NO: 488996 - RNA, 64 nt, hsa
gugguggcgcgcgccuguaaucccagcuacucaggaggcugaggcagaugaauugcuugaaucc

SEQ ID NO: 488997 - RNA, 64 nt, hsa
acgguggcucacgccuguaaucccagcacuuugggaggcugaggcaggucgaucacgaggucag

SEQ ID NO: 488998 - RNA, 64 nt, hsa
gugguggugugcaccuuuaguuccagcuacuugagaggcugaggcacaagagucgcuuaaaccu

SEQ ID NO: 488999 - RNA, 64 nt, hsa
gugguggcaggugccuguaguccuagcugcuugggaggcugaggcaggagaauggugugaaucc

SEQ ID NO: 489000 - RNA, 64 nt, hsa
gugguugugggcgccuguagucccagcuacucaggaggcugaggcaggagaauggcaugaaccg

SEQ ID NO: 489001 - RNA, 64 nt, hsa
gcuguggcucaggccuguaaucccauaauuuucagaggcugagacaguugggucacgugggccc

SEQ ID NO: 489002 - RNA, 64 nt, hsa
uuaguggugcaugccuguagucucagcuacuugggaggcugaggcaggagaauugcuugaaucc

SEQ ID NO: 489003 - RNA, 64 nt, hsa
gugguggcaggugccuguaaucccagcuacuugggaggcugaggcaggagagugcuugaaccca

SEQ ID NO: 489004 - RNA, 64 nt, hsa
gcgguggcucacaccuguaaucccagcacuuugggaggcugaggcagguggaucaccugagguc

SEQ ID NO: 489005 - RNA, 64 nt, hsa
auaguugugggcaccuguaaucccagcuacccgggaggcugaggcaggagaauugcuugaaccu

SEQ ID NO: 489006 - RNA, 64 nt, hsa
gguggcucaaaugccuguaaucccaguacuuugggaggcugaggugggcgcaucaccugagguc

SEQ ID NO: 489007 - RNA, 64 nt, hsa
auaguggugggugccuguagucccagcugcuugggaggcugaggcaggagaauucguuaaaccu

SEQ ID NO: 489008 - RNA, 64 nt, hsa
guuuuggcucaggccuguaaucccagcacuuugggaggcugagguggguggcuuacaaggucag

SEQ ID NO: 489009 - RNA, 64 nt, hsa
ugcaguagcucacacuguaaucacagugacucaggaggcugaggugagaggauuccuugaggcc

SEQ ID NO: 489010 - RNA, 64 nt, hsa
augguggcacaugccuauagucucagcuacuugugaggcugaggcaggaggauucuuugagccc

SEQ ID NO: 489011 - RNA, 64 nt, hsa
guaguggugcaugccuguaaucccaguuacucgagaggcugaggcaggaaaaucgcuugaaccc

SEQ ID NO: 489012 - RNA, 64 nt, hsa
acaguggcuuacgccuguaaucccagcacuuugggaggcugaggcuggcguaucaccugagguu

SEQ ID NO: 489013 - RNA, 64 nt, hsa
augguggugcacaccuguaguccuagcuucuugggaggcugaggcaggauugcuugagcccagg

SEQ ID NO: 489014 - RNA, 64 nt, hsa
gugguggcucaugccuguaaucccagcacugugggaggcugaggugguuguauugcuugaggcc

SEQ ID NO: 489015 - RNA, 64 nt, hsa
gugggggugggcgccuguagucccagcuacgugggaggcugaggcagcagacuggugugaaccc

SEQ ID NO: 489016 - RNA, 64 nt, hsa
acgguggcucaugccuguaaucccagcacuuugggaggcugaggcagguggaucacgaggucag

SEQ ID NO: 489017 - RNA, 64 nt, hsa
gugguggcucauaccuguaaccccagcacuuugggaggcugagguaggaggauugugggaagcc

SEQ ID NO: 489018 - RNA, 64 nt, hsa
augauggugugcaccuauagucccagcuacucgggaggcugaagcagaaggaucacuugagucu

SEQ ID NO: 489019 - RNA, 64 nt, hsa
caggguggcaugugccuuuaaucccagcuacagggaggcugaggcaggagaaucacuugaaccu

SEQ ID NO: 489020 - RNA, 64 nt, hsa
acgguggcucacaccuguaaucccagcacuuugggaggcugaggcaggcagaucaugaggucaa

SEQ ID NO: 489021 - RNA, 64 nt, hsa
gugguggcgcgcgccuguugucuuagcuacucaggaggcugaggcaggagaaucgcuugaaaac

SEQ ID NO: 489022 - RNA, 64 nt, hsa
ggagggaggccaggccucgcuugcaccgcgggacgaggcugaccgggcuguucuguagacucag

SEQ ID NO: 489023 - RNA, 64 nt, hsa
gugguggcacaugccuguaaucccagcuacucgggaggcugaggcaggagaauugcuugaaccu

SEQ ID NO: 489024 - RNA, 64 nt, hsa
guacaaaccagcugccucacuucuguuucacagggaggcugauggaaaaaggaagcaagcugga

SEQ ID NO: 489025 - RNA, 64 nt, hsa
gugguggugggcgccuguagucccagcuacuugggaggcugaggcaggagaaugguaugaacca

SEQ ID NO: 489026 - RNA, 64 nt, hsa
guggugguucaugccuguaauaccagcguuuugggaggcugagaugggaggauugcuugagccc

SEQ ID NO: 489027 - RNA, 64 nt, hsa
auagugguucaugccuguaaucccagcacuuugggaggcugaggaggguggaucacuugaggcc

SEQ ID NO: 489028 - RNA, 64 nt, hsa
caugguggcacacaccuguaaucccagcuacucggaggcugaggcacaagaauugcuugaaccu

SEQ ID NO: 489029 - RNA, 64 nt, hsa
gcagcgccucgcucgagagaagcagaugagggaggaggcugaacgcacgagggaugaguuggag

SEQ ID NO: 489030 - RNA, 64 nt, hsa
ggaggaggcaaaacuucuggcccagaaggccgcagaggcugagcaggaaaugcagcgcaucaag

SEQ ID NO: 489031 - RNA, 64 nt, hsa
gugaugauacaugccuguaauccuggcuacuugggaggcugaggcaugagaauugcuugaaccu

SEQ ID NO: 489032 - RNA, 64 nt, hsa
gugguggcggaugccuguagucccagcuacucaggaggcugaggcaggagaauggcgugaaccc

SEQ ID NO: 489033 - RNA, 64 nt, hsa
cgcaguggcuuacacuuguaacccuagaacuugggaggcugaggugggcggauuacuugagccc

SEQ ID NO: 489034 - RNA, 64 nt, hsa
gugguagugcaugccuguagucccagcuacuugggaggcugaagugggaggauggccugagcuc

SEQ ID NO: 489035 - RNA, 64 nt, hsa
acacacggggccaugucuggacgagcaggggagagaggcugaacuggccagaaguggccccucc

SEQ ID NO: 489036 - RNA, 64 nt, hsa
gugguggcacaugacuguaaucccagcuacucaggaggcugaggcaggaggaucacuugaaccu

SEQ ID NO: 489037 - RNA, 64 nt, hsa
gugguggcacaugccaguaauuccaucuacucgggaggcugaggcaggagaaucgucuaagccc

SEQ ID NO: 489038 - RNA, 64 nt, hsa
cuguggcuucagucaauugucuugagacugugaagaggcugaaagacaccuucccggguggaag

SEQ ID NO: 489039 - RNA, 64 nt, hsa
augguggcgcaugccuuuaaucccagcuacucgggaggcugaggcacgagaaucacuugaaccc

SEQ ID NO: 489040 - RNA, 64 nt, hsa
augguggcgugcaccuguaaucccagcuacucaggaggcugaggcaggagaaucgcuuguaccc

SEQ ID NO: 489041 - RNA, 64 nt, hsa
gugguggcucacgccuauaaucccagcaguuugggaggcugaguugggcagaucaccugagauc

SEQ ID NO: 489042 - RNA, 64 nt, hsa
ggugguggcaguggaggaggcugaggaggcugaagaggcugacaggucggggggcuuucugucu

SEQ ID NO: 489043 - RNA, 64 nt, hsa
cucaggccuggugguggcaguggaggaggcugaggaggcugaagaggcugacaggucggggggc

SEQ ID NO: 489044 - RNA, 64 nt, hsa
cuugcccaccucaggccuggugguggcaguggaggaggcugaggaggcugaagaggcugacagg

SEQ ID NO: 489045 - RNA, 64 nt, hsa
ucaguggcucacgccuguaaucccagcacuuugggaggcugaggcagguggaucacgaggucag

SEQ ID NO: 489046 - RNA, 64 nt, hsa
gugguggcgggcgccuguagucccagcuacucgggaggcugaggcaggagaauggugugaaccc

SEQ ID NO: 489047 - RNA, 64 nt, hsa
cagaggcugaggugggaagaucauuugagcccaggaggcugaggcugcaaugagcuauaauuau

SEQ ID NO: 489048 - RNA, 64 nt, hsa
augguggugugcaccuguggucccagcuacuccagaggcugaggugggaagaucauuugagccc

SEQ ID NO: 489049 - RNA, 64 nt, hsa
gugguggcgggcaccuguaauccuggcuacucgggaggcugaggcaggagaaucgcuugaaccc

SEQ ID NO: 489050 - RNA, 64 nt, hsa
augguggcacgugaguguagucucagcuacucaggaggcugagaugagaggaucacuugagccu

SEQ ID NO: 489051 - RNA, 64 nt, hsa
gcaguggcuuguuccuauagucccagcacuuugggaggcugagguggguggauugcuugagccc

SEQ ID NO: 489052 - RNA, 64 nt, hsa
guaguggcgcgugccuguaauuccaucuacucgggaggcugaggcaggagaaucgcuugauccu

SEQ ID NO: 489053 - RNA, 64 nt, hsa
gcgguggcucaugccuguaacccuagcacuuugggaggcugaggcgggcagaucacuugagguu

SEQ ID NO: 489054 - RNA, 64 nt, hsa
gugguggcaggagccuguaaucccagcuacacaggaggcugaggcacgagaaucacuugaacuc

SEQ ID NO: 489055 - RNA, 64 nt, hsa
uugguggcucaugccuauaauccuagcuacuugggaggcugaggcacgagacuugcuuaauacc

SEQ ID NO: 489056 - RNA, 64 nt, hsa
gcgguggcacccgccuguaaucccagcuacucgggaggcugaggcggaagauucgcuugagccc

SEQ ID NO: 489057 - RNA, 64 nt, hsa
gacugauggcaugugccuguaaucccagcuucuggaggcugaggccagagaaucgcuugaaccu

SEQ ID NO: 489058 - RNA, 64 nt, hsa; identical to SEQ ID NO: 299681

SEQ ID NO: 489059 - RNA, 64 nt, hsa; identical to SEQ ID NO: 299682

SEQ ID NO: 489060 - RNA, 64 nt, hsa; identical to SEQ ID NO: 299683

SEQ ID NO: 489061 - RNA, 64 nt, hsa; identical to SEQ ID NO: 299684

SEQ ID NO: 489062 - RNA, 64 nt, hsa; identical to SEQ ID NO: 299685

SEQ ID NO: 489063 - RNA, 64 nt, hsa; identical to SEQ ID NO: 299686

SEQ ID NO: 489064 - RNA, 64 nt, hsa; identical to SEQ ID NO: 299687

SEQ ID NO: 489065 - RNA, 64 nt, hsa; identical to SEQ ID NO: 299688

SEQ ID NO: 489066 - RNA, 64 nt, hsa; identical to SEQ ID NO: 299689

SEQ ID NO: 489067 - RNA, 64 nt, hsa; identical to SEQ ID NO: 299690

SEQ ID NO: 489068 - RNA, 64 nt, hsa; identical to SEQ ID NO: 299691

SEQ ID NO: 489069 - RNA, 64 nt, hsa; identical to SEQ ID NO: 299692

SEQ ID NO: 489070 - RNA, 53 nt, hsa; identical to SEQ ID NO: 299693

SEQ ID NO: 489071 - RNA, 64 nt, hsa; identical to SEQ ID NO: 299694

SEQ ID NO: 489072 - RNA, 64 nt, hsa; identical to SEQ ID NO: 299695

SEQ ID NO: 489073 - RNA, 64 nt, hsa; identical to SEQ ID NO: 299696

SEQ ID NO: 489074 - RNA, 64 nt, hsa; identical to SEQ ID NO: 299697

SEQ ID NO: 489075 - RNA, 64 nt, hsa; identical to SEQ ID NO: 299698

SEQ ID NO: 489076 - RNA, 64 nt, hsa; identical to SEQ ID NO: 299699

SEQ ID NO: 489077 - RNA, 64 nt, hsa; identical to SEQ ID NO: 299700

SEQ ID NO: 489078 - RNA, 64 nt, hsa; identical to SEQ ID NO: 299701

SEQ ID NO: 489079 - RNA, 64 nt, hsa; identical to SEQ ID NO: 299702

SEQ ID NO: 489080 - RNA, 64 nt, hsa; identical to SEQ ID NO: 299703

SEQ ID NO: 489081 - RNA, 64 nt, hsa; identical to SEQ ID NO: 299704

SEQ ID NO: 489082 - RNA, 64 nt, hsa; identical to SEQ ID NO: 299705

SEQ ID NO: 489083 - RNA, 64 nt, hsa; identical to SEQ ID NO: 299706

SEQ ID NO: 489084 - RNA, 64 nt, hsa; identical to SEQ ID NO: 299707

SEQ ID NO: 489085 - RNA, 64 nt, hsa; identical to SEQ ID NO: 299708

SEQ ID NO: 489086 - RNA, 64 nt, hsa; identical to SEQ ID NO: 299709

SEQ ID NO: 489087 - RNA, 64 nt, hsa; identical to SEQ ID NO: 299710

SEQ ID NO: 489088 - RNA, 64 nt, hsa; identical to SEQ ID NO: 299711

SEQ ID NO: 489089 - RNA, 63 nt, hsa
ugccaugcggcugccugcaccccagacaauaaagggaccaaaaccacccaacccccacccugc

SEQ ID NO: 489090 - RNA, 63 nt, hsa
cuaggaucauuccacaccccugcaccugaccaagggaccaaugaggcagaggcuugccccaag

SEQ ID NO: 489091 - RNA, 63 nt, hsa
ucuuccauucccagacagcagugugagggugcagggaccaagaugucaagcuggccguggagu

SEQ ID NO: 489092 - RNA, 63 nt, hsa
aucauaaggucuuauucuugugcacuuuaucuugggaccaaaacugccuacccaccccuuccc

SEQ ID NO: 489093 - RNA, 63 nt, hsa
acuucccagggcccaggccucagcccaggccucgggaccaacucuuuguauaaccuaccugaa

SEQ ID NO: 489094 - RNA, 63 nt, hsa
agucaugagcugucugggaagaauggacgugcugggaccaacucaagaccuuguuuugcuguc

SEQ ID NO: 489095 - RNA, 63 nt, hsa
auaagcacuggggacugccagguuggcacuguagggaccaagauuaacuuuuuggugcaucua

SEQ ID NO: 489096 - RNA, 63 nt, hsa
aaaggggguggagacaggaccgugacagucucagggaccaaucccugccucugcccaucagau

SEQ ID NO: 489097 - RNA, 63 nt, hsa
augcugugccuugucacccauugagcugcaagagggaccaagagggggccacgcagccagcca

SEQ ID NO: 489098 - RNA, 63 nt, hsa
aauccucucccccacgggacaccucucugguucgggaccaaucccucccuggggacgugcccc

SEQ ID NO: 489099 - RNA, 63 nt, hsa
ccaagaagcacugggugaccagcuggcagacucgggaccaauacuacugacguccucccugau

SEQ ID NO: 489100 - RNA, 63 nt, hsa
cuggggcacggcgggauccuccacagagaggaggggaccaauucuggacagacagauguuggg

SEQ ID NO: 489101 - RNA, 64 nt, hsa; identical to SEQ ID NO: 160525

SEQ ID NO: 489102 - RNA, 64 nt, hsa; identical to SEQ ID NO: 160526

SEQ ID NO: 489103 - RNA, 64 nt, hsa; identical to SEQ ID NO: 160527

SEQ ID NO: 489104 - RNA, 64 nt, hsa; identical to SEQ ID NO: 160528

SEQ ID NO: 489105 - RNA, 64 nt, hsa; identical to SEQ ID NO: 160529

SEQ ID NO: 489106 - RNA, 64 nt, hsa; identical to SEQ ID NO: 160530

SEQ ID NO: 489107 - RNA, 64 nt, hsa; identical to SEQ ID NO: 160531

SEQ ID NO: 489108 - RNA, 64 nt, hsa; identical to SEQ ID NO: 160532

SEQ ID NO: 489109 - RNA, 64 nt, hsa; identical to SEQ ID NO: 160533

SEQ ID NO: 489110 - RNA, 64 nt, hsa; identical to SEQ ID NO: 160534

SEQ ID NO: 489111 - RNA, 64 nt, hsa; identical to SEQ ID NO: 160535

SEQ ID NO: 489112 - RNA, 64 nt, hsa; identical to SEQ ID NO: 160536

SEQ ID NO: 489113 - RNA, 64 nt, hsa; identical to SEQ ID NO: 160537

SEQ ID NO: 489114 - RNA, 64 nt, hsa; identical to SEQ ID NO: 160538

SEQ ID NO: 489115 - RNA, 64 nt, hsa; identical to SEQ ID NO: 160539

SEQ ID NO: 489116 - RNA, 64 nt, hsa; identical to SEQ ID NO: 160540

SEQ ID NO: 489117 - RNA, 64 nt, hsa; identical to SEQ ID NO: 160541

SEQ ID NO: 489118 - RNA, 64 nt, hsa; identical to SEQ ID NO: 160542

SEQ ID NO: 489119 - RNA, 64 nt, hsa; identical to SEQ ID NO: 160543

SEQ ID NO: 489120 - RNA, 64 nt, hsa; identical to SEQ ID NO: 160544

SEQ ID NO: 489121 - RNA, 64 nt, hsa; identical to SEQ ID NO: 160545

SEQ ID NO: 489122 - RNA, 64 nt, hsa; identical to SEQ ID NO: 160546

SEQ ID NO: 489123 - RNA, 64 nt, hsa; identical to SEQ ID NO: 160547

SEQ ID NO: 489124 - RNA, 64 nt, hsa; identical to SEQ ID NO: 160548

SEQ ID NO: 489125 - RNA, 64 nt, hsa; identical to SEQ ID NO: 160549

SEQ ID NO: 489126 - RNA, 64 nt, hsa; identical to SEQ ID NO: 160550

SEQ ID NO: 489127 - RNA, 64 nt, hsa; identical to SEQ ID NO: 160551

SEQ ID NO: 489128 - RNA, 64 nt, hsa; identical to SEQ ID NO: 160552

SEQ ID NO: 489129 - RNA, 64 nt, hsa; identical to SEQ ID NO: 160553

SEQ ID NO: 489130 - RNA, 64 nt, hsa
auuugaguggaggauuuuuuuucucauuuuucuaguguuaaauuuuaaccagcauuaacauggu

SEQ ID NO: 489131 - RNA, 64 nt, hsa
auccauuacaguuaccuuacauagcacuugauacguguuaaaugaacauaugaauguaauuuau

SEQ ID NO: 489132 - RNA, 64 nt, hsa
uuugaauaaauucaguugcuaaaguagauccaaaguguuaaaaaugcugaagucaugucaagua

SEQ ID NO: 489133 - RNA, 64 nt, hsa
agagauaagggcauuuguuucaaugaaaaaguuaguguuaaaggaagugagucagggagggcgg

SEQ ID NO: 489134 - RNA, 64 nt, hsa
ucauuaaaauaauaguggugaauuauauguuauuguguuaaaaccucacuugccaaauucuggc

SEQ ID NO: 489135 - RNA, 64 nt, hsa
uugucuuccgaguuuuuugguuccuuuuuuaacuguguuaaaguacuugaaauguauugacugc

SEQ ID NO: 489136 - RNA, 64 nt, hsa
uuuuaauguuuuuugccuuuaauaauaggggugaguguuaaaggccagagagccuaacuugaua

SEQ ID NO: 489137 - RNA, 64 nt, hsa
ugugaauucucugguguucauuaaagugugagcuguguuaaaaggcauucuuagauucauuuua

SEQ ID NO: 489138 - RNA, 64 nt, hsa
aguuuguuuuaaagucaucuuuacuuucccaaauguguuaaauuuguaacuccucuuugggguc

SEQ ID NO: 489139 - RNA, 64 nt, hsa
uuuuuaagcuuauuguguuuaagaaaguagcuauguguuaaacagaggugauggcagcccuucc

SEQ ID NO: 489140 - RNA, 64 nt, hsa
uacagauuuuuagcacaaaaauagccauuguaaaguguuaaaauuuacgauaaguauucuauug

SEQ ID NO: 489141 - RNA, 64 nt, hsa
gccucaccaauuugcccgucuuuaauaaaaucuuguguuaaaauuugcaucacgucgccuuccu

SEQ ID NO: 489142 - RNA, 64 nt, hsa
gcagacugaccguacaguaauuuauuugucguuaguguuaaagauuaagcauaguaacugacuc

SEQ ID NO: 489143 - RNA, 64 nt, hsa
guguuaaagauuaagcauaguaacugacucuuaaguguuaaauaauguagaaguaaaaaaauuu

SEQ ID NO: 489144 - RNA, 64 nt, hsa
uaagauaaauacgaagauaaagcuuuauucuuuaguguuaaaauacaguauaucuaauaacuag

SEQ ID NO: 489145 - RNA, 64 nt, hsa
caauaugaucugaaaacccaguggauggcugaagguguuaaaugugcuauaaucauuaagaaua

SEQ ID NO: 489146 - RNA, 64 nt, hsa; identical to SEQ ID NO: 117511

SEQ ID NO: 489147 - RNA, 64 nt, hsa; identical to SEQ ID NO: 117512

SEQ ID NO: 489148 - RNA, 64 nt, hsa; identical to SEQ ID NO: 117513

SEQ ID NO: 489149 - RNA, 64 nt, hsa; identical to SEQ ID NO: 117514

SEQ ID NO: 489150 - RNA, 64 nt, hsa; identical to SEQ ID NO: 256782

SEQ ID NO: 489151 - RNA, 64 nt, hsa; identical to SEQ ID NO: 256783

SEQ ID NO: 489152 - RNA, 53 nt, hsa; identical to SEQ ID NO: 256784

SEQ ID NO: 489153 - RNA, 64 nt, hsa; identical to SEQ ID NO: 256785

SEQ ID NO: 489154 - RNA, 64 nt, hsa; identical to SEQ ID NO: 256786

SEQ ID NO: 489155 - RNA, 64 nt, hsa; identical to SEQ ID NO: 256787

SEQ ID NO: 489156 - RNA, 64 nt, hsa; identical to SEQ ID NO: 256788

SEQ ID NO: 489157 - RNA, 64 nt, hsa; identical to SEQ ID NO: 256789

SEQ ID NO: 489158 - RNA, 64 nt, hsa; identical to SEQ ID NO: 476338

SEQ ID NO: 489159 - RNA, 64 nt, hsa; identical to SEQ ID NO: 476339

SEQ ID NO: 489160 - RNA, 64 nt, hsa; identical to SEQ ID NO: 476340

SEQ ID NO: 489161 - RNA, 64 nt, hsa; identical to SEQ ID NO: 476341

SEQ ID NO: 489162 - RNA, 64 nt, hsa; identical to SEQ ID NO: 476342

SEQ ID NO: 489163 - RNA, 64 nt, hsa; identical to SEQ ID NO: 476343

SEQ ID NO: 489164 - RNA, 64 nt, hsa; identical to SEQ ID NO: 476344

SEQ ID NO: 489165 - RNA, 64 nt, hsa; identical to SEQ ID NO: 476345

SEQ ID NO: 489166 - RNA, 64 nt, hsa; identical to SEQ ID NO: 476346

SEQ ID NO: 489167 - RNA, 64 nt, hsa; identical to SEQ ID NO: 476347

SEQ ID NO: 489168 - RNA, 64 nt, hsa; identical to SEQ ID NO: 476348

SEQ ID NO: 489169 - RNA, 64 nt, hsa; identical to SEQ ID NO: 476349

SEQ ID NO: 489170 - RNA, 64 nt, hsa; identical to SEQ ID NO: 476350

SEQ ID NO: 489171 - RNA, 64 nt, hsa; identical to SEQ ID NO: 476351

SEQ ID NO: 489172 - RNA, 64 nt, hsa; identical to SEQ ID NO: 476352

SEQ ID NO: 489173 - RNA, 64 nt, hsa; identical to SEQ ID NO: 476353

SEQ ID NO: 489174 - RNA, 64 nt, hsa; identical to SEQ ID NO: 476354

SEQ ID NO: 489175 - RNA, 64 nt, hsa; identical to SEQ ID NO: 476355

SEQ ID NO: 489176 - RNA, 64 nt, hsa; identical to SEQ ID NO: 476356

SEQ ID NO: 489177 - RNA, 64 nt, hsa; identical to SEQ ID NO: 476357

SEQ ID NO: 489178 - RNA, 64 nt, hsa; identical to SEQ ID NO: 476358

SEQ ID NO: 489179 - RNA, 64 nt, hsa; identical to SEQ ID NO: 476359

SEQ ID NO: 489180 - RNA, 64 nt, hsa; identical to SEQ ID NO: 476360

SEQ ID NO: 489181 - RNA, 64 nt, hsa; identical to SEQ ID NO: 476361

SEQ ID NO: 489182 - RNA, 64 nt, hsa; identical to SEQ ID NO: 476362

SEQ ID NO: 489183 - RNA, 64 nt, hsa; identical to SEQ ID NO: 476363

SEQ ID NO: 489184 - RNA, 64 nt, hsa
guaggaggagggugcacauaacccuuacccuaccucugccaaaaagugggggcuguacugggga

SEQ ID NO: 489185 - RNA, 64 nt, hsa
gguugugccuuauugucccaucugugggccucauucugccaaagcuggaccaaggcuaaccuuu

SEQ ID NO: 489186 - RNA, 64 nt, hsa
uaguggggucaggaauguaggaacugguauccauucugccaauuccaccacccauucaguuugc

SEQ ID NO: 489187 - RNA, 64 nt, hsa
auuccauuuaaguuuuggggcaucuuuccugcccucugccaaccucccugcuggcccaggugag

SEQ ID NO: 489188 - RNA, 64 nt, hsa
gggauggugggucugggaccccaauucauucuuaucugccaaagaauuaucuagaagcacauca

SEQ ID NO: 489189 - RNA, 64 nt, hsa
agagacucagcuguugucacacccaaagggaugcucugccaaagguuuaaacacccaggagacc

SEQ ID NO: 489190 - RNA, 64 nt, hsa
caugcccuacacacccccacagucuaccccaaagucugccaaaggcagugcaaagaaggaaggc

SEQ ID NO: 489191 - RNA, 64 nt, hsa
agaugaggauguuuuugucugugaaucacgguauucugccaaaaccaaaucuuuuaagaaaauu

SEQ ID NO: 489192 - RNA, 64 nt, hsa
aaaucucuuuaccuccuuggccauuuucauguucucugccaauuacuauaggcagucuucauuu

SEQ ID NO: 489193 - RNA, 64 nt, hsa
ggaaguauaagucauugacaguuuccugaguggcucugccaauccauaccacccuugguacugu

SEQ ID NO: 489194 - RNA, 64 nt, hsa
aaagacaaauuuugcauauucucuauuuuacuuuucugccaaaauaaaccuguucuuccuuuuu

SEQ ID NO: 489195 - RNA, 64 nt, hsa
uugaacaaagacauuuauauggguuuauuuucauucugccaaaguaaaacaauacaucaacaag

SEQ ID NO: 489196 - RNA, 64 nt, hsa
ccuuagagcaucucugccuccaacccagcaguucucugccaaagcuuguggaggagggagagcc

SEQ ID NO: 489197 - RNA, 64 nt, hsa
cuccucuucccagagucacaaguagccucugggaucugccaacacacguccacucccaagccac

SEQ ID NO: 489198 - RNA, 64 nt, hsa
cuucugugggccuugcaccgucuuaguuuacacaucugccaaagggguagaauuacacuucuuu

SEQ ID NO: 489199 - RNA, 64 nt, hsa
agcugguaccugaagccccgcuuagcucugacacucugccaacauccucugauucuaggugugg

SEQ ID NO: 489200 - RNA, 64 nt, hsa
gauuggaauagcaaguuuaaaccuuuguuguccaucugccaaaugaacuagugauugucagacu

SEQ ID NO: 489201 - RNA, 64 nt, hsa
aucuuaauuaucaucugcaaguuucaagaaguauucugccaaaaguauuuacaaguauggacuc

SEQ ID NO: 489202 - RNA, 64 nt, hsa
cuggagcaaugggugugccagcccucagcaugacucugccaagcauccagaccacaaaugcagg

SEQ ID NO: 489203 - RNA, 64 nt, hsa
ggggugcuggacuggacucuuguucacuuuaccuucugccaaaugcagagagggaggccagugu

SEQ ID NO: 489204 - RNA, 64 nt, hsa
uuauaaauguaagauaugugggaggggcuuuuauucugccaagucauuucaaauacaugaaaaa

SEQ ID NO: 489205 - RNA, 64 nt, hsa
cugugaauguaagcauugugggaaagcauucauaucugccaagauccuuugaauacaugcaaga

SEQ ID NO: 489206 - RNA, 64 nt, hsa
uuauaaauauaagauauaugggaaacacuuuuauucugccaaguuauuucaaacacaugaaaaa

SEQ ID NO: 489207 - RNA, 64 nt, hsa
cuaagaauguaagcauugugggaaagcauucauaucugccaagaucguuugaauacaugcaaaa

SEQ ID NO: 489208 - RNA, 64 nt, hsa
uuauaaauguuagauaugugggaaaggccuuuauucugccaagucauuucgaagacaugaaaaa

SEQ ID NO: 489209 - RNA, 64 nt, hsa
cuaugaguguaaggaaugugggaaagccuucagaucugccaagaaccuucgaauucaugaaagg

SEQ ID NO: 489210 - RNA, 64 nt, hsa
uuauaaauguaagauaugugggaaaggcuuuuauucugccaagucauuucaaauaccugaaaaa

SEQ ID NO: 489211 - RNA, 64 nt, hsa
cucccuggcaaggcucuuccuuuucagggauaucucugccaaccccuccccuguccucggguug

SEQ ID NO: 489212 - RNA, 64 nt, hsa
agucccagcucugccucugacucgcugugugcccucugccaagucaugcccauucucuaguucu

SEQ ID NO: 489213 - RNA, 64 nt, hsa
uguuggccaaaauccuuuaaagacauacgaaacaucugccaacuuuuuagcgaacuuaacaggu

SEQ ID NO: 489214 - RNA, 64 nt, hsa
ucgggaggccucgguagccaggcagaacaggauaucugccaaagggugucugaugugggguggg

SEQ ID NO: 489215 - RNA, 64 nt, hsa
aucccacccucgaggcagggaaaagccaucuauucuucugcagccucaggagcgagacuucaag

SEQ ID NO: 489216 - RNA, 64 nt, hsa
aagcaaccuggugcuucggccuggauaagagccccuucugcaucuuauucacagcuugcagccu

SEQ ID NO: 489217 - RNA, 64 nt, hsa
ggauacacuugcucucuggaaguguguccuuacccuucugcagagugaggagcaagcuguuaga

SEQ ID NO: 489218 - RNA, 64 nt, hsa
uauuguuggccaugaaggaaaaucacccagaaugcuucugcaagguaaagucuccaacguacug

SEQ ID NO: 489219 - RNA, 64 nt, hsa
auuuaaggcuucuuuucaccugagagcuucaguucuucugcagaauggcugcaaauuuaauugc

SEQ ID NO: 489220 - RNA, 64 nt, hsa
uggaguucucaagaguuggugacuuggaaggccgcuucugcaaggcaagucucaggaacccaug

SEQ ID NO: 489221 - RNA, 64 nt, hsa
acauuuuugcacagauuaugcuccaucccauucacuucugcauuccuguaacuuuuaaucccua

SEQ ID NO: 489222 - RNA, 64 nt, hsa
auucugaaaccacaguuucauuauucucauaauccuucugcaacugaaauuacauauugcagga

SEQ ID NO: 489223 - RNA, 64 nt, hsa
gcacucaccuccgccuuggggaaugaaagggucacuucugcaucaucacuagcuaguuuucuag

SEQ ID NO: 489224 - RNA, 64 nt, hsa
ccuuucuccuuucagcuaaauuucaacagugccacuucugcauucucuguucucaaggcaccug

SEQ ID NO: 489225 - RNA, 64 nt, hsa
aaaauaagcuugcaaaugacagcagagacauuuacuucugcaguuaguuaacuuuauaggaguu

SEQ ID NO: 489226 - RNA, 64 nt, hsa
accuaaaaauguacaaauuagugaaaugguuaaacuucugcacuuucuuaguuaccacagucuu

SEQ ID NO: 489227 - RNA, 64 nt, hsa
cccucccuaccucauccaucccacacaccuuggccuucugcaagccaagugguucugcaagguc

SEQ ID NO: 489228 - RNA, 64 nt, hsa
guuagcacagauugagaaccucggggacuugagccuucugcaggggauguccacagagagggaa

SEQ ID NO: 489229 - RNA, 64 nt, hsa
cuacugccuggcuuucuuggcccucauuucucagcuucugcauuuccuucccugcuccuaacaa

SEQ ID NO: 489230 - RNA, 64 nt, hsa
guuccagucuggcuaaucucuguccugugagaagcuucugcacaaguuuccuuaccaccuccuc

SEQ ID NO: 489231 - RNA, 64 nt, hsa
uaaaucauauuuuuuauuacaacacuaaguucugcuucugcauuccuagguuucaucauuuuug

SEQ ID NO: 489232 - RNA, 64 nt, hsa
cgguccuugcccauuugggaaacugagcuucuuucuucugcacugggggacuggaugcuagcca

SEQ ID NO: 489233 - RNA, 64 nt, hsa
gcuguuacauaacuccucccugcagaagaggggacuucugcaacagauucuguuucuuuuuccc

SEQ ID NO: 489234 - RNA, 64 nt, hsa
agggaaaugaccucaacagugacagacaacaggccuucugcagccaggugugguaggaguccag

SEQ ID NO: 489235 - RNA, 64 nt, hsa
uuuugcucgucuucauggacgagugaacgccucgcuucugcagguugaguccagaugcuucuca

SEQ ID NO: 489236 - RNA, 64 nt, hsa
ucuaugggaaucuggcuuuuagcgaauguggcgucuucugcaaacaauagcaauugggcuggcu

SEQ ID NO: 489237 - RNA, 64 nt, hsa
ggcagggaccaucaagaaccuacagacuccaucucuucugcaagccucaugccaacccugggcu

SEQ ID NO: 489238 - RNA, 64 nt, hsa
aaagaauuaaugacuuacuuuaauuacuggaauucuucugcaacauuugacaaaacuaaccuug

SEQ ID NO: 489239 - RNA, 64 nt, hsa
gcauagcaccuuuuguauaaacaaugugauauugcuucugcacauccaaaaauucugggucuuu

SEQ ID NO: 489240 - RNA, 64 nt, hsa
aaaagggccuacuacauuggcgcuauucuuaggacuucugcaacuuuuaaagucuuacuugucu

SEQ ID NO: 489241 - RNA, 64 nt, hsa
ugcuuuuucucggcacgugguaucuccaccauuucuucugcacaaagaugucuucuguucaucc

SEQ ID NO: 489242 - RNA, 64 nt, hsa
gauauuuacguaaagaaaaucauaaaauccaaugcuucugcauacuguguuauguuacagucca

SEQ ID NO: 489243 - RNA, 64 nt, hsa
ucggcugccaccuccaccggacaccucagacacgcuucugcagcugugccucggcucacaacac

SEQ ID NO: 489244 - RNA, 53 nt, hsa
uagaggagugugaauuuuagacacuucugcagggaucugccugcauccugacg

SEQ ID NO: 489245 - RNA, 64 nt, hsa
gcucauuuuuuaccauguuuuccagucuguuuaacuucugcagugccuucacuacacugccuua

SEQ ID NO: 489246 - RNA, 64 nt, hsa
accccaaacccccaccuucaacaauauuucaacgcuucugcaaugaugaaaaagaaacauaguu

SEQ ID NO: 489247 - RNA, 64 nt, hsa
cuucuuuuucucaugcccugccuucaucugucuccuucugcacccagaguagggguggaguaua

SEQ ID NO: 489248 - RNA, 64 nt, hsa
gaagagauuucucccucuagcacuugcuaccucucuucugcacacauaucacacaucaguacug

SEQ ID NO: 489249 - RNA, 64 nt, hsa; identical to SEQ ID NO: 87818

SEQ ID NO: 489250 - RNA, 64 nt, hsa; identical to SEQ ID NO: 87819

SEQ ID NO: 489251 - RNA, 64 nt, hsa; identical to SEQ ID NO: 87820

SEQ ID NO: 489252 - RNA, 64 nt, hsa; identical to SEQ ID NO: 87821

SEQ ID NO: 489253 - RNA, 64 nt, hsa; identical to SEQ ID NO: 87822

SEQ ID NO: 489254 - RNA, 64 nt, hsa; identical to SEQ ID NO: 87823

SEQ ID NO: 489255 - RNA, 64 nt, hsa; identical to SEQ ID NO: 87824

SEQ ID NO: 489256 - RNA, 64 nt, hsa; identical to SEQ ID NO: 87825

SEQ ID NO: 489257 - RNA, 64 nt, hsa; identical to SEQ ID NO: 87826

SEQ ID NO: 489258 - RNA, 64 nt, hsa; identical to SEQ ID NO: 87827

SEQ ID NO: 489259 - RNA, 64 nt, hsa; identical to SEQ ID NO: 87828

SEQ ID NO: 489260 - RNA, 64 nt, hsa; identical to SEQ ID NO: 87829

SEQ ID NO: 489261 - RNA, 64 nt, hsa; identical to SEQ ID NO: 87830

SEQ ID NO: 489262 - RNA, 64 nt, hsa; identical to SEQ ID NO: 87831

SEQ ID NO: 489263 - RNA, 64 nt, hsa; identical to SEQ ID NO: 87832

SEQ ID NO: 489264 - RNA, 64 nt, hsa; identical to SEQ ID NO: 87833

SEQ ID NO: 489265 - RNA, 64 nt, hsa; identical to SEQ ID NO: 87834

SEQ ID NO: 489266 - RNA, 64 nt, hsa; identical to SEQ ID NO: 87835

SEQ ID NO: 489267 - RNA, 64 nt, hsa; identical to SEQ ID NO: 87836

SEQ ID NO: 489268 - RNA, 64 nt, hsa; identical to SEQ ID NO: 87837

SEQ ID NO: 489269 - RNA, 64 nt, hsa; identical to SEQ ID NO: 87838

SEQ ID NO: 489270 - RNA, 64 nt, hsa; identical to SEQ ID NO: 87839

SEQ ID NO: 489271 - RNA, 64 nt, hsa; identical to SEQ ID NO: 87840

SEQ ID NO: 489272 - RNA, 64 nt, hsa; identical to SEQ ID NO: 87841

SEQ ID NO: 489273 - RNA, 64 nt, hsa; identical to SEQ ID NO: 87842

SEQ ID NO: 489274 - RNA, 64 nt, hsa; identical to SEQ ID NO: 87843

SEQ ID NO: 489275 - RNA, 64 nt, hsa; identical to SEQ ID NO: 87844

SEQ ID NO: 489276 - RNA, 64 nt, hsa; identical to SEQ ID NO: 87845

SEQ ID NO: 489277 - RNA, 64 nt, hsa; identical to SEQ ID NO: 87846

SEQ ID NO: 489278 - RNA, 64 nt, hsa; identical to SEQ ID NO: 87847

SEQ ID NO: 489279 - RNA, 64 nt, hsa; identical to SEQ ID NO: 87848

SEQ ID NO: 489280 - RNA, 64 nt, hsa; identical to SEQ ID NO: 87849

SEQ ID NO: 489281 - RNA, 64 nt, hsa; identical to SEQ ID NO: 87850

SEQ ID NO: 489282 - RNA, 64 nt, hsa; identical to SEQ ID NO: 87851

SEQ ID NO: 489283 - RNA, 64 nt, hsa; identical to SEQ ID NO: 114926

SEQ ID NO: 489284 - RNA, 64 nt, hsa; identical to SEQ ID NO: 114927

SEQ ID NO: 489285 - RNA, 64 nt, hsa; identical to SEQ ID NO: 357146

SEQ ID NO: 489286 - RNA, 64 nt, hsa; identical to SEQ ID NO: 357147

SEQ ID NO: 489287 - RNA, 64 nt, hsa; identical to SEQ ID NO: 357148

SEQ ID NO: 489288 - RNA, 64 nt, hsa; identical to SEQ ID NO: 357149

SEQ ID NO: 489289 - RNA, 64 nt, hsa; identical to SEQ ID NO: 357150

SEQ ID NO: 489290 - RNA, 64 nt, hsa; identical to SEQ ID NO: 357151

SEQ ID NO: 489291 - RNA, 64 nt, hsa; identical to SEQ ID NO: 357152

SEQ ID NO: 489292 - RNA, 64 nt, hsa; identical to SEQ ID NO: 357153

SEQ ID NO: 489293 - RNA, 64 nt, hsa; identical to SEQ ID NO: 357154

SEQ ID NO: 489294 - RNA, 64 nt, hsa; identical to SEQ ID NO: 357155

SEQ ID NO: 489295 - RNA, 64 nt, hsa; identical to SEQ ID NO: 357156

SEQ ID NO: 489296 - RNA, 64 nt, hsa; identical to SEQ ID NO: 357157

SEQ ID NO: 489297 - RNA, 64 nt, hsa; identical to SEQ ID NO: 288888

SEQ ID NO: 489298 - RNA, 64 nt, hsa; identical to SEQ ID NO: 288889

SEQ ID NO: 489299 - RNA, 64 nt, hsa; identical to SEQ ID NO: 288890

SEQ ID NO: 489300 - RNA, 64 nt, hsa; identical to SEQ ID NO: 288891

SEQ ID NO: 489301 - RNA, 64 nt, hsa; identical to SEQ ID NO: 453097

SEQ ID NO: 489302 - RNA, 64 nt, hsa; identical to SEQ ID NO: 453098

SEQ ID NO: 489303 - RNA, 64 nt, hsa; identical to SEQ ID NO: 453099

SEQ ID NO: 489304 - RNA, 64 nt, hsa; identical to SEQ ID NO: 453100

SEQ ID NO: 489305 - RNA, 64 nt, hsa; identical to SEQ ID NO: 453101

SEQ ID NO: 489306 - RNA, 64 nt, hsa; identical to SEQ ID NO: 453102

SEQ ID NO: 489307 - RNA, 64 nt, hsa; identical to SEQ ID NO: 453103

SEQ ID NO: 489308 - RNA, 64 nt, hsa; identical to SEQ ID NO: 453104

SEQ ID NO: 489309 - RNA, 64 nt, hsa; identical to SEQ ID NO: 453105

SEQ ID NO: 489310 - RNA, 64 nt, hsa; identical to SEQ ID NO: 453106

SEQ ID NO: 489311 - RNA, 64 nt, hsa; identical to SEQ ID NO: 159322

SEQ ID NO: 489312 - RNA, 64 nt, hsa; identical to SEQ ID NO: 159323

SEQ ID NO: 489313 - RNA, 64 nt, hsa; identical to SEQ ID NO: 159324

SEQ ID NO: 489314 - RNA, 64 nt, hsa; identical to SEQ ID NO: 159325

SEQ ID NO: 489315 - RNA, 64 nt, hsa; identical to SEQ ID NO: 159326

SEQ ID NO: 489316 - RNA, 64 nt, hsa; identical to SEQ ID NO: 159327

SEQ ID NO: 489317 - RNA, 64 nt, hsa; identical to SEQ ID NO: 159328

SEQ ID NO: 489318 - RNA, 64 nt, hsa; identical to SEQ ID NO: 159329

SEQ ID NO: 489319 - RNA, 64 nt, hsa; identical to SEQ ID NO: 159330

SEQ ID NO: 489320 - RNA, 64 nt, hsa; identical to SEQ ID NO: 159331

SEQ ID NO: 489321 - RNA, 64 nt, hsa; identical to SEQ ID NO: 159332

SEQ ID NO: 489322 - RNA, 64 nt, hsa; identical to SEQ ID NO: 159333

SEQ ID NO: 489323 - RNA, 64 nt, hsa; identical to SEQ ID NO: 159334

SEQ ID NO: 489324 - RNA, 64 nt, hsa; identical to SEQ ID NO: 159335

SEQ ID NO: 489325 - RNA, 64 nt, hsa; identical to SEQ ID NO: 159336

SEQ ID NO: 489326 - RNA, 64 nt, hsa; identical to SEQ ID NO: 159337

SEQ ID NO: 489327 - RNA, 64 nt, hsa; identical to SEQ ID NO: 159338

SEQ ID NO: 489328 - RNA, 64 nt, hsa; identical to SEQ ID NO: 159339

SEQ ID NO: 489329 - RNA, 64 nt, hsa; identical to SEQ ID NO: 159340

SEQ ID NO: 489330 - RNA, 64 nt, hsa; identical to SEQ ID NO: 159341

SEQ ID NO: 489331 - RNA, 64 nt, hsa; identical to SEQ ID NO: 159342

SEQ ID NO: 489332 - RNA, 64 nt, hsa; identical to SEQ ID NO: 159343

SEQ ID NO: 489333 - RNA, 64 nt, hsa; identical to SEQ ID NO: 159344

SEQ ID NO: 489334 - RNA, 64 nt, hsa; identical to SEQ ID NO: 159345

SEQ ID NO: 489335 - RNA, 64 nt, hsa; identical to SEQ ID NO: 159346

SEQ ID NO: 489336 - RNA, 64 nt, hsa; identical to SEQ ID NO: 159347

SEQ ID NO: 489337 - RNA, 64 nt, hsa; identical to SEQ ID NO: 159348

SEQ ID NO: 489338 - RNA, 64 nt, hsa; identical to SEQ ID NO: 159349

SEQ ID NO: 489339 - RNA, 64 nt, hsa; identical to SEQ ID NO: 159350

SEQ ID NO: 489340 - RNA, 64 nt, hsa; identical to SEQ ID NO: 159351

SEQ ID NO: 489341 - RNA, 64 nt, hsa; identical to SEQ ID NO: 159352

SEQ ID NO: 489342 - RNA, 64 nt, hsa; identical to SEQ ID NO: 159353

SEQ ID NO: 489343 - RNA, 64 nt, hsa; identical to SEQ ID NO: 159354

SEQ ID NO: 489344 - RNA, 64 nt, hsa; identical to SEQ ID NO: 159355

SEQ ID NO: 489345 - RNA, 64 nt, hsa; identical to SEQ ID NO: 159356

SEQ ID NO: 489346 - RNA, 64 nt, hsa; identical to SEQ ID NO: 159357

SEQ ID NO: 489347 - RNA, 64 nt, hsa; identical to SEQ ID NO: 159358

SEQ ID NO: 489348 - RNA, 64 nt, hsa; identical to SEQ ID NO: 159359

SEQ ID NO: 489349 - RNA, 64 nt, hsa; identical to SEQ ID NO: 159360

SEQ ID NO: 489350 - RNA, 64 nt, hsa; identical to SEQ ID NO: 159361

SEQ ID NO: 489351 - RNA, 64 nt, hsa; identical to SEQ ID NO: 159362

SEQ ID NO: 489352 - RNA, 64 nt, hsa; identical to SEQ ID NO: 159363

SEQ ID NO: 489353 - RNA, 64 nt, hsa; identical to SEQ ID NO: 159364

SEQ ID NO: 489354 - RNA, 64 nt, hsa; identical to SEQ ID NO: 159365

SEQ ID NO: 489355 - RNA, 64 nt, hsa; identical to SEQ ID NO: 159366

SEQ ID NO: 489356 - RNA, 64 nt, hsa; identical to SEQ ID NO: 159365

SEQ ID NO: 489357 - RNA, 64 nt, hsa; identical to SEQ ID NO: 159368

SEQ ID NO: 489358 - RNA, 64 nt, hsa; identical to SEQ ID NO: 159369

SEQ ID NO: 489359 - RNA, 64 nt, hsa; identical to SEQ ID NO: 159370

SEQ ID NO: 489360 - RNA, 64 nt, hsa; identical to SEQ ID NO: 159371

SEQ ID NO: 489361 - RNA, 64 nt, hsa; identical to SEQ ID NO: 159372

SEQ ID NO: 489362 - RNA, 64 nt, hsa; identical to SEQ ID NO: 159373

SEQ ID NO: 489363 - RNA, 64 nt, hsa; identical to SEQ ID NO: 159374

SEQ ID NO: 489364 - RNA, 64 nt, hsa; identical to SEQ ID NO: 159375

SEQ ID NO: 489365 - RNA, 64 nt, hsa; identical to SEQ ID NO: 159376

SEQ ID NO: 489366 - RNA, 64 nt, hsa; identical to SEQ ID NO: 159377

SEQ ID NO: 489367 - RNA, 64 nt, hsa; identical to SEQ ID NO: 210821

SEQ ID NO: 489368 - RNA, 64 nt, hsa; identical to SEQ ID NO: 210822

SEQ ID NO: 489369 - RNA, 64 nt, hsa; identical to SEQ ID NO: 210823

SEQ ID NO: 489370 - RNA, 64 nt, hsa; identical to SEQ ID NO: 210824

SEQ ID NO: 489371 - RNA, 64 nt, hsa; identical to SEQ ID NO: 210825

SEQ ID NO: 489372 - RNA, 64 nt, hsa; identical to SEQ ID NO: 210826

SEQ ID NO: 489373 - RNA, 64 nt, hsa; identical to SEQ ID NO: 210827

SEQ ID NO: 489374 - RNA, 64 nt, hsa; identical to SEQ ID NO: 210828

SEQ ID NO: 489375 - RNA, 64 nt, hsa; identical to SEQ ID NO: 210829

SEQ ID NO: 489376 - RNA, 64 nt, hsa; identical to SEQ ID NO: 210830

SEQ ID NO: 489377 - RNA, 64 nt, hsa; identical to SEQ ID NO: 210831

SEQ ID NO: 489378 - RNA, 64 nt, hsa; identical to SEQ ID NO: 210832

SEQ ID NO: 489379 - RNA, 64 nt, hsa; identical to SEQ ID NO: 210833

SEQ ID NO: 489380 - RNA, 64 nt, hsa; identical to SEQ ID NO: 210834

SEQ ID NO: 489381 - RNA, 64 nt, hsa; identical to SEQ ID NO: 210835

SEQ ID NO: 489382 - RNA, 64 nt, hsa; identical to SEQ ID NO: 210836

SEQ ID NO: 489383 - RNA, 64 nt, hsa; identical to SEQ ID NO: 210837

SEQ ID NO: 489384 - RNA, 64 nt, hsa; identical to SEQ ID NO: 210838

SEQ ID NO: 489385 - RNA, 64 nt, hsa; identical to SEQ ID NO: 210839

SEQ ID NO: 489386 - RNA, 64 nt, hsa; identical to SEQ ID NO: 210840

SEQ ID NO: 489387 - RNA, 64 nt, hsa; identical to SEQ ID NO: 210841

SEQ ID NO: 489388 - RNA, 64 nt, hsa
uauaggaacaagacucccaaauccaugaaaacgcuuagugaauauauucuuaaucauuaauaaa

SEQ ID NO: 489389 - RNA, 64 nt, hsa
uuagaauuuguuuaacugguacuuuuauuauuuuuuagugaaagacuuuugaaaagugcccuuu

SEQ ID NO: 489390 - RNA, 64 nt, hsa
cagaguauaagaaugcuuugaacaauuuguagacuuagugaaauaaaauaagaggaaagccaaa

SEQ ID NO: 489391 - RNA, 64 nt, hsa
ugaauacauaauuucucauguauucguguauccauuagugaauaguucaagucuguuuaagagu

SEQ ID NO: 489392 - RNA, 64 nt, hsa
gguaggacucuagacaaaaccuucuauuuuagcuuuagugaauuucaaaaguaaugggucuugg

SEQ ID NO: 489393 - RNA, 64 nt, hsa
uucuaaaauuuguaauuugcuaacuugauuugaguuagugaaaacugguacaguguucugcuug

SEQ ID NO: 489394 - RNA, 64 nt, hsa
aacugggguuuuguaaccucugaaugauauggacuuagugaauucuaaggaacucagggggcac

SEQ ID NO: 489395 - RNA, 64 nt, hsa
ugcaaagaaaaaucuugaacauuuaugaugucaauuagugaaaguauugaaaauacuaaauuau

SEQ ID NO: 489396 - RNA, 64 nt, hsa
uugcuuugcuuuaucaguucauuccagcucccuguuagugaaggacacugcuguuagugaagga

SEQ ID NO: 489397 - RNA, 64 nt, hsa
cauuccagcucccuguuagugaaggacacugcuguuagugaaggaacaaagucuaugaguccua

SEQ ID NO: 489398 - RNA, 64 nt, hsa
auauacucacuuuauauguauguuucuaaaagcuuuagugaaggcugaauccaaguuucaugua

SEQ ID NO: 489399 - RNA, 64 nt, hsa
ucuaguguuaaguguauuuuuuucaacuaauuuuuuagugaauuuuuuuuaaacuuacagcaug

SEQ ID NO: 489400 - RNA, 64 nt, hsa
acaugugagagacaucucaucugcuguauuuuacuuagugaauauuguucacucuuccgugucu

SEQ ID NO: 489401 - RNA, 64 nt, hsa
ggguuuuaauuacaguuccauuagugccuguagauuagugaacagaaaauugcuuuggaagaga

SEQ ID NO: 489402 - RNA, 64 nt, hsa
aguuagguucugugaauuuucugugcacacugaauuagugaaugcugaaugauuguugcuaggg

SEQ ID NO: 489403 - RNA, 64 nt, hsa
gauacaggaaggccuauuacaaguguguuugucuuuagugaacucauaguggugacauaccuuu

SEQ ID NO: 489404 - RNA, 64 nt, hsa
aaauaauccucaguuuuugugaaaagcuccauuuuuagugaaauauuauuuuauagcuacuaau

SEQ ID NO: 489405 - RNA, 64 nt, hsa
gauuguguauggguguuggugaacuugguuuuaauuagugaacugcugagagacagagcuauuc

SEQ ID NO: 489406 - RNA, 65 nt, hsa
uuguauuguacuaaccccucaugcugggaugagcgacugccuagcaagcaacccacugccuacua

SEQ ID NO: 489407 - RNA, 65 nt, hsa
caugcugggaugagcgacugccuagcaagcaacccacugccuacuaacaucaagaggggcuaaau

SEQ ID NO: 489408 - RNA, 63 nt, hsa
aggccuuuucagccaggaguaagaaaagaugguuagugauauuuggaaauaccuggauauuug

SEQ ID NO: 489409 - RNA, 50 nt, hsa
ugguaggauuuucugucuaauagugauauaauuugcaauuugguuaaaug

SEQ ID NO: 489410 - RNA, 63 nt, hsa
auguuuaaguuauaacuuauugagcacuuuuaguagugauaacuguuuuuaaacuugccuaau

SEQ ID NO: 489411 - RNA, 63 nt, hsa
gaaauuuauugauugagacacagaaauccugauuagugauaggccugucuucugggcaauauu

SEQ ID NO: 489412 - RNA, 63 nt, hsa
ugauugggcauuugccuacuuuucuuucauaauuagugauauaugcgauguaaaaccacuagu

SEQ ID NO: 489413 - RNA, 63 nt, hsa
auaaucaauuagccaaccaugagucauuuagaauagugauaaauagaauacacagaauaguga

SEQ ID NO: 489414 - RNA, 63 nt, hsa
caaaaaagaaauaaaaagaaaguaaaaguccccuagugauagccacuauucacagcuucucau

SEQ ID NO: 489415 - RNA, 63 nt, hsa
guuuuuuacugcuuucaaagcuguauccuaguuuagugauacaaaugauugcaauuuuucuaa

SEQ ID NO: 489416 - RNA, 63 nt, hsa
aaauaagaguuaauagcuauccuaaauuugaaauagugauaagcauaaugaaaauagaugcaa

SEQ ID NO: 489417 - RNA, 63 nt, hsa
agauauaaaaagaauggaagaaggaaugccuuauagugauauugugacauuauaucuauauau

SEQ ID NO: 489418 - RNA, 63 nt, hsa
auaauccagaauuucaaugcuuuugaauguucuuagugauacugaccugugauaauauaauuc

SEQ ID NO: 489419 - RNA, 63 nt, hsa
auguaugcuuuaaccuuaaacugcauacacauguagugauaccuaggcugcauuuagaucacc

SEQ ID NO: 489420 - RNA, 63 nt, hsa
acaugauccuaagaggaaaguucuguucuauuuuagugauaaucuggaagauugugucaauau

SEQ ID NO: 489421 - RNA, 63 nt, hsa
uagcucaaugaugcguuuguaagaaauaagcucuagugauaucugugggggcaaaauuuaauu

SEQ ID NO: 489422 - RNA, 63 nt, hsa
augaaauagaaacuuucuggaaaaauauuuuaauagugauaauaacaucagauuuuaauauaa

SEQ ID NO: 489423 - RNA, 63 nt, hsa
aaaaaaucugccccaugauucuaacacucgcaguagugauaguguaucuaguuguucugcugg

SEQ ID NO: 489424 - RNA, 63 nt, hsa
cuuaacuaucuuauguuucuagucuuucaagcuuagugauaagguggaagcacaagaaaaauu

SEQ ID NO: 489425 - RNA, 63 nt, hsa
uuaggauguugaaaaaguucugcagauaaacaguagugauaguuguaccgcaaugugacuuaa

SEQ ID NO: 489426 - RNA, 63 nt, hsa
auguaaaguuauuagaaugguaucuguucauuuuagugauaugaagaucacaacuaacaacug

SEQ ID NO: 489427 - RNA, 63 nt, hsa
uuaaguagaaaugaguuguauggugaaucuguguagugauaauuauauaauuuauuuauuuug

SEQ ID NO: 489428 - RNA, 63 nt, hsa
uuuauugauacuucccuuuuauguaaaauguaguagugauaccuauauuuccacauugugcau

SEQ ID NO: 489429 - RNA, 63 nt, hsa
auaagugaaaauaucuuccuuuaauguucuaaguagugauaauauuacuagaaugaaagaaua

SEQ ID NO: 489430 - RNA, 63 nt, hsa
cucccccucucaccuggcagccccuucagcugcuagugauaucacuuguuggacauuuuucca

SEQ ID NO: 489431 - RNA, 63 nt, hsa
auccauaaugaaauaggaguuauaaaaaauuuauagugauauuaaucuuuccauauuucccau

SEQ ID NO: 489432 - RNA, 63 nt, hsa
gcuagaacuaucucauugcuaucuguuauagacuagugauacaaacuuuaagaaaacaggaua

SEQ ID NO: 489433 - RNA, 63 nt, hsa
ugcugguaaaauaaugucccaagccuuuccuuuuagugauaaacaguagcagccugcguuaau

SEQ ID NO: 489434 - RNA, 63 nt, hsa
ucagaggggcaaagucaccugcaugguagcacauagugauaggguagcgauauaaauuuauca

SEQ ID NO: 489435 - RNA, 63 nt, hsa
aggagaagaaaaugauguauaauuuguaguuuuuagugauaguauuuaaaauauauccucauu

SEQ ID NO: 489436 - RNA, 63 nt, hsa
ccuguuuugggcugaaagaaugauuuagaaaacuagugauaccaaauaaguauauucaguuca

SEQ ID NO: 489437 - RNA, 63 nt, hsa
ugaaaaagaacuguauuuagugauuauuuuagauagugauauuauaguauucaucugugugua

SEQ ID NO: 489438 - RNA, 63 nt, hsa
gcaggugcuuuuauuuucacagcccauaauucauagugauagagugcagugauguuugccauu

SEQ ID NO: 489439 - RNA, 63 nt, hsa
ucuccuaaaguguaaaaaaaaucuguuacuauauagugauaaaccaucugcucaucguaagug

SEQ ID NO: 489440 - RNA, 63 nt, hsa
guguagaugucugugccacaucugacacuggaguagugauaacaaauagcccaucucuagacu

SEQ ID NO: 489441 - RNA, 63 nt, hsa
uuucucguuaguggcaguagugccuccgucuccuagugauaaugcuccaagucuaugaacugu

SEQ ID NO: 489442 - RNA, 63 nt, hsa
auacauaggaauaaauauauacaagguaucauguagugauaauugcuguggagaaaaauaaag

SEQ ID NO: 489443 - RNA, 63 nt, hsa
aaaguacuuagauuuauaaggcagcuuccccuguagugauaaauuacaagcagacaaucuuau

SEQ ID NO: 489444 - RNA, 63 nt, hsa
cauagagccaaauucugaaaauaauuguaguaguagugauauagucaauggacacagugaaau

SEQ ID NO: 489445 - RNA, 63 nt, hsa
cacuuauaaacuguuauuucaaagcaaacauacuagugauauauauaugauuuauggauguug

SEQ ID NO: 489446 - RNA, 63 nt, hsa
aaauuuuugucaccagcaaaacuuuucacuaauuagugauaugaaaugugauuuuuguguugu

SEQ ID NO: 489447 - RNA, 63 nt, hsa
gaaggacaucacuguauuuggaauucugccugcuagugauagcucacacaucacaucccagaa

SEQ ID NO: 489448 - RNA, 63 nt, hsa
cauuucuaggcaaguaucagccaauaaguauguuagugauaucacagauuguaccaacuauua

SEQ ID NO: 489449 - RNA, 63 nt, hsa
auuguguuuagaaauacuguaauaaauaugcaguagugauauaaagaauuauauccaagguaa

SEQ ID NO: 489450 - RNA, 63 nt, hsa
uccuauauucuuuucuggauuuuuuuuaauaauuagugauauaagcauuguuuuuauugcagc

SEQ ID NO: 489451 - RNA, 63 nt, hsa
uucucuugguacugaacacuauuagaauaucauuagugauauuuuuucucuuuagagcauuuu

SEQ ID NO: 489452 - RNA, 63 nt, hsa
gcuguguugcuaaugguuaaagaagucuguaucuagugauaaauauaccaguuuuuuuaaaaa

SEQ ID NO: 489453 - RNA, 63 nt, hsa
ugcccacugugacagaacaagacacucacagauuagugauacguuuuauuuuuaacaaaauga

SEQ ID NO: 489454 - RNA, 63 nt, hsa
cagccugaagccaugguuuuucauuucugucucuagugauaagcaggaaagagggaugaagaa

SEQ ID NO: 489455 - RNA, 63 nt, hsa
ugaguugugccucauuuauuuauuggcaauaccuagugauacggauuuagcuaacaaaagaua

SEQ ID NO: 489456 - RNA, 63 nt, hsa
gugcaucaugaauuacauguacaugagaggagauagugauaucagcauaaugauuuugagguc

SEQ ID NO: 489457 - RNA, 63 nt, hsa
aagggguuggguggggcaauacccaugaguugauagugauaagcuccuaaggauuuuuaacuu

SEQ ID NO: 489458 - RNA, 63 nt, hsa
caauuaaucuagauuuuaacauuuucagaaacuuagugauaacauuaugaacaauucuaaaag

SEQ ID NO: 489459 - RNA, 63 nt, hsa
agaggccccuauagaauguauuguuugaaaguguagugauauauuuguguuuuuauuucaagu

SEQ ID NO: 489460 - RNA, 63 nt, hsa
cagccuucuuccauuucagaaauugucaauagcuagugauacuuggacuuaagaaaaugaacu

SEQ ID NO: 489461 - RNA, 63 nt, hsa
aggcuauguauaaaauacauagugaaaauuguuuagugauauuacauuuauuuauccagaaaa

SEQ ID NO: 489462 - RNA, 63 nt, hsa
aauguaccuagcaagcugguucuugcuuauauauagugauaaacuuuguagcugccucuuuaa

SEQ ID NO: 489463 - RNA, 63 nt, hsa
cagcuguuuucccuuaaagauguccuguugcuuuagugauauuuagaccccucucaguuaaga

SEQ ID NO: 489464 - RNA, 63 nt, hsa
uacauauuuguugaauaaaugaaaauuuauuuuuagugauaagauucauacacucuguauuug

SEQ ID NO: 489465 - RNA, 63 nt, hsa
agaaguagcaaaugaaugguuuaggauuucaaauagugauacccuccugagacaugagcauuu

SEQ ID NO: 489466 - RNA, 63 nt, hsa
augguccacugguuucaggccaaaucuagaauuuagugauacuggcucagaagaauuuaaguu

SEQ ID NO: 489467 - RNA, 63 nt, hsa
uauaaauugguuaaaauuuaugagucaaauauauagugauaauguuaacauguuuguaauugc

SEQ ID NO: 489468 - RNA, 63 nt, hsa
uuauaaagcaguuaguuaguuaguuacucacucuagugauaaaucgggaaauuuacacacaca

SEQ ID NO: 489469 - RNA, 63 nt, hsa
uaaauguuacagacuuaaagucacaauaaaaauuagugauauucucaugccuggacaaaaucu

SEQ ID NO: 489470 - RNA, 63 nt, hsa
aauuacaguuaucaaaguauuuuuaaaacuucauagugauaaaugagacuauauaguuauauu

SEQ ID NO: 489471 - RNA, 63 nt, hsa
auaugggagaucaguagguuauacuuauauagauagugauauauuucauuuuuaauuugucau

SEQ ID NO: 489472 - RNA, 63 nt, hsa
ucagauucccacaaccacuccugauucuaaauuuagugauaugguaaugaaauugguauuuau

SEQ ID NO: 489473 - RNA, 63 nt, hsa
gugcuuaaaugaguacuauauugcaauaaaauguagugauauaauuaaccagccauuaaaaau

SEQ ID NO: 489474 - RNA, 63 nt, hsa
ucaaaccuuuuaaaucugaaugcgaucacacuguagugauauaguagaagcagugaugauauu

SEQ ID NO: 489475 - RNA, 63 nt, hsa
auuuaaauauuuuaagaaaaaaggaaaaguagauagugauacugaggguaaaaaaaaauugau

SEQ ID NO: 489476 - RNA, 63 nt, hsa
cagcaaguauuuauuguugacauuauucagaauuagugauaauaaaaagcagagugauuuugg

SEQ ID NO: 489477 - RNA, 63 nt, hsa
uuguauaucagaaagauuaucuagggucuauccuagugauaauacauugucagccuuuucugu

SEQ ID NO: 489478 - RNA, 63 nt, hsa
guugaaacuuguuaaaugagauuucaacugacuuagugauagaguuuucuucaaguuaauuuu

SEQ ID NO: 489479 - RNA, 63 nt, hsa
uuuuuagguugguuguuuuguggauuucuuuaguagugauaguagccugaaccacauuuuaga

SEQ ID NO: 489480 - RNA, 63 nt, hsa
aaaaugaaaaaaaaaaacccuuagaccuguagauagugauaucguaauauuaauuguuaauaa

SEQ ID NO: 489481 - RNA, 63 nt, hsa
gguugucuucgugcugugucucauggguuuccauagugauaaagacaaggaaacgcugcaggg

SEQ ID NO: 489482 - RNA, 63 nt, hsa
ucaccagauaucuuauuguuucauuuaggaaaguagugauauagaugaagagccaacuugaug

SEQ ID NO: 489483 - RNA, 63 nt, hsa
acuagauaucuuuauauguaugggcauuacucuuagugauauuuguuuccuguccuuuguugc

SEQ ID NO: 489484 - RNA, 63 nt, hsa
ugccuguggcuugugcugggagugggucugacuuagugauaaaaggacucuauucacuaagua

SEQ ID NO: 489485 - RNA, 63 nt, hsa
cuauauauucaccauguaaacugcagccaccuuuagugauacuuuugaaaaaaaaaaauaaag

SEQ ID NO: 489486 - RNA, 63 nt, hsa
uacccaugaaaugauaauuuguaaaauaacacuuagugauaucuggaaauaauaauucaauua

SEQ ID NO: 489487 - RNA, 63 nt, hsa
ccagaucucucucucuuuuuuuuuuauuuuuuuuagugauagagucucacucugucacccagg

SEQ ID NO: 489488 - RNA, 63 nt, hsa
uguucuaauucaugugcugccaacugaguuaucuagugauaugaccucacugucuugaccaaa

SEQ ID NO: 489489 - RNA, 63 nt, hsa
ugugcuuuauuuuucuuagucauuuguggaauauagugauauauuguguuaauuuggacagua

SEQ ID NO: 489490 - RNA, 63 nt, hsa
aucaaagaugaauugguaaauaauggaaaugaguagugauaugaaaaugguuauguaacuaca

SEQ ID NO: 489491 - RNA, 63 nt, hsa
ggauaacuagaguugguggccgcaaccacuugcuagugauacacuguaucuaaaaaauaacug

SEQ ID NO: 489492 - RNA, 63 nt, hsa
aucuuucuaugcugcuuuuauaucuguauguauuagugauauuucucuaguaguuaaaaaaaa

SEQ ID NO: 489493 - RNA, 63 nt, hsa
ugaagaaaacuugaggcuuuagggauaagugguuagugauauuuuauugaaaccacuaaagag

SEQ ID NO: 489494 - RNA, 63 nt, hsa
cuugcacuuguuccuuguuuccucuggguuuuauagugauacagugguguccccggggccagg

SEQ ID NO: 489495 - RNA, 63 nt, hsa
acuaguuuuuauuuuauugaaaaguggaauuuuuagugauaaaauacauuuguaaguguaaag

SEQ ID NO: 489496 - RNA, 63 nt, hsa
ccuauaagacagggcaccuuuuaacucuaaaacuagugauacucagugacauagacuuugucu

SEQ ID NO: 489497 - RNA, 63 nt, hsa
gcaguuuuaguauggcucaacaugggucagauuuagugauaaagcaaauucuccuuggccuca

SEQ ID NO: 489498 - RNA, 63 nt, hsa
aagcucuugcuauguugcuauaagacaguaauauagugauaauuuaccaacuuuauugaaaau

SEQ ID NO: 489499 - RNA, 63 nt, hsa
auuuuuuaaaaaacuaauuuguauugucugcucuagugauacaaguuuuacuagugauaaacu

SEQ ID NO: 489500 - RNA, 63 nt, hsa
uuguauugucugcucuagugauacaaguuuuacuagugauaaacuauuuuaaucaaccauacu

SEQ ID NO: 489501 - RNA, 63 nt, hsa
caggagaaaauuaauacuaaauuauaaucauuuuagugauauuuuucaacuucaccacaguaa

SEQ ID NO: 489502 - RNA, 63 nt, hsa
aaauauaaguaaugaaggcauauuuccaauaacuagugauauggcaucguugcauuuuacagu

SEQ ID NO: 489503 - RNA, 57 nt, hsa
uaaugcaagucagaaaguagcaagacuuagugauaaaacugggccuguagcucaaga

SEQ ID NO: 489504 - RNA, 63 nt, hsa
uugaaguagaggggccuucaaacuacuuuauacuagugauaguuugaguuagguaagcaucuu

SEQ ID NO: 489505 - RNA, 63 nt, hsa
accuuugauagaaauguuggcauuuaguagaaauagugauaaguugaggaaagaaauaauaca

SEQ ID NO: 489506 - RNA, 63 nt, hsa
ucucugugccucaguucccaucccauaaaagaguagugauagugacaacaucuuaggauugcu

SEQ ID NO: 489507 - RNA, 63 nt, hsa
ggcuaggaccuccagcagaaugcugacuauaaguagugauaguggguauucuugucucauccu

SEQ ID NO: 489508 - RNA, 63 nt, hsa
auuuuauuauaggacuuugccucguacaauuaauagugauauuuuggacaaggaguucuggug

SEQ ID NO: 489509 - RNA, 63 nt, hsa
auccacuauuguauguuuuguuucauugaccucuagugauaccuugaucuuucccacuuucug

SEQ ID NO: 489510 - RNA, 63 nt, hsa
guaauuauaugguuauaugugccauguaaaauauagugauaucaaauauucuguuguuuccaa

SEQ ID NO: 489511 - RNA, 63 nt, hsa
gcugcacauuguaacaguaaaggcagaaagcuguagugauaaccucucuccuaaaagaguuaa

SEQ ID NO: 489512 - RNA, 63 nt, hsa
auugaauuaauauuuuugucuugaagcauuuucuagugauagaauguauuugucuuuuuuccu

SEQ ID NO: 489513 - RNA, 63 nt, hsa
cagccucuaccugucgccccagggagaaagggguagugauacaagucucauagccagagaugg

SEQ ID NO: 489514 - RNA, 63 nt, hsa
uaacuaucaacuugauaaauaacuuauaggugauagugauaauuccugauuccaagaaugcca

SEQ ID NO: 489515 - RNA, 63 nt, hsa
aaauuauaaaauaauucaacauguccaucuuuuuagugauaauaaaagaaagcaugguauuaa

SEQ ID NO: 489516 - RNA, 63 nt, hsa
ggauucacgcuccagccuccuucuugguugucauagugauaggguagccuuauugcccccucu

SEQ ID NO: 489517 - RNA, 63 nt, hsa
caaauacagauaaacagaguuggcaguauauuauagugauaauuuuguauuuucacaaaaaaa

SEQ ID NO: 489518 - RNA, 63 nt, hsa
agcccgggaagcagagguugcagugaacugagauagugauagugccacugcaauucagccugg

SEQ ID NO: 489519 - RNA, 63 nt, hsa
aaaguagguauaaaugauauugaauguuggguauagugauacucugccauaguucuuacugca

SEQ ID NO: 489520 - RNA, 63 nt, hsa
aaggcagaacaaauaaugcaaaauucucaguaauagugauacauggauauacuuccuuuuaaa

SEQ ID NO: 489521 - RNA, 63 nt, hsa
guuuccucaguggauagcacucaauuuauuccguagugauauuguaacaauacugccauuccc

SEQ ID NO: 489522 - RNA, 63 nt, hsa
auguuucaguuggcuucuaggaaauaauuaaauuagugauauuuuaaucagguuuuacuaucu

SEQ ID NO: 489523 - RNA, 63 nt, hsa
uauguauuacugagaacguaaaauaucauuacauagugauagcuggacacacaaggaauucac

SEQ ID NO: 489524 - RNA, 63 nt, hsa
uauuauuugauucauuugaguuaacagugguguuagugauagauuuuucuauucuuuucccuu

SEQ ID NO: 489525 - RNA, 63 nt, hsa
uuugggaagaugugaauuucaguguuagauucauagugauaagaacugcaaacagcaauuuga

SEQ ID NO: 489526 - RNA, 63 nt, hsa
cccucugaagcaugggccgugccagcugugcccuagugauaaggguaagaggagagaugucag

SEQ ID NO: 489527 - RNA, 63 nt, hsa
auuuggcaacaugucagcuuuauaguugccgauuagugauaugggucugauuucgaucucuuc

SEQ ID NO: 489528 - RNA, 63 nt, hsa
uucaaaaacagguuuuugauuuugaauagcaauuagugauauagugcuguuuaagcuacuaac

SEQ ID NO: 489529 - RNA, 63 nt, hsa
gccauugguuuuuguaguauuggggcccucuuuuagugauacuggauuggcguuguuuguggc

SEQ ID NO: 489530 - RNA, 63 nt, hsa
aguuuuacuuugaacuuucacgcugaaacaugcuagugauaucuagaaagggcuaauuagguc

SEQ ID NO: 489531 - RNA, 63 nt, hsa
gucagaauaaugucaaagugcuuacagugcagguagugauaugugcaucuacugcagugaagg

SEQ ID NO: 489532 - RNA, 63 nt, hsa
uuguaacuaugaauauuuacauauuuugccuuuuagugauauuuaauguuaaagugccaugaa

SEQ ID NO: 489533 - RNA, 63 nt, hsa
guuuuaaaauaauauguaaauuuuucagcuauuuagugauauauuuuaugggugggaauaaaa

SEQ ID NO: 489534 - RNA, 63 nt, hsa
ugaaaguauguuuucucuaaaauauuucucuaauagugauauaaauggcuauuuuauuaugau

SEQ ID NO: 489535 - RNA, 63 nt, hsa
caagcaauuucccuccaacaagggcugcaguucuagugauaaauagcaucuuuagcugcacag

SEQ ID NO: 489536 - RNA, 63 nt, hsa
uauuuguugcagagcugaggaacagagcaaauguagugauagaagcgcaaugagagaagcagc

SEQ ID NO: 489537 - RNA, 63 nt, hsa
cugcccuaaauuuuacuaauaaauccauuuuucuagugauacacaaauuguuuaagguuauac

SEQ ID NO: 489538 - RNA, 63 nt, hsa
ucauacaccucaccugccuuggcaagccuauuuuagugauauggcagcacggauauaacacua

SEQ ID NO: 489539 - RNA, 63 nt, hsa
ugaacauaauuuaagaaccagauuuauuuucuauagugauaaacccuuuuuucucagaacucc

SEQ ID NO: 489540 - RNA, 63 nt, hsa
auucuagccacacacaaauaaauaucugcggcuuagugauaggacucuaccuuuucuccuaga

SEQ ID NO: 489541 - RNA, 63 nt, hsa
aauuugauuauguauuauaauguaaucuguaaauagugauaugauuaacaucuuaaucacauc

SEQ ID NO: 489542 - RNA, 63 nt, hsa
ggauuggguuuagauuggggccagugcugguguuagugauagugucaggauggagguuagguu

SEQ ID NO: 489543 - RNA, 63 nt, hsa
uuuaucucaaguagauauagacacuaaccuugauagugauacguuagaggguuccuauucuuc

SEQ ID NO: 489544 - RNA, 63 nt, hsa
gaguccaggaguuugagaccagccugggcaacauagugauaccccaucucuuaaaaaaaaaaa

SEQ ID NO: 489545 - RNA, 63 nt, hsa
guucccauuugaguuccuccuugcacugaguuuuagugauauagaacuagcuuguaguuagug

SEQ ID NO: 489546 - RNA, 63 nt, hsa
aggaaccauacuucucugggacagcauggcauauagugauauaugcuauuugcguucuccaga

SEQ ID NO: 489547 - RNA, 63 nt, hsa
acauguauauauaccauuuauuauguucuacuuuagugauauaccuuaauuuagugggcuuug

SEQ ID NO: 489548 - RNA, 63 nt, hsa
cuucuuuuugcaugguuuugcccaccucugcaauagugauaaucugaugcugaagaucaaaua

SEQ ID NO: 489549 - RNA, 63 nt, hsa
auuggcaaagcucuaaaaugcacugcugccaucuagugauacacuuuuguaaaguacagcaaa

SEQ ID NO: 489550 - RNA, 63 nt, hsa
ucagauucuucaaugugguuuacccaacuggaguagugauaaacaccuuaaucauaaaaugaa

SEQ ID NO: 489551 - RNA, 63 nt, hsa
gguuggucagcagucagacaacucuaauguguguagugauaagagauucaaguaacaucaguu

SEQ ID NO: 489552 - RNA, 63 nt, hsa
gagcucaggaguccuaaaccagccugggcaacauagugauaccuugucucuaccaaaaguuaa

SEQ ID NO: 489553 - RNA, 63 nt, hsa
cagauuuccuuucagaacacucaaagguucgacuagugauaguggaugguauugcuuuuccau

SEQ ID NO: 489554 - RNA, 63 nt, hsa
aauuuauccuaagaaaauacuuaaggauuuaguuagugauaagauguucaucccagcauugca

SEQ ID NO: 489555 - RNA, 51 nt, hsa
augugaugaaugaaacuuaaguagugauaaaaggaaguuuagcauaaauua

SEQ ID NO: 489556 - RNA, 63 nt, hsa
uagccccgcccaccaacgagucccggcuucgaguagugauacgcaugaacaaagccauauccu

SEQ ID NO: 489557 - RNA, 63 nt, hsa
agacuguuuuaccuccacaacccuauuuguuauuagugauacuuuauuuuauauaauauuuuu

SEQ ID NO: 489558 - RNA, 63 nt, hsa
acccucuacucuccagcuuuagucuuauaaauguagugauaggauuccuuguugcuugguccc

SEQ ID NO: 489559 - RNA, 63 nt, hsa
uuugcacucuaacuuaagaguuuuuacuuuauguagugauaccuaauacaauuuugaaaauac

SEQ ID NO: 489560 - RNA, 63 nt, hsa
gagucaaggauucuucugauucuaguguguguuuagugauagauguagucuugacgaauauug

SEQ ID NO: 489561 - RNA, 63 nt, hsa
ucgauggaauugugugaucagaagguggaauucuagugauaggcgaccucagacccgcauuca

SEQ ID NO: 489562 - RNA, 63 nt, hsa
acaauuccaacacacagcaaucacugcuguuaauagugauauacauccuucccuauuaugugu

SEQ ID NO: 489563 - RNA, 63 nt, hsa
accacaccuguauucauaugggaacaauuggaauagugauauccucaagguguaaaaaauaua

SEQ ID NO: 489564 - RNA, 63 nt, hsa
uaauuagggaaaucccacagaugaaaaaugccuuagugauaagcuuucauggcagagcacguc

SEQ ID NO: 489565 - RNA, 63 nt, hsa
ucuuaauuuacgauuuuuuauuauaaaaauguauagugauacaaugggacaugugaagaauac

SEQ ID NO: 489566 - RNA, 63 nt, hsa
cauaccugcugucagcaaggguguaauauaccauagugauaaauaugaccaaaagccauaaau

SEQ ID NO: 489567 - RNA, 63 nt, hsa
cauaccugcugucagcaaguguguaauauaccauagugauaaauaugaccaaaagccauaaau

SEQ ID NO: 489568 - RNA, 63 nt, hsa
aagcaguuacugaucagauuaagaaucaggcacuagugauacacauucauuuuuaaaauucau

SEQ ID NO: 489569 - RNA, 63 nt, hsa
acaccugaagagcacugacugugugccgggcacuagugauacaaaagagugugacaguuguuc

SEQ ID NO: 489570 - RNA, 63 nt, hsa
ucacccccuccucccugaucugucagggccacuuagugauaauaaauucuucccaacugcaga

SEQ ID NO: 489571 - RNA, 63 nt, hsa
gcgaauagccacugcacugcggccuggacgacguagugauacccugacucuuauaaauaaaua

SEQ ID NO: 489572 - RNA, 63 nt, hsa
uaagaccuccucggaucauugucccuucuuauguagugauaaaguaaccuuccuugaagugua

SEQ ID NO: 489573 - RNA, 63 nt, hsa
agcuaagaaaaaaaaaaagucugugcauaguuuuagugauacaccaccuccgauaagcaaaaa

SEQ ID NO: 489574 - RNA, 63 nt, hsa
uccuguguccuuuaacacuuuaaguacagaucuuagugauacauaaccaguuuuaucucucuc

SEQ ID NO: 489575 - RNA, 63 nt, hsa
uccuguguccuuuaacacuuuaauuacagaucuuagugauacauaccauuuuaucugucucaa

SEQ ID NO: 489576 - RNA, 63 nt, hsa
auuuuuauuuccauuuuauaaacauguaaauaauagugauaacuuguuaauaauaguaaaccu

SEQ ID NO: 489577 - RNA, 63 nt, hsa
uuuuauucugagugcaauauuucaauagccuuguagugauaacuaguguugcuuuuguuuuag

SEQ ID NO: 489578 - RNA, 63 nt, hsa
gguuuuguaccaucugaugcuggaaguuuugauuagugauauuuucuacuacuacauauuuag

SEQ ID NO: 489579 - RNA, 63 nt, hsa
ugggaaggaggacgguuguaagcaguuguuauuuagugauauuguggguaacgugagaagaua

SEQ ID NO: 489580 - RNA, 63 nt, hsa
ggaaaguacuaugaacgucucgaagcaguauucuagugauaagaauucuuaacauagccaagc

SEQ ID NO: 489581 - RNA, 63 nt, hsa
ggcucccagugggggccccguggagggcgcccguagugauaagcacaccggcacgaacgucag

SEQ ID NO: 489582 - RNA, 63 nt, hsa
aaguccccuacagucaguuuauaagggcuucaguagugauagacauuguuauaaaaacuugua

SEQ ID NO: 489583 - RNA, 63 nt, hsa
aacauacaaagauggguuucugaauaaaauuuguagugauaacaguauucuugguguaacuua

SEQ ID NO: 489584 - RNA, 63 nt, hsa
agacuccugucucuggaggucugcaagcacugguagugauauugcagcagacaaggucugggu

SEQ ID NO: 489585 - RNA, 63 nt, hsa
ucaagauuacuugcccagaaucacucaggcagcuagugauagagguggggccaagcccaggcu

SEQ ID NO: 489586 - RNA, 63 nt, hsa
aucacacauuuauugcuguuuaucagguugguuuagugauaauaauuuuguuuuugaaauaca

SEQ ID NO: 489587 - RNA, 63 nt, hsa
uuuucccuuaaaggaaugucaaagauuguuugauagugauaaguuacauuuauguggagcucu

SEQ ID NO: 489588 - RNA, 63 nt, hsa
uauaauauuuuucauaggcaaguuuccucucaguagugauaacaacauuuuuagacauucaaa

SEQ ID NO: 489589 - RNA, 63 nt, hsa
ccauccugaaccauucguuuugacccauaauaauagugauaguauaauggcuaccaguuauug

SEQ ID NO: 489590 - RNA, 63 nt, hsa
uuuagaaaggauuuucacacuggcauuucuagguagugauauuuucuuccacuuaccugcuga

SEQ ID NO: 489591 - RNA, 63 nt, hsa
ucuuaucucauauuucaugacuuaagaauuuuuuagugauaauaaacauagacuuaauuccaa

SEQ ID NO: 489592 - RNA, 63 nt, hsa
accuuugauuacugaaucccuacacucaaacuauagugauauaucaguguuugagagugaccu

SEQ ID NO: 489593 - RNA, 63 nt, hsa
ucccuucaguggaaaccauguuaugucgacuauuagugauaacaaaugggucacuaucuggug

SEQ ID NO: 489594 - RNA, 63 nt, hsa
aacauuguuauccuauaucauuuucaucccaaguagugauaucugugaaaucacagguuugau

SEQ ID NO: 489595 - RNA, 63 nt, hsa
ggaugagugcagggcagaggugagggaacccaauagugauaccugguaaggugcuucuuccuc

SEQ ID NO: 489596 - RNA, 63 nt, hsa
aacuuugauuacugaauccauacacucaaacuauagugauauaucaguguuugggagugaccu

SEQ ID NO: 489597 - RNA, 63 nt, hsa
cuuuuagugugauuuauuaaguuguagucaccauagugauagcccauaaauaauugcuggaaa

SEQ ID NO: 489598 - RNA, 65 nt, hsa
ucuauaauuguacuuguuuuuuaauuacuuccuuucacugccaaccucgaauuacuguacaguau

SEQ ID NO: 489599 - RNA, 65 nt, hsa
auuccacagaccaggacauuccaugugccucauggcacugccaccuggcccuuugcccuauuuuc

SEQ ID NO: 489600 - RNA, 65 nt, hsa
ucccccaggggcacguguggcuccugcccccuggccacugccaagagaaugaagcacccagucuc

SEQ ID NO: 489601 - RNA, 65 nt, hsa
aagcagaggaagaagcugccgaaggggacagacuccacugccagacggccagccguuugcugucc

SEQ ID NO: 489602 - RNA, 65 nt, hsa
uuucucgcacguugaggcuuaguggagaugggcaccacugccauuugcucagaagaaggcugguc

SEQ ID NO: 489603 - RNA, 65 nt, hsa
ccuccucccaccugccaccaggccucaccaaagcccacugccauggggccaucugggccauucag

SEQ ID NO: 489604 - RNA, 65 nt, hsa
agaaagugggaauagggugcauuggggcuaguuggcacugccauguaucucaggcuuggguucac

SEQ ID NO: 489605 - RNA, 65 nt, hsa
gcaggcugugaauuugucucucagucacugauugccacugccaucuggaaauguuugcuaaaggc

SEQ ID NO: 489606 - RNA, 65 nt, hsa
auucagcaggagguccuauuacccucuccagcugccacugccagagcuggauuccuguaaaggag

SEQ ID NO: 489607 - RNA, 65 nt, hsa
aagauagugaaguggucuugauugauuuugauuuucacugccaagccaaucaugugaaggacaga

SEQ ID NO: 489608 - RNA, 65 nt, hsa
cccagaauccgcauguuuccccagugauuacacuccacugccaccguggugccuggcuuuaacuc

SEQ ID NO: 489609 - RNA, 65 nt, hsa
aacagauguaaugcaugucacagugacggagauaacacugccaugauaaaaguacucauguuucc

SEQ ID NO: 489610 - RNA, 65 nt, hsa
ucacuaaccaguugacgagcagugcauuuacaaggcacugccaaacaagaugcccuugggagcug

SEQ ID NO: 489611 - RNA, 65 nt, hsa
gccuucugaggagaaaagcaacccuguuucaaauccacugccaauucagcuccucuggaguggag

SEQ ID NO: 489612 - RNA, 65 nt, hsa
cccugccucccuaauuagcuagggcuggggucagccacugccaauccugccuuacucaggaaggc

SEQ ID NO: 489613 - RNA, 65 nt, hsa
gggagaucauagcccuuccuaggcagaauccuguucacugccaggcuauaguaauuauuacuauu

SEQ ID NO: 489614 - RNA, 65 nt, hsa
auaaaacacaaacgggcucagcaaaagaugcuucucacugccaugccagcuuaucucaggggugu

SEQ ID NO: 489615 - RNA, 65 nt, hsa
auguucaagguaauaugccaggcgcuguaugucuccacugccaaguagaagugacucaaaacccu

SEQ ID NO: 489616 - RNA, 65 nt, hsa
ccaugaccccaccuuuacuaagcacaaguacuugccacugccaucacugccaaguaacuagaugu

SEQ ID NO: 489617 - RNA, 65 nt, hsa
caccuuuacuaagcacaaguacuugccacugccaucacugccaaguaacuagaugucucuguuuc

SEQ ID NO: 489618 - RNA, 65 nt, hsa
ucugguuaucuuccuguuccuguagcauagccaggcacugccagucaccugugcccccauugcug

SEQ ID NO: 489619 - RNA, 65 nt, hsa
uggguccugaguguggguauccacuuuuacccgcucacugccaccuguggacacucugugucuac

SEQ ID NO: 489620 - RNA, 65 nt, hsa
aggcuucuccgccagccuccucuggacggcaggcucacugccaggccagccuccgagagggagag

SEQ ID NO: 489621 - RNA, 65 nt, hsa
uggaauuugcuggaggacuaggccagagcaagccucacugccacugugccuuuggggcacccuug

SEQ ID NO: 489622 - RNA, 52 nt, hsa
aggcagacacucaggccuaacccacugccagccccugagaggacacgcuccu

SEQ ID NO: 489623 - RNA, 65 nt, hsa
caugcccaucccgaugaaccugcaucauuccccgacacugccaagccaacccuggaaaaggaguu

SEQ ID NO: 489624 - RNA, 65 nt, hsa
acauauauauucuacauauauguauauuaaaacugcacugccaugucugcccuuuuuuguggugu

SEQ ID NO: 489625 - RNA, 65 nt, hsa
ccaccaaauugcuuuauuccccuuugcaagaugggcacugccauaguucugccucuuugcugggg

SEQ ID NO: 489626 - RNA, 65 nt, hsa
uccucccucaccagcucuuacgccucagccagcaccacugccaccagggcaacugcagcagcauc

SEQ ID NO: 489627 - RNA, 65 nt, hsa
cagauuuucucacagacccuucccaauuccaucaccacugccaacaacuccucccccagagaucu

SEQ ID NO: 489628 - RNA, 65 nt, hsa
ccugaaggauugucgaggccaggguucgggaaguacacugccaucggucaggggacagcugccuc

SEQ ID NO: 489629 - RNA, 65 nt, hsa
agucacaacccaggugacgaugcccucucagccaacacugccaaccugacccugucaucccgauu

SEQ ID NO: 489630 - RNA, 65 nt, hsa
gcucucuccgcucccuugugauuucugagggucaccacugccagccucaggcaacauagagagcc

SEQ ID NO: 489631 - RNA, 65 nt, hsa
agaacaucuuuaugguaaagaugggagcccaguuucacugccauauacucuucaaggacuuucug

SEQ ID NO: 489632 - RNA, 65 nt, hsa
aaagaaacugagccuggggcaaacgaggcuucccacacugccaggggagccucacugugaagucu

SEQ ID NO: 489633 - RNA, 65 nt, hsa
ucugccccuugggcauccacccagugcugccaugccacugccaggcaccuggccugcugggaacc

SEQ ID NO: 489634 - RNA, 65 nt, hsa
gaguuaacggugugggccacuccagcuugcccuuccacugccacucacuggggugaggcuggggg

SEQ ID NO: 489635 - RNA, 65 nt, hsa
aguccaggcagaaggagaccacaaccuccugggaccacugccaccugcaagagcccugcccagga

SEQ ID NO: 489636 - RNA, 65 nt, hsa
ggagaggcagaaucuauauacugaagggcuaguggcacugccaggggaagggagugcguaggcuu

SEQ ID NO: 489637 - RNA, 65 nt, hsa
ccucagccucccgaguagcugggacugcaggcacacacugccacgcccagcuaauuuuuugcauu

SEQ ID NO: 489638 - RNA, 65 nt, hsa
gauuggguuuaguuucagaacuggacuuguuccuucacugccacagaaucagaaagagcuagaag

SEQ ID NO: 489639 - RNA, 65 nt, hsa
aaaucugaguggaauuuucaaaugaucagcacagccacugccaacagauaugauguaaagugaaa

SEQ ID NO: 489640 - RNA, 65 nt, hsa
gaucccuccagaagucucccacccuggggccaacucacugccauguucagugucccggcuccaaa

SEQ ID NO: 489641 - RNA, 65 nt, hsa
uucuuauuuuggagggagaagggaauugcacuucacacugccaucaggguuuaguugaccucaua

SEQ ID NO: 489642 - RNA, 65 nt, hsa
gaaggguguucacccaucccacccaaggcuuggcacacugccagugucuuagcagggucuuguga

SEQ ID NO: 489643 - RNA, 65 nt, hsa
aauaaggaguauuuugguagaguauauacauaccucacugccagugaaauugcuuuccuauggua

SEQ ID NO: 489644 - RNA, 65 nt, hsa
uaguuaaauaacuguguggcaguuaauuggauguucacugccaguugucuuaugugaaaaauuaa

SEQ ID NO: 489645 - RNA, 65 nt, hsa
augucuuccuuauucauuuuucucucccugccucucacugccauaagaauaucagccugggggca

SEQ ID NO: 489646 - RNA, 65 nt, hsa
acgaggauaccuucaguuugaaucugcauaauguucacugccaaacuccuucucauuuaaugcuu

SEQ ID NO: 489647 - RNA, 65 nt, hsa
ugugcacaaagaaaaugacaugaaucuuuauuuuucacugccagcuucaaggaaagaaaauuuuu

SEQ ID NO: 489648 - RNA, 65 nt, hsa
cgggcgauggcugucuuuucuugacuuuguaucuucacugccaagcaaaaagucugccaaguggg

SEQ ID NO: 489649 - RNA, 65 nt, hsa
aggucuucuaauguaauuuuguuuuauuuugagaacacugccauuggaauguuucuacacgaucc

SEQ ID NO: 489650 - RNA, 65 nt, hsa
gcauaugggaaguaacauugcacuaauauggaaaucacugccagagacagucuauuuucuuuuaa

SEQ ID NO: 489651 - RNA, 65 nt, hsa
auaugcauauguggggugaaaccguauacuacuuucacugccaugacacuaggcaaaaaauauuu

SEQ ID NO: 489652 - RNA, 65 nt, hsa
ucggacuugcuagacgcuucucaaaacuggacagucacugccacuuugcacauuuugauuuuuuu

SEQ ID NO: 489653 - RNA, 65 nt, hsa
uguauggauuuacuuugggguucaaaucaaaaugucacugccagaaagagcuguuccagcugauc

SEQ ID NO: 489654 - RNA, 65 nt, hsa
ccauuugguaaaccaguugauuauuuggaaauguucacugccaaaauaguaagugcuauaacuaa

SEQ ID NO: 489655 - RNA, 65 nt, hsa
cuuccugauuaaaaacacaguuuuauugcucucugcacugccaaaccaauaaauuuacagaagag

SEQ ID NO: 489656 - RNA, 65 nt, hsa
cauccuuuucuuuguuuuuacccccuggcugccaccacugccaugucacagcugcuuucucuggc

SEQ ID NO: 489657 - RNA, 65 nt, hsa
uccuaggggacuggcgauuuaaaccaguugagaaacacugccaucagcaggcaguuucagacuca

SEQ ID NO: 489658 - RNA, 65 nt, hsa
uuuugccaagggaauuauagcugcagguucucucucacugccaucaaacuguaaaagauuaaacu

SEQ ID NO: 489659 - RNA, 65 nt, hsa
ugcccaugauggucacuuaaaaugugcaguaauagcacugccaggaucaagcaugaaaggcuuuu

SEQ ID NO: 489660 - RNA, 65 nt, hsa
ccaugcccauuccucgccucauucauaggacacuucacugccauuuucuauucacauaaaagaaa

SEQ ID NO: 489661 - RNA, 65 nt, hsa
caaaaauuaagauuaucaaagcauuuugaauagugcacugccauguguccugucugugaaugaag

SEQ ID NO: 489662 - RNA, 65 nt, hsa
agcaguggcagcagagaguggccucggagggaagccacugccaccugagacagcccaagcagcaa

SEQ ID NO: 489663 - RNA, 65 nt, hsa
acccaucuccuugagucauucccuuugggaaaccccacugccaguauugaucuccuuuuugccuu

SEQ ID NO: 489664 - RNA, 65 nt, hsa
acaggaagucucagugugaaggggucuuuucucuccacugccaauguaaguagaauguucuaaau

SEQ ID NO: 489665 - RNA, 65 nt, hsa
ccuuccuugggaccaaggaccguuccaacagcauucacugccaguucuaauaggcgaggaaaaug

SEQ ID NO: 489666 - RNA, 65 nt, hsa
ccccugguugcaucccagaagcaucugacugucaccacugccaguggcuguggaacaguccuggg

SEQ ID NO: 489667 - RNA, 65 nt, hsa
cuggaaaagaggcccugccauacacccugcguacccacugccaggacccucucagacaagcgugg

SEQ ID NO: 489668 - RNA, 65 nt, hsa
gccgucuguuaggagcuuccagaguguucucucgacacugccagccccguguuagcaccugggcc

SEQ ID NO: 489669 - RNA, 65 nt, hsa
gggccugggcagggcucccagccugcaccgccucccacugccaguggggcaugauucucucaggc

SEQ ID NO: 489670 - RNA, 65 nt, hsa
uagcuucccugcuuccugggaaucaggagccuggacacugccaucucuagagcagaguggaggcc

SEQ ID NO: 489671 - RNA, 65 nt, hsa
ccccccaagccugagccauggcccugcccucaccccacugccaggccgaggcucagccccagacu

SEQ ID NO: 489672 - RNA, 65 nt, hsa
gagaccucuaccuaguagaaaguguagucuaugaccacugccacacuaaaaacuauuugucauug

SEQ ID NO: 489673 - RNA, 65 nt, hsa
uggcagaucaauaaagaaaggcuucuucaggacagcacugccagagaugccugggugugccacag

SEQ ID NO: 489674 - RNA, 65 nt, hsa
uauaaggucaguguuucucguccccgccggaucugcacugccaacugggauuggguucgaacagc

SEQ ID NO: 489675 - RNA, 65 nt, hsa
gcugaccgcagcaccgccccccgccgcgccuuucgcacugccaccauuccauccugugccccgcc

SEQ ID NO: 489676 - RNA, 65 nt, hsa
acccggccaugaggaccugcucugcucagcacgggcacugccacuugguguggcucaccagggca

SEQ ID NO: 489677 - RNA, 65 nt, hsa
auacauuucgauuccuuucaucucagcaaaaugggcacugccagagccauuucugaucacaccac

SEQ ID NO: 489678 - RNA, 65 nt, hsa
uacaguuccacaucaaggccgagugcaccgcccaccacugccacggccuuugaccaucuguaguu

SEQ ID NO: 489679 - RNA, 65 nt, hsa
uucaaugcuaagucuugccuuuuauuuuuuaauuucacugccaaguuugcagugguucuaaguga

SEQ ID NO: 489680 - RNA, 65 nt, hsa
uguguugcagugucugcuggagacauugaggcaggcacugccaaaacaucaaccugccagcuggc

SEQ ID NO: 489681 - RNA, 65 nt, hsa
gagauuuuuuuuuaaagaagaaaaaaaaaaauucacacugccagcguuaacaguuccuuucaaag

SEQ ID NO: 489682 - RNA, 65 nt, hsa
gcucagcaguccucccucuggggacucccugccaccacugccaguuucugaaacggucccacugg

SEQ ID NO: 489683 - RNA, 65 nt, hsa
ugaccagacgccacaccuugugcuucuuaucuguccacugccacucccccaguucaaauccuuac

SEQ ID NO: 489684 - RNA, 65 nt, hsa
uuuccccccaggaagccugccuggaaagauggguccacugccacguguguucuggcuguagacaa

SEQ ID NO: 489685 - RNA, 65 nt, hsa
ccaagcccacaucacaucuccuggccgagagcagccacugccacucagucugacagcuugcgacu

SEQ ID NO: 489686 - RNA, 65 nt, hsa
gaggugccugggagcugccuaaauucagaagccuccacugccauggagacugccuggcugugucc

SEQ ID NO: 489687 - RNA, 65 nt, hsa
ggucugaaagcaccaagggucccugccccuaccuccacugccagacccucagccugaggucuggu

SEQ ID NO: 489688 - RNA, 65 nt, hsa
uacuuuaucugggcuuaauaagucacugacaucagcacugccaacucggcugcaauuguggaccu

SEQ ID NO: 489689 - RNA, 65 nt, hsa
ucaccuuccuugaaauuucucagcgggagucuccucacugccacuaaaauccacccagcccacua

SEQ ID NO: 489690 - RNA, 65 nt, hsa
gucuuucaggugggggagaaauugguuagggcucccacugccaaaugcaagcagauagcauaacc

SEQ ID NO: 489691 - RNA, 65 nt, hsa
ucuacaaggacuuguacuagcagagaguccugagccacugccaacauuucccuucuuccaguugc

SEQ ID NO: 489692 - RNA, 65 nt, hsa
gggagugcaggguggacaucaccuuggaggcccugcacugccagcaucuggagaccguccuggag

SEQ ID NO: 489693 - RNA, 65 nt, hsa
gcacccccaaccuccaucgccuugcagguuuucuucacugccaggaguagugagcuguacgaguc

SEQ ID NO: 489694 - RNA, 63 nt, hsa
agucagcugugauguacugacaccauggaauuccacugccagugacccacugccuccggccgu

SEQ ID NO: 489695 - RNA, 65 nt, hsa
accaugauagucuacauucugauaagcugugaggccacugccaagggagggagaaauggucacuu

SEQ ID NO: 489696 - RNA, 65 nt, hsa
acagcuccgucgccccuagcaacuccaccauugggcacugccaugcagagacguggcuggcccag

SEQ ID NO: 489697 - RNA, 65 nt, hsa
gcuucucccagcccguggguggcagcgugcuagcacacugccaccaucucaaagccaucccccua

SEQ ID NO: 489698 - RNA, 65 nt, hsa
ucaggcaugugacuggccuaacugcaugcccagggcacugccaggguucaaugggccagccgucu

SEQ ID NO: 489699 - RNA, 65 nt, hsa
uuuagcaagagacaauuuucuguacuagaaucuuccacugccagaaaacacagugccaguaaggu

SEQ ID NO: 489700 - RNA, 65 nt, hsa
uauccacugacuuccaucugacacugguugaggaccacugccagggaugcuaacucccugguaau

SEQ ID NO: 489701 - RNA, 65 nt, hsa
cucugagccgccacucccgggccaagacagauggacacugccaagagccgacaaugcccugcugg

SEQ ID NO: 489702 - RNA, 65 nt, hsa
ggggccgucccgggagccaggugggagcugccuuccacugccaucgggucuccucuccucuccca

SEQ ID NO: 489703 - RNA, 65 nt, hsa
aguuuggagacucauaaauaccaugcagguguaaccacugccaauaggcuguuucuaugcuuauu

SEQ ID NO: 489704 - RNA, 65 nt, hsa
ggccuccagaauugacuuagcccuaguaauaaaagcacugccaaaacaucucagagacuucuuuu

SEQ ID NO: 489705 - RNA, 65 nt, hsa
aagugacagguauccacauuugcaugguuacaagccacugccaguuagcaguagcacuuuccugg

SEQ ID NO: 489706 - RNA, 65 nt, hsa
uuuuugugaaauucaaccugugucuuauagguuuccacugccaaaacaaugcccguaagauggcu

SEQ ID NO: 489707 - RNA, 65 nt, hsa
ggcaggggugccucacugugagcgggaugacuguucacugccacuguccuguggcucggggaagg

SEQ ID NO: 489708 - RNA, 65 nt, hsa
gccucacucaggcacguaccugcugaccagucagccacugccaacccauggcccagccacugugu

SEQ ID NO: 489709 - RNA, 65 nt, hsa
aagcaauugauagauuuuacaucuuugauauaaagcacugccauauuuauauuuuaaaaggaaau

SEQ ID NO: 489710 - RNA, 65 nt, hsa
uaaugagcuguaugagaggugaaucuccucacugucacugccauagccaagcauccucaugagag

SEQ ID NO: 489711 - RNA, 65 nt, hsa
guucuuccaucaccuccccccccccgccacccucccacugccaaagaacuuggaaauagugauuu

SEQ ID NO: 489712 - RNA, 65 nt, hsa
cuggagcaagcuggggcgggggguggguaaacccucacugccagcaggccccaaguggcuuguaa

SEQ ID NO: 489713 - RNA, 65 nt, hsa
ggccuuuccuggacagacugaagagcugagcagggcacugccagccugucccucauuacccaagg

SEQ ID NO: 489714 - RNA, 65 nt, hsa
ggacagccuggacauuggacauugcuaaguugggucacugccacauggagucuugccaugccugu

SEQ ID NO: 489715 - RNA, 65 nt, hsa
uggacgcugccacaucugggcauacagugucuggacacugccacauggagccacugucaugcagg

SEQ ID NO: 489716 - RNA, 65 nt, hsa
ggcugggcuugucagggggcaccccaaagagggggcacugccagguagcugggggaguggcaugg

SEQ ID NO: 489717 - RNA, 65 nt, hsa
aggcuucuggaauagaaacagugguuugaagaccccacugccaccuuuauggacuggccccuuug

SEQ ID NO: 489718 - RNA, 65 nt, hsa
aggaaaaagaaaacaggaccuagguguuugggguacacugccacccagggaguggaucaaaaaua

SEQ ID NO: 489719 - RNA, 65 nt, hsa
ggcugcccuucuucuugacccauguucucaauacccacugccagacaugccacguguccccagag

SEQ ID NO: 489720 - RNA, 65 nt, hsa
ggcuccugacccuagcaguguaccugucuugccagcacugccagcgucagucccaggaguccaca

SEQ ID NO: 489721 - RNA, 59 nt, hsa
gacugacagccaagauauaaggaggguggcacugccacaucccacuggcagaaacucuc

SEQ ID NO: 489722 - RNA, 65 nt, hsa
uuagcacaaguuucucuuuuuuaugcugguauucucacugccacauuuuuggaaaccuguauuac

SEQ ID NO: 489723 - RNA, 65 nt, hsa
aagauaugugcccucaucauaaauaucaucucuagcacugccauccaauuuaguucaauaaaauu

SEQ ID NO: 489724 - RNA, 65 nt, hsa
ugucuguggagaugcugguguaaacaaaccuacuacacugccaguuguauaaaaguacagcacau

SEQ ID NO: 489725 - RNA, 65 nt, hsa
guuuucuuuauacaaagcaagauaacggcauauaacacugccauuacauggcaaaauguuugcua

SEQ ID NO: 489726 - RNA, 65 nt, hsa
ugggggacugggagccgcagcagcucccccucccccacugccauaaaacauuaagaaaaucauau

SEQ ID NO: 489727 - RNA, 65 nt, hsa
cuccccacuccuccucucuucuuccucuucucucucacugccacgccuuccuuucccuccuccuc

SEQ ID NO: 489728 - RNA, 65 nt, hsa
cgcccaggcuggagugcaaugccgugaucuccgcucacugccaccuccgccucucuaguucaagc

SEQ ID NO: 489729 - RNA, 65 nt, hsa
uucugauuccauaagcuguuuuugcuuaggugauccacugccaugugauccauaauuuuucuaca

SEQ ID NO: 489730 - RNA, 65 nt, hsa
ugauucacugcauggcucccacaggagugggaaaacacugccaucuuaguuuggauucuuaugua

SEQ ID NO: 489731 - RNA, 65 nt, hsa
cuacucaauauucucuucaagcauuuuuuuucuuccacugccacucucuuuaccuuuaucauuuc

SEQ ID NO: 489732 - RNA, 65 nt, hsa
ugcacauccaggaaaaaagacuaggacuugccacacacugccaauucauaauccgcaggaucugu

SEQ ID NO: 489733 - RNA, 65 nt, hsa
uuauuuuauuuucucacaggauaucacauuggagucacugccaagucauagccauaaaugaugag

SEQ ID NO: 489734 - RNA, 65 nt, hsa
uuucuuugguuuucuucaaacauaggugaaaaaaacacugccauucacaagucaaggaacccagg

SEQ ID NO: 489735 - RNA, 65 nt, hsa
guugugucuuuauuuaauuuuacaucuuuuugaagcacugccacagguuauuagccaagguggcc

SEQ ID NO: 489736 - RNA, 65 nt, hsa
uguaacaguccuguuuuguugaguugcugcuauugcacugccagugcagcccacaccaaaucaca

SEQ ID NO: 489737 - RNA, 65 nt, hsa
ucugugccucuuaucaaguguuacagaggacauaccacugccaugucagggguuugcuuacagug

SEQ ID NO: 489738 - RNA, 65 nt, hsa
gcuuuuuaaagaaugcucuuuacuucauggacuuccacugccauccucccaaggggcccaaauuc

SEQ ID NO: 489739 - RNA, 65 nt, hsa
uguucagaaauggguaauguggccauuucaccagucacugccaacaacaacgagguuccuauaau

SEQ ID NO: 489740 - RNA, 65 nt, hsa
aacauuaacccuacacucggaauucccugaagcaacacugccagaaguguguuuugguaugcacu

SEQ ID NO: 489741 - RNA, 65 nt, hsa
ggucacugcuagagacgcugauccauaaagacaaucacugccaaccccucuuucgucuacugcaa

SEQ ID NO: 489742 - RNA, 53 nt, hsa
accacuuccacccguccuagcgccacugccaagcacaccucgcucccagcaca

SEQ ID NO: 489743 - RNA, 65 nt, hsa
ggaaccagacgcuacagagacugcaacguguaaaacacugccauucuuuucauuccuuugaauaa

SEQ ID NO: 489744 - RNA, 65 nt, hsa
uuuuaaaagauuaauuuuggaaacagaaggagaagcacugccauuuguuuuuauuucaacaauug

SEQ ID NO: 489745 - RNA, 65 nt, hsa
ccgccuuuggggaggucuggaccacccagggccuccacugccaccuuggcuggcaagggagaaau

SEQ ID NO: 489746 - RNA, 65 nt, hsa
ggaccccauaccguuagcccuuguauguauaccaacacugccaaaguaaaacauuaggucaggca

SEQ ID NO: 489747 - RNA, 65 nt, hsa
gguaguuacuuuugccauguccuauugaucagugacacugccagaggcccauaccggcaagagga

SEQ ID NO: 489748 - RNA, 65 nt, hsa
gaaaaucuggacaauagauguggacuccaaggggccacugccaucccuuccugugugcucuuuuu

SEQ ID NO: 489749 - RNA, 65 nt, hsa
ccuagcuaccuucucuacccaucucccccaucccccacugccacacccuccccauucagacacuu

SEQ ID NO: 489750 - RNA, 65 nt, hsa
gcaagcaagguggacaagagcucaggacuccagcccacugccacugggugacacagacugucguu

SEQ ID NO: 489751 - RNA, 65 nt, hsa
ccguauggccuauaguuuaaaagcacaucuauguucacugccacucugaaaaagggaauuauuuc

SEQ ID NO: 489752 - RNA, 65 nt, hsa
ucuaaacaguuccuaagcgcugacugugcgcuagacacugccaggcccgggccucgaggaggaaa

SEQ ID NO: 489753 - RNA, 65 nt, hsa
uguguaaucugaaggaaggcugugccaucuuugggcacugccaagggaguuggggugaugggcuu

SEQ ID NO: 489754 - RNA, 65 nt, hsa
aguguggugacccccauacauuccucccugcuccccacugccaggaggaccacuguccccagcca

SEQ ID NO: 489755 - RNA, 65 nt, hsa
uuccucacccccaccccacuuagguccugggcccccacugccaggcugggcccagcuugcucagu

SEQ ID NO: 489756 - RNA, 65 nt, hsa
agaaaauuucugccuggcacacaccuggcuccaaccacugccaagugaucacucuuaggcccagg

SEQ ID NO: 489757 - RNA, 65 nt, hsa
cucccaccucuccauggccugccuagccaggcuggcacugccacucacacucggccccagggccc

SEQ ID NO: 489758 - RNA, 65 nt, hsa
gcccuggcugggagagcgggagcuggcagaggagccacugccaaacucaaggcuccucuggccca

SEQ ID NO: 489759 - RNA, 65 nt, hsa
agcucaucccaccccacaccccucccaggucugcucacugccaggcuccucuccccuuuguucag

SEQ ID NO: 489760 - RNA, 65 nt, hsa
aggcagguguguguucucuucugcauguuuuuaugcacugccaauuagcuucuacuaaccacggu

SEQ ID NO: 489761 - RNA, 65 nt, hsa
gcugacggguguggccacccgcugucacaauggcacacugccacugucccuuggcacgcacacag

SEQ ID NO: 489762 - RNA, 65 nt, hsa
cagggggcugagcagagcccauccaggacacuccacacugccaggacacacccaggcggcccgcc

SEQ ID NO: 489763 - RNA, 65 nt, hsa
ucaaucaaucaccucgacuuguuuuuuagcauggacacugccagcaggacagacagggauggagu

SEQ ID NO: 489764 - RNA, 65 nt, hsa
cacucccugccuuggugcguguagucccagugucucacugccaaaccucuugguuacgcugcggg

SEQ ID NO: 489765 - RNA, 65 nt, hsa
acaaaaguuauuguaaugaccucugaacagagaaacacugccauugaagaggcuucugguauaga

SEQ ID NO: 489766 - RNA, 65 nt, hsa
uugguacaguagaguuaacuuacuuuccauuuauccacugccaauauaaagaggaaacagggguu

SEQ ID NO: 489767 - RNA, 65 nt, hsa
cguccaggccaccucuaccuucuaaccauucucuccacugccagccuacccuccaccacuucaca

SEQ ID NO: 489768 - RNA, 65 nt, hsa
acuucugugggccccucaacagccaagugugaccccacugccaaguggggauggggccucccucc

SEQ ID NO: 489769 - RNA, 65 nt, hsa
cuucucaggcaagcuguauacuaguuacuggucuccacugccaugccuuuucaagguucccaugg

SEQ ID NO: 489770 - RNA, 65 nt, hsa
aaacuuguaaauccacacacaacucugagaauacccacugccagcaucaaaaagcaaagauacua

SEQ ID NO: 489771 - RNA, 65 nt, hsa
agcugcucagaaguacgaggcacuguauauggggacacugccagucaccaaggccaugggugagg

SEQ ID NO: 489772 - RNA, 65 nt, hsa
ucauuaguaagugggagguccacuggggcaacagacacugccacaauuucaguguuguguucagc

SEQ ID NO: 489773 - RNA, 65 nt, hsa
agccauccucccaaauagaugggacuacugaugcacacugccaugcuggccuuacgaaauguuuu

SEQ ID NO: 489774 - RNA, 65 nt, hsa
aggucagaggaucccacuuccugagcaugggccaucacugccagucaggggcugggggcugagcc

SEQ ID NO: 489775 - RNA, 65 nt, hsa
caugcucugaaauggcgugcccucugcccagguggcacugccaggugcguagacagacgguguca

SEQ ID NO: 489776 - RNA, 65 nt, hsa
gagaugccugcgccagccccgagcccacuggcagccacugccauuccacccauggucccucaccc

SEQ ID NO: 489777 - RNA, 65 nt, hsa
aaggaggaggagccggggacucccaggcuggagagcacugccaggacccaccacuggaagcagga

SEQ ID NO: 489778 - RNA, 65 nt, hsa
accucguucugcucagaggccuugcuguggagcuccacugccauguacccaguaggguuugacau

SEQ ID NO: 489779 - RNA, 65 nt, hsa
gcaauuuuguacaaaaauagcaauuaauuuguaaacacugccagaauacuuucuagcugcuuugu

SEQ ID NO: 489780 - RNA, 65 nt, hsa
uggcugcuaaacccuucuaauaauauaauaaauggcacugccacagccaacaugccugaaagauu

SEQ ID NO: 489781 - RNA, 65 nt, hsa
uaggcaccuuggucccagugucuuccuuuuguucucacugccaaacugccuguccugggaucuag

SEQ ID NO: 489782 - RNA, 65 nt, hsa
aacacuuaaauuggguuuucaacagucccagcuuucacugccagggucccagucagauuccagga

SEQ ID NO: 489783 - RNA, 65 nt, hsa
cuguaaggguguuucguucccuuuaaaugaaucaacacugccaccuucuguacgaguuuguuugu

SEQ ID NO: 489784 - RNA, 65 nt, hsa
uaauauuucuugcuuccuuguguucccacccuuggcacugccacccaccccucaauucaggcaac

SEQ ID NO: 489785 - RNA, 65 nt, hsa
aauauuucuuucuuccuuuuguuccuacccuuggccacugccagccaccccucaauucagguacc

SEQ ID NO: 489786 - RNA, 65 nt, hsa
aagauaaccacugcugcugauggauacuuuucccucacugccauggcacaccagucauggaucuu

SEQ ID NO: 489787 - RNA, 65 nt, hsa
ugcugcggaaacauagacgugggggcauaggcucccacugccaccaccgccaucgccucaccugc

SEQ ID NO: 489788 - RNA, 65 nt, hsa
aggggaguuuuggacaaaacagucacuggggagaucacugccauuuuuacacacuugacuuuuua

SEQ ID NO: 489789 - RNA, 52 nt, hsa
auggggaccuguccgacugagccacugccagccgcucuccugcccaccucuc

SEQ ID NO: 489790 - RNA, 65 nt, hsa
cugcccaguuucuuuuugaggggcuuuguuugggccacugccagcagcuguuucuggaaauggcu

SEQ ID NO: 489791 - RNA, 65 nt, hsa
ccaacuugcaagggguuccuucugguccucccauccacugccaccuuccauuuuguccaucucau

SEQ ID NO: 489792 - RNA, 65 nt, hsa
ccuccagauggcauucaugucuuacucagaaagggcacugccauuguccccaaggcuucugucua

SEQ ID NO: 489793 - RNA, 65 nt, hsa
cuuuucugaagaugaagaguuuaguuuuaaaacugcacugccaacaaguucacuucauauauaaa

SEQ ID NO: 489794 - RNA, 65 nt, hsa
uuaagauuaaauuaagacagagagagaauacauaucacugccaggccugauaggaaaaaucugcu

SEQ ID NO: 489795 - RNA, 65 nt, hsa
aagaagccgagguucagugguggcagcaggaaggacacugccacaaauuuugucuauuucauauu

SEQ ID NO: 489796 - RNA, 65 nt, hsa
gggcuccugucauugagggaagucguuacgccuuucacugccacaguuacagcucaagugcuuac

SEQ ID NO: 489797 - RNA, 57 nt, hsa
gugucuaugggacacucugagcugugccacugccacagggguauucugccuucagga

SEQ ID NO: 489798 - RNA, 57 nt, hsa
ucuuccagaaagcagagugagggcacucacugccauccuguggaagccaccaucauc

SEQ ID NO: 489799 - RNA, 65 nt, hsa
cuuucccuuuguagccgaucucuaggcccuucuugcacugccaccucacuuuccaccacugucag

SEQ ID NO: 489800 - RNA, 65 nt, hsa
ggcuggucuuacuuugcaucaccucugcuuuccuccacugccaucauuaaaccucagcugugaca

SEQ ID NO: 489801 - RNA, 65 nt, hsa
caugcuucuuuuccccaugccgcgccaguauuuuucacugccauaugcucuugucaaaacugcau

SEQ ID NO: 489802 - RNA, 65 nt, hsa
gguuuuucauauaaaaauauucugaauuuguuaagcacugccauaauaucauuauaauguuuuug

SEQ ID NO: 489803 - RNA, 65 nt, hsa
guuggaaaauccuaauggggauuccucugguuguucacugccaaaacuguggcauuuucauuaca

SEQ ID NO: 489804 - RNA, 65 nt, hsa
guaaccuguggcacugagaucgcacaccggucguccacugccaaguccguggccuccuucucugg

SEQ ID NO: 489805 - RNA, 62 nt, hsa
ccauccucgcaggccucugagccagccccgcccacugccagggacgccgagggccugaccag

SEQ ID NO: 489806 - RNA, 65 nt, hsa
uuuauuugcaaaauuccuaaaaggaaaaauuuuaucacugccaucacagcagguuuccucaucca

SEQ ID NO: 489807 - RNA, 65 nt, hsa
ugguuuucuugaucggugagaucugucucugaagucacugccagccucccugggaacgucuauag

SEQ ID NO: 489808 - RNA, 65 nt, hsa
cuuagcaugggauguguccaguauugaaaaggcugcacugccaaccaugauuugugagccuucug

SEQ ID NO: 489809 - RNA, 65 nt, hsa
agccaagcccugccuguggccaagcccugaguggccacugccaagcugcggggaaggguccugag

SEQ ID NO: 489810 - RNA, 65 nt, hsa
cacaccccuccggacauccagcgugacggagcccacacugccaccuuguggccgccugagacccu

SEQ ID NO: 489811 - RNA, 65 nt, hsa
ucgccacugcaccucggcauaugccaccuccaugccacugccagagcuggccuagcaagaugugc

SEQ ID NO: 489812 - RNA, 65 nt, hsa
auggaaguauuugagagagagaaccuuuccacucccacugccaggauuuuguauugccaucgggu

SEQ ID NO: 489813 - RNA, 65 nt, hsa
guuauuauugcuguuacucuggaugauauggaaaacacugccauauuuuaaaucaacuacuccac

SEQ ID NO: 489814 - RNA, 65 nt, hsa
ucaggguggggggcugggaccauggcccgcagaggcacugccacagcugugagggccaagaugcu

SEQ ID NO: 489815 - RNA, 65 nt, hsa
uggcugcaguccacuggugggacaagagcaaagcccacugccaguaagaaggccaaagggcccuu

SEQ ID NO: 489816 - RNA, 65 nt, hsa
cuuagcaugggauguguccaguauugaaaaggcugcacugccaaccaugauuugugaaccuucug

SEQ ID NO: 489817 - RNA, 65 nt, hsa
gagggacagcccagcucugagucucagucgcugaucacugccagggaggcucaggcugccauggc

SEQ ID NO: 489818 - RNA, 65 nt, hsa
aggccaaauccuuggagucccaggggcagccacaccacugccauuacccagugccgaggacaugc

SEQ ID NO: 489819 - RNA, 65 nt, hsa
gugucucucacugagggaaagaaaauccccaagggcacugccacugugcucggaggugcccugga

SEQ ID NO: 489820 - RNA, 65 nt, hsa
gaguuuuguuauaguuguuuucuaacccagcccuccacugccaaaggccaaaagcucagacaguu

SEQ ID NO: 489821 - RNA, 65 nt, hsa
cuugacccaagaacaaaggcuuguuguaugaguuccacugccagauuuaugggaugccuggauca

SEQ ID NO: 489822 - RNA, 65 nt, hsa
uccagccugaucuuggauugucaggcgucucucaacacugccagccaccugagaugcugaccagc

SEQ ID NO: 489823 - RNA, 65 nt, hsa
gaaggcacagacuacuuucaaccugccucgcccuucacugccaccccucccuucucccuugauaa

SEQ ID NO: 489824 - RNA, 65 nt, hsa
aguugguuuggcugugauuuugaccuccucuuccccacugccaucuucuaagagacuuuguagcu

SEQ ID NO: 489825 - RNA, 65 nt, hsa
aggaauaggaaauugaaccugggguuuugacuugccacugccauaacuuguuuguaaaagagcug

SEQ ID NO: 489826 - RNA, 65 nt, hsa
aaaaaaaaaauuaauuugguagugagagcuugugucacugccacucuguuuuaucccugaaauua

SEQ ID NO: 489827 - RNA, 65 nt, hsa
ucucagucuccucaguagcuggggcuuuaggugggcacugccacaccguacuaauuuuuguauuu

SEQ ID NO: 489828 - RNA, 65 nt, hsa
gcgcacguaggacugaauucagugauaucccuauacacugccauuuaguggauagguuauuguac

SEQ ID NO: 489829 - RNA, 65 nt, hsa
guauuucuguauguccuucuauccaaacagacguucacugccacuuguaaagugaaggauguaaa

SEQ ID NO: 489830 - RNA, 65 nt, hsa
ggucauagguuauguacacuuaaguuuuugacacucacugccaagucaucugucagaauucuaaa

SEQ ID NO: 489831 - RNA, 65 nt, hsa
guugagccacuucccuuugaaaagacacucaaaaucacugccaugguucaauguucccaggcccc

SEQ ID NO: 489832 - RNA, 65 nt, hsa
cgaacggggcucagcaccagagaccagggaguauucacugccauccauuggacguguuuggguca

SEQ ID NO: 489833 - RNA, 65 nt, hsa
cuugccacacuucccuuccugagcugaccugaccucacugccaccucuugcauugggauccugag

SEQ ID NO: 489834 - RNA, 65 nt, hsa
uccauguuugcuucugauaaauggaaauguagguucacugccacuucaugagauaucucugcuca

SEQ ID NO: 489835 - RNA, 65 nt, hsa
ucgaguccuucgcugaacccggauacuucuccaaucacugccaaagucaagcguaacgugucaga

SEQ ID NO: 489836 - RNA, 65 nt, hsa
aggagggcgagcugucuuucuaugacgcggagcgccacugccaccuguacaccuuccacgcccgc

SEQ ID NO: 489837 - RNA, 65 nt, hsa
gccuggccucccccugagucagugggacucccagacacugccaccacagcugaaauucucaugca

SEQ ID NO: 489838 - RNA, 65 nt, hsa
uucaguuaaguuuaccuggguauuuuguccugauucacugccaauugucacauuuuaagacuuuu

SEQ ID NO: 489839 - RNA, 65 nt, hsa
agagccugugagauuccuaccuuuguucugcuacccacugccagaugcugcaagcgagguccaag

SEQ ID NO: 489840 - RNA, 65 nt, hsa
ggcuccugacuggccuccuuuuccuuugacuggaccacugccaccucuugguagccaucgcuuuc

SEQ ID NO: 489841 - RNA, 65 nt, hsa
ggagauuggcuuugccuuuagcguguaaauggaagcacugccauuagacugaauuuaacuacuaa

SEQ ID NO: 489842 - RNA, 65 nt, hsa
gcugugauugauugcccuagccaauucacaaguuacacugccauucugauuuuaaaacuuacaau

SEQ ID NO: 489843 - RNA, 65 nt, hsa
ucuguuaaaagugggccuucuaucuuggaugguuucacugccaucagccaugcugauauauuaga

SEQ ID NO: 489844 - RNA, 65 nt, hsa
cacauucaagagaggcguccguggaugcugggucucacugccaaagccgaacacggcuucgggau

SEQ ID NO: 489845 - RNA, 65 nt, hsa
cagaggccugagcugcaccugagggccuggcuucucacugccaccucacacccgcugccagagcc

SEQ ID NO: 489846 - RNA, 65 nt, hsa
cccuccuuugaaacauccuuuacaggcucccuucucacugccacugcucuugccucuugugaugu

SEQ ID NO: 489847 - RNA, 65 nt, hsa
aaggaaauacuagugaaucacccacaaggaaaagccacugccacagaggaggcggguccccuugu

SEQ ID NO: 489848 - RNA, 65 nt, hsa
aaggugccaugaugggcuguucuaacccccacccccacugccagguaugggccagcaguuuccug

SEQ ID NO: 489849 - RNA, 65 nt, hsa
uacuaaugaaaacagaaugucucuuccugguagaccacugccauaugauuuacauuuccucacca

SEQ ID NO: 489850 - RNA, 65 nt, hsa
acucuggcuagaagcuaggggucccagugaagagccacugccauuaaagaauaugaaacauagau

SEQ ID NO: 489851 - RNA, 65 nt, hsa
augcuggcccggaaggcagaaagaggcagcaugggcacugccagggacagccacauccugcuggu

SEQ ID NO: 489852 - RNA, 65 nt, hsa
cgggaagugaagguugccgugagcugagaucacaccacugccauaaacaugacaggcuuuuggac

SEQ ID NO: 489853 - RNA, 65 nt, hsa
aggugacuggguggauguuguggucucuggagaagcacugccauucagccuccugcuccagcugu

SEQ ID NO: 489854 - RNA, 65 nt, hsa
cacagauggcugggaucccuccccuguacccuucucacugccaggagaacuacgugugaagguau

SEQ ID NO: 489855 - RNA, 65 nt, hsa
aagccugugcccccaucaucucacuccuuugccugcacugccaggguggggcccaccaagauucc

SEQ ID NO: 489856 - RNA, 65 nt, hsa
ccccgagacugcugaugucuguaaccacuggggagcacugccaaaaauacagcuuucugguuugu

SEQ ID NO: 489857 - RNA, 65 nt, hsa
guaccagguccccggccagcugggccccucccaggcacugccaggaagccccagcugccccuggc

SEQ ID NO: 489858 - RNA, 65 nt, hsa
guuccugaucaaagaaauugauaccuguuagcauucacugccaccauauuuuaaggagaaagaac

SEQ ID NO: 489859 - RNA, 65 nt, hsa
ccaccacacagcccagcagcccuucgugaauccugcacugccaccuggcuauagcuacacugguc

SEQ ID NO: 489860 - RNA, 65 nt, hsa
ccucacuuccccagccucaccuugcuguccucugacacugccaucagggcuguuaguggcaccug

SEQ ID NO: 489861 - RNA, 65 nt, hsa
cgucaggccggagccucagagccuugacacccaagcacugccacggaagucucccccuuugccaa

SEQ ID NO: 489862 - RNA, 65 nt, hsa
uugaacaaugcaacuuuuuauuuaaaaaagcucugcacugccauguaugaaagucucuuuaugau

SEQ ID NO: 489863 - RNA, 65 nt, hsa
ggcauuuuuaaaucccagacaguggauaugacccacacugccagaagagaauucaguauuuuuua

SEQ ID NO: 489864 - RNA, 65 nt, hsa
aaaaagaaagagagauauauguaauguacaacugacacugccauuuuuccuuuuuggaggaaaug

SEQ ID NO: 489865 - RNA, 65 nt, hsa
gccuccaggaucagcaccuugaagaagugugugggcacugccacgugguucuugccgaugaccug

SEQ ID NO: 489866 - RNA, 65 nt, hsa
caggcuguuguaacacuuuaagggccccaggucuccacugccaagcaggacuuggcacaugagca

SEQ ID NO: 489867 - RNA, 65 nt, hsa
cuguacacuucccugacaccuucccaggugugggucacugccaccugugcccaugggcaccccag

SEQ ID NO: 489868 - RNA, 65 nt, hsa
aggcauguguagaaggcaauuuaucaaaccuauugcacugccaugaaaaguguguauaauaauuu

SEQ ID NO: 489869 - RNA, 53 nt, hsa
cgaacaguguggccaucugagcacacugccagucucacugugggaaggccagc

SEQ ID NO: 489870 - RNA, 65 nt, hsa
gugggcggggaggcuagauuguuuccugguacugucacugccacuggggcuuugauuuggaggaa

SEQ ID NO: 489871 - RNA, 65 nt, hsa
ugucacuggcauaggaaggccagccccgcaucucccacugccaacagcugaagccgagcacagac

SEQ ID NO: 489872 - RNA, 65 nt, hsa
caacagggcaaagauaccaggccugcugcugaggucacugccacuucucacaugcugcuuaaggg

SEQ ID NO: 489873 - RNA, 65 nt, hsa
uuacuacccacuucauuccccaccgcugccagugccacugccaacccuguucacaggcgcuucca

SEQ ID NO: 489874 - RNA, 65 nt, hsa
gaaucuucucuauaauaagggaaguucucuuaccccacugccacauaccucuguuuuaaaagaua

SEQ ID NO: 489875 - RNA, 65 nt, hsa
aaauaaucuuacucuagauaccuaaaacauaagaucacugccagagauaaacuaaugguccacac

SEQ ID NO: 489876 - RNA, 65 nt, hsa
ccuugcuuugggaaacuaaaagauuuagaccaagucacugccaguuuuugccuuuguugcauuuu

SEQ ID NO: 489877 - RNA, 65 nt, hsa
acagagagcugauugugaaacaucuacuagcacaccacugccagacaugacugugugugucccug

SEQ ID NO: 489878 - RNA, 65 nt, hsa
uggguagaaaacacaagugagaaacccuagaugggcacugccaccugacacagcuauacagcagg

SEQ ID NO: 489879 - RNA, 65 nt, hsa
gccccucaagagaagggcugaaccuggggagaugucacugccagggugagguggagccacauggc

SEQ ID NO: 489880 - RNA, 65 nt, hsa
cauucucagcagacuccaguauuggcacagucacucacugccauucucacacuauaacaagaaaa

SEQ ID NO: 489881 - RNA, 65 nt, hsa
auguaaaauuuguuaagaaggaaguacccacagaucacugccaucaacuccccagaaguugcacu

SEQ ID NO: 489882 - RNA, 65 nt, hsa
cuccaguacugacuuguggggaaagcauacuuuuucacugccagguacugaaugcagaggcucag

SEQ ID NO: 489883 - RNA, 65 nt, hsa
uaugccaaccuccuggcagcccagggcagccuggccacugccaugagcuuucuacccagggacug

SEQ ID NO: 489884 - RNA, 65 nt, hsa
agaucuccccacuacauuaaucccgugcuccuccucacugccauuauaguuuauuguguggucau

SEQ ID NO: 489885 - RNA, 65 nt, hsa
ccaagcacuucuuuuucucgcuguccuuucuagagcacugccaccaguagguuauuuagcuuggg

SEQ ID NO: 489886 - RNA, 65 nt, hsa
gccacaggaggcagcgcccugcagccucccguccacacugccagcaaugccccuggcccagugag

SEQ ID NO: 489887 - RNA, 65 nt, hsa
cugagagggagauggcccagccugaccccacuggccacugccauccugcugccuucccagugggg

SEQ ID NO: 489888 - RNA, 65 nt, hsa
acagcacagucagcucugcagaguuuggaggggcucacugccacuggguacucagaaccucugug

SEQ ID NO: 489889 - RNA, 65 nt, hsa
ccuggaggcaacuguuuugauccauuucuuacacacacugccagagauacucuaggcauguaaag

SEQ ID NO: 489890 - RNA, 65 nt, hsa
guuagugugaaauaguucugccaccucugacgcaccacugccaaugcuguacguacugcauuugc

SEQ ID NO: 489891 - RNA, 65 nt, hsa
cuccaaucuugguccguauuuccaaagcuuguaaacacugccaucuucaaauuuaaauguaauuu

SEQ ID NO: 489892 - RNA, 65 nt, hsa
ucccaaaugggucucuuuagaacuugauggcugggcacugccaucucuagaauugccacgagucu

SEQ ID NO: 489893 - RNA, 65 nt, hsa
ccaggaguggccugugccucccaccucuuccuucccacugccaaaggccuguguugagaaagaug

SEQ ID NO: 489894 - RNA, 65 nt, hsa
cccucagccccagucgagaggaaagagaaucgggccacugccagaaagagagucaagcaaaccug

SEQ ID NO: 489895 - RNA, 65 nt, hsa
ugcggccaggggacgagcgccuuccuugcccaccucacugccacauuccagugggacggccacgg

SEQ ID NO: 489896 - RNA, 65 nt, hsa
acgagcuggccuugccaacccucugcuugacuccgcacugccacuuguccccccacacccgucca

SEQ ID NO: 489897 - RNA, 65 nt, hsa
agggagugggccauucccugggacucucgcuccugcacugccagccccuucuccucuccccaggg

SEQ ID NO: 489898 - RNA, 65 nt, hsa
cugaggcccugucucccagccacuuucccuccuggcacugccaccagccucaccgccugcgggca

SEQ ID NO: 489899 - RNA, 65 nt, hsa
agggucugccucucacucgcccaggucccgaaggacacugccacagggacgccuucccuccccuc

SEQ ID NO: 489900 - RNA, 65 nt, hsa
ccaauugcuuccccucugugaucucauuucaucugcacugccauacguggagugagcaagacagg

SEQ ID NO: 489901 - RNA, 65 nt, hsa
aaagugagcugagcaggacaggcccagccuuucuccacugccacgucccucaugcacaucacuca

SEQ ID NO: 489902 - RNA, 65 nt, hsa
caaaagcagucuaucugccugugaccuccaauguacacugccaaacacaagaguaggacacaucu

SEQ ID NO: 489903 - RNA, 65 nt, hsa
uaccuagcuaggucaccaacgugaagaaguuaugccacugccacuuuugcuugcccuccuggcug

SEQ ID NO: 489904 - RNA, 65 nt, hsa
cacaagcacaaccacgggcauaaguuggccuuggccacugccacccacggcccuccuuuugugcu

SEQ ID NO: 489905 - RNA, 65 nt, hsa
auggggauggaguggugagaauugaaugguuaaugcacugccauucauaauugccaauugaggac

SEQ ID NO: 489906 - RNA, 65 nt, hsa
uggugggaggcagcgggcagaaauuuacuguuggccacugccaggucuauuucauauuucaaagg

SEQ ID NO: 489907 - RNA, 65 nt, hsa
caggacacuccgggggagaauguggaacccagccacacugccaccgccacacuagugcugaacgu

SEQ ID NO: 489908 - RNA, 65 nt, hsa
gcagcacugugcaugauuccgagagggugugguggcacugccagccgacugcugacagcuuggga

SEQ ID NO: 489909 - RNA, 64 nt, hsa
aaggauccacugacuauugauggcuuucucuggacacugccacucuccccauuggcaccgcuuc

SEQ ID NO: 489910 - RNA, 65 nt, hsa
cuacuuugaucacuuaacuuauagaccuuuuuugacacugccagucucacuuguggccuauuucu

SEQ ID NO: 489911 - RNA, 65 nt, hsa
guuuuuugaacagugugcuaaaucaauagcaaacccacugccauauuaguuauucugaauauacu

SEQ ID NO: 489912 - RNA, 65 nt, hsa
gccucugagagguuaagucacucacccaaaauuuccacugccaggaagugguagugaugggauuc

SEQ ID NO: 489913 - RNA, 65 nt, hsa
cguggccaguaaaugauccagccagcugccagggccacugccaugacccagcugcucaugaguga

SEQ ID NO: 489914 - RNA, 65 nt, hsa
uugcugcuguggcuuuuuugccuucuccaaagacgcacugccaggucccaagcuucagacugcug

SEQ ID NO: 489915 - RNA, 65 nt, hsa
aguugugguguccagugugcagcagcccugggagccacugccaccuucagagggguuccuugcug

SEQ ID NO: 489916 - RNA, 65 nt, hsa
cagguggugguaccugguugggggaggggggcgugcacugccaugucuuuuuuuuuuuuuuuuuu

SEQ ID NO: 489917 - RNA, 65 nt, hsa
aggaguauuaugucugagcccccggcacugcgccccacugccagcugccccuccugggagggccc

SEQ ID NO: 489918 - RNA, 65 nt, hsa
cacuuuacccaccuagaacacuaacucaccagccccacugccagcagcagcaggugauuggacca

SEQ ID NO: 489919 - RNA, 65 nt, hsa
uuagagguccucuggagcccuaaccccuuccagaucacugccacacucuccaucacccucuuccu

SEQ ID NO: 489920 - RNA, 65 nt, hsa
agcagagcuaggacuuccgcccuaaggcugugccucacugccaccaggcacagccgccuccggaa

SEQ ID NO: 489921 - RNA, 65 nt, hsa
aacagaaguagaagaggaggagggauucuggucuucacugccaugccucaagaacaccuuuguuu

SEQ ID NO: 489922 - RNA, 65 nt, hsa
cuaguuuagaguuagcagacuacccaaaucuggcccacugccaauaaagucucauuggaacacag

SEQ ID NO: 489923 - RNA, 65 nt, hsa
cagaugcacauguuggaggagagagccuugggagccacugccacuccaguccugccaccacccug

SEQ ID NO: 489924 - RNA, 65 nt, hsa
cccuucuucccugggcuuuagaccuuuguccccgucacugccagcgcuugggcugaaggaagcuc

SEQ ID NO: 489925 - RNA, 65 nt, hsa
aacucaucagcucaguaccuaacugccaaucaacacacugccaaugcgggugggcuaagccgcca

SEQ ID NO: 489926 - RNA, 65 nt, hsa
aaaaaaaaaaaaggcaauugugcggagccaaccaucacugccauuacacucacauucaauggaaa

SEQ ID NO: 489927 - RNA, 65 nt, hsa
ccacuugauuuagccauuuucuuccauugugagaccacugccaucuauccaccugcccaccuccc

SEQ ID NO: 489928 - RNA, 65 nt, hsa
guggccgccuccugagaguuggcccucccuugugccacugccaggggaggaaaggccuugauguu

SEQ ID NO: 489929 - RNA, 65 nt, hsa
gggauggaauauaagucagugugaaacugaguauacacugccauguuacaucaguguccauuggc

SEQ ID NO: 489930 - RNA, 65 nt, hsa
gggacugcuuuggcauccagggccuccagucaccucacugccauacauuagaaaugagacaauca

SEQ ID NO: 489931 - RNA, 65 nt, hsa
uucugacaaaauuagcuguuuugaauuacccauaucacugccaguuuuauuuuaaaauauuuugu

SEQ ID NO: 489932 - RNA, 65 nt, hsa
cacuuuuauuaacaaaaguaaacauggacagaacacacugccauuucugggaagaguaaagauga

SEQ ID NO: 489933 - RNA, 65 nt, hsa
aaaaauguuucaaaagaaagguauuuucacuaaaccacugccaguauaaaagcacccugucaagg

SEQ ID NO: 489934 - RNA, 65 nt, hsa
ugugagggccuggacgggagaugccagccaucacucacugccaccugggccaucaacugugaauu

SEQ ID NO: 489935 - RNA, 65 nt, hsa
cuugccuuagugaucaugauuacacaaaagaggugcacugccaauaaguaucucuaauucaauag

SEQ ID NO: 489936 - RNA, 65 nt, hsa
cagccaccagucucuacuaaaagacagaaacaauacacugccaaaauguuaaguugaccaccgug

SEQ ID NO: 489937 - RNA, 65 nt, hsa
uauuucuguauuaucugacauagaacaguauccuccacugccaagacagccugaguuuggagugg

SEQ ID NO: 489938 - RNA, 65 nt, hsa
uuccuaucccaucgaaauuccccaaagcccugggccacugccauuggguuagucaagaugaagga

SEQ ID NO: 489939 - RNA, 65 nt, hsa
guucgcagccacccugaggagucugagguccugagcacugccaggagggacaaaggagccuguga

SEQ ID NO: 489940 - RNA, 65 nt, hsa
aacaacagcuucuucccagucacuuuuuuuuuucucacugccaucacauacuaaccuuauacuuu

SEQ ID NO: 489941 - RNA, 65 nt, hsa
agccaggaacagagaagagauuacaccagcgguaacacugccaacugagacuaaaggaaacaaac

SEQ ID NO: 489942 - RNA, 65 nt, hsa
cccuccucccuguccacagcugggucccucuucaacacugccacauuuccuuauugaugcaucuu

SEQ ID NO: 489943 - RNA, 65 nt, hsa
cagucuuuuaucaaguuuugacgguuuaugcugggcacugccagacugaaccagagcuggaacac

SEQ ID NO: 489944 - RNA, 65 nt, hsa
uagcacauggagauaaucaucugaaaguuauagggcacugccacugcugaaucagagcaugccca

SEQ ID NO: 489945 - RNA, 65 nt, hsa
gaccuccagcugggggugggaaggaaaaaacuggacacugccaucugcugccuaggccuggaggg

SEQ ID NO: 489946 - RNA, 65 nt, hsa
aggaugguaccaucgaggacaucaucacaggccuccacugccagccuaugguuguucgccaccaa

SEQ ID NO: 489947 - RNA, 65 nt, hsa
gggaggcaagauuucugguuucugguuccuagccucacugccagcgggcuccugcuauuagguga

SEQ ID NO: 489948 - RNA, 65 nt, hsa
cacuuuguccauuucccguggcauccggcugcagccacugccaugacagcaccugucauuuugcc

SEQ ID NO: 489949 - RNA, 65 nt, hsa
caugacuaccccuggcuccucucaccuugucccuccacugccaacagaaaacaaagcagcugacu

SEQ ID NO: 489950 - RNA, 65 nt, hsa
ccuggauauuguauuguaauuuaaugugcuuaccacacugccacauuuuaaugagucagagaaaa

SEQ ID NO: 489951 - RNA, 65 nt, hsa
gaguaaaugcaauucaaaaauuguauaaaaaugaacacugccaagauaaagccaaccagacccuu

SEQ ID NO: 489952 - RNA, 65 nt, hsa
aaaagggugugugagaaagccuacugaagcagcagcacugccacuacauguggacaaaagugacc

SEQ ID NO: 489953 - RNA, 65 nt, hsa
gucaaaaaucccccaaggaggaaagcugaaagaugcacugccauauuaucuuucuuaacuuuuuc

SEQ ID NO: 489954 - RNA, 65 nt, hsa
aaggaagauggagcucccccaucccacacgcacugcacugccauugucuuuugguugccaugguc

SEQ ID NO: 489955 - RNA, 65 nt, hsa
uauuggugugguccuagggagggcggaaagggaggcacugccauuuggagacauuccauuucaga

SEQ ID NO: 489956 - RNA, 65 nt, hsa
aguugucacugcugcucccuccugcuaugaaacgacacugccagugccagcaguguccuugggaa

SEQ ID NO: 489957 - RNA, 65 nt, hsa
gugugugugugugugugugugagagagagcccucccacugccagcucagguuguucacagauuug

SEQ ID NO: 489958 - RNA, 65 nt, hsa
guggccuggcuggcguggcagggccaaggcccacccacugccaucccccuucugugugucccucu

SEQ ID NO: 489959 - RNA, 65 nt, hsa
ugcucuggagagguagggccagaggaaugcugcugcacugccaacucaggcacaugcuuagcugu

SEQ ID NO: 489960 - RNA, 65 nt, hsa
ugaacaacacaaccggaagcgggauuccaagcuggcacugccacuguggagggcgcugaaacuuc

SEQ ID NO: 489961 - RNA, 65 nt, hsa
aauacugaggggagggugugguggguucuccacuccacugccacccccagcguggcugcuuucaa

SEQ ID NO: 489962 - RNA, 65 nt, hsa
cagaagcucaaggcugcagugagccaaguucacaccacugccauuuccuccugggcaacagagug

SEQ ID NO: 489963 - RNA, 65 nt, hsa
ccucucaagguggacuauucuguuuucugccaggacacugccauucaugcauugucagauauuua

SEQ ID NO: 489964 - RNA, 65 nt, hsa
uugucugcacauaacucuuuuuucacaagaagggucacugccacaacagcacagucagcggguga

SEQ ID NO: 489965 - RNA, 65 nt, hsa
cucugagcccucccaacacagcacacuagucagcccacugccacgaccucccugccagccagaag

SEQ ID NO: 489966 - RNA, 65 nt, hsa
acuuugccccuuucaguauguccccauaagacaaacacugccauauuguguaauuuaagugacac

SEQ ID NO: 489967 - RNA, 65 nt, hsa
ugucaucccucacgucucuguggccacccgggugucacugccagcaccaggcacugcuuucacgu

SEQ ID NO: 489968 - RNA, 65 nt, hsa
gcugagcagagagggagccguucaugucagagacucacugccagaaaagccuuacccauuuuggu

SEQ ID NO: 489969 - RNA, 65 nt, hsa
gaaggaacucaaagacucaagugggaacgacugggcacugccaccaccagaaagcuguucgacga

SEQ ID NO: 489970 - RNA, 65 nt, hsa
aacaagauuugcuuggacagaaagagggucugcaucacugccaucagaaagguuacugauaugac

SEQ ID NO: 489971 - RNA, 65 nt, hsa
gauuuguuagcuuuaaaguuaguuuaagacuuuuacacugccaguauuccacauuuggugaaauu

SEQ ID NO: 489972 - RNA, 65 nt, hsa
gugaacugcuaauaguguaaguacgugcacaaaaccacugccagauaaccagaggggccugggaa

SEQ ID NO: 489973 - RNA, 65 nt, hsa
cccguggccauccgcugugacugcggagccugcuccacugccaccacggagugugagaccaucug

SEQ ID NO: 489974 - RNA, 65 nt, hsa
uaugcuacuauacauugauuuacugccuguuuuuacacugccauuaccuuucauguuauccauga

SEQ ID NO: 489975 - RNA, 65 nt, hsa
uugcuauaugcacuggguauaauccguaauccauacacugccagauaaugccauuucaaggaagg

SEQ ID NO: 489976 - RNA, 65 nt, hsa
uaaagguguaauugacuaggaaggauguaguucuacacugccauuuaccuauuuaaauucauccu

SEQ ID NO: 489977 - RNA, 65 nt, hsa
ucagcaguugacauccaaaucuagccagagcccuucacugccaugauagcuggggcuucaccagu

SEQ ID NO: 489978 - RNA, 65 nt, hsa
ugcugggauuacaggcguaagccacugcgcccagccacugccaucaucuuuaggaagagagaagu

SEQ ID NO: 489979 - RNA, 65 nt, hsa
guccagccuggagaugaaaucuuacagcuggguggcacugccaugcagggccucacacgguuuga

SEQ ID NO: 489980 - RNA, 65 nt, hsa
agcagcugucuggcccuugcugggugagggcacaccacugccaggggucagccucgcacccaggc

SEQ ID NO: 489981 - RNA, 65 nt, hsa
ugguuuucaggaugcugacagcugcaagcaacaggcacugccaaauucagggaacagugguggcc

SEQ ID NO: 489982 - RNA, 65 nt, hsa
uuggaggccccaggauugguccugagguacagagccacugccaccacuggcggccugggaccagc

SEQ ID NO: 489983 - RNA, 65 nt, hsa
aaauaagccugagagaccaucuuuagcagccucagcacugccaggccugcccugaaacuccagau

SEQ ID NO: 489984 - RNA, 65 nt, hsa
cacagcuacaugggcagcugaaggagcaaagggugcacugccagcgccugucuuacccgguggcc

SEQ ID NO: 489985 - RNA, 65 nt, hsa
ugccagagacgaguaugcccaugcucccucuaccucacugccaccacuccugcuguuaggagcug

SEQ ID NO: 489986 - RNA, 65 nt, hsa
uaaaacacuagccaaacucuaauuaauucucaaaucacugccaggaguucuugcuccuggcugca

SEQ ID NO: 489987 - RNA, 65 nt, hsa
auccugggcucacugccccccacaggcacuguggccacugccagcacugggguggcagccugcca

SEQ ID NO: 489988 - RNA, 65 nt, hsa
cuccaggccacuuguguguguauguguguguguaccacugccaucugaacaaacuaugcaauacc

SEQ ID NO: 489989 - RNA, 65 nt, hsa
aaacaagcggaacauagauaauggacaaugcuggccacugccauucuguguucagaaagacuaug

SEQ ID NO: 489990 - RNA, 65 nt, hsa
cagggaggcgccccgggugggcuuuggggcugcggcacugccacacauccuuucccuccuggccu

SEQ ID NO: 489991 - RNA, 65 nt, hsa
guguugugaaugaugagcugccuccauagggaacccacugccaccugggccagcuucuggagcau

SEQ ID NO: 489992 - RNA, 65 nt, hsa
ggucugagccuaccugagcccaugcagccuggggccacugccaagucaggcccugguucucuucu

SEQ ID NO: 489993 - RNA, 65 nt, hsa
caccccguucugcucccacaaggccccccuacagucacugccacacugguggggaccugggaccc

SEQ ID NO: 489994 - RNA, 65 nt, hsa
cucuuccaaagccccaaagccgaggguuucacccacacugccagccuggguuggggcccaaggau

SEQ ID NO: 489995 - RNA, 65 nt, hsa
agagaaaaugccugcuuucuuucccucuuuuucugcacugccauauucacccccaaccauccaau

SEQ ID NO: 489996 - RNA, 65 nt, hsa
gucugugaaugcuaaguccaucacccuuuccggcacacugccaaauaaacagcuauuuaaggggg

SEQ ID NO: 489997 - RNA, 65 nt, hsa
ugaccugugaaccccagccucaccaucacccccagcacugccagggacugcccugucugcugugc

SEQ ID NO: 489998 - RNA, 65 nt, hsa
ccuguggcugucacccuuggucaccuccgugcugucacugccaucuccccccugaccccucuaac

SEQ ID NO: 489999 - RNA, 65 nt, hsa
uccagccaaugccuguuuacacagacaccuggccucacugccagcccaccuccccuacagcccug

SEQ ID NO: 490000 - RNA, 65 nt, hsa
uuaccucuucugcaggcucugccaugcacgcaccucacugccaggccauuaaaaucagcacccag

SEQ ID NO: 490001 - RNA, 65 nt, hsa
ucccugagcugcaccucuugcuaaccccaccaucacacugccacccugcccuagggucucacuag

SEQ ID NO: 490002 - RNA, 65 nt, hsa
cauguaucacauucauauauauuguuucuuggccccacugccaaaggaagucagucaguaauuuc

SEQ ID NO: 490003 - RNA, 65 nt, hsa
uucaucgucaggccacgugugacuucuguucuuagcacugccagggucauugacuuccaucuaag

SEQ ID NO: 490004 - RNA, 65 nt, hsa
ucccuugccaaguugguagcagugacccagugauucacugccaucccaggccuuaacuagcaaaa

SEQ ID NO: 490005 - RNA, 65 nt, hsa
ccagagacuguguguuuuguuucccccaccaccaucacugccaccuggcuucugccauguggcag

SEQ ID NO: 490006 - RNA, 65 nt, hsa
cucuuacacugaauguacaggcagugggcuugcagcacugccaucuugccauguacaggcuuggg

SEQ ID NO: 490007 - RNA, 65 nt, hsa
ucucuuuauugaguucgaggacuacaaccaauuuacacugccaucugaugccgugauccugagcc

SEQ ID NO: 490008 - RNA, 65 nt, hsa
ccugagaucacaugcuaaagucgaugaaaaguaaccacugccacugucuugugucagaacuuuua

SEQ ID NO: 490009 - RNA, 65 nt, hsa
cggcccucaccgccucgaagccaugccccagaugccacugccacagcgggcgcucgcuccucccu

SEQ ID NO: 490010 - RNA, 65 nt, hsa
cugccgagaagcccgugcccccgggagggcugccgcacugccaaagagucucccuccuccugggg

SEQ ID NO: 490011 - RNA, 65 nt, hsa
aaucaucucuauugcuuggugucauuuauaggaagcacugccaguuaaagagcauuagaagaggu

SEQ ID NO: 490012 - RNA, 65 nt, hsa
ccauccacggagugagcuggggcugaaguuguccccacugccauacucaguccaugucaccccac

SEQ ID NO: 490013 - RNA, 65 nt, hsa
aguggauggaauccuugguccccuaggccagacuucacugccacugugccagacagcucccugca

SEQ ID NO: 490014 - RNA, 65 nt, hsa
caaacacaagaaaucaaaauccaaaauuuguuugucacugccaaaguauuuuuuucacuguuuca

SEQ ID NO: 490015 - RNA, 65 nt, hsa
cacgccagacuucccacggcuccucgagaucccaacacugccagcauuucccuuccuuccucucc

SEQ ID NO: 490016 - RNA, 65 nt, hsa
acucugcuccccucucacacaucugggaguagccccacugccaccugcagccgcagccuggacug

SEQ ID NO: 490017 - RNA, 65 nt, hsa
ugugggcccugggugggagcagcccacuucagcagcacugccacugccuuuggccaccugaggug

SEQ ID NO: 490018 - RNA, 65 nt, hsa
auggcuggcagggucuuccaaguaccuuccucccacacugccaaguauacacaacuucccaguaa

SEQ ID NO: 490019 - RNA, 65 nt, hsa
ccucaauuuagccuuagugaaggagggguuguacacacugccauuuuuguauuuuaaaggaaaaa

SEQ ID NO: 490020 - RNA, 50 nt, hsa
uuuaugccuacuucgccugacacugccauccuggacagaaaggcaggagc

SEQ ID NO: 490021 - RNA, 65 nt, hsa
cuguugcccacugcacugaucaugaagccaccggccacugccacgcauguugcaccugugccauc

SEQ ID NO: 490022 - RNA, 65 nt, hsa
agugauaaaacacuguggugugaaagugucaucuucacugccaaucaggcaaagaccggaaagau

SEQ ID NO: 490023 - RNA, 65 nt, hsa
ccccccaggccuccagaaccuuacuggcacuguggcacugccaccagcaaugcccugccuugcug

SEQ ID NO: 490024 - RNA, 65 nt, hsa
aagcacuaggccuacugcccagcaagccagucuggcacugccaggaccuccuguggcacccuuca

SEQ ID NO: 490025 - RNA, 65 nt, hsa
acuugauacuaagugauuaguuuuccaaguugucccacugccauucaaagucagcccuugagugu

SEQ ID NO: 490026 - RNA, 65 nt, hsa
cuuuggcauuuaauguuccucuccuggcaaaaauucacugccacagacaaaccacccccacuccu

SEQ ID NO: 490027 - RNA, 65 nt, hsa
gugacaccguucccuccaaaagcagaccucggaaucacugccaaauaaguaacuagacguuuaca

SEQ ID NO: 490028 - RNA, 65 nt, hsa
cuucaccugcucuaggccagcccugucaccaccuccacugccaugaccaggccgaaggcagggaa

SEQ ID NO: 490029 - RNA, 65 nt, hsa
agccccgccugccucagcgggucaggccuucagaacacugccacccacccaguuuuauaaucccg

SEQ ID NO: 490030 - RNA, 65 nt, hsa
cuugccuuagauuuuacacacacuccacagccaagcacugccacgguccuccaggaccugggaag

SEQ ID NO: 490031 - RNA, 65 nt, hsa
acucuccgcugaggacccagggcgucagcacccagcacugccacauguccaccaaggaacagaau

SEQ ID NO: 490032 - RNA, 65 nt, hsa
aaaugauucucuaccaacaauaaaccaaacccagccacugccaagcuuccugugcccucacccca

SEQ ID NO: 490033 - RNA, 65 nt, hsa
guuuuuggggccaagauggcugcccuagcagcaaucacugccaagggcaagaucauggcuuuugg

SEQ ID NO: 490034 - RNA, 65 nt, hsa
acugcccccccugaauuuaggguggggguacuagucacugccaauguguguaugggacuugcugg

SEQ ID NO: 490035 - RNA, 65 nt, hsa
cuaagccagacccggcuccccuacaccugaaguuacacugccagcaguuccccaggccucuuccg

SEQ ID NO: 490036 - RNA, 65 nt, hsa
ccaccuccuccucuuccucuccuuuaccccacuuucacugccacuuucaucagguuugugucuca

SEQ ID NO: 490037 - RNA, 65 nt, hsa
uuggggccugcgcccgugaaacuggugccagggagcacugccagcuugccaguuucugcccagca

SEQ ID NO: 490038 - RNA, 65 nt, hsa
uggaacuguccaagaacgaaccugccaucacaucucacugccagauguauaaagcaccugcaugc

SEQ ID NO: 490039 - RNA, 65 nt, hsa
ugcaacacugaagacagaaagaagaagccucuggacacugccagagauggggguugagccucugg

SEQ ID NO: 490040 - RNA, 65 nt, hsa
uggaugagaaacugaagguguccccaggccuacaccacugccaugcccgaacacuauccaugcua

SEQ ID NO: 490041 - RNA, 65 nt, hsa
uggagcugggguuucucuccuccccagucccacaacacugccaaaaaucuguguaugugccauug

SEQ ID NO: 490042 - RNA, 65 nt, hsa
gcaggcccuaagucuggcuucagcacagaggcgugcacugccagggaggugggcauucauggggu

SEQ ID NO: 490043 - RNA, 65 nt, hsa
gccccugggacugcugcuucuuaaccccaguaagccacugccacacgucugacccucuccacccc

SEQ ID NO: 490044 - RNA, 65 nt, hsa
gucuaugggcccacccagugccuuuccuuggcccucacugccagugccaaaccgccccucagcag

SEQ ID NO: 490045 - RNA, 65 nt, hsa
ggcuccugagcccacccccuuggggcacaaccugccacugccacaguagcucaaccaagcaguug

SEQ ID NO: 490046 - RNA, 65 nt, hsa
ggcccggugauccuccagccacaguccagcccaaccacugccacuuuccaugggacuuagaacuu

SEQ ID NO: 490047 - RNA, 65 nt, hsa
uuaaccucagggagugcagacaccuaaccccagggcacugccagcccacccccuuugacucuggg

SEQ ID NO: 490048 - RNA, 65 nt, hsa
ccuccuccucugguagagcacucuugcgaugcugacacugccaaccuccaguauccucacccucg

SEQ ID NO: 490049 - RNA, 65 nt, hsa
guacaggcagaagcuuuggccagcaccgucacucucacugccauugccgagaguccuguuauuga

SEQ ID NO: 490050 - RNA, 65 nt, hsa
uuucuuuccagaacaacucuuucccaccccaacaccacugccaccaccccucuuuuuauccuggu

SEQ ID NO: 490051 - RNA, 65 nt, hsa
cagcccucuuccauccgcccggcucugcccaccaccacugccaggcugaacaggggacuagugcc

SEQ ID NO: 490052 - RNA, 65 nt, hsa
ggaagagccuugugcucuccacuuugccacaguaccacugccaccaugcugcucacuuaugucau

SEQ ID NO: 490053 - RNA, 65 nt, hsa
agacgauucauacacuuccagugcugccuucuuuacacugccaguuuugacaaaacagguuuguu

SEQ ID NO: 490054 - RNA, 65 nt, hsa
cgccguggcugcggcacccuugcgcuuuugcuggucacugccauggaggcacacagcugcagaga

SEQ ID NO: 490055 - RNA, 65 nt, hsa
aaaacaaaacaaaaacaaaacaaaacaaaacaaaacacugccaaacuguuuccaaagcaucugca

SEQ ID NO: 490056 - RNA, 65 nt, hsa
gaccugaccaagcuguaggccuccacuggccccaucacugccaacugcagggggccccucgggcc

SEQ ID NO: 490057 - RNA, 65 nt, hsa
cugcugcccuucgauccuuccacacauggccaggacacugccacaauccucgggguguggucaag

SEQ ID NO: 490058 - RNA, 65 nt, hsa
uccaccugguacucccucucaggauccaagcuaagcacugccacuggggaaaacuccaccuuccc

SEQ ID NO: 490059 - RNA, 65 nt, hsa
uggcuccuccgucugacccucugcggccacugcgccacugccaucggacaggaggauuccuugug

SEQ ID NO: 490060 - RNA, 65 nt, hsa
aaaagcagcccagucccccucacugcuugagcuaacacugccaccucuuuugugugagcacaaaa

SEQ ID NO: 490061 - RNA, 65 nt, hsa
ccucacauguuuccugggcaccuaacucugucagccacugccagggaccaaggauccagcaucca

SEQ ID NO: 490062 - RNA, 65 nt, hsa
ugauuccccucccgccccgcacagagaccccgacucacugccagccggggcggggcagggugccg

SEQ ID NO: 490063 - RNA, 65 nt, hsa
uuuguaacugucuagagcucuugauggaauuauaucacugccagugccuguggcggaagccaucu

SEQ ID NO: 490064 - RNA, 65 nt, hsa
ucuaaaccugcccagggaccuuaccagauucgugucacugccaguuucugcggcugaagccuuuu

SEQ ID NO: 490065 - RNA, 65 nt, hsa
uucuaaucugccgaggccuauagccugauuuaugucacugccaauuucugaggcugaagccauuu

SEQ ID NO: 490066 - RNA, 65 nt, hsa
ggaaguggcuuagagaauguaacugaccaaagucacacugccaggaacuggaagcacuaggauuu

SEQ ID NO: 490067 - RNA, 65 nt, hsa
gacaggugggguccuaaugagagccaacacaugcucacugccagcuccuguccugaguacuggga

SEQ ID NO: 490068 - RNA, 65 nt, hsa
ucgggacuuggucgcccggcgcugccagaaugcuccacugccagccggccccccugccucgguuu

SEQ ID NO: 490069 - RNA, 65 nt, hsa
uuggucaucucugacaucuccugcaucgcagaggccacugccagccccccuuuucccccaugguc

SEQ ID NO: 490070 - RNA, 65 nt, hsa
cggccaccccggcccugugccugcucggaagagcucacugccagcugcggccugggcaccgcggg

SEQ ID NO: 490071 - RNA, 65 nt, hsa
caugugacuuaccugggauuucacuugccgggcuucacugccaggagccuccccugcuggggacc

SEQ ID NO: 490072 - RNA, 65 nt, hsa
gggcuugaggggcugacaacaggaaguaccaucaucacugccagagcucaagaucccacacccga

SEQ ID NO: 490073 - RNA, 65 nt, hsa
ccagugcucagaccuuuagacucauuguaaguugccacugccaacaugagaccaaagugugugac

SEQ ID NO: 490074 - RNA, 65 nt, hsa
ugggacauguuccauagccuugcuggggaagggcccacugccaacucccucugccccagccccac

SEQ ID NO: 490075 - RNA, 65 nt, hsa
ccucacacucucugucccucgcguuauuuauucuacacugccacuucuguaagaaaaacaguuuc

SEQ ID NO: 490076 - RNA, 65 nt, hsa
ugacuggcaggacaaggucuggcauggcacagcaccacugccaggccuccccaggcacaccacuc

SEQ ID NO: 490077 - RNA, 65 nt, hsa
gauaaugucccagaguccccccacuagacacaggucacugccaagcaucagggccacucgggcuc

SEQ ID NO: 490078 - RNA, 65 nt, hsa
aagcuaagggcugcccucugcccacacgcugcguucacugccaaugcuguacucaccuccaucac

SEQ ID NO: 490079 - RNA, 65 nt, hsa
caggccuaggccugggccugggcuggggucccccccacugccagcugcaaggaaccagcaaagac

SEQ ID NO: 490080 - RNA, 65 nt, hsa
gccugugggagggcuaggggagcaaaagacagggacacugccaucgauaaugucagccugcagca

SEQ ID NO: 490081 - RNA, 65 nt, hsa
cagacaggcuaaaaugugaacguggggugagggaucacugccaaaaugguacagcuucuggagca

SEQ ID NO: 490082 - RNA, 65 nt, hsa
uguauauaacuccccucccccagaaaaauaaaugucacugccaacgucaggaggugcuuucuaaa

SEQ ID NO: 490083 - RNA, 65 nt, hsa
acugcuccuggaguucucaucggauuccccaagggcacugccagcuucgcuccacucagcccccu

SEQ ID NO: 490084 - RNA, 65 nt, hsa
cucagcuaacauuccauguuucagaagcauucaggcacugccaggcuugcagucucccagauguu

SEQ ID NO: 490085 - RNA, 65 nt, hsa
gacguccacccugcagccaggacugggguucacgucacugccagagcuacacucgccuucugcuu

SEQ ID NO: 490086 - RNA, 65 nt, hsa
gcugaaucucccuccaacccuucuugccuacuccucacugccagcugggaccuaggcucaguccu

SEQ ID NO: 490087 - RNA, 65 nt, hsa
uugguucccuuucauacagaggguuuucuauggaucacugccaaacauugggaucaucuccucug

SEQ ID NO: 490088 - RNA, 65 nt, hsa
caugauagcguucuggugagcugggaaggacccaccacugccacugaggauuguuuuggaagaaa

SEQ ID NO: 490089 - RNA, 65 nt, hsa
uugucuccucacuaggucauuuggaucaucuuuuacacugccauccauuaugacugaugguguac

SEQ ID NO: 490090 - RNA, 65 nt, hsa
agugccuaagcgggggugaaagaggacguguuacccacugccaugcaccaggacuggcuguguaa

SEQ ID NO: 490091 - RNA, 65 nt, hsa
ucaccauggcccccucaucauagcaauaacauucccacugccagggguucuugagccagccaggc

SEQ ID NO: 490092 - RNA, 65 nt, hsa
aaaaggauggaaguuaagacucagagucucauuaccacugccaaugugguuuuagcaggggaggg

SEQ ID NO: 490093 - RNA, 65 nt, hsa
gaagggcccgagaacauggccuaagggccacaucccacugccacccuugacgcccugcucuggau

SEQ ID NO: 490094 - RNA, 65 nt, hsa
ccccagcuccagcaggaaggaccccacauccuucucacugccauggaauucccuccugagugccc

SEQ ID NO: 490095 - RNA, 65 nt, hsa
aaguacuucauucgagaugaguuucugaggaucagcacugccaguggagaugggcgucacuacug

SEQ ID NO: 490096 - RNA, 65 nt, hsa
uucuuaauuacaguuuaccuauuucugacaugcagcacugccaucucuuccagcaccaucagggu

SEQ ID NO: 490097 - RNA, 65 nt, hsa
uggcuucugugcauccacccaggcccccgacccaucacugccacauucuccgggucauggccgag

SEQ ID NO: 490098 - RNA, 65 nt, hsa
cucuaguguaauaacucccaaccugaccaauuucacacugccaacaguuaaacaaccagauugca

SEQ ID NO: 490099 - RNA, 65 nt, hsa
ugugcacugugguuccaguguagcugcugugagcccacugccacugccucagaagggagccacug

SEQ ID NO: 490100 - RNA, 65 nt, hsa
gaagugaggagaaggaaggggaggacagacguucacacugccacguaugucuacguggauuuuug

SEQ ID NO: 490101 - RNA, 65 nt, hsa
ucuuugguagaaaaggcuagguacacagcucuagacacugccacacagggucugcaaggucuuug

SEQ ID NO: 490102 - RNA, 65 nt, hsa
gaggaaggccucuguaucaccccaguacucugcaccacugccauacgagcuucccacccuuccua

SEQ ID NO: 490103 - RNA, 65 nt, hsa
ccaauugcugccaauaguggauaacauguaucacucacugccaaaaauagaaagugaccaugaaa

SEQ ID NO: 490104 - RNA, 65 nt, hsa
ccucaacuuccauccugcgggaggccuuggccgggcacugccagugucuuccagagucacaccca

SEQ ID NO: 490105 - RNA, 65 nt, hsa
uggcccucuguagggcguuuaacuggaaauacccucacugccaaguggagacuggggcgugugcc

SEQ ID NO: 490106 - RNA, 65 nt, hsa
gugccugcugagccuuuuccuuccacgccgccucucacugccaggccagcggcuuccgcugagac

SEQ ID NO: 490107 - RNA, 65 nt, hsa
cuauaccucaaaguagcugcggauuuugucuccugcacugccaauaugcaacugaucccgcuuuu

SEQ ID NO: 490108 - RNA, 65 nt, hsa
gaauuuagcuuauacaauucagagaauagcaguuucacugccaacuuuuagugggugagaaauuu

SEQ ID NO: 490109 - RNA, 65 nt, hsa
ggcaaauguccccaagugagugggcuccccgcugucacugccagucacccacaggaagggacugg

SEQ ID NO: 490110 - RNA, 65 nt, hsa
cuuccucucuccgugguucucaccccauacucugucacugccacauuuucaccugggccuggccu

SEQ ID NO: 490111 - RNA, 65 nt, hsa
cucuuuggggcacccucucucagccaggcuuggcccacugccaucacccagcaccccagaucacc

SEQ ID NO: 490112 - RNA, 65 nt, hsa
uaagcuaauuauuuaaaauaaauacauguaaaggccacugccacauucucagcagacuuccacuu

SEQ ID NO: 490113 - RNA, 65 nt, hsa
guggcgccucaucugcaucucugccucaccccauccacugccacaggcugccugaugaccacuag

SEQ ID NO: 490114 - RNA, 65 nt, hsa
ccggaacaaaagcggaagaggggccagccucaucccacugccagcugacccucaguuccucaaac

SEQ ID NO: 490115 - RNA, 65 nt, hsa
ccgggcccaugccccaaggagcccuucagagcccacacugccagucgaggccuggcuggaggcug

SEQ ID NO: 490116 - RNA, 65 nt, hsa
uggcaggggaacaggaaauguggccgccucugccccacugccagccugagugggcaaggaagcag

SEQ ID NO: 490117 - RNA, 65 nt, hsa
uccuuggucucuccgguugguguuaaagggcccuccacugccaccucucaugggauggacccugc

SEQ ID NO: 490118 - RNA, 65 nt, hsa
cgugauuugucuuuucaugcagauuaguuagaauucacugccagguuucuucugcccaccaaaau

SEQ ID NO: 490119 - RNA, 65 nt, hsa
gcaacuguuauggcaguggguccagcccaggccagcacugccagccuccucucccugcaguaggc

SEQ ID NO: 490120 - RNA, 65 nt, hsa
acaaaaugguuuccggaaauauuuguauccccuuacacugccaccagcaaggauaaacaugucca

SEQ ID NO: 490121 - RNA, 65 nt, hsa
gccuguaugguacuguuuuguuuguuaauaaagugcacugccacccccaaugcagacucgacucc

SEQ ID NO: 490122 - RNA, 65 nt, hsa
aguaccaguauaagcaucucccaucugcuuuucuccacugccauguguccuggucaagccccccu

SEQ ID NO: 490123 - RNA, 65 nt, hsa
cccuccuacgaggcuuauccuggcaaugggguagucacugccacccuuccacacacacacacaca

SEQ ID NO: 490124 - RNA, 65 nt, hsa
gaacauucccagugccccuggcuaggggcagagggcacugccaggcuguguucaguuagcacagc

SEQ ID NO: 490125 - RNA, 65 nt, hsa
uccaaaauuugaaaaagaagcuauauccaguguuucacugccaaacagauucacuacucuuacug

SEQ ID NO: 490126 - RNA, 65 nt, hsa
ugaggaaacucauacagucucuauuugauuugcaacacugccaaacaucagucaauugcuugagc

SEQ ID NO: 490127 - RNA, 65 nt, hsa
augggcuugggagggggcucccuaaagccaguggacacugccagagucuaccuuccuggcaagag

SEQ ID NO: 490128 - RNA, 65 nt, hsa
aacccagccccugcggccgucaccccgccagccuacacugccagccgccaccggggcacacgggc

SEQ ID NO: 490129 - RNA, 65 nt, hsa
aaucuuuuuuuucuugaauuuaaucuggcacuuugcacugccacagaggugacgaugaacuaugu

SEQ ID NO: 490130 - RNA, 65 nt, hsa
cauguacuccccucauccgauuccccucuaucagucacugccaguuaauaaaccuuugcaaacgu

SEQ ID NO: 490131 - RNA, 56 nt, hsa
gcuaucagcaguaccacugaggaagccacugccaccaugggagcuacuucucgguu

SEQ ID NO: 490132 - RNA, 65 nt, hsa
acccccaaucugcccccaacucccaaaagcuagaacacugccaacugaucuguuauagguccuuu

SEQ ID NO: 490133 - RNA, 65 nt, hsa
agagccggcuuuaaguccccaacccuuacagacaccacugccaccaccaccaaccacgaccacca

SEQ ID NO: 490134 - RNA, 65 nt, hsa
agcagaagaauaauguaguuuagaaauuaugcugucacugccaaacaguaaccuccaggagaaaa

SEQ ID NO: 490135 - RNA, 65 nt, hsa
aaccaguauuuauugagcaccuaauaugugccaggcacugccacugcaaucuuauaaauggaguu

SEQ ID NO: 490136 - RNA, 65 nt, hsa
cuucuccuucccacagacaucuuacacuugcucgacacugccaccugcagaagccuggcgggcuc

SEQ ID NO: 490137 - RNA, 65 nt, hsa
cugggcagcgccugugcagaccucccugcaggccgcacugccaacugcugcauuuguuguguuuu

SEQ ID NO: 490138 - RNA, 65 nt, hsa
gauggcugccugcagcuuccacggaaucccucccucacugccagagcagcaucuucucuguguac

SEQ ID NO: 490139 - RNA, 65 nt, hsa
cgcccaggcuggagugcaguggcgcaaugucagcucacugccaccuccgccucccggguucaagc

SEQ ID NO: 490140 - RNA, 65 nt, hsa
ucccaaucuugcaguccuaacucaggcaaauugugcacugccagaggggcccuggguucugccau

SEQ ID NO: 490141 - RNA, 65 nt, hsa
agacccagcaaggaguugccugggugcuggcuggucacugccagaggccugggcugcaugaggac

SEQ ID NO: 490142 - RNA, 65 nt, hsa
ccucagaaggagcuuuuugcuuaucuauaauuuuucacugccaauuuuugauauccucucuccua

SEQ ID NO: 490143 - RNA, 64 nt, hsa
acuaguuaauuuugaguaauuguauugucagaaaagugauuaguacuauuuuuuuuuguuguuu

SEQ ID NO: 490144 - RNA, 64 nt, hsa
uucauuuuggauauucuccuguuuuuauuaaaccagugauuacaccuggccaucccucuaaaug

SEQ ID NO: 490145 - RNA, 64 nt, hsa
ggugccuggagccuguguccugcccugcuacaguagugauuaauagugucaugguagcuaaagg

SEQ ID NO: 490146 - RNA, 64 nt, hsa
gagggacacuuccccagaauccgcauguuuccccagugauuacacuccacugccaccguggugc

SEQ ID NO: 490147 - RNA, 64 nt, hsa; identical to SEQ ID NO: 217662

SEQ ID NO: 490148 - RNA, 64 nt, hsa; identical to SEQ ID NO: 217663

SEQ ID NO: 490149 - RNA, 64 nt, hsa
ucuaauuauuccauugagucaguuuuuugugauuagugauuaucagagcaaacaucauguagau

SEQ ID NO: 490150 - RNA, 64 nt, hsa
gcuaacccaaaauguuauuuguaaucaaauguguagugauuacacuugaauuguguacuuagug

SEQ ID NO: 490151 - RNA, 64 nt, hsa
caaggugauggcauuaagaagugggccuuugggaagugauuagaucaggagugcagagcccuca

SEQ ID NO: 490152 - RNA, 64 nt, hsa
cugaccagcuuaguucuaauaauuuuuaguugugagugauuaaaaaacuuuggaucaauuuugg

SEQ ID NO: 490153 - RNA, 64 nt, hsa
acccuuuccaaugcaucuucuacccugcuaccucagugauuauucuaaaauaaauauauaugau

SEQ ID NO: 490154 - RNA, 64 nt, hsa
gcuuaggaguucagaguuccuucaucaucgaaauagugauuaagugaucccagaacaaggaaua

SEQ ID NO: 490155 - RNA, 64 nt, hsa
auauacuuguacauacaauggaaaugcuuuuaguagugauuauuuagcaauuuuuguuuuuguu

SEQ ID NO: 490156 - RNA, 64 nt, hsa
cccaaucauguguuuuuguugaaaugauccuaccagugauuaguggcuauugagaguuuuacag

SEQ ID NO: 490157 - RNA, 64 nt, hsa
ugcccauaggccaacaaccauaguuccucacauuagugauuagcagacucuuuguggacgagug

SEQ ID NO: 490158 - RNA, 64 nt, hsa
cauaaaagauuguauuuuuauuacuauuuaaacaagugauuaaauuuagucugcacagugagca

SEQ ID NO: 490159 - RNA, 64 nt, hsa; identical to SEQ ID NO: 217664

SEQ ID NO: 490160 - RNA, 64 nt, hsa; identical to SEQ ID NO: 217665

SEQ ID NO: 490161 - RNA, 64 nt, hsa
aaccgauagaaaaguaaccaucagcaaauacugcagugauuaguuagaaucuguauuauuccuu

SEQ ID NO: 490162 - RNA, 64 nt, hsa
uuauccucaaaaaaggcgauggaagggcuggggaagugauuaaauaaaagcaacgcaagaaaaa

SEQ ID NO: 490163 - RNA, 64 nt, hsa
uggugaaaggaaauagcaguuacagcaaaaccucagugauuacaauugaggaaaaagucaaaau

SEQ ID NO: 490164 - RNA, 64 nt, hsa
caaauguugcauaguuaccagggaagauuaguccagugauuacauaagaguugggcaccauaaa

SEQ ID NO: 490165 - RNA, 64 nt, hsa
guccugugaucuagccaggagcagccauuaaccuagugauuaauaugggagacauuaccauaug

SEQ ID NO: 490166 - RNA, 64 nt, hsa
gaccaucccagccucugaguucucuuugaguaugagugauuacuuggauuuuaguaucuguucu

SEQ ID NO: 490167 - RNA, 64 nt, hsa
uaacaaaauuuuuaaagacccagugagagucuguagugauuauuacacggauaauguuuuaaau

SEQ ID NO: 490168 - RNA, 64 nt, hsa
cauuuauguuugcuagaaacauuuucuaaaugauagugauuagcugguuagccaucuuccuguu

SEQ ID NO: 490169 - RNA, 64 nt, hsa
gagaccucuugcuacagcauacaaagccucuacuagugauuaucagguauuuuaaggauuggau

SEQ ID NO: 490170 - RNA, 64 nt, hsa
acaaauauuuguauuauuuuuguuagcaggaaagagugauuaagugagguuauuuaccccuaaa

SEQ ID NO: 490171 - RNA, 64 nt, hsa
agccguacugcuuuuuugagcaguuauucauuccagugauuaaaacugauugugcagaauauuc

SEQ ID NO: 490172 - RNA, 64 nt, hsa
gagugaacaaauuuacagagacagaaagcagaacagugauuaccagggacugaggggaggggag

SEQ ID NO: 490173 - RNA, 64 nt, hsa
uuggaucaaaaguguuuaaaauuaauauguugucagugauuagaacaacacuguuuacauaaaa

SEQ ID NO: 490174 - RNA, 64 nt, hsa
aaauaaauagaguguaaauucuuuuuaaugcuuuagugauuaaauguuuuaguauuuugaacug

SEQ ID NO: 490175 - RNA, 64 nt, hsa
aucaguauuuauuaaguaaaugauguagcacuguagugauuaggaaucauuagcaaauguguug

SEQ ID NO: 490176 - RNA, 64 nt, hsa
auucacuuuauucaugugacauuuauaguaccagagugauuauuucauaccaaugaaaucuuac

SEQ ID NO: 490177 - RNA, 64 nt, hsa
uaaccagaaaaagcuggaauuugcauucgcaaacagugauuaucuggcccuucuacaagcguau

SEQ ID NO: 490178 - RNA, 64 nt, hsa
acacaggauaaacccaauacauauuguacugcucagugauuaaauggguucacuuccucgugag

SEQ ID NO: 490179 - RNA, 64 nt, hsa
augcaaagcuuuuggagacugcuaaguguuaaaaagugauuaaacacacacucugcuauuuuuu

SEQ ID NO: 490180 - RNA, 64 nt, hsa
aguucuuaaaggagugguagaauuuggguaggaaagugauuaaguccaacuuaaaaccaacagu

SEQ ID NO: 490181 - RNA, 64 nt, hsa
ccuugugaugacuacuaacaaauguaaaauuaugagugauuaagaaaacauugcuuugugguua

SEQ ID NO: 490182 - RNA, 64 nt, hsa
uuugcuuguuuauuucugaaaaagaacuguauuuagugauuauuuuagauagugauauuauagu

SEQ ID NO: 490183 - RNA, 64 nt, hsa
uuaaacaguaaaugccaguagugaccaagaacacagugauuauauacacuauacuggagggauu

SEQ ID NO: 490184 - RNA, 64 nt, hsa
aucuuuuuuuuuuuucgccuuuaagaagguuuucagugauuauaccucagguauuucugagugu

SEQ ID NO: 490185 - RNA, 64 nt, hsa
ugaaaucuucaauucuugcagcuguguuuuggaaagugauuaagcaauauuucucaaaccugau

SEQ ID NO: 490186 - RNA, 64 nt, hsa
uaaagagaauguaguucccuacucaggcuuucguagugauuagcuuacuaaggaacugaaaaug

SEQ ID NO: 490187 - RNA, 64 nt, hsa
uuucaaauguagugcuggugaaaagguagggcugagugauuaccuuagccacaggguggcugag

SEQ ID NO: 490188 - RNA, 64 nt, hsa
uaaaccuccaccuccaguggcugugacuggucccagugauuauacguuauugguugcugugggu

SEQ ID NO: 490189 - RNA, 64 nt, hsa
gcuccugguucagugccauggcuucauggcauucagugauuagugguaaugguaaacacuggug

SEQ ID NO: 490190 - RNA, 64 nt, hsa
uuguguucccuaggaaaugacugucccaagagccagugauuauuccagguguucccuggaaagg

SEQ ID NO: 490191 - RNA, 64 nt, hsa
cuuggaugucuuuuauagauuuuuaaauuauuuuagugauuauuauuuuauuaaaggggucugg

SEQ ID NO: 490192 - RNA, 64 nt, hsa
ucuuuuuucaaaguuuaaugugaacuuuuagaaaagugauuaauguugcccuaauacuuuauau

SEQ ID NO: 490193 - RNA, 64 nt, hsa
uaacucauguuuagguaauuaacugcuuguuuuaagugauuauauuucuuccacuguuuuugaa

SEQ ID NO: 490194 - RNA, 64 nt, hsa
caacugaaggccacaaaaaugaacuccaucuacaagugauuaccuaguugugagcuguuggcau

SEQ ID NO: 490195 - RNA, 64 nt, hsa
cagggucacacuuuuccaaguuuaucagugaaguagugauuaacaauggggagugucaaaacua

SEQ ID NO: 490196 - RNA, 64 nt, hsa; identical to SEQ ID NO: 217666

SEQ ID NO: 490197 - RNA, 64 nt, hsa; identical to SEQ ID NO: 217667

SEQ ID NO: 490198 - RNA, 64 nt, hsa
cccucuggauuuggaaggcaaauaaaacucuuacagugauuauuuagauauuaaagacugagaa

SEQ ID NO: 490199 - RNA, 64 nt, hsa
uuaauaaaugugcauuuugauuguaaucuaucgaagugauuauuacaccaguuacagcaguaau

SEQ ID NO: 490200 - RNA, 64 nt, hsa
uauauuccauaucuacaacuauaauaucaaauaaagugauuauuuuuuacaacccucuuaacau

SEQ ID NO: 490201 - RNA, 64 nt, hsa
uuaaaugaacuaacugaaaauaauaauuauaggaagugauuauuccauuuuaaguauuagagcu

SEQ ID NO: 490202 - RNA, 64 nt, hsa
cuucuuuguaagaacaccaaccaaccaagguuuaagugauuaauaggcuugagcaccggguggc

SEQ ID NO: 490203 - RNA, 64 nt, hsa
aaucccgauuaaugaauuauauauagauagauagagugauuaguuaaucaaaacuauauauuug

SEQ ID NO: 490204 - RNA, 64 nt, hsa
caaauauguuacuguauuaauuaaucuaauauugagugauuauuuguaaaauuaugaauauggg

SEQ ID NO: 490205 - RNA, 64 nt, hsa
aaccuguacacguugauuauuuuuguaagucaaaagugauuaagaggaguuuaagcuaucauuu

SEQ ID NO: 490206 - RNA, 64 nt, hsa
caccaaaauaauaaauguucuuuauuuuacagguagugauuauuagugcuucauccccauuuaa

SEQ ID NO: 490207 - RNA, 64 nt, hsa
auuaccuaacgucuguguaacugcugauuugaguagugauuagcauuuagauaauguaacagga

SEQ ID NO: 490208 - RNA, 64 nt, hsa
uacaacauuuaaaaaauuaagaguauuuugcauuagugauuaugauucuuaucccaaaauucua

SEQ ID NO: 490209 - RNA, 64 nt, hsa
uuguuugccugcacauacauguuguaauaugcacagugauuacaaccuuuaaagcaagaggagg

SEQ ID NO: 490210 - RNA, 64 nt, hsa; identical to SEQ ID NO: 217668

SEQ ID NO: 490211 - RNA, 64 nt, hsa; identical to SEQ ID NO: 217669

SEQ ID NO: 490212 - RNA, 64 nt, hsa
auuuacaagaaagaaaaauuaagaucuuaaaaucagugauuaucuuuuucuaaauaaaauauca

SEQ ID NO: 490213 - RNA, 64 nt, hsa
aaagucuuuaacuaaauuaagauugcagaaugauagugauuauucaauuagauuuuaaguaagg

SEQ ID NO: 490214 - RNA, 64 nt, hsa
guagcauuauugaaauaaauguuuaacuauccaaagugauuacuuucaaagaugauuuuuacuu

SEQ ID NO: 490215 - RNA, 64 nt, hsa
auauacaggagaaaggaagcauuuaaauuuuuauagugauuauagagaaugauuauaugauguu

SEQ ID NO: 490216 - RNA, 64 nt, hsa
cucuucacccaaauaugcuugauuauucugcaaaagugauuagaacuaagaugcaggggaaauu

SEQ ID NO: 490217 - RNA, 64 nt, hsa
cguaugugcaacccuucugcuaguagugcacauaagugauuaucccugccagguaucgaguugg

SEQ ID NO: 490218 - RNA, 64 nt, hsa
aacauuugagaguaagauauccuucaggaugugaagugauuauuaaguacucauaccugaaauc

SEQ ID NO: 490219 - RNA, 64 nt, hsa
gugguccuuuuccucuugugaccaccacaugucuagugauuauuuuguuuauuugguugcuacu

SEQ ID NO: 490220 - RNA, 64 nt, hsa
uuuuuaagcuguaaaaagagagaaaacuuauuugagugauuauuuguuauuuguacaguucagu

SEQ ID NO: 490221 - RNA, 64 nt, hsa
gaaaaagaaugaugcuucuugcaacaaaaacaaaagugauuaugucacgagaggagaggcugga

SEQ ID NO: 490222 - RNA, 64 nt, hsa; identical to SEQ ID NO: 217670

SEQ ID NO: 490223 - RNA, 64 nt, hsa; identical to SEQ ID NO: 217671

SEQ ID NO: 490224 - RNA, 64 nt, hsa
uagugggugggaaaaggggaaaaacuguuucuucagugauuacaaucauacucuucauuacuau

SEQ ID NO: 490225 - RNA, 64 nt, hsa
cuuuucuuugggcuugacaccugucuugaauaagagugauuagagcugcauaaugucccucucu

SEQ ID NO: 490226 - RNA, 64 nt, hsa; identical to SEQ ID NO: 217672

SEQ ID NO: 490227 - RNA, 64 nt, hsa; identical to SEQ ID NO: 217673

SEQ ID NO: 490228 - RNA, 64 nt, hsa; identical to SEQ ID NO: 217674

SEQ ID NO: 490229 - RNA, 64 nt, hsa
aaucacauuucuuacgcaaaugaagggagcagacagugauuaaugguucuguuggccaaggcuu

SEQ ID NO: 490230 - RNA, 64 nt, hsa
aaugaggacaucagggagccuuuuuaagcuaaagagugauuaucuuucacaguagaacuagaaa

SEQ ID NO: 490231 - RNA, 64 nt, hsa
uacguuauuggcuuugucuguaauacugccacuaagugauuauaauuaagcuguccuguuugca

SEQ ID NO: 490232 - RNA, 64 nt, hsa
uguuuguuuuuagcagucauuauuuacaauuugcagugauuaacuuggcaaggcuuccuuccgu

SEQ ID NO: 490233 - RNA, 64 nt, hsa
ugcuacuuuuaaguaauguaugugcgcucuguaaagugauuacauuuguuuccuguuuguuuau

SEQ ID NO: 490234 - RNA, 64 nt, hsa
auguuaauugguuuuuuuuuuuaaaagguaaguuagugauuacuguuaauggugggggaguaag

SEQ ID NO: 490235 - RNA, 64 nt, hsa
ucgacacugaacccccuaggcuucugaugaauccagugauuagcuaaauuugacauagaaagua

SEQ ID NO: 490236 - RNA, 64 nt, hsa
ccauugauuuuuuuuuuuuuuuaccaagucuuacagugauuauuuuacguguuuccauguaucu

SEQ ID NO: 490237 - RNA, 64 nt, hsa
acuuuucacuuaucucauguuagcuguaccagucagugauuaaguagaacuacaaguuguauag

SEQ ID NO: 490238 - RNA, 64 nt, hsa
guaagaaagcagagagcggaaaaucaauggcuccagugauuaauagauggguuuuuaguaauug

SEQ ID NO: 490239 - RNA, 64 nt, hsa
uaggaaguaaagugaagaauuuaucucuuuaguuagugauuauauuucacccaucucucaggaa

SEQ ID NO: 490240 - RNA, 64 nt, hsa
aaaggauuuaaaaaacaagaaugcaugaucucagagugauuaaaaaaaaaucaguggaaauaaa

SEQ ID NO: 490241 - RNA, 64 nt, hsa
aguaaggauaaauuuuuuaaaggcccauaagacaagugauuauuaugauucccauacuccagau

SEQ ID NO: 490242 - RNA, 64 nt, hsa
gucguaggaguacaagguuuuuauuuuuuuuaacagugauuaaaauauuuauuggucauuuacu

SEQ ID NO: 490243 - RNA, 64 nt, hsa
aaagaaaggagauuauuacccagaauucacauguagugauuauuaaggacaauuuuuuuuuuua

SEQ ID NO: 490244 - RNA, 64 nt, hsa
uacauugcuuuuccaaggaagggaacaaaagucuagugauuaguaugccaacugccacuacucc

SEQ ID NO: 490245 - RNA, 64 nt, hsa
uuauaguucuguuaccaagaauaaauaauaggaaagugauuacaaauauuaccuccaggguuca

SEQ ID NO: 490246 - RNA, 64 nt, hsa
uuuugaacaauccuauucaauuuucucauucucuagugauuaccuucauacuuuuaugcaggaa

SEQ ID NO: 490247 - RNA, 64 nt, hsa
aggcaugugcugucaaauguuagagaccaaacuuagugauuagagguugguccuuugaccuucu

SEQ ID NO: 490248 - RNA, 64 nt, hsa
aguccucacuguuaaauaaaacccaaucauaguaagugauuaacuagcaaaaaguaaagcuauu

SEQ ID NO: 490249 - RNA, 64 nt, hsa
cugugccuccuauguaugucugguuugcuggaagagugauuaauacaucuuuaauuuauuaaaa

SEQ ID NO: 490250 - RNA, 64 nt, hsa
cacuuagaaaaugaguaauaguguuuaauaagucagugauuauaugugugcucaaauaaguguu

SEQ ID NO: 490251 - RNA, 64 nt, hsa
cuauauaaaagaacauggcuuuuugacugauaaaagugauuacagauguuggcucaaguucagg

SEQ ID NO: 490252 - RNA, 64 nt, hsa
aaauauucauuuagaauuuccuuuagaagauggcagugauuauaauauuaauaugauuucauuu

SEQ ID NO: 490253 - RNA, 64 nt, hsa
acauuucauugucuuagucaaagcaggauuauuaagugauuauuuaaaauucguuuuuuuaaau

SEQ ID NO: 490254 - RNA, 64 nt, hsa
guuuaaaaaaaaaaaacaaaacaagaaaagcagcagugauuauagagaggucacacucuaagug

SEQ ID NO: 490255 - RNA, 64 nt, hsa
gacauaguguauguuaauguaaguuuugcuuuccagugauuaccugauacguaagccuauuuga

SEQ ID NO: 490256 - RNA, 64 nt, hsa
auguuaugcagugaacuauuuuuaaggucuaaucagugauuauuuuuccagcuccguguuucuc

SEQ ID NO: 490257 - RNA, 64 nt, hsa
uauguuaugccacauugcaaaagaauuuugcagaagugauuaauuuaaaauguuauuaagggcc

SEQ ID NO: 490258 - RNA, 64 nt, hsa
ugacuguuaguagugcaaggauuuguaugggcucagugauuacaaacaaagacaugcaaaauac

SEQ ID NO: 490259 - RNA, 64 nt, hsa
agagaccccauuuaaauaacacaaaauugaccacagugauuagaugaaaaaauuauuuguagau

SEQ ID NO: 490260 - RNA, 64 nt, hsa
ugucuuaaaauuggugcauauguaccauauucaaagugauuauugauauaguuggauuaauauc

SEQ ID NO: 490261 - RNA, 64 nt, hsa
ccguuguggaaauuauuggaauuaacugagccaaagugauuaugcauucuucaucuauuuuagu

SEQ ID NO: 490262 - RNA, 64 nt, hsa
auaaaguaggaaaaaaagaaucugaaagauacaaagugauuauaaaagaauugacaggacaaua

SEQ ID NO: 490263 - RNA, 64 nt, hsa
guagauuacguuuuccuauaaggauaauuuuugcagugauuauauugcuaacucucauugcaug

SEQ ID NO: 490264 - RNA, 64 nt, hsa
guaacauucuuuuuuaaaaguggaagucauuaacagugauuauuauaucacuuauauccugcua

SEQ ID NO: 490265 - RNA, 64 nt, hsa
uuaguuggcagcacucuccacacuucuguggcucagugauuacugcuauuacuauauuuacuug

SEQ ID NO: 490266 - RNA, 64 nt, hsa
ucaaauaauugaagagacaauagcauuagaaauaagugauuaaaggccucugccucacaacaug

SEQ ID NO: 490267 - RNA, 64 nt, hsa
aguuaaugauacuacaacuaaguucuuuuuaaaaagugauuaauguauuuuauaaauuaccuuu

SEQ ID NO: 490268 - RNA, 64 nt, hsa
aaaaacuuaaguccugguuugcguagcuugauagagugauuauacaacuuccauucucucacuu

SEQ ID NO: 490269 - RNA, 64 nt, hsa
uauuccuagucuuuccagucaacaucguggauguagugauuaaauauaucuagaacuaucauuu

SEQ ID NO: 490270 - RNA, 63 nt, hsa
ugguugauugugaccuugaauacaaaauaaaaguagugauuaguaguuuacagugaccuuuuu

SEQ ID NO: 490271 - RNA, 64 nt, hsa
acagccccaaccucccaccccugauacaugagccagugauuauucuuguucagggagaagauca

SEQ ID NO: 490272 - RNA, 64 nt, hsa
cugcagcugagauuccagaacgcccuguguccacagugauuagccucgucuuucagcgagcaua

SEQ ID NO: 490273 - RNA, 64 nt, hsa
caugggaaagcuguaguuuagugacuuagcccuuagugauuaauagauuugcauguacauagaa

SEQ ID NO: 490274 - RNA, 64 nt, hsa
uggacuuuugcauuauuucauugugcaugcauccagugauuauacauaagcaacauauguaauc

SEQ ID NO: 490275 - RNA, 64 nt, hsa
gacagagaacacugccugaagacacacagcaauaagugauuacagcuccuagacuaccuuccaa

SEQ ID NO: 490276 - RNA, 64 nt, hsa
uccaugauauguuuggcucugcaugccaaaguccagugauuaagcauauauaaguugucaagga

SEQ ID NO: 490277 - RNA, 64 nt, hsa
ucuugaaaugcuuuuguuauuaaacucaaaaggcagugauuaggaugaaauaauuguacauaau

SEQ ID NO: 490278 - RNA, 64 nt, hsa
gaaucucccacuccagcgcugagugggagaaggcagugauuagcacuugggugacggcagucga

SEQ ID NO: 490279 - RNA, 64 nt, hsa
caaaaaugugaaguuauaccaaauaaaguuucuaagugauuaaugcauacgaacagcuacauau

SEQ ID NO: 490280 - RNA, 64 nt, hsa
gaauaacaacuuaagcuguaguuagauaacaccuagugauuaauuggcugagaaaacccuggag

SEQ ID NO: 490281 - RNA, 64 nt, hsa
guguauuuugcacaaaaaaauuaaccuggucaauagugauuaccaaaauauauauuaauaaucu

SEQ ID NO: 490282 - RNA, 64 nt, hsa
aagaacauuuuuaauucuuuaggaaucugcaaugagugauuacaugcuuguaauagguaggcaa

SEQ ID NO: 490283 - RNA, 64 nt, hsa
cugcucuuagguuguuuugauaaagugacauuauagugauuaaauucuucccccuuuaaaaaaa

SEQ ID NO: 490284 - RNA, 64 nt, hsa
guuuuuaaaaagggagacuaaaagcaaauaccucagugauuaauauuuaagcuacagagaaugu

SEQ ID NO: 490285 - RNA, 64 nt, hsa
cuaggcucaccacaaccucugccuuccagguucaagugauuagagacagugaaauuuuuaugga

SEQ ID NO: 490286 - RNA, 64 nt, hsa
cuuuguugcaugcaguuggguucaaaugccaaauagugauuagaagacgaccauucugaucugu

SEQ ID NO: 490287 - RNA, 64 nt, hsa
agcagagucaguuacaccugcagcucuugucuaaagugauuagauggccacccucaccacuguc

SEQ ID NO: 490288 - RNA, 64 nt, hsa
uguuauauauugugaaauuuauuuuauauaguaaagugauuaugucuaacugugaucaaacuua

SEQ ID NO: 490289 - RNA, 64 nt, hsa
cuuuuuaauauguuaucacuguaaaacacagaaaagugauuaaugaaugauaauuuagauccau

SEQ ID NO: 490290 - RNA, 64 nt, hsa
auuuagauaaacuacauuuuaacugaaugucuaaagugauuaucuuuuuuccccccaaguuagu

SEQ ID NO: 490291 - RNA, 64 nt, hsa
uguauuuuuuuagaacugguuuguguauauauauagugauuauggauacuaauucaauguaauu

SEQ ID NO: 490292 - RNA, 64 nt, hsa; identical to SEQ ID NO: 217675

SEQ ID NO: 490293 - RNA, 64 nt, hsa; identical to SEQ ID NO: 217676

SEQ ID NO: 490294 - RNA, 64 nt, hsa
ggccucagugccccauucucacugcuaucuggggagugauuaccccgggagacugaacugcagg

SEQ ID NO: 490295 - RNA, 64 nt, hsa
caggcuuaaccauaacccucaagaucugcuugacagugauuaaauccuuagcucacauccauuc

SEQ ID NO: 490296 - RNA, 64 nt, hsa
aaaggaaucucacuguuccuaaauaaauguguauagugauuaugaaaaguaucccacuguugau

SEQ ID NO: 490297 - RNA, 64 nt, hsa
ccacaauccucuacuucagugggaugcugugucuagugauuaaacaaaaauauagagcugugca

SEQ ID NO: 490298 - RNA, 64 nt, hsa
guuccacuauuggacugcuuuaaauguagugaucagugauuaugcuauaauccaaucauguauu

SEQ ID NO: 490299 - RNA, 64 nt, hsa
uuuggaugaagguugcugggauuaaggggauuagagugauuaugggagcagcuaaagaugagag

SEQ ID NO: 490300 - RNA, 64 nt, hsa
caagagaauggaagucuuaauagaaggaagcaggagugauuaguucggguuaaagcaaaagugu

SEQ ID NO: 490301 - RNA, 64 nt, hsa
gauaaguaaacaaauaaauaauguaguuugagauagugauuaagugcuaugaagaaaauaaacu

SEQ ID NO: 490302 - RNA, 64 nt, hsa
aucugguauuucuugcugcuuggaacuacuuugcagugauuacuugguugcaguccaaguacuc

SEQ ID NO: 490303 - RNA, 64 nt, hsa
gagaaacaaagggauugauaaaaugcugagaacuagugauuauauauuuuucuguauuuaccug

SEQ ID NO: 490304 - RNA, 64 nt, hsa
auugcuguuuguaaaauaaaucaggaugguagaaagugauuauauggaaaauuggaaccuggau

SEQ ID NO: 490305 - RNA, 64 nt, hsa
ccagaugugggacccgguaccaugcucuaaagcgagugauuaggcagcagcugaagccaccccu

SEQ ID NO: 490306 - RNA, 64 nt, hsa
aagagguaagcacauuuuauauagacguaaggaaagugauuauuguuuaauaucugugaauuua

SEQ ID NO: 490307 - RNA, 64 nt, hsa
aucacagcauaaccccacccuuuacauuuugugcagugauuauuuuuuaaagucuucuuucaug

SEQ ID NO: 490308 - RNA, 64 nt, hsa
aucacuaauuuuuaguugcugagguuggcauuuuagugauuauuaagcacuucugucagucuuu

SEQ ID NO: 490309 - RNA, 64 nt, hsa
cuuggcucacugcagccucuaccucccagguucaagugauuauccugccuuagccuccugagua

SEQ ID NO: 490310 - RNA, 64 nt, hsa
uuugauaauuuugcuuaaaccacucauucguuaaagugauuacaaaaaaguucaagaaugaugu

SEQ ID NO: 490311 - RNA, 64 nt, hsa
acacaccucuucuuuucuugguauuucugguggcagugauuaguugaacagcacauuuaaggca

SEQ ID NO: 490312 - RNA, 64 nt, hsa
uuugggaacaugauuguauuguauuaaaauucgaagugauuauuaucagcuuaauuggauuaaa

SEQ ID NO: 490313 - RNA, 64 nt, hsa
aaacauggaaagauacuccacugaugaguuuagaagugauuagggcaagcuaguugaccugcac

SEQ ID NO: 490314 - RNA, 64 nt, hsa
ccaaaugcagguguguagguugagucuuuaacaaagugauuaagagcuuggucuguaaggccgg

SEQ ID NO: 490315 - RNA, 64 nt, hsa
ggaacacaagcugcugugaaccaaacugauaucaagugauuagcucaccgggccuugguugcuu

SEQ ID NO: 490316 - RNA, 64 nt, hsa
ucucauuuucaguuuaaguaacugcuguuacuuaagugauuacacuuuugcucaaauugaagcu

SEQ ID NO: 490317 - RNA, 64 nt, hsa
ggaaaagaggagaacuucauacucacaaugaaauagugauuaugaaaauacaguguucuguaau

SEQ ID NO: 490318 - RNA, 64 nt, hsa
aucuuguuuuuuuuuuuuuuccuuuauuuugauaagugauuauuaugcuugauaaacuuugaau

SEQ ID NO: 490319 - RNA, 64 nt, hsa
uacucuauaaauauauacauauauuuauauauaaagugauuaguugaacuggcauccugcuuua

SEQ ID NO: 490320 - RNA, 53 nt, hsa
ccaaugagcuaaagcuguaacccagugauuaugauguaaauuaaguagcaauu

SEQ ID NO: 490321 - RNA, 64 nt, hsa
uguuauuuuuccuagaugaaaauaaaagucaagcagugauuaguuucacucacuguccuagcua

SEQ ID NO: 490322 - RNA, 64 nt, hsa
caauugaggugauucaaccuaauuuucaguaagaagugauuaaaauaaugacaugcuaaaaggc

SEQ ID NO: 490323 - RNA, 64 nt, hsa
ccaagugaacagaggagaaaugagauugccagaaagugauuaacuuuggccguugcaaucugcu

SEQ ID NO: 490324 - RNA, 64 nt, hsa
caccugcaaaaugccuaacaaccuucuucuuuucagugauuaccacuuucuuaccaaugacuuc

SEQ ID NO: 490325 - RNA, 64 nt, hsa
uagaauuuugguaccuacaacaugcuugauuuugagugauuaaaaaaaaauaauuuggcugggu

SEQ ID NO: 490326 - RNA, 64 nt, hsa
gaauuugacauuguccaaaccuuuuucauuuuugagugauuaaaaaugaaauguccuuuguaua

SEQ ID NO: 490327 - RNA, 64 nt, hsa
uuuaauggacaugagauaauguuagagguuuuaaagugauuaaacgugcagacuaugcaaacca

SEQ ID NO: 490328 - RNA, 64 nt, hsa
accuuuaauuuagaggcaauauuauuacuguuuaagugauuauuugcuuaacacagguuuuauu

SEQ ID NO: 490329 - RNA, 64 nt, hsa
uuuuccacauguagaccaacugguaaacuaacagagugauuaagcaugguguacagaaaagcau

SEQ ID NO: 490330 - RNA, 64 nt, hsa
agagucggaaucuaaacuguauagcacuuugugaagugauuacaucuaaggaccuccagaagca

SEQ ID NO: 490331 - RNA, 64 nt, hsa
augaauugcaguauauacguaugauugcuuuuuaagugauuaucuuuucuucuguuaagucaug

SEQ ID NO: 490332 - RNA, 64 nt, hsa
uagaaaugaagccuuaagcugcaucaaguuacgaagugauuaauuuccuucucagcaaaccucc

SEQ ID NO: 490333 - RNA, 64 nt, hsa
gguuuugaccuugccagugaaguuucgguuuugaagugauuaaaugucacuuccucaucaguuu

SEQ ID NO: 490334 - RNA, 64 nt, hsa
augugacuguaauuggaaauaagaccuuuaaagaagugauuaagguuaaaugaagucauaagaa

SEQ ID NO: 490335 - RNA, 64 nt, hsa
auucaucccaacugucuuuuuuucccuaccauucagugauuacugucaaggcugcuuagaaucc

SEQ ID NO: 490336 - RNA, 64 nt, hsa; identical to SEQ ID NO: 217677

SEQ ID NO: 490337 - RNA, 64 nt, hsa; identical to SEQ ID NO: 217678

SEQ ID NO: 490338 - RNA, 64 nt, hsa
uaaugcuuugauuggauuugccaguucaccggacagugauuaaaacuauguaaugaauauaauc

SEQ ID NO: 490339 - RNA, 64 nt, hsa
auuauuaauuugacuugaaaacugcuggaacaauagugauuaauaaagauauguauagauaauu

SEQ ID NO: 490340 - RNA, 64 nt, hsa
ggaaaaugucgacuuuguuuuguucuguuccuaaagugauuagcacuaaucucugggauuuuua

SEQ ID NO: 490341 - RNA, 64 nt, hsa
uaaagucacaucccuguaaauugcagaauucaaaagugauuaucucuuugaucuacuugccuca

SEQ ID NO: 490342 - RNA, 64 nt, hsa
ggcucaaguuggugacccaagccuauuguaaacaagugauuaucucaaagggagaugccaaugg

SEQ ID NO: 490343 - RNA, 64 nt, hsa
ccauuaaaggaaaucuugauugcuuccaguuuucagugauuaaaaauaaagccgcuauaaacau

SEQ ID NO: 490344 - RNA, 64 nt, hsa
cuuuccaagauacagccugcaagugguagcaagaagugauuagaggcagaucuggacuuggcaa

SEQ ID NO: 490345 - RNA, 64 nt, hsa
ccuggguauucacaacaggccugacuugauacuaagugauuaguuuuccaaguugucccacugc

SEQ ID NO: 490346 - RNA, 64 nt, hsa
cuucuguuaguuuuuguuuuuaagugugaaugcaagugauuaaugaauacagacuuaacaagug

SEQ ID NO: 490347 - RNA, 64 nt, hsa
cagaaaccacuugcuaaaagcgucucuauggugcagugauuauguguacccugugcuguugcuc

SEQ ID NO: 490348 - RNA, 64 nt, hsa
aaucagccauaagaaagcacuauuaauacucugcagugauuagaaggggugggguggcgggaau

SEQ ID NO: 490349 - RNA, 64 nt, hsa
uagcauuucuccuuauaucaccaugggcagcaucagugauuacaagguaagaaaaagcagggaa

SEQ ID NO: 490350 - RNA, 64 nt, hsa
aauccuuuaacucugcggauagcauuugguagguagugauuaacugugaauaauaaauacacaa

SEQ ID NO: 490351 - RNA, 64 nt, hsa
aaaauaacugcuuuuguaagaacggugauauuggagugauuaguauaaauucaauggaauuuga

SEQ ID NO: 490352 - RNA, 64 nt, hsa
agauagugaaauuuaccuuugagauauaacaauaagugauuaacuguucacuuucagauguaau

SEQ ID NO: 490353 - RNA, 64 nt, hsa
uguuggaaccuccuggggacauguuauauuuugaagugauuaaacuauuuaauugugugucuau

SEQ ID NO: 490354 - RNA, 64 nt, hsa
ccuugggagcaagcagcacuaaaucacaucagggagugauuaguccuggggaaauucaguggag

SEQ ID NO: 490355 - RNA, 64 nt, hsa
agaggaaacuacugccuuuagaaaauauaaguaaagugauuaaagugcucacguuaccuugaca

SEQ ID NO: 490356 - RNA, 64 nt, hsa
agugaauguaaauuuuauuauagaauuuucugauagugauuaugauuuguagcucuagugaaua

SEQ ID NO: 490357 - RNA, 64 nt, hsa
gugaugauuuguguguauuaauaagcucacaaauagugauuauuuucaaaagaucuuuuuguaa

SEQ ID NO: 490358 - RNA, 64 nt, hsa
gcugccacaacuggccaugcccugccauugaaacagugauuaaguuugaucaagccauggugac

SEQ ID NO: 490359 - RNA, 64 nt, hsa
uucuuuuuuuuucuagguuuugcaggcaugaaauagugauuauaucuguggaaaagcauaggaa

SEQ ID NO: 490360 - RNA, 64 nt, hsa
agauguagcucuggcccagugggaaaaauuaggaagugauuauaaaucgagaggaguuauaaua

SEQ ID NO: 490361 - RNA, 64 nt, hsa
aaagcuggagaguuuaccaacaaauauugacugcagugauuaaccaagacauuuuuguuaacua

SEQ ID NO: 490362 - RNA, 64 nt, hsa
uuaauccccuccauugcucuccaaaagccaauaaagugauuacacccgaugcaccuggcucugu

SEQ ID NO: 490363 - RNA, 64 nt, hsa
ucugaaggcucauuuugguauuugaucuuaaccaagugauuauuagagaaauguaucaacucca

SEQ ID NO: 490364 - RNA, 64 nt, hsa
cacuuccgagacccaacccugcacgcccagcuccagugauuacucggaccuacagagggugaaa

SEQ ID NO: 490365 - RNA, 64 nt, hsa
gcucuguguggaauucagaggaaaacccagauucagugauuaacaaugccaaaaaaugcaagua

SEQ ID NO: 490366 - RNA, 64 nt, hsa
uguuuuuuagaacaacacuuggaaaauaauuugcagugauuauauuucugaacaagguucagaa

SEQ ID NO: 490367 - RNA, 64 nt, hsa
acaguguaaguauuaggaggugggaccuuugggaagugauuaagucaagucacgaagauagagc

SEQ ID NO: 490368 - RNA, 64 nt, hsa
uucauucccaugggcacagcuaacauuaucccccagugauuacuuucgauuacacugaagagac

SEQ ID NO: 490369 - RNA, 64 nt, hsa
accuguaaggaauuuguacuuuuucauaaugcccagugauuagugaguauuucccuuuugccag

SEQ ID NO: 490370 - RNA, 64 nt, hsa
gaagaagaaauaggacucagaauacaguggcaugagugauuacacuggcagcauuaucucaggc

SEQ ID NO: 490371 - RNA, 64 nt, hsa
cuggaaaaguaaauuguuuauuuuacaauaagaaagugauuacauauuuuuuuuuuuacaaugg

SEQ ID NO: 490372 - RNA, 64 nt, hsa
aauauucccagaauaguuuucaauguauuaaugaagugauuaauuggcuccauauuuagacuaa

SEQ ID NO: 490373 - RNA, 64 nt, hsa
uugugauauguuuuggcgcauaggagacagaaauagugauuaucaggcguugagccuuuuugua

SEQ ID NO: 490374 - RNA, 64 nt, hsa
ugcuaaaucuugcuuugcauucaguaaagugucaagugauuaaguguguauuuguacccuagau

SEQ ID NO: 490375 - RNA, 64 nt, hsa
acuugaugaguguaacaagaaaggagagucuugcagugauuaaggucucucuuuggacucuccc

SEQ ID NO: 490376 - RNA, 64 nt, hsa
ucauuuguaacaguccacucugucuuuaaaacauagugauuacaauauuuagaaaguuuugagc

SEQ ID NO: 490377 - RNA, 64 nt, hsa
uacugaauauucuagugaguuauaugauuuacggagugauuaacagaggucuauauaaaguuac

SEQ ID NO: 490378 - RNA, 64 nt, hsa
uugggcuguuaaauccuaggaaaucucgaaucauagugauuaaaauaguugggguaaaguugua

SEQ ID NO: 490379 - RNA, 64 nt, hsa
ccaguuuagacuaaguuacaguauguguuucauaagugauuaaagcuauaucauucccaguuau

SEQ ID NO: 490380 - RNA, 64 nt, hsa
guuuacccgacagaggcuuuauuugugcuguaucagugauuacuuucaauucaguaugcaguga

SEQ ID NO: 490381 - RNA, 65 nt, hsa
uacuaguuaauuuugaguaauuguauugucagaaaagugauuaguacuauuuuuuuuuguuguuu

SEQ ID NO: 490382 - RNA, 65 nt, hsa
uuucauuuuggauauucuccuguuuuuauuaaaccagugauuacaccuggccaucccucuaaaug

SEQ ID NO: 490383 - RNA, 65 nt, hsa
uggugccuggagccuguguccugcccugcuacaguagugauuaauagugucaugguagcuaaagg

SEQ ID NO: 490384 - RNA, 65 nt, hsa
ggagggacacuuccccagaauccgcauguuuccccagugauuacacuccacugccaccguggugc

SEQ ID NO: 490385 - RNA, 65 nt, hsa
aaaggaacuugaaauguggggagugauaauaguccagugauuaaacuacaguccagugauuacca

SEQ ID NO: 490386 - RNA, 65 nt, hsa
ggagugauaauaguccagugauuaaacuacaguccagugauuaccaccaacuuucugacuaagcu

SEQ ID NO: 490387 - RNA, 65 nt, hsa
uucuaauuauuccauugagucaguuuuuugugauuagugauuaucagagcaaacaucauguagau

SEQ ID NO: 490388 - RNA, 65 nt, hsa
ugcuaacccaaaauguuauuuguaaucaaauguguagugauuacacuugaauuguguacuuagug

SEQ ID NO: 490389 - RNA, 65 nt, hsa
ccaaggugauggcauuaagaagugggccuuugggaagugauuagaucaggagugcagagcccuca

SEQ ID NO: 490390 - RNA, 65 nt, hsa
ccugaccagcuuaguucuaauaauuuuuaguugugagugauuaaaaaacuuuggaucaauuuugg

SEQ ID NO: 490391 - RNA, 65 nt, hsa
cacccuuuccaaugcaucuucuacccugcuaccucagugauuauucuaaaauaaauauauaugau

SEQ ID NO: 490392 - RNA, 65 nt, hsa
ugcuuaggaguucagaguuccuucaucaucgaaauagugauuaagugaucccagaacaaggaaua

SEQ ID NO: 490393 - RNA, 65 nt, hsa
uauauacuuguacauacaauggaaaugcuuuuaguagugauuauuuagcaauuuuuguuuuuguu

SEQ ID NO: 490394 - RNA, 65 nt, hsa
gcccaaucauguguuuuuguugaaaugauccuaccagugauuaguggcuauugagaguuuuacag

SEQ ID NO: 490395 - RNA, 65 nt, hsa
cugcccauaggccaacaaccauaguuccucacauuagugauuagcagacucuuuguggacgagug

SEQ ID NO: 490396 - RNA, 65 nt, hsa
ccauaaaagauuguauuuuuauuacuauuuaaacaagugauuaaauuuagucugcacagugagca

SEQ ID NO: 490397 - RNA, 65 nt, hsa
cauucugacuggugugagaugguaugcauuucuguagugauuagugaugaugagugauuuuuaua

SEQ ID NO: 490398 - RNA, 65 nt, hsa
uagcaguuucauucaagaaaaguuuaaaauuaaaaagugauuaucaaagaauaucagggccugac

SEQ ID NO: 490399 - RNA, 65 nt, hsa
aaaccgauagaaaaguaaccaucagcaaauacugcagugauuaguuagaaucuguauuauuccuu

SEQ ID NO: 490400 - RNA, 65 nt, hsa
cuuauccucaaaaaaggcgauggaagggcuggggaagugauuaaauaaaagcaacgcaagaaaaa

SEQ ID NO: 490401 - RNA, 65 nt, hsa
uuggugaaaggaaauagcaguuacagcaaaaccucagugauuacaauugaggaaaaagucaaaau

SEQ ID NO: 490402 - RNA, 65 nt, hsa
ccaaauguugcauaguuaccagggaagauuaguccagugauuacauaagaguugggcaccauaaa

SEQ ID NO: 490403 - RNA, 65 nt, hsa
gguccugugaucuagccaggagcagccauuaaccuagugauuaauaugggagacauuaccauaug

SEQ ID NO: 490404 - RNA, 65 nt, hsa
agaccaucccagccucugaguucucuuugaguaugagugauuacuuggauuuuaguaucuguucu

SEQ ID NO: 490405 - RNA, 65 nt, hsa
uuaacaaaauuuuuaaagacccagugagagucuguagugauuauuacacggauaauguuuuaaau

SEQ ID NO: 490406 - RNA, 65 nt, hsa
ucauuuauguuugcuagaaacauuuucuaaaugauagugauuagcugguuagccaucuuccuguu

SEQ ID NO: 490407 - RNA, 65 nt, hsa
ugagaccucuugcuacagcauacaaagccucuacuagugauuaucagguauuuuaaggauuggau

SEQ ID NO: 490408 - RNA, 65 nt, hsa
aacaaauauuuguauuauuuuuguuagcaggaaagagugauuaagugagguuauuuaccccuaaa

SEQ ID NO: 490409 - RNA, 65 nt, hsa
aagccguacugcuuuuuugagcaguuauucauuccagugauuaaaacugauugugcagaauauuc

SEQ ID NO: 490410 - RNA, 65 nt, hsa
agagugaacaaauuuacagagacagaaagcagaacagugauuaccagggacugaggggaggggag

SEQ ID NO: 490411 - RNA, 65 nt, hsa
uuuggaucaaaaguguuuaaaauuaauauguugucagugauuagaacaacacuguuuacauaaaa

SEQ ID NO: 490412 - RNA, 65 nt, hsa
aaaauaaauagaguguaaauucuuuuuaaugcuuuagugauuaaauguuuuaguauuuugaacug

SEQ ID NO: 490413 - RNA, 65 nt, hsa
aaucaguauuuauuaaguaaaugauguagcacuguagugauuaggaaucauuagcaaauguguug

SEQ ID NO: 490414 - RNA, 65 nt, hsa
aauucacuuuauucaugugacauuuauaguaccagagugauuauuucauaccaaugaaaucuuac

SEQ ID NO: 490415 - RNA, 65 nt, hsa
cuaaccagaaaaagcuggaauuugcauucgcaaacagugauuaucuggcccuucuacaagcguau

SEQ ID NO: 490416 - RNA, 65 nt, hsa
uacacaggauaaacccaauacauauuguacugcucagugauuaaauggguucacuuccucgugag

SEQ ID NO: 490417 - RNA, 65 nt, hsa
aaugcaaagcuuuuggagacugcuaaguguuaaaaagugauuaaacacacacucugcuauuuuuu

SEQ ID NO: 490418 - RNA, 65 nt, hsa
gaguucuuaaaggagugguagaauuuggguaggaaagugauuaaguccaacuuaaaaccaacagu

SEQ ID NO: 490419 - RNA, 65 nt, hsa
accuugugaugacuacuaacaaauguaaaauuaugagugauuaagaaaacauugcuuugugguua

SEQ ID NO: 490420 - RNA, 65 nt, hsa
cuuugcuuguuuauuucugaaaaagaacuguauuuagugauuauuuuagauagugauauuauagu

SEQ ID NO: 490421 - RNA, 65 nt, hsa
guuaaacaguaaaugccaguagugaccaagaacacagugauuauauacacuauacuggagggauu

SEQ ID NO: 490422 - RNA, 65 nt, hsa
aaucuuuuuuuuuuuucgccuuuaagaagguuuucagugauuauaccucagguauuucugagugu

SEQ ID NO: 490423 - RNA, 65 nt, hsa
augaaaucuucaauucuugcagcuguguuuuggaaagugauuaagcaauauuucucaaaccugau

SEQ ID NO: 490424 - RNA, 65 nt, hsa
auaaagagaauguaguucccuacucaggcuuucguagugauuagcuuacuaaggaacugaaaaug

SEQ ID NO: 490425 - RNA, 65 nt, hsa
uuuucaaauguagugcuggugaaaagguagggcugagugauuaccuuagccacaggguggcugag

SEQ ID NO: 490426 - RNA, 65 nt, hsa
uuaaaccuccaccuccaguggcugugacuggucccagugauuauacguuauugguugcugugggu

SEQ ID NO: 490427 - RNA, 65 nt, hsa
agcuccugguucagugccauggcuucauggcauucagugauuagugguaaugguaaacacuggug

SEQ ID NO: 490428 - RNA, 65 nt, hsa
auuguguucccuaggaaaugacugucccaagagccagugauuauuccagguguucccuggaaagg

SEQ ID NO: 490429 - RNA, 65 nt, hsa
gcuuggaugucuuuuauagauuuuuaaauuauuuuagugauuauuauuuuauuaaaggggucugg

SEQ ID NO: 490430 - RNA, 65 nt, hsa
aucuuuuuucaaaguuuaaugugaacuuuuagaaaagugauuaauguugcccuaauacuuuauau

SEQ ID NO: 490431 - RNA, 65 nt, hsa
guaacucauguuuagguaauuaacugcuuguuuuaagugauuauauuucuuccacuguuuuugaa

SEQ ID NO: 490432 - RNA, 65 nt, hsa
ucaacugaaggccacaaaaaugaacuccaucuacaagugauuaccuaguugugagcuguuggcau

SEQ ID NO: 490433 - RNA, 65 nt, hsa
ccagggucacacuuuuccaaguuuaucagugaaguagugauuaacaauggggagugucaaaacua

SEQ ID NO: 490434 - RNA, 65 nt, hsa
uuauaaauuguaaagguaauguuuaaucauuguauagugauuaugccucugguauagcuuuccua

SEQ ID NO: 490435 - RNA, 65 nt, hsa
caaaagaaaugugcauauauuuauucuguaauuucagugauuauaaauuguaaagguaauguuua

SEQ ID NO: 490436 - RNA, 65 nt, hsa
acccucuggauuuggaaggcaaauaaaacucuuacagugauuauuuagauauuaaagacugagaa

SEQ ID NO: 490437 - RNA, 65 nt, hsa
uuuaauaaaugugcauuuugauuguaaucuaucgaagugauuauuacaccaguuacagcaguaau

SEQ ID NO: 490438 - RNA, 65 nt, hsa
auauauuccauaucuacaacuauaauaucaaauaaagugauuauuuuuuacaacccucuuaacau

SEQ ID NO: 490439 - RNA, 65 nt, hsa
auuaaaugaacuaacugaaaauaauaauuauaggaagugauuauuccauuuuaaguauuagagcu

SEQ ID NO: 490440 - RNA, 65 nt, hsa
acuucuuuguaagaacaccaaccaaccaagguuuaagugauuaauaggcuugagcaccggguggc

SEQ ID NO: 490441 - RNA, 65 nt, hsa
aaaucccgauuaaugaauuauauauagauagauagagugauuaguuaaucaaaacuauauauuug

SEQ ID NO: 490442 - RNA, 65 nt, hsa
ccaaauauguuacuguauuaauuaaucuaauauugagugauuauuuguaaaauuaugaauauggg

SEQ ID NO: 490443 - RNA, 65 nt, hsa
aaaccuguacacguugauuauuuuuguaagucaaaagugauuaagaggaguuuaagcuaucauuu

SEQ ID NO: 490444 - RNA, 65 nt, hsa
ucaccaaaauaauaaauguucuuuauuuuacagguagugauuauuagugcuucauccccauuuaa

SEQ ID NO: 490445 - RNA, 65 nt, hsa
aauuaccuaacgucuguguaacugcugauuugaguagugauuagcauuuagauaauguaacagga

SEQ ID NO: 490446 - RNA, 65 nt, hsa
auacaacauuuaaaaaauuaagaguauuuugcauuagugauuaugauucuuaucccaaaauucua

SEQ ID NO: 490447 - RNA, 65 nt, hsa
auuguuugccugcacauacauguuguaauaugcacagugauuacaaccuuuaaagcaagaggagg

SEQ ID NO: 490448 - RNA, 65 nt, hsa
gaguacuuuccuuauuggcaacuuauggacucgcuagugauuaaacgaggcaaugacugugagcg

SEQ ID NO: 490449 - RNA, 65 nt, hsa
agcauuggccuuaauauaccuaaaucuccaaaaacagugauuaaagcaagagaauuauuacaagg

SEQ ID NO: 490450 - RNA, 65 nt, hsa
cauuuacaagaaagaaaaauuaagaucuuaaaaucagugauuaucuuuuucuaaauaaaauauca

SEQ ID NO: 490451 - RNA, 65 nt, hsa
gaaagucuuuaacuaaauuaagauugcagaaugauagugauuauucaauuagauuuuaaguaagg

SEQ ID NO: 490452 - RNA, 65 nt, hsa
gguagcauuauugaaauaaauguuuaacuauccaaagugauuacuuucaaagaugauuuuuacuu

SEQ ID NO: 490453 - RNA, 65 nt, hsa
cauauacaggagaaaggaagcauuuaaauuuuuauagugauuauagagaaugauuauaugauguu

SEQ ID NO: 490454 - RNA, 65 nt, hsa
ucucuucacccaaauaugcuugauuauucugcaaaagugauuagaacuaagaugcaggggaaauu

SEQ ID NO: 490455 - RNA, 65 nt, hsa
acguaugugcaacccuucugcuaguagugcacauaagugauuaucccugccagguaucgaguugg

SEQ ID NO: 490456 - RNA, 65 nt, hsa
uaacauuugagaguaagauauccuucaggaugugaagugauuauuaaguacucauaccugaaauc

SEQ ID NO: 490457 - RNA, 65 nt, hsa
ugugguccuuuuccucuugugaccaccacaugucuagugauuauuuuguuuauuugguugcuacu

SEQ ID NO: 490458 - RNA, 65 nt, hsa
uuuuuuaagcuguaaaaagagagaaaacuuauuugagugauuauuuguuauuuguacaguucagu

SEQ ID NO: 490459 - RNA, 65 nt, hsa
agaaaaagaaugaugcuucuugcaacaaaaacaaaagugauuaugucacgagaggagaggcugga

SEQ ID NO: 490460 - RNA, 65 nt, hsa
uaccuuuacaauggagacaucuaccagaucauccaagugauuaaauuuaacaucaucaaugaugg

SEQ ID NO: 490461 - RNA, 65 nt, hsa
uuggguggcggggagaaggauacaccaaaaaacuaagugauuaucuuuggaugggaaaauguuug

SEQ ID NO: 490462 - RNA, 65 nt, hsa
guagugggugggaaaaggggaaaaacuguuucuucagugauuacaaucauacucuucauuacuau

SEQ ID NO: 490463 - RNA, 65 nt, hsa
ccuuuucuuugggcuugacaccugucuugaauaagagugauuagagcugcauaaugucccucucu

SEQ ID NO: 490464 - RNA, 65 nt, hsa
gaagacauuagugauuagacaggagggaagauauuagugauuagacagcagggaagauauuagug

SEQ ID NO: 490465 - RNA, 65 nt, hsa
ccuuaacucagugauuagacaggaaggaagacauuagugauuagacaggagggaagauauuagug

SEQ ID NO: 490466 - RNA, 65 nt, hsa
uuccuguaaguaaaugacuauuuuucccuuaacucagugauuagacaggaaggaagacauuagug

SEQ ID NO: 490467 - RNA, 65 nt, hsa
gaaucacauuucuuacgcaaaugaagggagcagacagugauuaaugguucuguuggccaaggcuu

SEQ ID NO: 490468 - RNA, 65 nt, hsa
uaaugaggacaucagggagccuuuuuaagcuaaagagugauuaucuuucacaguagaacuagaaa

SEQ ID NO: 490469 - RNA, 65 nt, hsa
auacguuauuggcuuugucuguaauacugccacuaagugauuauaauuaagcuguccuguuugca

SEQ ID NO: 490470 - RNA, 65 nt, hsa
cuguuuguuuuuagcagucauuauuuacaauuugcagugauuaacuuggcaaggcuuccuuccgu

SEQ ID NO: 490471 - RNA, 65 nt, hsa
gugcuacuuuuaaguaauguaugugcgcucuguaaagugauuacauuuguuuccuguuuguuuau

SEQ ID NO: 490472 - RNA, 65 nt, hsa
uauguuaauugguuuuuuuuuuuaaaagguaaguuagugauuacuguuaauggugggggaguaag

SEQ ID NO: 490473 - RNA, 65 nt, hsa
cucgacacugaacccccuaggcuucugaugaauccagugauuagcuaaauuugacauagaaagua

SEQ ID NO: 490474 - RNA, 65 nt, hsa
accauugauuuuuuuuuuuuuuuaccaagucuuacagugauuauuuuacguguuuccauguaucu

SEQ ID NO: 490475 - RNA, 65 nt, hsa
aacuuuucacuuaucucauguuagcuguaccagucagugauuaaguagaacuacaaguuguauag

SEQ ID NO: 490476 - RNA, 65 nt, hsa
uguaagaaagcagagagcggaaaaucaauggcuccagugauuaauagauggguuuuuaguaauug

SEQ ID NO: 490477 - RNA, 65 nt, hsa
cuaggaaguaaagugaagaauuuaucucuuuaguuagugauuauauuucacccaucucucaggaa

SEQ ID NO: 490478 - RNA, 65 nt, hsa
aaaaggauuuaaaaaacaagaaugcaugaucucagagugauuaaaaaaaaaucaguggaaauaaa

SEQ ID NO: 490479 - RNA, 65 nt, hsa
gaguaaggauaaauuuuuuaaaggcccauaagacaagugauuauuaugauucccauacuccagau

SEQ ID NO: 490480 - RNA, 65 nt, hsa
agucguaggaguacaagguuuuuauuuuuuuuaacagugauuaaaauauuuauuggucauuuacu

SEQ ID NO: 490481 - RNA, 65 nt, hsa
gaaagaaaggagauuauuacccagaauucacauguagugauuauuaaggacaauuuuuuuuuuua

SEQ ID NO: 490482 - RNA, 65 nt, hsa
uuacauugcuuuuccaaggaagggaacaaaagucuagugauuaguaugccaacugccacuacucc

SEQ ID NO: 490483 - RNA, 65 nt, hsa
auuauaguucuguuaccaagaauaaauaauaggaaagugauuacaaauauuaccuccaggguuca

SEQ ID NO: 490484 - RNA, 65 nt, hsa
guuuugaacaauccuauucaauuuucucauucucuagugauuaccuucauacuuuuaugcaggaa

SEQ ID NO: 490485 - RNA, 65 nt, hsa
gaggcaugugcugucaaauguuagagaccaaacuuagugauuagagguugguccuuugaccuucu

SEQ ID NO: 490486 - RNA, 65 nt, hsa
uaguccucacuguuaaauaaaacccaaucauaguaagugauuaacuagcaaaaaguaaagcuauu

SEQ ID NO: 490487 - RNA, 65 nt, hsa
gcugugccuccuauguaugucugguuugcuggaagagugauuaauacaucuuuaauuuauuaaaa

SEQ ID NO: 490488 - RNA, 65 nt, hsa
acacuuagaaaaugaguaauaguguuuaauaagucagugauuauaugugugcucaaauaaguguu

SEQ ID NO: 490489 - RNA, 65 nt, hsa
gcuauauaaaagaacauggcuuuuugacugauaaaagugauuacagauguuggcucaaguucagg

SEQ ID NO: 490490 - RNA, 65 nt, hsa
caaauauucauuuagaauuuccuuuagaagauggcagugauuauaauauuaauaugauuucauuu

SEQ ID NO: 490491 - RNA, 65 nt, hsa
cacauuucauugucuuagucaaagcaggauuauuaagugauuauuuaaaauucguuuuuuuaaau

SEQ ID NO: 490492 - RNA, 65 nt, hsa
uguuuaaaaaaaaaaaacaaaacaagaaaagcagcagugauuauagagaggucacacucuaagug

SEQ ID NO: 490493 - RNA, 65 nt, hsa
ugacauaguguauguuaauguaaguuuugcuuuccagugauuaccugauacguaagccuauuuga

SEQ ID NO: 490494 - RNA, 65 nt, hsa
cauguuaugcagugaacuauuuuuaaggucuaaucagugauuauuuuuccagcuccguguuucuc

SEQ ID NO: 490495 - RNA, 65 nt, hsa
auauguuaugccacauugcaaaagaauuuugcagaagugauuaauuuaaaauguuauuaagggcc

SEQ ID NO: 490496 - RNA, 65 nt, hsa
gugacuguuaguagugcaaggauuuguaugggcucagugauuacaaacaaagacaugcaaaauac

SEQ ID NO: 490497 - RNA, 65 nt, hsa
cagagaccccauuuaaauaacacaaaauugaccacagugauuagaugaaaaaauuauuuguagau

SEQ ID NO: 490498 - RNA, 65 nt, hsa
cugucuuaaaauuggugcauauguaccauauucaaagugauuauugauauaguuggauuaauauc

SEQ ID NO: 490499 - RNA, 65 nt, hsa
cccguuguggaaauuauuggaauuaacugagccaaagugauuaugcauucuucaucuauuuuagu

SEQ ID NO: 490500 - RNA, 65 nt, hsa
uauaaaguaggaaaaaaagaaucugaaagauacaaagugauuauaaaagaauugacaggacaaua

SEQ ID NO: 490501 - RNA, 65 nt, hsa
aguagauuacguuuuccuauaaggauaauuuuugcagugauuauauugcuaacucucauugcaug

SEQ ID NO: 490502 - RNA, 65 nt, hsa
uguaacauucuuuuuuaaaaguggaagucauuaacagugauuauuauaucacuuauauccugcua

SEQ ID NO: 490503 - RNA, 65 nt, hsa
cuuaguuggcagcacucuccacacuucuguggcucagugauuacugcuauuacuauauuuacuug

SEQ ID NO: 490504 - RNA, 65 nt, hsa
aucaaauaauugaagagacaauagcauuagaaauaagugauuaaaggccucugccucacaacaug

SEQ ID NO: 490505 - RNA, 65 nt, hsa
gaguuaaugauacuacaacuaaguucuuuuuaaaaagugauuaauguauuuuauaaauuaccuuu

SEQ ID NO: 490506 - RNA, 65 nt, hsa
aaaaaacuuaaguccugguuugcguagcuugauagagugauuauacaacuuccauucucucacuu

SEQ ID NO: 490507 - RNA, 65 nt, hsa
uuauuccuagucuuuccagucaacaucguggauguagugauuaaauauaucuagaacuaucauuu

SEQ ID NO: 490508 - RNA, 64 nt, hsa
cugguugauugugaccuugaauacaaaauaaaaguagugauuaguaguuuacagugaccuuuuu

SEQ ID NO: 490509 - RNA, 65 nt, hsa
cacagccccaaccucccaccccugauacaugagccagugauuauucuuguucagggagaagauca

SEQ ID NO: 490510 - RNA, 65 nt, hsa
ccugcagcugagauuccagaacgcccuguguccacagugauuagccucgucuuucagcgagcaua

SEQ ID NO: 490511 - RNA, 65 nt, hsa
ucaugggaaagcuguaguuuagugacuuagcccuuagugauuaauagauuugcauguacauagaa

SEQ ID NO: 490512 - RNA, 65 nt, hsa
auggacuuuugcauuauuucauugugcaugcauccagugauuauacauaagcaacauauguaauc

SEQ ID NO: 490513 - RNA, 65 nt, hsa
ugacagagaacacugccugaagacacacagcaauaagugauuacagcuccuagacuaccuuccaa

SEQ ID NO: 490514 - RNA, 65 nt, hsa
uuccaugauauguuuggcucugcaugccaaaguccagugauuaagcauauauaaguugucaagga

SEQ ID NO: 490515 - RNA, 65 nt, hsa
uucuugaaaugcuuuuguuauuaaacucaaaaggcagugauuaggaugaaauaauuguacauaau

SEQ ID NO: 490516 - RNA, 65 nt, hsa
ugaaucucccacuccagcgcugagugggagaaggcagugauuagcacuugggugacggcagucga

SEQ ID NO: 490517 - RNA, 65 nt, hsa
ccaaaaaugugaaguuauaccaaauaaaguuucuaagugauuaaugcauacgaacagcuacauau

SEQ ID NO: 490518 - RNA, 65 nt, hsa
ggaauaacaacuuaagcuguaguuagauaacaccuagugauuaauuggcugagaaaacccuggag

SEQ ID NO: 490519 - RNA, 65 nt, hsa
aguguauuuugcacaaaaaaauuaaccuggucaauagugauuaccaaaauauauauuaauaaucu

SEQ ID NO: 490520 - RNA, 65 nt, hsa
gaagaacauuuuuaauucuuuaggaaucugcaaugagugauuacaugcuuguaauagguaggcaa

SEQ ID NO: 490521 - RNA, 65 nt, hsa
acugcucuuagguuguuuugauaaagugacauuauagugauuaaauucuucccccuuuaaaaaaa

SEQ ID NO: 490522 - RNA, 65 nt, hsa
uguuuuuaaaaagggagacuaaaagcaaauaccucagugauuaauauuuaagcuacagagaaugu

SEQ ID NO: 490523 - RNA, 65 nt, hsa
ucuaggcucaccacaaccucugccuuccagguucaagugauuagagacagugaaauuuuuaugga

SEQ ID NO: 490524 - RNA, 65 nt, hsa
ccuuuguugcaugcaguuggguucaaaugccaaauagugauuagaagacgaccauucugaucugu

SEQ ID NO: 490525 - RNA, 65 nt, hsa
cagcagagucaguuacaccugcagcucuugucuaaagugauuagauggccacccucaccacuguc

SEQ ID NO: 490526 - RNA, 65 nt, hsa
cuguuauauauugugaaauuuauuuuauauaguaaagugauuaugucuaacugugaucaaacuua

SEQ ID NO: 490527 - RNA, 65 nt, hsa
acuuuuuaauauguuaucacuguaaaacacagaaaagugauuaaugaaugauaauuuagauccau

SEQ ID NO: 490528 - RNA, 65 nt, hsa
gauuuagauaaacuacauuuuaacugaaugucuaaagugauuaucuuuuuuccccccaaguuagu

SEQ ID NO: 490529 - RNA, 65 nt, hsa
guguauuuuuuuagaacugguuuguguauauauauagugauuauggauacuaauucaauguaauu

SEQ ID NO: 490530 - RNA, 65 nt, hsa
gaauuuuaccuauuuuuauaauuauuauuucuuaaagugauuaaaugagaacauggaugagugga

SEQ ID NO: 490531 - RNA, 65 nt, hsa
gcuaaauaagauuuuaaacuaauucauauguaaaaagugauuaggaagaacuugaaguaucauuu

SEQ ID NO: 490532 - RNA, 65 nt, hsa
gggccucagugccccauucucacugcuaucuggggagugauuaccccgggagacugaacugcagg

SEQ ID NO: 490533 - RNA, 65 nt, hsa
ucaggcuuaaccauaacccucaagaucugcuugacagugauuaaauccuuagcucacauccauuc

SEQ ID NO: 490534 - RNA, 65 nt, hsa
caaaggaaucucacuguuccuaaauaaauguguauagugauuaugaaaaguaucccacuguugau

SEQ ID NO: 490535 - RNA, 65 nt, hsa
cccacaauccucuacuucagugggaugcugugucuagugauuaaacaaaaauauagagcugugca

SEQ ID NO: 490536 - RNA, 65 nt, hsa
uguuccacuauuggacugcuuuaaauguagugaucagugauuaugcuauaauccaaucauguauu

SEQ ID NO: 490537 - RNA, 65 nt, hsa
uuuuggaugaagguugcugggauuaaggggauuagagugauuaugggagcagcuaaagaugagag

SEQ ID NO: 490538 - RNA, 65 nt, hsa
gcaagagaauggaagucuuaauagaaggaagcaggagugauuaguucggguuaaagcaaaagugu

SEQ ID NO: 490539 - RNA, 65 nt, hsa
ugauaaguaaacaaauaaauaauguaguuugagauagugauuaagugcuaugaagaaaauaaacu

SEQ ID NO: 490540 - RNA, 65 nt, hsa
aaucugguauuucuugcugcuuggaacuacuuugcagugauuacuugguugcaguccaaguacuc

SEQ ID NO: 490541 - RNA, 65 nt, hsa
agagaaacaaagggauugauaaaaugcugagaacuagugauuauauauuuuucuguauuuaccug

SEQ ID NO: 490542 - RNA, 65 nt, hsa
aauugcuguuuguaaaauaaaucaggaugguagaaagugauuauauggaaaauuggaaccuggau

SEQ ID NO: 490543 - RNA, 65 nt, hsa
cccagaugugggacccgguaccaugcucuaaagcgagugauuaggcagcagcugaagccaccccu

SEQ ID NO: 490544 - RNA, 65 nt, hsa
aaagagguaagcacauuuuauauagacguaaggaaagugauuauuguuuaauaucugugaauuua

SEQ ID NO: 490545 - RNA, 65 nt, hsa
uaucacagcauaaccccacccuuuacauuuugugcagugauuauuuuuuaaagucuucuuucaug

SEQ ID NO: 490546 - RNA, 65 nt, hsa
aaucacuaauuuuuaguugcugagguuggcauuuuagugauuauuaagcacuucugucagucuuu

SEQ ID NO: 490547 - RNA, 65 nt, hsa
ucuuggcucacugcagccucuaccucccagguucaagugauuauccugccuuagccuccugagua

SEQ ID NO: 490548 - RNA, 65 nt, hsa
uuuugauaauuuugcuuaaaccacucauucguuaaagugauuacaaaaaaguucaagaaugaugu

SEQ ID NO: 490549 - RNA, 65 nt, hsa
cacacaccucuucuuuucuugguauuucugguggcagugauuaguugaacagcacauuuaaggca

SEQ ID NO: 490550 - RNA, 65 nt, hsa
auuugggaacaugauuguauuguauuaaaauucgaagugauuauuaucagcuuaauuggauuaaa

SEQ ID NO: 490551 - RNA, 65 nt, hsa
uaaacauggaaagauacuccacugaugaguuuagaagugauuagggcaagcuaguugaccugcac

SEQ ID NO: 490552 - RNA, 65 nt, hsa
cccaaaugcagguguguagguugagucuuuaacaaagugauuaagagcuuggucuguaaggccgg

SEQ ID NO: 490553 - RNA, 65 nt, hsa
uggaacacaagcugcugugaaccaaacugauaucaagugauuagcucaccgggccuugguugcuu

SEQ ID NO: 490554 - RNA, 65 nt, hsa
aucucauuuucaguuuaaguaacugcuguuacuuaagugauuacacuuuugcucaaauugaagcu

SEQ ID NO: 490555 - RNA, 65 nt, hsa
aggaaaagaggagaacuucauacucacaaugaaauagugauuaugaaaauacaguguucuguaau

SEQ ID NO: 490556 - RNA, 65 nt, hsa
caucuuguuuuuuuuuuuuuuccuuuauuuugauaagugauuauuaugcuugauaaacuuugaau

SEQ ID NO: 490557 - RNA, 65 nt, hsa
cuacucuauaaauauauacauauauuuauauauaaagugauuaguugaacuggcauccugcuuua

SEQ ID NO: 490558 - RNA, 53 nt, hsa; identical to SEQ ID NO: 490320

SEQ ID NO: 490559 - RNA, 65 nt, hsa
auguuauuuuuccuagaugaaaauaaaagucaagcagugauuaguuucacucacuguccuagcua

SEQ ID NO: 490560 - RNA, 65 nt, hsa
gcaauugaggugauucaaccuaauuuucaguaagaagugauuaaaauaaugacaugcuaaaaggc

SEQ ID NO: 490561 - RNA, 65 nt, hsa
cccaagugaacagaggagaaaugagauugccagaaagugauuaacuuuggccguugcaaucugcu

SEQ ID NO: 490562 - RNA, 65 nt, hsa
acaccugcaaaaugccuaacaaccuucuucuuuucagugauuaccacuuucuuaccaaugacuuc

SEQ ID NO: 490563 - RNA, 65 nt, hsa
uuagaauuuugguaccuacaacaugcuugauuuugagugauuaaaaaaaaauaauuuggcugggu

SEQ ID NO: 490564 - RNA, 65 nt, hsa
ggaauuugacauuguccaaaccuuuuucauuuuugagugauuaaaaaugaaauguccuuuguaua

SEQ ID NO: 490565 - RNA, 65 nt, hsa
auuuaauggacaugagauaauguuagagguuuuaaagugauuaaacgugcagacuaugcaaacca

SEQ ID NO: 490566 - RNA, 65 nt, hsa
uaccuuuaauuuagaggcaauauuauuacuguuuaagugauuauuugcuuaacacagguuuuauu

SEQ ID NO: 490567 - RNA, 65 nt, hsa
auuuuccacauguagaccaacugguaaacuaacagagugauuaagcaugguguacagaaaagcau

SEQ ID NO: 490568 - RNA, 65 nt, hsa
cagagucggaaucuaaacuguauagcacuuugugaagugauuacaucuaaggaccuccagaagca

SEQ ID NO: 490569 - RNA, 65 nt, hsa
aaugaauugcaguauauacguaugauugcuuuuuaagugauuaucuuuucuucuguuaagucaug

SEQ ID NO: 490570 - RNA, 65 nt, hsa
uuagaaaugaagccuuaagcugcaucaaguuacgaagugauuaauuuccuucucagcaaaccucc

SEQ ID NO: 490571 - RNA, 65 nt, hsa
ggguuuugaccuugccagugaaguuucgguuuugaagugauuaaaugucacuuccucaucaguuu

SEQ ID NO: 490572 - RNA, 65 nt, hsa
aaugugacuguaauuggaaauaagaccuuuaaagaagugauuaagguuaaaugaagucauaagaa

SEQ ID NO: 490573 - RNA, 65 nt, hsa
aauucaucccaacugucuuuuuuucccuaccauucagugauuacugucaaggcugcuuagaaucc

SEQ ID NO: 490574 - RNA, 65 nt, hsa
acauuucuugccacuuccccaacuagaccacuccuagugauuacugacuuuagugccuaaaccuu

SEQ ID NO: 490575 - RNA, 65 nt, hsa
ucauucaggccagagacacagagaccacauagcccagugauuaaaccccgguuucacucuggccc

SEQ ID NO: 490576 - RNA, 65 nt, hsa
cuaaugcuuugauuggauuugccaguucaccggacagugauuaaaacuauguaaugaauauaauc

SEQ ID NO: 490577 - RNA, 65 nt, hsa
gauuauuaauuugacuugaaaacugcuggaacaauagugauuaauaaagauauguauagauaauu

SEQ ID NO: 490578 - RNA, 65 nt, hsa
gggaaaaugucgacuuuguuuuguucuguuccuaaagugauuagcacuaaucucugggauuuuua

SEQ ID NO: 490579 - RNA, 65 nt, hsa
uuaaagucacaucccuguaaauugcagaauucaaaagugauuaucucuuugaucuacuugccuca

SEQ ID NO: 490580 - RNA, 65 nt, hsa
aggcucaaguuggugacccaagccuauuguaaacaagugauuaucucaaagggagaugccaaugg

SEQ ID NO: 490581 - RNA, 65 nt, hsa
cccauuaaaggaaaucuugauugcuuccaguuuucagugauuaaaaauaaagccgcuauaaacau

SEQ ID NO: 490582 - RNA, 65 nt, hsa
ccuuuccaagauacagccugcaagugguagcaagaagugauuagaggcagaucuggacuuggcaa

SEQ ID NO: 490583 - RNA, 65 nt, hsa
accuggguauucacaacaggccugacuugauacuaagugauuaguuuuccaaguugucccacugc

SEQ ID NO: 490584 - RNA, 65 nt, hsa
ucuucuguuaguuuuuguuuuuaagugugaaugcaagugauuaaugaauacagacuuaacaagug

SEQ ID NO: 490585 - RNA, 65 nt, hsa
acagaaaccacuugcuaaaagcgucucuauggugcagugauuauguguacccugugcuguugcuc

SEQ ID NO: 490586 - RNA, 65 nt, hsa
aaaucagccauaagaaagcacuauuaauacucugcagugauuagaaggggugggguggcgggaau

SEQ ID NO: 490587 - RNA, 65 nt, hsa
guagcauuucuccuuauaucaccaugggcagcaucagugauuacaagguaagaaaaagcagggaa

SEQ ID NO: 490588 - RNA, 65 nt, hsa
uaauccuuuaacucugcggauagcauuugguagguagugauuaacugugaauaauaaauacacaa

SEQ ID NO: 490589 - RNA, 65 nt, hsa
uaaaauaacugcuuuuguaagaacggugauauuggagugauuaguauaaauucaauggaauuuga

SEQ ID NO: 490590 - RNA, 65 nt, hsa
uagauagugaaauuuaccuuugagauauaacaauaagugauuaacuguucacuuucagauguaau

SEQ ID NO: 490591 - RNA, 65 nt, hsa
guguuggaaccuccuggggacauguuauauuuugaagugauuaaacuauuuaauugugugucuau

SEQ ID NO: 490592 - RNA, 65 nt, hsa
uccuugggagcaagcagcacuaaaucacaucagggagugauuaguccuggggaaauucaguggag

SEQ ID NO: 490593 - RNA, 65 nt, hsa
gagaggaaacuacugccuuuagaaaauauaaguaaagugauuaaagugcucacguuaccuugaca

SEQ ID NO: 490594 - RNA, 65 nt, hsa
aagugaauguaaauuuuauuauagaauuuucugauagugauuaugauuuguagcucuagugaaua

SEQ ID NO: 490595 - RNA, 65 nt, hsa
agugaugauuuguguguauuaauaagcucacaaauagugauuauuuucaaaagaucuuuuuguaa

SEQ ID NO: 490596 - RNA, 65 nt, hsa
agcugccacaacuggccaugcccugccauugaaacagugauuaaguuugaucaagccauggugac

SEQ ID NO: 490597 - RNA, 65 nt, hsa
cuucuuuuuuuuucuagguuuugcaggcaugaaauagugauuauaucuguggaaaagcauaggaa

SEQ ID NO: 490598 - RNA, 65 nt, hsa
aagauguagcucuggcccagugggaaaaauuaggaagugauuauaaaucgagaggaguuauaaua

SEQ ID NO: 490599 - RNA, 65 nt, hsa
caaagcuggagaguuuaccaacaaauauugacugcagugauuaaccaagacauuuuuguuaacua

SEQ ID NO: 490600 - RNA, 65 nt, hsa
auuaauccccuccauugcucuccaaaagccaauaaagugauuacacccgaugcaccuggcucugu

SEQ ID NO: 490601 - RNA, 65 nt, hsa
uucugaaggcucauuuugguauuugaucuuaaccaagugauuauuagagaaauguaucaacucca

SEQ ID NO: 490602 - RNA, 65 nt, hsa
ccacuuccgagacccaacccugcacgcccagcuccagugauuacucggaccuacagagggugaaa

SEQ ID NO: 490603 - RNA, 65 nt, hsa
ugcucuguguggaauucagaggaaaacccagauucagugauuaacaaugccaaaaaaugcaagua

SEQ ID NO: 490604 - RNA, 65 nt, hsa
uuguuuuuuagaacaacacuuggaaaauaauuugcagugauuauauuucugaacaagguucagaa

SEQ ID NO: 490605 - RNA, 65 nt, hsa
aacaguguaaguauuaggaggugggaccuuugggaagugauuaagucaagucacgaagauagagc

SEQ ID NO: 490606 - RNA, 65 nt, hsa
auucauucccaugggcacagcuaacauuaucccccagugauuacuuucgauuacacugaagagac

SEQ ID NO: 490607 - RNA, 65 nt, hsa
uaccuguaaggaauuuguacuuuuucauaaugcccagugauuagugaguauuucccuuuugccag

SEQ ID NO: 490608 - RNA, 65 nt, hsa
ggaagaagaaauaggacucagaauacaguggcaugagugauuacacuggcagcauuaucucaggc

SEQ ID NO: 490609 - RNA, 65 nt, hsa
ccuggaaaaguaaauuguuuauuuuacaauaagaaagugauuacauauuuuuuuuuuuacaaugg

SEQ ID NO: 490610 - RNA, 65 nt, hsa
caauauucccagaauaguuuucaauguauuaaugaagugauuaauuggcuccauauuuagacuaa

SEQ ID NO: 490611 - RNA, 65 nt, hsa
guugugauauguuuuggcgcauaggagacagaaauagugauuaucaggcguugagccuuuuugua

SEQ ID NO: 490612 - RNA, 65 nt, hsa
augcuaaaucuugcuuugcauucaguaaagugucaagugauuaaguguguauuuguacccuagau

SEQ ID NO: 490613 - RNA, 65 nt, hsa
uacuugaugaguguaacaagaaaggagagucuugcagugauuaaggucucucuuuggacucuccc

SEQ ID NO: 490614 - RNA, 65 nt, hsa
aucauuuguaacaguccacucugucuuuaaaacauagugauuacaauauuuagaaaguuuugagc

SEQ ID NO: 490615 - RNA, 65 nt, hsa
cuacugaauauucuagugaguuauaugauuuacggagugauuaacagaggucuauauaaaguuac

SEQ ID NO: 490616 - RNA, 65 nt, hsa
cuugggcuguuaaauccuaggaaaucucgaaucauagugauuaaaauaguugggguaaaguugua

SEQ ID NO: 490617 - RNA, 65 nt, hsa
accaguuuagacuaaguuacaguauguguuucauaagugauuaaagcuauaucauucccaguuau

SEQ ID NO: 490618 - RNA, 65 nt, hsa
uguuuacccgacagaggcuuuauuugugcuguaucagugauuacuuucaauucaguaugcaguga

SEQ ID NO: 490619 - RNA, 61 nt, hsa
cucacgugccucucggguagcauggagaaguugccaagaguucuuuaggugccuccugucu

SEQ ID NO: 490620 - RNA, 64 nt, hsa
aagggcaauaaaugcccucucugaauguuugaacugccaagaaaaggcauggagacagcgaacu

SEQ ID NO: 490621 - RNA, 64 nt, hsa
uguucuuggcauauuauuguacuaucccuguaacugccaagagcucaggagccaggcuagugau

SEQ ID NO: 490622 - RNA, 64 nt, hsa
gagggcucuggagcugugaguggugccaaaagacugccaagaaucaaggcuuuugugauauguc

SEQ ID NO: 490623 - RNA, 64 nt, hsa
ugggacagaggacacagagguggaagauugaucuugccaagagugagggcagaugucuccagcc

SEQ ID NO: 490624 - RNA, 64 nt, hsa
cgucagagagaaccagagcuccaagucuuuaauuugccaagaugaagaaaaugaguucucaagg

SEQ ID NO: 490625 - RNA, 64 nt, hsa
cugggcccucucuccucacugcaccaggaccugaugccaagaaagugaggauuuaggcaacaag

SEQ ID NO: 490626 - RNA, 64 nt, hsa
agaacugaggcuuggauaucuucuucaacauccuugccaagacuucuccacccucuugcauacc

SEQ ID NO: 490627 - RNA, 64 nt, hsa
gcaaauauuuuaccaccagucaauaauacauuuuugccaagacaugaaguuuuauaaagaucug

SEQ ID NO: 490628 - RNA, 64 nt, hsa
auuaaugaaauaauuacauuuuauguauugaggaugccaagauuaaaaggugacagguagaugu

SEQ ID NO: 490629 - RNA, 64 nt, hsa
acccaaaucucucaaaauguaaauuauguauaccugccaagauaccuuuuccagggugucugcg

SEQ ID NO: 490630 - RNA, 64 nt, hsa
cagaaccugcacugaccaacaaauaaacacauguugccaagaugaaucggucucuaucucuauc

SEQ ID NO: 490631 - RNA, 64 nt, hsa
uaugaccuugggaagacauuggcuccauaagcaaugccaagagaaugaucaauagugaguuugg

SEQ ID NO: 490632 - RNA, 64 nt, hsa
aucauccucagugugaguccucagagccuccaucugccaagaacauucaguuggauuccaucgu

SEQ ID NO: 490633 - RNA, 64 nt, hsa
ugaccucucaaaguugggaaacaagcugauuucuugccaagaggucucccaggagauauuuggg

SEQ ID NO: 490634 - RNA, 64 nt, hsa
gucacauuaagguaaagguuuuggcuggucagugugccaagaccucuccagcuucucauucaug

SEQ ID NO: 490635 - RNA, 64 nt, hsa
caggaagcaugagugcuggauauuuuacuaccaaugccaagauaauucacucuacucagccggc

SEQ ID NO: 490636 - RNA, 64 nt, hsa
uucacauaguucuccaguuguauggagccucuucugccaagagagggccaugcaauucauccca

SEQ ID NO: 490637 - RNA, 63 nt, hsa
cagcgauugcgcagugcgaugcuguuagguugcgcaagcgauguuugcgcucgcauuacaggg

SEQ ID NO: 490638 - RNA, 63 nt, hsa
agcagccagcuguggcagcgcauuaguuuuggcgcaagcgagccuaugcugcagggucacuuu

SEQ ID NO: 490639 - RNA, 64 nt, hsa
gaacccaggaggcagagguugcagugagccaagaucgcgcuauugcacuccagccugggugaca

SEQ ID NO: 490640 - RNA, 64 nt, hsa
cuaggugccugcccagggaggaacggaggaggacucgcgcuacaagaggccacucccagggacc

SEQ ID NO: 490641 - RNA, 64 nt, hsa
cugccauggcuuuuucauugagggccuaaaguaaucgcgcuaagaauaaagggaaaacggcguc

SEQ ID NO: 490642 - RNA, 64 nt, hsa
gaaccugggaggcggagguugcaaugagccgagaucgcgcuacugcacuccagccugggcaaca

SEQ ID NO: 490643 - RNA, 64 nt, hsa
caaacccuuaggauggugaguugaagcaucacccucgcgcuaucuucagugacgggugacggcu

SEQ ID NO: 490644 - RNA, 64 nt, hsa
gaaccugggaggcagagguugcagugagcugagaucgcgcuacugcauuccagccugggcgccg

SEQ ID NO: 490645 - RNA, 64 nt, hsa
uuucauuuucaaaugccaaggcaagugacuagacucgcgcuaauacagugcuggacaacacauu

SEQ ID NO: 490646 - RNA, 64 nt, hsa
uggugauuucugccgugaucuguuugauauuucuucgcgcuaauguguucagauuucguuuggg

SEQ ID NO: 490647 - RNA, 64 nt, hsa; identical to SEQ ID NO: 58517

SEQ ID NO: 490648 - RNA, 64 nt, hsa; identical to SEQ ID NO: 58518

SEQ ID NO: 490649 - RNA, 64 nt, hsa; identical to SEQ ID NO: 58519

SEQ ID NO: 490650 - RNA, 64 nt, hsa; identical to SEQ ID NO: 58520

SEQ ID NO: 490651 - RNA, 64 nt, hsa; identical to SEQ ID NO: 58521

SEQ ID NO: 490652 - RNA, 64 nt, hsa; identical to SEQ ID NO: 58522

SEQ ID NO: 490653 - RNA, 64 nt, hsa; identical to SEQ ID NO: 58523

SEQ ID NO: 490654 - RNA, 64 nt, hsa; identical to SEQ ID NO: 58524

SEQ ID NO: 490655 - RNA, 64 nt, hsa; identical to SEQ ID NO: 58525

SEQ ID NO: 490656 - RNA, 64 nt, hsa; identical to SEQ ID NO: 58526

SEQ ID NO: 490657 - RNA, 64 nt, hsa; identical to SEQ ID NO: 58527

SEQ ID NO: 490658 - RNA, 64 nt, hsa; identical to SEQ ID NO: 58528

SEQ ID NO: 490659 - RNA, 64 nt, hsa; identical to SEQ ID NO: 58529

SEQ ID NO: 490660 - RNA, 64 nt, hsa; identical to SEQ ID NO: 58530

SEQ ID NO: 490661 - RNA, 64 nt, hsa; identical to SEQ ID NO: 58531

SEQ ID NO: 490662 - RNA, 64 nt, hsa; identical to SEQ ID NO: 58532

SEQ ID NO: 490663 - RNA, 64 nt, hsa; identical to SEQ ID NO: 77283

SEQ ID NO: 490664 - RNA, 64 nt, hsa; identical to SEQ ID NO: 77284

SEQ ID NO: 490665 - RNA, 64 nt, hsa; identical to SEQ ID NO: 77285

SEQ ID NO: 490666 - RNA, 57 nt, hsa; identical to SEQ ID NO: 77286

SEQ ID NO: 490667 - RNA, 64 nt, hsa; identical to SEQ ID NO: 77287

SEQ ID NO: 490668 - RNA, 64 nt, hsa; identical to SEQ ID NO: 77288

SEQ ID NO: 490669 - RNA, 64 nt, hsa; identical to SEQ ID NO: 77289

SEQ ID NO: 490670 - RNA, 64 nt, hsa; identical to SEQ ID NO: 77290

SEQ ID NO: 490671 - RNA, 64 nt, hsa; identical to SEQ ID NO: 77291

SEQ ID NO: 490672 - RNA, 64 nt, hsa; identical to SEQ ID NO: 77292

SEQ ID NO: 490673 - RNA, 64 nt, hsa; identical to SEQ ID NO: 77293

SEQ ID NO: 490674 - RNA, 64 nt, hsa; identical to SEQ ID NO: 77294

SEQ ID NO: 490675 - RNA, 64 nt, hsa; identical to SEQ ID NO: 77295

SEQ ID NO: 490676 - RNA, 64 nt, hsa; identical to SEQ ID NO: 77296

SEQ ID NO: 490677 - RNA, 64 nt, hsa; identical to SEQ ID NO: 77297

SEQ ID NO: 490678 - RNA, 64 nt, hsa; identical to SEQ ID NO: 77298

SEQ ID NO: 490679 - RNA, 64 nt, hsa; identical to SEQ ID NO: 77299

SEQ ID NO: 490680 - RNA, 64 nt, hsa; identical to SEQ ID NO: 77300

SEQ ID NO: 490681 - RNA, 64 nt, hsa; identical to SEQ ID NO: 77301

SEQ ID NO: 490682 - RNA, 64 nt, hsa; identical to SEQ ID NO: 77302

SEQ ID NO: 490683 - RNA, 64 nt, hsa; identical to SEQ ID NO: 77303

SEQ ID NO: 490684 - RNA, 64 nt, hsa; identical to SEQ ID NO: 77304

SEQ ID NO: 490685 - RNA, 64 nt, hsa; identical to SEQ ID NO: 77305

SEQ ID NO: 490686 - RNA, 64 nt, hsa; identical to SEQ ID NO: 77306

SEQ ID NO: 490687 - RNA, 64 nt, hsa; identical to SEQ ID NO: 77307

SEQ ID NO: 490688 - RNA, 64 nt, hsa; identical to SEQ ID NO: 77308

SEQ ID NO: 490689 - RNA, 64 nt, hsa; identical to SEQ ID NO: 77309

SEQ ID NO: 490690 - RNA, 64 nt, hsa; identical to SEQ ID NO: 77310

SEQ ID NO: 490691 - RNA, 64 nt, hsa; identical to SEQ ID NO: 77311

SEQ ID NO: 490692 - RNA, 64 nt, hsa; identical to SEQ ID NO: 77312

SEQ ID NO: 490693 - RNA, 64 nt, hsa; identical to SEQ ID NO: 77313

SEQ ID NO: 490694 - RNA, 64 nt, hsa; identical to SEQ ID NO: 77314

SEQ ID NO: 490695 - RNA, 64 nt, hsa; identical to SEQ ID NO: 77315

SEQ ID NO: 490696 - RNA, 64 nt, hsa; identical to SEQ ID NO: 77316

SEQ ID NO: 490697 - RNA, 64 nt, hsa; identical to SEQ ID NO: 77317

SEQ ID NO: 490698 - RNA, 64 nt, hsa; identical to SEQ ID NO: 77318

SEQ ID NO: 490699 - RNA, 64 nt, hsa; identical to SEQ ID NO: 77319

SEQ ID NO: 490700 - RNA, 64 nt, hsa; identical to SEQ ID NO: 77320

SEQ ID NO: 490701 - RNA, 64 nt, hsa; identical to SEQ ID NO: 77321

SEQ ID NO: 490702 - RNA, 64 nt, hsa; identical to SEQ ID NO: 77322

SEQ ID NO: 490703 - RNA, 64 nt, hsa; identical to SEQ ID NO: 77323

SEQ ID NO: 490704 - RNA, 64 nt, hsa; identical to SEQ ID NO: 77324

SEQ ID NO: 490705 - RNA, 64 nt, hsa; identical to SEQ ID NO: 77325

SEQ ID NO: 490706 - RNA, 64 nt, hsa; identical to SEQ ID NO: 77326

SEQ ID NO: 490707 - RNA, 64 nt, hsa; identical to SEQ ID NO: 77327

SEQ ID NO: 490708 - RNA, 64 nt, hsa; identical to SEQ ID NO: 77328

SEQ ID NO: 490709 - RNA, 64 nt, hsa; identical to SEQ ID NO: 77329

SEQ ID NO: 490710 - RNA, 64 nt, hsa; identical to SEQ ID NO: 77330

SEQ ID NO: 490711 - RNA, 64 nt, hsa; identical to SEQ ID NO: 77331

SEQ ID NO: 490712 - RNA, 64 nt, hsa; identical to SEQ ID NO: 77332

SEQ ID NO: 490713 - RNA, 64 nt, hsa; identical to SEQ ID NO: 77333

SEQ ID NO: 490714 - RNA, 64 nt, hsa; identical to SEQ ID NO: 77334

SEQ ID NO: 490715 - RNA, 64 nt, hsa; identical to SEQ ID NO: 77335

SEQ ID NO: 490716 - RNA, 64 nt, hsa; identical to SEQ ID NO: 77336

SEQ ID NO: 490717 - RNA, 64 nt, hsa; identical to SEQ ID NO: 77337

SEQ ID NO: 490718 - RNA, 64 nt, hsa; identical to SEQ ID NO: 77338

SEQ ID NO: 490719 - RNA, 64 nt, hsa; identical to SEQ ID NO: 77339

SEQ ID NO: 490720 - RNA, 64 nt, hsa; identical to SEQ ID NO: 77340

SEQ ID NO: 490721 - RNA, 64 nt, hsa; identical to SEQ ID NO: 77341

SEQ ID NO: 490722 - RNA, 64 nt, hsa; identical to SEQ ID NO: 77342

SEQ ID NO: 490723 - RNA, 64 nt, hsa; identical to SEQ ID NO: 77343

SEQ ID NO: 490724 - RNA, 64 nt, hsa; identical to SEQ ID NO: 77344

SEQ ID NO: 490725 - RNA, 64 nt, hsa; identical to SEQ ID NO: 77345

SEQ ID NO: 490726 - RNA, 64 nt, hsa; identical to SEQ ID NO: 77346

SEQ ID NO: 490727 - RNA, 64 nt, hsa; identical to SEQ ID NO: 77347

SEQ ID NO: 490728 - RNA, 64 nt, hsa; identical to SEQ ID NO: 77348

SEQ ID NO: 490729 - RNA, 64 nt, hsa; identical to SEQ ID NO: 77349

SEQ ID NO: 490730 - RNA, 64 nt, hsa; identical to SEQ ID NO: 77350

SEQ ID NO: 490731 - RNA, 64 nt, hsa; identical to SEQ ID NO: 77351

SEQ ID NO: 490732 - RNA, 64 nt, hsa; identical to SEQ ID NO: 77352

SEQ ID NO: 490733 - RNA, 64 nt, hsa; identical to SEQ ID NO: 77353

SEQ ID NO: 490734 - RNA, 64 nt, hsa; identical to SEQ ID NO: 77354

SEQ ID NO: 490735 - RNA, 64 nt, hsa; identical to SEQ ID NO: 77355

SEQ ID NO: 490736 - RNA, 64 nt, hsa; identical to SEQ ID NO: 77356

SEQ ID NO: 490737 - RNA, 64 nt, hsa; identical to SEQ ID NO: 77357

SEQ ID NO: 490738 - RNA, 64 nt, hsa; identical to SEQ ID NO: 77358

SEQ ID NO: 490739 - RNA, 64 nt, hsa; identical to SEQ ID NO: 77359

SEQ ID NO: 490740 - RNA, 64 nt, hsa; identical to SEQ ID NO: 77360

SEQ ID NO: 490741 - RNA, 64 nt, hsa; identical to SEQ ID NO: 77361

SEQ ID NO: 490742 - RNA, 64 nt, hsa; identical to SEQ ID NO: 77362

SEQ ID NO: 490743 - RNA, 64 nt, hsa; identical to SEQ ID NO: 77363

SEQ ID NO: 490744 - RNA, 64 nt, hsa; identical to SEQ ID NO: 77364

SEQ ID NO: 490745 - RNA, 64 nt, hsa; identical to SEQ ID NO: 77365

SEQ ID NO: 490746 - RNA, 64 nt, hsa; identical to SEQ ID NO: 77366

SEQ ID NO: 490747 - RNA, 64 nt, hsa; identical to SEQ ID NO: 77367

SEQ ID NO: 490748 - RNA, 64 nt, hsa; identical to SEQ ID NO: 77368

SEQ ID NO: 490749 - RNA, 64 nt, hsa; identical to SEQ ID NO: 77369

SEQ ID NO: 490750 - RNA, 64 nt, hsa; identical to SEQ ID NO: 77370

SEQ ID NO: 490751 - RNA, 64 nt, hsa; identical to SEQ ID NO: 77371

SEQ ID NO: 490752 - RNA, 64 nt, hsa; identical to SEQ ID NO: 77372

SEQ ID NO: 490753 - RNA, 64 nt, hsa; identical to SEQ ID NO: 77373

SEQ ID NO: 490754 - RNA, 64 nt, hsa; identical to SEQ ID NO: 77374

SEQ ID NO: 490755 - RNA, 64 nt, hsa; identical to SEQ ID NO: 77375

SEQ ID NO: 490756 - RNA, 64 nt, hsa; identical to SEQ ID NO: 77376

SEQ ID NO: 490757 - RNA, 64 nt, hsa; identical to SEQ ID NO: 77377

SEQ ID NO: 490758 - RNA, 64 nt, hsa; identical to SEQ ID NO: 77378

SEQ ID NO: 490759 - RNA, 64 nt, hsa; identical to SEQ ID NO: 77379

SEQ ID NO: 490760 - RNA, 64 nt, hsa; identical to SEQ ID NO: 77380

SEQ ID NO: 490761 - RNA, 64 nt, hsa; identical to SEQ ID NO: 77381

SEQ ID NO: 490762 - RNA, 64 nt, hsa; identical to SEQ ID NO: 77382

SEQ ID NO: 490763 - RNA, 64 nt, hsa; identical to SEQ ID NO: 77383

SEQ ID NO: 490764 - RNA, 64 nt, hsa; identical to SEQ ID NO: 77384

SEQ ID NO: 490765 - RNA, 64 nt, hsa; identical to SEQ ID NO: 77385

SEQ ID NO: 490766 - RNA, 64 nt, hsa; identical to SEQ ID NO: 77386

SEQ ID NO: 490767 - RNA, 64 nt, hsa; identical to SEQ ID NO: 77387

SEQ ID NO: 490768 - RNA, 64 nt, hsa; identical to SEQ ID NO: 77388

SEQ ID NO: 490769 - RNA, 64 nt, hsa; identical to SEQ ID NO: 77389

SEQ ID NO: 490770 - RNA, 64 nt, hsa; identical to SEQ ID NO: 77390

SEQ ID NO: 490771 - RNA, 64 nt, hsa; identical to SEQ ID NO: 77391

SEQ ID NO: 490772 - RNA, 64 nt, hsa; identical to SEQ ID NO: 77392

SEQ ID NO: 490773 - RNA, 64 nt, hsa; identical to SEQ ID NO: 77393

SEQ ID NO: 490774 - RNA, 64 nt, hsa; identical to SEQ ID NO: 77394

SEQ ID NO: 490775 - RNA, 64 nt, hsa; identical to SEQ ID NO: 77395

SEQ ID NO: 490776 - RNA, 64 nt, hsa; identical to SEQ ID NO: 77396

SEQ ID NO: 490777 - RNA, 64 nt, hsa; identical to SEQ ID NO: 77397

SEQ ID NO: 490778 - RNA, 64 nt, hsa; identical to SEQ ID NO: 77398

SEQ ID NO: 490779 - RNA, 64 nt, hsa; identical to SEQ ID NO: 77399

SEQ ID NO: 490780 - RNA, 64 nt, hsa; identical to SEQ ID NO: 77400

SEQ ID NO: 490781 - RNA, 64 nt, hsa; identical to SEQ ID NO: 77401

SEQ ID NO: 490782 - RNA, 64 nt, hsa; identical to SEQ ID NO: 77402

SEQ ID NO: 490783 - RNA, 64 nt, hsa; identical to SEQ ID NO: 77403

SEQ ID NO: 490784 - RNA, 64 nt, hsa; identical to SEQ ID NO: 77404

SEQ ID NO: 490785 - RNA, 64 nt, hsa; identical to SEQ ID NO: 77405

SEQ ID NO: 490786 - RNA, 64 nt, hsa; identical to SEQ ID NO: 77406

SEQ ID NO: 490787 - RNA, 64 nt, hsa; identical to SEQ ID NO: 77407

SEQ ID NO: 490788 - RNA, 64 nt, hsa; identical to SEQ ID NO: 77408

SEQ ID NO: 490789 - RNA, 64 nt, hsa; identical to SEQ ID NO: 77409

SEQ ID NO: 490790 - RNA, 64 nt, hsa; identical to SEQ ID NO: 77410

SEQ ID NO: 490791 - RNA, 64 nt, hsa; identical to SEQ ID NO: 77411

SEQ ID NO: 490792 - RNA, 64 nt, hsa; identical to SEQ ID NO: 77412

SEQ ID NO: 490793 - RNA, 64 nt, hsa; identical to SEQ ID NO: 77413

SEQ ID NO: 490794 - RNA, 62 nt, hsa; identical to SEQ ID NO: 77414

SEQ ID NO: 490795 - RNA, 64 nt, hsa; identical to SEQ ID NO: 77415

SEQ ID NO: 490796 - RNA, 64 nt, hsa; identical to SEQ ID NO: 77416

SEQ ID NO: 490797 - RNA, 64 nt, hsa; identical to SEQ ID NO: 77417

SEQ ID NO: 490798 - RNA, 64 nt, hsa; identical to SEQ ID NO: 77418

SEQ ID NO: 490799 - RNA, 64 nt, hsa; identical to SEQ ID NO: 77419

SEQ ID NO: 490800 - RNA, 64 nt, hsa; identical to SEQ ID NO: 77420

SEQ ID NO: 490801 - RNA, 64 nt, hsa; identical to SEQ ID NO: 77421

SEQ ID NO: 490802 - RNA, 64 nt, hsa; identical to SEQ ID NO: 77422

SEQ ID NO: 490803 - RNA, 64 nt, hsa
ugugggggccccaggaauccuuagcugaagcggggagacucacucuccaucucaggaaauucua

SEQ ID NO: 490804 - RNA, 64 nt, hsa
ugggugggcaagucugggcccugggguagggagggagacucaggcccacacuuggguauuuucu

SEQ ID NO: 490805 - RNA, 64 nt, hsa
guucuucauaggagacucagagaagacuucauaggagacucauuauuguuuacuggacaucagg

SEQ ID NO: 490806 - RNA, 64 nt, hsa
cccagguacccacagcauuggcuguucuucauaggagacucagagaagacuucauaggagacuc

SEQ ID NO: 490807 - RNA, 64 nt, hsa
caacacuaguuugauauuugauuuacucuccaaugagacucaauggcugggccgugguagacuc

SEQ ID NO: 490808 - RNA, 64 nt, hsa
auauguacuagaaaggaaaugggcaagggucaaagagacucaugggcaagaucuuucaggcuuc

SEQ ID NO: 490809 - RNA, 64 nt, hsa
uaauccaggggggacccagaccccacaagccauggagacucaggaccccagaaggcauggaagc

SEQ ID NO: 490810 - RNA, 64 nt, hsa
agcccagggaggacccagaccuccacacuccauggagacucaguucuccuaggaccauuuauuc

SEQ ID NO: 490811 - RNA, 64 nt, hsa
aaacacuaucugaugcacagaacaccucuacuuugagacucaccucucauaaagcuucuuuuuc

SEQ ID NO: 490812 - RNA, 64 nt, hsa
aaucaggcagggaaucgaaacgacagugcuggaggagacucaggaagcagaggcgucccugccg

SEQ ID NO: 490813 - RNA, 64 nt, hsa; identical to SEQ ID NO: 220328

SEQ ID NO: 490814 - RNA, 64 nt, hsa; identical to SEQ ID NO: 220329

SEQ ID NO: 490815 - RNA, 64 nt, hsa; identical to SEQ ID NO: 220330

SEQ ID NO: 490816 - RNA, 64 nt, hsa; identical to SEQ ID NO: 220331

SEQ ID NO: 490817 - RNA, 64 nt, hsa; identical to SEQ ID NO: 220332

SEQ ID NO: 490818 - RNA, 64 nt, hsa; identical to SEQ ID NO: 220333

SEQ ID NO: 490819 - RNA, 64 nt, hsa; identical to SEQ ID NO: 220334

SEQ ID NO: 490820 - RNA, 64 nt, hsa; identical to SEQ ID NO: 220335

SEQ ID NO: 490821 - RNA, 64 nt, hsa; identical to SEQ ID NO: 220336

SEQ ID NO: 490822 - RNA, 64 nt, hsa; identical to SEQ ID NO: 220337

SEQ ID NO: 490823 - RNA, 64 nt, hsa; identical to SEQ ID NO: 220338

SEQ ID NO: 490824 - RNA, 64 nt, hsa; identical to SEQ ID NO: 220339

SEQ ID NO: 490825 - RNA, 64 nt, hsa; identical to SEQ ID NO: 220340

SEQ ID NO: 490826 - RNA, 64 nt, hsa; identical to SEQ ID NO: 220341

SEQ ID NO: 490827 - RNA, 64 nt, hsa; identical to SEQ ID NO: 220342

SEQ ID NO: 490828 - RNA, 64 nt, hsa; identical to SEQ ID NO: 220343

SEQ ID NO: 490829 - RNA, 64 nt, hsa; identical to SEQ ID NO: 220344

SEQ ID NO: 490830 - RNA, 64 nt, hsa; identical to SEQ ID NO: 220345

SEQ ID NO: 490831 - RNA, 64 nt, hsa; identical to SEQ ID NO: 220346

SEQ ID NO: 490832 - RNA, 64 nt, hsa; identical to SEQ ID NO: 220347

SEQ ID NO: 490833 - RNA, 64 nt, hsa
ucccgcuacagcauguucucugaggacacuaaccacgcuggaccuugaacuggguacuugugga

SEQ ID NO: 490834 - RNA, 64 nt, hsa
uuuuuuugagacagaguuuucacucuuauugcccacgcuggagugcaguggcaugaucucggcu

SEQ ID NO: 490835 - RNA, 64 nt, hsa
ucuguuuuuagcagagacaugcaacaacaacacacacgcacacacgcacacacacacacguaca

SEQ ID NO: 490836 - RNA, 64 nt, hsa
uagcagagacaugcaacaacaacacacacgcacacacgcacacacacacacguacacacacaua

SEQ ID NO: 490837 - RNA, 64 nt, hsa
cacacacacacgcacacaugcgugugcacccgcgcacgcacauacacacacacauauagcagua

SEQ ID NO: 490838 - RNA, 64 nt, hsa
cuucuucagcaccacacacacgcacacacacacacacgcacacaugcgugugcacccgcgcacg

SEQ ID NO: 490839 - RNA, 64 nt, hsa
ggccaagcaaccuccacuucuucagcaccacacacacgcacacacacacacacgcacacaugcg

SEQ ID NO: 490840 - RNA, 64 nt, hsa
gcacacgugcucccugaaggcacacguacgcacacacgcacaugcacagauaugccgccugggc

SEQ ID NO: 490841 - RNA, 64 nt, hsa
ugccgccugggcacacagauaagcugcccaaaugcacgcacacgcacagagacaugccagaaca

SEQ ID NO: 490842 - RNA, 64 nt, hsa
cugggcacacagauaagcugcccaaaugcacgcacacgcacagagacaugccagaacauacaag

SEQ ID NO: 490843 - RNA, 64 nt, hsa
cagaacauacaaggacaugcugccugaacauacacacgcacacccaugcgcagaugugcugccu

SEQ ID NO: 490844 - RNA, 64 nt, hsa
acacacacacgugugcacagauaugcugucuggacacgcacacacaugcagauaugcugccugg

SEQ ID NO: 490845 - RNA, 64 nt, hsa
acacacgugcagauaugcuguccggauacacacgcacgcacacaugcagauaugcugccugggc

SEQ ID NO: 490846 - RNA, 64 nt, hsa
ugcagcaacaugugcacaggcacgcacaugugugcacgcacacauacaaucuggguuaucuuug

SEQ ID NO: 490847 - RNA, 64 nt, hsa
aagagagggaggggugcagcaacaugugcacaggcacgcacaugugugcacgcacacauacaau

SEQ ID NO: 490848 - RNA, 64 nt, hsa
cugugcaaauucugaugauggccccacccccgcacacgcacacgcacaucaugcuuuuccagcu

SEQ ID NO: 490849 - RNA, 64 nt, hsa
aaauucugaugauggccccacccccgcacacgcacacgcacaucaugcuuuuccagcucaucac

SEQ ID NO: 490850 - RNA, 64 nt, hsa
ccucccucccuucuuccucucucucucucucacucacgcacacgcacacacacacacacacaca

SEQ ID NO: 490851 - RNA, 64 nt, hsa
ucccuucuuccucucucucucucucacucacgcacacgcacacacacacacacacacacacaca

SEQ ID NO: 490852 - RNA, 64 nt, hsa
aaauucugaugaugaccccacccccgcacacgcacacgcacaucaugcuuuuccagcucaucac

SEQ ID NO: 490853 - RNA, 64 nt, hsa
cugugcaaauucugaugaugaccccacccccgcacacgcacacgcacaucaugcuuuuccagcu

SEQ ID NO: 490854 - RNA, 64 nt, hsa
gguagcaaaugacacaugcacgcacacacacauacacgcacaagcgccagugcgcacguguaca

SEQ ID NO: 490855 - RNA, 64 nt, hsa
acugaaacauucaccugguagcaaaugacacaugcacgcacacacacauacacgcacaagcgcc

SEQ ID NO: 490856 - RNA, 64 nt, hsa
ugcacacacaugcaugcacacacaugcacacauacacgcacaugcacacauacacaugcaugca

SEQ ID NO: 490857 - RNA, 64 nt, hsa
cauacacaggcauacaugcaugcacacacacaugcacgcacacacacaugcacacauacacgug

SEQ ID NO: 490858 - RNA, 64 nt, hsa
uucacacccagucccugccacagaccgucucagacacgcacagugggccugcugcaugauucac

SEQ ID NO: 490859 - RNA, 64 nt, hsa; identical to SEQ ID NO: 490858

SEQ ID NO: 490860 - RNA, 64 nt, hsa
uucacacccagucccugccacagaccgucucagacacgcacagugggccugcugcaugcguguu

SEQ ID NO: 490861 - RNA, 64 nt, hsa
acguaugagcuucuacugcacacaugcacacacacacgcacacguacauucacuacaaacgugc

SEQ ID NO: 490862 - RNA, 64 nt, hsa
acguacacacagaugcacauggacacaccccaaacacgcacaggcuccuacacacaugcacaca

SEQ ID NO: 490863 - RNA, 64 nt, hsa
uggucacacagagauacgcaaacacaccgaugcacacgcacauagagauaugcacacacagaug

SEQ ID NO: 490864 - RNA, 64 nt, hsa
cacacagaugcacacacagauauacacauggaugcacgcacaugccaaugcacgcacacaucag

SEQ ID NO: 490865 - RNA, 64 nt, hsa
cagauauacacauggaugcacgcacaugccaaugcacgcacacaucagugcacacggaugcaca

SEQ ID NO: 490866 - RNA, 64 nt, hsa
uuucaggacgucccuaagcugagcuaggaggcaccacgcacaggccggaggcaccacgcacagg

SEQ ID NO: 490867 - RNA, 64 nt, hsa
gagcuaggaggcaccacgcacaggccggaggcaccacgcacaggccagagucucccaaauccug

SEQ ID NO: 490868 - RNA, 64 nt, hsa
cacacacacaaaugcacgcccacuugcacaugcucacgcacauguucacacaugcacacucacg

SEQ ID NO: 490869 - RNA, 64 nt, hsa
cacucacgcucacacaugcugucacgcauacacacacgcacauacuccugcacauguucccaug

SEQ ID NO: 490870 - RNA, 64 nt, hsa
cacacacacacacacacacacacacacgcacgcacacgcacacaucuuaccucucaugcguguu

SEQ ID NO: 490871 - RNA, 64 nt, hsa
gggacacacacacacacacacacacacacacacgcacgcacacgcacacaucuuaccucucaug

SEQ ID NO: 490872 - RNA, 64 nt, hsa
ggaaugaaccgaggccgucgccccugcacacgcacacgcacacagccugguuuuguccucaugc

SEQ ID NO: 490873 - RNA, 64 nt, hsa
uccccaggaaugaaccgaggccgucgccccugcacacgcacacgcacacagccugguuuugucc

SEQ ID NO: 490874 - RNA, 64 nt, hsa
cccucuaacaagaacuugucucagcacaugcgcacacgcacacucggacucacacgaagucaca

SEQ ID NO: 490875 - RNA, 64 nt, hsa
ugcgcacacgcacacucggacucacacgaagucacacgcacacaugcacgcacacacacauaug

SEQ ID NO: 490876 - RNA, 64 nt, hsa
cacucggacucacacgaagucacacgcacacaugcacgcacacacacauauggggaccugcaca

SEQ ID NO: 490877 - RNA, 64 nt, hsa
caugugugggcacacacgcacaaacacacacacgcacgcacacaguggcagaagggauuuauau

SEQ ID NO: 490878 - RNA, 64 nt, hsa
ucugugaauuaaaauaugcucaugugugggcacacacgcacaaacacacacacgcacgcacaca

SEQ ID NO: 490879 - RNA, 64 nt, hsa
ccaucccccaugcucuugcgugugcuugcacgugcacgcacacacacacccagugcucucucca

SEQ ID NO: 490880 - RNA, 64 nt, hsa
gugugugugugcgcgcgcgcgugcucgcugugcgcacgcacacaucuccucgucugggugugcg

SEQ ID NO: 490881 - RNA, 64 nt, hsa
ggcagacaccccuuccagcggaaguuacuaauucggaccugacugaugcaguuuccauagcaac

SEQ ID NO: 490882 - RNA, 64 nt, hsa
guuuuauacauuuccagaccauucaucaaggaaaggaccugaagaaguggaaagcacacuucau

SEQ ID NO: 490883 - RNA, 64 nt, hsa
gcacugggcuguguccugauuccucagaguauggggaccugacaucuuuggguccccaagaguu

SEQ ID NO: 490884 - RNA, 64 nt, hsa
gaugcuccguucacauaagccagugugguucuggggaccugaggagcccuguggcacccacagg

SEQ ID NO: 490885 - RNA, 64 nt, hsa
gcuccagugguagaggaccaaggauugagguuugggaccugaagcuccagugugugccuuuggc

SEQ ID NO: 490886 - RNA, 64 nt, hsa
cuggagcccaagcagcuccccuaggggacugaccggaccugaccuccccucccugugucugggu

SEQ ID NO: 490887 - RNA, 64 nt, hsa
cuagucuuucuaugcuccaaaugaaugucuguggggaccugagagcaccuggaauuuguuggaa

SEQ ID NO: 490888 - RNA, 64 nt, hsa
guggagucguaguaauaugugcacacacagaaggggaccugauugggugggagcugguuaugug

SEQ ID NO: 490889 - RNA, 64 nt, hsa
cccuuggcacacuuguacccacaggugaggggcaggaccugaagguauuggccuguucaacaau

SEQ ID NO: 490890 - RNA, 64 nt, hsa
uggggaccaaaggucagggacacauccccuuagaggaccugaguuugggagaguggugagugga

SEQ ID NO: 490891 - RNA, 64 nt, hsa
gauuugaucaccgaagcagccaccugcuguaguuggaccugaggucagaggcggggcaucagag

SEQ ID NO: 490892 - RNA, 64 nt, hsa
ccuugcugugugugagggcccagguggaaggcgcggaccugacagcauuccaauaaagcauacg

SEQ ID NO: 490893 - RNA, 64 nt, hsa; identical to SEQ ID NO: 119910

SEQ ID NO: 490894 - RNA, 64 nt, hsa; identical to SEQ ID NO: 119911

SEQ ID NO: 490895 - RNA, 64 nt, hsa; identical to SEQ ID NO: 119912

SEQ ID NO: 490896 - RNA, 64 nt, hsa; identical to SEQ ID NO: 119913

SEQ ID NO: 490897 - RNA, 64 nt, hsa; identical to SEQ ID NO: 119914

SEQ ID NO: 490898 - RNA, 64 nt, hsa; identical to SEQ ID NO: 119915

SEQ ID NO: 490899 - RNA, 64 nt, hsa; identical to SEQ ID NO: 119916

SEQ ID NO: 490900 - RNA, 64 nt, hsa; identical to SEQ ID NO: 119917

SEQ ID NO: 490901 - RNA, 64 nt, hsa; identical to SEQ ID NO: 119918

SEQ ID NO: 490902 - RNA, 64 nt, hsa; identical to SEQ ID NO: 119919

SEQ ID NO: 490903 - RNA, 64 nt, hsa; identical to SEQ ID NO: 119920

SEQ ID NO: 490904 - RNA, 64 nt, hsa; identical to SEQ ID NO: 119921

SEQ ID NO: 490905 - RNA, 64 nt, hsa; identical to SEQ ID NO: 119922

SEQ ID NO: 490906 - RNA, 64 nt, hsa; identical to SEQ ID NO: 119923

SEQ ID NO: 490907 - RNA, 64 nt, hsa; identical to SEQ ID NO: 119924

SEQ ID NO: 490908 - RNA, 64 nt, hsa; identical to SEQ ID NO: 119925

SEQ ID NO: 490909 - RNA, 64 nt, hsa; identical to SEQ ID NO: 119926

SEQ ID NO: 490910 - RNA, 64 nt, hsa; identical to SEQ ID NO: 119927

SEQ ID NO: 490911 - RNA, 64 nt, hsa; identical to SEQ ID NO: 119928

SEQ ID NO: 490912 - RNA, 64 nt, hsa; identical to SEQ ID NO: 119929

SEQ ID NO: 490913 - RNA, 64 nt, hsa; identical to SEQ ID NO: 119930

SEQ ID NO: 490914 - RNA, 64 nt, hsa; identical to SEQ ID NO: 119931

SEQ ID NO: 490915 - RNA, 64 nt, hsa; identical to SEQ ID NO: 119932

SEQ ID NO: 490916 - RNA, 64 nt, hsa; identical to SEQ ID NO: 119933

SEQ ID NO: 490917 - RNA, 64 nt, hsa; identical to SEQ ID NO: 119934

SEQ ID NO: 490918 - RNA, 64 nt, hsa; identical to SEQ ID NO: 119935

SEQ ID NO: 490919 - RNA, 64 nt, hsa; identical to SEQ ID NO: 119936

SEQ ID NO: 490920 - RNA, 64 nt, hsa; identical to SEQ ID NO: 119937

SEQ ID NO: 490921 - RNA, 64 nt, hsa; identical to SEQ ID NO: 119938

SEQ ID NO: 490922 - RNA, 64 nt, hsa; identical to SEQ ID NO: 119939

SEQ ID NO: 490923 - RNA, 64 nt, hsa; identical to SEQ ID NO: 119940

SEQ ID NO: 490924 - RNA, 64 nt, hsa; identical to SEQ ID NO: 119941

SEQ ID NO: 490925 - RNA, 64 nt, hsa; identical to SEQ ID NO: 119942

SEQ ID NO: 490926 - RNA, 64 nt, hsa; identical to SEQ ID NO: 119943

SEQ ID NO: 490927 - RNA, 64 nt, hsa; identical to SEQ ID NO: 119944

SEQ ID NO: 490928 - RNA, 64 nt, hsa; identical to SEQ ID NO: 119945

SEQ ID NO: 490929 - RNA, 64 nt, hsa; identical to SEQ ID NO: 119946

SEQ ID NO: 490930 - RNA, 64 nt, hsa; identical to SEQ ID NO: 119947

SEQ ID NO: 490931 - RNA, 64 nt, hsa; identical to SEQ ID NO: 119948

SEQ ID NO: 490932 - RNA, 64 nt, hsa; identical to SEQ ID NO: 119949

SEQ ID NO: 490933 - RNA, 64 nt, hsa; identical to SEQ ID NO: 119950

SEQ ID NO: 490934 - RNA, 64 nt, hsa; identical to SEQ ID NO: 119951

SEQ ID NO: 490935 - RNA, 64 nt, hsa; identical to SEQ ID NO: 119952

SEQ ID NO: 490936 - RNA, 64 nt, hsa; identical to SEQ ID NO: 119953

SEQ ID NO: 490937 - RNA, 64 nt, hsa; identical to SEQ ID NO: 119954

SEQ ID NO: 490938 - RNA, 64 nt, hsa; identical to SEQ ID NO: 119955

SEQ ID NO: 490939 - RNA, 64 nt, hsa; identical to SEQ ID NO: 119956

SEQ ID NO: 490940 - RNA, 64 nt, hsa; identical to SEQ ID NO: 119957

SEQ ID NO: 490941 - RNA, 64 nt, hsa; identical to SEQ ID NO: 119958

SEQ ID NO: 490942 - RNA, 64 nt, hsa; identical to SEQ ID NO: 119959

SEQ ID NO: 490943 - RNA, 64 nt, hsa; identical to SEQ ID NO: 119960

SEQ ID NO: 490944 - RNA, 64 nt, hsa; identical to SEQ ID NO: 119961

SEQ ID NO: 490945 - RNA, 58 nt, hsa; identical to SEQ ID NO: 119962

SEQ ID NO: 490946 - RNA, 64 nt, hsa; identical to SEQ ID NO: 119963

SEQ ID NO: 490947 - RNA, 64 nt, hsa; identical to SEQ ID NO: 119964

SEQ ID NO: 490948 - RNA, 64 nt, hsa; identical to SEQ ID NO: 119965

SEQ ID NO: 490949 - RNA, 64 nt, hsa; identical to SEQ ID NO: 119966

SEQ ID NO: 490950 - RNA, 64 nt, hsa; identical to SEQ ID NO: 119967

SEQ ID NO: 490951 - RNA, 64 nt, hsa; identical to SEQ ID NO: 119968

SEQ ID NO: 490952 - RNA, 64 nt, hsa; identical to SEQ ID NO: 119969

SEQ ID NO: 490953 - RNA, 64 nt, hsa; identical to SEQ ID NO: 119970

SEQ ID NO: 490954 - RNA, 55 nt, hsa; identical to SEQ ID NO: 119971

SEQ ID NO: 490955 - RNA, 64 nt, hsa; identical to SEQ ID NO: 119972

SEQ ID NO: 490956 - RNA, 64 nt, hsa; identical to SEQ ID NO: 119973

SEQ ID NO: 490957 - RNA, 64 nt, hsa; identical to SEQ ID NO: 119974

SEQ ID NO: 490958 - RNA, 64 nt, hsa; identical to SEQ ID NO: 119975

SEQ ID NO: 490959 - RNA, 64 nt, hsa; identical to SEQ ID NO: 119976

SEQ ID NO: 490960 - RNA, 64 nt, hsa; identical to SEQ ID NO: 119977

SEQ ID NO: 490961 - RNA, 64 nt, hsa; identical to SEQ ID NO: 119978

SEQ ID NO: 490962 - RNA, 64 nt, hsa; identical to SEQ ID NO: 119979

SEQ ID NO: 490963 - RNA, 64 nt, hsa; identical to SEQ ID NO: 119980

SEQ ID NO: 490964 - RNA, 64 nt, hsa; identical to SEQ ID NO: 119981

SEQ ID NO: 490965 - RNA, 64 nt, hsa; identical to SEQ ID NO: 119982

SEQ ID NO: 490966 - RNA, 64 nt, hsa; identical to SEQ ID NO: 119983

SEQ ID NO: 490967 - RNA, 64 nt, hsa; identical to SEQ ID NO: 119984

SEQ ID NO: 490968 - RNA, 64 nt, hsa; identical to SEQ ID NO: 119985

SEQ ID NO: 490969 - RNA, 64 nt, hsa; identical to SEQ ID NO: 119986

SEQ ID NO: 490970 - RNA, 64 nt, hsa; identical to SEQ ID NO: 119987

SEQ ID NO: 490971 - RNA, 55 nt, hsa; identical to SEQ ID NO: 119988

SEQ ID NO: 490972 - RNA, 64 nt, hsa; identical to SEQ ID NO: 119989

SEQ ID NO: 490973 - RNA, 64 nt, hsa; identical to SEQ ID NO: 119990

SEQ ID NO: 490974 - RNA, 64 nt, hsa; identical to SEQ ID NO: 119991

SEQ ID NO: 490975 - RNA, 64 nt, hsa; identical to SEQ ID NO: 119992

SEQ ID NO: 490976 - RNA, 64 nt, hsa; identical to SEQ ID NO: 119993

SEQ ID NO: 490977 - RNA, 64 nt, hsa; identical to SEQ ID NO: 119994

SEQ ID NO: 490978 - RNA, 64 nt, hsa; identical to SEQ ID NO: 119995

SEQ ID NO: 490979 - RNA, 64 nt, hsa; identical to SEQ ID NO: 119996

SEQ ID NO: 490980 - RNA, 64 nt, hsa; identical to SEQ ID NO: 119997

SEQ ID NO: 490981 - RNA, 64 nt, hsa; identical to SEQ ID NO: 119998

SEQ ID NO: 490982 - RNA, 62 nt, hsa; identical to SEQ ID NO: 119999

SEQ ID NO: 490983 - RNA, 64 nt, hsa; identical to SEQ ID NO: 120000

SEQ ID NO: 490984 - RNA, 64 nt, hsa; identical to SEQ ID NO: 120001

SEQ ID NO: 490985 - RNA, 64 nt, hsa; identical to SEQ ID NO: 120002

SEQ ID NO: 490986 - RNA, 64 nt, hsa; identical to SEQ ID NO: 120003

SEQ ID NO: 490987 - RNA, 64 nt, hsa; identical to SEQ ID NO: 120004

SEQ ID NO: 490988 - RNA, 64 nt, hsa; identical to SEQ ID NO: 120005

SEQ ID NO: 490989 - RNA, 64 nt, hsa; identical to SEQ ID NO: 120006

SEQ ID NO: 490990 - RNA, 64 nt, hsa; identical to SEQ ID NO: 120007

SEQ ID NO: 490991 - RNA, 64 nt, hsa; identical to SEQ ID NO: 120008

SEQ ID NO: 490992 - RNA, 64 nt, hsa; identical to SEQ ID NO: 486536

SEQ ID NO: 490993 - RNA, 64 nt, hsa; identical to SEQ ID NO: 486537

SEQ ID NO: 490994 - RNA, 64 nt, hsa; identical to SEQ ID NO: 486538

SEQ ID NO: 490995 - RNA, 64 nt, hsa; identical to SEQ ID NO: 486539

SEQ ID NO: 490996 - RNA, 64 nt, hsa; identical to SEQ ID NO: 486540

SEQ ID NO: 490997 - RNA, 64 nt, hsa; identical to SEQ ID NO: 486541

SEQ ID NO: 490998 - RNA, 64 nt, hsa; identical to SEQ ID NO: 486542

SEQ ID NO: 490999 - RNA, 64 nt, hsa; identical to SEQ ID NO: 486543

SEQ ID NO: 491000 - RNA, 64 nt, hsa; identical to SEQ ID NO: 486544

SEQ ID NO: 491001 - RNA, 64 nt, hsa; identical to SEQ ID NO: 486545

SEQ ID NO: 491002 - RNA, 64 nt, hsa; identical to SEQ ID NO: 486546

SEQ ID NO: 491003 - RNA, 64 nt, hsa; identical to SEQ ID NO: 486547

SEQ ID NO: 491004 - RNA, 64 nt, hsa; identical to SEQ ID NO: 486548

SEQ ID NO: 491005 - RNA, 64 nt, hsa; identical to SEQ ID NO: 486549

SEQ ID NO: 491006 - RNA, 64 nt, hsa
cuuugacuaaauuacccccauccuccuugcccggaaaagggagagcuagagccacucacuguca

SEQ ID NO: 491007 - RNA, 64 nt, hsa
uuugaugccaaccccaacagacccguagggggagaaaagggaggaaaaaaguaauuuuaagggg

SEQ ID NO: 491008 - RNA, 64 nt, hsa
ccuggggcuagaucgaugauaugaccagaaaucaaaaagggaaugcauuauuuauugcugugua

SEQ ID NO: 491009 - RNA, 64 nt, hsa
guguccagcugaguuucucuuggguauaaaggcuaaaagggaaaaaggauauguggagaaucau

SEQ ID NO: 491010 - RNA, 64 nt, hsa
gaacuuaaagaacuggugauuuuuuuuuaacaaaaaaagggaccauugcaacuuuuguuaauuu

SEQ ID NO: 491011 - RNA, 64 nt, hsa
auuaauauauuuucaggcguauuuuuguacagugaaaagggaacauucuugcuguguuuuuuca

SEQ ID NO: 491012 - RNA, 64 nt, hsa
uagugacuugacugagaaguuaggguagaaaacaaaaagggaguggauucugggagccucuucc

SEQ ID NO: 491013 - RNA, 64 nt, hsa
aagagcguccauaggagaagugagaauacugugaaaaagggauguuagcauucauuagaguaug

SEQ ID NO: 491014 - RNA, 64 nt, hsa
ggaggugugggguaagggagggaagucacaucagaaaagggaaagccacggaaugugugugaag

SEQ ID NO: 491015 - RNA, 64 nt, hsa
agugcuacgcugcacaguucuacacugucaagggaaaagggagacuaaugaggcuuaacucaaa

SEQ ID NO: 491016 - RNA, 64 nt, hsa
ugggcacaaguauuacacaucagaaaauccugacaaaagggacacauaguguuuguaacaccgu

SEQ ID NO: 491017 - RNA, 64 nt, hsa
uguguuugcaaaaaaaaagaaaauaaauacauaaaaaagggacaagcauguugauucuagguug

SEQ ID NO: 491018 - RNA, 64 nt, hsa
aagcacugucuaaguuuauguugcauuuuuagucaaaagggagaaaucuuauuccuucuugaaa

SEQ ID NO: 491019 - RNA, 64 nt, hsa
uguuuaaucuguaaauaagaaauguauuuaaauuaaaagggaucuuuuuguaaaaggaccaaau

SEQ ID NO: 491020 - RNA, 64 nt, hsa
cccaaagcccugguaaaagggauacacaggacugaaaagggaaucauuuuucacuguacauuau

SEQ ID NO: 491021 - RNA, 64 nt, hsa
uuuccuacuuucuccugaaacccaaagcccugguaaaagggauacacaggacugaaaagggaau

SEQ ID NO: 491022 - RNA, 64 nt, hsa
guuguuucucuuucuugcuuugagaguguacaguaaaagggauuuuuucgaauuauuuuuauau

SEQ ID NO: 491023 - RNA, 64 nt, hsa
ucauccugcuucaagucagcuucagaaauguuuuaaaagggacuuuagcucuggaacucaaaau

SEQ ID NO: 491024 - RNA, 64 nt, hsa
uaaaaaggcccggcccaggaccacugugagcuggaaaagggagaaaggcagugggaaaagaggu

SEQ ID NO: 491025 - RNA, 64 nt, hsa
ccuccaaggaguuagaauuucccaguuuaaaacaaaaagggaaauguccuagguuuucuuugug

SEQ ID NO: 491026 - RNA, 64 nt, hsa
aaaagaauagaagugaaauuugcauaaugaauguaaaagggaaauaaaagucuuuugaagguag

SEQ ID NO: 491027 - RNA, 64 nt, hsa
uuuaaaagcacaucuauguucacugccacucugaaaaagggaauuauuucucagucuuucaagg

SEQ ID NO: 491028 - RNA, 64 nt, hsa
cccaagguuggagggugggaugaguacccucugaaaaagggaauuugcuggugaaaagaggcug

SEQ ID NO: 491029 - RNA, 64 nt, hsa
auguauguuguaagaaaagaaaaaagaaaagaaaaaaagggaaaaaagaaaagcaaggaaaagg

SEQ ID NO: 491030 - RNA, 64 nt, hsa
uuucuccucuugguuuucauuugcucaagcacacaaaagggacuuuuguuuacucuaucaugaa

SEQ ID NO: 491031 - RNA, 64 nt, hsa
auuucaauacggugauauccuuauuugcuagcagaaaagggacuaacgucccauuccucuuuuc

SEQ ID NO: 491032 - RNA, 64 nt, hsa
ucuuguagugcuuuucuuuuaagggagauguaguaaaagggaaaauguagcucuuaguuuacac

SEQ ID NO: 491033 - RNA, 64 nt, hsa
gggacagacaagcugggacgucagggaaaugaacaaaagggacgcagguuauuuggggugagug

SEQ ID NO: 491034 - RNA, 64 nt, hsa
agaaacgaaaaggacagacgaagaguuuaaagagaaaagggaaaaaagaaagaaaaaguaagca

SEQ ID NO: 491035 - RNA, 64 nt, hsa
guccagaggcuuuaaaacuggugcaauuacagcaaaaagggauucuguagcuuuaacuuguaaa

SEQ ID NO: 491036 - RNA, 64 nt, hsa
agaucccaauggugugagucugacuuuggaaagaaaaagggacuaaagagaaauguaacaaacu

SEQ ID NO: 491037 - RNA, 64 nt, hsa
ugccaaaacaguguugccauuuucaagggcagggaaaagggaguaaaagguguauuuuugucgu

SEQ ID NO: 491038 - RNA, 64 nt, hsa
gaaauguugucuuuuauacuuaguuauauaagaaaaaagggaguuaugcaauuaauaucuauca

SEQ ID NO: 491039 - RNA, 64 nt, hsa
uuuuacaaaagguguagcuuuuauaagagugcagaaaagggaaggauguguuuuuuucucucac

SEQ ID NO: 491040 - RNA, 64 nt, hsa
aaaucauuguuuauuacuggucacuuagaaaauuaaaagggauagggccaggcacaguggcuua

SEQ ID NO: 491041 - RNA, 64 nt, hsa
caagacuccgucucaaagaaacaaacaaaaaauuaaaagggauagaauauaaugaaauauauuu

SEQ ID NO: 491042 - RNA, 64 nt, hsa
gauuuccaaucaguguauugcucauuuacugacaaaaagggaaaauacgaaacacagaaaggga

SEQ ID NO: 491043 - RNA, 64 nt, hsa
cuggaguuaccucagcagaagacuagaauuagagaaaagggaaagaccuuuucuucuaguaagu

SEQ ID NO: 491044 - RNA, 64 nt, hsa
cuuagcuugguuaaaaaaaaaaaaaaaaaaaaaaaaaagggauuaacauuaaauaaaaguaguu

SEQ ID NO: 491045 - RNA, 64 nt, hsa
uggccuuaguaggcuguauucacugcuaauuuaaaaaagggaguaccaggauuuauuaaguaaa

SEQ ID NO: 491046 - RNA, 64 nt, hsa
aacacgaaagaaaagucaggaagguagagagagaaaaagggagggaaggagaaagaaugggaau

SEQ ID NO: 491047 - RNA, 64 nt, hsa
gcuucaggaguggagugagaauuucuuuuuuaugaaaagggauauaaaggcaccgagcugaugc

SEQ ID NO: 491048 - RNA, 64 nt, hsa
aaugguccaagccgcauaauaagucuggaagagcaaaagggaguuacuaggauauggggugggc

SEQ ID NO: 491049 - RNA, 64 nt, hsa
cuucccauaucugguggaggugagggggcuccucaaaagggaacugagaggcugcucuuaggga

SEQ ID NO: 491050 - RNA, 64 nt, hsa
caggcuuaucugccugcuccucucccuccuaaggaaaagggaguagcagauugaucugagggga

SEQ ID NO: 491051 - RNA, 64 nt, hsa
ugcauuuuuaccgugcacguaaauuggucagcagaaaagggagcccagaaaaggcagcagaugg

SEQ ID NO: 491052 - RNA, 64 nt, hsa
aaagcugcucauuucauuuuguccaaccaaaaagaaaagggagauaacuaaugagcuucuagug

SEQ ID NO: 491053 - RNA, 64 nt, hsa
auauuagaaaauuggcauauguacuuuauuuuugaaaagggaagagaugggugugggguggcaa

SEQ ID NO: 491054 - RNA, 64 nt, hsa
gcugaaaaccacggagcuccauggcucuucauucaaaagggaaaauaaugauuccacguugcuu

SEQ ID NO: 491055 - RNA, 64 nt, hsa
aagguccuugacuuucuccccaggaauucacuuaaaaagggacugagcauugugucaaccuguu

SEQ ID NO: 491056 - RNA, 64 nt, hsa
acuuuaacuguuagacaucagaaaagggauugagaaaagggauggaacugauuugaggcuaaac

SEQ ID NO: 491057 - RNA, 57 nt, hsa
cacaggacuuuaacuguuagacaucagaaaagggauugagaaaagggauggaacuga

SEQ ID NO: 491058 - RNA, 64 nt, hsa
aauuccaccuccuuccugaacucuaauagagguuaaaagggaaaaaaaaaauucuguagauagc

SEQ ID NO: 491059 - RNA, 64 nt, hsa
acuuggccaaguuugcagccuugagccaacaccuaaaagggagaggugggcucuucugccaguu

SEQ ID NO: 491060 - RNA, 64 nt, hsa
guccaaaugaauuucuguauacucuucuauaaauaaaagggaggaauauauucugcuggaagcc

SEQ ID NO: 491061 - RNA, 64 nt, hsa
acacgcuuucuuguagugcuucugcaaaaaacaaaaaagggacuuauuuugcauucucaauggu

SEQ ID NO: 491062 - RNA, 64 nt, hsa
agaggagccagccuccccgcacugcuucagauggaaaagggaggcagggugggcuuccguucuc

SEQ ID NO: 491063 - RNA, 64 nt, hsa
acuuagucauuguucuguguuuuuauuaaugaagaaaagggaagacagacuuccaagaguuacu

SEQ ID NO: 491064 - RNA, 64 nt, hsa
uagggaaaagauucuuggacucaauuuuagaaucaaaagggaaaggaucaaaagguucaguaac

SEQ ID NO: 491065 - RNA, 64 nt, hsa
agagaaugggagagugagagaaaauaaaaaaggcaaaagggagagagaggggaagggggucuca

SEQ ID NO: 491066 - RNA, 64 nt, hsa
cccucccaagcucccaucuauggggcuuagcaaaaaaagggaggaagugggggcuggauaugcc

SEQ ID NO: 491067 - RNA, 64 nt, hsa
uacugccuucuaacuccugcauccucagaaggggaaaagggacugggaaguaaagggaaaccau

SEQ ID NO: 491068 - RNA, 64 nt, hsa
uagugcagcauuucagcauauguaaaaaaaaaaaaaaagggaauugacaugucacauaucaaau

SEQ ID NO: 491069 - RNA, 64 nt, hsa
agccgcuucauucaugccuacacaauuuuuuuuuaaaagggaacuuuaguuaauuaagugauaa

SEQ ID NO: 491070 - RNA, 64 nt, hsa
gauuuuaaaggugguuucuccagcacauuuuaagaaaagggaccaaaaguuauuuuagcuuccu

SEQ ID NO: 491071 - RNA, 64 nt, hsa
aaauuuaguuaugaccuauuuagcaaugccuuugaaaagggauauuguauccaugguaaauuaa

SEQ ID NO: 491072 - RNA, 64 nt, hsa; identical to SEQ ID NO: 171676

SEQ ID NO: 491073 - RNA, 64 nt, hsa; identical to SEQ ID NO: 171677

SEQ ID NO: 491074 - RNA, 64 nt, hsa; identical to SEQ ID NO: 171678

SEQ ID NO: 491075 - RNA, 64 nt, hsa; identical to SEQ ID NO: 171679

SEQ ID NO: 491076 - RNA, 64 nt, hsa; identical to SEQ ID NO: 171680

SEQ ID NO: 491077 - RNA, 64 nt, hsa; identical to SEQ ID NO: 171681

SEQ ID NO: 491078 - RNA, 64 nt, hsa; identical to SEQ ID NO: 171682

SEQ ID NO: 491079 - RNA, 64 nt, hsa; identical to SEQ ID NO: 171683

SEQ ID NO: 491080 - RNA, 64 nt, hsa; identical to SEQ ID NO: 171684

SEQ ID NO: 491081 - RNA, 64 nt, hsa; identical to SEQ ID NO: 171685

SEQ ID NO: 491082 - RNA, 64 nt, hsa; identical to SEQ ID NO: 171686

SEQ ID NO: 491083 - RNA, 64 nt, hsa; identical to SEQ ID NO: 171687

SEQ ID NO: 491084 - RNA, 64 nt, hsa; identical to SEQ ID NO: 171688

SEQ ID NO: 491085 - RNA, 64 nt, hsa; identical to SEQ ID NO: 171689

SEQ ID NO: 491086 - RNA, 64 nt, hsa; identical to SEQ ID NO: 171690

SEQ ID NO: 491087 - RNA, 64 nt, hsa; identical to SEQ ID NO: 171691

SEQ ID NO: 491088 - RNA, 64 nt, hsa; identical to SEQ ID NO: 171692

SEQ ID NO: 491089 - RNA, 64 nt, hsa; identical to SEQ ID NO: 171693

SEQ ID NO: 491090 - RNA, 64 nt, hsa; identical to SEQ ID NO: 171694

SEQ ID NO: 491091 - RNA, 64 nt, hsa; identical to SEQ ID NO: 171695

SEQ ID NO: 491092 - RNA, 64 nt, hsa; identical to SEQ ID NO: 171696

SEQ ID NO: 491093 - RNA, 64 nt, hsa; identical to SEQ ID NO: 171697

SEQ ID NO: 491094 - RNA, 64 nt, hsa; identical to SEQ ID NO: 171698

SEQ ID NO: 491095 - RNA, 64 nt, hsa; identical to SEQ ID NO: 171699

SEQ ID NO: 491096 - RNA, 64 nt, hsa; identical to SEQ ID NO: 171700

SEQ ID NO: 491097 - RNA, 64 nt, hsa; identical to SEQ ID NO: 171701

SEQ ID NO: 491098 - RNA, 64 nt, hsa; identical to SEQ ID NO: 171702

SEQ ID NO: 491099 - RNA, 64 nt, hsa; identical to SEQ ID NO: 171703

SEQ ID NO: 491100 - RNA, 64 nt, hsa; identical to SEQ ID NO: 171704

SEQ ID NO: 491101 - RNA, 64 nt, hsa; identical to SEQ ID NO: 171705

SEQ ID NO: 491102 - RNA, 64 nt, hsa; identical to SEQ ID NO: 171706

SEQ ID NO: 491103 - RNA, 64 nt, hsa; identical to SEQ ID NO: 171707

SEQ ID NO: 491104 - RNA, 61 nt, hsa; identical to SEQ ID NO: 171708

SEQ ID NO: 491105 - RNA, 64 nt, hsa; identical to SEQ ID NO: 171709

SEQ ID NO: 491106 - RNA, 64 nt, hsa; identical to SEQ ID NO: 171710

SEQ ID NO: 491107 - RNA, 64 nt, hsa; identical to SEQ ID NO: 171711

SEQ ID NO: 491108 - RNA, 64 nt, hsa; identical to SEQ ID NO: 171712

SEQ ID NO: 491109 - RNA, 64 nt, hsa; identical to SEQ ID NO: 171713

SEQ ID NO: 491110 - RNA, 64 nt, hsa; identical to SEQ ID NO: 171714

SEQ ID NO: 491111 - RNA, 64 nt, hsa; identical to SEQ ID NO: 171715

SEQ ID NO: 491112 - RNA, 64 nt, hsa; identical to SEQ ID NO: 171716

SEQ ID NO: 491113 - RNA, 64 nt, hsa; identical to SEQ ID NO: 171717

SEQ ID NO: 491114 - RNA, 64 nt, hsa; identical to SEQ ID NO: 171718

SEQ ID NO: 491115 - RNA, 64 nt, hsa; identical to SEQ ID NO: 171719

SEQ ID NO: 491116 - RNA, 64 nt, hsa; identical to SEQ ID NO: 171720

SEQ ID NO: 491117 - RNA, 64 nt, hsa; identical to SEQ ID NO: 171721

SEQ ID NO: 491118 - RNA, 64 nt, hsa; identical to SEQ ID NO: 171722

SEQ ID NO: 491119 - RNA, 64 nt, hsa; identical to SEQ ID NO: 171723

SEQ ID NO: 491120 - RNA, 64 nt, hsa; identical to SEQ ID NO: 171724

SEQ ID NO: 491121 - RNA, 64 nt, hsa; identical to SEQ ID NO: 171725

SEQ ID NO: 491122 - RNA, 64 nt, hsa; identical to SEQ ID NO: 171726

SEQ ID NO: 491123 - RNA, 64 nt, hsa; identical to SEQ ID NO: 171727

SEQ ID NO: 491124 - RNA, 64 nt, hsa; identical to SEQ ID NO: 171728

SEQ ID NO: 491125 - RNA, 64 nt, hsa; identical to SEQ ID NO: 171729

SEQ ID NO: 491126 - RNA, 64 nt, hsa; identical to SEQ ID NO: 171730

SEQ ID NO: 491127 - RNA, 64 nt, hsa; identical to SEQ ID NO: 171731

SEQ ID NO: 491128 - RNA, 64 nt, hsa; identical to SEQ ID NO: 171732

SEQ ID NO: 491129 - RNA, 64 nt, hsa; identical to SEQ ID NO: 171733

SEQ ID NO: 491130 - RNA, 64 nt, hsa; identical to SEQ ID NO: 171734

SEQ ID NO: 491131 - RNA, 64 nt, hsa; identical to SEQ ID NO: 171735

SEQ ID NO: 491132 - RNA, 64 nt, hsa; identical to SEQ ID NO: 171736

SEQ ID NO: 491133 - RNA, 64 nt, hsa; identical to SEQ ID NO: 171737

SEQ ID NO: 491134 - RNA, 64 nt, hsa; identical to SEQ ID NO: 171738

SEQ ID NO: 491135 - RNA, 64 nt, hsa; identical to SEQ ID NO: 171739

SEQ ID NO: 491136 - RNA, 64 nt, hsa; identical to SEQ ID NO: 171740

SEQ ID NO: 491137 - RNA, 64 nt, hsa; identical to SEQ ID NO: 171741

SEQ ID NO: 491138 - RNA, 64 nt, hsa; identical to SEQ ID NO: 171742

SEQ ID NO: 491139 - RNA, 64 nt, hsa; identical to SEQ ID NO: 171743

SEQ ID NO: 491140 - RNA, 64 nt, hsa; identical to SEQ ID NO: 171744

SEQ ID NO: 491141 - RNA, 64 nt, hsa; identical to SEQ ID NO: 171745

SEQ ID NO: 491142 - RNA, 64 nt, hsa; identical to SEQ ID NO: 171746

SEQ ID NO: 491143 - RNA, 64 nt, hsa; identical to SEQ ID NO: 171747

SEQ ID NO: 491144 - RNA, 64 nt, hsa; identical to SEQ ID NO: 171748

SEQ ID NO: 491145 - RNA, 64 nt, hsa; identical to SEQ ID NO: 171749

SEQ ID NO: 491146 - RNA, 64 nt, hsa; identical to SEQ ID NO: 171750

SEQ ID NO: 491147 - RNA, 64 nt, hsa; identical to SEQ ID NO: 171751

SEQ ID NO: 491148 - RNA, 64 nt, hsa; identical to SEQ ID NO: 171752

SEQ ID NO: 491149 - RNA, 64 nt, hsa; identical to SEQ ID NO: 171753

SEQ ID NO: 491150 - RNA, 64 nt, hsa; identical to SEQ ID NO: 171754

SEQ ID NO: 491151 - RNA, 64 nt, hsa; identical to SEQ ID NO: 171755

SEQ ID NO: 491152 - RNA, 64 nt, hsa; identical to SEQ ID NO: 171756

SEQ ID NO: 491153 - RNA, 64 nt, hsa; identical to SEQ ID NO: 171757

SEQ ID NO: 491154 - RNA, 64 nt, hsa; identical to SEQ ID NO: 171758

SEQ ID NO: 491155 - RNA, 64 nt, hsa; identical to SEQ ID NO: 171759

SEQ ID NO: 491156 - RNA, 64 nt, hsa; identical to SEQ ID NO: 171760

SEQ ID NO: 491157 - RNA, 64 nt, hsa; identical to SEQ ID NO: 171761

SEQ ID NO: 491158 - RNA, 64 nt, hsa; identical to SEQ ID NO: 171762

SEQ ID NO: 491159 - RNA, 64 nt, hsa; identical to SEQ ID NO: 171763

SEQ ID NO: 491160 - RNA, 64 nt, hsa; identical to SEQ ID NO: 171764

SEQ ID NO: 491161 - RNA, 64 nt, hsa; identical to SEQ ID NO: 171765

SEQ ID NO: 491162 - RNA, 64 nt, hsa; identical to SEQ ID NO: 171766

SEQ ID NO: 491163 - RNA, 64 nt, hsa; identical to SEQ ID NO: 171767

SEQ ID NO: 491164 - RNA, 64 nt, hsa; identical to SEQ ID NO: 171768

SEQ ID NO: 491165 - RNA, 64 nt, hsa; identical to SEQ ID NO: 171769

SEQ ID NO: 491166 - RNA, 64 nt, hsa; identical to SEQ ID NO: 171770

SEQ ID NO: 491167 - RNA, 64 nt, hsa; identical to SEQ ID NO: 171771

SEQ ID NO: 491168 - RNA, 64 nt, hsa; identical to SEQ ID NO: 171772

SEQ ID NO: 491169 - RNA, 64 nt, hsa; identical to SEQ ID NO: 171773

SEQ ID NO: 491170 - RNA, 64 nt, hsa; identical to SEQ ID NO: 171774

SEQ ID NO: 491171 - RNA, 64 nt, hsa; identical to SEQ ID NO: 171775

SEQ ID NO: 491172 - RNA, 64 nt, hsa; identical to SEQ ID NO: 171776

SEQ ID NO: 491173 - RNA, 64 nt, hsa; identical to SEQ ID NO: 171777

SEQ ID NO: 491174 - RNA, 64 nt, hsa; identical to SEQ ID NO: 171778

SEQ ID NO: 491175 - RNA, 64 nt, hsa; identical to SEQ ID NO: 171779

SEQ ID NO: 491176 - RNA, 64 nt, hsa; identical to SEQ ID NO: 171780

SEQ ID NO: 491177 - RNA, 64 nt, hsa; identical to SEQ ID NO: 171781

SEQ ID NO: 491178 - RNA, 64 nt, hsa; identical to SEQ ID NO: 171782

SEQ ID NO: 491179 - RNA, 64 nt, hsa; identical to SEQ ID NO: 171783

SEQ ID NO: 491180 - RNA, 64 nt, hsa; identical to SEQ ID NO: 171784

SEQ ID NO: 491181 - RNA, 64 nt, hsa; identical to SEQ ID NO: 171785

SEQ ID NO: 491182 - RNA, 64 nt, hsa; identical to SEQ ID NO: 171786

SEQ ID NO: 491183 - RNA, 64 nt, hsa; identical to SEQ ID NO: 171787

SEQ ID NO: 491184 - RNA, 64 nt, hsa; identical to SEQ ID NO: 171788

SEQ ID NO: 491185 - RNA, 64 nt, hsa; identical to SEQ ID NO: 171789

SEQ ID NO: 491186 - RNA, 64 nt, hsa; identical to SEQ ID NO: 171790

SEQ ID NO: 491187 - RNA, 64 nt, hsa; identical to SEQ ID NO: 171791

SEQ ID NO: 491188 - RNA, 64 nt, hsa; identical to SEQ ID NO: 171792

SEQ ID NO: 491189 - RNA, 64 nt, hsa; identical to SEQ ID NO: 171793

SEQ ID NO: 491190 - RNA, 64 nt, hsa; identical to SEQ ID NO: 171794

SEQ ID NO: 491191 - RNA, 64 nt, hsa; identical to SEQ ID NO: 171795

SEQ ID NO: 491192 - RNA, 64 nt, hsa; identical to SEQ ID NO: 171796

SEQ ID NO: 491193 - RNA, 64 nt, hsa; identical to SEQ ID NO: 171797

SEQ ID NO: 491194 - RNA, 64 nt, hsa; identical to SEQ ID NO: 171798

SEQ ID NO: 491195 - RNA, 64 nt, hsa; identical to SEQ ID NO: 171799

SEQ ID NO: 491196 - RNA, 64 nt, hsa; identical to SEQ ID NO: 89598

SEQ ID NO: 491197 - RNA, 64 nt, hsa; identical to SEQ ID NO: 89599

SEQ ID NO: 491198 - RNA, 64 nt, hsa; identical to SEQ ID NO: 89600

SEQ ID NO: 491199 - RNA, 64 nt, hsa; identical to SEQ ID NO: 89601

SEQ ID NO: 491200 - RNA, 64 nt, hsa; identical to SEQ ID NO: 89602

SEQ ID NO: 491201 - RNA, 64 nt, hsa; identical to SEQ ID NO: 89603

SEQ ID NO: 491202 - RNA, 64 nt, hsa; identical to SEQ ID NO: 89604

SEQ ID NO: 491203 - RNA, 64 nt, hsa; identical to SEQ ID NO: 89605

SEQ ID NO: 491204 - RNA, 64 nt, hsa; identical to SEQ ID NO: 89606

SEQ ID NO: 491205 - RNA, 64 nt, hsa; identical to SEQ ID NO: 89607

SEQ ID NO: 491206 - RNA, 64 nt, hsa; identical to SEQ ID NO: 89608

SEQ ID NO: 491207 - RNA, 64 nt, hsa; identical to SEQ ID NO: 89609

SEQ ID NO: 491208 - RNA, 64 nt, hsa; identical to SEQ ID NO: 89610

SEQ ID NO: 491209 - RNA, 64 nt, hsa; identical to SEQ ID NO: 89611

SEQ ID NO: 491210 - RNA, 64 nt, hsa; identical to SEQ ID NO: 89612

SEQ ID NO: 491211 - RNA, 64 nt, hsa; identical to SEQ ID NO: 89613

SEQ ID NO: 491212 - RNA, 64 nt, hsa; identical to SEQ ID NO: 89614

SEQ ID NO: 491213 - RNA, 64 nt, hsa; identical to SEQ ID NO: 89615

SEQ ID NO: 491214 - RNA, 64 nt, hsa; identical to SEQ ID NO: 89616

SEQ ID NO: 491215 - RNA, 64 nt, hsa; identical to SEQ ID NO: 89617

SEQ ID NO: 491216 - RNA, 64 nt, hsa; identical to SEQ ID NO: 89618

SEQ ID NO: 491217 - RNA, 64 nt, hsa; identical to SEQ ID NO: 89619

SEQ ID NO: 491218 - RNA, 64 nt, hsa; identical to SEQ ID NO: 89620

SEQ ID NO: 491219 - RNA, 64 nt, hsa; identical to SEQ ID NO: 89621

SEQ ID NO: 491220 - RNA, 64 nt, hsa; identical to SEQ ID NO: 89622

SEQ ID NO: 491221 - RNA, 64 nt, hsa; identical to SEQ ID NO: 89623

SEQ ID NO: 491222 - RNA, 64 nt, hsa; identical to SEQ ID NO: 89624

SEQ ID NO: 491223 - RNA, 64 nt, hsa; identical to SEQ ID NO: 89625

SEQ ID NO: 491224 - RNA, 64 nt, hsa; identical to SEQ ID NO: 89626

SEQ ID NO: 491225 - RNA, 64 nt, hsa; identical to SEQ ID NO: 89627

SEQ ID NO: 491226 - RNA, 64 nt, hsa; identical to SEQ ID NO: 89628

SEQ ID NO: 491227 - RNA, 64 nt, hsa; identical to SEQ ID NO: 89629

SEQ ID NO: 491228 - RNA, 64 nt, hsa; identical to SEQ ID NO: 89630

SEQ ID NO: 491229 - RNA, 64 nt, hsa; identical to SEQ ID NO: 89631

SEQ ID NO: 491230 - RNA, 64 nt, hsa; identical to SEQ ID NO: 89632

SEQ ID NO: 491231 - RNA, 64 nt, hsa; identical to SEQ ID NO: 89633

SEQ ID NO: 491232 - RNA, 64 nt, hsa
ugacacacauuucuuauccccauuuuacaaccaaggcaucuaaagcaacaagaaaugaacuugc

SEQ ID NO: 491233 - RNA, 64 nt, hsa
ggauacuuuuagauauauuuaaaauuuuaacauuggcaucuaaaguguuauuugaaaauaaaau

SEQ ID NO: 491234 - RNA, 64 nt, hsa; identical to SEQ ID NO: 246041

SEQ ID NO: 491235 - RNA, 64 nt, hsa; identical to SEQ ID NO: 246042

SEQ ID NO: 491236 - RNA, 64 nt, hsa; identical to SEQ ID NO: 246043

SEQ ID NO: 491237 - RNA, 64 nt, hsa; identical to SEQ ID NO: 246044

SEQ ID NO: 491238 - RNA, 64 nt, hsa; identical to SEQ ID NO: 246045

SEQ ID NO: 491239 - RNA, 64 nt, hsa; identical to SEQ ID NO: 246046

SEQ ID NO: 491240 - RNA, 64 nt, hsa; identical to SEQ ID NO: 246047

SEQ ID NO: 491241 - RNA, 64 nt, hsa; identical to SEQ ID NO: 246048

SEQ ID NO: 491242 - RNA, 64 nt, hsa; identical to SEQ ID NO: 246049

SEQ ID NO: 491243 - RNA, 64 nt, hsa; identical to SEQ ID NO: 246050

SEQ ID NO: 491244 - RNA, 64 nt, hsa; identical to SEQ ID NO: 246051

SEQ ID NO: 491245 - RNA, 64 nt, hsa; identical to SEQ ID NO: 246052

SEQ ID NO: 491246 - RNA, 64 nt, hsa; identical to SEQ ID NO: 246053

SEQ ID NO: 491247 - RNA, 64 nt, hsa; identical to SEQ ID NO: 246054

SEQ ID NO: 491248 - RNA, 64 nt, hsa; identical to SEQ ID NO: 246055

SEQ ID NO: 491249 - RNA, 64 nt, hsa; identical to SEQ ID NO: 246056

SEQ ID NO: 491250 - RNA, 64 nt, hsa
gcuucuucauguuuguagggaugguucccuaagccuguucaaguaggcucucacuagaguuacc

SEQ ID NO: 491251 - RNA, 64 nt, hsa
uugcaaaagaaucccauuuuuguuucguaccacacuguucaaaggaaaauuguuuaucucucuu

SEQ ID NO: 491252 - RNA, 64 nt, hsa
uuuagcugacaaaauacuugucuguuuuaaaaaccuguucaagucuaccaaccuguucaagucu

SEQ ID NO: 491253 - RNA, 64 nt, hsa
ugucuguuuuaaaaaccuguucaagucuaccaaccuguucaagucuaccaauuauaagggcaaa

SEQ ID NO: 491254 - RNA, 64 nt, hsa
ugcugccaaagaccaacuguagaauccuuaaguccuguucaagugucacuucauuuuuuauuag

SEQ ID NO: 491255 - RNA, 64 nt, hsa
ccucgucuggccugcaggucuuuuuaagcauuugcuguucaauaauaagcaucuucuuuaugcc

SEQ ID NO: 491256 - RNA, 64 nt, hsa
aggaggagccugucaaaaaguagaaucauaaggacuguucaaaccauaaggacuguucaaauca

SEQ ID NO: 491257 - RNA, 64 nt, hsa
aguagaaucauaaggacuguucaaaccauaaggacuguucaaaucauaccagugacuguucaaa

SEQ ID NO: 491258 - RNA, 64 nt, hsa
caaaccauaaggacuguucaaaucauaccagugacuguucaaaccaaccauacuuuuuauuaga

SEQ ID NO: 491259 - RNA, 64 nt, hsa
caauccauuacuuauauacuaacuacauaaugaccuguucaaaccagacucuauuuaaugaacu

SEQ ID NO: 491260 - RNA, 64 nt, hsa
cucaaaaacaguccacaguggcaauaccggacuucuguucaagcuuuuuaaagugcugagccuu

SEQ ID NO: 491261 - RNA, 64 nt, hsa
acuuccuacucaggcacccugcuuaggugcacagcuguucaauauacacagagaacagaaauau

SEQ ID NO: 491262 - RNA, 64 nt, hsa
uugcaugucaguaaacaggaaggaaggaggccaucuguucaaaaauugugacauugggcaugag

SEQ ID NO: 491263 - RNA, 64 nt, hsa; identical to SEQ ID NO: 293702

SEQ ID NO: 491264 - RNA, 64 nt, hsa; identical to SEQ ID NO: 293703

SEQ ID NO: 491265 - RNA, 64 nt, hsa; identical to SEQ ID NO: 293704

SEQ ID NO: 491266 - RNA, 64 nt, hsa; identical to SEQ ID NO: 293705

SEQ ID NO: 491267 - RNA, 64 nt, hsa; identical to SEQ ID NO: 293706

SEQ ID NO: 491268 - RNA, 64 nt, hsa; identical to SEQ ID NO: 293707

SEQ ID NO: 491269 - RNA, 64 nt, hsa; identical to SEQ ID NO: 293708

SEQ ID NO: 491270 - RNA, 64 nt, hsa; identical to SEQ ID NO: 293709

SEQ ID NO: 491271 - RNA, 64 nt, hsa; identical to SEQ ID NO: 293710

SEQ ID NO: 491272 - RNA, 64 nt, hsa; identical to SEQ ID NO: 293711

SEQ ID NO: 491273 - RNA, 64 nt, hsa; identical to SEQ ID NO: 293712

SEQ ID NO: 491274 - RNA, 64 nt, hsa; identical to SEQ ID NO: 293713

SEQ ID NO: 491275 - RNA, 64 nt, hsa; identical to SEQ ID NO: 293714

SEQ ID NO: 491276 - RNA, 64 nt, hsa; identical to SEQ ID NO: 293715

SEQ ID NO: 491277 - RNA, 64 nt, hsa; identical to SEQ ID NO: 293716

SEQ ID NO: 491278 - RNA, 64 nt, hsa; identical to SEQ ID NO: 293717

SEQ ID NO: 491279 - RNA, 64 nt, hsa; identical to SEQ ID NO: 293718

SEQ ID NO: 491280 - RNA, 64 nt, hsa; identical to SEQ ID NO: 293719

SEQ ID NO: 491281 - RNA, 64 nt, hsa; identical to SEQ ID NO: 293720

SEQ ID NO: 491282 - RNA, 64 nt, hsa; identical to SEQ ID NO: 293721

SEQ ID NO: 491283 - RNA, 64 nt, hsa; identical to SEQ ID NO: 293722

SEQ ID NO: 491284 - RNA, 64 nt, hsa; identical to SEQ ID NO: 293723

SEQ ID NO: 491285 - RNA, 64 nt, hsa; identical to SEQ ID NO: 293724

SEQ ID NO: 491286 - RNA, 64 nt, hsa; identical to SEQ ID NO: 293725

SEQ ID NO: 491287 - RNA, 64 nt, hsa; identical to SEQ ID NO: 293726

SEQ ID NO: 491288 - RNA, 64 nt, hsa; identical to SEQ ID NO: 293727

SEQ ID NO: 491289 - RNA, 64 nt, hsa; identical to SEQ ID NO: 96825

SEQ ID NO: 491290 - RNA, 64 nt, hsa; identical to SEQ ID NO: 96826

SEQ ID NO: 491291 - RNA, 64 nt, hsa; identical to SEQ ID NO: 96827

SEQ ID NO: 491292 - RNA, 64 nt, hsa; identical to SEQ ID NO: 96828

SEQ ID NO: 491293 - RNA, 64 nt, hsa; identical to SEQ ID NO: 96829

SEQ ID NO: 491294 - RNA, 64 nt, hsa; identical to SEQ ID NO: 96830

SEQ ID NO: 491295 - RNA, 64 nt, hsa; identical to SEQ ID NO: 96831

SEQ ID NO: 491296 - RNA, 64 nt, hsa; identical to SEQ ID NO: 96832

SEQ ID NO: 491297 - RNA, 64 nt, hsa; identical to SEQ ID NO: 96833

SEQ ID NO: 491298 - RNA, 64 nt, hsa; identical to SEQ ID NO: 96834

SEQ ID NO: 491299 - RNA, 64 nt, hsa; identical to SEQ ID NO: 96835

SEQ ID NO: 491300 - RNA, 64 nt, hsa
aaggcaaagucaaauggggaccagaauaaaucuuagaccccacaguccuucccauuuccagccc

SEQ ID NO: 491301 - RNA, 64 nt, hsa
cucccugcuugccuccacucccuucugacuuuccagaccccagguccagucugcagauccuacc

SEQ ID NO: 491302 - RNA, 64 nt, hsa
cagauccccugcugaacagauacacagaguucucagaccccacccccacccucaggugggcugg

SEQ ID NO: 491303 - RNA, 64 nt, hsa
gauggacccccagcaaaucaggaccuaucuaggcagaccccagccagacccccgccagacagac

SEQ ID NO: 491304 - RNA, 64 nt, hsa
gcuuguacauaugugauugcugugggcacaccccagaccccaugucauagcugccgucccgacg

SEQ ID NO: 491305 - RNA, 64 nt, hsa
aggcugucccacgugaugcugacaugagccucagagaccccaaucccaugccugggggagagac

SEQ ID NO: 491306 - RNA, 64 nt, hsa
agugggagaggcugcagcaaggcuuugccucugcagaccccaucuuaguggcacggugcuuggg

SEQ ID NO: 491307 - RNA, 64 nt, hsa
gugugaggggcuuaaugaccaccacagggagcucagaccccaacccuggaucccaggagaaagg

SEQ ID NO: 491308 - RNA, 64 nt, hsa
aacuaaagccuuuuuaagaaaugccagcugcuguagaccccaugagaaaagaugucuuaaucau

SEQ ID NO: 491309 - RNA, 64 nt, hsa
gagugcaccuccaucuccaagcacugcugcuggaagaccccauucccucuuuaucuaucaacuc

SEQ ID NO: 491310 - RNA, 64 nt, hsa
aaauaugaacacuuuauaauuguauguucuuuuuagaccccauaaauccuguauacaucaaaga

SEQ ID NO: 491311 - RNA, 64 nt, hsa
gacugaacagacaucagcacaucagacgucuuuuagaccccaagacaauuuuucuguuucaguu

SEQ ID NO: 491312 - RNA, 64 nt, hsa
uuaauagcagcaguccucccccuaccccgccccgagaccccaccccgagaccccaccccggacc

SEQ ID NO: 491313 - RNA, 64 nt, hsa
uccucccccuaccccgccccgagaccccaccccgagaccccaccccggaccaguuacauucguu

SEQ ID NO: 491314 - RNA, 64 nt, hsa
ugcaccacugcacuccagccugggugauagagcaagaccccaacucaaaaaaaaaaaaaaggau

SEQ ID NO: 491315 - RNA, 64 nt, hsa
cgaggcugacaaugacuccuguuuucacgcugagagaccccacuccccugcugagaucgcgcca

SEQ ID NO: 491316 - RNA, 64 nt, hsa
ccaggaguuugagaccagccugggcaacauagcgagaccccaucucuacaaaagauuaaaaauu

SEQ ID NO: 491317 - RNA, 64 nt, hsa
ucugcagugagcuaugaucgcaccacugcauuccagaccccaucucgaaaaaaaaaaaaaaaaa

SEQ ID NO: 491318 - RNA, 64 nt, hsa
cauguggagcgagagggaggcagguggacgcugcagaccccagguucagugcggccccucggcu

SEQ ID NO: 491319 - RNA, 64 nt, hsa
ugaaugucuuguuccugugcauugguggcaucacagaccccagcuggggcgcgaugucaaaggu

SEQ ID NO: 491320 - RNA, 64 nt, hsa
ccagaaguucgagaccagccugggcaauguagugagaccccaucacuacuaaaaauacauaaau

SEQ ID NO: 491321 - RNA, 64 nt, hsa
cuggaugauuuugcagguccaaugcaaacaucacagaccccacccaugcauaggagagacucua

SEQ ID NO: 491322 - RNA, 64 nt, hsa
cuucuggaccuggaaagccuggggaaggacugacagaccccaggaccagcccuggggcucaggg

SEQ ID NO: 491323 - RNA, 64 nt, hsa
accaaggcagcuuuccuuacccugacacagccccagaccccacaaagccuucuggaccuggaaa

SEQ ID NO: 491324 - RNA, 64 nt, hsa
caccaaccaaccacacccggugggggcacagcacagaccccagagccaggaaccucucagccga

SEQ ID NO: 491325 - RNA, 64 nt, hsa
caccaaccagccacacccggugggggcacagcacagaccccagaggcaggaaccucucagccga

SEQ ID NO: 491326 - RNA, 64 nt, hsa
caccaaccagccacacccagugggggcacagcacagaccccagagccaggaaccucucagccga

SEQ ID NO: 491327 - RNA, 64 nt, hsa
caccaaccagccacucccgguggggacacagcacagaccccaaagccaggaaccucucagccga

SEQ ID NO: 491328 - RNA, 64 nt, hsa
uccacgggcucuccugggccaccccugagugcccagaccccauuccacagcucugggcuuccuc

SEQ ID NO: 491329 - RNA, 64 nt, hsa
ccucccuuagcucacucugccaucuguuuuggcaagaccccaccuccacgggcucuccugggcc

SEQ ID NO: 491330 - RNA, 64 nt, hsa
uccucacuccccagccuccucuggauagggaugaagaccccacugggguuggaagugcagaggc

SEQ ID NO: 491331 - RNA, 64 nt, hsa
aagaaaugaaaggugacaaaaggcagaaggagggagaccccaaaaagagguaaauuugguaucu

SEQ ID NO: 491332 - RNA, 64 nt, hsa
caugauccauggacaaggccaucccggccgugggagaccccagucccgaagucuugccugcagg

SEQ ID NO: 491333 - RNA, 64 nt, hsa
auaugcaagcacugagcuccucuuuuguccucugagaccccaucuccauucucacccaguuccu

SEQ ID NO: 491334 - RNA, 64 nt, hsa
cuccccugugcccucaaguccuacagccccuagaagaccccaaugccguaacuccuaggacccc

SEQ ID NO: 491335 - RNA, 64 nt, hsa
auuaacagauacucccauaauaacccccaaauacagaccccaugucacccagaaagagauuccc

SEQ ID NO: 491336 - RNA, 64 nt, hsa
ccaggaguucaagaccagccugggcaacauagugagaccccaucucuacuuaaaauaaagaaga

SEQ ID NO: 491337 - RNA, 64 nt, hsa
ggcacccuccauuugggauggaaggaaucuguggagaccccauccuccucccugcacacugugg

SEQ ID NO: 491338 - RNA, 64 nt, hsa
ccugguuccuuccuaugcccagguaccacccuucagaccccaguucuaggggagaagagcccug

SEQ ID NO: 491339 - RNA, 64 nt, hsa
gcuagugagcaaaauaugccccuucuugggccccagaccccagggcagggugggcagccuaugg

SEQ ID NO: 491340 - RNA, 64 nt, hsa
gaccccucaugaaugaaaccagugcccuuauaagagaccccaaagagcugccuugcccuucugc

SEQ ID NO: 491341 - RNA, 64 nt, hsa
uuccccaaaaagagggaagagucacaaaaaguccagaccccagggacgguacuuucccucucua

SEQ ID NO: 491342 - RNA, 64 nt, hsa
gagcagcccuaagguagaggccucauggcccaggagaccccaccucuggcagagccacauuacc

SEQ ID NO: 491343 - RNA, 64 nt, hsa
cuuucccagcuccagccuggagggaaggggacaaagaccccaggaggccaaagggcugcaguca

SEQ ID NO: 491344 - RNA, 64 nt, hsa
aguccccaugauucccuccucgucagucucucaaagaccccaugguccauccccugaggguggu

SEQ ID NO: 491345 - RNA, 64 nt, hsa
ggagcugucugcggagccagcgccugcccgagagagaccccaccgccaccgugugccuuucccg

SEQ ID NO: 491346 - RNA, 64 nt, hsa
uuguaacugugaaacuauggcuuaauacuguuaaagaccccaaggcuccacucuguagccaggu

SEQ ID NO: 491347 - RNA, 64 nt, hsa
cuaggaguucgagaccgaccugggcagcauagcgagaccccaucucuauauaaaaaaaaagaug

SEQ ID NO: 491348 - RNA, 64 nt, hsa
augccagagagcuaagagaagaaaacggggucuguggcgguacucugaacaauuuccucagaac

SEQ ID NO: 491349 - RNA, 64 nt, hsa
cccaucucuacaauuuuuuuuuaaugaccaaauguggcgguacauaccuguacauaccugcggu

SEQ ID NO: 491350 - RNA, 64 nt, hsa
gugccugcaacaggacaagacccacuccuguuucuggcgguaccagcuacccuggaaugguggc

SEQ ID NO: 491351 - RNA, 64 nt, hsa
augguuuggcuuuuauauucaucauaguauacauuggcgguaucuagcccuuucucuguaaaau

SEQ ID NO: 491352 - RNA, 64 nt, hsa
cuugcccggggcuccagguagccugcagguuaacuggcgguaagugcuagacuguaagcccgac

SEQ ID NO: 491353 - RNA, 64 nt, hsa
cucuagcccccagcccgaggcccccaccagcaguuggcgguagcagcuacuccgagcgccguuu

SEQ ID NO: 491354 - RNA, 64 nt, hsa
accgaucucugcgccuuucugggggcgggcaagcuggcgguagauuugugaugucacagugcaa

SEQ ID NO: 491355 - RNA, 64 nt, hsa
uuguauuuaugaaaauaguuucauugucauuuauuggcgguauacaaaguaaaauguuauaaau

SEQ ID NO: 491356 - RNA, 64 nt, hsa
cauuuuucuagcauuuucagaaacucaucggaaauggcgguaccuguguuucccuucgaaagcc

SEQ ID NO: 491357 - RNA, 64 nt, hsa
ggaugcuuucugguauucuaucggggaggguccuuggcgguaaccagagggcagcguaguguca

SEQ ID NO: 491358 - RNA, 64 nt, hsa
guuaacaagcaguaacacugcacuccucaaaaaguggcgguauguaaugaaaggcccuuuugau

SEQ ID NO: 491359 - RNA, 64 nt, hsa
accgacaucacguggcucaacucccccagucagguggcgguagugcccuggggguugcgcaaag

SEQ ID NO: 491360 - RNA, 64 nt, hsa
agguggaaggcgcggcgggcguaggagggugggcuggcgguacccacccagcccaagggaguca

SEQ ID NO: 491361 - RNA, 64 nt, hsa
guucuucccagacugcgaggaccgccucggcagguggcgguaaaagcgcccccaucaagucaca

SEQ ID NO: 491362 - RNA, 64 nt, hsa
ggauccuuugguccuuggaugcuucucagccaaguggcgguagcacagauguggugaacaauga

SEQ ID NO: 491363 - RNA, 64 nt, hsa
uugagaagguagcacuggagagaauuggaauggguggcgguaauuggugauacuucuuugaaug

SEQ ID NO: 491364 - RNA, 64 nt, hsa
gccccggccucaauuaccuuggcugaaggaaagauggcgguaggagagaaaagugaagaggcgu

SEQ ID NO: 491365 - RNA, 64 nt, hsa
uggcgguguggagcccucgcugcgaaaggugguguggcgguaccugcugaacguguauccagau

SEQ ID NO: 491366 - RNA, 64 nt, hsa
uuuaagaaagcugccuuuucauuuuuagacaaaaucuuuucaacgcugaaauguaccuaaucug

SEQ ID NO: 491367 - RNA, 64 nt, hsa
cuccaacauguauaauuuuauuugaaauacauaaucuuuucacuaugcuuuugugggguuuuuu

SEQ ID NO: 491368 - RNA, 64 nt, hsa
gaaaauccagaaccagaaacauaaaucuugaguuucuuuucauguacauaaaaagcaauagccu

SEQ ID NO: 491369 - RNA, 64 nt, hsa
cuagaaaagagcuuguucacuuauucccuuaguuucuuuucauaaaguaaguuauuuuagugug

SEQ ID NO: 491370 - RNA, 64 nt, hsa
ucgcucgagucgccggcugcuugacuccaaaggcucuuuucagagccacccaccuaaucacuag

SEQ ID NO: 491371 - RNA, 64 nt, hsa
uucuuuuaccuuugagucuuuucuuuuguuuaccucuuuucaucucaaagugggaaagcuccag

SEQ ID NO: 491372 - RNA, 64 nt, hsa
uucacaaaugaaaaggaggcagauguuaccauugucuuuucacuguauauacuucuaagacagc

SEQ ID NO: 491373 - RNA, 64 nt, hsa
cucaaaucuucacugucugugaaauccccuucagucuuuucagauugcauugacuguccucuug

SEQ ID NO: 491374 - RNA, 64 nt, hsa
ucuggcuuuuguuaacauuuuggggcuuuuuuaaucuuuucaaucuggcguauugcuguuugac

SEQ ID NO: 491375 - RNA, 64 nt, hsa
aaccaaaauaucacugacucaucccuacccauauucuuuucauaaaacccacucaccagguaca

SEQ ID NO: 491376 - RNA, 64 nt, hsa
guucauguuccccacacaccugaaggugguagaaucuuuucagccucuuagccagugagcuaaa

SEQ ID NO: 491377 - RNA, 64 nt, hsa
aggagcuauagauuugaaucuaauguugcauuagucuuuucaguuaucuucuaccuccuguauu

SEQ ID NO: 491378 - RNA, 64 nt, hsa
aguuucuaucuuuccaggcaaaacaaauggguauucuuuucauacaaccauuuucaaaugaacc

SEQ ID NO: 491379 - RNA, 64 nt, hsa
uaccuuuuuugagcaaacugagacuaaacuucucucuuuucaaaauuguguuaucuuccuuaau

SEQ ID NO: 491380 - RNA, 64 nt, hsa
cccuuaaauaucuuucacaugcauuuuaggauauucuuuucaaauauuuguaggacaacuuuga

SEQ ID NO: 491381 - RNA, 64 nt, hsa
caauguaucucauuauuuguagccaauuuuagacucuuuucaauaccucccccccauuuuaauu

SEQ ID NO: 491382 - RNA, 64 nt, hsa
uugcaaguccaguuucaucccuguaaggcaaaugucuuuucacgcagaaagugccauauagacg

SEQ ID NO: 491383 - RNA, 64 nt, hsa
uugaaguuaccucuuuuagccuagauacauggauucuuuucaaaucaggaaagauuagaaaagg

SEQ ID NO: 491384 - RNA, 64 nt, hsa
ucaugccuuccuaacagucccccaaagucuuaacucuuuucagcauuaacgcaaaaauccacag

SEQ ID NO: 491385 - RNA, 64 nt, hsa
uuacuaauugcccaaaaugucaauuugauguaguucuuuucaugcaaguauaaauucaauuguu

SEQ ID NO: 491386 - RNA, 64 nt, hsa
uaaaugagucaaaguucaaaaauauucauuucaaucuuuucauaauuguugaccuaagaauaua

SEQ ID NO: 491387 - RNA, 64 nt, hsa
aguugucagucuuuaauccugagucauguggcucucuuuucaucuuugaugucaguuccaauua

SEQ ID NO: 491388 - RNA, 64 nt, hsa
uauuuuccuuccuaucaauuuaucugaacuuuggucuuuucacuaaauuguacaguauucuacu

SEQ ID NO: 491389 - RNA, 64 nt, hsa
uggcaacaccucuuaguugauuucuguuuucuucucuuuucacuuuuuguuucuaccaggguag

SEQ ID NO: 491390 - RNA, 64 nt, hsa
uuucuaccaggguagaggccauguugaacuggccucuuuucaggacuuuuauuucccccuggau

SEQ ID NO: 491391 - RNA, 64 nt, hsa
gcaaaucugcaccuauguagcucugcaucuccugucuuuucagguuugucaucagauggaaaua

SEQ ID NO: 491392 - RNA, 64 nt, hsa
uugugagauuccucuguauugugcugauuguggaucuuuucauucucauugcagaauaauguuc

SEQ ID NO: 491393 - RNA, 64 nt, hsa
ugaaucccagaaaaaaauuuccuguuuuuaauguucuuuucaaucccaucuagauaauuuauag

SEQ ID NO: 491394 - RNA, 64 nt, hsa
ucucugacaaacuaacugcaguaacagaaaccuuucuuuucaguuacucuuuuucaagaaugaa

SEQ ID NO: 491395 - RNA, 64 nt, hsa
gugucuuaacaguuugugauaauuucuaaaacugucuuuucaacuuauguaaugauguugacac

SEQ ID NO: 491396 - RNA, 64 nt, hsa
ccaaauuugguguuuguuuucaccuugacgcucuucuuuucauuauuucuaaugcuacaagaau

SEQ ID NO: 491397 - RNA, 64 nt, hsa
agucuaccauuaguucauauguuuuuguagcacaucuuuucauaacauacugaaauuuuaaugu

SEQ ID NO: 491398 - RNA, 64 nt, hsa
uuucugguaaaauuucaguaacugauaacugcccucuuuucaguuuuuucacuuccuuauuuua

SEQ ID NO: 491399 - RNA, 64 nt, hsa
aaacacauaagcuuugcucuuuaggcaggaaugaucuuuucaaaucauuagcacaauauuuaaa

SEQ ID NO: 491400 - RNA, 64 nt, hsa
accucuuuaugccaauaaugauuuuaaugaaggcucuuuucagauguaaccuuaugaaggaaau

SEQ ID NO: 491401 - RNA, 64 nt, hsa
uuagccuaugcacauuugucucagcugggcauugucuuuucagagagcuuguagcacaagggcu

SEQ ID NO: 491402 - RNA, 64 nt, hsa
gaaacacacacagauauggacacaguacaauucuucuuuucaaaugaagacauugauaauauua

SEQ ID NO: 491403 - RNA, 64 nt, hsa
agugguuacccuauugaauaggucagaaguagaaucuuuucaucaucacagaaaguucuauugg

SEQ ID NO: 491404 - RNA, 64 nt, hsa
aucaccauuuccuccuuuaccuuucagugcaguuucuuuucacauuaggcuguugguucaaacu

SEQ ID NO: 491405 - RNA, 64 nt, hsa
aguuauaguuguuauauauacauaaagauaauuuucuuuucauuuuugagacaauucuuuuuau

SEQ ID NO: 491406 - RNA, 64 nt, hsa
acauauaauuuuguuuuccuuuuuaagagaggauucuuuucauccuaaaucuuuuaccuuucaa

SEQ ID NO: 491407 - RNA, 64 nt, hsa
gucuccucucaagccugguuguaguucagaugagucuuuucaacauggucuucaacauggucua

SEQ ID NO: 491408 - RNA, 64 nt, hsa
uauuuauuauuguaauuagaucuucacaaaguugucuuuucacuguguuuugucaacgugaaau

SEQ ID NO: 491409 - RNA, 64 nt, hsa
uuugcauuucccugauggcgaaugauauugagcaucuuuucaugagcuuauuggccauuugcau

SEQ ID NO: 491410 - RNA, 64 nt, hsa
auuugagcuaaaacucauuuuucuuuuggcauuuucuuuucaauguucuuauaagcaaaguuca

SEQ ID NO: 491411 - RNA, 64 nt, hsa
aucaauuugcuauauugcacagaaucagugugugucuuuucauaagguuuuacaaugguuuauu

SEQ ID NO: 491412 - RNA, 64 nt, hsa
uauuuugucguguuucauccuucuuaacaugcuaucuuuucauuuaauaauaguaauaguguau

SEQ ID NO: 491413 - RNA, 64 nt, hsa
uaugaguaaaaacaaauaggaagaaauugaaauuucuuuucaucaacauguagagcugcuauuu

SEQ ID NO: 491414 - RNA, 64 nt, hsa
guuugaaugugaccaaaugugguucuaguugacuucuuuucacuuuggcuuauaucaauucuug

SEQ ID NO: 491415 - RNA, 64 nt, hsa
uuuacgugaagcaugugauuaggaaaacucauuuucuuuucaagccucaggaccuaccugaaga

SEQ ID NO: 491416 - RNA, 64 nt, hsa
uauccaaagaucuccugaucauaaagacaaggggucuuuucagucuucccucuccucaaaccuu

SEQ ID NO: 491417 - RNA, 64 nt, hsa
caaaucaugaauuaaucacauaccucaucauuaaucuuuucaagguccuucuauuguuuugucu

SEQ ID NO: 491418 - RNA, 64 nt, hsa
ucacuaugucuuauuaaaauaaaaccugucaaguucuuuucaaaagaugcuaugagcguuucca

SEQ ID NO: 491419 - RNA, 64 nt, hsa
cagggcuuggaaaugaacuagaauaggaaauagaucuuuucagaugcugcuuucccauguaaua

SEQ ID NO: 491420 - RNA, 64 nt, hsa
gcauuaaagagcuguucuuuucuguggccuagacucuuuucacugaucucaaaauaaacugguu

SEQ ID NO: 491421 - RNA, 64 nt, hsa
uugcacugugaaaagcacucuucccucucaguuuucuuuucaucccagccauguuuaucagauc

SEQ ID NO: 491422 - RNA, 64 nt, hsa
guauucuuuauauguugccuuguuuaacuacaguucuuuucauuccaucacuuuaggugauggg

SEQ ID NO: 491423 - RNA, 64 nt, hsa
uuguuuucucucaguccuuuugcuacauucacuuucuuuucaaagaaauguuaauuauuacaaa

SEQ ID NO: 491424 - RNA, 64 nt, hsa
uggaagcccccaccacuuuggggaucucuuuauuucuuuucagccagggaccuguccacucccu

SEQ ID NO: 491425 - RNA, 64 nt, hsa
ccucgugcccacauggaagguaucuuuaauagggucuuuucaaaccuuaguggaggagggucag

SEQ ID NO: 491426 - RNA, 64 nt, hsa
agcuggcccuucccggagucaccccgaugauuacucuuuucagacacagcgguuuuuguuucca

SEQ ID NO: 491427 - RNA, 64 nt, hsa
ucuuaaauauuucccaauuguguuuuucauuauuucuuuucaauauauaacuuuuauaacaaau

SEQ ID NO: 491428 - RNA, 64 nt, hsa
cuuucuuucugcauaauguugauuauaaauccucucuuuucaggcuaaugauuaccucuuauuc

SEQ ID NO: 491429 - RNA, 64 nt, hsa
guaugcaaauauuauuuucuucauacauucauuuucuuuucaggggaaaauuuugggauggggg

SEQ ID NO: 491430 - RNA, 64 nt, hsa
uucaguauaaaaguguccuaagcauauuagccaaucuuuucacaguagagcauacuuaaggcug

SEQ ID NO: 491431 - RNA, 64 nt, hsa
cuaccacuucuugauuuuuacagauuuaaaaaaaucuuuucagugaccuuucuuuuuaauguaa

SEQ ID NO: 491432 - RNA, 64 nt, hsa
agucaggguccugguguuggccuuuuugguuuucucuuuucaggcuguuuaacuuaggcacagg

SEQ ID NO: 491433 - RNA, 64 nt, hsa
cccaguuccaaacuugcuuucauauuuuuggcuaucuuuucagcaaugccccacucuacuguua

SEQ ID NO: 491434 - RNA, 64 nt, hsa
ugcuuuuugccuuacacuaaugcuuagaaagcugucuuuucagugguguugcagcccccagaug

SEQ ID NO: 491435 - RNA, 64 nt, hsa
gaaggacagugauguggggaggccguggggcagcucuuuucauggcuuguacacgccucagcuc

SEQ ID NO: 491436 - RNA, 64 nt, hsa
cgacacaaaaaaaaugguaugugaagaugcaccgucuuuucaaauggccugggagagucaaaug

SEQ ID NO: 491437 - RNA, 64 nt, hsa
uguuuguuuaacaucugugauaggcagcuuuccuucuuuucaacagugauaccuacgaaaauca

SEQ ID NO: 491438 - RNA, 64 nt, hsa
aacccaaugcugcgugugaggccuuuuuuauuuuucuuuucacucucuuucuaaugcuucccac

SEQ ID NO: 491439 - RNA, 64 nt, hsa
gcucuggacauagaauagguagguucauuccuggucuuuucacuuuagauucucuuuagguuca

SEQ ID NO: 491440 - RNA, 64 nt, hsa
uuauuuuuauuuauuagaaagaaaauauauuuuuucuuuucauugucaaauaucuucccuauau

SEQ ID NO: 491441 - RNA, 64 nt, hsa
uucugauaacuuaugaagccaggguguucuaaacucuuuucaugucauguuuugauuauaggcu

SEQ ID NO: 491442 - RNA, 64 nt, hsa
ucuuuucaugucauguuuugauuauaggcuuuggucuuuucaucugcaaagccuuuuuuuuuug

SEQ ID NO: 491443 - RNA, 64 nt, hsa
augcuuuuuccaaccaagccagaaaccugugucaucuuuucaccccaccuucaaucaacaaguc

SEQ ID NO: 491444 - RNA, 64 nt, hsa
uuuugaaugccucucccuccgcaucucaucuuucucuuuucaaucaggcuuuuccaaaggguug

SEQ ID NO: 491445 - RNA, 64 nt, hsa
aauuuuuauuacuacuuuauguucaauaccagguucuuuucauuucucuggauuauuuugcaaa

SEQ ID NO: 491446 - RNA, 64 nt, hsa
gcuugucauguaaauuaaaaaccuuguauuuaacucuuuucaauccuuuuagauaaaauuguuc

SEQ ID NO: 491447 - RNA, 64 nt, hsa
augucaauaaaagggaguugugucuguuaaguggucuuuucauagaaucguccauuagaaaugu

SEQ ID NO: 491448 - RNA, 64 nt, hsa
ucacuggucgauuuugaacuuuagguacauguguucuuuucaaaaauucagagaaucgucaugu

SEQ ID NO: 491449 - RNA, 64 nt, hsa
cugccuggguaucuggccccuuuccauaaacauuucuuuucaguucauguaguucuuuaauaga

SEQ ID NO: 491450 - RNA, 64 nt, hsa
cucuucuucacuuuuucugacuuuggguccauuuucuuuucauugccuccuuuuccaggcagcu

SEQ ID NO: 491451 - RNA, 64 nt, hsa
uuaauuggugaucugaaaucuugggagaagcuguucuuuucaggccugaggugcucuugacugu

SEQ ID NO: 491452 - RNA, 64 nt, hsa
ucauaacuuccuucuugcugaacauauuuuauucucuuuucagagaaggaaaauaaaaaggauu

SEQ ID NO: 491453 - RNA, 64 nt, hsa
gagaagacauugguuuguugacaauaacaguacaucuuuucaaguucucagcuauuucuucuac

SEQ ID NO: 491454 - RNA, 64 nt, hsa
acaacaccaaaaaggcuucuuauucgggugugagucuuuucagcaacccgguccaguacuggga

SEQ ID NO: 491455 - RNA, 64 nt, hsa
acguauauaauuggcauggaaacuuaauuugcagucuuuucaagccuuuaggauagugugaugu

SEQ ID NO: 491456 - RNA, 64 nt, hsa
uaaaaacuaaggaauauacuuagcacuuacuuaaucuuuucaguuuuccaguuuacgucucagg

SEQ ID NO: 491457 - RNA, 64 nt, hsa
cuguccuucgugaaacgcaacaaagcuaguucugucuuuucagaaguccuacaaccuugacaaa

SEQ ID NO: 491458 - RNA, 64 nt, hsa
aaccucagccuauguguuucuacccugauuuuuuucuuuucauggguaucugaagccucuaagu

SEQ ID NO: 491459 - RNA, 64 nt, hsa
cccuaauaacuauagagagacuguguuucaacucucuuuucauugcuguuuccagaagagugga

SEQ ID NO: 491460 - RNA, 64 nt, hsa
cauguaaccuguaauugcugcucuccaguaauugucuuuucauuuugaugguaggggccagacu

SEQ ID NO: 491461 - RNA, 64 nt, hsa
caagcaauguggcaaagcuuucacuucuuccaguucuuuucaauaucaugaaagaacacacuag

SEQ ID NO: 491462 - RNA, 64 nt, hsa
uaagcaaugugcaaaagccuuuauuucuuccacuucuuuucaauaucaugaaaggacucacaug

SEQ ID NO: 491463 - RNA, 64 nt, hsa
uaagaaauguggaaaagcguuccauaauuucucuucuuuucaaauacaugaaaguugcacagag

SEQ ID NO: 491464 - RNA, 64 nt, hsa
aagcaauguggcaaaagcuuucacuucuuccaguucuuuucaauaucaugaaaggacucacacu

SEQ ID NO: 491465 - RNA, 64 nt, hsa
aggggacauagaaaaaaugaaaugcaagcacacaucuuuucaggcuucucugccaagccuaugg

SEQ ID NO: 491466 - RNA, 64 nt, hsa
ucuuucuugaaaucccaaaccuucuauuaacauuucuuuucaguuauacacugaacuuuacugu

SEQ ID NO: 491467 - RNA, 64 nt, hsa
ccaaggcaggguuuccagccaggccucggggucaucuuuucaccaggagcaaacccaagucuua

SEQ ID NO: 491468 - RNA, 64 nt, hsa
acguggcuggccuggcuccuccguagaccccuguucuuuucaaccucugcccacccgugcaugu

SEQ ID NO: 491469 - RNA, 64 nt, hsa
uuccuuccccaccccccagccuuagaugccucgcucuuuucaaucucuuaaucuaaaugcuuuu

SEQ ID NO: 491470 - RNA, 64 nt, hsa
ucaaaccuugguaucuguugggugaacaguauaaucuuuucaucugcuuuuagaaugugggaua

SEQ ID NO: 491471 - RNA, 64 nt, hsa
cuuggcuuuccuuuuaaaggcuauuuugaaauggucuuuucacuuucauucagucaucaccccc

SEQ ID NO: 491472 - RNA, 64 nt, hsa
auggaugacaguugcucauucugagaaacuucacucuuuucacuuaugcaucacgaggaaauaa

SEQ ID NO: 491473 - RNA, 64 nt, hsa
cugaaagggaucauuuaugaauaacaaucugaagucuuuucauaaaaaaaauuaauaaacuuua

SEQ ID NO: 491474 - RNA, 64 nt, hsa
uucuauuauuauuuuuaaauaaucacacuuggacucuuuucaaacauuagguuaguuuguaaug

SEQ ID NO: 491475 - RNA, 64 nt, hsa
uuuauacauguaauguacuuagaucagugucugcucuuuucacuugauauccaguacuauguaa

SEQ ID NO: 491476 - RNA, 64 nt, hsa
uguggcuauuuuuauacugauuuugauaucauguucuuuucauagucguauuuugccaccguaa

SEQ ID NO: 491477 - RNA, 64 nt, hsa; identical to SEQ ID NO: 138762

SEQ ID NO: 491478 - RNA, 64 nt, hsa; identical to SEQ ID NO: 138763

SEQ ID NO: 491479 - RNA, 64 nt, hsa; identical to SEQ ID NO: 138764

SEQ ID NO: 491480 - RNA, 64 nt, hsa; identical to SEQ ID NO: 138765

SEQ ID NO: 491481 - RNA, 64 nt, hsa
cagaaacauugacucagaaaaaagguaugaagucuuuccauaaaaucuuuucacaauauuacuc

SEQ ID NO: 491482 - RNA, 64 nt, hsa
uguuuguuuuauauuugucauccaguccauugcauuuccauaagaagacauuuugacuggcugg

SEQ ID NO: 491483 - RNA, 64 nt, hsa
accuuuguuuguagauuuaauguugaacaguacuuuuccauaaaguucuagucacuucuguugg

SEQ ID NO: 491484 - RNA, 64 nt, hsa
uuuuuagucagaaaaaauaauuuuucauuucaguuuuccauaaacuguuacacaaaauauaaac

SEQ ID NO: 491485 - RNA, 64 nt, hsa
uuggcaagcuggauuucucagagccagcauguuguuuccauaacuacuuugauauuuuaacuca

SEQ ID NO: 491486 - RNA, 64 nt, hsa
acauuuagaguuuaucuagagagcuugguuaaucuuuccauauuauuuguaguauuggucacaa

SEQ ID NO: 491487 - RNA, 64 nt, hsa
ccacaggggaagauaaagauggucacacaaacaguuuccauaaagauguacauauucauuauac

SEQ ID NO: 491488 - RNA, 64 nt, hsa
caagaaagcauaugucgaugguugagauauuuauuuuccauaugguucauguucaaauguucac

SEQ ID NO: 491489 - RNA, 64 nt, hsa
guuuaauuguuucagguggaaaguauucuuugaguuuccauauugaauguguuuggacuaaaca

SEQ ID NO: 491490 - RNA, 64 nt, hsa
uuuuuucccccaagcauauuuucuuguauuucuguuuccauauauauauauauauauauaauuu

SEQ ID NO: 491491 - RNA, 64 nt, hsa
aacucggaucuuuuaaaaagcaucauagaucauuuuuccauaugacacugguuccgauuuuaaa

SEQ ID NO: 491492 - RNA, 64 nt, hsa
gaaaugugugcuuucuguacaaugaaguuauugcuuuccauauauccuugaaucuucagauuaa

SEQ ID NO: 491493 - RNA, 64 nt, hsa
ccaagucucaaaccuugaugaaaaacacaaaauuuuuccauaaacuuaucagaagacucacuuu

SEQ ID NO: 491494 - RNA, 64 nt, hsa
acuaugaauaaggauucagggguuuuuaaucuacuuuccauaaauuaccaauaucacugauuca

SEQ ID NO: 491495 - RNA, 64 nt, hsa
cagaguggugggccauuaaccccaacauggaauuuuuccauauaaaucucaaugaauucccuuu

SEQ ID NO: 491496 - RNA, 64 nt, hsa
ggcuggguaaaagcagcuggagugaagcacucauuuuccauaaagguaacaaagggcagcucag

SEQ ID NO: 491497 - RNA, 64 nt, hsa
caaacaaaacgaaugaaaaacuggaaauaauucguuuccauaucuuuccauacauccauuucug

SEQ ID NO: 491498 - RNA, 64 nt, hsa
gaaugaaaaacuggaaauaauucguuuccauaucuuuccauacauccauuucugaaguauucag

SEQ ID NO: 491499 - RNA, 64 nt, hsa
agccaaucggggaugcagacaaguggcuacaaacuuuccauacaacaggugaagauaacgagac

SEQ ID NO: 491500 - RNA, 64 nt, hsa
uccuccacucuaaaguguucuuuguggcuagguauuuccauaauuucuuuaagccuuccuuugu

SEQ ID NO: 491501 - RNA, 64 nt, hsa
ggaggauguuuacagcuuugaggcuucaaauaaguuuccauaugcagggaguaacuuuaaacaa

SEQ ID NO: 491502 - RNA, 64 nt, hsa
augacacauggaacuaauggaauacauuuaugauuuuccauaauaauuuuaugaaaguuaagau

SEQ ID NO: 491503 - RNA, 64 nt, hsa
uuaaaaaucuaauuagaauuuccaaauaaaacaguuuccauaaggugucagcaacagcacuaaa

SEQ ID NO: 491504 - RNA, 64 nt, hsa
acagugacauuggaaucauuuccauaggagguaauuuccauagcaacuaaucauagugacccaa

SEQ ID NO: 491505 - RNA, 64 nt, hsa
augucauauucuuacaacagugacauuggaaucauuuccauaggagguaauuuccauagcaacu

SEQ ID NO: 491506 - RNA, 64 nt, hsa
gaguuugaaacccugagcuguuucucuguuccacuuuccauacugucauuucccuucuaaguua

SEQ ID NO: 491507 - RNA, 64 nt, hsa
uuuguuguucuguuuccuauuuugccaggaaguauuuccauaguugcugagaaucaaagcacaa

SEQ ID NO: 491508 - RNA, 64 nt, hsa
ugugaaggaucuaaggagacacaugcaccggaaauuuccauaagccaguugcaguuuucaggcu

SEQ ID NO: 491509 - RNA, 64 nt, hsa
auuuuauuuuaggagcuuauaaggcaugagacaauuuccauauaaauauauuaauuauugccac

SEQ ID NO: 491510 - RNA, 64 nt, hsa
cugagguuaacacuugauuuagccccuacauaucuuuccauauauccuauuauuucugaauaua

SEQ ID NO: 491511 - RNA, 64 nt, hsa
gauagucacgaaaauacugaaaguuugauuuuucuuuccauauuugaauuaauuuuuucuguuu

SEQ ID NO: 491512 - RNA, 64 nt, hsa
ccuuuaggggaaaaaaccccuaaauagcuucauguuuccauaaucaguacuuuauauuuauaaa

SEQ ID NO: 491513 - RNA, 64 nt, hsa
acagaaaacaauuuauuuuuuaaauaauugucuuuuuccauaaaaaagauuacuuuccauuccu

SEQ ID NO: 491514 - RNA, 64 nt, hsa
augaaaggcucgauguaauauagcuguaauuuacuuuccauaugaauacaguggcuagguucau

SEQ ID NO: 491515 - RNA, 64 nt, hsa
uguauuuuaugaugcccagcuuggaaauaguugcuuuccauagucucaacuguauugugucauc

SEQ ID NO: 491516 - RNA, 64 nt, hsa
ugcuguggcaggccuaauuugucuuguucuuuccuuuccauaucccaguauaaucucuguuaau

SEQ ID NO: 491517 - RNA, 64 nt, hsa
ucuagcugacagugguacuuagcaaaggccacuguuuccauagugaccagcugauaccucuucc

SEQ ID NO: 491518 - RNA, 64 nt, hsa
agaguucaauagcuguuucuaugauuauccucaauuuccauauguuacugaaucugaaaaacau

SEQ ID NO: 491519 - RNA, 64 nt, hsa
gugaugagccauuuuucaaaugaaauaccuuuuauuuccauauaauuuuuuuauuuuagaguuc

SEQ ID NO: 491520 - RNA, 64 nt, hsa
uuguuccaaaagacaaguguuuuuaaaaagaaccuuuccauacuucguguucuguucuauagag

SEQ ID NO: 491521 - RNA, 64 nt, hsa
aacauucaaucuaaguuacaaauagcacuuccauuuuccauagacucuaaaacuccccaaauug

SEQ ID NO: 491522 - RNA, 64 nt, hsa
cucuucaggggauaugaaacaaucuguagauugguuuccauacagggaaguucucuguccuaug

SEQ ID NO: 491523 - RNA, 64 nt, hsa
aauuuuuucagugaaauuccuauuauuuuaaaacuuuccauauuuucacuacgcuuggacauuu

SEQ ID NO: 491524 - RNA, 64 nt, hsa
acaaaauacuugucuguuuuaaaaaccuguucaagucuaccaaccuguucaagucuaccaauua

SEQ ID NO: 491525 - RNA, 64 nt, hsa
uuaaaaaccuguucaagucuaccaaccuguucaagucuaccaauuauaagggcaaauuggagaa

SEQ ID NO: 491526 - RNA, 64 nt, hsa
caauucacauuauauuggaaugaacaauucacaugucuaccacaagucuguaaacauaaccuua

SEQ ID NO: 491527 - RNA, 64 nt, hsa
cuuugcaaauucuguaauuucacucaacgauuaagucuaccaaagaacacacugcauguaaaag

SEQ ID NO: 491528 - RNA, 64 nt, hsa; identical to SEQ ID NO: 147960

SEQ ID NO: 491529 - RNA, 64 nt, hsa; identical to SEQ ID NO: 147961

SEQ ID NO: 491530 - RNA, 64 nt, hsa; identical to SEQ ID NO: 147962

SEQ ID NO: 491531 - RNA, 64 nt, hsa; identical to SEQ ID NO: 147963

SEQ ID NO: 491532 - RNA, 64 nt, hsa
uuaagcccaugugcaagaaaaugagggcuugagucgccugaaccaagagcaggaagagguugcu

SEQ ID NO: 491533 - RNA, 64 nt, hsa
uuaagcccaaguggaagaaaaugagggcuugagucgccugaacgaagagcaggaagagguugcu

SEQ ID NO: 491534 - RNA, 64 nt, hsa
cacacaccuguaaucguagcugaggcaggagaaucgccugaacccaggaggcggagcuugcagu

SEQ ID NO: 491535 - RNA, 64 nt, hsa
uaaaauacauaaauuagccgggugugguggcaggcgccugaaaucccagcuacucaagaggcug

SEQ ID NO: 491536 - RNA, 64 nt, hsa; identical to SEQ ID NO: 173420

SEQ ID NO: 491537 - RNA, 64 nt, hsa; identical to SEQ ID NO: 173421

SEQ ID NO: 491538 - RNA, 64 nt, hsa; identical to SEQ ID NO: 173422

SEQ ID NO: 491539 - RNA, 64 nt, hsa; identical to SEQ ID NO: 173423

SEQ ID NO: 491540 - RNA, 64 nt, hsa; identical to SEQ ID NO: 173424

SEQ ID NO: 491541 - RNA, 64 nt, hsa; identical to SEQ ID NO: 173425

SEQ ID NO: 491542 - RNA, 64 nt, hsa; identical to SEQ ID NO: 173426

SEQ ID NO: 491543 - RNA, 64 nt, hsa; identical to SEQ ID NO: 173427

SEQ ID NO: 491544 - RNA, 64 nt, hsa; identical to SEQ ID NO: 173428

SEQ ID NO: 491545 - RNA, 64 nt, hsa; identical to SEQ ID NO: 173429

SEQ ID NO: 491546 - RNA, 64 nt, hsa; identical to SEQ ID NO: 23154

SEQ ID NO: 491547 - RNA, 64 nt, hsa; identical to SEQ ID NO: 23155

SEQ ID NO: 491548 - RNA, 64 nt, hsa; identical to SEQ ID NO: 23156

SEQ ID NO: 491549 - RNA, 64 nt, hsa; identical to SEQ ID NO: 23157

SEQ ID NO: 491550 - RNA, 64 nt, hsa; identical to SEQ ID NO: 68768

SEQ ID NO: 491551 - RNA, 64 nt, hsa; identical to SEQ ID NO: 68769

SEQ ID NO: 491552 - RNA, 64 nt, hsa; identical to SEQ ID NO: 68770

SEQ ID NO: 491553 - RNA, 64 nt, hsa; identical to SEQ ID NO: 68771

SEQ ID NO: 491554 - RNA, 64 nt, hsa; identical to SEQ ID NO: 68772

SEQ ID NO: 491555 - RNA, 64 nt, hsa; identical to SEQ ID NO: 68773

SEQ ID NO: 491556 - RNA, 64 nt, hsa; identical to SEQ ID NO: 68774

SEQ ID NO: 491557 - RNA, 64 nt, hsa; identical to SEQ ID NO: 68775

SEQ ID NO: 491558 - RNA, 64 nt, hsa; identical to SEQ ID NO: 68776

SEQ ID NO: 491559 - RNA, 64 nt, hsa; identical to SEQ ID NO: 68777

SEQ ID NO: 491560 - RNA, 64 nt, hsa; identical to SEQ ID NO: 68778

SEQ ID NO: 491561 - RNA, 64 nt, hsa; identical to SEQ ID NO: 68779

SEQ ID NO: 491562 - RNA, 64 nt, hsa; identical to SEQ ID NO: 68780

SEQ ID NO: 491563 - RNA, 64 nt, hsa; identical to SEQ ID NO: 68781

SEQ ID NO: 491564 - RNA, 64 nt, hsa; identical to SEQ ID NO: 68782

SEQ ID NO: 491565 - RNA, 64 nt, hsa; identical to SEQ ID NO: 68783

SEQ ID NO: 491566 - RNA, 64 nt, hsa; identical to SEQ ID NO: 68784

SEQ ID NO: 491567 - RNA, 64 nt, hsa; identical to SEQ ID NO: 68785

SEQ ID NO: 491568 - RNA, 64 nt, hsa; identical to SEQ ID NO: 68786

SEQ ID NO: 491569 - RNA, 64 nt, hsa; identical to SEQ ID NO: 68787

SEQ ID NO: 491570 - RNA, 64 nt, hsa; identical to SEQ ID NO: 68788

SEQ ID NO: 491571 - RNA, 64 nt, hsa; identical to SEQ ID NO: 68789

SEQ ID NO: 491572 - RNA, 64 nt, hsa; identical to SEQ ID NO: 68790

SEQ ID NO: 491573 - RNA, 64 nt, hsa; identical to SEQ ID NO: 68791

SEQ ID NO: 491574 - RNA, 64 nt, hsa; identical to SEQ ID NO: 68792

SEQ ID NO: 491575 - RNA, 64 nt, hsa; identical to SEQ ID NO: 68793

SEQ ID NO: 491576 - RNA, 64 nt, hsa; identical to SEQ ID NO: 68794

SEQ ID NO: 491577 - RNA, 64 nt, hsa; identical to SEQ ID NO: 68795

SEQ ID NO: 491578 - RNA, 64 nt, hsa; identical to SEQ ID NO: 68796

SEQ ID NO: 491579 - RNA, 64 nt, hsa; identical to SEQ ID NO: 68797

SEQ ID NO: 491580 - RNA, 64 nt, hsa; identical to SEQ ID NO: 68798

SEQ ID NO: 491581 - RNA, 64 nt, hsa; identical to SEQ ID NO: 68799

SEQ ID NO: 491582 - RNA, 64 nt, hsa; identical to SEQ ID NO: 68800

SEQ ID NO: 491583 - RNA, 64 nt, hsa; identical to SEQ ID NO: 68801

SEQ ID NO: 491584 - RNA, 59 nt, hsa; identical to SEQ ID NO: 68802

SEQ ID NO: 491585 - RNA, 64 nt, hsa; identical to SEQ ID NO: 68803

SEQ ID NO: 491586 - RNA, 64 nt, hsa; identical to SEQ ID NO: 68804

SEQ ID NO: 491587 - RNA, 64 nt, hsa; identical to SEQ ID NO: 68805

SEQ ID NO: 491588 - RNA, 64 nt, hsa; identical to SEQ ID NO: 68806

SEQ ID NO: 491589 - RNA, 64 nt, hsa; identical to SEQ ID NO: 68807

SEQ ID NO: 491590 - RNA, 64 nt, hsa; identical to SEQ ID NO: 68808

SEQ ID NO: 491591 - RNA, 64 nt, hsa; identical to SEQ ID NO: 68809

SEQ ID NO: 491592 - RNA, 64 nt, hsa; identical to SEQ ID NO: 68810

SEQ ID NO: 491593 - RNA, 64 nt, hsa; identical to SEQ ID NO: 68811

SEQ ID NO: 491594 - RNA, 64 nt, hsa; identical to SEQ ID NO: 68812

SEQ ID NO: 491595 - RNA, 64 nt, hsa; identical to SEQ ID NO: 480284

SEQ ID NO: 491596 - RNA, 64 nt, hsa; identical to SEQ ID NO: 480285

SEQ ID NO: 491597 - RNA, 64 nt, hsa; identical to SEQ ID NO: 480286

SEQ ID NO: 491598 - RNA, 64 nt, hsa; identical to SEQ ID NO: 480287

SEQ ID NO: 491599 - RNA, 64 nt, hsa; identical to SEQ ID NO: 480288

SEQ ID NO: 491600 - RNA, 64 nt, hsa; identical to SEQ ID NO: 480289

SEQ ID NO: 491601 - RNA, 64 nt, hsa; identical to SEQ ID NO: 480290

SEQ ID NO: 491602 - RNA, 64 nt, hsa; identical to SEQ ID NO: 480291

SEQ ID NO: 491603 - RNA, 64 nt, hsa; identical to SEQ ID NO: 480292

SEQ ID NO: 491604 - RNA, 64 nt, hsa; identical to SEQ ID NO: 480293

SEQ ID NO: 491605 - RNA, 64 nt, hsa; identical to SEQ ID NO: 480294

SEQ ID NO: 491606 - RNA, 64 nt, hsa; identical to SEQ ID NO: 480295

SEQ ID NO: 491607 - RNA, 64 nt, hsa; identical to SEQ ID NO: 480296

SEQ ID NO: 491608 - RNA, 64 nt, hsa; identical to SEQ ID NO: 480297

SEQ ID NO: 491609 - RNA, 64 nt, hsa; identical to SEQ ID NO: 480298

SEQ ID NO: 491610 - RNA, 64 nt, hsa; identical to SEQ ID NO: 480299

SEQ ID NO: 491611 - RNA, 64 nt, hsa; identical to SEQ ID NO: 480300

SEQ ID NO: 491612 - RNA, 64 nt, hsa; identical to SEQ ID NO: 480301

SEQ ID NO: 491613 - RNA, 64 nt, hsa; identical to SEQ ID NO: 480302

SEQ ID NO: 491614 - RNA, 64 nt, hsa; identical to SEQ ID NO: 480303

SEQ ID NO: 491615 - RNA, 64 nt, hsa; identical to SEQ ID NO: 480304

SEQ ID NO: 491616 - RNA, 64 nt, hsa
cacaaaaacaccugaaaaaacucaagcugacuuccacugcgaagggaaauuauugguuugugua

SEQ ID NO: 491617 - RNA, 59 nt, hsa
acauugcugauugguguuaaguugcuagacacugcgaaaccaagcugacucacaagaag

SEQ ID NO: 491618 - RNA, 64 nt, hsa
gaugggcugggggaguugagagugugcuuauuuucacugcgaucaugagaccacaguucugggu

SEQ ID NO: 491619 - RNA, 64 nt, hsa
uccccaucggccuccagcacugccucccuccucccacugcgacucugggaucuccaggugcugc

SEQ ID NO: 491620 - RNA, 64 nt, hsa
uuccgggaggcagagaggagugaccgggcacuggcacugcgaucaggaagacuggacccccagc

SEQ ID NO: 491621 - RNA, 64 nt, hsa
gccuccuaaaaguucugggauuacaagugugagucacugcgacuggccaacauuaugugauuua

SEQ ID NO: 491622 - RNA, 64 nt, hsa
cugugcuuuaaaugguaacgcuacggccccaggucacugcgaggcacuuaccauguagauacgg

SEQ ID NO: 491623 - RNA, 64 nt, hsa
acccaggcuggagugcaauggcgugaccucagcucacugcgaccuccaccuccuggguucaagc

SEQ ID NO: 491624 - RNA, 64 nt, hsa
gggucugcagggggcccggccuccgcugccgcgacacugcgagggagcagccagccaagagccg

SEQ ID NO: 491625 - RNA, 64 nt, hsa
ucucauuauucaagguaguuacguucuauaaagucacugcgaacacugaauuagcaaauauaga

SEQ ID NO: 491626 - RNA, 64 nt, hsa
ggugggcagcagaggcaggccccagugugaccaccacugcgaccccugagcccacaagggcaga

SEQ ID NO: 491627 - RNA, 64 nt, hsa
ugccacgcuggaaugcaguaacgugaucuuggcucacugcgaccuccaccuccccaguucaagc

SEQ ID NO: 491628 - RNA, 64 nt, hsa
aacaacaacaaaaugaaacgcaaccaccaccaaccacugcgaccacaagaaggaugauucaaca

SEQ ID NO: 491629 - RNA, 64 nt, hsa
uuguucauuuccaaagcuacuuguuuacauuguacacugcgaccaccuugccgcuuuucaucac

SEQ ID NO: 491630 - RNA, 64 nt, hsa
cuuaaacccucugccuuugaaagcaggucauguucacugcgaugcuggacacuacagguaucug

SEQ ID NO: 491631 - RNA, 64 nt, hsa
augugaagaagaaaaaaaugccauguuuuaaaaccacugcgaaaauuuccccaaagcauaggug

SEQ ID NO: 491632 - RNA, 64 nt, hsa
ccuuaaaaccaaaaaaauaauggaaugauugcaucacugcgaggaaguauacuuaauuaagaaa

SEQ ID NO: 491633 - RNA, 64 nt, hsa
ugcaauucacucuggcgacccugugcuuuccugacacugcgaauacauuccuuaacccgcugcc

SEQ ID NO: 491634 - RNA, 64 nt, hsa
uccagcugcgguuaauccagcuugggccugucugcacugcgauccucuugggcucuccuaggau

SEQ ID NO: 491635 - RNA, 64 nt, hsa
gcacggcucugccccauggggggccuuuuuuacacacugcgaggcccagcuuucuaggggacuu

SEQ ID NO: 491636 - RNA, 64 nt, hsa
cugagcaaaaggcaaugaaaagucuugguucccacacugcgauauauuggaauuuucaccucag

SEQ ID NO: 491637 - RNA, 64 nt, hsa
acccaggcuggagugcaauggugcaaucucggcucacugcgaccucugccucccagguucaagc

SEQ ID NO: 491638 - RNA, 64 nt, hsa
acugugcucgaaguagagguuuuacucuacucaucacugcgauuugcacauugcuccguggaca

SEQ ID NO: 491639 - RNA, 64 nt, hsa
cccuggcucccuccuccaggccugccucccacuucacugcgaagacccucuugcccauccugac

SEQ ID NO: 491640 - RNA, 64 nt, hsa
acuguugcuaugauguaacugcauuugaccuaaccacugcgaaaauucauuccgcuguaauguu

SEQ ID NO: 491641 - RNA, 64 nt, hsa
caggaauaucagaaacgaaguuguugaucaggcccacugcgaccuuccuuucuaucucaggguu

SEQ ID NO: 491642 - RNA, 64 nt, hsa
aguaacuucuaaaauauaacaauacuaaauaucacacugcgauggaggucccaaauaugugguc

SEQ ID NO: 491643 - RNA, 64 nt, hsa
aaauguugacuggccaaaaauaucuuuuuucccccacugcgagguuguuuuaaagucagauuug

SEQ ID NO: 491644 - RNA, 64 nt, hsa
ucagugaaauugcuaaaugucaauguauuuuuggcacugcgauuuuaaccauuuauuaaauaaa

SEQ ID NO: 491645 - RNA, 64 nt, hsa
agcuugacgcguggucacaggacgauuucacugacacugcgaacucucaggacuaccguuacca

SEQ ID NO: 491646 - RNA, 64 nt, hsa
ucuuucagcccagcgcugcggccccgggaagggccacugcgaauagagaggaagcuggaaaagu

SEQ ID NO: 491647 - RNA, 64 nt, hsa
ucaccucuggaaauacacuagugugagccuucagcacugcgagaauaccuucaaguacaguauu

SEQ ID NO: 491648 - RNA, 64 nt, hsa
gggcuuccaugguaagggggccugcgucccugcacacugcgaggacugccuuggccacaggccc

SEQ ID NO: 491649 - RNA, 64 nt, hsa
acccaggcuggagugcaguggcgugaucucggcucacugcgaccuccgucucccgggcucacgc

SEQ ID NO: 491650 - RNA, 64 nt, hsa
cagggagccuggccaggccugagacacagaggcccacugcgagggggacaguggcggugggacu

SEQ ID NO: 491651 - RNA, 64 nt, hsa
ccccuagccuugcuaugcaguggaaaacccagggcacugcgacuuugugaagcugaggacaaug

SEQ ID NO: 491652 - RNA, 57 nt, hsa
ccgagccgcaggucugcugaggccuggcacugcgacugcccagucuggccugcgcuc

SEQ ID NO: 491653 - RNA, 64 nt, hsa
gggugauuuuaggcagcaagaauuggagaacucacacugcgaaaagaaaaccuuggguggcagu

SEQ ID NO: 491654 - RNA, 64 nt, hsa
ccuccagaagacaucuguccugcagaggcccuaccacugcgaggccugcgggaaggacuuccuc

SEQ ID NO: 491655 - RNA, 64 nt, hsa
cguucguuacgcggugugugaagacugacaucugcacugcgaggauggagaucuuggucaucuc

SEQ ID NO: 491656 - RNA, 64 nt, hsa
ugcuauaggcugggcuuccccuuggggcggaacucacugcgaugggggucaccaggugaccagu

SEQ ID NO: 491657 - RNA, 64 nt, hsa
aaagugccccuugaugagggaaaaugucccacugcacugcgaauuucucaguuccauuuuaccu

SEQ ID NO: 491658 - RNA, 64 nt, hsa
cgggguggcagagugaguugucucaggaccccgucacugcgacguugacacuccucucccuucc

SEQ ID NO: 491659 - RNA, 64 nt, hsa
uauauuaguaggagggcuucacaccagcacugcucacugcgacuccuggaaauguguggggaau

SEQ ID NO: 491660 - RNA, 64 nt, hsa
aacuaucaggaauaucugaagacauuggcuucuccacugcgagagauugauccagaccaaccca

SEQ ID NO: 491661 - RNA, 64 nt, hsa
aagagggagucugagcaugagcugcagccagggccacugcgaggggggcugggccagugcaccu

SEQ ID NO: 491662 - RNA, 64 nt, hsa
gaagaagcgguaaugcgcccggagcgaccggggagcgagcgagugcgucaagaaagaaugaaug

SEQ ID NO: 491663 - RNA, 64 nt, hsa
uuacguuuucaaagaaaucaaguauaugaggagagcgagcgagcgugagagaacacccgugaga

SEQ ID NO: 491664 - RNA, 64 nt, hsa
agggccuucuacauggaggagggcgugcccuauugcgagcgagacuaugagaagauguuuggca

SEQ ID NO: 491665 - RNA, 64 nt, hsa
caucacuaugcaucuguuccaggaaagaagaaaagcgagcgaggaagacggaaaagacugccug

SEQ ID NO: 491666 - RNA, 64 nt, hsa
uccgcuggaaaaacguuucgaagcacaguggccagcgagcgagcacguggcuacucccuguugc

SEQ ID NO: 491667 - RNA, 64 nt, hsa
cggcgcugggguaucagugagggcggccgggagggcgagcgagggagaggagggagagggggag

SEQ ID NO: 491668 - RNA, 64 nt, hsa
gcauccagagaggaguccugggagagcgggcggagcgagcgagggcccccggacuggaggcuug

SEQ ID NO: 491669 - RNA, 64 nt, hsa
gugucagcugcacagcgggacucuagggagaugggcgagcgagcgucugcucacuggcucuggg

SEQ ID NO: 491670 - RNA, 64 nt, hsa
aucaucucugcuacagucauguuucugcaugucagcgagcgacacugucccugccucagguugg

SEQ ID NO: 491671 - RNA, 64 nt, hsa
gccccugcccuucaccuagcucccuuggccaggagcgagcgaagcuguggccuuggugaagcug

SEQ ID NO: 491672 - RNA, 64 nt, hsa
ggucccuggggcagcuguccccaucaggccaagagcgagcgagaggcgcugccccagccaggcc

SEQ ID NO: 491673 - RNA, 64 nt, hsa
ugaaaaguugaaaagacaaaaaaaaaaaaaaaaagcgagcgagagagagagcgagagagagagc

SEQ ID NO: 491674 - RNA, 64 nt, hsa
cucccccagaagcucacaaaggaaaacggagagagcgagcgagagagauuuccuuggaaauuuc

SEQ ID NO: 491675 - RNA, 64 nt, hsa
gcgaguaugagcagcucaagagcgagugggcccagcgagcgaacccugaggaccuggaauucau

SEQ ID NO: 491676 - RNA, 64 nt, hsa
aauuuaauuugcuuaagauuuaguacauuucagaacuuuugaacuuuugacaaauugcauugga

SEQ ID NO: 491677 - RNA, 64 nt, hsa
uugcuuaagauuuaguacauuucagaacuuuugaacuuuugacaaauugcauuggaaaaagaag

SEQ ID NO: 491678 - RNA, 64 nt, hsa
aguuguaacucaaugaaauuuaauuaaacaugcuacuuuugauuucauuuacuuggcugauaga

SEQ ID NO: 491679 - RNA, 64 nt, hsa
ucauacauaauuuuagguuaucauuauccuuuggacuuuugauauacucaaagccagaaagcuu

SEQ ID NO: 491680 - RNA, 64 nt, hsa
uucuccagcuuguccauuuccccacuugaagaaaacuuuugauauauaugccuuacugaguaca

SEQ ID NO: 491681 - RNA, 64 nt, hsa
gccagggggaacaaaguaagcuugaugggcuggaacuuuugacuuuggguccccaaacagccaa

SEQ ID NO: 491682 - RNA, 64 nt, hsa
aacagaugacaaaucucugaaagagguuuuuaaaacuuuugauccaacugcuucaccauuuugu

SEQ ID NO: 491683 - RNA, 64 nt, hsa
ugguuguuuaguuucaagcaauaugauguacauuacuuuugagaaacaguauuuugacuaggac

SEQ ID NO: 491684 - RNA, 64 nt, hsa
gaacuuuguaaaacugcauauggaccuguaaucaacuuuugauauuucuuaauaaaggcguuga

SEQ ID NO: 491685 - RNA, 64 nt, hsa
gcugauguuccugcauccaguuguucucggucauacuuuugaccacuugugacuggaguucagu

SEQ ID NO: 491686 - RNA, 64 nt, hsa
auucuuugcuguaccuuuugcugcccauccuguuacuuuugaguuucuuucauugugguuguuc

SEQ ID NO: 491687 - RNA, 64 nt, hsa
guuggccacuuacgcuaauccuggaaguaugaucacuuuugaaccugccccuuaaccuugacga

SEQ ID NO: 491688 - RNA, 64 nt, hsa
aaugguuugaaguacucaaaaucuguuacgcuaaacuuuugauucuuuaacacaauuauuuuua

SEQ ID NO: 491689 - RNA, 64 nt, hsa
uguagacuguuuaaugacuggauaucuuccuucaacuuuugaaauacaaaaccaguguuuuuua

SEQ ID NO: 491690 - RNA, 64 nt, hsa
aaugaaaccaggccauagcugucauaaaucuuugacuuuugaauauuuacauucuucaguauaa

SEQ ID NO: 491691 - RNA, 64 nt, hsa
gauuuucuccuuugguuuguagaauuaggacugaacuuuugacucaaauugcuacaguugccau

SEQ ID NO: 491692 - RNA, 64 nt, hsa
gguuuccaccuuggacugacuuugauccuguuccacuuuugaaauuuuauuuguuccuuuucca

SEQ ID NO: 491693 - RNA, 64 nt, hsa
agaaaagagaggauguccgugcuuaauucuagauacuuuugagacaacaccuucagaaaacaca

SEQ ID NO: 491694 - RNA, 64 nt, hsa
agauaaaauugugcauucaaaugaugguacuuugacuuuugaggguuuuuauuucuguuauuca

SEQ ID NO: 491695 - RNA, 64 nt, hsa
auuuauaaacauaaaagcucauuguguuuuuuagacuuuugauauuauuugauacuguacaaac

SEQ ID NO: 491696 - RNA, 64 nt, hsa
caagaauaacaacuuccacuuuuuuuuaaacugcacuuuugacuuuuuuuaugguauaaaaaca

SEQ ID NO: 491697 - RNA, 64 nt, hsa
uuuuugaucuguauugggcuaaccagagccaaauacuuuugaagaguuucccagggacuaguca

SEQ ID NO: 491698 - RNA, 64 nt, hsa
ucucuagcccauuauaaccugcuaucuuggggcaacuuuugauguaugacaugucacccuuccc

SEQ ID NO: 491699 - RNA, 64 nt, hsa
ccaucuagguuucuuuuaucuggagaaaaagaacacuuuugaacuauguaaugcuucacccuga

SEQ ID NO: 491700 - RNA, 64 nt, hsa
aaauuucccauaaacuuaagugccuacacuuaggacuuuugaacuuucagucaucuuuuucgug

SEQ ID NO: 491701 - RNA, 64 nt, hsa
aaguaaaacacaaugcugaagaaauauuggugugacuuuugaauguuaccgauuggauguaaaa

SEQ ID NO: 491702 - RNA, 64 nt, hsa
uuaucccauccuugcacuaccagaagauucauacacuuuugagacuccagugagacgcuguuuu

SEQ ID NO: 491703 - RNA, 64 nt, hsa; identical to SEQ ID NO: 22256

SEQ ID NO: 491704 - RNA, 64 nt, hsa; identical to SEQ ID NO: 22257

SEQ ID NO: 491705 - RNA, 64 nt, hsa; identical to SEQ ID NO: 22258

SEQ ID NO: 491706 - RNA, 64 nt, hsa; identical to SEQ ID NO: 22259

SEQ ID NO: 491707 - RNA, 64 nt, hsa; identical to SEQ ID NO: 22260

SEQ ID NO: 491708 - RNA, 64 nt, hsa; identical to SEQ ID NO: 22261

SEQ ID NO: 491709 - RNA, 64 nt, hsa; identical to SEQ ID NO: 22262

SEQ ID NO: 491710 - RNA, 64 nt, hsa; identical to SEQ ID NO: 22263

SEQ ID NO: 491711 - RNA, 64 nt, hsa; identical to SEQ ID NO: 22264

SEQ ID NO: 491712 - RNA, 64 nt, hsa; identical to SEQ ID NO: 22265

SEQ ID NO: 491713 - RNA, 64 nt, hsa
gcugcuguggcuucagcuuuggaagcugucaaucccggagcaacuuucccaacuacccaacccc

SEQ ID NO: 491714 - RNA, 64 nt, hsa
gcccggaaggaaggccaugaccaccacugagggcccggagcaggguggggaggugcaguggcac

SEQ ID NO: 491715 - RNA, 64 nt, hsa
uuccuauauucuucugcaaaucaaacguucuuucccaauccaauccagccuugguuuuauuuua

SEQ ID NO: 491716 - RNA, 64 nt, hsa
auauucuucugcaaaucaaacguucuuucccaauccaauccagccuugguuuuauuuuaaauua

SEQ ID NO: 491717 - RNA, 64 nt, hsa
auuuaauuaaaaucagucuuauaugaaguauguuccaauccaugugggaacuugacucucucau

SEQ ID NO: 491718 - RNA, 64 nt, hsa
aaauauaaaauuauauauaaaggguuauuugaaaccaauccauggcaacgcuggugcuugauac

SEQ ID NO: 491719 - RNA, 64 nt, hsa
gcagggucagggccaaagucuaugcguuccaucuccaauccaggcagugaggaauccugaaaca

SEQ ID NO: 491720 - RNA, 64 nt, hsa
cccuggggcucccagggaagugggagcuggggagccaauccacccagacccgcguccaccuggg

SEQ ID NO: 491721 - RNA, 64 nt, hsa
aagacacaggggacacccagaaacgccacaucccccaauccaucagugccaaacuagccaacgg

SEQ ID NO: 491722 - RNA, 64 nt, hsa
cccgugguggcucaagucuggccccacaccagccccaauccaaaacuggcaaggacgcuucaca

SEQ ID NO: 491723 - RNA, 64 nt, hsa; identical to SEQ ID NO: 218812

SEQ ID NO: 491724 - RNA, 64 nt, hsa; identical to SEQ ID NO: 218813

SEQ ID NO: 491725 - RNA, 64 nt, hsa; identical to SEQ ID NO: 218814

SEQ ID NO: 491726 - RNA, 64 nt, hsa; identical to SEQ ID NO: 218815

SEQ ID NO: 491727 - RNA, 64 nt, hsa; identical to SEQ ID NO: 218816

SEQ ID NO: 491728 - RNA, 64 nt, hsa; identical to SEQ ID NO: 218817

SEQ ID NO: 491729 - RNA, 64 nt, hsa; identical to SEQ ID NO: 218818

SEQ ID NO: 491730 - RNA, 64 nt, hsa; identical to SEQ ID NO: 218819

SEQ ID NO: 491731 - RNA, 64 nt, hsa; identical to SEQ ID NO: 218820

SEQ ID NO: 491732 - RNA, 64 nt, hsa; identical to SEQ ID NO: 218821

SEQ ID NO: 491733 - RNA, 64 nt, hsa; identical to SEQ ID NO: 218822

SEQ ID NO: 491734 - RNA, 64 nt, hsa; identical to SEQ ID NO: 218823

SEQ ID NO: 491735 - RNA, 64 nt, hsa; identical to SEQ ID NO: 218824

SEQ ID NO: 491736 - RNA, 64 nt, hsa; identical to SEQ ID NO: 218825

SEQ ID NO: 491737 - RNA, 64 nt, hsa; identical to SEQ ID NO: 218826

SEQ ID NO: 491738 - RNA, 64 nt, hsa; identical to SEQ ID NO: 218827

SEQ ID NO: 491739 - RNA, 64 nt, hsa; identical to SEQ ID NO: 218828

SEQ ID NO: 491740 - RNA, 64 nt, hsa; identical to SEQ ID NO: 218829

SEQ ID NO: 491741 - RNA, 64 nt, hsa; identical to SEQ ID NO: 218830

SEQ ID NO: 491742 - RNA, 64 nt, hsa; identical to SEQ ID NO: 218831

SEQ ID NO: 491743 - RNA, 64 nt, hsa; identical to SEQ ID NO: 218832

SEQ ID NO: 491744 - RNA, 64 nt, hsa; identical to SEQ ID NO: 218833

SEQ ID NO: 491745 - RNA, 64 nt, hsa; identical to SEQ ID NO: 218834

SEQ ID NO: 491746 - RNA, 64 nt, hsa; identical to SEQ ID NO: 218835

SEQ ID NO: 491747 - RNA, 64 nt, hsa; identical to SEQ ID NO: 218836

SEQ ID NO: 491748 - RNA, 64 nt, hsa; identical to SEQ ID NO: 168067

SEQ ID NO: 491749 - RNA, 64 nt, hsa; identical to SEQ ID NO: 168068

SEQ ID NO: 491750 - RNA, 64 nt, hsa; identical to SEQ ID NO: 168069

SEQ ID NO: 491751 - RNA, 64 nt, hsa; identical to SEQ ID NO: 168070

SEQ ID NO: 491752 - RNA, 64 nt, hsa; identical to SEQ ID NO: 168071

SEQ ID NO: 491753 - RNA, 64 nt, hsa; identical to SEQ ID NO: 168072

SEQ ID NO: 491754 - RNA, 64 nt, hsa; identical to SEQ ID NO: 168073

SEQ ID NO: 491755 - RNA, 64 nt, hsa; identical to SEQ ID NO: 168074

SEQ ID NO: 491756 - RNA, 64 nt, hsa; identical to SEQ ID NO: 168075

SEQ ID NO: 491757 - RNA, 64 nt, hsa; identical to SEQ ID NO: 168076

SEQ ID NO: 491758 - RNA, 64 nt, hsa; identical to SEQ ID NO: 168077

SEQ ID NO: 491759 - RNA, 64 nt, hsa; identical to SEQ ID NO: 168078

SEQ ID NO: 491760 - RNA, 64 nt, hsa; identical to SEQ ID NO: 168079

SEQ ID NO: 491761 - RNA, 64 nt, hsa; identical to SEQ ID NO: 168080

SEQ ID NO: 491762 - RNA, 64 nt, hsa
aagcuauaaauuaccuggucauuuugugaucacaagagucuaugcaaaaaaaaaaauuucuuua

SEQ ID NO: 491763 - RNA, 64 nt, hsa
uuaugaauguugauuuucauaccaaagaagauggagagucuaaaauuuggauaugauucuuaug

SEQ ID NO: 491764 - RNA, 64 nt, hsa
gguagguauugucuuccaggcuucaaagcugcacagagucuacguuuuagagaguuggcaccuu

SEQ ID NO: 491765 - RNA, 64 nt, hsa
uuacaaagaaucauauuuaaaggcugcccaauguagagucuagugaccuguucaggacaccuga

SEQ ID NO: 491766 - RNA, 64 nt, hsa
uuaacauuccaagacucuagaguccaagguuuaaagagucuagauucaaagguucuagguuuca

SEQ ID NO: 491767 - RNA, 64 nt, hsa
cuaggauucuaaaaugugauguucuaaggcucugagagucuagauucucuggcuguaaggcucu

SEQ ID NO: 491768 - RNA, 64 nt, hsa
cgaaagcucuagaaucugcaauucaaaaguuccaagagucuaaagauggaguuucuaagguccg

SEQ ID NO: 491769 - RNA, 64 nt, hsa; identical to SEQ ID NO: 106172

SEQ ID NO: 491770 - RNA, 64 nt, hsa; identical to SEQ ID NO: 106173

SEQ ID NO: 491771 - RNA, 64 nt, hsa; identical to SEQ ID NO: 106174

SEQ ID NO: 491772 - RNA, 64 nt, hsa; identical to SEQ ID NO: 106175

SEQ ID NO: 491773 - RNA, 64 nt, hsa; identical to SEQ ID NO: 106176

SEQ ID NO: 491774 - RNA, 64 nt, hsa; identical to SEQ ID NO: 106177

SEQ ID NO: 491775 - RNA, 64 nt, hsa; identical to SEQ ID NO: 106178

SEQ ID NO: 491776 - RNA, 64 nt, hsa; identical to SEQ ID NO: 106179

SEQ ID NO: 491777 - RNA, 64 nt, hsa; identical to SEQ ID NO: 106180

SEQ ID NO: 491778 - RNA, 64 nt, hsa; identical to SEQ ID NO: 106181

SEQ ID NO: 491779 - RNA, 64 nt, hsa; identical to SEQ ID NO: 106182

SEQ ID NO: 491780 - RNA, 64 nt, hsa; identical to SEQ ID NO: 106183

SEQ ID NO: 491781 - RNA, 64 nt, hsa; identical to SEQ ID NO: 106184

SEQ ID NO: 491782 - RNA, 64 nt, hsa; identical to SEQ ID NO: 106185

SEQ ID NO: 491783 - RNA, 64 nt, hsa; identical to SEQ ID NO: 106186

SEQ ID NO: 491784 - RNA, 64 nt, hsa; identical to SEQ ID NO: 106187

SEQ ID NO: 491785 - RNA, 64 nt, hsa; identical to SEQ ID NO: 106188

SEQ ID NO: 491786 - RNA, 64 nt, hsa; identical to SEQ ID NO: 106189

SEQ ID NO: 491787 - RNA, 64 nt, hsa; identical to SEQ ID NO: 181517

SEQ ID NO: 491788 - RNA, 64 nt, hsa; identical to SEQ ID NO: 181518

SEQ ID NO: 491789 - RNA, 64 nt, hsa; identical to SEQ ID NO: 181519

SEQ ID NO: 491790 - RNA, 64 nt, hsa; identical to SEQ ID NO: 181520

SEQ ID NO: 491791 - RNA, 64 nt, hsa; identical to SEQ ID NO: 181521

SEQ ID NO: 491792 - RNA, 64 nt, hsa; identical to SEQ ID NO: 181522

SEQ ID NO: 491793 - RNA, 64 nt, hsa; identical to SEQ ID NO: 181523

SEQ ID NO: 491794 - RNA, 64 nt, hsa; identical to SEQ ID NO: 181524

SEQ ID NO: 491795 - RNA, 64 nt, hsa; identical to SEQ ID NO: 181525

SEQ ID NO: 491796 - RNA, 64 nt, hsa; identical to SEQ ID NO: 181526

SEQ ID NO: 491797 - RNA, 64 nt, hsa; identical to SEQ ID NO: 181527

SEQ ID NO: 491798 - RNA, 64 nt, hsa; identical to SEQ ID NO: 181528

SEQ ID NO: 491799 - RNA, 64 nt, hsa; identical to SEQ ID NO: 181529

SEQ ID NO: 491800 - RNA, 64 nt, hsa; identical to SEQ ID NO: 181530

SEQ ID NO: 491801 - RNA, 64 nt, hsa; identical to SEQ ID NO: 181531

SEQ ID NO: 491802 - RNA, 64 nt, hsa; identical to SEQ ID NO: 181532

SEQ ID NO: 491803 - RNA, 64 nt, hsa; identical to SEQ ID NO: 181533

SEQ ID NO: 491804 - RNA, 64 nt, hsa; identical to SEQ ID NO: 181534

SEQ ID NO: 491805 - RNA, 64 nt, hsa; identical to SEQ ID NO: 181535

SEQ ID NO: 491806 - RNA, 64 nt, hsa; identical to SEQ ID NO: 181536

SEQ ID NO: 491807 - RNA, 64 nt, hsa; identical to SEQ ID NO: 181537

SEQ ID NO: 491808 - RNA, 64 nt, hsa; identical to SEQ ID NO: 181538

SEQ ID NO: 491809 - RNA, 64 nt, hsa; identical to SEQ ID NO: 181539

SEQ ID NO: 491810 - RNA, 64 nt, hsa; identical to SEQ ID NO: 181540

SEQ ID NO: 491811 - RNA, 64 nt, hsa; identical to SEQ ID NO: 181541

SEQ ID NO: 491812 - RNA, 64 nt, hsa; identical to SEQ ID NO: 181542

SEQ ID NO: 491813 - RNA, 64 nt, hsa; identical to SEQ ID NO: 181543

SEQ ID NO: 491814 - RNA, 64 nt, hsa; identical to SEQ ID NO: 181544

SEQ ID NO: 491815 - RNA, 64 nt, hsa; identical to SEQ ID NO: 181545

SEQ ID NO: 491816 - RNA, 64 nt, hsa; identical to SEQ ID NO: 181546

SEQ ID NO: 491817 - RNA, 64 nt, hsa; identical to SEQ ID NO: 181547

SEQ ID NO: 491818 - RNA, 64 nt, hsa; identical to SEQ ID NO: 181548

SEQ ID NO: 491819 - RNA, 53 nt, hsa; identical to SEQ ID NO: 181549

SEQ ID NO: 491820 - RNA, 59 nt, hsa; identical to SEQ ID NO: 181550

SEQ ID NO: 491821 - RNA, 64 nt, hsa; identical to SEQ ID NO: 181551

SEQ ID NO: 491822 - RNA, 64 nt, hsa; identical to SEQ ID NO: 181552

SEQ ID NO: 491823 - RNA, 64 nt, hsa; identical to SEQ ID NO: 181553

SEQ ID NO: 491824 - RNA, 64 nt, hsa; identical to SEQ ID NO: 181554

SEQ ID NO: 491825 - RNA, 64 nt, hsa; identical to SEQ ID NO: 181555

SEQ ID NO: 491826 - RNA, 64 nt, hsa; identical to SEQ ID NO: 181556

SEQ ID NO: 491827 - RNA, 64 nt, hsa; identical to SEQ ID NO: 181557

SEQ ID NO: 491828 - RNA, 64 nt, hsa; identical to SEQ ID NO: 181558

SEQ ID NO: 491829 - RNA, 64 nt, hsa; identical to SEQ ID NO: 181559

SEQ ID NO: 491830 - RNA, 64 nt, hsa; identical to SEQ ID NO: 181560

SEQ ID NO: 491831 - RNA, 64 nt, hsa; identical to SEQ ID NO: 181561

SEQ ID NO: 491832 - RNA, 64 nt, hsa; identical to SEQ ID NO: 181562

SEQ ID NO: 491833 - RNA, 64 nt, hsa; identical to SEQ ID NO: 181563

SEQ ID NO: 491834 - RNA, 64 nt, hsa; identical to SEQ ID NO: 181564

SEQ ID NO: 491835 - RNA, 64 nt, hsa; identical to SEQ ID NO: 181565

SEQ ID NO: 491836 - RNA, 64 nt, hsa; identical to SEQ ID NO: 181566

SEQ ID NO: 491837 - RNA, 64 nt, hsa; identical to SEQ ID NO: 181567

SEQ ID NO: 491838 - RNA, 64 nt, hsa; identical to SEQ ID NO: 181568

SEQ ID NO: 491839 - RNA, 64 nt, hsa; identical to SEQ ID NO: 485179

SEQ ID NO: 491840 - RNA, 64 nt, hsa; identical to SEQ ID NO: 485180

SEQ ID NO: 491841 - RNA, 64 nt, hsa; identical to SEQ ID NO: 485181

SEQ ID NO: 491842 - RNA, 64 nt, hsa; identical to SEQ ID NO: 485182

SEQ ID NO: 491843 - RNA, 64 nt, hsa; identical to SEQ ID NO: 485183

SEQ ID NO: 491844 - RNA, 64 nt, hsa; identical to SEQ ID NO: 485184

SEQ ID NO: 491845 - RNA, 64 nt, hsa; identical to SEQ ID NO: 485185

SEQ ID NO: 491846 - RNA, 64 nt, hsa; identical to SEQ ID NO: 485186

SEQ ID NO: 491847 - RNA, 64 nt, hsa; identical to SEQ ID NO: 485187

SEQ ID NO: 491848 - RNA, 64 nt, hsa; identical to SEQ ID NO: 485188

SEQ ID NO: 491849 - RNA, 64 nt, hsa; identical to SEQ ID NO: 485189

SEQ ID NO: 491850 - RNA, 64 nt, hsa; identical to SEQ ID NO: 485190

SEQ ID NO: 491851 - RNA, 64 nt, hsa; identical to SEQ ID NO: 485191

SEQ ID NO: 491852 - RNA, 64 nt, hsa; identical to SEQ ID NO: 485192

SEQ ID NO: 491853 - RNA, 64 nt, hsa; identical to SEQ ID NO: 485193

SEQ ID NO: 491854 - RNA, 64 nt, hsa; identical to SEQ ID NO: 485194

SEQ ID NO: 491855 - RNA, 64 nt, hsa; identical to SEQ ID NO: 485195

SEQ ID NO: 491856 - RNA, 64 nt, hsa; identical to SEQ ID NO: 485196

SEQ ID NO: 491857 - RNA, 64 nt, hsa; identical to SEQ ID NO: 485197

SEQ ID NO: 491858 - RNA, 64 nt, hsa; identical to SEQ ID NO: 485198

SEQ ID NO: 491859 - RNA, 64 nt, hsa; identical to SEQ ID NO: 485199

SEQ ID NO: 491860 - RNA, 64 nt, hsa; identical to SEQ ID NO: 485200

SEQ ID NO: 491861 - RNA, 64 nt, hsa; identical to SEQ ID NO: 485201

SEQ ID NO: 491862 - RNA, 64 nt, hsa; identical to SEQ ID NO: 485202

SEQ ID NO: 491863 - RNA, 64 nt, hsa; identical to SEQ ID NO: 485203

SEQ ID NO: 491864 - RNA, 64 nt, hsa; identical to SEQ ID NO: 485204

SEQ ID NO: 491865 - RNA, 64 nt, hsa; identical to SEQ ID NO: 485205

SEQ ID NO: 491866 - RNA, 64 nt, hsa; identical to SEQ ID NO: 485206

SEQ ID NO: 491867 - RNA, 64 nt, hsa; identical to SEQ ID NO: 485207

SEQ ID NO: 491868 - RNA, 64 nt, hsa; identical to SEQ ID NO: 485208

SEQ ID NO: 491869 - RNA, 64 nt, hsa; identical to SEQ ID NO: 485209

SEQ ID NO: 491870 - RNA, 64 nt, hsa; identical to SEQ ID NO: 485210

SEQ ID NO: 491871 - RNA, 64 nt, hsa; identical to SEQ ID NO: 485211

SEQ ID NO: 491872 - RNA, 64 nt, hsa; identical to SEQ ID NO: 485212

SEQ ID NO: 491873 - RNA, 64 nt, hsa; identical to SEQ ID NO: 485213

SEQ ID NO: 491874 - RNA, 64 nt, hsa; identical to SEQ ID NO: 485214

SEQ ID NO: 491875 - RNA, 64 nt, hsa; identical to SEQ ID NO: 485215

SEQ ID NO: 491876 - RNA, 64 nt, hsa; identical to SEQ ID NO: 485216

SEQ ID NO: 491877 - RNA, 64 nt, hsa; identical to SEQ ID NO: 485217

SEQ ID NO: 491878 - RNA, 64 nt, hsa; identical to SEQ ID NO: 485218

SEQ ID NO: 491879 - RNA, 64 nt, hsa; identical to SEQ ID NO: 485219

SEQ ID NO: 491880 - RNA, 64 nt, hsa; identical to SEQ ID NO: 485220

SEQ ID NO: 491881 - RNA, 64 nt, hsa; identical to SEQ ID NO: 485221

SEQ ID NO: 491882 - RNA, 64 nt, hsa; identical to SEQ ID NO: 485222

SEQ ID NO: 491883 - RNA, 64 nt, hsa; identical to SEQ ID NO: 485223

SEQ ID NO: 491884 - RNA, 64 nt, hsa; identical to SEQ ID NO: 485224

SEQ ID NO: 491885 - RNA, 64 nt, hsa; identical to SEQ ID NO: 485225

SEQ ID NO: 491886 - RNA, 64 nt, hsa; identical to SEQ ID NO: 485226

SEQ ID NO: 491887 - RNA, 64 nt, hsa; identical to SEQ ID NO: 485227

SEQ ID NO: 491888 - RNA, 64 nt, hsa; identical to SEQ ID NO: 485228

SEQ ID NO: 491889 - RNA, 64 nt, hsa; identical to SEQ ID NO: 485229

SEQ ID NO: 491890 - RNA, 64 nt, hsa; identical to SEQ ID NO: 485230

SEQ ID NO: 491891 - RNA, 64 nt, hsa; identical to SEQ ID NO: 485231

SEQ ID NO: 491892 - RNA, 64 nt, hsa; identical to SEQ ID NO: 485232

SEQ ID NO: 491893 - RNA, 64 nt, hsa; identical to SEQ ID NO: 485233

SEQ ID NO: 491894 - RNA, 64 nt, hsa; identical to SEQ ID NO: 485234

SEQ ID NO: 491895 - RNA, 64 nt, hsa; identical to SEQ ID NO: 485235

SEQ ID NO: 491896 - RNA, 64 nt, hsa; identical to SEQ ID NO: 485236

SEQ ID NO: 491897 - RNA, 64 nt, hsa; identical to SEQ ID NO: 485237

SEQ ID NO: 491898 - RNA, 64 nt, hsa; identical to SEQ ID NO: 485238

SEQ ID NO: 491899 - RNA, 64 nt, hsa; identical to SEQ ID NO: 485239

SEQ ID NO: 491900 - RNA, 64 nt, hsa; identical to SEQ ID NO: 415046

SEQ ID NO: 491901 - RNA, 64 nt, hsa; identical to SEQ ID NO: 415047

SEQ ID NO: 491902 - RNA, 64 nt, hsa
ccacccucauguuucuguaggauucucaccguggggcuggaagaaaagagcaucgacuugauuu

SEQ ID NO: 491903 - RNA, 64 nt, hsa
aaggcuccacauuaggucaccugugcacagccauggcuggaaugaugaaggggauacgcuggag

SEQ ID NO: 491904 - RNA, 64 nt, hsa
guguuuuugaaacggaguuuugcucugucacccaggcuggaaugcaauggcaccaucuuggcuc

SEQ ID NO: 491905 - RNA, 64 nt, hsa
gccccagacccaucucuuggauugagggugugugggcuggaaccagugggucacuguggcagcu

SEQ ID NO: 491906 - RNA, 64 nt, hsa
uccguuagcuccuguggccccacccugggcccugggcuggaaucaggaauauuuuccaaagagu

SEQ ID NO: 491907 - RNA, 64 nt, hsa
gauccgacugcuuuggaccuaaauggccucauguggcuggaagauccugcggguggggcuuggg

SEQ ID NO: 491908 - RNA, 64 nt, hsa
agaauaaagaaugcugagucaagauuuauauuaaggcuggaagcuguggcucacaccuguaauc

SEQ ID NO: 491909 - RNA, 64 nt, hsa
auggugggaggauggguugagcacaggagucagaggcuggaaugcaauggcgugaucuuggcuc

SEQ ID NO: 491910 - RNA, 64 nt, hsa
gaccaccauccaggcugagacugaaaggagcagaggcuggaacuacaguauucuuuccccugcu

SEQ ID NO: 491911 - RNA, 64 nt, hsa
ccauccugacuguggaguugggauguggaaguggggcuggaacaaagcuucugccuagggagga

SEQ ID NO: 491912 - RNA, 64 nt, hsa
uccccacaggggggaggcacuaagucaugguccuggcuggaagguacugaaggcuucugcagcu

SEQ ID NO: 491913 - RNA, 64 nt, hsa
cggcagaugcuguuguuguuacuucccuccaagaggcuggaaaagggcucagagcugcugagca

SEQ ID NO: 491914 - RNA, 64 nt, hsa
acaccacaccacccuccaggccccccugcccuccggcuggaaacugcagcucuguaaaugccuc

SEQ ID NO: 491915 - RNA, 64 nt, hsa
uggaaaccaagcugggagaggcugaggauggcagggcuggaagggccaucagcgugacccucau

SEQ ID NO: 491916 - RNA, 64 nt, hsa
gguuuuguuuaaaugggcaagaaguaaauaauguggcuggaauacaaguugaacaaacuagaag

SEQ ID NO: 491917 - RNA, 64 nt, hsa
ucauacucuuccagguuuuuuuuuuuuggucuaaggcuggaacuuuuuucuuuuuuuucagcug

SEQ ID NO: 491918 - RNA, 64 nt, hsa
aggugccaccagucaguugugccuaugucccuuuggcuggaaaugcagaauaugaauugauuag

SEQ ID NO: 491919 - RNA, 64 nt, hsa
uguggacauugaagcuugagcucucaaagcaguuggcuggaauacuuuugucagaauacgguac

SEQ ID NO: 491920 - RNA, 64 nt, hsa
cuggagacuggcugcuggggccuccuugcuuggaggcuggaaagagcuccauuucaguaucuuu

SEQ ID NO: 491921 - RNA, 64 nt, hsa
caacuccagcuggcuguacugauucacacaccucggcuggaaguacagcucaggcuucguuacu

SEQ ID NO: 491922 - RNA, 64 nt, hsa
ggguggggggagaugaucaugugugcucgggguuggcuggaagcccugggugggggguuggggg

SEQ ID NO: 491923 - RNA, 64 nt, hsa
caccaaucuggauugagcggguggugauaauaggggcuggaaagccagcagcugugguacucca

SEQ ID NO: 491924 - RNA, 64 nt, hsa
uucccugcccugggacgcucaccccugggcaagaggcuggaaguucacaccauccaaaauuuau

SEQ ID NO: 491925 - RNA, 64 nt, hsa
agaaggugagcgcugaagaaccaggaugggacggggcuggaacagcuggguucagcuuuugcag

SEQ ID NO: 491926 - RNA, 64 nt, hsa
ccugagcuagaagcuggaggacuagaaccuggagggcuggaaucuggagagcuagaaccuggag

SEQ ID NO: 491927 - RNA, 64 nt, hsa
gagagcuagaaccuagaagggcuagaaccuggagggcuggaaucuggagagcuagaaccuggag

SEQ ID NO: 491928 - RNA, 64 nt, hsa
gagggcuagaaccuagaagggcuagaaccuggagggcuggaaucuggagagcuagaaccuggag

SEQ ID NO: 491929 - RNA, 64 nt, hsa
cucugcaggccuucugcaaaucagugcuggccugggcuggaaacagcucugugugugaagguga

SEQ ID NO: 491930 - RNA, 64 nt, hsa
uguucacugcacaagggcaccugcagcuaauggaggcuggaauucagcuuguguucugcucacu

SEQ ID NO: 491931 - RNA, 64 nt, hsa
ggugucgggaaaugugugacuuaaccguggugagggcuggaaauccaaacucaccaccaugauc

SEQ ID NO: 491932 - RNA, 64 nt, hsa
cuuugggaaugagggguucccuugaacaugcguaggcuggaaccccgucugagaggucucccug

SEQ ID NO: 491933 - RNA, 64 nt, hsa
uucccgcccaguggggcuggaauguggcccagccggcuggaaccucaagggccccacccaccga

SEQ ID NO: 491934 - RNA, 64 nt, hsa
cccccuucuccacccucuacuucccgcccaguggggcuggaauguggcccagccggcuggaacc

SEQ ID NO: 491935 - RNA, 64 nt, hsa
agcuuuuaugaagagucaccguagcagcccccacggcuggaaagaggccuguacguucuggacg

SEQ ID NO: 491936 - RNA, 64 nt, hsa
cugugccuuaccagcccuggggaggggggcauuuggcuggaagacuggaauuuaauugccaucg

SEQ ID NO: 491937 - RNA, 64 nt, hsa
auggaacgggcaugggccucucugggggaggcagggcuggaaugggagaccuguuggccugugg

SEQ ID NO: 491938 - RNA, 64 nt, hsa
cccccagucuccagggacccuugccugccuccuaggcuggaagccauggucccgaaguguaggg

SEQ ID NO: 491939 - RNA, 64 nt, hsa
ccuugguggggacagcuggggagauggcagugcaggcuggaaccugggcugccccagaacacag

SEQ ID NO: 491940 - RNA, 64 nt, hsa
guggagcugugccuggcccuguaggcccaggguuggcuggaaggugacaucuguguuucguuuu

SEQ ID NO: 491941 - RNA, 64 nt, hsa
gaaucuucuuuguucauugggugguuuuucagucggcuggaauucuaucuucugggggccuucc

SEQ ID NO: 491942 - RNA, 64 nt, hsa
cucugcagccagugagggagguccccgccaugccggcuggaagaagaaccucgcaucuuuuggu

SEQ ID NO: 491943 - RNA, 64 nt, hsa
agcuccuuaacccaaugacccagugaugcugcaaggcuggaacgggguccaggagacugugugu

SEQ ID NO: 491944 - RNA, 64 nt, hsa
ggccaguagcaggaauaauaaaucccacuuuguaggcuggaaaacugagcugucaaaagaauca

SEQ ID NO: 491945 - RNA, 64 nt, hsa
gccugggccuuguggggcaaauauuggguccccaggcuggaaagauggacagaggcccaauggg

SEQ ID NO: 491946 - RNA, 64 nt, hsa
cugcuccuuggaggaggcccccaggggugguagaggcuggaaggaagccacaucaggaggacgc

SEQ ID NO: 491947 - RNA, 64 nt, hsa; identical to SEQ ID NO: 415046

SEQ ID NO: 491948 - RNA, 64 nt, hsa; identical to SEQ ID NO: 415047

SEQ ID NO: 491949 - RNA, 64 nt, hsa; identical to SEQ ID NO: 491902

SEQ ID NO: 491950 - RNA, 64 nt, hsa; identical to SEQ ID NO: 491903

SEQ ID NO: 491951 - RNA, 64 nt, hsa; identical to SEQ ID NO: 491904

SEQ ID NO: 491952 - RNA, 64 nt, hsa; identical to SEQ ID NO: 491905

SEQ ID NO: 491953 - RNA, 64 nt, hsa; identical to SEQ ID NO: 491906

SEQ ID NO: 491954 - RNA, 64 nt, hsa; identical to SEQ ID NO: 491907

SEQ ID NO: 491955 - RNA, 64 nt, hsa; identical to SEQ ID NO: 491908

SEQ ID NO: 491956 - RNA, 64 nt, hsa; identical to SEQ ID NO: 491909

SEQ ID NO: 491957 - RNA, 64 nt, hsa; identical to SEQ ID NO: 491910

SEQ ID NO: 491958 - RNA, 64 nt, hsa; identical to SEQ ID NO: 491911

SEQ ID NO: 491959 - RNA, 64 nt, hsa; identical to SEQ ID NO: 491912

SEQ ID NO: 491960 - RNA, 64 nt, hsa; identical to SEQ ID NO: 491913

SEQ ID NO: 491961 - RNA, 64 nt, hsa; identical to SEQ ID NO: 491914

SEQ ID NO: 491962 - RNA, 64 nt, hsa; identical to SEQ ID NO: 491915

SEQ ID NO: 491963 - RNA, 64 nt, hsa; identical to SEQ ID NO: 491916

SEQ ID NO: 491964 - RNA, 64 nt, hsa; identical to SEQ ID NO: 491917

SEQ ID NO: 491965 - RNA, 64 nt, hsa; identical to SEQ ID NO: 491918

SEQ ID NO: 491966 - RNA, 64 nt, hsa; identical to SEQ ID NO: 491919

SEQ ID NO: 491967 - RNA, 64 nt, hsa; identical to SEQ ID NO: 491920

SEQ ID NO: 491968 - RNA, 64 nt, hsa; identical to SEQ ID NO: 491921

SEQ ID NO: 491969 - RNA, 64 nt, hsa; identical to SEQ ID NO: 491922

SEQ ID NO: 491970 - RNA, 64 nt, hsa; identical to SEQ ID NO: 491923

SEQ ID NO: 491971 - RNA, 64 nt, hsa; identical to SEQ ID NO: 491924

SEQ ID NO: 491972 - RNA, 64 nt, hsa; identical to SEQ ID NO: 491925

SEQ ID NO: 491973 - RNA, 64 nt, hsa; identical to SEQ ID NO: 491926

SEQ ID NO: 491974 - RNA, 64 nt, hsa; identical to SEQ ID NO: 491927

SEQ ID NO: 491975 - RNA, 64 nt, hsa; identical to SEQ ID NO: 491928

SEQ ID NO: 491976 - RNA, 64 nt, hsa; identical to SEQ ID NO: 491929

SEQ ID NO: 491977 - RNA, 64 nt, hsa; identical to SEQ ID NO: 491930

SEQ ID NO: 491978 - RNA, 64 nt, hsa; identical to SEQ ID NO: 491931

SEQ ID NO: 491979 - RNA, 64 nt, hsa; identical to SEQ ID NO: 491932

SEQ ID NO: 491980 - RNA, 64 nt, hsa; identical to SEQ ID NO: 491933

SEQ ID NO: 491981 - RNA, 64 nt, hsa; identical to SEQ ID NO: 491934

SEQ ID NO: 491982 - RNA, 64 nt, hsa; identical to SEQ ID NO: 491935

SEQ ID NO: 491983 - RNA, 64 nt, hsa; identical to SEQ ID NO: 491936

SEQ ID NO: 491984 - RNA, 64 nt, hsa; identical to SEQ ID NO: 491937

SEQ ID NO: 491985 - RNA, 64 nt, hsa; identical to SEQ ID NO: 491938

SEQ ID NO: 491986 - RNA, 64 nt, hsa; identical to SEQ ID NO: 491939

SEQ ID NO: 491987 - RNA, 64 nt, hsa; identical to SEQ ID NO: 491940

SEQ ID NO: 491988 - RNA, 64 nt, hsa; identical to SEQ ID NO: 491941

SEQ ID NO: 491989 - RNA, 64 nt, hsa; identical to SEQ ID NO: 491942

SEQ ID NO: 491990 - RNA, 64 nt, hsa; identical to SEQ ID NO: 491943

SEQ ID NO: 491991 - RNA, 64 nt, hsa; identical to SEQ ID NO: 491944

SEQ ID NO: 491992 - RNA, 64 nt, hsa; identical to SEQ ID NO: 491945

SEQ ID NO: 491993 - RNA, 64 nt, hsa; identical to SEQ ID NO: 491946

SEQ ID NO: 491994 - RNA, 64 nt, hsa; identical to SEQ ID NO: 326636

SEQ ID NO: 491995 - RNA, 64 nt, hsa; identical to SEQ ID NO: 326637

SEQ ID NO: 491996 - RNA, 64 nt, hsa; identical to SEQ ID NO: 326638

SEQ ID NO: 491997 - RNA, 64 nt, hsa; identical to SEQ ID NO: 326639

SEQ ID NO: 491998 - RNA, 64 nt, hsa; identical to SEQ ID NO: 326640

SEQ ID NO: 491999 - RNA, 64 nt, hsa; identical to SEQ ID NO: 266283

SEQ ID NO: 492000 - RNA, 64 nt, hsa; identical to SEQ ID NO: 266284

SEQ ID NO: 492001 - RNA, 64 nt, hsa; identical to SEQ ID NO: 266285

SEQ ID NO: 492002 - RNA, 64 nt, hsa; identical to SEQ ID NO: 266286

SEQ ID NO: 492003 - RNA, 64 nt, hsa; identical to SEQ ID NO: 266287

SEQ ID NO: 492004 - RNA, 64 nt, hsa; identical to SEQ ID NO: 266288

SEQ ID NO: 492005 - RNA, 64 nt, hsa; identical to SEQ ID NO: 266289

SEQ ID NO: 492006 - RNA, 64 nt, hsa; identical to SEQ ID NO: 266290

SEQ ID NO: 492007 - RNA, 64 nt, hsa; identical to SEQ ID NO: 266291

SEQ ID NO: 492008 - RNA, 64 nt, hsa; identical to SEQ ID NO: 266292

SEQ ID NO: 492009 - RNA, 64 nt, hsa; identical to SEQ ID NO: 266293

SEQ ID NO: 492010 - RNA, 64 nt, hsa; identical to SEQ ID NO: 266294

SEQ ID NO: 492011 - RNA, 64 nt, hsa; identical to SEQ ID NO: 266295

SEQ ID NO: 492012 - RNA, 64 nt, hsa; identical to SEQ ID NO: 266296

SEQ ID NO: 492013 - RNA, 64 nt, hsa; identical to SEQ ID NO: 266297

SEQ ID NO: 492014 - RNA, 64 nt, hsa; identical to SEQ ID NO: 266298

SEQ ID NO: 492015 - RNA, 64 nt, hsa; identical to SEQ ID NO: 266299

SEQ ID NO: 492016 - RNA, 64 nt, hsa; identical to SEQ ID NO: 266300

SEQ ID NO: 492017 - RNA, 64 nt, hsa; identical to SEQ ID NO: 266301

SEQ ID NO: 492018 - RNA, 64 nt, hsa; identical to SEQ ID NO: 266302

SEQ ID NO: 492019 - RNA, 64 nt, hsa; identical to SEQ ID NO: 266303

SEQ ID NO: 492020 - RNA, 64 nt, hsa; identical to SEQ ID NO: 266304

SEQ ID NO: 492021 - RNA, 64 nt, hsa; identical to SEQ ID NO: 266305

SEQ ID NO: 492022 - RNA, 64 nt, hsa; identical to SEQ ID NO: 266306

SEQ ID NO: 492023 - RNA, 64 nt, hsa; identical to SEQ ID NO: 266307

SEQ ID NO: 492024 - RNA, 64 nt, hsa; identical to SEQ ID NO: 266308

SEQ ID NO: 492025 - RNA, 64 nt, hsa; identical to SEQ ID NO: 266309

SEQ ID NO: 492026 - RNA, 64 nt, hsa; identical to SEQ ID NO: 266310

SEQ ID NO: 492027 - RNA, 64 nt, hsa; identical to SEQ ID NO: 266311

SEQ ID NO: 492028 - RNA, 64 nt, hsa; identical to SEQ ID NO: 266312

SEQ ID NO: 492029 - RNA, 64 nt, hsa; identical to SEQ ID NO: 266313

SEQ ID NO: 492030 - RNA, 64 nt, hsa; identical to SEQ ID NO: 266314

SEQ ID NO: 492031 - RNA, 64 nt, hsa; identical to SEQ ID NO: 266315

SEQ ID NO: 492032 - RNA, 64 nt, hsa; identical to SEQ ID NO: 266316

SEQ ID NO: 492033 - RNA, 64 nt, hsa; identical to SEQ ID NO: 266317

SEQ ID NO: 492034 - RNA, 64 nt, hsa; identical to SEQ ID NO: 266318

SEQ ID NO: 492035 - RNA, 64 nt, hsa; identical to SEQ ID NO: 266319

SEQ ID NO: 492036 - RNA, 64 nt, hsa; identical to SEQ ID NO: 266320

SEQ ID NO: 492037 - RNA, 64 nt, hsa; identical to SEQ ID NO: 266321

SEQ ID NO: 492038 - RNA, 64 nt, hsa; identical to SEQ ID NO: 266322

SEQ ID NO: 492039 - RNA, 64 nt, hsa; identical to SEQ ID NO: 266323

SEQ ID NO: 492040 - RNA, 64 nt, hsa; identical to SEQ ID NO: 266324

SEQ ID NO: 492041 - RNA, 64 nt, hsa; identical to SEQ ID NO: 266325

SEQ ID NO: 492042 - RNA, 64 nt, hsa; identical to SEQ ID NO: 266326

SEQ ID NO: 492043 - RNA, 64 nt, hsa; identical to SEQ ID NO: 266327

SEQ ID NO: 492044 - RNA, 64 nt, hsa; identical to SEQ ID NO: 266328

SEQ ID NO: 492045 - RNA, 64 nt, hsa; identical to SEQ ID NO: 266329

SEQ ID NO: 492046 - RNA, 64 nt, hsa; identical to SEQ ID NO: 266330

SEQ ID NO: 492047 - RNA, 64 nt, hsa; identical to SEQ ID NO: 349054

SEQ ID NO: 492048 - RNA, 64 nt, hsa; identical to SEQ ID NO: 349055

SEQ ID NO: 492049 - RNA, 64 nt, hsa; identical to SEQ ID NO: 349056

SEQ ID NO: 492050 - RNA, 64 nt, hsa; identical to SEQ ID NO: 349057

SEQ ID NO: 492051 - RNA, 64 nt, hsa; identical to SEQ ID NO: 349058

SEQ ID NO: 492052 - RNA, 64 nt, hsa; identical to SEQ ID NO: 349059

SEQ ID NO: 492053 - RNA, 64 nt, hsa; identical to SEQ ID NO: 349060

SEQ ID NO: 492054 - RNA, 64 nt, hsa; identical to SEQ ID NO: 349061

SEQ ID NO: 492055 - RNA, 64 nt, hsa; identical to SEQ ID NO: 349062

SEQ ID NO: 492056 - RNA, 64 nt, hsa; identical to SEQ ID NO: 349063

SEQ ID NO: 492057 - RNA, 64 nt, hsa; identical to SEQ ID NO: 349064

SEQ ID NO: 492058 - RNA, 64 nt, hsa; identical to SEQ ID NO: 349065

SEQ ID NO: 492059 - RNA, 64 nt, hsa; identical to SEQ ID NO: 349066

SEQ ID NO: 492060 - RNA, 64 nt, hsa; identical to SEQ ID NO: 349067

SEQ ID NO: 492061 - RNA, 64 nt, hsa; identical to SEQ ID NO: 349068

SEQ ID NO: 492062 - RNA, 64 nt, hsa; identical to SEQ ID NO: 349069

SEQ ID NO: 492063 - RNA, 64 nt, hsa; identical to SEQ ID NO: 189531

SEQ ID NO: 492064 - RNA, 64 nt, hsa; identical to SEQ ID NO: 189532

SEQ ID NO: 492065 - RNA, 64 nt, hsa; identical to SEQ ID NO: 189533

SEQ ID NO: 492066 - RNA, 64 nt, hsa; identical to SEQ ID NO: 189534

SEQ ID NO: 492067 - RNA, 64 nt, hsa; identical to SEQ ID NO: 189535

SEQ ID NO: 492068 - RNA, 64 nt, hsa; identical to SEQ ID NO: 189536

SEQ ID NO: 492069 - RNA, 64 nt, hsa; identical to SEQ ID NO: 189537

SEQ ID NO: 492070 - RNA, 64 nt, hsa; identical to SEQ ID NO: 189538

SEQ ID NO: 492071 - RNA, 64 nt, hsa; identical to SEQ ID NO: 189539

SEQ ID NO: 492072 - RNA, 64 nt, hsa; identical to SEQ ID NO: 189540

SEQ ID NO: 492073 - RNA, 64 nt, hsa; identical to SEQ ID NO: 189541

SEQ ID NO: 492074 - RNA, 64 nt, hsa; identical to SEQ ID NO: 189542

SEQ ID NO: 492075 - RNA, 64 nt, hsa; identical to SEQ ID NO: 189543

SEQ ID NO: 492076 - RNA, 64 nt, hsa; identical to SEQ ID NO: 189544

SEQ ID NO: 492077 - RNA, 64 nt, hsa; identical to SEQ ID NO: 189545

SEQ ID NO: 492078 - RNA, 64 nt, hsa; identical to SEQ ID NO: 189546

SEQ ID NO: 492079 - RNA, 64 nt, hsa; identical to SEQ ID NO: 189547

SEQ ID NO: 492080 - RNA, 64 nt, hsa; identical to SEQ ID NO: 189548

SEQ ID NO: 492081 - RNA, 64 nt, hsa; identical to SEQ ID NO: 189549

SEQ ID NO: 492082 - RNA, 64 nt, hsa; identical to SEQ ID NO: 189550

SEQ ID NO: 492083 - RNA, 64 nt, hsa; identical to SEQ ID NO: 189551

SEQ ID NO: 492084 - RNA, 64 nt, hsa; identical to SEQ ID NO: 189552

SEQ ID NO: 492085 - RNA, 64 nt, hsa; identical to SEQ ID NO: 189553

SEQ ID NO: 492086 - RNA, 64 nt, hsa; identical to SEQ ID NO: 189554

SEQ ID NO: 492087 - RNA, 64 nt, hsa; identical to SEQ ID NO: 189555

SEQ ID NO: 492088 - RNA, 64 nt, hsa; identical to SEQ ID NO: 189556

SEQ ID NO: 492089 - RNA, 64 nt, hsa; identical to SEQ ID NO: 189557

SEQ ID NO: 492090 - RNA, 64 nt, hsa; identical to SEQ ID NO: 189558

SEQ ID NO: 492091 - RNA, 64 nt, hsa; identical to SEQ ID NO: 189559

SEQ ID NO: 492092 - RNA, 53 nt, hsa; identical to SEQ ID NO: 189560

SEQ ID NO: 492093 - RNA, 64 nt, hsa; identical to SEQ ID NO: 189561

SEQ ID NO: 492094 - RNA, 64 nt, hsa; identical to SEQ ID NO: 189562

SEQ ID NO: 492095 - RNA, 63 nt, hsa; identical to SEQ ID NO: 189563

SEQ ID NO: 492096 - RNA, 64 nt, hsa; identical to SEQ ID NO: 189564

SEQ ID NO: 492097 - RNA, 64 nt, hsa; identical to SEQ ID NO: 189565

SEQ ID NO: 492098 - RNA, 64 nt, hsa; identical to SEQ ID NO: 189566

SEQ ID NO: 492099 - RNA, 64 nt, hsa; identical to SEQ ID NO: 189567

SEQ ID NO: 492100 - RNA, 64 nt, hsa; identical to SEQ ID NO: 189568

SEQ ID NO: 492101 - RNA, 64 nt, hsa; identical to SEQ ID NO: 189569

SEQ ID NO: 492102 - RNA, 64 nt, hsa; identical to SEQ ID NO: 189570

SEQ ID NO: 492103 - RNA, 64 nt, hsa; identical to SEQ ID NO: 189571

SEQ ID NO: 492104 - RNA, 64 nt, hsa; identical to SEQ ID NO: 189572

SEQ ID NO: 492105 - RNA, 64 nt, hsa; identical to SEQ ID NO: 189573

SEQ ID NO: 492106 - RNA, 64 nt, hsa; identical to SEQ ID NO: 189574

SEQ ID NO: 492107 - RNA, 64 nt, hsa; identical to SEQ ID NO: 189575

SEQ ID NO: 492108 - RNA, 64 nt, hsa; identical to SEQ ID NO: 189576

SEQ ID NO: 492109 - RNA, 64 nt, hsa; identical to SEQ ID NO: 189577

SEQ ID NO: 492110 - RNA, 64 nt, hsa; identical to SEQ ID NO: 189578

SEQ ID NO: 492111 - RNA, 64 nt, hsa; identical to SEQ ID NO: 189579

SEQ ID NO: 492112 - RNA, 64 nt, hsa; identical to SEQ ID NO: 189580

SEQ ID NO: 492113 - RNA, 64 nt, hsa; identical to SEQ ID NO: 189581

SEQ ID NO: 492114 - RNA, 64 nt, hsa; identical to SEQ ID NO: 189582

SEQ ID NO: 492115 - RNA, 64 nt, hsa; identical to SEQ ID NO: 189583

SEQ ID NO: 492116 - RNA, 64 nt, hsa; identical to SEQ ID NO: 189584

SEQ ID NO: 492117 - RNA, 64 nt, hsa; identical to SEQ ID NO: 189585

SEQ ID NO: 492118 - RNA, 64 nt, hsa; identical to SEQ ID NO: 189586

SEQ ID NO: 492119 - RNA, 64 nt, hsa; identical to SEQ ID NO: 189587

SEQ ID NO: 492120 - RNA, 64 nt, hsa; identical to SEQ ID NO: 189588

SEQ ID NO: 492121 - RNA, 64 nt, hsa; identical to SEQ ID NO: 189589

SEQ ID NO: 492122 - RNA, 64 nt, hsa; identical to SEQ ID NO: 189590

SEQ ID NO: 492123 - RNA, 64 nt, hsa; identical to SEQ ID NO: 189591

SEQ ID NO: 492124 - RNA, 64 nt, hsa; identical to SEQ ID NO: 189592

SEQ ID NO: 492125 - RNA, 64 nt, hsa; identical to SEQ ID NO: 189593

SEQ ID NO: 492126 - RNA, 64 nt, hsa; identical to SEQ ID NO: 189594

SEQ ID NO: 492127 - RNA, 64 nt, hsa; identical to SEQ ID NO: 189595

SEQ ID NO: 492128 - RNA, 64 nt, hsa; identical to SEQ ID NO: 189596

SEQ ID NO: 492129 - RNA, 64 nt, hsa; identical to SEQ ID NO: 189597

SEQ ID NO: 492130 - RNA, 64 nt, hsa; identical to SEQ ID NO: 189598

SEQ ID NO: 492131 - RNA, 64 nt, hsa; identical to SEQ ID NO: 364943

SEQ ID NO: 492132 - RNA, 64 nt, hsa; identical to SEQ ID NO: 364944

SEQ ID NO: 492133 - RNA, 64 nt, hsa; identical to SEQ ID NO: 364945

SEQ ID NO: 492134 - RNA, 64 nt, hsa; identical to SEQ ID NO: 364946

SEQ ID NO: 492135 - RNA, 64 nt, hsa; identical to SEQ ID NO: 364947

SEQ ID NO: 492136 - RNA, 64 nt, hsa; identical to SEQ ID NO: 364948

SEQ ID NO: 492137 - RNA, 64 nt, hsa; identical to SEQ ID NO: 364949

SEQ ID NO: 492138 - RNA, 64 nt, hsa; identical to SEQ ID NO: 364950

SEQ ID NO: 492139 - RNA, 64 nt, hsa; identical to SEQ ID NO: 364951

SEQ ID NO: 492140 - RNA, 64 nt, hsa; identical to SEQ ID NO: 364952

SEQ ID NO: 492141 - RNA, 64 nt, hsa; identical to SEQ ID NO: 364953

SEQ ID NO: 492142 - RNA, 64 nt, hsa; identical to SEQ ID NO: 364954

SEQ ID NO: 492143 - RNA, 64 nt, hsa; identical to SEQ ID NO: 364955

SEQ ID NO: 492144 - RNA, 64 nt, hsa; identical to SEQ ID NO: 364956

SEQ ID NO: 492145 - RNA, 64 nt, hsa; identical to SEQ ID NO: 364957

SEQ ID NO: 492146 - RNA, 64 nt, hsa; identical to SEQ ID NO: 364958

SEQ ID NO: 492147 - RNA, 64 nt, hsa; identical to SEQ ID NO: 364959

SEQ ID NO: 492148 - RNA, 64 nt, hsa; identical to SEQ ID NO: 364960

SEQ ID NO: 492149 - RNA, 64 nt, hsa; identical to SEQ ID NO: 364961

SEQ ID NO: 492150 - RNA, 64 nt, hsa; identical to SEQ ID NO: 364962

SEQ ID NO: 492151 - RNA, 64 nt, hsa; identical to SEQ ID NO: 364963

SEQ ID NO: 492152 - RNA, 64 nt, hsa; identical to SEQ ID NO: 364964

SEQ ID NO: 492153 - RNA, 64 nt, hsa
uauauccauuucuuccuuuuccaauuucauugguuuucucuaaacagugcuccauuuuauuuug

SEQ ID NO: 492154 - RNA, 64 nt, hsa
agaacaugauuaaugaaagugacaaauuuuaaauuuucucuaauaguccucaucauaaacuuuu

SEQ ID NO: 492155 - RNA, 64 nt, hsa
uaguuuaaaagcuuccuccuccauagggacacauuuucucuaacccuuaacuaaaguguaggau

SEQ ID NO: 492156 - RNA, 64 nt, hsa
auugaauaaaucuuuagacuacaaaagcccaacuuuucucuauuuacauaugcaucucuccuau

SEQ ID NO: 492157 - RNA, 64 nt, hsa
aauggauuuuucuuagugcccuaauugugaaggguuucucuagcuuugguuauguguaauguuc

SEQ ID NO: 492158 - RNA, 64 nt, hsa
uuacucauagaacugguguuguuugcuguuuuuauuucucuaauuguugcagaguucugccugu

SEQ ID NO: 492159 - RNA, 64 nt, hsa
guguuuucucuacuauugagcuguagacgaacuguuucucuaauuauaaagcaaacuguuuggg

SEQ ID NO: 492160 - RNA, 64 nt, hsa
gcuuccgcuaaguaagagcaccucauuccuguguuuucucuacuauugagcuguagacgaacug

SEQ ID NO: 492161 - RNA, 64 nt, hsa
uaguuuaagauaagcuaacaauaacagucuguguuuucucuaaaauaaucugaguuuuuuggaa

SEQ ID NO: 492162 - RNA, 64 nt, hsa
uccaacuggagggcagacaauuuucugacuugcuuuucucuaggugguucauuuugaaagggga

SEQ ID NO: 492163 - RNA, 64 nt, hsa
aacaaauuuguauuagaguacaauuuaaaguguuuuucucuauagccuuuuuugacuggggaag

SEQ ID NO: 492164 - RNA, 64 nt, hsa
guuugauuuuuuuugacaacaguacauauaucuauuucucuagggauauggaaguaaguggaga

SEQ ID NO: 492165 - RNA, 64 nt, hsa
guugaucucaggguacuuucugggauugcucacauuucucuaauguacugcacuugaugccagu

SEQ ID NO: 492166 - RNA, 64 nt, hsa
aaggauuuaaccuggugccaagguuaaaauaacauuucucuacugccuauuguuuauguuaaac

SEQ ID NO: 492167 - RNA, 64 nt, hsa
guuucucuaacaaacaaacaaacaaacagccuuguuucucuagucacaucauguguauacaagg

SEQ ID NO: 492168 - RNA, 64 nt, hsa
gccccuauggggcggggccgcagggccagccuuguuucucuaacaaacaaacaaacaaacagcc

SEQ ID NO: 492169 - RNA, 64 nt, hsa
cacaugcugagcgccgguccugggcccacuguucuuucucuauacuuugucucugugucuuauu

SEQ ID NO: 492170 - RNA, 64 nt, hsa
agaagaucuuugucugggacccccaaagggauccuuucucuaaggucucugacgguggguccag

SEQ ID NO: 492171 - RNA, 64 nt, hsa
gaaaagcaguuucuaagucauauuaaaaggacuauuucucuaaaacucaaaaaaaaaaaaaaaa

SEQ ID NO: 492172 - RNA, 64 nt, hsa
cuguugcugaggaaaagccucauguaaaacccuauuucucuaagaccauucgcgauuuagaagu

SEQ ID NO: 492173 - RNA, 64 nt, hsa
aacauaaucaaagacaacucacucaggcaucuucuuucucuaaauaccagaaucuaguauguaa

SEQ ID NO: 492174 - RNA, 64 nt, hsa
uuuguaacaucaaagaaaacauacccaucaguaauuucucuaauacugaccuuucuauucucua

SEQ ID NO: 492175 - RNA, 64 nt, hsa
uuacgaauccaaagaacugggguuuguuagguucuuucucuaauguagaggcccagaucccauc

SEQ ID NO: 492176 - RNA, 64 nt, hsa
caauccccacagauuacuuucagaaauagauguauuucucuacguaagggccagguuuauuuuc

SEQ ID NO: 492177 - RNA, 64 nt, hsa
ucuuuucugugaucucuguccuuguuucugagacuuucucuaccauuaagcucuauuuuagcuu

SEQ ID NO: 492178 - RNA, 64 nt, hsa
ucgaguucugugauccuuauuguucuuaauuguguuucucuacguauuguuacagaugagccau

SEQ ID NO: 492179 - RNA, 64 nt, hsa
aaguaugaauauuaauaaaauagcauuuaucuuauuucucuauuuuauguugugacuuaaccua

SEQ ID NO: 492180 - RNA, 64 nt, hsa
ugacacuuacugguuaaacuuacguugcuaaagauuucucuauaauaagccacacauuauauuu

SEQ ID NO: 492181 - RNA, 64 nt, hsa
uguguguguguguagaccaugguguuucucuauguuucucuaaguuggggggugagcgugugug

SEQ ID NO: 492182 - RNA, 64 nt, hsa
ggaguguguguguguguguguguagaccaugguguuucucuauguuucucuaaguuggggggug

SEQ ID NO: 492183 - RNA, 64 nt, hsa
guauguggcuccagucugugaggauacauaacauuuucucuacaaugaaucugugcuaauauuu

SEQ ID NO: 492184 - RNA, 64 nt, hsa
acauacuccugcaaagcuuuuaugcugcuucgcuuuucucuaaacagaucugauauugcugcuc

SEQ ID NO: 492185 - RNA, 64 nt, hsa
ucuucuuucuggguaguuaaaaauuacucccucuuuucucuagcauuuugacauuucagacuca

SEQ ID NO: 492186 - RNA, 64 nt, hsa
agaccauauucuuugaauuaaauuuguuuuuaauuuucucuacacauuuuuuuuuuccuggagu

SEQ ID NO: 492187 - RNA, 64 nt, hsa
aaaacauaggggcuaucauuuuuaaagacuugauuuucucuauugugguaaaauauauaaauac

SEQ ID NO: 492188 - RNA, 64 nt, hsa
ucacccugugacuauucagccucccugaauaugcuuucucuauagaaccacuaacauauggcua

SEQ ID NO: 492189 - RNA, 64 nt, hsa
aaggcauggaagaacucuugaauguguuggccauuuucucuaacuaacaugugguauguauggu

SEQ ID NO: 492190 - RNA, 64 nt, hsa
auuguggaaggcuguuuuauaguuuauuuaauuuuuucucuaugauuuauuacaacucucacgg

SEQ ID NO: 492191 - RNA, 64 nt, hsa
auggaaauaaagcuacuacauauauaugccaguauuucucuaguaagauuauguuucucuuacu

SEQ ID NO: 492192 - RNA, 64 nt, hsa
aauuuuuauuuuugcugagacuaaucuuauucauuuucucuaauauggcaaccauuauaaccuu

SEQ ID NO: 492193 - RNA, 64 nt, hsa
acuuacuuuuucuggucucuaccacugcugauauuuucucuaggaaauauacuuuuacaaguaa

SEQ ID NO: 492194 - RNA, 64 nt, hsa
ggguugaaagccaaggagucacugagaccaaggcuuucucuacugauuccgcagcucagacccu

SEQ ID NO: 492195 - RNA, 64 nt, hsa
ccucuugcugaaagccaaggcagcucuucuggaguuucucuaaagucacuagugaacaauucgg

SEQ ID NO: 492196 - RNA, 64 nt, hsa
ugguauuuauguaaaaggauuauuacuaauucuauuucucuauguuuauucuaguuaaggaaau

SEQ ID NO: 492197 - RNA, 64 nt, hsa
uggaucuggccuauagauuagugacauaaaauauuuucucuauuuuccccuguucuuuuugugu

SEQ ID NO: 492198 - RNA, 64 nt, hsa
ccugaugagaaucuacuugagaauauagaaagucuuucucuaaaggagauacugacucccuggu

SEQ ID NO: 492199 - RNA, 64 nt, hsa
aggccacuagugaaaguauguuuucucuaaaauauuucucuaauagugauauaaauggcuauuu

SEQ ID NO: 492200 - RNA, 64 nt, hsa
augauggcauuugaggccacuagugaaaguauguuuucucuaaaauauuucucuaauagugaua

SEQ ID NO: 492201 - RNA, 64 nt, hsa
cugauucacugaccaaaagucaguguugcagagauuucucuaccccguaugguauuuuguuaga

SEQ ID NO: 492202 - RNA, 64 nt, hsa
aacccccaccccacccccaccuaccacuccaugcuuucucuacucccugccucaaaccaccccu

SEQ ID NO: 492203 - RNA, 64 nt, hsa
aaaggaacuuucagauuaagaaauuucucucuuuuuucucuauaaauucugacucuccagacuu

SEQ ID NO: 492204 - RNA, 64 nt, hsa
uaaguggaaacuuuccuuguaucaaauccugaguuuucucuacuucaggguuucuagcuuugac

SEQ ID NO: 492205 - RNA, 64 nt, hsa
auuuuuauuucuucuuguauuaaaauuuuguuuuuuucucuacuuugggagauguuuauuuaca

SEQ ID NO: 492206 - RNA, 64 nt, hsa
uuugugauuagaacagaacaauucuauuugcauguuucucuaucugaauauucugugacaaaaa

SEQ ID NO: 492207 - RNA, 64 nt, hsa
uucuauaaacuaccuuguauaaaauauuauuuauuuucucuaucccggcauucuaauuucucuu

SEQ ID NO: 492208 - RNA, 64 nt, hsa
gaaaaaccaaaagcuguuuugcagugcuugccaauuucucuaguguaauaacucccaaccugac

SEQ ID NO: 492209 - RNA, 64 nt, hsa
caacauguauauuuucucuauacauagagcucuauuucucuacgguuuuauaaaagccuugggu

SEQ ID NO: 492210 - RNA, 64 nt, hsa
aggaaagagucacacaauuaaucaacauguauauuuucucuauacauagagcucuauuucucua

SEQ ID NO: 492211 - RNA, 64 nt, hsa
gaaccugacccaagaguaaaugucugcagagagauggauggauggauggauagauggauggaug

SEQ ID NO: 492212 - RNA, 64 nt, hsa
cugacccaagaguaaaugucugcagagagauggauggauggauggauagauggauggauggguu

SEQ ID NO: 492213 - RNA, 64 nt, hsa
cccaagaguaaaugucugcagagagauggauggauggauggauagauggauggauggguugggg

SEQ ID NO: 492214 - RNA, 64 nt, hsa
ugucugcagagagauggauggauggauggauagauggauggauggguuggggagugggggugga

SEQ ID NO: 492215 - RNA, 64 nt, hsa
uggauagauggauggauggguuggggaguggggguggauggauggauagauggauggauggaug

SEQ ID NO: 492216 - RNA, 64 nt, hsa
uagauggauggauggguuggggaguggggguggauggauggauagauggauggauggauggaug

SEQ ID NO: 492217 - RNA, 64 nt, hsa
uggguuggggaguggggguggauggauggauagauggauggauggauggauggauggguugggg

SEQ ID NO: 492218 - RNA, 64 nt, hsa
uuggggaguggggguggauggauggauagauggauggauggauggauggauggguuggggggug

SEQ ID NO: 492219 - RNA, 64 nt, hsa
ggaguggggguggauggauggauagauggauggauggauggauggauggguugggggguggggg

SEQ ID NO: 492220 - RNA, 64 nt, hsa
uggggguggauggauggauagauggauggauggauggauggauggguuggggggugggggugga

SEQ ID NO: 492221 - RNA, 64 nt, hsa
uggauggauggauggauggguugggggguggggguggauggauagauggauggauggauggacg

SEQ ID NO: 492222 - RNA, 64 nt, hsa
uggauggguugggggguggggguggauggauagauggauggauggauggacggauggggugggg

SEQ ID NO: 492223 - RNA, 64 nt, hsa
uggguugggggguggggguggauggauagauggauggauggauggacggauggggugggggaag

SEQ ID NO: 492224 - RNA, 64 nt, hsa
uugggggguggggguggauggauagauggauggauggauggacggauggggugggggaaggaag

SEQ ID NO: 492225 - RNA, 64 nt, hsa
cagucuguguuugaccuucacauuuguucaugaguggauggauggacagaaugauggacuuuug

SEQ ID NO: 492226 - RNA, 64 nt, hsa
cuguguuugaccuucacauuuguucaugaguggauggauggacagaaugauggacuuuuggggg

SEQ ID NO: 492227 - RNA, 64 nt, hsa
gcaagaacccuccugacaguacuggcuagaaguuuggauggauuauuuacaauauaggaaagaa

SEQ ID NO: 492228 - RNA, 64 nt, hsa
uacaugcagaaauauauauguguguguguaucuguggauggauauauguauaucucuuccuaua

SEQ ID NO: 492229 - RNA, 64 nt, hsa
uuucaaugaaccaaaagauaacugucaauuuauuuggauggauggauggagggauggaaggagg

SEQ ID NO: 492230 - RNA, 64 nt, hsa
aaugaaccaaaagauaacugucaauuuauuuggauggauggauggagggauggaaggagggagg

SEQ ID NO: 492231 - RNA, 64 nt, hsa
aaccaaaagauaacugucaauuuauuuggauggauggauggagggauggaaggagggagggaag

SEQ ID NO: 492232 - RNA, 64 nt, hsa
cuuggcacauaguaggccuuccauaaauguuggauggauggauaaauagauugggaccaucaga

SEQ ID NO: 492233 - RNA, 64 nt, hsa
ccuccuuggcacauaguaggccuuccauaaauguuggauggauggauaaauagauugggaccau

SEQ ID NO: 492234 - RNA, 64 nt, hsa
caggagucugccuaccugucgcccugaccgcuuguggauggagaaggggagagcaucuaggcag

SEQ ID NO: 492235 - RNA, 64 nt, hsa
cucacuuggacacucaggggaccacacagagaaguggauggacacuucgccauccaggcagaac

SEQ ID NO: 492236 - RNA, 64 nt, hsa
gccagccggccagacucucaucuugaugucuugauggauggaccccagcuagucagacaugauc

SEQ ID NO: 492237 - RNA, 64 nt, hsa
ggacccacccagcgcguccuuucuuauccccgaguggauggauggauggauggaugguagggau

SEQ ID NO: 492238 - RNA, 64 nt, hsa
ccacccagcgcguccuuucuuauccccgaguggauggauggauggauggaugguagggauguua

SEQ ID NO: 492239 - RNA, 64 nt, hsa
ccagcgcguccuuucuuauccccgaguggauggauggauggauggaugguagggauguuaauaa

SEQ ID NO: 492240 - RNA, 64 nt, hsa
cgcguccuuucuuauccccgaguggauggauggauggauggaugguagggauguuaauaauuuu

SEQ ID NO: 492241 - RNA, 64 nt, hsa
acccugagcuuucuucauggaaccucuugaaugauggauggaagagcuauaagaggugguaggc

SEQ ID NO: 492242 - RNA, 64 nt, hsa
aagguccauuucuucccaggaauccaaucuccuguggauggagcuaucucuacauuuaaaaauc

SEQ ID NO: 492243 - RNA, 64 nt, hsa
aaugaauggauggauggaugguuggauggauggauggauggaugagcgagaacccgcgcccgcg

SEQ ID NO: 492244 - RNA, 64 nt, hsa
aaagaaugaauggauggauggaugguuggauggauggauggauggaugagcgagaacccgcgcc

SEQ ID NO: 492245 - RNA, 64 nt, hsa
caagaaagaaugaauggauggauggaugguuggauggauggauggauggaugagcgagaacccg

SEQ ID NO: 492246 - RNA, 64 nt, hsa
gcgucaagaaagaaugaauggauggauggaugguuggauggauggauggauggaugagcgagaa

SEQ ID NO: 492247 - RNA, 64 nt, hsa
gagcgagcgagugcgucaagaaagaaugaauggauggauggaugguuggauggauggauggaug

SEQ ID NO: 492248 - RNA, 64 nt, hsa
cggggagcgagcgagugcgucaagaaagaaugaauggauggauggaugguuggauggauggaug

SEQ ID NO: 492249 - RNA, 64 nt, hsa
cugaguauuacugagaagcaacagaaaagagccauggauggagcccuugggcucucugggaaau

SEQ ID NO: 492250 - RNA, 64 nt, hsa
ugagugugcuucuuggaagagccuagaagauuccuggauggagaccccauugguucagccucaa

SEQ ID NO: 492251 - RNA, 64 nt, hsa
gcacagugccucacacaaagaacuauuggguggguggauggauggauggaggaauggagacagu

SEQ ID NO: 492252 - RNA, 64 nt, hsa
agugccucacacaaagaacuauuggguggguggauggauggauggaggaauggagacaguuggc

SEQ ID NO: 492253 - RNA, 64 nt, hsa
ccucacacaaagaacuauuggguggguggauggauggauggaggaauggagacaguuggcuuaa

SEQ ID NO: 492254 - RNA, 64 nt, hsa
uauuacccuguguuguauuucccaagugucuggauggauggagagguacucaaacaaguuacuu

SEQ ID NO: 492255 - RNA, 64 nt, hsa
caacuauuacccuguguuguauuucccaagugucuggauggauggagagguacucaaacaaguu

SEQ ID NO: 492256 - RNA, 64 nt, hsa
aauguccuuuuaugauugucuaggauuccauggauggauggaauauaauugagucaucugguag

SEQ ID NO: 492257 - RNA, 64 nt, hsa
cauaaauguccuuuuaugauugucuaggauuccauggauggauggaauauaauugagucaucug

SEQ ID NO: 492258 - RNA, 54 nt, hsa
ucaaagcucuucuccagugauggauggauggacugauaacuccggaagaaugac

SEQ ID NO: 492259 - RNA, 50 nt, hsa
ucaaagcucuucuccagugauggauggauggacugauaacuccggaagaa

SEQ ID NO: 492260 - RNA, 64 nt, hsa
gacgcaucccucaccacguccggauuuccuucuuuggauggaauguaacgcgaucucuauuuaa

SEQ ID NO: 492261 - RNA, 64 nt, hsa
ggggccuggagccagcccugagccagaggcagaauggauggacagacaggccauggaggcagca

SEQ ID NO: 492262 - RNA, 64 nt, hsa
uggggcucccugccuucuggacuccugaaggucguggauggauggaaggcacacagcccgugcc

SEQ ID NO: 492263 - RNA, 64 nt, hsa
gcucccugccuucuggacuccugaaggucguggauggauggaaggcacacagcccgugccggcu

SEQ ID NO: 492264 - RNA, 64 nt, hsa
augcccucccuucuaugcaggggggcaaguuuacuggauggagaugauuugggccucucuucca

SEQ ID NO: 492265 - RNA, 64 nt, hsa
cuugccuuugggauugggauccaaggguucuccauggauggauccaagucauagaggggaaugu

SEQ ID NO: 492266 - RNA, 64 nt, hsa
ugcgagccugcggccugcuggagccugcgcagcuuggauggagacuccaugagaagccgugggu

SEQ ID NO: 492267 - RNA, 64 nt, hsa
auucauuuauuauuucaaugugacuuuaauuuuuuggauggauaagcuugucuaugguacaaaa

SEQ ID NO: 492268 - RNA, 64 nt, hsa
uucccgaguauaaccacucaagggggagcaaauuuggauggauuuacgacuucacaggcauugu

SEQ ID NO: 492269 - RNA, 64 nt, hsa
agccuuuaaggguuucuuugcagacugauuucauuggauggauacuuaaugcugugaaacauga

SEQ ID NO: 492270 - RNA, 64 nt, hsa
ggucacgcaggacucggacacugcccuggaaacauggauggacaagggcuuuuggccacaggug

SEQ ID NO: 492271 - RNA, 64 nt, hsa
ucccagcacagcccaagauuauuuggcagccaaguggauggaacuaacuuuccuggacuguguu

SEQ ID NO: 492272 - RNA, 64 nt, hsa
acccuuugugaaaaccaaucaauuacuagaugaguggauggaugcagaaaaaucugggcugagc

SEQ ID NO: 492273 - RNA, 64 nt, hsa
uaauauaaaccaccgucgugaggcauuuaccuguuggauggaagguagacagcaacaagauuuu

SEQ ID NO: 492274 - RNA, 64 nt, hsa
gauggauggauggauggauggauggauggauggauggauggaugaauagauagaugguguuugc

SEQ ID NO: 492275 - RNA, 64 nt, hsa
gauggauggauggauggauggauggauggauggauggauggauggaugaauagauagauggugu

SEQ ID NO: 492276 - RNA, 64 nt, hsa
gcaggauggauggauggauggauggauggauggauggauggauggauggaugaauagauagaug

SEQ ID NO: 492277 - RNA, 64 nt, hsa
acaagcaggauggauggauggauggauggauggauggauggauggauggauggaugaauagaua

SEQ ID NO: 492278 - RNA, 64 nt, hsa
ggagacaagcaggauggauggauggauggauggauggauggauggauggauggauggaugaaua

SEQ ID NO: 492279 - RNA, 64 nt, hsa
caaaggagacaagcaggauggauggauggauggauggauggauggauggauggauggauggaug

SEQ ID NO: 492280 - RNA, 64 nt, hsa
uggucaaaggagacaagcaggauggauggauggauggauggauggauggauggauggauggaug

SEQ ID NO: 492281 - RNA, 64 nt, hsa
uggcuggucaaaggagacaagcaggauggauggauggauggauggauggauggauggauggaug

SEQ ID NO: 492282 - RNA, 64 nt, hsa
ggcuuggcuggucaaaggagacaagcaggauggauggauggauggauggauggauggauggaug

SEQ ID NO: 492283 - RNA, 64 nt, hsa
auagggcuuggcuggucaaaggagacaagcaggauggauggauggauggauggauggauggaug

SEQ ID NO: 492284 - RNA, 64 nt, hsa
augaagaacauugagaacaaucagcugguaauuauggauggaggaagagggagaggaaaaaaau

SEQ ID NO: 492285 - RNA, 64 nt, hsa
gacugcucagaacuugcugcugucuuguugcggauggauggaagguuggauggauggguggaug

SEQ ID NO: 492286 - RNA, 64 nt, hsa
cuugcugcugucuuguugcggauggauggaagguuggauggauggguggauggccguggauggc

SEQ ID NO: 492287 - RNA, 55 nt, hsa
caggucacgaugaacucugaguguguggauggauggguggauggaggguggcagg

SEQ ID NO: 492288 - RNA, 64 nt, hsa
gucacgaugaacucugaguguguggauggauggguggauggaggguggcagguggggcgucugc

SEQ ID NO: 492289 - RNA, 64 nt, hsa
auuggauuguuuguaacacaaauaaauacuugaguggauggauacccaauucuccaugauguga

SEQ ID NO: 492290 - RNA, 64 nt, hsa
uagugucaaaaauucaggggcaguuaaggagucauggauggaacuagaggucacuauauuaagu

SEQ ID NO: 492291 - RNA, 64 nt, hsa
auuucaggggagucaaaaaccuugcaacuuccuucuccacuaacccaggacuaaaaauggacag

SEQ ID NO: 492292 - RNA, 64 nt, hsa
ucuuucuaugauaagaggguuguguugguggcaccuccacuacucuuuucuguuuguugaguuu

SEQ ID NO: 492293 - RNA, 64 nt, hsa
ggacucaauuugaaguacuaaugcuucucaaguucuccacuaugagaguuacccuguauuagac

SEQ ID NO: 492294 - RNA, 64 nt, hsa
uccuaccccucuuaaaacucaguucagguagcagcuccacuaggaagccuuggcugaccauaau

SEQ ID NO: 492295 - RNA, 64 nt, hsa
caagaccagccugaccaacguggagaaacuccgucuccacuaaaauacaaaauuagcugggugu

SEQ ID NO: 492296 - RNA, 64 nt, hsa
uugcuguuaacaauaauucucccggccaucuccacuccacuacucaaaaaugccugaauccuug

SEQ ID NO: 492297 - RNA, 64 nt, hsa; identical to SEQ ID NO: 247175

SEQ ID NO: 492298 - RNA, 64 nt, hsa; identical to SEQ ID NO: 247176

SEQ ID NO: 492299 - RNA, 64 nt, hsa; identical to SEQ ID NO: 247177

SEQ ID NO: 492300 - RNA, 64 nt, hsa; identical to SEQ ID NO: 247178

SEQ ID NO: 492301 - RNA, 64 nt, hsa; identical to SEQ ID NO: 247179

SEQ ID NO: 492302 - RNA, 64 nt, hsa; identical to SEQ ID NO: 247180

SEQ ID NO: 492303 - RNA, 64 nt, hsa; identical to SEQ ID NO: 247181

SEQ ID NO: 492304 - RNA, 64 nt, hsa; identical to SEQ ID NO: 247182

SEQ ID NO: 492305 - RNA, 64 nt, hsa; identical to SEQ ID NO: 247183

SEQ ID NO: 492306 - RNA, 64 nt, hsa; identical to SEQ ID NO: 247184

SEQ ID NO: 492307 - RNA, 64 nt, hsa; identical to SEQ ID NO: 247185

SEQ ID NO: 492308 - RNA, 64 nt, hsa; identical to SEQ ID NO: 247186

SEQ ID NO: 492309 - RNA, 64 nt, hsa; identical to SEQ ID NO: 247187

SEQ ID NO: 492310 - RNA, 64 nt, hsa; identical to SEQ ID NO: 247188

SEQ ID NO: 492311 - RNA, 64 nt, hsa; identical to SEQ ID NO: 247189

SEQ ID NO: 492312 - RNA, 64 nt, hsa; identical to SEQ ID NO: 247190

SEQ ID NO: 492313 - RNA, 64 nt, hsa; identical to SEQ ID NO: 247191

SEQ ID NO: 492314 - RNA, 64 nt, hsa; identical to SEQ ID NO: 247192

SEQ ID NO: 492315 - RNA, 64 nt, hsa; identical to SEQ ID NO: 247193

SEQ ID NO: 492316 - RNA, 64 nt, hsa; identical to SEQ ID NO: 247194

SEQ ID NO: 492317 - RNA, 64 nt, hsa; identical to SEQ ID NO: 247195

SEQ ID NO: 492318 - RNA, 64 nt, hsa; identical to SEQ ID NO: 247196

SEQ ID NO: 492319 - RNA, 64 nt, hsa; identical to SEQ ID NO: 247197

SEQ ID NO: 492320 - RNA, 64 nt, hsa; identical to SEQ ID NO: 247198

SEQ ID NO: 492321 - RNA, 64 nt, hsa; identical to SEQ ID NO: 247199

SEQ ID NO: 492322 - RNA, 64 nt, hsa; identical to SEQ ID NO: 247200

SEQ ID NO: 492323 - RNA, 64 nt, hsa; identical to SEQ ID NO: 247201

SEQ ID NO: 492324 - RNA, 61 nt, hsa; identical to SEQ ID NO: 247202

SEQ ID NO: 492325 - RNA, 64 nt, hsa; identical to SEQ ID NO: 247203

SEQ ID NO: 492326 - RNA, 64 nt, hsa; identical to SEQ ID NO: 247204

SEQ ID NO: 492327 - RNA, 64 nt, hsa; identical to SEQ ID NO: 247205

SEQ ID NO: 492328 - RNA, 64 nt, hsa; identical to SEQ ID NO: 247206

SEQ ID NO: 492329 - RNA, 64 nt, hsa; identical to SEQ ID NO: 247207

SEQ ID NO: 492330 - RNA, 64 nt, hsa; identical to SEQ ID NO: 247208

SEQ ID NO: 492331 - RNA, 64 nt, hsa; identical to SEQ ID NO: 247209

SEQ ID NO: 492332 - RNA, 64 nt, hsa; identical to SEQ ID NO: 247210

SEQ ID NO: 492333 - RNA, 64 nt, hsa; identical to SEQ ID NO: 247211

SEQ ID NO: 492334 - RNA, 64 nt, hsa; identical to SEQ ID NO: 247212

SEQ ID NO: 492335 - RNA, 64 nt, hsa; identical to SEQ ID NO: 247213

SEQ ID NO: 492336 - RNA, 64 nt, hsa; identical to SEQ ID NO: 247214

SEQ ID NO: 492337 - RNA, 64 nt, hsa; identical to SEQ ID NO: 247215

SEQ ID NO: 492338 - RNA, 64 nt, hsa; identical to SEQ ID NO: 247216

SEQ ID NO: 492339 - RNA, 64 nt, hsa; identical to SEQ ID NO: 247217

SEQ ID NO: 492340 - RNA, 64 nt, hsa; identical to SEQ ID NO: 247218

SEQ ID NO: 492341 - RNA, 64 nt, hsa; identical to SEQ ID NO: 247219

SEQ ID NO: 492342 - RNA, 64 nt, hsa; identical to SEQ ID NO: 247220

SEQ ID NO: 492343 - RNA, 64 nt, hsa; identical to SEQ ID NO: 247221

SEQ ID NO: 492344 - RNA, 64 nt, hsa; identical to SEQ ID NO: 247222

SEQ ID NO: 492345 - RNA, 64 nt, hsa; identical to SEQ ID NO: 247223

SEQ ID NO: 492346 - RNA, 64 nt, hsa; identical to SEQ ID NO: 247224

SEQ ID NO: 492347 - RNA, 64 nt, hsa; identical to SEQ ID NO: 247225

SEQ ID NO: 492348 - RNA, 64 nt, hsa; identical to SEQ ID NO: 247226

SEQ ID NO: 492349 - RNA, 64 nt, hsa; identical to SEQ ID NO: 247227

SEQ ID NO: 492350 - RNA, 64 nt, hsa; identical to SEQ ID NO: 247228

SEQ ID NO: 492351 - RNA, 64 nt, hsa; identical to SEQ ID NO: 247229

SEQ ID NO: 492352 - RNA, 64 nt, hsa; identical to SEQ ID NO: 247230

SEQ ID NO: 492353 - RNA, 64 nt, hsa; identical to SEQ ID NO: 247231

SEQ ID NO: 492354 - RNA, 64 nt, hsa; identical to SEQ ID NO: 247232

SEQ ID NO: 492355 - RNA, 64 nt, hsa; identical to SEQ ID NO: 247233

SEQ ID NO: 492356 - RNA, 64 nt, hsa; identical to SEQ ID NO: 247234

SEQ ID NO: 492357 - RNA, 64 nt, hsa; identical to SEQ ID NO: 247235

SEQ ID NO: 492358 - RNA, 64 nt, hsa; identical to SEQ ID NO: 247236

SEQ ID NO: 492359 - RNA, 64 nt, hsa; identical to SEQ ID NO: 247237

SEQ ID NO: 492360 - RNA, 64 nt, hsa; identical to SEQ ID NO: 247238

SEQ ID NO: 492361 - RNA, 64 nt, hsa; identical to SEQ ID NO: 247239

SEQ ID NO: 492362 - RNA, 64 nt, hsa; identical to SEQ ID NO: 247240

SEQ ID NO: 492363 - RNA, 64 nt, hsa; identical to SEQ ID NO: 247241

SEQ ID NO: 492364 - RNA, 64 nt, hsa; identical to SEQ ID NO: 247242

SEQ ID NO: 492365 - RNA, 64 nt, hsa; identical to SEQ ID NO: 247243

SEQ ID NO: 492366 - RNA, 64 nt, hsa; identical to SEQ ID NO: 247244

SEQ ID NO: 492367 - RNA, 64 nt, hsa; identical to SEQ ID NO: 247245

SEQ ID NO: 492368 - RNA, 64 nt, hsa; identical to SEQ ID NO: 247246

SEQ ID NO: 492369 - RNA, 64 nt, hsa; identical to SEQ ID NO: 247247

SEQ ID NO: 492370 - RNA, 64 nt, hsa; identical to SEQ ID NO: 247248

SEQ ID NO: 492371 - RNA, 64 nt, hsa; identical to SEQ ID NO: 247249

SEQ ID NO: 492372 - RNA, 64 nt, hsa; identical to SEQ ID NO: 247250

SEQ ID NO: 492373 - RNA, 64 nt, hsa; identical to SEQ ID NO: 247251

SEQ ID NO: 492374 - RNA, 64 nt, hsa; identical to SEQ ID NO: 247252

SEQ ID NO: 492375 - RNA, 64 nt, hsa
gcuucagguucagcgcccuuggggcuaugaaugggaggcucagcagugcccugaggaugggcuu

SEQ ID NO: 492376 - RNA, 64 nt, hsa
auguucugugcagccgcucuuaguauucuuccuugaggcucacaucaugugucccuaucacucu

SEQ ID NO: 492377 - RNA, 64 nt, hsa
ugccauccaccccucagggagcuagguuuucucagaggcucagcuggacagcacuuuuuagaaa

SEQ ID NO: 492378 - RNA, 64 nt, hsa
cucugggcugaaccaaggcuaugacuucuggagagaggcucagggguuggucugagaggccugc

SEQ ID NO: 492379 - RNA, 64 nt, hsa
ucucuguccccugcccuuccccuccugccagggggaggcucagguugguccccgagugccgccu

SEQ ID NO: 492380 - RNA, 64 nt, hsa
gccagcuccccagggcagacucacgugccccucugaggcucagaaaaugcccagcccuuccuca

SEQ ID NO: 492381 - RNA, 64 nt, hsa
cguucagcucugccucuguucuuucaacuccuuugaggcucaaaaaaaacacaaagaucagaag

SEQ ID NO: 492382 - RNA, 64 nt, hsa
ugauuaauuggcugagaaaacccuggaguggagggaggcucagagauacugauauggauguggg

SEQ ID NO: 492383 - RNA, 64 nt, hsa
agugugggggaaggauagcugcagauugacaggcgaggcucagaaacuccuggcuuagauugaa

SEQ ID NO: 492384 - RNA, 64 nt, hsa
ucugggguccugguuccugaagagcucacccagagaggcucaaagcagccuuuugucccagcuc

SEQ ID NO: 492385 - RNA, 64 nt, hsa
cuccuagagucccccuaggucucuggcugcccaugaggcucaugaagcagaggguaucccaguc

SEQ ID NO: 492386 - RNA, 64 nt, hsa
uuucaagcuagcagccacauagguuaggaaagcggaggcucaugguggggcuggggccccagag

SEQ ID NO: 492387 - RNA, 64 nt, hsa
aacacuucccugucugcagccagagguggauggugaggcucauguggguguccccucucucacu

SEQ ID NO: 492388 - RNA, 64 nt, hsa
gcugccucggcugcguguacgagaaguggccgaagaggcucaggcagcccggcuggccgccgcc

SEQ ID NO: 492389 - RNA, 64 nt, hsa; identical to SEQ ID NO: 183750

SEQ ID NO: 492390 - RNA, 64 nt, hsa; identical to SEQ ID NO: 183751

SEQ ID NO: 492391 - RNA, 64 nt, hsa; identical to SEQ ID NO: 183752

SEQ ID NO: 492392 - RNA, 64 nt, hsa; identical to SEQ ID NO: 183753

SEQ ID NO: 492393 - RNA, 64 nt, hsa; identical to SEQ ID NO: 183754

SEQ ID NO: 492394 - RNA, 64 nt, hsa; identical to SEQ ID NO: 183755

SEQ ID NO: 492395 - RNA, 64 nt, hsa; identical to SEQ ID NO: 183756

SEQ ID NO: 492396 - RNA, 64 nt, hsa; identical to SEQ ID NO: 183757

SEQ ID NO: 492397 - RNA, 64 nt, hsa; identical to SEQ ID NO: 183758

SEQ ID NO: 492398 - RNA, 64 nt, hsa; identical to SEQ ID NO: 183759

SEQ ID NO: 492399 - RNA, 64 nt, hsa; identical to SEQ ID NO: 234645

SEQ ID NO: 492400 - RNA, 64 nt, hsa; identical to SEQ ID NO: 234646

SEQ ID NO: 492401 - RNA, 64 nt, hsa; identical to SEQ ID NO: 234647

SEQ ID NO: 492402 - RNA, 64 nt, hsa; identical to SEQ ID NO: 234648

SEQ ID NO: 492403 - RNA, 64 nt, hsa; identical to SEQ ID NO: 234649

SEQ ID NO: 492404 - RNA, 64 nt, hsa; identical to SEQ ID NO: 234650

SEQ ID NO: 492405 - RNA, 64 nt, hsa; identical to SEQ ID NO: 234651

SEQ ID NO: 492406 - RNA, 64 nt, hsa; identical to SEQ ID NO: 234652

SEQ ID NO: 492407 - RNA, 64 nt, hsa; identical to SEQ ID NO: 234653

SEQ ID NO: 492408 - RNA, 64 nt, hsa; identical to SEQ ID NO: 234654

SEQ ID NO: 492409 - RNA, 64 nt, hsa; identical to SEQ ID NO: 234655

SEQ ID NO: 492410 - RNA, 64 nt, hsa; identical to SEQ ID NO: 234656

SEQ ID NO: 492411 - RNA, 64 nt, hsa; identical to SEQ ID NO: 234657

SEQ ID NO: 492412 - RNA, 64 nt, hsa; identical to SEQ ID NO: 234658

SEQ ID NO: 492413 - RNA, 64 nt, hsa; identical to SEQ ID NO: 234659

SEQ ID NO: 492414 - RNA, 64 nt, hsa; identical to SEQ ID NO: 234660

SEQ ID NO: 492415 - RNA, 64 nt, hsa; identical to SEQ ID NO: 234661

SEQ ID NO: 492416 - RNA, 64 nt, hsa; identical to SEQ ID NO: 234662

SEQ ID NO: 492417 - RNA, 64 nt, hsa; identical to SEQ ID NO: 234663

SEQ ID NO: 492418 - RNA, 64 nt, hsa; identical to SEQ ID NO: 234664

SEQ ID NO: 492419 - RNA, 64 nt, hsa; identical to SEQ ID NO: 234665

SEQ ID NO: 492420 - RNA, 63 nt, hsa; identical to SEQ ID NO: 234666

SEQ ID NO: 492421 - RNA, 64 nt, hsa; identical to SEQ ID NO: 234667

SEQ ID NO: 492422 - RNA, 64 nt, hsa; identical to SEQ ID NO: 234668

SEQ ID NO: 492423 - RNA, 64 nt, hsa; identical to SEQ ID NO: 234669

SEQ ID NO: 492424 - RNA, 64 nt, hsa; identical to SEQ ID NO: 234670

SEQ ID NO: 492425 - RNA, 64 nt, hsa; identical to SEQ ID NO: 234671

SEQ ID NO: 492426 - RNA, 64 nt, hsa; identical to SEQ ID NO: 234672

SEQ ID NO: 492427 - RNA, 64 nt, hsa; identical to SEQ ID NO: 234673

SEQ ID NO: 492428 - RNA, 64 nt, hsa; identical to SEQ ID NO: 234674

SEQ ID NO: 492429 - RNA, 64 nt, hsa; identical to SEQ ID NO: 234675

SEQ ID NO: 492430 - RNA, 64 nt, hsa; identical to SEQ ID NO: 234676

SEQ ID NO: 492431 - RNA, 64 nt, hsa; identical to SEQ ID NO: 234677

SEQ ID NO: 492432 - RNA, 64 nt, hsa; identical to SEQ ID NO: 234678

SEQ ID NO: 492433 - RNA, 64 nt, hsa; identical to SEQ ID NO: 234679

SEQ ID NO: 492434 - RNA, 64 nt, hsa; identical to SEQ ID NO: 234680

SEQ ID NO: 492435 - RNA, 64 nt, hsa; identical to SEQ ID NO: 234681

SEQ ID NO: 492436 - RNA, 64 nt, hsa; identical to SEQ ID NO: 234682

SEQ ID NO: 492437 - RNA, 64 nt, hsa; identical to SEQ ID NO: 234683

SEQ ID NO: 492438 - RNA, 64 nt, hsa; identical to SEQ ID NO: 234684

SEQ ID NO: 492439 - RNA, 64 nt, hsa; identical to SEQ ID NO: 234685

SEQ ID NO: 492440 - RNA, 64 nt, hsa; identical to SEQ ID NO: 234686

SEQ ID NO: 492441 - RNA, 64 nt, hsa; identical to SEQ ID NO: 234687

SEQ ID NO: 492442 - RNA, 64 nt, hsa; identical to SEQ ID NO: 234688

SEQ ID NO: 492443 - RNA, 64 nt, hsa; identical to SEQ ID NO: 234689

SEQ ID NO: 492444 - RNA, 64 nt, hsa; identical to SEQ ID NO: 234690

SEQ ID NO: 492445 - RNA, 64 nt, hsa; identical to SEQ ID NO: 234691

SEQ ID NO: 492446 - RNA, 64 nt, hsa; identical to SEQ ID NO: 234692

SEQ ID NO: 492447 - RNA, 64 nt, hsa; identical to SEQ ID NO: 234693

SEQ ID NO: 492448 - RNA, 64 nt, hsa; identical to SEQ ID NO: 234694

SEQ ID NO: 492449 - RNA, 64 nt, hsa; identical to SEQ ID NO: 234695

SEQ ID NO: 492450 - RNA, 64 nt, hsa; identical to SEQ ID NO: 234696

SEQ ID NO: 492451 - RNA, 64 nt, hsa
uugcacaaauugggccaaagaaacauugccuugaggaagauaugauuggaaaaucaagagugua

SEQ ID NO: 492452 - RNA, 64 nt, hsa
uccuuuccuuuguagucucuggcaagaugcuuuaggaagauaaaaguuugaggagaacaaacag

SEQ ID NO: 492453 - RNA, 64 nt, hsa
gacaggagggaagauauuagugauuagacagcagggaagauauuagugguaaagagugaaugau

SEQ ID NO: 492454 - RNA, 64 nt, hsa
gacaggaaggaagacauuagugauuagacaggagggaagauauuagugauuagacagcagggaa

SEQ ID NO: 492455 - RNA, 64 nt, hsa
gacucagccucugugggugacagacuucuaagcaggaagauagacgugaagcacaugguuacau

SEQ ID NO: 492456 - RNA, 64 nt, hsa
ucaagugcuucaaaugaauuaagaguccaguuucggaagauaauaaauguuuguuagauacacc

SEQ ID NO: 492457 - RNA, 64 nt, hsa
gcaccuuuuugacagugaacauggucuaaaaaagggaagauauuguagaagauuucacacacac

SEQ ID NO: 492458 - RNA, 64 nt, hsa
aguagucaggaacuggucacuuugaaugugggagggaagauauucacgacaagguuuucuacga

SEQ ID NO: 492459 - RNA, 64 nt, hsa
augaugaugaagaugaugaugaggaugaagauaaggaagauacguuaccauugucaaagaaagc

SEQ ID NO: 492460 - RNA, 64 nt, hsa
cugccauaauagagauguuugaauuuauuagaguggaagauauaaaaucauuaacugcucaugu

SEQ ID NO: 492461 - RNA, 64 nt, hsa
acccccauaccccuucuuccacccccagacuaaaggaagauacuuacucucugccccucuccau

SEQ ID NO: 492462 - RNA, 64 nt, hsa
gugucucuccaccagcccccaugcaguagggacuggaagauaugucaucugcugguuguguuau

SEQ ID NO: 492463 - RNA, 64 nt, hsa
agugcaucgcugaagcuuuuggagacuuuuggauggaagauaagauagggaagauuaaguucca

SEQ ID NO: 492464 - RNA, 64 nt, hsa
cauggcuaguguggcguugaaagaguagcgacugggaagauacaacuuacacaguggggccuau

SEQ ID NO: 492465 - RNA, 64 nt, hsa
ggguccaggugggccacacaggggccaggauggcggaagauacggguggggagggaagauaucc

SEQ ID NO: 492466 - RNA, 64 nt, hsa
aggggccaggauggcggaagauacggguggggagggaagauauccagaaaggagccacagcuga

SEQ ID NO: 492467 - RNA, 64 nt, hsa
gaaacuggcucugaaauaggcagaccuagcaagaggaagauacaggguaucgggcguuugagug

SEQ ID NO: 492468 - RNA, 64 nt, hsa
guaucgggcguuugaguguuucagaagucauucgggaagauaaauccagugcgcuggccgcagc

SEQ ID NO: 492469 - RNA, 64 nt, hsa; identical to SEQ ID NO: 154357

SEQ ID NO: 492470 - RNA, 64 nt, hsa; identical to SEQ ID NO: 154358

SEQ ID NO: 492471 - RNA, 64 nt, hsa; identical to SEQ ID NO: 154359

SEQ ID NO: 492472 - RNA, 64 nt, hsa; identical to SEQ ID NO: 154360

SEQ ID NO: 492473 - RNA, 64 nt, hsa; identical to SEQ ID NO: 154361

SEQ ID NO: 492474 - RNA, 64 nt, hsa; identical to SEQ ID NO: 154362

SEQ ID NO: 492475 - RNA, 64 nt, hsa; identical to SEQ ID NO: 154363

SEQ ID NO: 492476 - RNA, 64 nt, hsa; identical to SEQ ID NO: 154364

SEQ ID NO: 492477 - RNA, 64 nt, hsa; identical to SEQ ID NO: 154365

SEQ ID NO: 492478 - RNA, 64 nt, hsa; identical to SEQ ID NO: 154366

SEQ ID NO: 492479 - RNA, 64 nt, hsa; identical to SEQ ID NO: 154367

SEQ ID NO: 492480 - RNA, 64 nt, hsa; identical to SEQ ID NO: 154368

SEQ ID NO: 492481 - RNA, 64 nt, hsa; identical to SEQ ID NO: 154369

SEQ ID NO: 492482 - RNA, 64 nt, hsa; identical to SEQ ID NO: 154370

SEQ ID NO: 492483 - RNA, 64 nt, hsa; identical to SEQ ID NO: 154371

SEQ ID NO: 492484 - RNA, 64 nt, hsa; identical to SEQ ID NO: 154372

SEQ ID NO: 492485 - RNA, 64 nt, hsa; identical to SEQ ID NO: 154373

SEQ ID NO: 492486 - RNA, 64 nt, hsa; identical to SEQ ID NO: 154374

SEQ ID NO: 492487 - RNA, 64 nt, hsa; identical to SEQ ID NO: 154375

SEQ ID NO: 492488 - RNA, 64 nt, hsa; identical to SEQ ID NO: 154376

SEQ ID NO: 492489 - RNA, 64 nt, hsa; identical to SEQ ID NO: 154377

SEQ ID NO: 492490 - RNA, 64 nt, hsa; identical to SEQ ID NO: 154378

SEQ ID NO: 492491 - RNA, 64 nt, hsa; identical to SEQ ID NO: 154379

SEQ ID NO: 492492 - RNA, 64 nt, hsa; identical to SEQ ID NO: 154380

SEQ ID NO: 492493 - RNA, 64 nt, hsa; identical to SEQ ID NO: 154381

SEQ ID NO: 492494 - RNA, 64 nt, hsa; identical to SEQ ID NO: 154382

SEQ ID NO: 492495 - RNA, 64 nt, hsa; identical to SEQ ID NO: 154383

SEQ ID NO: 492496 - RNA, 64 nt, hsa; identical to SEQ ID NO: 154384

SEQ ID NO: 492497 - RNA, 64 nt, hsa; identical to SEQ ID NO: 154385

SEQ ID NO: 492498 - RNA, 64 nt, hsa; identical to SEQ ID NO: 154386

SEQ ID NO: 492499 - RNA, 64 nt, hsa; identical to SEQ ID NO: 154387

SEQ ID NO: 492500 - RNA, 64 nt, hsa; identical to SEQ ID NO: 154388

SEQ ID NO: 492501 - RNA, 64 nt, hsa; identical to SEQ ID NO: 154389

SEQ ID NO: 492502 - RNA, 64 nt, hsa; identical to SEQ ID NO: 154390

SEQ ID NO: 492503 - RNA, 64 nt, hsa; identical to SEQ ID NO: 194715

SEQ ID NO: 492504 - RNA, 64 nt, hsa; identical to SEQ ID NO: 194716

SEQ ID NO: 492505 - RNA, 64 nt, hsa; identical to SEQ ID NO: 194717

SEQ ID NO: 492506 - RNA, 64 nt, hsa; identical to SEQ ID NO: 194718

SEQ ID NO: 492507 - RNA, 64 nt, hsa; identical to SEQ ID NO: 194719

SEQ ID NO: 492508 - RNA, 64 nt, hsa; identical to SEQ ID NO: 194720

SEQ ID NO: 492509 - RNA, 64 nt, hsa; identical to SEQ ID NO: 194721

SEQ ID NO: 492510 - RNA, 64 nt, hsa; identical to SEQ ID NO: 194722

SEQ ID NO: 492511 - RNA, 64 nt, hsa; identical to SEQ ID NO: 194723

SEQ ID NO: 492512 - RNA, 64 nt, hsa; identical to SEQ ID NO: 194724

SEQ ID NO: 492513 - RNA, 64 nt, hsa; identical to SEQ ID NO: 194725

SEQ ID NO: 492514 - RNA, 64 nt, hsa; identical to SEQ ID NO: 194726

SEQ ID NO: 492515 - RNA, 64 nt, hsa; identical to SEQ ID NO: 194727

SEQ ID NO: 492516 - RNA, 64 nt, hsa; identical to SEQ ID NO: 194728

SEQ ID NO: 492517 - RNA, 64 nt, hsa; identical to SEQ ID NO: 194729

SEQ ID NO: 492518 - RNA, 64 nt, hsa; identical to SEQ ID NO: 194730

SEQ ID NO: 492519 - RNA, 64 nt, hsa; identical to SEQ ID NO: 194731

SEQ ID NO: 492520 - RNA, 64 nt, hsa; identical to SEQ ID NO: 194732

SEQ ID NO: 492521 - RNA, 64 nt, hsa; identical to SEQ ID NO: 194733

SEQ ID NO: 492522 - RNA, 64 nt, hsa; identical to SEQ ID NO: 194734

SEQ ID NO: 492523 - RNA, 64 nt, hsa; identical to SEQ ID NO: 194735

SEQ ID NO: 492524 - RNA, 64 nt, hsa; identical to SEQ ID NO: 194736

SEQ ID NO: 492525 - RNA, 64 nt, hsa; identical to SEQ ID NO: 194737

SEQ ID NO: 492526 - RNA, 64 nt, hsa; identical to SEQ ID NO: 194738

SEQ ID NO: 492527 - RNA, 64 nt, hsa; identical to SEQ ID NO: 194739

SEQ ID NO: 492528 - RNA, 64 nt, hsa; identical to SEQ ID NO: 194740

SEQ ID NO: 492529 - RNA, 64 nt, hsa; identical to SEQ ID NO: 194741

SEQ ID NO: 492530 - RNA, 64 nt, hsa; identical to SEQ ID NO: 194742

SEQ ID NO: 492531 - RNA, 64 nt, hsa; identical to SEQ ID NO: 194743

SEQ ID NO: 492532 - RNA, 64 nt, hsa; identical to SEQ ID NO: 194744

SEQ ID NO: 492533 - RNA, 64 nt, hsa; identical to SEQ ID NO: 194745

SEQ ID NO: 492534 - RNA, 64 nt, hsa; identical to SEQ ID NO: 194746

SEQ ID NO: 492535 - RNA, 64 nt, hsa; identical to SEQ ID NO: 194747

SEQ ID NO: 492536 - RNA, 64 nt, hsa
aagagaaaaagaaaugcaaaaaucucugcgugcagggacaaagaggccuuuaaccauggugcuu

SEQ ID NO: 492537 - RNA, 64 nt, hsa
agaaaggggcaguuuaaagcacaaugucucacaugggacaaaguuccaaaaugccaaauucuua

SEQ ID NO: 492538 - RNA, 64 nt, hsa
acuucuguccuuauuucacuugcugaaaagcugugggacaaaauguauggaauagacaaggcca

SEQ ID NO: 492539 - RNA, 64 nt, hsa
cuauaagaggaaauaagagagaaaguggaggagagggacaaaaggaguaauuauuugguauaga

SEQ ID NO: 492540 - RNA, 64 nt, hsa
ucuugguggggaugagaagggagagagagcuagagggacaaagagaaugagaagacauggauga

SEQ ID NO: 492541 - RNA, 64 nt, hsa
augacaaaaccuuuaaucugcaccuuacaacucggggacaaauggggacaggaaggaucaaguu

SEQ ID NO: 492542 - RNA, 64 nt, hsa
aggaaugcauguguucuuagugauucacauccacgggacaaaaacucaagaagaaauaagagcu

SEQ ID NO: 492543 - RNA, 64 nt, hsa
gucuaaaguguggcaagacauagugcacaacacagggacaaaggcagguuuccugcagcucgcu

SEQ ID NO: 492544 - RNA, 64 nt, hsa
uugaaaaaagugcagauaaaacccucaucucccugggacaaagcacgugggggaaagggguggc

SEQ ID NO: 492545 - RNA, 64 nt, hsa
agagcucuggcuggcaucuggugggugccccucugggacaaagcuuccagaggaaggaacaggc

SEQ ID NO: 492546 - RNA, 64 nt, hsa; identical to SEQ ID NO: 437603

SEQ ID NO: 492547 - RNA, 64 nt, hsa; identical to SEQ ID NO: 437604

SEQ ID NO: 492548 - RNA, 64 nt, hsa; identical to SEQ ID NO: 437605

SEQ ID NO: 492549 - RNA, 64 nt, hsa; identical to SEQ ID NO: 437606

SEQ ID NO: 492550 - RNA, 64 nt, hsa
ccccggccccuccccaccuuucccaccccagcccucuugcaagaggagaggcacgguagggaaa

SEQ ID NO: 492551 - RNA, 64 nt, hsa
uaaccuuuaucccaccuuugacacuacccuccaaucuugcaacacuauccuguuucucagaaca

SEQ ID NO: 492552 - RNA, 64 nt, hsa
cgugguggcggcggcacuucaagcaaagacaguuucuugcaagcuccaguagcuccgcgugucu

SEQ ID NO: 492553 - RNA, 64 nt, hsa
gucauucucauccaaaagugaccagcauaccaguucuugcaauaagauauuacccucagaauau

SEQ ID NO: 492554 - RNA, 64 nt, hsa
cagaaguuggagcuuuuuaaauuuuucuugaacuucuugcaauaguaacugaauguccuccauu

SEQ ID NO: 492555 - RNA, 64 nt, hsa
uggaggauagguuaagaaaggaaagggacagaagucuugcaauaggcugcagacauuuuaauac

SEQ ID NO: 492556 - RNA, 64 nt, hsa
cgugccagagacgccacaacuucaugucccugucucuugcaagcuccccgugcugccaguacuu

SEQ ID NO: 492557 - RNA, 64 nt, hsa
cugcuuuuccuuuuuacuuccuauuuucaccuuaucuugcaauuuuucugucugauuuuuacaa

SEQ ID NO: 492558 - RNA, 64 nt, hsa
ccugugaugcuccgucucaaacagccgaaaccugucuugcaauggggggagggggcguuucgcu

SEQ ID NO: 492559 - RNA, 64 nt, hsa
auugccaacaauuuaauguuuauguguugccaauucuugcaaccacugcccuaccaaaccugug

SEQ ID NO: 492560 - RNA, 64 nt, hsa
auacguaaaggugugcuuucuguguuuuauauuaucuugcaaauccuuuugcccuuuaaaaagc

SEQ ID NO: 492561 - RNA, 64 nt, hsa
uuaagcacaugggaaagauucuagacuuuuuguuucuugcaacaacagugcccucugcugcuag

SEQ ID NO: 492562 - RNA, 64 nt, hsa
uaaaauacuuaaguuauucaaagaauguuaucuuucuugcaagaguaauuuaagcacaugggaa

SEQ ID NO: 492563 - RNA, 64 nt, hsa
uaaaaaguauguuguacauacugccgaagaauugucuugcaaguuaaggcuucccccuuuacua

SEQ ID NO: 492564 - RNA, 64 nt, hsa
cugagugaauuguaccuauuucugaugaugucggucuugcaaagcgacagauucauaaaguaau

SEQ ID NO: 492565 - RNA, 64 nt, hsa; identical to SEQ ID NO: 275005

SEQ ID NO: 492566 - RNA, 64 nt, hsa; identical to SEQ ID NO: 275006

SEQ ID NO: 492567 - RNA, 64 nt, hsa; identical to SEQ ID NO: 275007

SEQ ID NO: 492568 - RNA, 64 nt, hsa; identical to SEQ ID NO: 275008

SEQ ID NO: 492569 - RNA, 64 nt, hsa; identical to SEQ ID NO: 275009

SEQ ID NO: 492570 - RNA, 64 nt, hsa; identical to SEQ ID NO: 275010

SEQ ID NO: 492571 - RNA, 64 nt, hsa; identical to SEQ ID NO: 275011

SEQ ID NO: 492572 - RNA, 64 nt, hsa; identical to SEQ ID NO: 275012

SEQ ID NO: 492573 - RNA, 64 nt, hsa; identical to SEQ ID NO: 275013

SEQ ID NO: 492574 - RNA, 64 nt, hsa; identical to SEQ ID NO: 275014

SEQ ID NO: 492575 - RNA, 64 nt, hsa; identical to SEQ ID NO: 275015

SEQ ID NO: 492576 - RNA, 64 nt, hsa; identical to SEQ ID NO: 275016

SEQ ID NO: 492577 - RNA, 51 nt, hsa; identical to SEQ ID NO: 275017

SEQ ID NO: 492578 - RNA, 64 nt, hsa; identical to SEQ ID NO: 275018

SEQ ID NO: 492579 - RNA, 64 nt, hsa; identical to SEQ ID NO: 275019

SEQ ID NO: 492580 - RNA, 64 nt, hsa; identical to SEQ ID NO: 275020

SEQ ID NO: 492581 - RNA, 64 nt, hsa; identical to SEQ ID NO: 275021

SEQ ID NO: 492582 - RNA, 64 nt, hsa; identical to SEQ ID NO: 275022

SEQ ID NO: 492583 - RNA, 64 nt, hsa; identical to SEQ ID NO: 275023

SEQ ID NO: 492584 - RNA, 64 nt, hsa; identical to SEQ ID NO: 275024

SEQ ID NO: 492585 - RNA, 64 nt, hsa; identical to SEQ ID NO: 275025

SEQ ID NO: 492586 - RNA, 64 nt, hsa; identical to SEQ ID NO: 275026

SEQ ID NO: 492587 - RNA, 64 nt, hsa; identical to SEQ ID NO: 275027

SEQ ID NO: 492588 - RNA, 64 nt, hsa; identical to SEQ ID NO: 275028

SEQ ID NO: 492589 - RNA, 64 nt, hsa; identical to SEQ ID NO: 275029

SEQ ID NO: 492590 - RNA, 64 nt, hsa; identical to SEQ ID NO: 275030

SEQ ID NO: 492591 - RNA, 64 nt, hsa; identical to SEQ ID NO: 275031

SEQ ID NO: 492592 - RNA, 64 nt, hsa; identical to SEQ ID NO: 275032

SEQ ID NO: 492593 - RNA, 64 nt, hsa; identical to SEQ ID NO: 275033

SEQ ID NO: 492594 - RNA, 64 nt, hsa; identical to SEQ ID NO: 275034

SEQ ID NO: 492595 - RNA, 64 nt, hsa; identical to SEQ ID NO: 275035

SEQ ID NO: 492596 - RNA, 64 nt, hsa; identical to SEQ ID NO: 275036

SEQ ID NO: 492597 - RNA, 64 nt, hsa; identical to SEQ ID NO: 275037

SEQ ID NO: 492598 - RNA, 64 nt, hsa; identical to SEQ ID NO: 275038

SEQ ID NO: 492599 - RNA, 64 nt, hsa; identical to SEQ ID NO: 275038

SEQ ID NO: 492600 - RNA, 64 nt, hsa; identical to SEQ ID NO: 275040

SEQ ID NO: 492601 - RNA, 64 nt, hsa; identical to SEQ ID NO: 275041

SEQ ID NO: 492602 - RNA, 64 nt, hsa; identical to SEQ ID NO: 275042

SEQ ID NO: 492603 - RNA, 64 nt, hsa; identical to SEQ ID NO: 275043

SEQ ID NO: 492604 - RNA, 64 nt, hsa; identical to SEQ ID NO: 275044

SEQ ID NO: 492605 - RNA, 64 nt, hsa; identical to SEQ ID NO: 275045

SEQ ID NO: 492606 - RNA, 64 nt, hsa; identical to SEQ ID NO: 275046

SEQ ID NO: 492607 - RNA, 64 nt, hsa; identical to SEQ ID NO: 275047

SEQ ID NO: 492608 - RNA, 64 nt, hsa; identical to SEQ ID NO: 275048

SEQ ID NO: 492609 - RNA, 64 nt, hsa; identical to SEQ ID NO: 275049

SEQ ID NO: 492610 - RNA, 64 nt, hsa; identical to SEQ ID NO: 275050

SEQ ID NO: 492611 - RNA, 64 nt, hsa; identical to SEQ ID NO: 275051

SEQ ID NO: 492612 - RNA, 64 nt, hsa
caggagugcuuuggaaauugagagguggagcaaucucagguaaaggcaaaauagaggguaugac

SEQ ID NO: 492613 - RNA, 64 nt, hsa
ugacccuuuauggcacugcuaacagaccccuucccucagguaauucuggauccagaacucauua

SEQ ID NO: 492614 - RNA, 64 nt, hsa
aggcauuuuggguuuuaagaccccugcuuuacaucucagguaauguguagauuguacuucucug

SEQ ID NO: 492615 - RNA, 64 nt, hsa
acccacacaauguaaggguacuguugucauuguucucagguaggugauucugccuuccaagagu

SEQ ID NO: 492616 - RNA, 64 nt, hsa
agaaugaguugugaucauugucacccuaugucuucucagguagcagggcgcguuuccacuuaag

SEQ ID NO: 492617 - RNA, 64 nt, hsa
uccacagaggcugaccugugggggaaaagaagugcucagguaagguugucuccucuccuguccu

SEQ ID NO: 492618 - RNA, 64 nt, hsa; identical to SEQ ID NO: 275005

SEQ ID NO: 492619 - RNA, 64 nt, hsa; identical to SEQ ID NO: 275006

SEQ ID NO: 492620 - RNA, 64 nt, hsa; identical to SEQ ID NO: 275007

SEQ ID NO: 492621 - RNA, 64 nt, hsa; identical to SEQ ID NO: 275008

SEQ ID NO: 492622 - RNA, 64 nt, hsa; identical to SEQ ID NO: 275009

SEQ ID NO: 492623 - RNA, 64 nt, hsa; identical to SEQ ID NO: 275010

SEQ ID NO: 492624 - RNA, 64 nt, hsa; identical to SEQ ID NO: 275011

SEQ ID NO: 492625 - RNA, 64 nt, hsa; identical to SEQ ID NO: 275012

SEQ ID NO: 492626 - RNA, 64 nt, hsa; identical to SEQ ID NO: 275013

SEQ ID NO: 492627 - RNA, 64 nt, hsa; identical to SEQ ID NO: 275014

SEQ ID NO: 492628 - RNA, 64 nt, hsa; identical to SEQ ID NO: 275015

SEQ ID NO: 492629 - RNA, 64 nt, hsa; identical to SEQ ID NO: 275016

SEQ ID NO: 492630 - RNA, 51 nt, hsa; identical to SEQ ID NO: 275017

SEQ ID NO: 492631 - RNA, 64 nt, hsa; identical to SEQ ID NO: 275018

SEQ ID NO: 492632 - RNA, 64 nt, hsa; identical to SEQ ID NO: 275019

SEQ ID NO: 492633 - RNA, 64 nt, hsa; identical to SEQ ID NO: 275020

SEQ ID NO: 492634 - RNA, 64 nt, hsa; identical to SEQ ID NO: 275021

SEQ ID NO: 492635 - RNA, 64 nt, hsa; identical to SEQ ID NO: 275022

SEQ ID NO: 492636 - RNA, 64 nt, hsa; identical to SEQ ID NO: 275023

SEQ ID NO: 492637 - RNA, 64 nt, hsa; identical to SEQ ID NO: 275024

SEQ ID NO: 492638 - RNA, 64 nt, hsa; identical to SEQ ID NO: 275025

SEQ ID NO: 492639 - RNA, 64 nt, hsa; identical to SEQ ID NO: 275026

SEQ ID NO: 492640 - RNA, 64 nt, hsa; identical to SEQ ID NO: 275027

SEQ ID NO: 492641 - RNA, 64 nt, hsa; identical to SEQ ID NO: 275028

SEQ ID NO: 492642 - RNA, 64 nt, hsa; identical to SEQ ID NO: 275029

SEQ ID NO: 492643 - RNA, 64 nt, hsa; identical to SEQ ID NO: 275030

SEQ ID NO: 492644 - RNA, 64 nt, hsa; identical to SEQ ID NO: 275031

SEQ ID NO: 492645 - RNA, 64 nt, hsa; identical to SEQ ID NO: 275032

SEQ ID NO: 492646 - RNA, 64 nt, hsa; identical to SEQ ID NO: 275033

SEQ ID NO: 492647 - RNA, 64 nt, hsa; identical to SEQ ID NO: 275034

SEQ ID NO: 492648 - RNA, 64 nt, hsa; identical to SEQ ID NO: 275035

SEQ ID NO: 492649 - RNA, 64 nt, hsa; identical to SEQ ID NO: 275036

SEQ ID NO: 492650 - RNA, 64 nt, hsa; identical to SEQ ID NO: 275037

SEQ ID NO: 492651 - RNA, 64 nt, hsa; identical to SEQ ID NO: 275038

SEQ ID NO: 492652 - RNA, 64 nt, hsa; identical to SEQ ID NO: 275038

SEQ ID NO: 492653 - RNA, 64 nt, hsa; identical to SEQ ID NO: 275040

SEQ ID NO: 492654 - RNA, 64 nt, hsa; identical to SEQ ID NO: 275041

SEQ ID NO: 492655 - RNA, 64 nt, hsa; identical to SEQ ID NO: 275042

SEQ ID NO: 492656 - RNA, 64 nt, hsa; identical to SEQ ID NO: 275043

SEQ ID NO: 492657 - RNA, 64 nt, hsa; identical to SEQ ID NO: 275044

SEQ ID NO: 492658 - RNA, 64 nt, hsa; identical to SEQ ID NO: 275045

SEQ ID NO: 492659 - RNA, 64 nt, hsa; identical to SEQ ID NO: 275046

SEQ ID NO: 492660 - RNA, 64 nt, hsa; identical to SEQ ID NO: 275047

SEQ ID NO: 492661 - RNA, 64 nt, hsa; identical to SEQ ID NO: 275048

SEQ ID NO: 492662 - RNA, 64 nt, hsa; identical to SEQ ID NO: 275049

SEQ ID NO: 492663 - RNA, 64 nt, hsa; identical to SEQ ID NO: 275050

SEQ ID NO: 492664 - RNA, 64 nt, hsa; identical to SEQ ID NO: 275051

SEQ ID NO: 492665 - RNA, 64 nt, hsa
uaaguuauuuugcucaaguacuuaaguagucuggcucaaguacuuuguuuacaauuaaaaugga

SEQ ID NO: 492666 - RNA, 64 nt, hsa
ccuccuccucuuaagauuuuuuuaaguuauuuugcucaaguacuuaaguagucuggcucaagua

SEQ ID NO: 492667 - RNA, 64 nt, hsa; identical to SEQ ID NO: 77020

SEQ ID NO: 492668 - RNA, 64 nt, hsa; identical to SEQ ID NO: 77021

SEQ ID NO: 492669 - RNA, 64 nt, hsa; identical to SEQ ID NO: 77022

SEQ ID NO: 492670 - RNA, 64 nt, hsa; identical to SEQ ID NO: 77023

SEQ ID NO: 492671 - RNA, 64 nt, hsa; identical to SEQ ID NO: 77024

SEQ ID NO: 492672 - RNA, 64 nt, hsa; identical to SEQ ID NO: 77025

SEQ ID NO: 492673 - RNA, 64 nt, hsa; identical to SEQ ID NO: 77026

SEQ ID NO: 492674 - RNA, 64 nt, hsa; identical to SEQ ID NO: 77027

SEQ ID NO: 492675 - RNA, 64 nt, hsa; identical to SEQ ID NO: 77028

SEQ ID NO: 492676 - RNA, 64 nt, hsa; identical to SEQ ID NO: 77029

SEQ ID NO: 492677 - RNA, 64 nt, hsa; identical to SEQ ID NO: 77030

SEQ ID NO: 492678 - RNA, 64 nt, hsa; identical to SEQ ID NO: 77031

SEQ ID NO: 492679 - RNA, 64 nt, hsa
cucccgcaaugggcagagagagcagagacagguggaccaacagacagcuggccccuggaggcag

SEQ ID NO: 492680 - RNA, 64 nt, hsa
gaauguagggcccccagccucaccucugccccaggaccaacaacacccugguuuggagcuggga

SEQ ID NO: 492681 - RNA, 64 nt, hsa
ggaucaccugaggucaggaguucuagaccagccugaccaacauggagaaaccucgucucuacua

SEQ ID NO: 492682 - RNA, 57 nt, hsa
acauuguugaguggcacugaacaagcagaccaacaacacugaggaagauagaguggu

SEQ ID NO: 492683 - RNA, 61 nt, hsa
ugcggagcuggagccguagauuccgugccugccgccgcagcgccgccgacaacgcgggugc

SEQ ID NO: 492684 - RNA, 61 nt, hsa
ugccaacucacugagccgccugccgcuggggccgccgcacccugcaccuuggaccggcauc

SEQ ID NO: 492685 - RNA, 61 nt, hsa
acugaccccaucuccugccgccgcccuggggccgccgcagggaugccuugccuuuucagga

SEQ ID NO: 492686 - RNA, 61 nt, hsa
uuccuuccccuccacccucgccccgucuccgccgccgcaccccuguccagcuguugagcug

SEQ ID NO: 492687 - RNA, 61 nt, hsa
ugugcucagaggugguuguuggcggagaacgccgccgcaguguuugaccucuagcggugaa

SEQ ID NO: 492688 - RNA, 61 nt, hsa
caggggcugccccggaaucagcuccccggggccgccgcaacgaagguggauccgcaucuug

SEQ ID NO: 492689 - RNA, 61 nt, hsa
ggcugccuagcccuccccccagcucccugcaccgccgcagaagcagccccucgaggccuac

SEQ ID NO: 492690 - RNA, 61 nt, hsa
uccggucccgcuuccaguuuccuugaagcgcccgccgcacacgcccuauucagcaccagcu

SEQ ID NO: 492691 - RNA, 61 nt, hsa
caugcguguggaguguccgguggugcucgggccgccgcagugcagcgacugcccggcccuc

SEQ ID NO: 492692 - RNA, 61 nt, hsa
cuggaacccacugagcccuucccgggguuucccgccgcacucaguguguuccuucaggcua

SEQ ID NO: 492693 - RNA, 61 nt, hsa
cuccaccgcccgaggccugcgccgguggcucccgccgcaguugcguuugcuuuggaccuug

SEQ ID NO: 492694 - RNA, 61 nt, hsa
aagcccugugcuccggccauggccgcuguguccgccgcaccagccaccccaaagcccuccu

SEQ ID NO: 492695 - RNA, 61 nt, hsa
cuaaaaagcagacccaaguuuccuuucuccuccgccgcaaaggagaggcuucccagccccg

SEQ ID NO: 492696 - RNA, 61 nt, hsa
auguauauagcgaccagagcauucuuaauucccgccgcagaccuggcgcccccgccuuggc

SEQ ID NO: 492697 - RNA, 61 nt, hsa
uaccuacuuguacguacauguaaaacaaaucccgccgcaacuguuuucuguucuguuguuu

SEQ ID NO: 492698 - RNA, 55 nt, hsa
cgugccaguacaacagcugaccgccccgccgcaccacgcgggccggcggccggag

SEQ ID NO: 492699 - RNA, 61 nt, hsa
gucugaggaaaccuccaggcugaggaggucuccgccgcagccuugcuggagccgggucggg

SEQ ID NO: 492700 - RNA, 61 nt, hsa
agcugauuugcugcagggauggagaggaccaccgccgcaggguucuuuuaccugugccacc

SEQ ID NO: 492701 - RNA, 60 nt, hsa
ugcucuggcccagccgcugagcgcccgcacccgccgcaccccgaggccgccaauuguccg

SEQ ID NO: 492702 - RNA, 61 nt, hsa
aaggagcgcaccaaagcgcagagcuugcugcccgccgcacgcacgcgcgccugcgugcggg

SEQ ID NO: 492703 - RNA, 61 nt, hsa
gugaggagcucacagguccucccugguggucccgccgcaccucugcaucuccugggcguca

SEQ ID NO: 492704 - RNA, 61 nt, hsa
cuuauggagccccucccauggagcucucuucccgccgcacuuucuaccccgggcagaggcg

SEQ ID NO: 492705 - RNA, 61 nt, hsa
uccugugacggcggcgaggcuugggaggaaaccgccgcaaugggggugucuucccucgggg

SEQ ID NO: 492706 - RNA, 61 nt, hsa
agcugcacucagcaccuaggccaggguggggccgccgcagaugggcucaggaagccccagg

SEQ ID NO: 492707 - RNA, 50 nt, hsa
ccaagcucgacgccaaguagccgccgcacuuuccagcagggaucggagga

SEQ ID NO: 492708 - RNA, 61 nt, hsa
acucgcagccccaucggacgcucucccgggaccgccgcaggaccaguuuccauagacugcg

SEQ ID NO: 492709 - RNA, 61 nt, hsa
uugggggggaagacccucgcugcgccgcuucccgccgcagcgcccgcgccuccgaggggac

SEQ ID NO: 492710 - RNA, 61 nt, hsa
aaaagcauaacuggcuaagucaccgccccacccgccgcauuacauuuccuaaaacauacug

SEQ ID NO: 492711 - RNA, 61 nt, hsa
cgagcgcccgaacuggccaggacccccgcgcccgccgcacagcgcgcagccgggcgcucaa

SEQ ID NO: 492712 - RNA, 61 nt, hsa
agaaagccaugaagguggauauggacaucugccgccgcaucgacaucaccgccaagcucug

SEQ ID NO: 492713 - RNA, 61 nt, hsa
cuggugcagcggcagaugcuggggcuucagcccgccgcagacuucacagcuggccacaacg

SEQ ID NO: 492714 - RNA, 61 nt, hsa
cucccugugcgugugcgucucugccuuccguccgccgcacacccgccugccuggccgcagg

SEQ ID NO: 492715 - RNA, 61 nt, hsa
aaugacgaagcugcucagcaacuccaccugcccgccgcaggaaggagcaguccccugcuau

SEQ ID NO: 492716 - RNA, 55 nt, hsa
ucaagccuugcgugaugugaggcugccgccgcaggcccuccuggugcaggcaggc

SEQ ID NO: 492717 - RNA, 61 nt, hsa
cccaugcccuggaccagccgcccagaucaugccgccgcagcugguugggggcaccaucugg

SEQ ID NO: 492718 - RNA, 61 nt, hsa
uccugcuacagcuagugugcuuuuagacuuuccgccgcagacuacauuucuagaguuagag

SEQ ID NO: 492719 - RNA, 61 nt, hsa
ggaaccagcccuacauccgcgcagacacaggccgccgcagugcccgucggcgucccccggg

SEQ ID NO: 492720 - RNA, 61 nt, hsa
ucaccuggagcugggcacuaaccauuccaagccgccgcaucgcuuguuuccaccuccuggg

SEQ ID NO: 492721 - RNA, 61 nt, hsa
gaguucagcugugacguuagcuucaguggcuccgccgcauccucacacugacgggggcucc

SEQ ID NO: 492722 - RNA, 61 nt, hsa
uuuaaacacugaagugccgaaguggcccgugccgccgcacagagaccccgacuuuaguuug

SEQ ID NO: 492723 - RNA, 61 nt, hsa
acuguccccaugcccacggaugcucagcagcccgccgcacuggggcagaugucuccccugc

SEQ ID NO: 492724 - RNA, 61 nt, hsa
uccgcagggcgcccagcgccguccggcggccccgccgcagaccagcuggcggguguggaga

SEQ ID NO: 492725 - RNA, 61 nt, hsa
cgcagggacagcgcuggggaggugacggcgcccgccgcagguggggcgaggcugggggagg

SEQ ID NO: 492726 - RNA, 61 nt, hsa
ggccuucagaggcuccuccugggacugggaaccgccgcagggccaggcggacggcgugagg

SEQ ID NO: 492727 - RNA, 61 nt, hsa
cuccuaggaaucacagcuccccguacuggugccgccgcaguggccaaguugcgacacugcc

SEQ ID NO: 492728 - RNA, 61 nt, hsa
caagcacugcggccacucagcagcuauguucccgccgcaguggggcccugacgcccaccuc

SEQ ID NO: 492729 - RNA, 61 nt, hsa
gugugagccacagcacccaaccuuuuuuuccccgccgcaccccaagauggugucucacucu

SEQ ID NO: 492730 - RNA, 61 nt, hsa
ucucuggucaucgccugggaggaagaugccaccgccgcagcaaggucccugcggccaccac

SEQ ID NO: 492731 - RNA, 61 nt, hsa
uccuugccucccacaacaacuacgcccgcuaccgccgcaccugggcuggcugcgcggguuu

SEQ ID NO: 492732 - RNA, 61 nt, hsa
ccgcugccuuuugcugcugcugcugcggcgaccgccgcagggacggggacuggcccucccu

SEQ ID NO: 492733 - RNA, 61 nt, hsa
cacgcugucugcgcuggcuccacccgggaacccgccgcacgcuguguucuaggcccgccca

SEQ ID NO: 492734 - RNA, 61 nt, hsa
acuaccgcucugcuacuuaggcacagggacuccgccgcacgcugacggaccacgagggcug

SEQ ID NO: 492735 - RNA, 64 nt, hsa; identical to SEQ ID NO: 60398

SEQ ID NO: 492736 - RNA, 64 nt, hsa; identical to SEQ ID NO: 60399

SEQ ID NO: 492737 - RNA, 64 nt, hsa; identical to SEQ ID NO: 60400

SEQ ID NO: 492738 - RNA, 64 nt, hsa; identical to SEQ ID NO: 60401

SEQ ID NO: 492739 - RNA, 64 nt, hsa; identical to SEQ ID NO: 60402

SEQ ID NO: 492740 - RNA, 64 nt, hsa; identical to SEQ ID NO: 60403

SEQ ID NO: 492741 - RNA, 64 nt, hsa; identical to SEQ ID NO: 60404

SEQ ID NO: 492742 - RNA, 64 nt, hsa; identical to SEQ ID NO: 60405

SEQ ID NO: 492743 - RNA, 64 nt, hsa; identical to SEQ ID NO: 60406

SEQ ID NO: 492744 - RNA, 64 nt, hsa; identical to SEQ ID NO: 60407

SEQ ID NO: 492745 - RNA, 64 nt, hsa; identical to SEQ ID NO: 60408

SEQ ID NO: 492746 - RNA, 64 nt, hsa; identical to SEQ ID NO: 60409

SEQ ID NO: 492747 - RNA, 64 nt, hsa; identical to SEQ ID NO: 60410

SEQ ID NO: 492748 - RNA, 64 nt, hsa; identical to SEQ ID NO: 60411

SEQ ID NO: 492749 - RNA, 64 nt, hsa; identical to SEQ ID NO: 60412

SEQ ID NO: 492750 - RNA, 64 nt, hsa; identical to SEQ ID NO: 60413

SEQ ID NO: 492751 - RNA, 64 nt, hsa; identical to SEQ ID NO: 60414

SEQ ID NO: 492752 - RNA, 64 nt, hsa; identical to SEQ ID NO: 60415

SEQ ID NO: 492753 - RNA, 64 nt, hsa; identical to SEQ ID NO: 60416

SEQ ID NO: 492754 - RNA, 64 nt, hsa; identical to SEQ ID NO: 60417

SEQ ID NO: 492755 - RNA, 64 nt, hsa; identical to SEQ ID NO: 60418

SEQ ID NO: 492756 - RNA, 64 nt, hsa; identical to SEQ ID NO: 60419

SEQ ID NO: 492757 - RNA, 64 nt, hsa; identical to SEQ ID NO: 60420

SEQ ID NO: 492758 - RNA, 64 nt, hsa; identical to SEQ ID NO: 60421

SEQ ID NO: 492759 - RNA, 64 nt, hsa; identical to SEQ ID NO: 60422

SEQ ID NO: 492760 - RNA, 64 nt, hsa; identical to SEQ ID NO: 60423

SEQ ID NO: 492761 - RNA, 64 nt, hsa; identical to SEQ ID NO: 60424

SEQ ID NO: 492762 - RNA, 64 nt, hsa; identical to SEQ ID NO: 60425

SEQ ID NO: 492763 - RNA, 64 nt, hsa; identical to SEQ ID NO: 60426

SEQ ID NO: 492764 - RNA, 64 nt, hsa; identical to SEQ ID NO: 60427

SEQ ID NO: 492765 - RNA, 64 nt, hsa; identical to SEQ ID NO: 60428

SEQ ID NO: 492766 - RNA, 64 nt, hsa; identical to SEQ ID NO: 60429

SEQ ID NO: 492767 - RNA, 64 nt, hsa; identical to SEQ ID NO: 60430

SEQ ID NO: 492768 - RNA, 64 nt, hsa; identical to SEQ ID NO: 60431

SEQ ID NO: 492769 - RNA, 64 nt, hsa; identical to SEQ ID NO: 60432

SEQ ID NO: 492770 - RNA, 64 nt, hsa; identical to SEQ ID NO: 60433

SEQ ID NO: 492771 - RNA, 64 nt, hsa; identical to SEQ ID NO: 60434

SEQ ID NO: 492772 - RNA, 64 nt, hsa; identical to SEQ ID NO: 60435

SEQ ID NO: 492773 - RNA, 64 nt, hsa; identical to SEQ ID NO: 60436

SEQ ID NO: 492774 - RNA, 64 nt, hsa; identical to SEQ ID NO: 60437

SEQ ID NO: 492775 - RNA, 64 nt, hsa; identical to SEQ ID NO: 60438

SEQ ID NO: 492776 - RNA, 64 nt, hsa; identical to SEQ ID NO: 60439

SEQ ID NO: 492777 - RNA, 64 nt, hsa; identical to SEQ ID NO: 60440

SEQ ID NO: 492778 - RNA, 64 nt, hsa; identical to SEQ ID NO: 60441

SEQ ID NO: 492779 - RNA, 64 nt, hsa; identical to SEQ ID NO: 60442

SEQ ID NO: 492780 - RNA, 64 nt, hsa; identical to SEQ ID NO: 60443

SEQ ID NO: 492781 - RNA, 64 nt, hsa; identical to SEQ ID NO: 60444

SEQ ID NO: 492782 - RNA, 64 nt, hsa; identical to SEQ ID NO: 60445

SEQ ID NO: 492783 - RNA, 64 nt, hsa; identical to SEQ ID NO: 60446

SEQ ID NO: 492784 - RNA, 64 nt, hsa; identical to SEQ ID NO: 60447

SEQ ID NO: 492785 - RNA, 64 nt, hsa; identical to SEQ ID NO: 55930

SEQ ID NO: 492786 - RNA, 64 nt, hsa; identical to SEQ ID NO: 55931

SEQ ID NO: 492787 - RNA, 64 nt, hsa; identical to SEQ ID NO: 55932

SEQ ID NO: 492788 - RNA, 64 nt, hsa; identical to SEQ ID NO: 55933

SEQ ID NO: 492789 - RNA, 64 nt, hsa; identical to SEQ ID NO: 55934

SEQ ID NO: 492790 - RNA, 64 nt, hsa; identical to SEQ ID NO: 55935

SEQ ID NO: 492791 - RNA, 64 nt, hsa; identical to SEQ ID NO: 55936

SEQ ID NO: 492792 - RNA, 64 nt, hsa; identical to SEQ ID NO: 55937

SEQ ID NO: 492793 - RNA, 64 nt, hsa; identical to SEQ ID NO: 55938

SEQ ID NO: 492794 - RNA, 64 nt, hsa; identical to SEQ ID NO: 55939

SEQ ID NO: 492795 - RNA, 64 nt, hsa; identical to SEQ ID NO: 55940

SEQ ID NO: 492796 - RNA, 64 nt, hsa; identical to SEQ ID NO: 55941

SEQ ID NO: 492797 - RNA, 64 nt, hsa; identical to SEQ ID NO: 55942

SEQ ID NO: 492798 - RNA, 64 nt, hsa; identical to SEQ ID NO: 55943

SEQ ID NO: 492799 - RNA, 64 nt, hsa; identical to SEQ ID NO: 55944

SEQ ID NO: 492800 - RNA, 64 nt, hsa; identical to SEQ ID NO: 55945

SEQ ID NO: 492801 - RNA, 64 nt, hsa; identical to SEQ ID NO: 55946

SEQ ID NO: 492802 - RNA, 64 nt, hsa; identical to SEQ ID NO: 55947

SEQ ID NO: 492803 - RNA, 64 nt, hsa; identical to SEQ ID NO: 55948

SEQ ID NO: 492804 - RNA, 64 nt, hsa; identical to SEQ ID NO: 55949

SEQ ID NO: 492805 - RNA, 64 nt, hsa; identical to SEQ ID NO: 55950

SEQ ID NO: 492806 - RNA, 64 nt, hsa; identical to SEQ ID NO: 55951

SEQ ID NO: 492807 - RNA, 64 nt, hsa; identical to SEQ ID NO: 55952

SEQ ID NO: 492808 - RNA, 64 nt, hsa; identical to SEQ ID NO: 55953

SEQ ID NO: 492809 - RNA, 64 nt, hsa; identical to SEQ ID NO: 55954

SEQ ID NO: 492810 - RNA, 64 nt, hsa; identical to SEQ ID NO: 55955

SEQ ID NO: 492811 - RNA, 64 nt, hsa; identical to SEQ ID NO: 55956

SEQ ID NO: 492812 - RNA, 64 nt, hsa; identical to SEQ ID NO: 55957

SEQ ID NO: 492813 - RNA, 64 nt, hsa; identical to SEQ ID NO: 55958

SEQ ID NO: 492814 - RNA, 64 nt, hsa; identical to SEQ ID NO: 55959

SEQ ID NO: 492815 - RNA, 64 nt, hsa; identical to SEQ ID NO: 55960

SEQ ID NO: 492816 - RNA, 64 nt, hsa; identical to SEQ ID NO: 295086

SEQ ID NO: 492817 - RNA, 64 nt, hsa; identical to SEQ ID NO: 295087

SEQ ID NO: 492818 - RNA, 64 nt, hsa; identical to SEQ ID NO: 295088

SEQ ID NO: 492819 - RNA, 64 nt, hsa; identical to SEQ ID NO: 295089

SEQ ID NO: 492820 - RNA, 64 nt, hsa; identical to SEQ ID NO: 295090

SEQ ID NO: 492821 - RNA, 64 nt, hsa; identical to SEQ ID NO: 295091

SEQ ID NO: 492822 - RNA, 64 nt, hsa; identical to SEQ ID NO: 295092

SEQ ID NO: 492823 - RNA, 64 nt, hsa; identical to SEQ ID NO: 295093

SEQ ID NO: 492824 - RNA, 64 nt, hsa; identical to SEQ ID NO: 295094

SEQ ID NO: 492825 - RNA, 64 nt, hsa; identical to SEQ ID NO: 295095

SEQ ID NO: 492826 - RNA, 64 nt, hsa; identical to SEQ ID NO: 295096

SEQ ID NO: 492827 - RNA, 64 nt, hsa; identical to SEQ ID NO: 295097

SEQ ID NO: 492828 - RNA, 64 nt, hsa; identical to SEQ ID NO: 295098

SEQ ID NO: 492829 - RNA, 64 nt, hsa; identical to SEQ ID NO: 295099

SEQ ID NO: 492830 - RNA, 64 nt, hsa; identical to SEQ ID NO: 295100

SEQ ID NO: 492831 - RNA, 64 nt, hsa; identical to SEQ ID NO: 295101

SEQ ID NO: 492832 - RNA, 64 nt, hsa; identical to SEQ ID NO: 295102

SEQ ID NO: 492833 - RNA, 64 nt, hsa; identical to SEQ ID NO: 295103

SEQ ID NO: 492834 - RNA, 64 nt, hsa; identical to SEQ ID NO: 295104

SEQ ID NO: 492835 - RNA, 64 nt, hsa; identical to SEQ ID NO: 295105

SEQ ID NO: 492836 - RNA, 64 nt, hsa; identical to SEQ ID NO: 295106

SEQ ID NO: 492837 - RNA, 64 nt, hsa; identical to SEQ ID NO: 295107

SEQ ID NO: 492838 - RNA, 64 nt, hsa; identical to SEQ ID NO: 295108

SEQ ID NO: 492839 - RNA, 64 nt, hsa; identical to SEQ ID NO: 295109

SEQ ID NO: 492840 - RNA, 64 nt, hsa; identical to SEQ ID NO: 295110

SEQ ID NO: 492841 - RNA, 64 nt, hsa; identical to SEQ ID NO: 295111

SEQ ID NO: 492842 - RNA, 64 nt, hsa; identical to SEQ ID NO: 295112

SEQ ID NO: 492843 - RNA, 64 nt, hsa; identical to SEQ ID NO: 295113

SEQ ID NO: 492844 - RNA, 64 nt, hsa; identical to SEQ ID NO: 295114

SEQ ID NO: 492845 - RNA, 64 nt, hsa; identical to SEQ ID NO: 295115

SEQ ID NO: 492846 - RNA, 64 nt, hsa; identical to SEQ ID NO: 295116

SEQ ID NO: 492847 - RNA, 64 nt, hsa; identical to SEQ ID NO: 295117

SEQ ID NO: 492848 - RNA, 64 nt, hsa; identical to SEQ ID NO: 295118

SEQ ID NO: 492849 - RNA, 64 nt, hsa; identical to SEQ ID NO: 295119

SEQ ID NO: 492850 - RNA, 64 nt, hsa
gauuauucuaaucuaauaagacaaguuuguggaaaugcaagaugaauacaagccuuggguccau

SEQ ID NO: 492851 - RNA, 64 nt, hsa
gagguaggaaagagaagauguucuuauucagauaaugcaagagaagcaauucgucaguuucacu

SEQ ID NO: 492852 - RNA, 64 nt, hsa
uuggcaggcucguuguaccucuuggaaaaccucaaugcaagauaguguuucagugcuggcauau

SEQ ID NO: 492853 - RNA, 64 nt, hsa
auguccaguuuauacaguuuacaaaauauagcagaugcaagauuaugggggaaauccuauauuc

SEQ ID NO: 492854 - RNA, 64 nt, hsa
aucuucuggugaaggaaauuaaugauguaagaaaaugcaagaggcucaacuucucuuccaaaaa

SEQ ID NO: 492855 - RNA, 64 nt, hsa
uucucacauucuagacaaugauggacaaagacgcaugcaagacucagacccggggaauggugug

SEQ ID NO: 492856 - RNA, 64 nt, hsa
caaaaucuguacaaaaaucuguuuuuacaucauaaugcaagaauuggaaauuuuucuaugguag

SEQ ID NO: 492857 - RNA, 64 nt, hsa
uguagggggcauagaggauucuugaaaaaaaaaaaugcaagagugauuuucuguuacauucaau

SEQ ID NO: 492858 - RNA, 64 nt, hsa
ccugccaugaugagugugaagaaaucauuucucuaugcaagacuggcauccugggacugcacga

SEQ ID NO: 492859 - RNA, 64 nt, hsa
cugccauaagcgugcuuucauuuucaaguagcauaugcaagaguccaaacaggcuacccaaugu

SEQ ID NO: 492860 - RNA, 64 nt, hsa
auuacuuuuauuauauuguuuacaaauauauuucaugcaagaaacagaaaaaaaaaaaaacccu

SEQ ID NO: 492861 - RNA, 64 nt, hsa
agauaaacuauaggauagauagaaugguuauuuuaugcaagaaauauuguaccgcaaggguggu

SEQ ID NO: 492862 - RNA, 64 nt, hsa
cuauuugcuguaaugucaagaaaauguucaccagaugcaagaauguaccuuuucuuuuuagaaa

SEQ ID NO: 492863 - RNA, 64 nt, hsa; identical to SEQ ID NO: 247253

SEQ ID NO: 492864 - RNA, 64 nt, hsa; identical to SEQ ID NO: 247254

SEQ ID NO: 492865 - RNA, 64 nt, hsa; identical to SEQ ID NO: 247255

SEQ ID NO: 492866 - RNA, 64 nt, hsa; identical to SEQ ID NO: 247256

SEQ ID NO: 492867 - RNA, 64 nt, hsa; identical to SEQ ID NO: 247257

SEQ ID NO: 492868 - RNA, 64 nt, hsa; identical to SEQ ID NO: 247258

SEQ ID NO: 492869 - RNA, 64 nt, hsa; identical to SEQ ID NO: 247259

SEQ ID NO: 492870 - RNA, 64 nt, hsa; identical to SEQ ID NO: 247260

SEQ ID NO: 492871 - RNA, 64 nt, hsa; identical to SEQ ID NO: 247261

SEQ ID NO: 492872 - RNA, 64 nt, hsa; identical to SEQ ID NO: 247262

SEQ ID NO: 492873 - RNA, 64 nt, hsa; identical to SEQ ID NO: 247263

SEQ ID NO: 492874 - RNA, 64 nt, hsa; identical to SEQ ID NO: 247264

SEQ ID NO: 492875 - RNA, 64 nt, hsa; identical to SEQ ID NO: 247265

SEQ ID NO: 492876 - RNA, 64 nt, hsa; identical to SEQ ID NO: 247266

SEQ ID NO: 492877 - RNA, 64 nt, hsa; identical to SEQ ID NO: 247267

SEQ ID NO: 492878 - RNA, 58 nt, hsa; identical to SEQ ID NO: 199452

SEQ ID NO: 492879 - RNA, 64 nt, hsa; identical to SEQ ID NO: 247269

SEQ ID NO: 492880 - RNA, 64 nt, hsa; identical to SEQ ID NO: 247270

SEQ ID NO: 492881 - RNA, 64 nt, hsa; identical to SEQ ID NO: 247271

SEQ ID NO: 492882 - RNA, 64 nt, hsa; identical to SEQ ID NO: 247272

SEQ ID NO: 492883 - RNA, 55 nt, hsa; identical to SEQ ID NO: 199457

SEQ ID NO: 492884 - RNA, 64 nt, hsa; identical to SEQ ID NO: 247274

SEQ ID NO: 492885 - RNA, 64 nt, hsa
aauauauucaaauguauuacaagguacauaaacacauaaacauguagaccgcuuuauaggcuuc

SEQ ID NO: 492886 - RNA, 64 nt, hsa
aaaauuaaaauauauucaaauguauuacaagguacauaaacacauaaacauguagaccgcuuua

SEQ ID NO: 492887 - RNA, 64 nt, hsa
uaaacuagagccuuaagucaaucucagaagguagcauaaacaaauaaaaauuaacuguauggca

SEQ ID NO: 492888 - RNA, 64 nt, hsa
uucuuacaagaggcagaaacaagacaggcuaguucauaaacaaacuguguaacuucucaaaaug

SEQ ID NO: 492889 - RNA, 64 nt, hsa
caguuuaaaaaguaaauauauauucuaucguauucauaaacaauaucuaucaaauggguuaccu

SEQ ID NO: 492890 - RNA, 64 nt, hsa
uuuuacaucauuucuauguucgguuguuuuuaggcauaaacaauguguauugcagugcauuucg

SEQ ID NO: 492891 - RNA, 64 nt, hsa
cgguuugaccccugaccuauaagccaagauaccccauaaacacacucagaaagcagagaaaaag

SEQ ID NO: 492892 - RNA, 64 nt, hsa
ccccagguugugacaggugcagguagacaacgcccauaaacagagaugguccugaacucuggag

SEQ ID NO: 492893 - RNA, 64 nt, hsa
gauaucaugaucacaggugauucacacguacacacauaaacacacccaccagugcagccugaag

SEQ ID NO: 492894 - RNA, 64 nt, hsa
aaggcuuuucuuuuauuacaucuaaagagcucuacauaaacagguaacauucaauagguaaaca

SEQ ID NO: 492895 - RNA, 64 nt, hsa
aacagauauagugacauagcucaggcuauucauucauaaacacagaguguagagugaaaacacu

SEQ ID NO: 492896 - RNA, 64 nt, hsa
uguacuuguuucaucugguuuuauuacucucacccauaaacaguaaugacucucugacccucug

SEQ ID NO: 492897 - RNA, 64 nt, hsa
uaaccaacaauauaaaccguggucucauguaacacauaaacaauucaugccuuucauaguuuau

SEQ ID NO: 492898 - RNA, 64 nt, hsa; identical to SEQ ID NO: 132617

SEQ ID NO: 492899 - RNA, 64 nt, hsa; identical to SEQ ID NO: 132618

SEQ ID NO: 492900 - RNA, 64 nt, hsa; identical to SEQ ID NO: 132619

SEQ ID NO: 492901 - RNA, 64 nt, hsa; identical to SEQ ID NO: 132620

SEQ ID NO: 492902 - RNA, 64 nt, hsa; identical to SEQ ID NO: 132621

SEQ ID NO: 492903 - RNA, 64 nt, hsa; identical to SEQ ID NO: 132622

SEQ ID NO: 492904 - RNA, 64 nt, hsa; identical to SEQ ID NO: 132623

SEQ ID NO: 492905 - RNA, 64 nt, hsa; identical to SEQ ID NO: 132624

SEQ ID NO: 492906 - RNA, 64 nt, hsa; identical to SEQ ID NO: 132625

SEQ ID NO: 492907 - RNA, 64 nt, hsa; identical to SEQ ID NO: 132626

SEQ ID NO: 492908 - RNA, 64 nt, hsa; identical to SEQ ID NO: 132627

SEQ ID NO: 492909 - RNA, 64 nt, hsa; identical to SEQ ID NO: 132628

SEQ ID NO: 492910 - RNA, 64 nt, hsa; identical to SEQ ID NO: 132629

SEQ ID NO: 492911 - RNA, 64 nt, hsa; identical to SEQ ID NO: 132630

SEQ ID NO: 492912 - RNA, 64 nt, hsa; identical to SEQ ID NO: 132631

SEQ ID NO: 492913 - RNA, 64 nt, hsa; identical to SEQ ID NO: 132632

SEQ ID NO: 492914 - RNA, 64 nt, hsa; identical to SEQ ID NO: 132633

SEQ ID NO: 492915 - RNA, 64 nt, hsa; identical to SEQ ID NO: 132634

SEQ ID NO: 492916 - RNA, 64 nt, hsa; identical to SEQ ID NO: 132635

SEQ ID NO: 492917 - RNA, 64 nt, hsa; identical to SEQ ID NO: 132636

SEQ ID NO: 492918 - RNA, 64 nt, hsa; identical to SEQ ID NO: 132637

SEQ ID NO: 492919 - RNA, 64 nt, hsa; identical to SEQ ID NO: 132638

SEQ ID NO: 492920 - RNA, 64 nt, hsa; identical to SEQ ID NO: 132639

SEQ ID NO: 492921 - RNA, 64 nt, hsa; identical to SEQ ID NO: 132640

SEQ ID NO: 492922 - RNA, 64 nt, hsa; identical to SEQ ID NO: 132641

SEQ ID NO: 492923 - RNA, 64 nt, hsa; identical to SEQ ID NO: 132642

SEQ ID NO: 492924 - RNA, 64 nt, hsa; identical to SEQ ID NO: 132643

SEQ ID NO: 492925 - RNA, 64 nt, hsa; identical to SEQ ID NO: 132644

SEQ ID NO: 492926 - RNA, 64 nt, hsa; identical to SEQ ID NO: 132645

SEQ ID NO: 492927 - RNA, 64 nt, hsa; identical to SEQ ID NO: 132646

SEQ ID NO: 492928 - RNA, 64 nt, hsa; identical to SEQ ID NO: 132647

SEQ ID NO: 492929 - RNA, 64 nt, hsa; identical to SEQ ID NO: 132648

SEQ ID NO: 492930 - RNA, 64 nt, hsa; identical to SEQ ID NO: 132649

SEQ ID NO: 492931 - RNA, 64 nt, hsa; identical to SEQ ID NO: 132650

SEQ ID NO: 492932 - RNA, 64 nt, hsa; identical to SEQ ID NO: 132651

SEQ ID NO: 492933 - RNA, 64 nt, hsa; identical to SEQ ID NO: 132652

SEQ ID NO: 492934 - RNA, 64 nt, hsa; identical to SEQ ID NO: 132653

SEQ ID NO: 492935 - RNA, 64 nt, hsa; identical to SEQ ID NO: 132654

SEQ ID NO: 492936 - RNA, 64 nt, hsa; identical to SEQ ID NO: 132655

SEQ ID NO: 492937 - RNA, 64 nt, hsa; identical to SEQ ID NO: 132656

SEQ ID NO: 492938 - RNA, 64 nt, hsa; identical to SEQ ID NO: 132657

SEQ ID NO: 492939 - RNA, 64 nt, hsa; identical to SEQ ID NO: 132658

SEQ ID NO: 492940 - RNA, 64 nt, hsa; identical to SEQ ID NO: 132659

SEQ ID NO: 492941 - RNA, 64 nt, hsa; identical to SEQ ID NO: 132660

SEQ ID NO: 492942 - RNA, 64 nt, hsa; identical to SEQ ID NO: 132661

SEQ ID NO: 492943 - RNA, 64 nt, hsa; identical to SEQ ID NO: 132662

SEQ ID NO: 492944 - RNA, 64 nt, hsa; identical to SEQ ID NO: 132663

SEQ ID NO: 492945 - RNA, 64 nt, hsa; identical to SEQ ID NO: 132664

SEQ ID NO: 492946 - RNA, 64 nt, hsa; identical to SEQ ID NO: 132665

SEQ ID NO: 492947 - RNA, 64 nt, hsa; identical to SEQ ID NO: 132666

SEQ ID NO: 492948 - RNA, 64 nt, hsa; identical to SEQ ID NO: 132667

SEQ ID NO: 492949 - RNA, 64 nt, hsa; identical to SEQ ID NO: 132668

SEQ ID NO: 492950 - RNA, 64 nt, hsa; identical to SEQ ID NO: 132669

SEQ ID NO: 492951 - RNA, 64 nt, hsa; identical to SEQ ID NO: 132670

SEQ ID NO: 492952 - RNA, 64 nt, hsa; identical to SEQ ID NO: 132671

SEQ ID NO: 492953 - RNA, 64 nt, hsa; identical to SEQ ID NO: 132672

SEQ ID NO: 492954 - RNA, 64 nt, hsa; identical to SEQ ID NO: 132673

SEQ ID NO: 492955 - RNA, 64 nt, hsa; identical to SEQ ID NO: 132674

SEQ ID NO: 492956 - RNA, 64 nt, hsa; identical to SEQ ID NO: 132675

SEQ ID NO: 492957 - RNA, 64 nt, hsa; identical to SEQ ID NO: 132676

SEQ ID NO: 492958 - RNA, 64 nt, hsa; identical to SEQ ID NO: 132677

SEQ ID NO: 492959 - RNA, 57 nt, hsa; identical to SEQ ID NO: 132678

SEQ ID NO: 492960 - RNA, 64 nt, hsa; identical to SEQ ID NO: 132679

SEQ ID NO: 492961 - RNA, 64 nt, hsa; identical to SEQ ID NO: 132680

SEQ ID NO: 492962 - RNA, 64 nt, hsa; identical to SEQ ID NO: 132681

SEQ ID NO: 492963 - RNA, 64 nt, hsa; identical to SEQ ID NO: 132682

SEQ ID NO: 492964 - RNA, 64 nt, hsa; identical to SEQ ID NO: 132683

SEQ ID NO: 492965 - RNA, 64 nt, hsa; identical to SEQ ID NO: 132684

SEQ ID NO: 492966 - RNA, 64 nt, hsa; identical to SEQ ID NO: 132685

SEQ ID NO: 492967 - RNA, 64 nt, hsa; identical to SEQ ID NO: 132686

SEQ ID NO: 492968 - RNA, 64 nt, hsa; identical to SEQ ID NO: 132687

SEQ ID NO: 492969 - RNA, 64 nt, hsa; identical to SEQ ID NO: 132688

SEQ ID NO: 492970 - RNA, 64 nt, hsa; identical to SEQ ID NO: 132689

SEQ ID NO: 492971 - RNA, 64 nt, hsa; identical to SEQ ID NO: 132690

SEQ ID NO: 492972 - RNA, 55 nt, hsa; identical to SEQ ID NO: 132691

SEQ ID NO: 492973 - RNA, 64 nt, hsa; identical to SEQ ID NO: 132692

SEQ ID NO: 492974 - RNA, 64 nt, hsa; identical to SEQ ID NO: 132693

SEQ ID NO: 492975 - RNA, 64 nt, hsa; identical to SEQ ID NO: 132694

SEQ ID NO: 492976 - RNA, 64 nt, hsa; identical to SEQ ID NO: 132695

SEQ ID NO: 492977 - RNA, 64 nt, hsa; identical to SEQ ID NO: 132696

SEQ ID NO: 492978 - RNA, 64 nt, hsa; identical to SEQ ID NO: 132697

SEQ ID NO: 492979 - RNA, 64 nt, hsa; identical to SEQ ID NO: 132698

SEQ ID NO: 492980 - RNA, 64 nt, hsa; identical to SEQ ID NO: 132699

SEQ ID NO: 492981 - RNA, 64 nt, hsa; identical to SEQ ID NO: 132700

SEQ ID NO: 492982 - RNA, 64 nt, hsa; identical to SEQ ID NO: 132701

SEQ ID NO: 492983 - RNA, 64 nt, hsa; identical to SEQ ID NO: 132702

SEQ ID NO: 492984 - RNA, 64 nt, hsa; identical to SEQ ID NO: 132703

SEQ ID NO: 492985 - RNA, 64 nt, hsa; identical to SEQ ID NO: 132704

SEQ ID NO: 492986 - RNA, 64 nt, hsa; identical to SEQ ID NO: 132705

SEQ ID NO: 492987 - RNA, 64 nt, hsa; identical to SEQ ID NO: 132706

SEQ ID NO: 492988 - RNA, 64 nt, hsa; identical to SEQ ID NO: 132707

SEQ ID NO: 492989 - RNA, 64 nt, hsa; identical to SEQ ID NO: 132708

SEQ ID NO: 492990 - RNA, 64 nt, hsa; identical to SEQ ID NO: 132709

SEQ ID NO: 492991 - RNA, 64 nt, hsa; identical to SEQ ID NO: 132710

SEQ ID NO: 492992 - RNA, 64 nt, hsa; identical to SEQ ID NO: 132711

SEQ ID NO: 492993 - RNA, 64 nt, hsa; identical to SEQ ID NO: 132712

SEQ ID NO: 492994 - RNA, 64 nt, hsa
gccugagccacugugcccagccuuguuugcuuuuuuaacagauaacagugugcucauagaaacu

SEQ ID NO: 492995 - RNA, 64 nt, hsa
uggaaaaugaauaagcgguuuucuuaggcacuucuuaacagacaauuggucaaaaugaacucca

SEQ ID NO: 492996 - RNA, 64 nt, hsa
uacaagauaaaauuggacuucauuuaguaucuuuuuaacagaauuacuuggaauaaugagauac

SEQ ID NO: 492997 - RNA, 64 nt, hsa
cauuuuggaaauuuuuuuaauuuuacaaguacauuuaacagaucauuuauaaagcaggagucca

SEQ ID NO: 492998 - RNA, 64 nt, hsa
guuguuuuaacagaugccaauuacgguguacaguuuaacagaguuuucuguugcauuacgauaa

SEQ ID NO: 492999 - RNA, 64 nt, hsa
agagaaaugcuguucguucaaaaguggaguuguuuuaacagaugccaauuacgguguacaguuu

SEQ ID NO: 493000 - RNA, 64 nt, hsa
gagcuuuuaccacuagacucaaggaagaauaauuuuaacagacauguauacuccauagaaacua

SEQ ID NO: 493001 - RNA, 64 nt, hsa
gguauuuuugaagucuccuuuugucugauagaguuuaacagauauuuaaauuuagugcucagaa

SEQ ID NO: 493002 - RNA, 64 nt, hsa
uucuuuuuuuuuuaauugggggaaauaagcacuauuaacagauucagcacuacaaguauuuuga

SEQ ID NO: 493003 - RNA, 64 nt, hsa
cacaucugccuuaaaagugcuauguagagauacauuaacagaguuauaauaaaacaguguuuua

SEQ ID NO: 493004 - RNA, 64 nt, hsa
uauguguugaaguaacagcuugugcccgagaaacuuaacagaugaguucuugaaucugggauga

SEQ ID NO: 493005 - RNA, 64 nt, hsa
caggcagucuguggccuccuguagcagggcgcucuuaacagacucagguguaagguuuggaucc

SEQ ID NO: 493006 - RNA, 64 nt, hsa
ccuccauuuuugccuucgaaugcauauuuaagaguuaacagaaugaaaaaaaaaagucuuguug

SEQ ID NO: 493007 - RNA, 64 nt, hsa
uuagaugaaucagugcccaagacauauuuucuguuuaacagaacuuucuacagauacauuuuuu

SEQ ID NO: 493008 - RNA, 64 nt, hsa
uuuguccuaacucagauuuugugagcagugaaguuuaacagagcagugacauuuaacaaagcag

SEQ ID NO: 493009 - RNA, 64 nt, hsa
aacagagcagugacauuuaacaaagcagugaaguuuaacagaguucugagaauaccaugaaaga

SEQ ID NO: 493010 - RNA, 64 nt, hsa
agcaagauccaaauugauuuugggauauuaaaaguuaacagaacacugaacaaggaaagaaugg

SEQ ID NO: 493011 - RNA, 64 nt, hsa
aauaucuuuuauguccucuagauaaaacacccgauuaacagauguuaaaccuuuuaauguuuug

SEQ ID NO: 493012 - RNA, 64 nt, hsa
aaauguaaguuauguguuaaauuuagugcaagcuuuaacagacuaaguugcuaaccucaauuua

SEQ ID NO: 493013 - RNA, 64 nt, hsa
cuuuaacagacuaaguugcuaaccucaauuuauguuaacagaugauccauuugaacaguuggcu

SEQ ID NO: 493014 - RNA, 64 nt, hsa
caggaaaaccaguauuaagcaaauaccaccauccuuaacagaaacaaaaauauauauauauauu

SEQ ID NO: 493015 - RNA, 64 nt, hsa
aggcugaacagaagggcuaguguauugauuacacuuaacagaucauauuuauccagacucagua

SEQ ID NO: 493016 - RNA, 64 nt, hsa
cccuauccccaaccccucagagcagauucccagauuaacagauuuccauaucaccccaaaugau

SEQ ID NO: 493017 - RNA, 64 nt, hsa
uguuagccagcccucgaucauugaggccccauuauuaacagauacucccauaauaacccccaaa

SEQ ID NO: 493018 - RNA, 64 nt, hsa
acaucacaggugauguccuguucacauaccugcuuguauuuaaagcccucagucuguccuguug

SEQ ID NO: 493019 - RNA, 64 nt, hsa
cgcaagacgugcugacacagugaguuuucucugauguauuuaaggugauguauuugcuugaguu

SEQ ID NO: 493020 - RNA, 64 nt, hsa
uuccuuugggacuaaguuauaguuauggugaguguguauuuacuguaguuuugccugaucucac

SEQ ID NO: 493021 - RNA, 64 nt, hsa
ggaggaugaacuugcugaaaauaaaacuuugcuauguauuuacucuuuuuuaaaagacaaaagc

SEQ ID NO: 493022 - RNA, 64 nt, hsa
cuuaagaaaaccaauguucuaaaucauaauuguuuguauuuauguaaaguauggucucuuacuu

SEQ ID NO: 493023 - RNA, 64 nt, hsa
uagggcauuuaacaaagaucgcuaugugcaauacuguauuuaguguuucuauuucaauuuuucu

SEQ ID NO: 493024 - RNA, 64 nt, hsa
agucagcacacaagugauuuuauuguuauuuuguuguauuuacuugcauuuguuguauuuacuu

SEQ ID NO: 493025 - RNA, 64 nt, hsa
uuauuguuauuuuguuguauuuacuugcauuuguuguauuuacuuucaucugcagcauuuggag

SEQ ID NO: 493026 - RNA, 64 nt, hsa
gccuuugaagugacucauuuuuuuaauguauuuauguauuuauuugauuguuuuauauaagaug

SEQ ID NO: 493027 - RNA, 64 nt, hsa
cuguggccgccuuugaagugacucauuuuuuuaauguauuuauguauuuauuugauuguuuuau

SEQ ID NO: 493028 - RNA, 64 nt, hsa
cauccuguaagugcuuaaucauaucuuuuaauuguguauuuaagaaaaguguuuucacaacaaa

SEQ ID NO: 493029 - RNA, 64 nt, hsa
uggcauuugaagaggagaacaaaauguagcaugauguauuuaaaguaaggccuuuaguaaugaa

SEQ ID NO: 493030 - RNA, 64 nt, hsa
aauguuuacauaauggccagaaggcuugcaaaucuguauuuaauugcauuuuaauuaauugcca

SEQ ID NO: 493031 - RNA, 64 nt, hsa
ggacugccaaaucauggguuuugccuuuuguuguuguauuuauccucuguugguaauacugaau

SEQ ID NO: 493032 - RNA, 64 nt, hsa
uguguguguaugucugauugcacggguguacuuuuguauuuaugugugugugugguugcacggg

SEQ ID NO: 493033 - RNA, 64 nt, hsa
gggcaucugguguuuaugugucugaguguagcuuuguauuuauguguguguguguguguauguc

SEQ ID NO: 493034 - RNA, 64 nt, hsa
acugugugcuccagcaaauguccauuuguguaaauguauuuauuuuauauuguauauauuguua

SEQ ID NO: 493035 - RNA, 64 nt, hsa
uaguuacacuuguguuucaaucagaucagauuguuguauuuauuccacuauuuugcauuuaaau

SEQ ID NO: 493036 - RNA, 64 nt, hsa
uggcccuguaagauggacucuuucauccuucaguuguauuuagcuuugaguuucucugcaucug

SEQ ID NO: 493037 - RNA, 64 nt, hsa
gguuuuuguuuucuguuuuuuuuuucucuuuuuuuguauuuaccgugcuaguucucuucuacac

SEQ ID NO: 493038 - RNA, 64 nt, hsa
agacuacaggugcacaccaccaagccuggcuuuauguauuuauuucuguucaugcggaaugauu

SEQ ID NO: 493039 - RNA, 64 nt, hsa
agcauuucuuuaaggaugaccggauguugccguauguauuuauggcacaagcagguguugucua

SEQ ID NO: 493040 - RNA, 64 nt, hsa
uggcuuuugaaugaguguaaauuguuuucuuuuguguauuuauacuuguauguaugauuugcau

SEQ ID NO: 493041 - RNA, 64 nt, hsa
aaaaaagaaaagauuacugacugugcauuguaccuguauuuauaguuuaugguuaucaggaagc

SEQ ID NO: 493042 - RNA, 64 nt, hsa
cugugccguaaggauugcaucggacuaaacuaucuguauuuauuauuugaagcgagucauuucg

SEQ ID NO: 493043 - RNA, 64 nt, hsa
cauuucguucccugauuauuuauccuugucugaauguauuuauguguauauuuguagauuuauc

SEQ ID NO: 493044 - RNA, 64 nt, hsa
uuucuguagaagaaaaagguuuaaauuuaaaauguguauuuagagcauggagagaaucauuuaa

SEQ ID NO: 493045 - RNA, 64 nt, hsa
cacuggauaagccuucuccuuucauaagaaaggauguauuuaaauacauuuuauuuugcuaaau

SEQ ID NO: 493046 - RNA, 64 nt, hsa
cauuuuuuuacuuuguaguuuauuuuuuagugaauguauuuaauuuuaugaauuauuuaugauu

SEQ ID NO: 493047 - RNA, 64 nt, hsa
cuaaacaaggacaaaugagaccagcaaugugaacuguauuuacauaaacgugcaaggcacauac

SEQ ID NO: 493048 - RNA, 64 nt, hsa
gcuaaugacuugugugugcugauguguuuccauuuguauuuaauguguguagacccuccucugu

SEQ ID NO: 493049 - RNA, 64 nt, hsa
uggugacuuauggaaauaaagcaucaauauuggauguauuuaauuccuaguuuguuuuccauuc

SEQ ID NO: 493050 - RNA, 64 nt, hsa
caacaaccagcauaagcaaaugaaagaaaggaauuguauuuaccuuuuauaauuauuauuagug

SEQ ID NO: 493051 - RNA, 64 nt, hsa
agauuauagauuuaaaaguauaugacauguauuuuguauuuaaaacuagaauagccaguauuua

SEQ ID NO: 493052 - RNA, 64 nt, hsa
uggacugugcacgugacacuuaaauaauuuucuauguauuuaaagaaaaaugcaccaggauggu

SEQ ID NO: 493053 - RNA, 64 nt, hsa
gaugauauuuuauguuuaaucuguaaauaagaaauguauuuaaauuaaaagggaucuuuuugua

SEQ ID NO: 493054 - RNA, 64 nt, hsa
guaacaauuuuguuuucuacuguuaauuacauuguguauuuauaguucuaugcuuacuguugug

SEQ ID NO: 493055 - RNA, 64 nt, hsa
uuuguuuauaucuuuguugugaaugaugcuuuuuuguauuuauuaauaucaaauucacuuauga

SEQ ID NO: 493056 - RNA, 64 nt, hsa
cagguauuguuauuaguaccuaucacugcugagcuguauuuaaaauuuugguacaauauauaaa

SEQ ID NO: 493057 - RNA, 64 nt, hsa
uauauuugaucauauuuuuuuuuugccuugucaauguauuuaaaguuuacuuaaggucaggaaa

SEQ ID NO: 493058 - RNA, 64 nt, hsa
cucaguaaauggcuucuucuagaauguaaaguuauguauuuaaaguuguaucuugacacaggaa

SEQ ID NO: 493059 - RNA, 64 nt, hsa
gggaaucaguccccuguggauaccaagguacaacuguauuuauuaacgcuuacuagaugugagg

SEQ ID NO: 493060 - RNA, 64 nt, hsa
ucacuauaguuacuuuuuucacuuuuguuauauauguauuuauuagagcauuugaauauuggua

SEQ ID NO: 493061 - RNA, 64 nt, hsa
auuuucagugacacuuauguaaggcccugugaguuguauuuauccuguauccggcacugcuaag

SEQ ID NO: 493062 - RNA, 64 nt, hsa
gaucagauacaugaacaugucuuacauggguugcuguauuuagaauuauaaacauuuuucauua

SEQ ID NO: 493063 - RNA, 64 nt, hsa
cgaaaaaucaguccuguguugucagcaugauucauguauuuauauagauuugauuauuuuaauu

SEQ ID NO: 493064 - RNA, 64 nt, hsa
auuguguuuaauuauuuugccauguauuacuaauuguauuuaaaauuucuacuucccuuaggca

SEQ ID NO: 493065 - RNA, 64 nt, hsa
ugaacagaaaauugagacuaugaagaggucaacuuguauuuaccaacuuuacucauuuucccau

SEQ ID NO: 493066 - RNA, 64 nt, hsa
uggcuacacuagauauuuugugauuggcaagacauguauuuaaacaauaaacuaaaaggaaaua

SEQ ID NO: 493067 - RNA, 64 nt, hsa
gaguuaucuguaguacuuggaaacagaaaauguguguauuuaaagacgaugccuaugcaguaua

SEQ ID NO: 493068 - RNA, 64 nt, hsa
aggaauaugaccauuugacuguucaaugauuauuuguauuuacaguuuccagaguuugucauua

SEQ ID NO: 493069 - RNA, 64 nt, hsa
acauacgacuuauuuuguugaaauugucaaagacuguauuuagaucucauaaugcuuuguuaaa

SEQ ID NO: 493070 - RNA, 64 nt, hsa
uuuaucccauugagacuauuuauuuauguauguauguauuuauuuauuuauugccuggagugug

SEQ ID NO: 493071 - RNA, 64 nt, hsa
auguauuuauuuauuuauugccuggagugugaacuguauuuauuuuagcagaggagccaugucc

SEQ ID NO: 493072 - RNA, 54 nt, hsa
auagcuugguauucaguuaaguauuguauuuaguucagugaaccgcccguuagu

SEQ ID NO: 493073 - RNA, 64 nt, hsa
uuaauguuugcaaggccagaguguuugaaaguuuuguauuuaacuuuauaauuaccuuguccuu

SEQ ID NO: 493074 - RNA, 64 nt, hsa
cuugagcuaugucucuacuccaggcucuguuuuguguauuuaucugccauuugcaucaugguuu

SEQ ID NO: 493075 - RNA, 64 nt, hsa
accccgaagucuucccagccagugagccacuuuguguauuuacuguauauuuauugugcccuaa

SEQ ID NO: 493076 - RNA, 64 nt, hsa
gaggagcgggcauuugagggggcauggaguaauuuguauuuaaaaaaccuuaaaguugugcugu

SEQ ID NO: 493077 - RNA, 64 nt, hsa
auuugacugggacagaaugaggaauggagauuuuuguauuuaucuuugggacuuuaugccuuac

SEQ ID NO: 493078 - RNA, 64 nt, hsa
uuauaaaugaaggacaaggaggagauggaaaauguguauuuauuguuaauucuuaaaauagugu

SEQ ID NO: 493079 - RNA, 64 nt, hsa
cuuguuuacuuuuuuaagggcuuuaaguuauuuauguauuuaauaugcccugagauaacuuugg

SEQ ID NO: 493080 - RNA, 64 nt, hsa
ggcuugggaauuuuauuauuuaaaagguaaaaccuguauuuauuugagcuauuuaaggaucuau

SEQ ID NO: 493081 - RNA, 64 nt, hsa
ggagguguuauaauuaauuauucagaaaaaugcauguauuuaccucuucaaccaaaagggcagu

SEQ ID NO: 493082 - RNA, 64 nt, hsa
auggagcucaggagaaugcaccaagacuuugaauuguauuuacauucacugucaguaaagaccu

SEQ ID NO: 493083 - RNA, 64 nt, hsa
guuguguaaguuauguauguacauauuccacauauguauuuaguauaaucugugacuaauaaag

SEQ ID NO: 493084 - RNA, 64 nt, hsa
auuguuguaugacauuuaaaaauuucuuucuauguguauuuauauuuauacauacaaguuggau

SEQ ID NO: 493085 - RNA, 64 nt, hsa
uuucuauauggacauagcacagaugaaccaaaaauguauuuauauucaccugaguuuuaauguu

SEQ ID NO: 493086 - RNA, 64 nt, hsa
guauuuauuuuuagagguacauguuuuaaguaaauguauuuaaaacaaauuuucauggucugaa

SEQ ID NO: 493087 - RNA, 64 nt, hsa
aaagaacucugagaauuagcuaaauggaggcuaguguauuuauuuuuagagguacauguuuuaa

SEQ ID NO: 493088 - RNA, 64 nt, hsa
uugcauaguacugaauguugacacacagcuuauauguauuuacaagaauaucuuuaaguguuuu

SEQ ID NO: 493089 - RNA, 64 nt, hsa
uuacuacuuuaaaucaaauguagcauuaucacacuguauuuaaauugucauuuuuuaaaggaau

SEQ ID NO: 493090 - RNA, 64 nt, hsa
gagcacuuugcuccaaauauauuauuuuucaguguguauuuaaacgaggcaguuuauuuugaua

SEQ ID NO: 493091 - RNA, 64 nt, hsa
cagagaauguuaauggauaccagaauuuuauuuuuguauuuauguucauaguacuuuuccucuu

SEQ ID NO: 493092 - RNA, 64 nt, hsa
ggcuagguugguagaaucaaaaacaagggccagauguauuuaagggguauucagaugccaccua

SEQ ID NO: 493093 - RNA, 64 nt, hsa
uggccuuaacuaugccaaucuaauuauaauucccuguauuuaaaaugguuucuuuuacuuauug

SEQ ID NO: 493094 - RNA, 64 nt, hsa
acuacaaggcagcuguuuuucaauaauguccugcuguauuuaccuacguguuuugagugucuau

SEQ ID NO: 493095 - RNA, 64 nt, hsa
uuauuuugguauuauucaaucuauacaaucuuuuuguauuuauugggaaaugaguaauauacaa

SEQ ID NO: 493096 - RNA, 64 nt, hsa
ccuuucuguucaacuaauuucacgugacagugcauguauuuauucaauaaaaccuuuauguuag

SEQ ID NO: 493097 - RNA, 64 nt, hsa
caaaaaauaaauaaaauagaagcagccuuguaacuguauuuaccaugauaauauauucugcacg

SEQ ID NO: 493098 - RNA, 64 nt, hsa
gaaaacaguuguggaauucuuacuucauuaugaauguauuuaaaaaacaaacaccaaauaauug

SEQ ID NO: 493099 - RNA, 64 nt, hsa
ugccaaagaucaacagacagaaaauaucauccuguguauuuacuugucauacuuuaacuuugug

SEQ ID NO: 493100 - RNA, 64 nt, hsa
gugguuaccaugacacccuaauuucauguguuuuuguauuuaugaaaauaguuucauugucauu

SEQ ID NO: 493101 - RNA, 64 nt, hsa
cgguagcaccacaugguuguguagaucagaccuguguauuuagaucagaccuguguaucacgua

SEQ ID NO: 493102 - RNA, 64 nt, hsa
acuauguucuaggucagucuaacaguuugccugcuguauuuauaguaaccauuuuccuuuggac

SEQ ID NO: 493103 - RNA, 64 nt, hsa
guauguggaaguauaccuggcuuuuuaaaauauauguauuuaaaaacaaaaagcaacaguaauc

SEQ ID NO: 493104 - RNA, 64 nt, hsa
cauaguuugagcaggauguuuugugaaguauguuuguauuuauuugccuacuuuguacuugaug

SEQ ID NO: 493105 - RNA, 64 nt, hsa
uugcacacuucuucccccaccuuucacugauuuuuguauuuauaaaugaauuugcgguaaggug

SEQ ID NO: 493106 - RNA, 64 nt, hsa
aaauauuacuguuacauauacugcuugcaauuucuguauuuauuguucucuggaaauaaauaua

SEQ ID NO: 493107 - RNA, 64 nt, hsa
uuugccuguuaaguuguauaaaaguaggugauucuguauuuaaagaaaauauuacuguuacaua

SEQ ID NO: 493108 - RNA, 64 nt, hsa
gggauggaagcaggacagacaccguggacagcgcuguauuuacagacacacccagugcgugaag

SEQ ID NO: 493109 - RNA, 64 nt, hsa
cauacccaugucagauugaauguauuuaaauguauguauuuaaggagaaccaugcucuuguucu

SEQ ID NO: 493110 - RNA, 64 nt, hsa
ugacaggcaaauuucauacccaugucagauugaauguauuuaaauguauguauuuaaggagaac

SEQ ID NO: 493111 - RNA, 64 nt, hsa
uguauaucaagcacagcaguaaaacaaaaacccauguauuuaacuuuuuuuuaggauuuuugcu

SEQ ID NO: 493112 - RNA, 64 nt, hsa
uagcuuucauuauuuuugcuacacucauuuuauuuguauuuaaauguuuuaggcaaccuaagaa

SEQ ID NO: 493113 - RNA, 64 nt, hsa
uguauuugccucuagagaaacacaguguucucuuuguauuuauggauuccuuuuuaccguguca

SEQ ID NO: 493114 - RNA, 64 nt, hsa
cuuuuuaccgugucacauuuacuuugguccucuauguauuuaaauguuugaagugccuuagacu

SEQ ID NO: 493115 - RNA, 64 nt, hsa
aaacucuuucuggggaauccaauuauaguugcuuuguauuuaaaaacaagaacagccaaggguu

SEQ ID NO: 493116 - RNA, 64 nt, hsa
auuuguaugcacguuauauuguaauagcuuugccuguauuuauugcaagaccaccagcuccugg

SEQ ID NO: 493117 - RNA, 64 nt, hsa
aaagaucauuuccaggucuaaaauuccaugauuuuguauuuaauucuuccugagaacagaagag

SEQ ID NO: 493118 - RNA, 64 nt, hsa
cucuaguuaacuuagcuuuauguagaauuucuacuguauuuaauuucuauugaagcccuucugu

SEQ ID NO: 493119 - RNA, 64 nt, hsa
ucagauuaauagagaaugaauauaauuauuuauuuguauuuauaauuuauauuuacaaguuguc

SEQ ID NO: 493120 - RNA, 64 nt, hsa
uaaaauaaauaaaaaaagauauaguauuaaugccuguauuuaugaagacagggccauugcacug

SEQ ID NO: 493121 - RNA, 64 nt, hsa
cagauggcauaugccuuaaagaugcauuuuucuauguauuuaauauuuuguguacaguaaaagu

SEQ ID NO: 493122 - RNA, 64 nt, hsa
cagcugauguuaucagaaaaauccuguuauccuguguauuuacuaguccucaugaucuagacuu

SEQ ID NO: 493123 - RNA, 64 nt, hsa
cccaugcugccuccagucuuugucuguauucuucuguauuuaaccuucagauuguaagccuuuu

SEQ ID NO: 493124 - RNA, 64 nt, hsa
ugucaaacuugccuggcaguguuuguucaaaacuuguauuuaauaaaugaacaucugacuuaca

SEQ ID NO: 493125 - RNA, 64 nt, hsa
cgcuccccaccaacucuccccuaaucacacacucuguauuuaucacuggcacaauugauguguu

SEQ ID NO: 493126 - RNA, 64 nt, hsa
ccucugccccagcaaaugcccagcccaggcaaauuguauuuaaagaauccugggggucauuaug

SEQ ID NO: 493127 - RNA, 64 nt, hsa
cugugugaagauuuuuagcuguauuuguggucucuguauuuauauuuauguuuagcaccgucag

SEQ ID NO: 493128 - RNA, 64 nt, hsa
uuggcagauauuggaaaaauauuuugugaaaagcuguauuuauuauaaauacuagggccaugac

SEQ ID NO: 493129 - RNA, 64 nt, hsa
uaugugaaacagcuggaauuguacaaauuuugguuguauuuaaagcucaguuuccuuuuuguuu

SEQ ID NO: 493130 - RNA, 64 nt, hsa
agaauuuggaagaaauugguauuuuaauacugucuguauuuauuacuguuaugcaggcugugcc

SEQ ID NO: 493131 - RNA, 64 nt, hsa
uacauuauaugucucuuguauguuuugaaacucuuguauuuaugauauagcuuauaugauuuuu

SEQ ID NO: 493132 - RNA, 64 nt, hsa
uaaaaugcugagaacuagugauuauauauuuuucuguauuuaccugacauuuauuuuaauguuc

SEQ ID NO: 493133 - RNA, 64 nt, hsa
ucaguguuuaaacuuacuguauauuuaugcuuucuguauuuaccagcuauuuuaaaugagcugu

SEQ ID NO: 493134 - RNA, 64 nt, hsa
uuuccccuuuagguucuuuacauugugauaaugcuguauuuaaagagaauauuuaaauguaaua

SEQ ID NO: 493135 - RNA, 64 nt, hsa
ccugaagucucuaaacucugagccugaaaagauuuguauuuaauacacauaacauuuuuuaguu

SEQ ID NO: 493136 - RNA, 64 nt, hsa
auuacagagcacaaugauugucauuggguauauauguauuuacucucuauuauugggcauaaag

SEQ ID NO: 493137 - RNA, 64 nt, hsa
ggaaaugugucuugauaauauuaccuauuaaauguguauuuauagucccuccuaucaaacaauu

SEQ ID NO: 493138 - RNA, 64 nt, hsa
gccucauguaccgauuugaagucagacuuaaaaauguauuuacagauucacuugagacuuuuua

SEQ ID NO: 493139 - RNA, 64 nt, hsa
uuuauaguugaaguuaggaaaaugcuauuugauuuguauuuagauauuuaagucacuuguccaa

SEQ ID NO: 493140 - RNA, 62 nt, hsa
ucuguuugaugcuauuuaugcaaguuagggucuauguauuuaugaugucugcaccuucugca

SEQ ID NO: 493141 - RNA, 64 nt, hsa
guuugacacgaagccuuauuucuagaagcacauguguauuuauacccccaggaaacuagcuuuu

SEQ ID NO: 493142 - RNA, 64 nt, hsa
uuguuuauuuuuaauggguauuucagauuccaaguguauuuaaaauuucuaaggagauauaaua

SEQ ID NO: 493143 - RNA, 64 nt, hsa
uuauuuuccauuuuucuuguuuccugauaauaaauguauuuaggacugaaaauacuccugagua

SEQ ID NO: 493144 - RNA, 64 nt, hsa
uugaaucuaguauuugcugggagaauuuuuucuuuguauuuauuuuaauguauuguucucaugu

SEQ ID NO: 493145 - RNA, 64 nt, hsa
aaugauuguauuuauaaaauugucaauaucuuaauguauuuaauguagaauauugcuuuuuaaa

SEQ ID NO: 493146 - RNA, 64 nt, hsa
ucagaaauuuaucauguuuacuguuuaaaaugauuguauuuauaaaauugucaauaucuuaaug

SEQ ID NO: 493147 - RNA, 64 nt, hsa
ccaaagaauauuagguauguuuggaaagaauuuuuguauuuauuccuguuacaguuuugacuuu

SEQ ID NO: 493148 - RNA, 64 nt, hsa
uuauuuuaaaccuuuuuauuugguuagagugauauguauuuagccauagauggagaaacaaagc

SEQ ID NO: 493149 - RNA, 64 nt, hsa
uucuauauacccugaccuuuuaauaaaguuucaguguauuuaucauuggucuuuagaaugguag

SEQ ID NO: 493150 - RNA, 64 nt, hsa
agguguagguuaauuuguuuauuuccuauaaauuuguauuuauguguauauaaaauguacaaug

SEQ ID NO: 493151 - RNA, 64 nt, hsa
aggcuaaggacaaaaauaaacuaaguaccuguaguguauuuaugugauaugugucaaguuacuc

SEQ ID NO: 493152 - RNA, 64 nt, hsa
ggacuguuuggaguuguugccuuacuuuuuaauauguauuuauaaaguauuccagcaaaagagg

SEQ ID NO: 493153 - RNA, 64 nt, hsa
uaaauuuagcuugucuuucugcuaagcuguuaaauguauuuauaguaaaggaagaaaaaaagac

SEQ ID NO: 493154 - RNA, 64 nt, hsa
aacaccaugguagacucuuuuuguaaauguauuuuguauuuaaugaaaugcaguauaaagguug

SEQ ID NO: 493155 - RNA, 64 nt, hsa
gaaaaaguaaaucaaagaugacuucuuuucaaaauguauuuaacucagaugaauuuauaaauua

SEQ ID NO: 493156 - RNA, 64 nt, hsa
ccaaaaauagaaaaguucuucuaagguuaaauuuuguauuuaaaaguuaguuggccauuugauc

SEQ ID NO: 493157 - RNA, 64 nt, hsa
uugcuuucgugugugugucuuuaaacagguaauguguauuuaaguguugucuaaacaguugauu

SEQ ID NO: 493158 - RNA, 64 nt, hsa
uuuuuauuuggaagggagcaguauaaagcuuauuuguauuuaguaguguaucucauagauacag

SEQ ID NO: 493159 - RNA, 64 nt, hsa
cuuuugguuaaauggcagucaaaauuuuccucaguguauuuaguguguucagugaugauaucac

SEQ ID NO: 493160 - RNA, 64 nt, hsa
caggccacugugauaauggucuguuuagcacuucuguauuuauuguaagaaugauuauaaugaa

SEQ ID NO: 493161 - RNA, 64 nt, hsa
agcaggagguuaucugugcagggggcuggcaucauguauuuaggggcaaguaauaauggaaugc

SEQ ID NO: 493162 - RNA, 64 nt, hsa
uguucauauucaauaucuuacagugauacaguuuuguauuuacauauaaauauaccgacaugau

SEQ ID NO: 493163 - RNA, 64 nt, hsa
guguauauuauuauuuuuuacaaucauuucauuuuguauuuaauaucaauggacugagucugau

SEQ ID NO: 493164 - RNA, 64 nt, hsa
aauguguguuucauuuuuuuggaaagcuauauuuuguauuuaggaaaugguauacuauuuugcu

SEQ ID NO: 493165 - RNA, 64 nt, hsa
ccagcaaaggccauagaaacaacaauuuauuaaauguauuuauggcagaaggaccuaaauaaac

SEQ ID NO: 493166 - RNA, 64 nt, hsa
gaaaaguccugaaaucuaguccaggaccguggauuguauuuaaaaaaauaaaaauagaagaaga

SEQ ID NO: 493167 - RNA, 64 nt, hsa
aguucacuguucaucauuuacaggucucuauuuauguauuuauuauuuauuuuucuacuuuccc

SEQ ID NO: 493168 - RNA, 64 nt, hsa
auuaguagcuucuguggggggaucccagagccccuguauuuauuuucccuguguuugucucuag

SEQ ID NO: 493169 - RNA, 64 nt, hsa
uguucagaacuguuuaauagcaguuacucuugaguguauuuaccuuuuuauguuuuuuaaacua

SEQ ID NO: 493170 - RNA, 64 nt, hsa
gccuuggugugcuguauccauccauggggcugauuguauuuaccuucuaccucuuggcugccuu

SEQ ID NO: 493171 - RNA, 64 nt, hsa
uauaugaagaaacuguaucaaagggggaagaaaauguauuuaacaggugaaucaaaucaggaau

SEQ ID NO: 493172 - RNA, 64 nt, hsa
auuuaacugccuuguguacaguuauuuaugccucuguauuuaaaaaacuaacacccagucuguu

SEQ ID NO: 493173 - RNA, 64 nt, hsa
caagugaccaccaggaggugcuaucgcaccacuguguauuuaacugccuuguguacaguuauuu

SEQ ID NO: 493174 - RNA, 64 nt, hsa
gaaagcugugaaaugucuugugucuuauguucucuguauuuaugcagcugauuugucugucugu

SEQ ID NO: 493175 - RNA, 64 nt, hsa
aagccaauauuugugacuuugcucugcuaccugcuguauuuauuauauggaagcaucuaaguac

SEQ ID NO: 493176 - RNA, 64 nt, hsa
acaaaacacaucccagacauuaggaguucauaaguguauuuaaugaaauuggugguuuuaggaa

SEQ ID NO: 493177 - RNA, 64 nt, hsa
uuucuuugucuuucuugcuuuuuguuuuugccguuguauuuauguuugagacacaaccagucau

SEQ ID NO: 493178 - RNA, 64 nt, hsa
gguuccugagacacccgauuccugcccaaacagcuguauuuauauaagucuguuauuuauuauu

SEQ ID NO: 493179 - RNA, 64 nt, hsa
ucuuggggacucgggggcuggucugauggaacuguguauuuauuuaaaacucuggugauaaaaa

SEQ ID NO: 493180 - RNA, 64 nt, hsa
uggcuguauuuaucuguuuauuuauaccuauuuauguauuuauuuauugaagugugaaauugag

SEQ ID NO: 493181 - RNA, 64 nt, hsa
uguuuuuuaguuauugcucucaugagaugauggcuguauuuaucuguuuauuuauaccuauuua

SEQ ID NO: 493182 - RNA, 64 nt, hsa
uccacccaguugagacacaccaugcuuguucacuuguauuuauugaaacuguggauucuugccc

SEQ ID NO: 493183 - RNA, 64 nt, hsa
auugaaacuguggauucuugcccgugcugucccuuguauuuacuuuaagcacugaucacuuauc

SEQ ID NO: 493184 - RNA, 64 nt, hsa
auaauagagguacaauucguuggauuuuuguuuauguauuuauuucauuccaguuugauuuauu

SEQ ID NO: 493185 - RNA, 64 nt, hsa
ggguaugugauaauagagggcuggaauuuaaaccuguauuuaaaaaaaagaaucaccaaaucua

SEQ ID NO: 493186 - RNA, 64 nt, hsa
aaucuuauaauuguucucagaaucccuuaacaguuguauuuaacagaaauuguauauuguaauu

SEQ ID NO: 493187 - RNA, 64 nt, hsa
auacauaagcacaggauguuuuucucaagagggauguauuuaucacuuggacaucuguuuauaa

SEQ ID NO: 493188 - RNA, 64 nt, hsa
auuuaugugugugugaauguguauuuuaauuauguguauuuaacucuuuaaaaucucuuagauu

SEQ ID NO: 493189 - RNA, 64 nt, hsa
uuuguuuuccuuugaaacccagcccuauuguauuuguauuuaaaauuuguacacauuuguauaa

SEQ ID NO: 493190 - RNA, 64 nt, hsa
guguguggauaugaugacguuucuuuaaaauguauguauuuaacaaauacuuaauuguauuaag

SEQ ID NO: 493191 - RNA, 64 nt, hsa
uuaaaacauugggauccuccaaaggccugccccauguauuuaacaguaauacaggaagcauggc

SEQ ID NO: 493192 - RNA, 64 nt, hsa
auuucuguuuacauccagaaaacaauguuaaggauguauuuauuccccuacccugaagaaagug

SEQ ID NO: 493193 - RNA, 64 nt, hsa
cauucuauuguccuaauuguacuguuuucugauuuguauuuaugucuugagacaguaacuuuuu

SEQ ID NO: 493194 - RNA, 64 nt, hsa
ucgauaugccucuuuccacauuuuuuccuugcaauguauuuauuauuuauuuguauuuagguga

SEQ ID NO: 493195 - RNA, 64 nt, hsa
acauuuuuuccuugcaauguauuuauuauuuauuuguauuuaggugaaauucacauaacauaaa

SEQ ID NO: 493196 - RNA, 64 nt, hsa
ugcaauauuucuuuucugauuuauuuaauuuucuuguauuuauauguuaaaaucaaaaauguua

SEQ ID NO: 493197 - RNA, 64 nt, hsa
cccaugugucaaaaaucuuacuucuacauuuuuuuguauuuauuuucuacuguguaaauguauu

SEQ ID NO: 493198 - RNA, 64 nt, hsa
ugcaauacuacuuggaggaauucuucuacuaauuuguauuuaauguggaaauuguauaguuuca

SEQ ID NO: 493199 - RNA, 64 nt, hsa
gaguuucuaaaaauucagcuauaaccccaguucauguauuuacuggugauuguucuugcugagg

SEQ ID NO: 493200 - RNA, 64 nt, hsa; identical to SEQ ID NO: 198342

SEQ ID NO: 493201 - RNA, 64 nt, hsa; identical to SEQ ID NO: 198343

SEQ ID NO: 493202 - RNA, 64 nt, hsa; identical to SEQ ID NO: 198344

SEQ ID NO: 493203 - RNA, 64 nt, hsa; identical to SEQ ID NO: 198345

SEQ ID NO: 493204 - RNA, 64 nt, hsa; identical to SEQ ID NO: 198346

SEQ ID NO: 493205 - RNA, 64 nt, hsa; identical to SEQ ID NO: 198347

SEQ ID NO: 493206 - RNA, 64 nt, hsa; identical to SEQ ID NO: 198348

SEQ ID NO: 493207 - RNA, 64 nt, hsa; identical to SEQ ID NO: 198349

SEQ ID NO: 493208 - RNA, 64 nt, hsa; identical to SEQ ID NO: 198350

SEQ ID NO: 493209 - RNA, 64 nt, hsa; identical to SEQ ID NO: 198351

SEQ ID NO: 493210 - RNA, 64 nt, hsa; identical to SEQ ID NO: 198352

SEQ ID NO: 493211 - RNA, 64 nt, hsa; identical to SEQ ID NO: 198353

SEQ ID NO: 493212 - RNA, 64 nt, hsa; identical to SEQ ID NO: 198354

SEQ ID NO: 493213 - RNA, 64 nt, hsa; identical to SEQ ID NO: 198355

SEQ ID NO: 493214 - RNA, 64 nt, hsa; identical to SEQ ID NO: 198356

SEQ ID NO: 493215 - RNA, 64 nt, hsa; identical to SEQ ID NO: 198357

SEQ ID NO: 493216 - RNA, 64 nt, hsa; identical to SEQ ID NO: 198358

SEQ ID NO: 493217 - RNA, 64 nt, hsa; identical to SEQ ID NO: 198359

SEQ ID NO: 493218 - RNA, 64 nt, hsa; identical to SEQ ID NO: 198360

SEQ ID NO: 493219 - RNA, 64 nt, hsa; identical to SEQ ID NO: 198361

SEQ ID NO: 493220 - RNA, 64 nt, hsa; identical to SEQ ID NO: 198362

SEQ ID NO: 493221 - RNA, 64 nt, hsa; identical to SEQ ID NO: 198363

SEQ ID NO: 493222 - RNA, 64 nt, hsa; identical to SEQ ID NO: 198364

SEQ ID NO: 493223 - RNA, 64 nt, hsa; identical to SEQ ID NO: 198365

SEQ ID NO: 493224 - RNA, 64 nt, hsa; identical to SEQ ID NO: 198366

SEQ ID NO: 493225 - RNA, 64 nt, hsa; identical to SEQ ID NO: 198367

SEQ ID NO: 493226 - RNA, 64 nt, hsa; identical to SEQ ID NO: 198368

SEQ ID NO: 493227 - RNA, 64 nt, hsa; identical to SEQ ID NO: 198369

SEQ ID NO: 493228 - RNA, 64 nt, hsa; identical to SEQ ID NO: 198370

SEQ ID NO: 493229 - RNA, 64 nt, hsa; identical to SEQ ID NO: 198371

SEQ ID NO: 493230 - RNA, 64 nt, hsa; identical to SEQ ID NO: 198372

SEQ ID NO: 493231 - RNA, 64 nt, hsa; identical to SEQ ID NO: 198373

SEQ ID NO: 493232 - RNA, 64 nt, hsa; identical to SEQ ID NO: 198374

SEQ ID NO: 493233 - RNA, 64 nt, hsa; identical to SEQ ID NO: 198375

SEQ ID NO: 493234 - RNA, 64 nt, hsa; identical to SEQ ID NO: 198376

SEQ ID NO: 493235 - RNA, 64 nt, hsa; identical to SEQ ID NO: 198377

SEQ ID NO: 493236 - RNA, 64 nt, hsa; identical to SEQ ID NO: 198378

SEQ ID NO: 493237 - RNA, 64 nt, hsa; identical to SEQ ID NO: 198379

SEQ ID NO: 493238 - RNA, 64 nt, hsa; identical to SEQ ID NO: 198380

SEQ ID NO: 493239 - RNA, 64 nt, hsa; identical to SEQ ID NO: 198381

SEQ ID NO: 493240 - RNA, 64 nt, hsa; identical to SEQ ID NO: 198382

SEQ ID NO: 493241 - RNA, 64 nt, hsa; identical to SEQ ID NO: 198383

SEQ ID NO: 493242 - RNA, 64 nt, hsa; identical to SEQ ID NO: 198384

SEQ ID NO: 493243 - RNA, 64 nt, hsa; identical to SEQ ID NO: 198385

SEQ ID NO: 493244 - RNA, 64 nt, hsa; identical to SEQ ID NO: 198386

SEQ ID NO: 493245 - RNA, 64 nt, hsa; identical to SEQ ID NO: 198387

SEQ ID NO: 493246 - RNA, 64 nt, hsa; identical to SEQ ID NO: 198388

SEQ ID NO: 493247 - RNA, 64 nt, hsa; identical to SEQ ID NO: 198389

SEQ ID NO: 493248 - RNA, 64 nt, hsa; identical to SEQ ID NO: 198390

SEQ ID NO: 493249 - RNA, 64 nt, hsa; identical to SEQ ID NO: 198391

SEQ ID NO: 493250 - RNA, 64 nt, hsa; identical to SEQ ID NO: 198392

SEQ ID NO: 493251 - RNA, 64 nt, hsa; identical to SEQ ID NO: 198393

SEQ ID NO: 493252 - RNA, 64 nt, hsa; identical to SEQ ID NO: 198394

SEQ ID NO: 493253 - RNA, 64 nt, hsa; identical to SEQ ID NO: 198395

SEQ ID NO: 493254 - RNA, 64 nt, hsa; identical to SEQ ID NO: 198396

SEQ ID NO: 493255 - RNA, 64 nt, hsa; identical to SEQ ID NO: 198397

SEQ ID NO: 493256 - RNA, 64 nt, hsa; identical to SEQ ID NO: 198398

SEQ ID NO: 493257 - RNA, 64 nt, hsa; identical to SEQ ID NO: 198399

SEQ ID NO: 493258 - RNA, 64 nt, hsa; identical to SEQ ID NO: 198400

SEQ ID NO: 493259 - RNA, 64 nt, hsa; identical to SEQ ID NO: 198401

SEQ ID NO: 493260 - RNA, 64 nt, hsa; identical to SEQ ID NO: 198402

SEQ ID NO: 493261 - RNA, 64 nt, hsa; identical to SEQ ID NO: 198403

SEQ ID NO: 493262 - RNA, 64 nt, hsa; identical to SEQ ID NO: 198404

SEQ ID NO: 493263 - RNA, 64 nt, hsa; identical to SEQ ID NO: 198405

SEQ ID NO: 493264 - RNA, 64 nt, hsa; identical to SEQ ID NO: 198406

SEQ ID NO: 493265 - RNA, 64 nt, hsa; identical to SEQ ID NO: 198407

SEQ ID NO: 493266 - RNA, 64 nt, hsa; identical to SEQ ID NO: 198408

SEQ ID NO: 493267 - RNA, 64 nt, hsa; identical to SEQ ID NO: 198409

SEQ ID NO: 493268 - RNA, 64 nt, hsa; identical to SEQ ID NO: 198410

SEQ ID NO: 493269 - RNA, 64 nt, hsa; identical to SEQ ID NO: 198411

SEQ ID NO: 493270 - RNA, 64 nt, hsa; identical to SEQ ID NO: 198412

SEQ ID NO: 493271 - RNA, 64 nt, hsa; identical to SEQ ID NO: 198413

SEQ ID NO: 493272 - RNA, 64 nt, hsa; identical to SEQ ID NO: 198414

SEQ ID NO: 493273 - RNA, 64 nt, hsa; identical to SEQ ID NO: 198415

SEQ ID NO: 493274 - RNA, 64 nt, hsa; identical to SEQ ID NO: 198416

SEQ ID NO: 493275 - RNA, 64 nt, hsa; identical to SEQ ID NO: 198417

SEQ ID NO: 493276 - RNA, 64 nt, hsa; identical to SEQ ID NO: 198418

SEQ ID NO: 493277 - RNA, 64 nt, hsa; identical to SEQ ID NO: 198419

SEQ ID NO: 493278 - RNA, 64 nt, hsa; identical to SEQ ID NO: 198420

SEQ ID NO: 493279 - RNA, 64 nt, hsa; identical to SEQ ID NO: 198421

SEQ ID NO: 493280 - RNA, 64 nt, hsa; identical to SEQ ID NO: 198422

SEQ ID NO: 493281 - RNA, 64 nt, hsa; identical to SEQ ID NO: 198423

SEQ ID NO: 493282 - RNA, 64 nt, hsa; identical to SEQ ID NO: 198424

SEQ ID NO: 493283 - RNA, 64 nt, hsa; identical to SEQ ID NO: 198425

SEQ ID NO: 493284 - RNA, 64 nt, hsa; identical to SEQ ID NO: 198426

SEQ ID NO: 493285 - RNA, 64 nt, hsa; identical to SEQ ID NO: 327831

SEQ ID NO: 493286 - RNA, 64 nt, hsa; identical to SEQ ID NO: 327832

SEQ ID NO: 493287 - RNA, 64 nt, hsa; identical to SEQ ID NO: 327833

SEQ ID NO: 493288 - RNA, 64 nt, hsa; identical to SEQ ID NO: 327834

SEQ ID NO: 493289 - RNA, 64 nt, hsa
aauauuuuucaccugagagaggaagagaaauuucucuaguaacacaaagagugaguucuaaaag

SEQ ID NO: 493290 - RNA, 64 nt, hsa
uaauggaaugauacgguaccugaaagccuuguuuucuaguaagaaaaugcuaccuugcuguaca

SEQ ID NO: 493291 - RNA, 64 nt, hsa
aagaaguggucagguuuucgcacuucuuggcugguccagggacugcagaaaccaaagcugcuau

SEQ ID NO: 493292 - RNA, 64 nt, hsa
ugaaaaacuggguuccuguaaguuaugaauggcauccagggauauuuggguuacuuuuaagaaa

SEQ ID NO: 493293 - RNA, 64 nt, hsa
gcugcauggagaauuucaccugcggugauuuugauccagggacugcaucuccucuuuccucauc

SEQ ID NO: 493294 - RNA, 64 nt, hsa
ugccuuguucccucccuggcccucaggcccuccuuccagggaugucucuccagcucuacuuuau

SEQ ID NO: 493295 - RNA, 64 nt, hsa
ccuuggacagggugggagaggggacacauggguguccagggagaaggcucugucccugccgcca

SEQ ID NO: 493296 - RNA, 64 nt, hsa
gaggagguguggucagaggugacuuguucccaccuccagggaggacgcuucgucuucggccagc

SEQ ID NO: 493297 - RNA, 64 nt, hsa
guccaccugugcccacagcuuccgcccacagaccuccagggacaggagcaaauugcaccacagc

SEQ ID NO: 493298 - RNA, 64 nt, hsa
caugaggcugcaccgcuuaccuggccacuggcacuccagggagcucugguagccuggccuuucc

SEQ ID NO: 493299 - RNA, 64 nt, hsa
gugacuggcgcaggucuccuuggggccugccguguccagggaggccucaugcgucugcuccuag

SEQ ID NO: 493300 - RNA, 64 nt, hsa
cguucccacccccucucaggcacaaaagccgguguccagggacucaagaccuguaccugggguu

SEQ ID NO: 493301 - RNA, 64 nt, hsa
caugagacccacagacuuggugccugagcgcagcuccagggaagccccagccccuuccaggcgg

SEQ ID NO: 493302 - RNA, 64 nt, hsa
gguuugcuuuaccuguggcagcagguugcugcuuuccagggauguguccagugcccuggguucu

SEQ ID NO: 493303 - RNA, 64 nt, hsa
uccuucccugagucacagagagcaagccaagacauccagggaaagaggaagaaaggccuuagug

SEQ ID NO: 493304 - RNA, 64 nt, hsa
cucacagaggccugguuugcucagucuucugaacuccagggaccagcccuggugggcauggggu

SEQ ID NO: 493305 - RNA, 64 nt, hsa
ucucgaagcaugucuuugccaugggcuguguccuuccagggaaauuguggucucgggccugggu

SEQ ID NO: 493306 - RNA, 64 nt, hsa
caccagcuuggauggccgucaccucagacaucacuccagggagcacccgcaggagcugggcccc

SEQ ID NO: 493307 - RNA, 64 nt, hsa
gccguuuuuccucuuguccaggcucacgaguuaguccagggauuccauacucccuauucccugg

SEQ ID NO: 493308 - RNA, 64 nt, hsa
uacgucugaaacugaguagggaaaggcauacuuuuccagggacuuagggggauaggcuuuggaa

SEQ ID NO: 493309 - RNA, 64 nt, hsa
cuccuuggaacuuauggcccaaucuuaccuguucuccagggacuggucacugccucaggacccc

SEQ ID NO: 493310 - RNA, 64 nt, hsa
cuuauccucggcugcccuucuuggcucccugcauuccagggacuugcucgucuuguuuaccccu

SEQ ID NO: 493311 - RNA, 64 nt, hsa
acugcuaggaugggccgcacccaggggucuggccuccagggaccuagagaaugggagggagaac

SEQ ID NO: 493312 - RNA, 64 nt, hsa
agcucccuacagacgcuguagccaucacugccucuccagggacccuccucuccugcccaggaca

SEQ ID NO: 493313 - RNA, 64 nt, hsa
ggccaccccacagcucuuuccuuccccuccucucuccagggagccggggcugugagaggaucau

SEQ ID NO: 493314 - RNA, 64 nt, hsa
ccacuugccugaagcuccccucuuccucucuuccuccagggacucuggggcccuuugguggggc

SEQ ID NO: 493315 - RNA, 64 nt, hsa
cauugugcaauggggcuacgaggcugcaucuggcuccagggaagcguguugcaauccaugagug

SEQ ID NO: 493316 - RNA, 64 nt, hsa
ccucccaaccaauucaguauuuuucuccccauuuuccagggagaaaucuaaggcgucagaaugu

SEQ ID NO: 493317 - RNA, 64 nt, hsa
cuaaggagcagaaaacccaagggcagguggagaguccagggaggcaggauggaucaccagacac

SEQ ID NO: 493318 - RNA, 64 nt, hsa
ucaaaauugauaagucacuuggcucucggccuuguccagggagguugggcuaaggagagaugga

SEQ ID NO: 493319 - RNA, 64 nt, hsa
ugagcuccugccuuagggccucauuugcucuucauccagggaacugagcacagggggccuccag

SEQ ID NO: 493320 - RNA, 64 nt, hsa
ugcuucaaaggccagagucacaggaaggacuucuuccagggagauuaguggugauggagaggag

SEQ ID NO: 493321 - RNA, 64 nt, hsa
cucccagccaagaucugucuuccuucauggugccuccagggagccuuccuggucccaggaccuc

SEQ ID NO: 493322 - RNA, 64 nt, hsa
acguauccucuguauucaguaaacaggcugccucuccagggagggcugccauucauuccaacag

SEQ ID NO: 493323 - RNA, 64 nt, hsa
gcuuuaugugagauaccccacuccacaucaacauuccagggaugagccaaaccagcagggaguu

SEQ ID NO: 493324 - RNA, 64 nt, hsa
aucuuugagaccauccauucuccucaguggcuucuccagggaauucuuacagccaaguugugac

SEQ ID NO: 493325 - RNA, 64 nt, hsa
uccgcagccccuuuccccacgcccacccccagucuccagggacccuugccugccuccuaggcug

SEQ ID NO: 493326 - RNA, 64 nt, hsa
agcacugccuccuguuuucucccucucaugucccuccagggaaaaugacuuuauugcuuaauuu

SEQ ID NO: 493327 - RNA, 64 nt, hsa
cuacuggaagagcacagggcagggcagccagugguccagggauggcugcuuccugauacacgug

SEQ ID NO: 493328 - RNA, 64 nt, hsa
augaacucaauggacauccguugcagugacaucauccagggagacacacaagguaugccugaug

SEQ ID NO: 493329 - RNA, 64 nt, hsa
augguacagcuucuggagcagaacuuuccagggauccagggacacuuuuuuuuaaagcucauaa

SEQ ID NO: 493330 - RNA, 64 nt, hsa
cugccaaaaugguacagcuucuggagcagaacuuuccagggauccagggacacuuuuuuuuaaa

SEQ ID NO: 493331 - RNA, 64 nt, hsa
cagauugguuuaaccaauuacucguccccgccauuccagggauugauucucaccagcguuucug

SEQ ID NO: 493332 - RNA, 64 nt, hsa
uuugaggcacccacaccccccgcuuuccuuuaucuccagggacucucaggcuaaccuuugagau

SEQ ID NO: 493333 - RNA, 64 nt, hsa
cuuuugcauaggaaauacuugauuuaauuacagguccagggaugagcugaugguugcuggagga

SEQ ID NO: 493334 - RNA, 64 nt, hsa
uuuauucuugcacgauuuaggcaauuaucucucuuccagggaguaccuuuuuuucuaguugaga

SEQ ID NO: 493335 - RNA, 64 nt, hsa
ggcuccgggccugagcauucgcaaagcucgcuucuccagggagccuccucuuggcuuuggaaaa

SEQ ID NO: 493336 - RNA, 64 nt, hsa
auaacauuucuacccaggauaauagucacaguuuuccagggagggaaugauauaauuuucauga

SEQ ID NO: 493337 - RNA, 64 nt, hsa
gugacggacccaaggggcaaauagggucccaggguccagggaggggcgccugcugagcacuucc

SEQ ID NO: 493338 - RNA, 64 nt, hsa
gaccccucacuuaggcuuuccucugccaccccgguccagggaagaggcucgcucccgcccaugg

SEQ ID NO: 493339 - RNA, 64 nt, hsa
uuagaucuggacuggaacugccaggaccaccgccuccagggagucgcugggcaccuggagguau

SEQ ID NO: 493340 - RNA, 64 nt, hsa
gagcauuuugguuuccuuaaggcccagcaagacuuccagggacaucucuggugaagccagaaug

SEQ ID NO: 493341 - RNA, 64 nt, hsa
gggaaacagccuuccuggagcguugucuggagguuccagggacagggcagccucccagagccga

SEQ ID NO: 493342 - RNA, 64 nt, hsa; identical to SEQ ID NO: 55280

SEQ ID NO: 493343 - RNA, 64 nt, hsa; identical to SEQ ID NO: 55281

SEQ ID NO: 493344 - RNA, 64 nt, hsa; identical to SEQ ID NO: 55282

SEQ ID NO: 493345 - RNA, 64 nt, hsa; identical to SEQ ID NO: 55283

SEQ ID NO: 493346 - RNA, 64 nt, hsa; identical to SEQ ID NO: 55284

SEQ ID NO: 493347 - RNA, 64 nt, hsa; identical to SEQ ID NO: 55285

SEQ ID NO: 493348 - RNA, 64 nt, hsa; identical to SEQ ID NO: 55286

SEQ ID NO: 493349 - RNA, 64 nt, hsa; identical to SEQ ID NO: 55287

SEQ ID NO: 493350 - RNA, 64 nt, hsa; identical to SEQ ID NO: 55288

SEQ ID NO: 493351 - RNA, 64 nt, hsa; identical to SEQ ID NO: 55289

SEQ ID NO: 493352 - RNA, 64 nt, hsa; identical to SEQ ID NO: 55290

SEQ ID NO: 493353 - RNA, 64 nt, hsa; identical to SEQ ID NO: 55291

SEQ ID NO: 493354 - RNA, 64 nt, hsa; identical to SEQ ID NO: 55292

SEQ ID NO: 493355 - RNA, 64 nt, hsa; identical to SEQ ID NO: 55293

SEQ ID NO: 493356 - RNA, 64 nt, hsa; identical to SEQ ID NO: 55294

SEQ ID NO: 493357 - RNA, 64 nt, hsa; identical to SEQ ID NO: 55295

SEQ ID NO: 493358 - RNA, 64 nt, hsa; identical to SEQ ID NO: 55296

SEQ ID NO: 493359 - RNA, 64 nt, hsa; identical to SEQ ID NO: 55297

SEQ ID NO: 493360 - RNA, 64 nt, hsa; identical to SEQ ID NO: 55298

SEQ ID NO: 493361 - RNA, 64 nt, hsa; identical to SEQ ID NO: 55299

SEQ ID NO: 493362 - RNA, 64 nt, hsa; identical to SEQ ID NO: 55300

SEQ ID NO: 493363 - RNA, 64 nt, hsa; identical to SEQ ID NO: 55301

SEQ ID NO: 493364 - RNA, 64 nt, hsa; identical to SEQ ID NO: 55302

SEQ ID NO: 493365 - RNA, 64 nt, hsa; identical to SEQ ID NO: 55303

SEQ ID NO: 493366 - RNA, 64 nt, hsa; identical to SEQ ID NO: 55304

SEQ ID NO: 493367 - RNA, 64 nt, hsa; identical to SEQ ID NO: 55305

SEQ ID NO: 493368 - RNA, 64 nt, hsa; identical to SEQ ID NO: 55306

SEQ ID NO: 493369 - RNA, 64 nt, hsa; identical to SEQ ID NO: 55307

SEQ ID NO: 493370 - RNA, 64 nt, hsa; identical to SEQ ID NO: 55308

SEQ ID NO: 493371 - RNA, 64 nt, hsa; identical to SEQ ID NO: 55309

SEQ ID NO: 493372 - RNA, 64 nt, hsa; identical to SEQ ID NO: 55310

SEQ ID NO: 493373 - RNA, 64 nt, hsa; identical to SEQ ID NO: 55311

SEQ ID NO: 493374 - RNA, 64 nt, hsa; identical to SEQ ID NO: 55312

SEQ ID NO: 493375 - RNA, 64 nt, hsa; identical to SEQ ID NO: 55313

SEQ ID NO: 493376 - RNA, 64 nt, hsa; identical to SEQ ID NO: 55314

SEQ ID NO: 493377 - RNA, 64 nt, hsa; identical to SEQ ID NO: 55315

SEQ ID NO: 493378 - RNA, 64 nt, hsa; identical to SEQ ID NO: 55316

SEQ ID NO: 493379 - RNA, 64 nt, hsa; identical to SEQ ID NO: 55317

SEQ ID NO: 493380 - RNA, 64 nt, hsa; identical to SEQ ID NO: 55318

SEQ ID NO: 493381 - RNA, 64 nt, hsa; identical to SEQ ID NO: 55319

SEQ ID NO: 493382 - RNA, 64 nt, hsa; identical to SEQ ID NO: 55320

SEQ ID NO: 493383 - RNA, 64 nt, hsa; identical to SEQ ID NO: 55321

SEQ ID NO: 493384 - RNA, 64 nt, hsa; identical to SEQ ID NO: 55322

SEQ ID NO: 493385 - RNA, 64 nt, hsa; identical to SEQ ID NO: 55323

SEQ ID NO: 493386 - RNA, 64 nt, hsa; identical to SEQ ID NO: 55324

SEQ ID NO: 493387 - RNA, 64 nt, hsa; identical to SEQ ID NO: 55325

SEQ ID NO: 493388 - RNA, 64 nt, hsa; identical to SEQ ID NO: 55326

SEQ ID NO: 493389 - RNA, 64 nt, hsa; identical to SEQ ID NO: 55327

SEQ ID NO: 493390 - RNA, 64 nt, hsa; identical to SEQ ID NO: 55328

SEQ ID NO: 493391 - RNA, 64 nt, hsa; identical to SEQ ID NO: 55329

SEQ ID NO: 493392 - RNA, 64 nt, hsa; identical to SEQ ID NO: 55330

SEQ ID NO: 493393 - RNA, 64 nt, hsa; identical to SEQ ID NO: 55331

SEQ ID NO: 493394 - RNA, 64 nt, hsa; identical to SEQ ID NO: 55332

SEQ ID NO: 493395 - RNA, 64 nt, hsa; identical to SEQ ID NO: 55333

SEQ ID NO: 493396 - RNA, 64 nt, hsa; identical to SEQ ID NO: 55334

SEQ ID NO: 493397 - RNA, 64 nt, hsa; identical to SEQ ID NO: 55335

SEQ ID NO: 493398 - RNA, 64 nt, hsa; identical to SEQ ID NO: 103925

SEQ ID NO: 493399 - RNA, 64 nt, hsa; identical to SEQ ID NO: 103926

SEQ ID NO: 493400 - RNA, 64 nt, hsa; identical to SEQ ID NO: 103927

SEQ ID NO: 493401 - RNA, 64 nt, hsa; identical to SEQ ID NO: 103928

SEQ ID NO: 493402 - RNA, 64 nt, hsa; identical to SEQ ID NO: 103929

SEQ ID NO: 493403 - RNA, 64 nt, hsa; identical to SEQ ID NO: 103930

SEQ ID NO: 493404 - RNA, 64 nt, hsa; identical to SEQ ID NO: 103931

SEQ ID NO: 493405 - RNA, 64 nt, hsa; identical to SEQ ID NO: 103932

SEQ ID NO: 493406 - RNA, 64 nt, hsa; identical to SEQ ID NO: 103933

SEQ ID NO: 493407 - RNA, 64 nt, hsa; identical to SEQ ID NO: 103934

SEQ ID NO: 493408 - RNA, 64 nt, hsa; identical to SEQ ID NO: 103935

SEQ ID NO: 493409 - RNA, 64 nt, hsa; identical to SEQ ID NO: 103936

SEQ ID NO: 493410 - RNA, 64 nt, hsa; identical to SEQ ID NO: 103937

SEQ ID NO: 493411 - RNA, 64 nt, hsa; identical to SEQ ID NO: 103938

SEQ ID NO: 493412 - RNA, 64 nt, hsa; identical to SEQ ID NO: 103939

SEQ ID NO: 493413 - RNA, 64 nt, hsa; identical to SEQ ID NO: 311765

SEQ ID NO: 493414 - RNA, 64 nt, hsa; identical to SEQ ID NO: 311766

SEQ ID NO: 493415 - RNA, 64 nt, hsa; identical to SEQ ID NO: 311767

SEQ ID NO: 493416 - RNA, 64 nt, hsa; identical to SEQ ID NO: 311768

SEQ ID NO: 493417 - RNA, 64 nt, hsa; identical to SEQ ID NO: 311769

SEQ ID NO: 493418 - RNA, 64 nt, hsa; identical to SEQ ID NO: 311770

SEQ ID NO: 493419 - RNA, 64 nt, hsa; identical to SEQ ID NO: 311771

SEQ ID NO: 493420 - RNA, 64 nt, hsa; identical to SEQ ID NO: 311772

SEQ ID NO: 493421 - RNA, 64 nt, hsa; identical to SEQ ID NO: 311773

SEQ ID NO: 493422 - RNA, 64 nt, hsa; identical to SEQ ID NO: 311774

SEQ ID NO: 493423 - RNA, 64 nt, hsa; identical to SEQ ID NO: 311775

SEQ ID NO: 493424 - RNA, 64 nt, hsa; identical to SEQ ID NO: 311776

SEQ ID NO: 493425 - RNA, 64 nt, hsa; identical to SEQ ID NO: 311777

SEQ ID NO: 493426 - RNA, 64 nt, hsa; identical to SEQ ID NO: 311778

SEQ ID NO: 493427 - RNA, 64 nt, hsa; identical to SEQ ID NO: 311779

SEQ ID NO: 493428 - RNA, 64 nt, hsa; identical to SEQ ID NO: 311780

SEQ ID NO: 493429 - RNA, 64 nt, hsa; identical to SEQ ID NO: 311781

SEQ ID NO: 493430 - RNA, 64 nt, hsa; identical to SEQ ID NO: 311782

SEQ ID NO: 493431 - RNA, 64 nt, hsa; identical to SEQ ID NO: 311783

SEQ ID NO: 493432 - RNA, 64 nt, hsa; identical to SEQ ID NO: 311784

SEQ ID NO: 493433 - RNA, 64 nt, hsa; identical to SEQ ID NO: 311785

SEQ ID NO: 493434 - RNA, 64 nt, hsa; identical to SEQ ID NO: 311786

SEQ ID NO: 493435 - RNA, 64 nt, hsa; identical to SEQ ID NO: 311787

SEQ ID NO: 493436 - RNA, 64 nt, hsa; identical to SEQ ID NO: 311788

SEQ ID NO: 493437 - RNA, 64 nt, hsa; identical to SEQ ID NO: 311789

SEQ ID NO: 493438 - RNA, 64 nt, hsa; identical to SEQ ID NO: 311790

SEQ ID NO: 493439 - RNA, 64 nt, hsa; identical to SEQ ID NO: 311791

SEQ ID NO: 493440 - RNA, 64 nt, hsa; identical to SEQ ID NO: 311792

SEQ ID NO: 493441 - RNA, 64 nt, hsa; identical to SEQ ID NO: 311793

SEQ ID NO: 493442 - RNA, 64 nt, hsa; identical to SEQ ID NO: 311794

SEQ ID NO: 493443 - RNA, 64 nt, hsa; identical to SEQ ID NO: 311795

SEQ ID NO: 493444 - RNA, 64 nt, hsa; identical to SEQ ID NO: 311796

SEQ ID NO: 493445 - RNA, 64 nt, hsa; identical to SEQ ID NO: 311797

SEQ ID NO: 493446 - RNA, 64 nt, hsa; identical to SEQ ID NO: 311798

SEQ ID NO: 493447 - RNA, 64 nt, hsa; identical to SEQ ID NO: 311799

SEQ ID NO: 493448 - RNA, 64 nt, hsa; identical to SEQ ID NO: 311800

SEQ ID NO: 493449 - RNA, 64 nt, hsa; identical to SEQ ID NO: 311801

SEQ ID NO: 493450 - RNA, 64 nt, hsa; identical to SEQ ID NO: 311802

SEQ ID NO: 493451 - RNA, 64 nt, hsa
cuugauuagauccaaagucaaagcaaccauacuucaccuagagaagacaguauuggcaaucaug

SEQ ID NO: 493452 - RNA, 64 nt, hsa
caccucuuguuagacucugugcauuaauaaaacacaccuagagucuguugucauuucacuaaua

SEQ ID NO: 493453 - RNA, 64 nt, hsa
agucuaaugagaacuccagaaagcuggagcagcccaccuagagcuggccgcggccgcccagucu

SEQ ID NO: 493454 - RNA, 64 nt, hsa
cuccuggcagcuggaacccuggcugugccgagugcaccuagagggcacgcagcgugagggugug

SEQ ID NO: 493455 - RNA, 64 nt, hsa
accuucagcacacugaccaaccuggaauuaagaccaccuagauugcgagagcugaauuuagaaa

SEQ ID NO: 493456 - RNA, 64 nt, hsa
ugucaacgucaauaucacaggaacacacauucggcaccuagaaggcacgugggcaaaguaauca

SEQ ID NO: 493457 - RNA, 64 nt, hsa
ccauuggcuuggccucucucuguuccucccucugcaccuagaacucuuauccuuccugugguuu

SEQ ID NO: 493458 - RNA, 64 nt, hsa
agaguccccaacccccuugucuucuaccuucugucaccuagauuugaucagggucuauuuggaa

SEQ ID NO: 493459 - RNA, 64 nt, hsa; identical to SEQ ID NO: 97683

SEQ ID NO: 493460 - RNA, 64 nt, hsa; identical to SEQ ID NO: 97684

SEQ ID NO: 493461 - RNA, 64 nt, hsa; identical to SEQ ID NO: 97685

SEQ ID NO: 493462 - RNA, 64 nt, hsa; identical to SEQ ID NO: 97686

SEQ ID NO: 493463 - RNA, 64 nt, hsa; identical to SEQ ID NO: 97687

SEQ ID NO: 493464 - RNA, 64 nt, hsa; identical to SEQ ID NO: 97688

SEQ ID NO: 493465 - RNA, 64 nt, hsa; identical to SEQ ID NO: 97689

SEQ ID NO: 493466 - RNA, 64 nt, hsa; identical to SEQ ID NO: 97690

SEQ ID NO: 493467 - RNA, 64 nt, hsa; identical to SEQ ID NO: 97691

SEQ ID NO: 493468 - RNA, 64 nt, hsa; identical to SEQ ID NO: 97692

SEQ ID NO: 493469 - RNA, 56 nt, hsa; identical to SEQ ID NO: 97693

SEQ ID NO: 493470 - RNA, 64 nt, hsa; identical to SEQ ID NO: 97694

SEQ ID NO: 493471 - RNA, 64 nt, hsa; identical to SEQ ID NO: 97695

SEQ ID NO: 493472 - RNA, 64 nt, hsa; identical to SEQ ID NO: 97696

SEQ ID NO: 493473 - RNA, 64 nt, hsa; identical to SEQ ID NO: 97697

SEQ ID NO: 493474 - RNA, 64 nt, hsa; identical to SEQ ID NO: 97698

SEQ ID NO: 493475 - RNA, 64 nt, hsa; identical to SEQ ID NO: 97699

SEQ ID NO: 493476 - RNA, 64 nt, hsa; identical to SEQ ID NO: 97700

SEQ ID NO: 493477 - RNA, 64 nt, hsa; identical to SEQ ID NO: 97701

SEQ ID NO: 493478 - RNA, 64 nt, hsa; identical to SEQ ID NO: 97702

SEQ ID NO: 493479 - RNA, 64 nt, hsa; identical to SEQ ID NO: 97703

SEQ ID NO: 493480 - RNA, 64 nt, hsa; identical to SEQ ID NO: 97704

SEQ ID NO: 493481 - RNA, 64 nt, hsa; identical to SEQ ID NO: 97705

SEQ ID NO: 493482 - RNA, 64 nt, hsa; identical to SEQ ID NO: 97706

SEQ ID NO: 493483 - RNA, 64 nt, hsa; identical to SEQ ID NO: 97707

SEQ ID NO: 493484 - RNA, 64 nt, hsa; identical to SEQ ID NO: 97708

SEQ ID NO: 493485 - RNA, 64 nt, hsa; identical to SEQ ID NO: 97709

SEQ ID NO: 493486 - RNA, 64 nt, hsa; identical to SEQ ID NO: 97710

SEQ ID NO: 493487 - RNA, 64 nt, hsa; identical to SEQ ID NO: 97711

SEQ ID NO: 493488 - RNA, 64 nt, hsa; identical to SEQ ID NO: 97712

SEQ ID NO: 493489 - RNA, 64 nt, hsa; identical to SEQ ID NO: 97713

SEQ ID NO: 493490 - RNA, 64 nt, hsa; identical to SEQ ID NO: 97714

SEQ ID NO: 493491 - RNA, 64 nt, hsa; identical to SEQ ID NO: 97715

SEQ ID NO: 493492 - RNA, 64 nt, hsa; identical to SEQ ID NO: 97716

SEQ ID NO: 493493 - RNA, 64 nt, hsa; identical to SEQ ID NO: 97717

SEQ ID NO: 493494 - RNA, 64 nt, hsa; identical to SEQ ID NO: 97718

SEQ ID NO: 493495 - RNA, 64 nt, hsa; identical to SEQ ID NO: 97719

SEQ ID NO: 493496 - RNA, 64 nt, hsa; identical to SEQ ID NO: 97720

SEQ ID NO: 493497 - RNA, 64 nt, hsa; identical to SEQ ID NO: 97721

SEQ ID NO: 493498 - RNA, 64 nt, hsa; identical to SEQ ID NO: 97722

SEQ ID NO: 493499 - RNA, 64 nt, hsa; identical to SEQ ID NO: 97723

SEQ ID NO: 493500 - RNA, 64 nt, hsa; identical to SEQ ID NO: 97724

SEQ ID NO: 493501 - RNA, 64 nt, hsa; identical to SEQ ID NO: 97725

SEQ ID NO: 493502 - RNA, 64 nt, hsa; identical to SEQ ID NO: 97726

SEQ ID NO: 493503 - RNA, 64 nt, hsa; identical to SEQ ID NO: 97727

SEQ ID NO: 493504 - RNA, 64 nt, hsa; identical to SEQ ID NO: 97728

SEQ ID NO: 493505 - RNA, 64 nt, hsa; identical to SEQ ID NO: 97729

SEQ ID NO: 493506 - RNA, 64 nt, hsa; identical to SEQ ID NO: 97730

SEQ ID NO: 493507 - RNA, 64 nt, hsa; identical to SEQ ID NO: 97731

SEQ ID NO: 493508 - RNA, 64 nt, hsa; identical to SEQ ID NO: 97732

SEQ ID NO: 493509 - RNA, 64 nt, hsa; identical to SEQ ID NO: 97733

SEQ ID NO: 493510 - RNA, 64 nt, hsa; identical to SEQ ID NO: 97734

SEQ ID NO: 493511 - RNA, 64 nt, hsa
uauuucucauuuaacuuuacuguuaagacaucacugaaaugaacuucaguaagcuuucaauuuu

SEQ ID NO: 493512 - RNA, 64 nt, hsa
cacuuaaccucucuuugccucaauuuccucaucuugaaaugaggauaauaauaccugcuguacc

SEQ ID NO: 493513 - RNA, 64 nt, hsa
cuuucugauuucuuggagcaggaauuuuagagauugaaaugaaugaucauuuagucagauuuau

SEQ ID NO: 493514 - RNA, 64 nt, hsa
cucuagggagaaaaauuaauuuacuagaaaggcaugaaaugaucaugggaagagugguuaagac

SEQ ID NO: 493515 - RNA, 64 nt, hsa
gugcuguguucuauauaaaaaacauaauaaaaauugaaaugaaagaauaauuguuauuauaaaa

SEQ ID NO: 493516 - RNA, 56 nt, hsa
uuaccauggaaacugagugaaugguuugaaaugaagacuuugucguguacuuagga

SEQ ID NO: 493517 - RNA, 64 nt, hsa
ucaccaccuaaauguaauguugauuccucaagaaugaaaugaaggcacuacauugaaauauguu

SEQ ID NO: 493518 - RNA, 64 nt, hsa
guuuuggaaaauagaguaauuuaaaaaauauauuugaaaugaaaaucuccaacacauuagaaga

SEQ ID NO: 493519 - RNA, 64 nt, hsa
uccacccaauacauuauuagacugaacugugaccugaaaugagcaauaaacucuguauuaauuc

SEQ ID NO: 493520 - RNA, 64 nt, hsa
uugccuauauauuuaugacuguguuaaugaguagugaaaugaugcggaaagacagcuaucagga

SEQ ID NO: 493521 - RNA, 64 nt, hsa
uuugaggcccagcaagcaccacuaaauuacuggaugaaaugaaauuguucacuugagggauuag

SEQ ID NO: 493522 - RNA, 64 nt, hsa
uuuuauucacauagauacuauguccuugacauauugaaaugauucuuuucugaaaguauucaug

SEQ ID NO: 493523 - RNA, 64 nt, hsa
uaucccuucauuguaaaaaguaccuaaacauucgugaaaugauuuuuuuuagcugaaaaaugcu

SEQ ID NO: 493524 - RNA, 64 nt, hsa
gacuagaccaaauaucaagaucauuuugagacucugaaaugaaguaaaagagauuuccugugac

SEQ ID NO: 493525 - RNA, 64 nt, hsa
auuuaaaaaccauuaaaacacugucucccacucaugaaaugagccacguaguuccuauuuaaug

SEQ ID NO: 493526 - RNA, 64 nt, hsa
cagaguucuuaagggacuggguaaggccugacccugaaaugaccauggauauuuuucuaccuac

SEQ ID NO: 493527 - RNA, 64 nt, hsa
acauguuucaaagugguguggugggccaaaauauugaaaugauggaacugacugauaaagcugu

SEQ ID NO: 493528 - RNA, 64 nt, hsa
cccauguuacaaggaaguuaaacaauuguaauaaugaaaugagcuuucucuauagccauauuua

SEQ ID NO: 493529 - RNA, 64 nt, hsa
caucuuuaugcuaauagauuuggaauuuuugaaaugaaaugaaaccuuguuuaaacauuaaaau

SEQ ID NO: 493530 - RNA, 64 nt, hsa
uguuacaucuuuaugcuaauagauuuggaauuuuugaaaugaaaugaaaccuuguuuaaacauu

SEQ ID NO: 493531 - RNA, 64 nt, hsa
acaaagcacaauuucccgccuuuuuuuuuuuuugugaaaugaaaaaaacaaauuguguuuuauu

SEQ ID NO: 493532 - RNA, 64 nt, hsa
ggacagagacuuugcaauccgaaagaauagacugugaaaugaguucuuaaagaaaagacuuguu

SEQ ID NO: 493533 - RNA, 64 nt, hsa
caauucaucaagccaguuauuacugaaaaaucauugaaaugagacaguuuacagucauuucugc

SEQ ID NO: 493534 - RNA, 64 nt, hsa
uaauagauugaguucuguaagggcaaaaacggauugaaaugaacauagcguuuugcacuaauga

SEQ ID NO: 493535 - RNA, 64 nt, hsa
guuucuuauauuuauguauuucuauucugauuucugaaaugauaaccuaguagugucugaugaa

SEQ ID NO: 493536 - RNA, 64 nt, hsa
auguaagugucagauacuaggcagguguuagggaugaaaugaugaaugaggcauggaccuguuc

SEQ ID NO: 493537 - RNA, 64 nt, hsa
uacuuggauauucauguaauauauaaagguuuggugaaaugaacuuuaguuaggaaaaagcugg

SEQ ID NO: 493538 - RNA, 64 nt, hsa
cuuuggauuaugauuuuaagaaauuauuaauuuaugaaaugauagguaaggagaagcuggauua

SEQ ID NO: 493539 - RNA, 64 nt, hsa
cuguuuaauaagagcaaauauaggggaaaaucuuugaaaugaaagcuacaaauacaugugagaa

SEQ ID NO: 493540 - RNA, 64 nt, hsa
ccuggggcuggcuaggccuccacuuguccaucugugaaaugaaaggaucagccuggacagcccu

SEQ ID NO: 493541 - RNA, 64 nt, hsa
uucucuuuauaaauauuuuugcucccucagauuuugaaaugauuuuaucaguuuuagagaggca

SEQ ID NO: 493542 - RNA, 64 nt, hsa
ugaauggauacaauagguuaaggcccaagauguuugaaaugaaugcaauauuaauagaugcaua

SEQ ID NO: 493543 - RNA, 64 nt, hsa
ucacucuguuuguuaggagaugucugcuuuuccaugaaaugaaauaguggcuaaagcccugaaa

SEQ ID NO: 493544 - RNA, 64 nt, hsa
auaaagccucagggaggccauuuuugccuaaauuugaaaugagggugggccagaugaguauguu

SEQ ID NO: 493545 - RNA, 64 nt, hsa
caauggcuugaaacuuguguaucauaugugauuuugaaaugaacaccuugaauagcacuaauuu

SEQ ID NO: 493546 - RNA, 64 nt, hsa
caauuuugugacuguuaccaugugaaaguccuguugaaaugaacaauugucugccccacaauca

SEQ ID NO: 493547 - RNA, 64 nt, hsa
cgugugaccauaagauacugauagcauugagucuugaaaugauuuaauaauaugagugaggauu

SEQ ID NO: 493548 - RNA, 64 nt, hsa
ccuuacugcuuauuaaucuguauuguacacaugaugaaaugaagcagaagcugggagucggccu

SEQ ID NO: 493549 - RNA, 64 nt, hsa
cacaccuagcuaauuuuuuucaucauaaaguggaugaaaugagcaaguaccuaaaaauuuuauu

SEQ ID NO: 493550 - RNA, 64 nt, hsa
aaaacagacauguaggagacauucaacaggaguaugaaaugagaguuagaccauaugggcugac

SEQ ID NO: 493551 - RNA, 64 nt, hsa
uucuuauaacauauccagccauuucaauuuugauugaaaugaacuacaaagaauaguguuuguc

SEQ ID NO: 493552 - RNA, 64 nt, hsa
ugguagccucagucucuuuaucacuaacuuggauugaaaugagugaggccaacucacauuccca

SEQ ID NO: 493553 - RNA, 64 nt, hsa
ggauguucacuauggaaaaacaaauauacaaauaugaaaugagggaaggcaagaaagaaccaug

SEQ ID NO: 493554 - RNA, 64 nt, hsa
acaaaauucuaaucuauguugaacuuuguauacuugaaaugauaauaaaaaggauauaauuucu

SEQ ID NO: 493555 - RNA, 64 nt, hsa
uccuauuugaccccuuuucuuuuuugaaauucccugaaaugauguuauucuagagaacuucuau

SEQ ID NO: 493556 - RNA, 64 nt, hsa
uggauuagcuuaaucaccaaguccugucaacuucugaaaugaaucucaaauuucuucccuucuc

SEQ ID NO: 493557 - RNA, 64 nt, hsa
uuucgauccuguuuauucaaaugugugauuuugcugaaaugaaagggauaaaaugaauacuuag

SEQ ID NO: 493558 - RNA, 64 nt, hsa
aaaagcauacuuaguacuccuguauuuguucuuaugaaaugacuaucugccuucuuguaucuag

SEQ ID NO: 493559 - RNA, 64 nt, hsa
auauucuguagauugauugcagauuucuuaaaucugaaaugaucuuuacacuguaauucucagc

SEQ ID NO: 493560 - RNA, 64 nt, hsa
gauuauaucuaaauggauuauuuguuaaaaguacugaaaugaguauaaggcaguaucacccauc

SEQ ID NO: 493561 - RNA, 64 nt, hsa
cacauacuggaugcucaauaaacuuuugaugaaaugaaaugacaacuuuauuccacauaaacaa

SEQ ID NO: 493562 - RNA, 64 nt, hsa
ccuagcacauacuggaugcucaauaaacuuuugaugaaaugaaaugacaacuuuauuccacaua

SEQ ID NO: 493563 - RNA, 64 nt, hsa
agaagaaacagacccaaaguugccagaagguaccugaaaugagugacaucagguauuuggaagg

SEQ ID NO: 493564 - RNA, 64 nt, hsa
aaggaaccaugauugacaacagucaagcuguggaugaaaugaccaggaacggagaaugaaguau

SEQ ID NO: 493565 - RNA, 64 nt, hsa
ggaaccacauuuuuaucuagaugaaaauuuggaaugaaaugaaggaauagaaauccaauaaaag

SEQ ID NO: 493566 - RNA, 64 nt, hsa
ucuugaucuuccuuuacacauuucucgggaaaucugaaaugaugcuggaugggacucuacacau

SEQ ID NO: 493567 - RNA, 64 nt, hsa
cugaaauauauauuuuaaacagcuacuguaaguaugaaaugaaagaaaaacaaucauuggacgg

SEQ ID NO: 493568 - RNA, 64 nt, hsa
uuauuucacaagaggagugugagggucaaggggaugaaaugaggggcugcuuuuagggcccucc

SEQ ID NO: 493569 - RNA, 64 nt, hsa
aucugguaauguacauugugagguagacugauaaugaaaugacaguguaacaucuuaaccaaga

SEQ ID NO: 493570 - RNA, 64 nt, hsa
uuaauaacaaauaggcguaaaaaaauuuucacauugaaaugauagaaacauuugauguaauaaa

SEQ ID NO: 493571 - RNA, 64 nt, hsa
ccaaaugcugugagucugaaguaugugccuggugugaaaugaucuauggccuguuucuuacaca

SEQ ID NO: 493572 - RNA, 64 nt, hsa
cuauacuuuggcagguuaugaacuuugaaugugaugaaaugacacguuuggcugcauuuggaug

SEQ ID NO: 493573 - RNA, 64 nt, hsa
gacaaauauuuauccacuaaguaaaauguuagacugaaaugauucuuugacaagcuugccaauu

SEQ ID NO: 493574 - RNA, 64 nt, hsa
auaaauauuugucuaccaaguaaaauauuuugacugaaaugauucuuugaaaugcauauugauu

SEQ ID NO: 493575 - RNA, 64 nt, hsa
ugaaaugagaacaaagaggaaaaugguaaaaacuugaaaugaggcugggguauaguuuguccua

SEQ ID NO: 493576 - RNA, 64 nt, hsa
uguauauuauuauuaaucaaugcaauauuuaaaaugaaaugagaacaaagaggaaaaugguaaa

SEQ ID NO: 493577 - RNA, 64 nt, hsa
ugcaccucccagaggugcagcugcccaaagucugugaaaugaaagucccugacaugaagcuccc

SEQ ID NO: 493578 - RNA, 64 nt, hsa
cuagauggcugccugcuuuccugggcacucauggugaaaugacaggcaagaaguggggaugaug

SEQ ID NO: 493579 - RNA, 64 nt, hsa
cucaauauucucagaauaauuuucaauguauuaaugaaaugaaaugauaauuuggcuucauauc

SEQ ID NO: 493580 - RNA, 64 nt, hsa
uauucucagaauaauuuucaauguauuaaugaaaugaaaugauaauuuggcuucauaucuagac

SEQ ID NO: 493581 - RNA, 64 nt, hsa
auggcaguaauggggcaaacaauaaaaugcaaugugaaaugauuugaugauuugggaaauaaga

SEQ ID NO: 493582 - RNA, 64 nt, hsa
uauaaauacagucuuaaaccuuuaugucugagucugaaaugaaccuguucacuuagacuagauu

SEQ ID NO: 493583 - RNA, 64 nt, hsa
acguagcucccagggagcucacagcaacacccccuaccaccaggaugggcaguaauaugugaca

SEQ ID NO: 493584 - RNA, 64 nt, hsa
acccggccaucaacccaaauuggacauuccagacuaccaccaacuggaucccagcugccuuccu

SEQ ID NO: 493585 - RNA, 64 nt, hsa
ucuaccaccauucccuucucuauuugagaaucucuaccaccauucccuucucuauuugggaaac

SEQ ID NO: 493586 - RNA, 64 nt, hsa
ucuguuacagcucaaaauggaggcugagaaucucuaccaccauucccuucucuauuugagaauc

SEQ ID NO: 493587 - RNA, 64 nt, hsa
uaagagauauuacuuuauugaauaugguuggcauuaaauuuagcauuucauuaucuaacaaaau

SEQ ID NO: 493588 - RNA, 64 nt, hsa
aauuucaaagucaauaccagcagauucaugaaaguaaauuuaguccuauaauuuucagcuuaau

SEQ ID NO: 493589 - RNA, 64 nt, hsa
gacaaaaugagacauugucucuaaaauacauaaguaaauuuaaaaaaaaaagaauaauaauuug

SEQ ID NO: 493590 - RNA, 64 nt, hsa
aaaaacuaguaagcaaauaaaugauaaacauaaguaaauuuaaacuguuguuuguauaaaacaa

SEQ ID NO: 493591 - RNA, 64 nt, hsa
uaggcauguuuggaggcuuuccuauucuagcauuuaaauuuaaauuuuauuaaaauuaaauaau

SEQ ID NO: 493592 - RNA, 64 nt, hsa
uuuuauuaaaauuaaauaauuuaaaucuagcauuuaaauuuaaauaauuuaagucuagcauuua

SEQ ID NO: 493593 - RNA, 64 nt, hsa
gcacaucuauggcuacuguucaaauacauaaagauaaauuuauuuucacacaguccacaagggg

SEQ ID NO: 493594 - RNA, 64 nt, hsa
ugugugaguguaugugugugugugauuuuuuuuuuaaauuuauguugcggaaagguaaccacaa

SEQ ID NO: 493595 - RNA, 64 nt, hsa
guguguuaaaauguuccuguaaaagaaacauugguaaauuuaaauacauacuguucuaauuuug

SEQ ID NO: 493596 - RNA, 64 nt, hsa
uaacauuaaugcaaaucaugcagaauuugaguuauaaauuuaaauauaaauugaccauugauga

SEQ ID NO: 493597 - RNA, 64 nt, hsa
cauagagaaaauacuuaauacacauuuguugacuuaaauuuaauucaaggauugaaaaauuaac

SEQ ID NO: 493598 - RNA, 64 nt, hsa
uaaauuuaccuagcuacaacuuuuaugucucuuguaaauuuauauauacuuucagugccauugu

SEQ ID NO: 493599 - RNA, 64 nt, hsa
auucaaaaaugaguuaaguaacaugauaaucuuuuaaauuuaccuagcuacaacuuuuaugucu

SEQ ID NO: 493600 - RNA, 64 nt, hsa
uaguaaucauugcuuucuguagaagaaaaagguuuaaauuuaaaauguguauuuagagcaugga

SEQ ID NO: 493601 - RNA, 64 nt, hsa
uaaugagucaauaccuuuauaagcaaaaccaugauaaauuuaaaaacaacagaaauguggcaug

SEQ ID NO: 493602 - RNA, 64 nt, hsa
gguguuggcuuuguuuggauguaauuuaggguacuaaauuuaaauuuaaagauauuguucaaac

SEQ ID NO: 493603 - RNA, 64 nt, hsa
ggcuuuguuuggauguaauuuaggguacuaaauuuaaauuuaaagauauuguucaaacaauauc

SEQ ID NO: 493604 - RNA, 64 nt, hsa
aggaaauguaagagguuuuguugucuguuuuaaauaaauuuaauucggaacacaugauccaaca

SEQ ID NO: 493605 - RNA, 64 nt, hsa
gauucuggaguucuuugaaaugugcuggaagacuuaaauuuauuaaucuuaaaucauguacuuu

SEQ ID NO: 493606 - RNA, 64 nt, hsa
guugccaaucacauagcuuucuauuuguuaaguauaaauuuaaauuuaaaaucacuuuuuuaac

SEQ ID NO: 493607 - RNA, 64 nt, hsa
aaucacauagcuuucuauuuguuaaguauaaauuuaaauuuaaaaucacuuuuuuaacgaaugg

SEQ ID NO: 493608 - RNA, 64 nt, hsa
gcuuuuggcugagaaaaggaauccaaaauauuaauaaauuuagaucucaaaaccacuauuuuua

SEQ ID NO: 493609 - RNA, 64 nt, hsa
ugguuguaauaugugaugguuaaccuguagcuuauaaauuuacuuauuauucuuuuacucauuu

SEQ ID NO: 493610 - RNA, 64 nt, hsa
gcuaucuuagcuaacuuauccuaaacccuuaaccuaaauuuaacuugagccccagucucagaaa

SEQ ID NO: 493611 - RNA, 64 nt, hsa
aucuaacugauaaaggucuaguauccaaaauauuuaaauuuaugaguguuaauaaaauuuaucu

SEQ ID NO: 493612 - RNA, 64 nt, hsa
uagauuucuauaaaagcaagauuuugucaaaaacuaaauuuaugauuauucaagaaagugaaaa

SEQ ID NO: 493613 - RNA, 64 nt, hsa
uaaaauaaauuuuuauaaggaauacuguuauaucuaaauuuaaacaguauuuauuuuuucaaaa

SEQ ID NO: 493614 - RNA, 64 nt, hsa
gccagaaggaagaagagacguuaagaauggcagauaaauuuaacagguaaugauacagagauug

SEQ ID NO: 493615 - RNA, 64 nt, hsa
auuagaauguaugucucagaagaugguuucuguuuaaauuuauggucaaguuacaacaacugaa

SEQ ID NO: 493616 - RNA, 64 nt, hsa
uuaaaaagucaaggguucuauauugugaguaaauuaaauuuacauuugaguuguuuguugcuaa

SEQ ID NO: 493617 - RNA, 64 nt, hsa
ucugaaauguucguuuuguggaaaagaaacuaguuaaauuuacuauuccuaacccgaaugaaau

SEQ ID NO: 493618 - RNA, 64 nt, hsa
uaggcuucuugguacaccagauuauuuauaacauuaaauuuaugaguauuuuacucugaauucu

SEQ ID NO: 493619 - RNA, 64 nt, hsa
acaaugaagcaccuaaaaacacugcuugauauuauaaauuuaaaacacaagugaaaguuuagcc

SEQ ID NO: 493620 - RNA, 64 nt, hsa
uuguaauugcuuuuuuaaauauuaguuaauggauuaaauuuaauucuucagcguaaaaugguga

SEQ ID NO: 493621 - RNA, 64 nt, hsa
ucauuuuauuaauauuuuucuccuugaccucucauaaauuuacuuuacacaauucuuacccugu

SEQ ID NO: 493622 - RNA, 64 nt, hsa
gagucuaugauacuguauaacaggggcuucuaauuaaauuuaggggauccugaugccacuuagc

SEQ ID NO: 493623 - RNA, 64 nt, hsa
caagcugauuuuaagugauauucagauggccuuuuaaauuuaauuauuauguauuuaaaauuua

SEQ ID NO: 493624 - RNA, 64 nt, hsa
acuuaacuaaauaaaaaacuaagcagauaugaguuaaauuuaaaaguuucaauuuauugcucag

SEQ ID NO: 493625 - RNA, 64 nt, hsa
uuauuguauaugaugaacaaaacuuaaaauuuuuuaaauuuaauuuuuaaauacuguuucagag

SEQ ID NO: 493626 - RNA, 64 nt, hsa
ggcaaaaauaauggucuaagccucccaauagggauaaauuuagggugacuguguggcugacuau

SEQ ID NO: 493627 - RNA, 64 nt, hsa
gaacuuuuguauuuuucauuuuucauuugauuuguaaauuuacuuauguuaaaaauaaaccauu

SEQ ID NO: 493628 - RNA, 64 nt, hsa
guauggucgcaguaaaugaaauuguguuuaagacuaaauuuacuaccguuuugaacagacauuc

SEQ ID NO: 493629 - RNA, 64 nt, hsa
uuguuaauauggcaguaauuaauuaguaucuacuuaaauuuaguggucagaaauguauuugaag

SEQ ID NO: 493630 - RNA, 64 nt, hsa
cugcucuguaaauaaagcuaauuaaacgucuguguaaauuuaaaaaggggaaauacuuuaauuu

SEQ ID NO: 493631 - RNA, 64 nt, hsa
uaccuucucuuguacauagucagacuauuuguauuaaauuuacauuucauucuaaguucaaaag

SEQ ID NO: 493632 - RNA, 64 nt, hsa
uaauuuuuacucugaugugcaauacauuuguuauuaaauuuauuauuuaagaugguagcacuag

SEQ ID NO: 493633 - RNA, 64 nt, hsa
gaaaaauaauuauggggaaauacauguuuguuauuaaauuuauuauuaaagauaguagcacuag

SEQ ID NO: 493634 - RNA, 64 nt, hsa
acugguaaagaauaacuauaaaauaugaaagcucuaaauuuaaaauaaauuuagagauagaauc

SEQ ID NO: 493635 - RNA, 64 nt, hsa
auaacuauaaaauaugaaagcucuaaauuuaaaauaaauuuagagauagaaucaugguacauua

SEQ ID NO: 493636 - RNA, 64 nt, hsa
ugccuuuuacuuuuaugucaacaauauuaauuauuaaauuuaguaagacgcacuuuccuuucuu

SEQ ID NO: 493637 - RNA, 64 nt, hsa
uuaauaguuuuaaaaaugucucuuuuguuaagaauaaauuuaggcuucaaucauuauaauccug

SEQ ID NO: 493638 - RNA, 64 nt, hsa
aguagaaucuuuugugcuucaguaacuugaaguuuaaauuuaaaaugcagagagaccaaugguu

SEQ ID NO: 493639 - RNA, 64 nt, hsa
auguuuacaguguagaaugauuaaaucaauguaauaaauuuauugccucauaccauuuuuugug

SEQ ID NO: 493640 - RNA, 64 nt, hsa
uaaauuucccuuuuauuuuggucaugcaucaaaauaaauuuacuaaguacuaaagagccaacau

SEQ ID NO: 493641 - RNA, 64 nt, hsa
aauuauuucucuggauaucuuucuguguuccauguaaauuuauuuaccaacaucuauugucaac

SEQ ID NO: 493642 - RNA, 64 nt, hsa
aaauagaaaggcugcuuuagugccuuacgcuuacuaaauuuaaaucuuuauuuaccuggguuug

SEQ ID NO: 493643 - RNA, 64 nt, hsa
uuggguacuuagaggauaaagcuucguggucguauaaauuuagaucauuuggauugauuuuuau

SEQ ID NO: 493644 - RNA, 64 nt, hsa
gaacaucuuuuggcauuccacuaaguauauauuguaaauuuaaugaacaaucaagguucacaau

SEQ ID NO: 493645 - RNA, 64 nt, hsa
uuuguuauucaguaguuuugcagacuuaaaaguguaaauuuagaauuagaagaugaagcuauag

SEQ ID NO: 493646 - RNA, 64 nt, hsa
aacaauuuuuaaaauucagaauguaaaaauuggguaaauuuacuacugaggggagugcacuuau

SEQ ID NO: 493647 - RNA, 64 nt, hsa
aaggcguuauguguugaacaguaugcuucagggguaaauuuaaaauagucucuugaagcccuag

SEQ ID NO: 493648 - RNA, 64 nt, hsa
uuaaauuuguguuauuuuuugaaccacagaugaguaaauuuaauaaugaaccaauuacacucuu

SEQ ID NO: 493649 - RNA, 64 nt, hsa
ugcugauggugugauuagguguagagaauuugcuuaaauuuaacuucaaaguucaucacacagc

SEQ ID NO: 493650 - RNA, 64 nt, hsa
cugccuauaaauuuacucuguugaauauuuagcauaaauuuaauguagacauuuuuauuuauau

SEQ ID NO: 493651 - RNA, 64 nt, hsa
uggggcuaguuuaagacuuaguuauuucugccuauaaauuuacucuguugaauauuuagcauaa

SEQ ID NO: 493652 - RNA, 64 nt, hsa
auguguuuuaauggcaccugggugauucuucagcuaaauuuagucauuucuguuucuaaauauu

SEQ ID NO: 493653 - RNA, 64 nt, hsa
uuugacaacuccuagugaacuuggacuugguugcuaaauuuaacuuacacuaauaaccaauuau

SEQ ID NO: 493654 - RNA, 64 nt, hsa
gucccaagaauucagcuacaugaugacucgaauuuaaauuuagauuaaucaaauggucuccugu

SEQ ID NO: 493655 - RNA, 64 nt, hsa
uggagcauauacaguucucauuauacucuuauuuuaaauuuauauuugaacacagucaaaucug

SEQ ID NO: 493656 - RNA, 64 nt, hsa
uaaauuuauccuccaacuaaauuuuugauagaauuaaauuuaaauuuguccuccaacuguuugc

SEQ ID NO: 493657 - RNA, 64 nt, hsa
uuuaaauuugauaaauuuuugauagaauuaaauuuaaauuuauccuccaacuaaauuuuugaua

SEQ ID NO: 493658 - RNA, 64 nt, hsa
gcacaauuuaaauuugauaaauuuuugauagaauuaaauuuaaauuuauccuccaacuaaauuu

SEQ ID NO: 493659 - RNA, 64 nt, hsa
agguggauuuuuggcugucauuucaaaaguggaauaaauuuauuaauuuaguaguacuaaaugg

SEQ ID NO: 493660 - RNA, 64 nt, hsa
ucuugugcagacaacaucauggcucuuggcaguuuaaauuuaguaauuuuaauuuagugaacag

SEQ ID NO: 493661 - RNA, 64 nt, hsa
gaauugaaauaaguaucaguuuaaaaauuuauauuaaauuuauuaaaauuaaaauccaguuccu

SEQ ID NO: 493662 - RNA, 64 nt, hsa
cuuaaaauucugaauucgucuuuucugagaaacauaaauuuacauauuuuucaacagaaggcua

SEQ ID NO: 493663 - RNA, 64 nt, hsa
uuuuauaguuaugcuuuuuaaaauucauuguuuuuaaauuuagacuucuuauuuccacacugga

SEQ ID NO: 493664 - RNA, 64 nt, hsa
aaacuuuauuaauguauuaaauauuacaacuagcuaaauuuauugucacuguguauauaauguu

SEQ ID NO: 493665 - RNA, 64 nt, hsa
caaaaaagaucccugggauuacuuagccaaggcuuaaauuuauuuuucaaagucaagaacauua

SEQ ID NO: 493666 - RNA, 64 nt, hsa
cauuuucuuccccaccccaacccccaugagcucuuaaauuuagauuucuaucucuuguaaguca

SEQ ID NO: 493667 - RNA, 64 nt, hsa
acuuaaaucagaggaaggauuuuauaaagauuaauaaauuuaauuuuaccaauaaauauuccca

SEQ ID NO: 493668 - RNA, 64 nt, hsa
agcuaagaaaacugagaacuaacauuaaaaaaauuaaauuuagaauaagaaugauuucuuuaau

SEQ ID NO: 493669 - RNA, 64 nt, hsa
uuugaauacucuauugcugauauaaugcaagauuuaaauuuauacauauaacuaauuucaaaug

SEQ ID NO: 493670 - RNA, 64 nt, hsa
cuuuauucuguguaauuguguuaauaaauccuaauaaauuuaaauuuuuaaaauuuuacaaacc

SEQ ID NO: 493671 - RNA, 64 nt, hsa
cauacucuucaagaucauaauaauaucauuaauauaaauuuaaacaacauggcuuguuagaaaa

SEQ ID NO: 493672 - RNA, 64 nt, hsa
ugggccuggcaacauuuucuacuguacuuuuguuuaaauuuaaugaaacaaaaaauuccuaaga

SEQ ID NO: 493673 - RNA, 64 nt, hsa
uuuuuagagaguaauguauaauuucauagcauuuuaaauuuaguguaucaugcgaguuuuuuuu

SEQ ID NO: 493674 - RNA, 64 nt, hsa
ugauacaagaagcacugacaauguuucuguuucuuaaauuuaaaacuggccugguuugccuuuu

SEQ ID NO: 493675 - RNA, 64 nt, hsa
cagucaugccuuauuuucuugcuaaaacucuauguaaauuuaaguaugcaaaauguuuaaguca

SEQ ID NO: 493676 - RNA, 64 nt, hsa
cggcuuucaguauuuuguacuuguaggcaccuaauaaauuuauuauuugcuauacugaacugau

SEQ ID NO: 493677 - RNA, 64 nt, hsa
uaaugguaaggauugacucaagagacaguauuaguaaauuuauuguguauggaucaaaagugaa

SEQ ID NO: 493678 - RNA, 64 nt, hsa
auaggaaacuaugugugucccaaggaaaucccuguaaauuuaacucaccuacaaaaggcuuuuu

SEQ ID NO: 493679 - RNA, 64 nt, hsa
gcuguuuuaugucauacucuguguaaucucugauuaaauuuaauauacugcauauccugguguc

SEQ ID NO: 493680 - RNA, 64 nt, hsa
auaagggaguaggcuguauuuucuuuuauaucuguaaauuuaacugcauauagauaauuaucca

SEQ ID NO: 493681 - RNA, 64 nt, hsa
auuccaagaagaucuggaaaguuaaauaaauuuauaaauuuaauaacauucauuuggcuucauu

SEQ ID NO: 493682 - RNA, 64 nt, hsa
ugacauuuauuccaagaagaucuggaaaguuaaauaaauuuauaaauuuaauaacauucauuug

SEQ ID NO: 493683 - RNA, 64 nt, hsa
gaaguguuugaaauguucaagcucacaauaagcuuaaauuuauagaaaaugcuaagguugucaa

SEQ ID NO: 493684 - RNA, 64 nt, hsa
cucuggacugugaagucacugaggacaaggaaacuaaauuuaaugucuguaucacuagugccua

SEQ ID NO: 493685 - RNA, 64 nt, hsa
ccuuuuaaauuuaguucuaucauuaauuuaucauuaaauuuaguucuaucauuugguacuauca

SEQ ID NO: 493686 - RNA, 64 nt, hsa
ucugcuuaacaaacuuagaaugacuuuuuccuuuuaaauuuaguucuaucauuaauuuaucauu

SEQ ID NO: 493687 - RNA, 64 nt, hsa
cuauuuuagguauuuugagguauuuaccauaaacuaaauuuagaaauuuuuuagauucacuuga

SEQ ID NO: 493688 - RNA, 64 nt, hsa
aaucauuuguugacaaaaaagaaaaacuaaaaaauaaauuuaaaaugugacccuucagguauug

SEQ ID NO: 493689 - RNA, 64 nt, hsa
gaaagauuucugguggcuuaaaguuuacuagcaguaaauuuaugauaugguacaguucuuugua

SEQ ID NO: 493690 - RNA, 64 nt, hsa
uguuagcaaauauuaauggcagaaaaccaaaaacuaaauuuaugguaucgagagcaccaccuuc

SEQ ID NO: 493691 - RNA, 64 nt, hsa
ucugaaaagucuccauuuaccagauuugagucacuaaauuuauugcuuucacuacuuuugaauu

SEQ ID NO: 493692 - RNA, 64 nt, hsa
cguacaauuucugucucaacaaaauuagaagaauuaaauuuaaaacuagcuccaaaagagcagu

SEQ ID NO: 493693 - RNA, 64 nt, hsa
acaaagcuguaaauuuaaagaaucauuuugaauauaaauuuaagaaguaauacuuauuggcuga

SEQ ID NO: 493694 - RNA, 64 nt, hsa
caagcuuguucuuuaaaauacauagacaaagcuguaaauuuaaagaaucauuuugaauauaaau

SEQ ID NO: 493695 - RNA, 64 nt, hsa
uuuaugccacuacaguguauuaccuacagauuuuuaaauuuagcuuuauuuaucaacccaaaaa

SEQ ID NO: 493696 - RNA, 64 nt, hsa
gguugaacaugcauuuuucauggaguuuggguucuaaauuuagacugcaguugguuuguauuuu

SEQ ID NO: 493697 - RNA, 64 nt, hsa
auacuaauacacuuaccuauuuuacauuguguuuuaaauuuaguuaaaacuuaaccguagaagu

SEQ ID NO: 493698 - RNA, 64 nt, hsa
uuuuuaaaauuaaacugcaguguuuccuggaauguaaauuuagcuuugcuuaauaguaaaauaa

SEQ ID NO: 493699 - RNA, 64 nt, hsa
gaaacaacuagaaaggaaagugugacacaguuuuuaaauuuagauguagaaaauaaugaauuaa

SEQ ID NO: 493700 - RNA, 64 nt, hsa
aaaaugguguucugaauuuugcuacagggcugcuuaaauuuaugauuaccuguagacacuugau

SEQ ID NO: 493701 - RNA, 64 nt, hsa
aaaaauuagucauaacccuuuuggguuauccacuuaaauuuagguauuuucauauuacucaggu

SEQ ID NO: 493702 - RNA, 64 nt, hsa
acagauccuuucaaaagaagaguuuuagagaaaauaaauuuaacuuuaaccacagugaaaguug

SEQ ID NO: 493703 - RNA, 64 nt, hsa
aguuuguaccauuuaugaagguuuguuccuuuguuaaauuuagcagccuguacuagcuuuugaa

SEQ ID NO: 493704 - RNA, 64 nt, hsa
agccauacuagaauuuuuauuucuacguuuuuaguaaauuuaauauucugggggaaaaaaggcc

SEQ ID NO: 493705 - RNA, 64 nt, hsa
uguagguuuucugucucucaaaucuuagaguucauaaauuuacuugagguugccucaagaacuc

SEQ ID NO: 493706 - RNA, 64 nt, hsa
guagaaaauaucauauuuuaaaacuauguauauuuaaauuuaguaauuuucuaaucucuagaaa

SEQ ID NO: 493707 - RNA, 64 nt, hsa
uauguacuuuaauuauuuguuuuucuccuauuuuuaaauuuauuaugcaaauuuuagaaaauaa

SEQ ID NO: 493708 - RNA, 64 nt, hsa
aagauaagacaaauuauaaauaaguucuaaaacauaaauuuaauucaucucugcauagugauuu

SEQ ID NO: 493709 - RNA, 64 nt, hsa
ugaagauuguuuucuccaauuuucugugccauuuuaaauuuaacuuugacauccagcuauagac

SEQ ID NO: 493710 - RNA, 64 nt, hsa
auguguuuucucagauuagugaaaauugugaccuuaaauuuaauacacauauacugccucagag

SEQ ID NO: 493711 - RNA, 64 nt, hsa
uuuuucuuuacauuccuuuuauuuuuccuuucucuaaauuuaauuuguuuuauaagccuaucgu

SEQ ID NO: 493712 - RNA, 64 nt, hsa
aaucagaagagaaaucccccuggcuuugguuucguaaauuuagcuauauguagcuugcgugcuu

SEQ ID NO: 493713 - RNA, 64 nt, hsa
aaucugagaacaauuaaauucauuuuaguuauaauaaauuuaauauuuguaaauguaacauagu

SEQ ID NO: 493714 - RNA, 64 nt, hsa
uaggcgaguggaaaguggcuacaauccaaaauuuuaaauuuaacucugccucggccauucaaaa

SEQ ID NO: 493715 - RNA, 64 nt, hsa
agggacaccaagccuuggcucuacccugaguucauaaauuuaugguucucaggccugacucuca

SEQ ID NO: 493716 - RNA, 64 nt, hsa
gaacauguauauaaacaugcuugcauuauauuuguaaauuuaugugauggcaaagaaggagagc

SEQ ID NO: 493717 - RNA, 64 nt, hsa
guuuguuuaaaauaguaaaucaguaagucacuucuaaauuuaaagaaaacaaaauuggaguuga

SEQ ID NO: 493718 - RNA, 64 nt, hsa
uuguauuuuaagugaugucauagacaggauuguuuaaauuuaguuaacuccauacucuucagac

SEQ ID NO: 493719 - RNA, 64 nt, hsa
uguaaagcccaaacauuuguaacaaacucccuaauaaauuuagagaaagucacucuguuaccau

SEQ ID NO: 493720 - RNA, 64 nt, hsa
agaaauguauauacaguugccuuauaaaacaacauaaauuuagaccauaacuuuuauagagaaa

SEQ ID NO: 493721 - RNA, 64 nt, hsa
auacauuucaaaaaauguuaugugcaaugaacacuaaauuuaagagcaguuacagugugacuca

SEQ ID NO: 493722 - RNA, 64 nt, hsa
ggaaggaaauauuuucuggacuuaaguaguugccuaaauuuaagauuccuacacuuuauuucug

SEQ ID NO: 493723 - RNA, 64 nt, hsa
cuauggguuaaauuuuuauucuuauuuucacauuuaaauuuauuuuucuuaauuuuuguggaua

SEQ ID NO: 493724 - RNA, 64 nt, hsa
acaagcaauucaauuguacacuuuuaguuauuuuuaaauuuacaauguuauugauuacaggguc

SEQ ID NO: 493725 - RNA, 64 nt, hsa
auucauugaaaaauuauuuuauuuauugcaagucuaaauuuauccuuuuuuucuuuccugauua

SEQ ID NO: 493726 - RNA, 64 nt, hsa
augagccaccaugccuggcccaguguuuguuuuuuaaauuuauauauauguaucuaugucucau

SEQ ID NO: 493727 - RNA, 64 nt, hsa
cugucagcccccucaccugcagccuguugcccaauaaauuuaagagagucccccccuccccaau

SEQ ID NO: 493728 - RNA, 64 nt, hsa
acacuggacucuaagccacuucuuacuccaguaguaaauuuauucaauaaacaaucauugaccc

SEQ ID NO: 493729 - RNA, 64 nt, hsa
ugacuguuaaaaaugaucccaaacuaacgguagauaaauuuauuuguacauaacuuuaaaagga

SEQ ID NO: 493730 - RNA, 64 nt, hsa
acucaacaucagagaguacuuaaaaaaaguauuauaaauuuaauuacugucaaaaaguauuuca

SEQ ID NO: 493731 - RNA, 64 nt, hsa
aaauuuuuaagaguuaaugguaagugaacaauuuuaaauuuauuuuuuauuauguaacauacuu

SEQ ID NO: 493732 - RNA, 64 nt, hsa
uauuuuucuuuucacuuuuuauaguugacauaaguaaauuuauuuauugagucaauuuguucag

SEQ ID NO: 493733 - RNA, 64 nt, hsa
gagccaccgugcccagccaaauguuuauuuuauuuaaauuuauuuuucuuaauuauuuggggua

SEQ ID NO: 493734 - RNA, 64 nt, hsa
cuugggcaaaaacgcaugcagaaggcggaguuuuuaaauuuaaaacauuuuuaaaauagcaaau

SEQ ID NO: 493735 - RNA, 64 nt, hsa
aucugauuggcauugcauugaauuauuaauuaaauaaauuuauuaauuggcauugcauugaauu

SEQ ID NO: 493736 - RNA, 64 nt, hsa
acaaguccuaguuguuguuguuguuguugaauacuaaauuuaagauaugucagcuugcuuucaa

SEQ ID NO: 493737 - RNA, 64 nt, hsa
agccaauagaauauuaugaauaauuuuaugcuaauaaauuuaacaacuucaacaucauaaacaa

SEQ ID NO: 493738 - RNA, 64 nt, hsa
ggauuuucuuuaagagguugauuauaaaguuuucuaaauuuaucaguaccuaaguaagauguag

SEQ ID NO: 493739 - RNA, 64 nt, hsa
guuacauauuauauguucuagaaacauguaauccuaaauuuacccucuugaauauaaucccugg

SEQ ID NO: 493740 - RNA, 64 nt, hsa
ccaaagcaaaaacccuuuuaauggaggugagaaauaaauuuaauguaacaacagcuagauuguu

SEQ ID NO: 493741 - RNA, 64 nt, hsa
uccuuaguuagggacugacuuucuuaaguaaguuuaaauuuacuacauauugugaagagacagg

SEQ ID NO: 493742 - RNA, 64 nt, hsa
ucuuaaaauagaaaguuuauuuagauucagaauauaaauuuagaaauggcaugcaucacacauu

SEQ ID NO: 493743 - RNA, 64 nt, hsa
guuugucuuacucaguucagucuuuuuuugcucauaaauuuaaaaguuacauaccugguuugcu

SEQ ID NO: 493744 - RNA, 64 nt, hsa
gacuuauauuccuacaucaaguuacuacugagaguaaauuuauuuugaguuuuaucccguaagu

SEQ ID NO: 493745 - RNA, 64 nt, hsa
ucuccugacuuaauguuuuuuaaacccaccaauauaaauuuaauuaaagauauauguuguaagg

SEQ ID NO: 493746 - RNA, 64 nt, hsa
uuagcacguuaucucagggcuuaugaaauguaauuaaauuuauuaagaaaauagaugaaaaauu

SEQ ID NO: 493747 - RNA, 64 nt, hsa
guuuaaauaggaaaaauuuaaugcuagcaaaaaauaaauuuagaaauauggcaugacaugaaaa

SEQ ID NO: 493748 - RNA, 64 nt, hsa
uuugagaauggacagugugucuaaggaugugauuuaaauuuacuuaggauggauuuagcauuga

SEQ ID NO: 493749 - RNA, 64 nt, hsa
caaaggaaauaaaucaguguccguuugccaguaauaaauuuaauauucuguuuuauacuauaaa

SEQ ID NO: 493750 - RNA, 64 nt, hsa
uuuuuucuuaauccaguucugcaaaaaugaccuauaaauuuauucauguacaauuuugguuacu

SEQ ID NO: 493751 - RNA, 64 nt, hsa
gcuuuuagcaaccauaaaauugucauaaaauuaauaaauuuaggaaagaauaaagauuuauaua

SEQ ID NO: 493752 - RNA, 64 nt, hsa
uuacacaaaguccuuguuuuaacuuagguauggguaaauuuacauuggugguauugcaggaauu

SEQ ID NO: 493753 - RNA, 64 nt, hsa
aaucuugauuauuuuucagaaagcagacugauacuaaauuuaaaauguaguuucaauuuaauaa

SEQ ID NO: 493754 - RNA, 64 nt, hsa
ugcagugaugguuuaugaaaggguguggcaauuuuaaauuuauauugugugugauguucaaaua

SEQ ID NO: 493755 - RNA, 64 nt, hsa
uugcggcaguaacauuuuccuuucugugaaguucuaaauuuaguuaugaccuauuuagcaaugc

SEQ ID NO: 493756 - RNA, 64 nt, hsa
guugagaaucgggaaaacuagaccccugccacuaacaggcuaggagacuuugggcaguaauggg

SEQ ID NO: 493757 - RNA, 64 nt, hsa
cugaaugguuggccugcauauucuuuuuuaggccacaggcuacagcugagcaauggcuuagucu

SEQ ID NO: 493758 - RNA, 64 nt, hsa
ggguuuagagauucuuacuaauauguugaacuaaaauagaaagaaaauguugcugucauguaau

SEQ ID NO: 493759 - RNA, 64 nt, hsa
aaauucaguuuauguguaaaauaauucagucauuaauagaaauggagugauuucacagugugua

SEQ ID NO: 493760 - RNA, 64 nt, hsa
uaucuugcacugcuaacuuuuuucuaccuuuguaaauagaaacauuucugcauaaaagucauac

SEQ ID NO: 493761 - RNA, 64 nt, hsa
uuuacuugaaauguaaaaacuuucacugaauacaaauagaaaaagugauguguuuuauaucaua

SEQ ID NO: 493762 - RNA, 64 nt, hsa
ugugugagcaguagaagagaccacauuuacagucaauagaaauaaugaaaaaaaauuagguguu

SEQ ID NO: 493763 - RNA, 64 nt, hsa
ggaaaaccuuuauuuuaaagucaaguugugagcaaauagaaauaaaagacaaaaggacaucacu

SEQ ID NO: 493764 - RNA, 64 nt, hsa
uuacgaugcccugccuuuuacuagcuacuuuagaaauagaaaaugugaagagugacuauuuaca

SEQ ID NO: 493765 - RNA, 64 nt, hsa
aauaacuugaacaaaaacacuaaacuaagcauuuaauagaaaugcuuuuuauugaggagguauu

SEQ ID NO: 493766 - RNA, 64 nt, hsa
aggaaagagaggaaaaugggggaauggguugcaaaauagaaaugagcuuaauccaggccgcaga

SEQ ID NO: 493767 - RNA, 64 nt, hsa
cuuuggcacaaagcagcagaaagggggaaaagccaauagaaauuuccuuagcuuccccaccaua

SEQ ID NO: 493768 - RNA, 64 nt, hsa
aucucuuaaacauuuauuacaacaauuguuuuaaaauagaaaaaauaaaaugcuucuauuuuac

SEQ ID NO: 493769 - RNA, 64 nt, hsa
auuauucuguuuauuaacagugucccaucuacugaauagaaaacuuugagaauaauauauauau

SEQ ID NO: 493770 - RNA, 64 nt, hsa
ucagaaaaaggcuuucuuucauaagacuauuuuaaauagaaauuauuucaacaauuaaaguaau

SEQ ID NO: 493771 - RNA, 64 nt, hsa
uuuuuuauuucuuuuaggucuagggacaggagugaauagaaagggaggagagcucuauuauguu

SEQ ID NO: 493772 - RNA, 64 nt, hsa
guugcuuuugcguuucucaugccuaggcaaguguaauagaaauuauguagcuccuuauguuggc

SEQ ID NO: 493773 - RNA, 64 nt, hsa
ggauggauuaugauaaagaagaugcuaccaaugaaauagaaaaccaacgagaugagaagacugu

SEQ ID NO: 493774 - RNA, 64 nt, hsa
auugcucuuacgaacuuuaauaaaauaguuagcuaauagaaaaacagguaagaauaaagcaaug

SEQ ID NO: 493775 - RNA, 64 nt, hsa
aaauggaaauauucaauugagacuugaggggaauaauagaaaauuaagguagauccccaauauu

SEQ ID NO: 493776 - RNA, 64 nt, hsa
uaagauuucuuuauguggaacaucuauagagauaaauagaaauuuucaauaagauguaguaaca

SEQ ID NO: 493777 - RNA, 64 nt, hsa
cugguagguaaauuucuuauuaaaucaaucuugaaauagaaaauguaauaacuuucuuaccauu

SEQ ID NO: 493778 - RNA, 64 nt, hsa
gaugugggguacacugaacuucaaagcccaaaugaauagaaacacauuuucuggcuagcagaaa

SEQ ID NO: 493779 - RNA, 64 nt, hsa
uccuuucuaacuuuauggacacuaaacuggagccaauagaaaagacaaaaaugaaagagacaca

SEQ ID NO: 493780 - RNA, 64 nt, hsa
guuuucuuggcucaaaguaucaauuuauuauuauaauagaaauuuauaaguugcuagaaagucu

SEQ ID NO: 493781 - RNA, 64 nt, hsa
aaaguacggaauaaaaauauguuuucuauuaagcaauagaaauauuuuuguguauaauuuuucu

SEQ ID NO: 493782 - RNA, 64 nt, hsa
aguuccguaggcagagugcucacuuugaauugcuaauagaaaauaaugcacaguguccucagga

SEQ ID NO: 493783 - RNA, 64 nt, hsa
aacuagaaaaccaaugaaaagugaggccaucagaaauagaaaaugccuggcacgaacagucuau

SEQ ID NO: 493784 - RNA, 64 nt, hsa
uuucuuuuuccaguguucuauuugcuuuaaugagaauagaaacguaaacuaugaccuagggguu

SEQ ID NO: 493785 - RNA, 64 nt, hsa
gcauuuuuauaaacuaccaaauuagugaaccaaaaauagaaauuagauuugugcaaacauggag

SEQ ID NO: 493786 - RNA, 64 nt, hsa
ccaggguuggcuuuauuuaaaagcuagugaccuaaauagaaagcgaacuucaagagaaguugua

SEQ ID NO: 493787 - RNA, 64 nt, hsa
uuaaauuucuaauugagcagauuagauugaauuaaauagaaacuuauugaauauacauucuuuu

SEQ ID NO: 493788 - RNA, 64 nt, hsa
uuaaaaaaauaaacauugucuuggaggguuaaaaaauagaaagguguauguguauagauucaca

SEQ ID NO: 493789 - RNA, 64 nt, hsa
ccccaccaccccacccccaagacuuguguuuguuaauagaaauaauuuuuuuagguauugggga

SEQ ID NO: 493790 - RNA, 64 nt, hsa
gcuaauauggaaccaaacucuuguaaguaauguaaauagaaagguggguggauaaaguuuucaa

SEQ ID NO: 493791 - RNA, 64 nt, hsa
guacauauguaccuauuuuuuuuuaaaaagcagaaauagaaauacaagacugguaaacaugccu

SEQ ID NO: 493792 - RNA, 64 nt, hsa
ugauaaaaccgcaacaaaaacauguaagaaauaaaauagaaaugcuuuauauaauuuaguuuaa

SEQ ID NO: 493793 - RNA, 64 nt, hsa
gaaucuuuuuguguuuggaguguaguccauuugcaauagaaauaaaaaaauccgucaccaaauu

SEQ ID NO: 493794 - RNA, 64 nt, hsa
ugucauguuucaaauaaagagaacugaaguagaaaauagaaaugccaguaaacaacauaauguu

SEQ ID NO: 493795 - RNA, 64 nt, hsa
auuuaaaguuuuugcuuguguccuccucagucagaauagaaaaguaacugaaauacuuuuaccu

SEQ ID NO: 493796 - RNA, 64 nt, hsa
gagaaauuggagcaggaaaagaaauuaucaaagcaauagaaauagcuuggugguccuauggugu

SEQ ID NO: 493797 - RNA, 64 nt, hsa
gucuaaaauuuggauaugauucuuauguuuuuuuaauagaaaaccuucuucaaguuuauuuucc

SEQ ID NO: 493798 - RNA, 64 nt, hsa
caacacaacuaaugucaucuuuucauuaaagacuaauagaaauuuagaaaucauuguguuaaag

SEQ ID NO: 493799 - RNA, 64 nt, hsa
auauuugaugagucuauacuuuuugcuugagaaaaauagaaauacuauugauucacugguguua

SEQ ID NO: 493800 - RNA, 64 nt, hsa
cauuucacugaucuucacuccagucacuagggacaauagaaaccugcaaaacacagauucauuc

SEQ ID NO: 493801 - RNA, 64 nt, hsa
ccuucaccaguggcuacuaagcuauaauuagcugaauagaaagaauguggaaguggucugaggc

SEQ ID NO: 493802 - RNA, 64 nt, hsa
gaaaaaaaauaauagaaagguaaacaaacaaauaaauagaaaagaucaacaaccccuuuggcua

SEQ ID NO: 493803 - RNA, 64 nt, hsa
acuucuuguuguggaggcugaaaagaaaaaaaauaauagaaagguaaacaaacaaauaaauaga

SEQ ID NO: 493804 - RNA, 64 nt, hsa
acauguagacuaaauagaaaccccucagcccuaaaauagaaaaaagaacaguucuggacuauug

SEQ ID NO: 493805 - RNA, 64 nt, hsa
uucucacguugcucagacugacacauguagacuaaauagaaaccccucagcccuaaaauagaaa

SEQ ID NO: 493806 - RNA, 64 nt, hsa
ucaauuuaaugcccuaacucucuuauuaaggagaaauagaaaagaagaaauuuauaaugaaaag

SEQ ID NO: 493807 - RNA, 64 nt, hsa
augggcauuucugccuuuuuuuuucuaaacgacaaauagaaauacaucuucuuuauuauccucc

SEQ ID NO: 493808 - RNA, 64 nt, hsa
aguuuuuaauuacacugagauaauuuugaaaagaaauagaaauuaagcuacuauauaaaacaau

SEQ ID NO: 493809 - RNA, 64 nt, hsa
gauuuguacauagagaaacaauuugauaauacuuaauagaaaucuguucaauuaaaaaugcuua

SEQ ID NO: 493810 - RNA, 64 nt, hsa
auauuaaaaugugaauaaauaaauguucugauaaaauagaaaagaaaguaaauuacagugauuu

SEQ ID NO: 493811 - RNA, 64 nt, hsa
augugcagaacgaaguuaccagcaggauggaccuaauagaaaaagaagucgaugguaauuuaag

SEQ ID NO: 493812 - RNA, 64 nt, hsa
guagaaagaaauaugguauauuuguauaguuuuuaauagaaagaucuauguuuauaaaccagca

SEQ ID NO: 493813 - RNA, 64 nt, hsa
uggugacagagcacaaauagaaaaccuauuuuuaaauagaaaucacaaauagcaaguguggaag

SEQ ID NO: 493814 - RNA, 64 nt, hsa
cauauaaaaggaaaaaaauuggugacagagcacaaauagaaaaccuauuuuuaaauagaaauca

SEQ ID NO: 493815 - RNA, 64 nt, hsa
uuguauaauacaaauuuucauuaagccaguauaaaauagaaacuagcuuuuaaacugagcuuug

SEQ ID NO: 493816 - RNA, 64 nt, hsa
aaagauacaauuaaucugauauuauauuuguugaaauagaaauuugauuguacuauaaaugauu

SEQ ID NO: 493817 - RNA, 64 nt, hsa
cuagccaacaugacgaaaccccaucucuacugaaaauagaaaaaaaaaauuagccaggcuugca

SEQ ID NO: 493818 - RNA, 64 nt, hsa
ucugagaccacagaggcucagacucacuguuaagaauagaaaacuggguaugcguuucauguag

SEQ ID NO: 493819 - RNA, 64 nt, hsa
guuauuaugggauuggaagaaacacguggucaugaauagaaaaaaaacaaacccaaagguagga

SEQ ID NO: 493820 - RNA, 64 nt, hsa
ggaaacaacuacuguguuucaacauaauaaauauaauagaaaaauauuuuauuuguauuguugu

SEQ ID NO: 493821 - RNA, 64 nt, hsa
aauuucuucaacaucauacuuaaacauuacagaaaauagaaauacaaacaagguugguacauga

SEQ ID NO: 493822 - RNA, 64 nt, hsa
guauccuacguuacaacaauaauaucaugggagaaauagaaauagccuaguuugcuuccaauag

SEQ ID NO: 493823 - RNA, 64 nt, hsa
caugggagaaauagaaauagccuaguuugcuuccaauagaaacugcuuuuaacaugggcuguau

SEQ ID NO: 493824 - RNA, 64 nt, hsa
agcuaaucaaaauaauucagccaagucuauuugaaauagaaaacugucuauuuaauauaguaaa

SEQ ID NO: 493825 - RNA, 64 nt, hsa
auuaggaaaaaaaucuggagaacaauaugguugaaauagaaacaagagaaugcaccuagguuaa

SEQ ID NO: 493826 - RNA, 64 nt, hsa
acccuguauaguaugggaauuauuuuuuauguuaaauagaaacugaauguacuggguugaaugg

SEQ ID NO: 493827 - RNA, 64 nt, hsa
acuccaggcccuccuggcuggagagggcuguggcaauagaaaauuagugccaacugcagugagu

SEQ ID NO: 493828 - RNA, 64 nt, hsa
uucuucuguugaugccguucccugaacauaggaaaauagaaacuugcuuaucaaaacuuagcau

SEQ ID NO: 493829 - RNA, 64 nt, hsa
cauaaacauuucuuuucaguucauguaguucuuuaauagaaagcugcuauuauguauauuguca

SEQ ID NO: 493830 - RNA, 64 nt, hsa
cuugcagagccauagcaggacauguuaaaauuccaauagaaaacacuaaaaggaaagucugugg

SEQ ID NO: 493831 - RNA, 64 nt, hsa
ggaggauaaaaguaaauaagugaaaguuaaugccaauagaaaaauucaagagauaauguacaau

SEQ ID NO: 493832 - RNA, 64 nt, hsa
uuuaucuagaugaaaauuuggaaugaaaugaaggaauagaaauccaauaaaagaguugaaggga

SEQ ID NO: 493833 - RNA, 64 nt, hsa
cagaagaauauucuuaaaaccuuuuguauuauacaauagaaauaaagguuuuauuuuuauuaaa

SEQ ID NO: 493834 - RNA, 64 nt, hsa
uucaugcacaauccauaauuugaguuuuacauaaaauagaaauuuguuagaauuuguuagauuu

SEQ ID NO: 493835 - RNA, 64 nt, hsa
ugcaucauaucauuucuguccauaauuguacugaaauagaaaagugaccgcucuugcucuuggu

SEQ ID NO: 493836 - RNA, 64 nt, hsa
ggugcuuuaucugaauaggccuggaucgaaguaaaauagaaaugggacuggcuuuccacaggaa

SEQ ID NO: 493837 - RNA, 64 nt, hsa
aggccguccauuagagauuuaacuagauauguucaauagaaagagucugaggcaaguggaaaug

SEQ ID NO: 493838 - RNA, 64 nt, hsa
aaugagggguuacagaugcauauguccaauauaaaauagaaaauauauuaacguuugaaauuaa

SEQ ID NO: 493839 - RNA, 64 nt, hsa
caaccaacuaaacaguuauaaucuuggcacuguuaauagaaaggugggauagucuuugcuguuu

SEQ ID NO: 493840 - RNA, 64 nt, hsa
auaggcuuaauucuuuguaaaucugaaugaccauaauagaaauacauuucuuguggcaaguaau

SEQ ID NO: 493841 - RNA, 64 nt, hsa
acuugacaauuauaaauaguaauagugaagaaaaaauagaaagguugcaauuauauaggccaug

SEQ ID NO: 493842 - RNA, 64 nt, hsa
auuuuauauacuuuuccagcuugauaauuuucacaauagaaagagaccaaauauuuuguacuau

SEQ ID NO: 493843 - RNA, 64 nt, hsa
guggucaugaaauuuuaauguuaaguuuguaccuaauagaaauaugucuaucacaaaucuuuau

SEQ ID NO: 493844 - RNA, 64 nt, hsa
gguccauccuaauucacagaauuaaaugagcuuaaauagaaaauucaguauuuuaugauaauca

SEQ ID NO: 493845 - RNA, 64 nt, hsa
cuuuguaagcuacuuaucuccaaaaaacuucagaaauagaaaacuacauuuuggcaggaauaau

SEQ ID NO: 493846 - RNA, 64 nt, hsa
cuugaaaacauaaaugaacgucaagacugaaggcaauagaaauuaaagaaugugagaaaguucu

SEQ ID NO: 493847 - RNA, 64 nt, hsa
auugauuuuucuuucaaucagcauguucaccaaaaauagaaaaguucuucuaagguuaaauuuu

SEQ ID NO: 493848 - RNA, 64 nt, hsa
auuuugcaaguuuaauuugauuuauuucagagaaaauagaaaaaacaauguuagaagguuauuu

SEQ ID NO: 493849 - RNA, 64 nt, hsa
aaaucucauuguaaagcuaucagucauuuaguagaauagaaaagcaacauagagcauacaagaa

SEQ ID NO: 493850 - RNA, 64 nt, hsa
gcuuucuccagagaaauuuuaaaauaauagaagaaauagaaauuuugaauguauaaaagaaaaa

SEQ ID NO: 493851 - RNA, 64 nt, hsa
acuugaaaugaggcugggguauaguuuguccuacaauagaaaaaagagagagcuuccuaggccu

SEQ ID NO: 493852 - RNA, 64 nt, hsa
auugcuuuguuuggcuugauuaacuuugaucagaaauagaaacguuuucauuuguugauuuagg

SEQ ID NO: 493853 - RNA, 64 nt, hsa
uuuagacaugaacccuacuauuuaguuauucuaaaauagaaaguuugcuggagaaagcguccac

SEQ ID NO: 493854 - RNA, 64 nt, hsa
gggcagggagaagagaaggcauuaguaagaaaaaaauagaaaaaaauaugaacagacucagcuu

SEQ ID NO: 493855 - RNA, 64 nt, hsa
gcagucucuuccccaaagucucaccuuuucuuccaauagaaaauuccgcuugaccuuuggugca

SEQ ID NO: 493856 - RNA, 64 nt, hsa
aaugccauuuuaaggaaaacuaccuguauuuaaaaauagaaacauaucaaaaacaagagaaaag

SEQ ID NO: 493857 - RNA, 64 nt, hsa
aucccacuaaugcaaacugggaugaaacuaaagcaauagaaacaacacaguuuugaccuaacau

SEQ ID NO: 493858 - RNA, 64 nt, hsa
ggaggaagccuggucuaagaagauacugucuuucaauagaaaugauuucuaaacugcuacagau

SEQ ID NO: 493859 - RNA, 64 nt, hsa
gguaugugggcuuuaaaagugauucuaaaucuugaauagaaaacacaugaauuggcuuuaauaa

SEQ ID NO: 493860 - RNA, 64 nt, hsa
aucucuuuguuguauuuuccaugauguuucuuaaaauagaaaguuuauuuagauucagaauaua

SEQ ID NO: 493861 - RNA, 64 nt, hsa
gguuuagugauaauaauuuuguuuuugaaauacaaauagaaaauccugaaauaauuuuugugau

SEQ ID NO: 493862 - RNA, 64 nt, hsa
gucacccccaccaaaaacaaaagagaagaaaaagaauagaaagaauuauccagugucagcuucc

SEQ ID NO: 493863 - RNA, 64 nt, hsa
uccagugucagcuuccaaucccuaguacauauauaauagaaaagggccaagaaaaauaugcauc

SEQ ID NO: 493864 - RNA, 64 nt, hsa
auuauacuucuuuaaaaagcucugaagcugcuacaauagaaaaaucaaaaaggguaacaguauc

SEQ ID NO: 493865 - RNA, 60 nt, hsa
uucgagaaauuaaaucuuaaaaucuguguaaauagaaaacuugaaccauuaguaauaaca

SEQ ID NO: 493866 - RNA, 64 nt, hsa
cuucuugaaaugucuauuuaagcugcuuuaaguuaauagaaaagauuaaagcaaaauauucauu

SEQ ID NO: 493867 - RNA, 64 nt, hsa; identical to SEQ ID NO: 420116

SEQ ID NO: 493868 - RNA, 64 nt, hsa; identical to SEQ ID NO: 420117

SEQ ID NO: 493869 - RNA, 64 nt, hsa; identical to SEQ ID NO: 420118

SEQ ID NO: 493870 - RNA, 64 nt, hsa; identical to SEQ ID NO: 420119

SEQ ID NO: 493871 - RNA, 64 nt, hsa; identical to SEQ ID NO: 420120

SEQ ID NO: 493872 - RNA, 64 nt, hsa; identical to SEQ ID NO: 420121

SEQ ID NO: 493873 - RNA, 64 nt, hsa; identical to SEQ ID NO: 420122

SEQ ID NO: 493874 - RNA, 64 nt, hsa; identical to SEQ ID NO: 420123

SEQ ID NO: 493875 - RNA, 64 nt, hsa; identical to SEQ ID NO: 420124

SEQ ID NO: 493876 - RNA, 64 nt, hsa; identical to SEQ ID NO: 420125

SEQ ID NO: 493877 - RNA, 64 nt, hsa; identical to SEQ ID NO: 420126

SEQ ID NO: 493878 - RNA, 64 nt, hsa; identical to SEQ ID NO: 420127

SEQ ID NO: 493879 - RNA, 64 nt, hsa; identical to SEQ ID NO: 420128

SEQ ID NO: 493880 - RNA, 64 nt, hsa; identical to SEQ ID NO: 420129

SEQ ID NO: 493881 - RNA, 64 nt, hsa; identical to SEQ ID NO: 420130

SEQ ID NO: 493882 - RNA, 64 nt, hsa; identical to SEQ ID NO: 420131

SEQ ID NO: 493883 - RNA, 64 nt, hsa; identical to SEQ ID NO: 420132

SEQ ID NO: 493884 - RNA, 64 nt, hsa; identical to SEQ ID NO: 420133

SEQ ID NO: 493885 - RNA, 64 nt, hsa; identical to SEQ ID NO: 420134

SEQ ID NO: 493886 - RNA, 64 nt, hsa; identical to SEQ ID NO: 420135

SEQ ID NO: 493887 - RNA, 64 nt, hsa; identical to SEQ ID NO: 420136

SEQ ID NO: 493888 - RNA, 64 nt, hsa; identical to SEQ ID NO: 420137

SEQ ID NO: 493889 - RNA, 64 nt, hsa; identical to SEQ ID NO: 420138

SEQ ID NO: 493890 - RNA, 64 nt, hsa; identical to SEQ ID NO: 420139

SEQ ID NO: 493891 - RNA, 64 nt, hsa; identical to SEQ ID NO: 420140

SEQ ID NO: 493892 - RNA, 64 nt, hsa
aaaugcccaggagcccaugaaguaauagcguaaaguaaaguaugauauggaaaugugaaguuug

SEQ ID NO: 493893 - RNA, 64 nt, hsa
agaccaaaugcccaggagcccaugaaguaauagcguaaaguaaaguaugauauggaaaugugaa

SEQ ID NO: 493894 - RNA, 64 nt, hsa
uucuauaguaaaggcaaugucuauuucagggauuguaaaguaguuaagcauuguuucaaaaguu

SEQ ID NO: 493895 - RNA, 64 nt, hsa
ucuuuuauuucuucauuguacucuuuuuuuuuuuguaaaguauauguaaaauaaaugugacauu

SEQ ID NO: 493896 - RNA, 64 nt, hsa
uugcaaauaaguugaguuuguagaggguaacaaaguaaaguaaaacaaaccuaucuugguuaac

SEQ ID NO: 493897 - RNA, 64 nt, hsa
cuguagccaggguuaaaaacuggacuuuuuagaaguaaaguaaaagcauaucgcuuauaucauu

SEQ ID NO: 493898 - RNA, 64 nt, hsa
ugaaucuuucauacauauauauauuuguaacauuguaaaguaugugaguagucuuauguaaagu

SEQ ID NO: 493899 - RNA, 64 nt, hsa
uuuguaacauuguaaaguaugugaguagucuuauguaaaguauguuuuuacauuaugcaaauaa

SEQ ID NO: 493900 - RNA, 64 nt, hsa
uuguuacagauaguuuuaugccuaagaccaagauguaaaguaccaucugcccuuaaaaaaaauu

SEQ ID NO: 493901 - RNA, 64 nt, hsa
acuuuuauaagucuagaugacguuugccuuagggguaaaguaaaagaacaauuggcaccuuaag

SEQ ID NO: 493902 - RNA, 64 nt, hsa
aagcaaaaugcauaguacuuaauuuguuuauacuguaaaguauauguuaaaugcuuuuaucacu

SEQ ID NO: 493903 - RNA, 64 nt, hsa
uguuauuauguauguggcacuugaggcacuguauguaaaguaaggaaugcuuuacuaguucucc

SEQ ID NO: 493904 - RNA, 64 nt, hsa
gauuuaaucugccaagggccgacuaagagaaguuguaaaguauguauuauuuacauuuaauaga

SEQ ID NO: 493905 - RNA, 64 nt, hsa
ggcuuauaucuggccucugcuuucuccuuuaauuguaaaguaaaagcuauaaagcaguauuuuu

SEQ ID NO: 493906 - RNA, 64 nt, hsa
uuuuaaacaacuuuccacugacaacgaaaguaaaguaaaguauuggauuuuuuuaaagggaaca

SEQ ID NO: 493907 - RNA, 64 nt, hsa
ucucauuuuaaacaacuuuccacugacaacgaaaguaaaguaaaguauuggauuuuuuuaaagg

SEQ ID NO: 493908 - RNA, 64 nt, hsa
uccaaugcacuguuguaugaaugcauuaaaaauuguaaaguaccaugcuuagaacugagaaaac

SEQ ID NO: 493909 - RNA, 64 nt, hsa
gcuuuuauguccacuuuuugagugguacuuaaauguaaaguaacaaccugaauugagucauugc

SEQ ID NO: 493910 - RNA, 64 nt, hsa; identical to SEQ ID NO: 301390

SEQ ID NO: 493911 - RNA, 64 nt, hsa; identical to SEQ ID NO: 301391

SEQ ID NO: 493912 - RNA, 64 nt, hsa; identical to SEQ ID NO: 301392

SEQ ID NO: 493913 - RNA, 64 nt, hsa; identical to SEQ ID NO: 301393

SEQ ID NO: 493914 - RNA, 64 nt, hsa; identical to SEQ ID NO: 301394

SEQ ID NO: 493915 - RNA, 64 nt, hsa; identical to SEQ ID NO: 301395

SEQ ID NO: 493916 - RNA, 64 nt, hsa; identical to SEQ ID NO: 301396

SEQ ID NO: 493917 - RNA, 64 nt, hsa; identical to SEQ ID NO: 301397

SEQ ID NO: 493918 - RNA, 64 nt, hsa; identical to SEQ ID NO: 301398

SEQ ID NO: 493919 - RNA, 64 nt, hsa; identical to SEQ ID NO: 301399

SEQ ID NO: 493920 - RNA, 64 nt, hsa; identical to SEQ ID NO: 301400

SEQ ID NO: 493921 - RNA, 64 nt, hsa; identical to SEQ ID NO: 301401

SEQ ID NO: 493922 - RNA, 64 nt, hsa; identical to SEQ ID NO: 301402

SEQ ID NO: 493923 - RNA, 64 nt, hsa; identical to SEQ ID NO: 301403

SEQ ID NO: 493924 - RNA, 64 nt, hsa; identical to SEQ ID NO: 301404

SEQ ID NO: 493925 - RNA, 64 nt, hsa; identical to SEQ ID NO: 301405

SEQ ID NO: 493926 - RNA, 64 nt, hsa; identical to SEQ ID NO: 301406

SEQ ID NO: 493927 - RNA, 64 nt, hsa; identical to SEQ ID NO: 301407

SEQ ID NO: 493928 - RNA, 64 nt, hsa
uauaaacgugaaauauauuugacacacacauucacauauaaauuguuaaaaacugaaggcagaa

SEQ ID NO: 493929 - RNA, 64 nt, hsa
gacauugaguuuaauucagcaacaacaaaaaauacauauaaaacuagaaagggacuuuuuuucc

SEQ ID NO: 493930 - RNA, 64 nt, hsa
aaaaauauaaacaauguucaggagaguaaaaauucauauaaagugcaauugcacaaauacaagc

SEQ ID NO: 493931 - RNA, 64 nt, hsa
uauauaaaguuuugccccaugauaaaauaaguaacauauaaauuaauacauaaguuaauauugg

SEQ ID NO: 493932 - RNA, 64 nt, hsa
uugucuugaauagagaagucuauguucguaaagucauauaaaagguuauaccacuauuuaguaa

SEQ ID NO: 493933 - RNA, 64 nt, hsa
cuuggguuuaaaauacauuagaacuuaaugcagacauauaaaguaacauugagaaugacaacua

SEQ ID NO: 493934 - RNA, 64 nt, hsa
gcuaucuggucaaccuccuggacauuuuuucagucauauaaaagcuauggugagaugcagcugg

SEQ ID NO: 493935 - RNA, 64 nt, hsa
aaugaagaucauauacgugaaaauuauuugaaaacauauaaagcacuauacagauucgaaacuc

SEQ ID NO: 493936 - RNA, 64 nt, hsa
gcaugcagucaugagaauuacagaaaauuugcaacauauaaaguaguuugaucuaagaggauuc

SEQ ID NO: 493937 - RNA, 64 nt, hsa
aacuguuguugacagugaggaaaaacucccauaucauauaaaauuucagggaaaacagaagcaa

SEQ ID NO: 493938 - RNA, 64 nt, hsa
ugucauuguggauguuaccuuuuucagauccaagcauauaaaaagccuguauauuuuuuaaaaa

SEQ ID NO: 493939 - RNA, 64 nt, hsa
ucaauguuuuauucugaaguaaacguuagcucuacauauaaauccuggaacagaaauuguuuau

SEQ ID NO: 493940 - RNA, 64 nt, hsa
aacagauauuguaccauguaccuaauccaaauaucauauaaacauuuuauuuauaguuaauaau

SEQ ID NO: 493941 - RNA, 64 nt, hsa
gacuagcacuagacaugucaugguccucauggugcauauaaauauauuuaacuuaacccagauu

SEQ ID NO: 493942 - RNA, 64 nt, hsa
uguuugaguucagccucuucauuuacuccauuuacauauaaaagaucuugaaaagguaguuguu

SEQ ID NO: 493943 - RNA, 64 nt, hsa
cuccgucacuauuauuuugccuuuucuggacugucauauaaacagaaucuuauaguacguuccc

SEQ ID NO: 493944 - RNA, 64 nt, hsa
ucucuagguaauugauuuaaguauaaaauccaaucauauaaaaacuuuaaugaauuaggauaac

SEQ ID NO: 493945 - RNA, 64 nt, hsa
ccaguugagcucccaagaccaggacccacuggggcauauaaaaaagucaaaaaucaaaaucaaa

SEQ ID NO: 493946 - RNA, 64 nt, hsa
ccaguugagcucccaagaccaggacccacuggggcauauaaaaucucugcuguauccuuucggc

SEQ ID NO: 493947 - RNA, 64 nt, hsa
ugguaaacauuucuguauaaaguuaccugacacacauauaaacacaaggaacauuccauaucau

SEQ ID NO: 493948 - RNA, 64 nt, hsa
aaaaaccuuuggucauuuguaagacaucucaugucauauaaaaguuaaauguaaaaagauacag

SEQ ID NO: 493949 - RNA, 64 nt, hsa
gagacagucacucuuuuuuuucuuaaaugauauacauauaaacaguuauuuuuauccuauuaua

SEQ ID NO: 493950 - RNA, 64 nt, hsa
aauaauguauuuagcaugaagcaugaauuauuuucauauaaauauagaaaauagagaaaaggcu

SEQ ID NO: 493951 - RNA, 64 nt, hsa
uagaguagauauuugauauaccacucugauaacucauauaaaaauaucaucauaaaaagcuuaa

SEQ ID NO: 493952 - RNA, 64 nt, hsa
aguuuauguuuauuguauuuuauaugaucuacaacauauaaaauuguguauuuuucuuugguug

SEQ ID NO: 493953 - RNA, 64 nt, hsa
caauuccuaggauaugugaucgugaaucagaucacauauaaaaagucuggauugucaguaguau

SEQ ID NO: 493954 - RNA, 64 nt, hsa
agauuauucauucuaucucagaguuaccggcaagcauauaaaaugcuacuuggauaauaucuac

SEQ ID NO: 493955 - RNA, 64 nt, hsa
acuguacaucagagaauucauacuggagaaaagccauauaaauguagugagugugggaaagcuu

SEQ ID NO: 493956 - RNA, 64 nt, hsa
gaaugguagagcaaccugaaggauuuagaaauuacauauaaaucuuugcaguuaugcuauuugu

SEQ ID NO: 493957 - RNA, 64 nt, hsa
gcaguauucuacaaguuuccagaaagagaauagccauauaaauuauuuuccuuucugcuauuau

SEQ ID NO: 493958 - RNA, 64 nt, hsa
guuuuauuuauucagauuuagaguaaaaaauaagcauauaaacuuuuauuaugugcucuuaaca

SEQ ID NO: 493959 - RNA, 64 nt, hsa
uguacagaagaugaacuguauuuugcauuuugucuacuuguaagugaauguaacauacugucaa

SEQ ID NO: 493960 - RNA, 64 nt, hsa
acuaauugcccugcuguuuuacugguguauaggauacuuguacauagguaaccaauguacaugg

SEQ ID NO: 493961 - RNA, 64 nt, hsa
uguguguguguuuuuuuuuuaagguaaacauuacuacuuguaacuuuuuuucuuagucauauuu

SEQ ID NO: 493962 - RNA, 64 nt, hsa
uuguuauauucccagcauuucaauauuuauuaguuacuuguaaauuacuguggcuguguaguuu

SEQ ID NO: 493963 - RNA, 64 nt, hsa
cuuagguaaauacaauucuuaucuagugguauucuacuuguauucagaauacuguauuaaaauu

SEQ ID NO: 493964 - RNA, 64 nt, hsa
uagcagaaaugacuguuuauuucaaacuauguuuuacuuguauaugauguagucaccuuaacua

SEQ ID NO: 493965 - RNA, 64 nt, hsa
gccuguucugaauggcagcacgaagcaggccuguuacuuguaugucgcuuuggacagaggaaag

SEQ ID NO: 493966 - RNA, 64 nt, hsa
gcuuagagggaggaccugaugacugauuccaggauacuuguacuucuaauaacauuuuucauga

SEQ ID NO: 493967 - RNA, 64 nt, hsa
uuuauaauccccugcagcggcuuucaguauuuuguacuuguaggcaccuaauaaauuuauuauu

SEQ ID NO: 493968 - RNA, 64 nt, hsa
agauaaagcaugauaaagauuauuauuuaagauauacuuguauuuauaccucagauauucuuuu

SEQ ID NO: 493969 - RNA, 64 nt, hsa
uuuucauggauaauuuuuaacuucauuauuucuguacuuguacaaacucaacacuaacuuuuuu

SEQ ID NO: 493970 - RNA, 64 nt, hsa
ccuucaacuuuugaaauacaaaaccaguguuuuuuacuuguacacuguuuuaaagucuauuaaa

SEQ ID NO: 493971 - RNA, 64 nt, hsa
uacgacuacacaauauauucauguaucuaaacuguacuuguacccccuaaauuuauuuuuaaaa

SEQ ID NO: 493972 - RNA, 64 nt, hsa
uaucacucaccauaauuuaaauaaagaauaaaaauacuuguauuuugugguggcaaauguuugg

SEQ ID NO: 493973 - RNA, 64 nt, hsa
uugguuaaguccuaacuuucaauguguacccaaauacuuguauuuaugcuuuugauaaaaugua

SEQ ID NO: 493974 - RNA, 64 nt, hsa
uccugcagugccaaguaucaaagguguccuuaaauacuuguagggaugagguuaggaauauuca

SEQ ID NO: 493975 - RNA, 64 nt, hsa; identical to SEQ ID NO: 164780

SEQ ID NO: 493976 - RNA, 64 nt, hsa; identical to SEQ ID NO: 164781

SEQ ID NO: 493977 - RNA, 64 nt, hsa; identical to SEQ ID NO: 164782

SEQ ID NO: 493978 - RNA, 64 nt, hsa; identical to SEQ ID NO: 164783

SEQ ID NO: 493979 - RNA, 64 nt, hsa; identical to SEQ ID NO: 164784

SEQ ID NO: 493980 - RNA, 64 nt, hsa; identical to SEQ ID NO: 164785

SEQ ID NO: 493981 - RNA, 64 nt, hsa; identical to SEQ ID NO: 164786

SEQ ID NO: 493982 - RNA, 64 nt, hsa; identical to SEQ ID NO: 164787

SEQ ID NO: 493983 - RNA, 64 nt, hsa; identical to SEQ ID NO: 164788

SEQ ID NO: 493984 - RNA, 64 nt, hsa; identical to SEQ ID NO: 164789

SEQ ID NO: 493985 - RNA, 64 nt, hsa; identical to SEQ ID NO: 164790

SEQ ID NO: 493986 - RNA, 64 nt, hsa; identical to SEQ ID NO: 164791

SEQ ID NO: 493987 - RNA, 64 nt, hsa; identical to SEQ ID NO: 164792

SEQ ID NO: 493988 - RNA, 64 nt, hsa; identical to SEQ ID NO: 164793

SEQ ID NO: 493989 - RNA, 64 nt, hsa; identical to SEQ ID NO: 293300

SEQ ID NO: 493990 - RNA, 64 nt, hsa; identical to SEQ ID NO: 293301

SEQ ID NO: 493991 - RNA, 64 nt, hsa; identical to SEQ ID NO: 293302

SEQ ID NO: 493992 - RNA, 64 nt, hsa; identical to SEQ ID NO: 293303

SEQ ID NO: 493993 - RNA, 64 nt, hsa; identical to SEQ ID NO: 293304

SEQ ID NO: 493994 - RNA, 64 nt, hsa; identical to SEQ ID NO: 293305

SEQ ID NO: 493995 - RNA, 64 nt, hsa; identical to SEQ ID NO: 127496

SEQ ID NO: 493996 - RNA, 64 nt, hsa; identical to SEQ ID NO: 127497

SEQ ID NO: 493997 - RNA, 64 nt, hsa; identical to SEQ ID NO: 127498

SEQ ID NO: 493998 - RNA, 64 nt, hsa; identical to SEQ ID NO: 127499

SEQ ID NO: 493999 - RNA, 64 nt, hsa; identical to SEQ ID NO: 127500

SEQ ID NO: 494000 - RNA, 64 nt, hsa; identical to SEQ ID NO: 127501

SEQ ID NO: 494001 - RNA, 64 nt, hsa; identical to SEQ ID NO: 127502

SEQ ID NO: 494002 - RNA, 64 nt, hsa; identical to SEQ ID NO: 127503

SEQ ID NO: 494003 - RNA, 59 nt, hsa
agugccugucagagcccugagggguguccaccggggacagacccaggggcgggcagaga

SEQ ID NO: 494004 - RNA, 64 nt, hsa
cuccccacaccagucaaggcuucucagcuggagaaccggggagcagcuggacacccagccaagg

SEQ ID NO: 494005 - RNA, 64 nt, hsa
uucuguucauuuaccaaccugggggauugauacgaccggggaaaauguuccuaaaccaggaagc

SEQ ID NO: 494006 - RNA, 64 nt, hsa
cuacucgggaggcugaggcaggagaauugcuugaaccggggaggcagaaguugcagugagccga

SEQ ID NO: 494007 - RNA, 64 nt, hsa
gaaaauggggugggggugggggugguaaggggagaccggggagucaguuucagacaguucucua

SEQ ID NO: 494008 - RNA, 64 nt, hsa
ugucagucuuuccugcucagccaggggggaugauaccggggacucuccagagccaugacuagau

SEQ ID NO: 494009 - RNA, 64 nt, hsa
cuacaccugaggcugaggcaggagaauugcuugaaccggggagacggagguugcagugagccga

SEQ ID NO: 494010 - RNA, 64 nt, hsa
ccuccugcggacaccagcuccucucuccgccgucaccggggaggccggggauccuugcagggcu

SEQ ID NO: 494011 - RNA, 64 nt, hsa
ccuagcauaguacaaucagaaccucguggagaccaccggggacaggcuugcggacgccggcugu

SEQ ID NO: 494012 - RNA, 64 nt, hsa
cguuacagaaaaauaguguaaacauuauuuccuuaccggggaaugaggguuuuuucuuuuucuu

SEQ ID NO: 494013 - RNA, 64 nt, hsa
auugccauccucuccuauuuaucucugaggaucgaccggggacugggauagaggaagggugagc

SEQ ID NO: 494014 - RNA, 63 nt, hsa
agcagaagaagaagcgguaaugcgcccggagcgaccggggagcgagcgagugcgucaagaaag

SEQ ID NO: 494015 - RNA, 64 nt, hsa
uggggggauacugaaccucuagacugaaguacuuaccggggagcacaguggacuaggggaugcc

SEQ ID NO: 494016 - RNA, 64 nt, hsa
gggcuuccagcaggauugagucacccugacgaugaccggggagaagccgugugcucuucauuau

SEQ ID NO: 494017 - RNA, 64 nt, hsa
aaaaaaaaaaaaaggaaaaaaaauucaccgggcaaccggggaaguauuguggccuuggaguuug

SEQ ID NO: 494018 - RNA, 64 nt, hsa
agcugcacucuugugccacagcugcccuggggaaaccggggaaccccaacugggaaaggaggcc

SEQ ID NO: 494019 - RNA, 64 nt, hsa
gacaggcagaagccggacaggggcccuuccccacaccggggagagcugcucggacaggcccccu

SEQ ID NO: 494020 - RNA, 64 nt, hsa
aagugucugcuccacgucaggcacugugcuuugcaccggggagaaaauggugauggagggcaac

SEQ ID NO: 494021 - RNA, 64 nt, hsa
uuaagacaaagccuugucuauguggggggcggggaccggggaaagagggaggcugaaauguuua

SEQ ID NO: 494022 - RNA, 64 nt, hsa
gaugaaguaacugaggcuuagaaagguuaauagcaccggggaacaauuucucugggugagaauu

SEQ ID NO: 494023 - RNA, 64 nt, hsa
ucugccaugcccagagaaucagggcaggcuugccaccggggaacccagcccugggguaugagcu

SEQ ID NO: 494024 - RNA, 64 nt, hsa
cccucccgagccucaaggcaaguccaggacucagaccggggaggcccgggccagcagcucccag

SEQ ID NO: 494025 - RNA, 64 nt, hsa
gccauuucuguacuaacuguucucuuguuccgguaccggggagaaggaugaccccuccuuauuc

SEQ ID NO: 494026 - RNA, 64 nt, hsa
aagccucaacuaacaaacccuucaggaagcauauaccggggaauguguagccuucaggaaaaaa

SEQ ID NO: 494027 - RNA, 64 nt, hsa
auucgcaugaaccacagaugcuggagaucaccagaccggggagagaagaggggcaccugggcug

SEQ ID NO: 494028 - RNA, 64 nt, hsa
ggacacaggugccaguucagcagugaccgucaagaccggggaagugcccuguggugaccaggag

SEQ ID NO: 494029 - RNA, 64 nt, hsa
aaggaccagggagcccugacucccagaggcugccaccggggagaagcagcgguccuccauccag

SEQ ID NO: 494030 - RNA, 64 nt, hsa
cagcugcccagcugucaaggucaggcaagugagcaccggggacugaggaucagggcgggacccc

SEQ ID NO: 494031 - RNA, 64 nt, hsa
ggcugggaauuccaccugagaacaagucccgcaaaccggggacggaaggacauuugacuuuuau

SEQ ID NO: 494032 - RNA, 64 nt, hsa
guccugccggcccacaggcccaucccggcggggcaccggggacucgcgggcuucugcugggucc

SEQ ID NO: 494033 - RNA, 64 nt, hsa
gaagaugggcuucauccaauggacugcauaaauaaccggggauucuguacaugcauugagcucu

SEQ ID NO: 494034 - RNA, 64 nt, hsa
ggagccagaaagguaugcaugugggugucuucacaccggggaggagggccucucaugggaaagc

SEQ ID NO: 494035 - RNA, 64 nt, hsa
caccugauguggagguacagggcagaucuucccuaccggggagggauggaugguuggauacagg

SEQ ID NO: 494036 - RNA, 64 nt, hsa
aaagaggcgaggcaaugacuguuggccaguucucaccggggaaaaacccacuguuaggauggca

SEQ ID NO: 494037 - RNA, 64 nt, hsa
acucugacaaggggagcugucaaucaaacaccaaaccggggagacaagaugauuggcagguauu

SEQ ID NO: 494038 - RNA, 64 nt, hsa
cuccugccucaagccugaguggaagcaccugaggaccggggaucgggaccugaccuggggcugg

SEQ ID NO: 494039 - RNA, 64 nt, hsa
gccucaucccuagcuccaaucccuuccccacgugaccggggauucugguugcaauaaaacaugc

SEQ ID NO: 494040 - RNA, 64 nt, hsa
gaggaggcucccgaggggaaggggcggugcccacaccggggacaggccgcagcuccauuuucuu

SEQ ID NO: 494041 - RNA, 64 nt, hsa
ccgggugcgguggcacacaccuguaaucccagcuaccggggaggcugaggcaggagaaucgcua

SEQ ID NO: 494042 - RNA, 64 nt, hsa
cuacccaggaggcugaggcaggagaaucgcuugaaccggggagguggagguugcagugagcuga

SEQ ID NO: 494043 - RNA, 64 nt, hsa
cucuucugcuuacuuuccacaugagaugcuuuguaccggggagcugugagcaggccucacgaug

SEQ ID NO: 494044 - RNA, 64 nt, hsa
ucuggguugccaaagcagccaggcuuaugcugaaaccggggaagucugacauaugcaggaaacu

SEQ ID NO: 494045 - RNA, 64 nt, hsa
cauccgcugcguggaggugucggacgaucaggacaccggggacacucugggcagcguccuccgg

SEQ ID NO: 494046 - RNA, 64 nt, hsa
cgugucucauccccagaacaugccgucuguccccaccggggagugggccuugauggccgggccu

SEQ ID NO: 494047 - RNA, 64 nt, hsa
gucuccuugggccaccaaaggugguggccaugguaccggggacuugggagagugagacccagug

SEQ ID NO: 494048 - RNA, 64 nt, hsa
gacccuuugaaaagugccuggggaccugaagagcaccggggaauuuguaaccccuauuuaagcc

SEQ ID NO: 494049 - RNA, 61 nt, hsa
cuaagaggcaugcugaguaaacugauuucccaccggggacuggacacaaacaggaaugucu

SEQ ID NO: 494050 - RNA, 64 nt, hsa
accaggacugccugggacucccuggcaacccagcaccggggaagccgucagcugcugugacaau

SEQ ID NO: 494051 - RNA, 64 nt, hsa
caacuccggccccuggacccgggccggggcgcccaccggggaccgccuggccgggggcuccaag

SEQ ID NO: 494052 - RNA, 64 nt, hsa
caaggguaucccaucuggggcaaacucacuguguaccggggaggaggcuacgugguccccuugg

SEQ ID NO: 494053 - RNA, 64 nt, hsa
cugucucugucuuccaacccccaauaauauuuccaccggggaugcaucauuuuuacucccaaua

SEQ ID NO: 494054 - RNA, 55 nt, hsa
cugccacauccccggugugagcccaaccggggagcccccgccccgccccacauuc

SEQ ID NO: 494055 - RNA, 64 nt, hsa
uuagguccugcaguacagucuuccccugaaugccaccggggacccagggggacuccaccccccu

SEQ ID NO: 494056 - RNA, 64 nt, hsa
ccacacugucucccuggaggggcucgagggcaugaccggggacugaccauucugugaaaggagc

SEQ ID NO: 494057 - RNA, 64 nt, hsa
cguggagagugagggcucccugcucccucccuccaccggggaagggcaugggcuagaagaggag

SEQ ID NO: 494058 - RNA, 64 nt, hsa
ugugaagcgcugcacccccaccaaccuuacccucaccggggaacccucacuagcaggacuggug

SEQ ID NO: 494059 - RNA, 64 nt, hsa
cucuggugcccagcgagcugagcaccagugggugaccggggagaaacagggcagacuggguaag

SEQ ID NO: 494060 - RNA, 64 nt, hsa
ugagguccaggacugggaaggaccgggugagugcaccggggacccaggccaggugccccccgga

SEQ ID NO: 494061 - RNA, 64 nt, hsa
ccaagaaggcggauuaggggguggcccaaggggcaccggggagaggacccggacccaggacccu

SEQ ID NO: 494062 - RNA, 64 nt, hsa
gacucaggcguggaagagaaucuucuccuuauucaccggggaggcugugucuugugcaaacaag

SEQ ID NO: 494063 - RNA, 58 nt, hsa
ggcccucucggcagcuguagggguggggaccggggagcaccugccuguagcccccauc

SEQ ID NO: 494064 - RNA, 64 nt, hsa
caggaagagccaccaucccugcccccguuuucccaccggggagucuguacagagauuuuucuac

SEQ ID NO: 494065 - RNA, 64 nt, hsa
ugucuccugggcuguggucucaucucaacguucaaccggggaugggucggccucuaagcucaug

SEQ ID NO: 494066 - RNA, 64 nt, hsa
uuggagagcuaggaaaaauaaacaaccuuaugccaccggggaaaaaaucacaauaaauauuuau

SEQ ID NO: 494067 - RNA, 64 nt, hsa
cuacucaggaggcugaggcaugagaaucgcuugaaccggggaggcagagguugcagugagccga

SEQ ID NO: 494068 - RNA, 64 nt, hsa
gggugaaugugugugagcaugugugugugcauguaccggggaaugaaggugaacauacaccucu

SEQ ID NO: 494069 - RNA, 64 nt, hsa
ggaggcgguggggcaugggaggaaggaggcacagaccggggaaauaugacagccgucauuucca

SEQ ID NO: 494070 - RNA, 64 nt, hsa
gccacugugguuugagaagaggcuggauccgcugaccggggagauggccuguguguacaagggc

SEQ ID NO: 494071 - RNA, 64 nt, hsa
cuaccacccucccuucuagagagcacaucgccugaccggggagaaguggggccgugguucgagg

SEQ ID NO: 494072 - RNA, 64 nt, hsa
cgccggcuccccgaggacccaggcuugacgauucaccggggaucuccugggcugggcucuccuu

SEQ ID NO: 494073 - RNA, 64 nt, hsa
ucauguagcuugugacacuuuuauuuuauuagucaccggggaacuuuucagugaugaaaauaca

SEQ ID NO: 494074 - RNA, 64 nt, hsa; identical to SEQ ID NO: 134009

SEQ ID NO: 494075 - RNA, 64 nt, hsa; identical to SEQ ID NO: 134010

SEQ ID NO: 494076 - RNA, 64 nt, hsa; identical to SEQ ID NO: 134011

SEQ ID NO: 494077 - RNA, 64 nt, hsa; identical to SEQ ID NO: 134012

SEQ ID NO: 494078 - RNA, 64 nt, hsa; identical to SEQ ID NO: 134013

SEQ ID NO: 494079 - RNA, 64 nt, hsa; identical to SEQ ID NO: 134014

SEQ ID NO: 494080 - RNA, 64 nt, hsa; identical to SEQ ID NO: 134015

SEQ ID NO: 494081 - RNA, 64 nt, hsa; identical to SEQ ID NO: 134016

SEQ ID NO: 494082 - RNA, 64 nt, hsa; identical to SEQ ID NO: 134017

SEQ ID NO: 494083 - RNA, 64 nt, hsa; identical to SEQ ID NO: 134018

SEQ ID NO: 494084 - RNA, 64 nt, hsa; identical to SEQ ID NO: 134019

SEQ ID NO: 494085 - RNA, 64 nt, hsa; identical to SEQ ID NO: 134020

SEQ ID NO: 494086 - RNA, 64 nt, hsa; identical to SEQ ID NO: 134021

SEQ ID NO: 494087 - RNA, 64 nt, hsa; identical to SEQ ID NO: 134022

SEQ ID NO: 494088 - RNA, 64 nt, hsa; identical to SEQ ID NO: 134023

SEQ ID NO: 494089 - RNA, 64 nt, hsa; identical to SEQ ID NO: 134024

SEQ ID NO: 494090 - RNA, 64 nt, hsa; identical to SEQ ID NO: 134025

SEQ ID NO: 494091 - RNA, 64 nt, hsa; identical to SEQ ID NO: 134026

SEQ ID NO: 494092 - RNA, 64 nt, hsa; identical to SEQ ID NO: 134027

SEQ ID NO: 494093 - RNA, 64 nt, hsa; identical to SEQ ID NO: 134028

SEQ ID NO: 494094 - RNA, 64 nt, hsa; identical to SEQ ID NO: 134029

SEQ ID NO: 494095 - RNA, 64 nt, hsa; identical to SEQ ID NO: 134030

SEQ ID NO: 494096 - RNA, 64 nt, hsa; identical to SEQ ID NO: 134031

SEQ ID NO: 494097 - RNA, 64 nt, hsa; identical to SEQ ID NO: 134032

SEQ ID NO: 494098 - RNA, 64 nt, hsa; identical to SEQ ID NO: 134033

SEQ ID NO: 494099 - RNA, 64 nt, hsa; identical to SEQ ID NO: 134034

SEQ ID NO: 494100 - RNA, 64 nt, hsa; identical to SEQ ID NO: 134035

SEQ ID NO: 494101 - RNA, 64 nt, hsa; identical to SEQ ID NO: 134036

SEQ ID NO: 494102 - RNA, 64 nt, hsa; identical to SEQ ID NO: 134037

SEQ ID NO: 494103 - RNA, 64 nt, hsa; identical to SEQ ID NO: 134038

SEQ ID NO: 494104 - RNA, 64 nt, hsa; identical to SEQ ID NO: 134039

SEQ ID NO: 494105 - RNA, 64 nt, hsa; identical to SEQ ID NO: 134040

SEQ ID NO: 494106 - RNA, 64 nt, hsa; identical to SEQ ID NO: 134041

SEQ ID NO: 494107 - RNA, 64 nt, hsa; identical to SEQ ID NO: 134042

SEQ ID NO: 494108 - RNA, 64 nt, hsa; identical to SEQ ID NO: 134043

SEQ ID NO: 494109 - RNA, 64 nt, hsa; identical to SEQ ID NO: 134044

SEQ ID NO: 494110 - RNA, 64 nt, hsa; identical to SEQ ID NO: 134045

SEQ ID NO: 494111 - RNA, 64 nt, hsa; identical to SEQ ID NO: 134046

SEQ ID NO: 494112 - RNA, 64 nt, hsa; identical to SEQ ID NO: 283773

SEQ ID NO: 494113 - RNA, 64 nt, hsa; identical to SEQ ID NO: 283774

SEQ ID NO: 494114 - RNA, 64 nt, hsa; identical to SEQ ID NO: 283775

SEQ ID NO: 494115 - RNA, 64 nt, hsa; identical to SEQ ID NO: 283776

SEQ ID NO: 494116 - RNA, 64 nt, hsa; identical to SEQ ID NO: 283777

SEQ ID NO: 494117 - RNA, 64 nt, hsa; identical to SEQ ID NO: 283778

SEQ ID NO: 494118 - RNA, 64 nt, hsa; identical to SEQ ID NO: 283779

SEQ ID NO: 494119 - RNA, 64 nt, hsa; identical to SEQ ID NO: 283780

SEQ ID NO: 494120 - RNA, 64 nt, hsa; identical to SEQ ID NO: 283781

SEQ ID NO: 494121 - RNA, 64 nt, hsa; identical to SEQ ID NO: 283782

SEQ ID NO: 494122 - RNA, 64 nt, hsa; identical to SEQ ID NO: 283783

SEQ ID NO: 494123 - RNA, 64 nt, hsa; identical to SEQ ID NO: 283784

SEQ ID NO: 494124 - RNA, 64 nt, hsa; identical to SEQ ID NO: 283785

SEQ ID NO: 494125 - RNA, 64 nt, hsa; identical to SEQ ID NO: 283786

SEQ ID NO: 494126 - RNA, 64 nt, hsa; identical to SEQ ID NO: 283787

SEQ ID NO: 494127 - RNA, 64 nt, hsa; identical to SEQ ID NO: 283788

SEQ ID NO: 494128 - RNA, 64 nt, hsa; identical to SEQ ID NO: 283789

SEQ ID NO: 494129 - RNA, 64 nt, hsa; identical to SEQ ID NO: 283790

SEQ ID NO: 494130 - RNA, 64 nt, hsa; identical to SEQ ID NO: 283791

SEQ ID NO: 494131 - RNA, 64 nt, hsa; identical to SEQ ID NO: 283792

SEQ ID NO: 494132 - RNA, 64 nt, hsa; identical to SEQ ID NO: 283793

SEQ ID NO: 494133 - RNA, 64 nt, hsa; identical to SEQ ID NO: 283794

SEQ ID NO: 494134 - RNA, 64 nt, hsa; identical to SEQ ID NO: 283795

SEQ ID NO: 494135 - RNA, 64 nt, hsa; identical to SEQ ID NO: 283796

SEQ ID NO: 494136 - RNA, 64 nt, hsa; identical to SEQ ID NO: 283797

SEQ ID NO: 494137 - RNA, 64 nt, hsa; identical to SEQ ID NO: 283798

SEQ ID NO: 494138 - RNA, 64 nt, hsa; identical to SEQ ID NO: 283799

SEQ ID NO: 494139 - RNA, 64 nt, hsa; identical to SEQ ID NO: 283800

SEQ ID NO: 494140 - RNA, 64 nt, hsa; identical to SEQ ID NO: 283801

SEQ ID NO: 494141 - RNA, 64 nt, hsa; identical to SEQ ID NO: 283802

SEQ ID NO: 494142 - RNA, 64 nt, hsa; identical to SEQ ID NO: 283803

SEQ ID NO: 494143 - RNA, 64 nt, hsa; identical to SEQ ID NO: 283804

SEQ ID NO: 494144 - RNA, 64 nt, hsa; identical to SEQ ID NO: 283805

SEQ ID NO: 494145 - RNA, 64 nt, hsa; identical to SEQ ID NO: 283806

SEQ ID NO: 494146 - RNA, 64 nt, hsa; identical to SEQ ID NO: 283807

SEQ ID NO: 494147 - RNA, 64 nt, hsa; identical to SEQ ID NO: 283808

SEQ ID NO: 494148 - RNA, 64 nt, hsa; identical to SEQ ID NO: 80933

SEQ ID NO: 494149 - RNA, 64 nt, hsa; identical to SEQ ID NO: 80934

SEQ ID NO: 494150 - RNA, 64 nt, hsa; identical to SEQ ID NO: 80935

SEQ ID NO: 494151 - RNA, 64 nt, hsa; identical to SEQ ID NO: 80936

SEQ ID NO: 494152 - RNA, 64 nt, hsa; identical to SEQ ID NO: 80937

SEQ ID NO: 494153 - RNA, 64 nt, hsa; identical to SEQ ID NO: 80938

SEQ ID NO: 494154 - RNA, 64 nt, hsa; identical to SEQ ID NO: 80939

SEQ ID NO: 494155 - RNA, 64 nt, hsa; identical to SEQ ID NO: 80940

SEQ ID NO: 494156 - RNA, 64 nt, hsa; identical to SEQ ID NO: 80941

SEQ ID NO: 494157 - RNA, 64 nt, hsa; identical to SEQ ID NO: 80942

SEQ ID NO: 494158 - RNA, 64 nt, hsa; identical to SEQ ID NO: 80943

SEQ ID NO: 494159 - RNA, 64 nt, hsa; identical to SEQ ID NO: 80944

SEQ ID NO: 494160 - RNA, 64 nt, hsa; identical to SEQ ID NO: 80945

SEQ ID NO: 494161 - RNA, 64 nt, hsa; identical to SEQ ID NO: 80946

SEQ ID NO: 494162 - RNA, 64 nt, hsa; identical to SEQ ID NO: 80947

SEQ ID NO: 494163 - RNA, 64 nt, hsa; identical to SEQ ID NO: 80948

SEQ ID NO: 494164 - RNA, 64 nt, hsa; identical to SEQ ID NO: 80949

SEQ ID NO: 494165 - RNA, 64 nt, hsa; identical to SEQ ID NO: 80950

SEQ ID NO: 494166 - RNA, 64 nt, hsa; identical to SEQ ID NO: 80951

SEQ ID NO: 494167 - RNA, 64 nt, hsa; identical to SEQ ID NO: 80952

SEQ ID NO: 494168 - RNA, 64 nt, hsa; identical to SEQ ID NO: 80953

SEQ ID NO: 494169 - RNA, 64 nt, hsa; identical to SEQ ID NO: 80954

SEQ ID NO: 494170 - RNA, 63 nt, hsa; identical to SEQ ID NO: 80955

SEQ ID NO: 494171 - RNA, 64 nt, hsa; identical to SEQ ID NO: 80956

SEQ ID NO: 494172 - RNA, 64 nt, hsa; identical to SEQ ID NO: 80957

SEQ ID NO: 494173 - RNA, 64 nt, hsa; identical to SEQ ID NO: 80958

SEQ ID NO: 494174 - RNA, 64 nt, hsa; identical to SEQ ID NO: 80959

SEQ ID NO: 494175 - RNA, 64 nt, hsa; identical to SEQ ID NO: 80960

SEQ ID NO: 494176 - RNA, 64 nt, hsa; identical to SEQ ID NO: 80961

SEQ ID NO: 494177 - RNA, 64 nt, hsa; identical to SEQ ID NO: 80962

SEQ ID NO: 494178 - RNA, 64 nt, hsa; identical to SEQ ID NO: 80963

SEQ ID NO: 494179 - RNA, 64 nt, hsa; identical to SEQ ID NO: 80964

SEQ ID NO: 494180 - RNA, 64 nt, hsa; identical to SEQ ID NO: 80965

SEQ ID NO: 494181 - RNA, 64 nt, hsa; identical to SEQ ID NO: 80966

SEQ ID NO: 494182 - RNA, 64 nt, hsa; identical to SEQ ID NO: 80967

SEQ ID NO: 494183 - RNA, 64 nt, hsa; identical to SEQ ID NO: 80968

SEQ ID NO: 494184 - RNA, 64 nt, hsa; identical to SEQ ID NO: 80969

SEQ ID NO: 494185 - RNA, 64 nt, hsa; identical to SEQ ID NO: 80970

SEQ ID NO: 494186 - RNA, 64 nt, hsa; identical to SEQ ID NO: 80971

SEQ ID NO: 494187 - RNA, 64 nt, hsa; identical to SEQ ID NO: 80972

SEQ ID NO: 494188 - RNA, 64 nt, hsa; identical to SEQ ID NO: 80973

SEQ ID NO: 494189 - RNA, 64 nt, hsa; identical to SEQ ID NO: 80974

SEQ ID NO: 494190 - RNA, 64 nt, hsa; identical to SEQ ID NO: 80975

SEQ ID NO: 494191 - RNA, 64 nt, hsa; identical to SEQ ID NO: 80976

SEQ ID NO: 494192 - RNA, 64 nt, hsa; identical to SEQ ID NO: 80977

SEQ ID NO: 494193 - RNA, 64 nt, hsa; identical to SEQ ID NO: 80978

SEQ ID NO: 494194 - RNA, 64 nt, hsa; identical to SEQ ID NO: 80979

SEQ ID NO: 494195 - RNA, 64 nt, hsa; identical to SEQ ID NO: 80980

SEQ ID NO: 494196 - RNA, 64 nt, hsa; identical to SEQ ID NO: 80981

SEQ ID NO: 494197 - RNA, 64 nt, hsa; identical to SEQ ID NO: 80982

SEQ ID NO: 494198 - RNA, 64 nt, hsa; identical to SEQ ID NO: 80983

SEQ ID NO: 494199 - RNA, 64 nt, hsa; identical to SEQ ID NO: 80984

SEQ ID NO: 494200 - RNA, 64 nt, hsa; identical to SEQ ID NO: 80985

SEQ ID NO: 494201 - RNA, 64 nt, hsa; identical to SEQ ID NO: 80986

SEQ ID NO: 494202 - RNA, 64 nt, hsa; identical to SEQ ID NO: 80987

SEQ ID NO: 494203 - RNA, 64 nt, hsa; identical to SEQ ID NO: 80988

SEQ ID NO: 494204 - RNA, 64 nt, hsa; identical to SEQ ID NO: 80989

SEQ ID NO: 494205 - RNA, 64 nt, hsa; identical to SEQ ID NO: 80990

SEQ ID NO: 494206 - RNA, 64 nt, hsa; identical to SEQ ID NO: 80991

SEQ ID NO: 494207 - RNA, 64 nt, hsa; identical to SEQ ID NO: 80992

SEQ ID NO: 494208 - RNA, 64 nt, hsa; identical to SEQ ID NO: 80993

SEQ ID NO: 494209 - RNA, 64 nt, hsa; identical to SEQ ID NO: 80994

SEQ ID NO: 494210 - RNA, 64 nt, hsa; identical to SEQ ID NO: 80995

SEQ ID NO: 494211 - RNA, 64 nt, hsa; identical to SEQ ID NO: 80996

SEQ ID NO: 494212 - RNA, 64 nt, hsa; identical to SEQ ID NO: 80997

SEQ ID NO: 494213 - RNA, 64 nt, hsa; identical to SEQ ID NO: 80998

SEQ ID NO: 494214 - RNA, 64 nt, hsa; identical to SEQ ID NO: 80999

SEQ ID NO: 494215 - RNA, 64 nt, hsa; identical to SEQ ID NO: 81000

SEQ ID NO: 494216 - RNA, 64 nt, hsa; identical to SEQ ID NO: 81001

SEQ ID NO: 494217 - RNA, 64 nt, hsa; identical to SEQ ID NO: 81002

SEQ ID NO: 494218 - RNA, 64 nt, hsa; identical to SEQ ID NO: 81003

SEQ ID NO: 494219 - RNA, 64 nt, hsa; identical to SEQ ID NO: 81004

SEQ ID NO: 494220 - RNA, 64 nt, hsa; identical to SEQ ID NO: 81005

SEQ ID NO: 494221 - RNA, 64 nt, hsa; identical to SEQ ID NO: 81006

SEQ ID NO: 494222 - RNA, 64 nt, hsa; identical to SEQ ID NO: 81007

SEQ ID NO: 494223 - RNA, 64 nt, hsa; identical to SEQ ID NO: 81008

SEQ ID NO: 494224 - RNA, 64 nt, hsa; identical to SEQ ID NO: 81009

SEQ ID NO: 494225 - RNA, 64 nt, hsa; identical to SEQ ID NO: 81010

SEQ ID NO: 494226 - RNA, 64 nt, hsa; identical to SEQ ID NO: 81011

SEQ ID NO: 494227 - RNA, 64 nt, hsa; identical to SEQ ID NO: 81012

SEQ ID NO: 494228 - RNA, 64 nt, hsa; identical to SEQ ID NO: 81013

SEQ ID NO: 494229 - RNA, 64 nt, hsa; identical to SEQ ID NO: 81014

SEQ ID NO: 494230 - RNA, 64 nt, hsa; identical to SEQ ID NO: 81015

SEQ ID NO: 494231 - RNA, 64 nt, hsa; identical to SEQ ID NO: 81016

SEQ ID NO: 494232 - RNA, 64 nt, hsa; identical to SEQ ID NO: 81017

SEQ ID NO: 494233 - RNA, 64 nt, hsa; identical to SEQ ID NO: 81018

SEQ ID NO: 494234 - RNA, 64 nt, hsa; identical to SEQ ID NO: 81019

SEQ ID NO: 494235 - RNA, 64 nt, hsa; identical to SEQ ID NO: 81020

SEQ ID NO: 494236 - RNA, 64 nt, hsa; identical to SEQ ID NO: 81021

SEQ ID NO: 494237 - RNA, 64 nt, hsa; identical to SEQ ID NO: 81022

SEQ ID NO: 494238 - RNA, 64 nt, hsa; identical to SEQ ID NO: 81023

SEQ ID NO: 494239 - RNA, 64 nt, hsa; identical to SEQ ID NO: 81024

SEQ ID NO: 494240 - RNA, 64 nt, hsa; identical to SEQ ID NO: 81025

SEQ ID NO: 494241 - RNA, 64 nt, hsa; identical to SEQ ID NO: 81026

SEQ ID NO: 494242 - RNA, 64 nt, hsa; identical to SEQ ID NO: 81027

SEQ ID NO: 494243 - RNA, 64 nt, hsa; identical to SEQ ID NO: 81028

SEQ ID NO: 494244 - RNA, 64 nt, hsa; identical to SEQ ID NO: 81029

SEQ ID NO: 494245 - RNA, 64 nt, hsa; identical to SEQ ID NO: 81030

SEQ ID NO: 494246 - RNA, 64 nt, hsa; identical to SEQ ID NO: 81031

SEQ ID NO: 494247 - RNA, 64 nt, hsa; identical to SEQ ID NO: 81032

SEQ ID NO: 494248 - RNA, 64 nt, hsa; identical to SEQ ID NO: 81033

SEQ ID NO: 494249 - RNA, 64 nt, hsa; identical to SEQ ID NO: 81034

SEQ ID NO: 494250 - RNA, 64 nt, hsa; identical to SEQ ID NO: 81035

SEQ ID NO: 494251 - RNA, 64 nt, hsa; identical to SEQ ID NO: 81036

SEQ ID NO: 494252 - RNA, 64 nt, hsa; identical to SEQ ID NO: 81037

SEQ ID NO: 494253 - RNA, 64 nt, hsa; identical to SEQ ID NO: 81038

SEQ ID NO: 494254 - RNA, 64 nt, hsa; identical to SEQ ID NO: 81039

SEQ ID NO: 494255 - RNA, 64 nt, hsa; identical to SEQ ID NO: 81040

SEQ ID NO: 494256 - RNA, 64 nt, hsa; identical to SEQ ID NO: 81041

SEQ ID NO: 494257 - RNA, 64 nt, hsa; identical to SEQ ID NO: 81042

SEQ ID NO: 494258 - RNA, 64 nt, hsa
agacacuuucucugccucauccugcccucaagcuuuagucaagaaguuauggcccccagucccu

SEQ ID NO: 494259 - RNA, 64 nt, hsa
ucuguuugucagaaguucuccguuaguuccuguauuagucaagguuuuccagagaaacagaauc

SEQ ID NO: 494260 - RNA, 64 nt, hsa
augucucaguuuuugaauucuaccuuuaaggguuuuagucaacaugccauaucucauuauugca

SEQ ID NO: 494261 - RNA, 64 nt, hsa
uagcuaaguguguaugauaaugaaacucaucauuuuagucaaguagaggcaaugcaaagauuca

SEQ ID NO: 494262 - RNA, 64 nt, hsa
uucucuuccagaggcuuuggcuacucuccugcgcccacgguaccuggaccugcuagucuccagc

SEQ ID NO: 494263 - RNA, 64 nt, hsa
cugcccaccucaggcccccacccuccacuccuccccacgguacugugaacgucgugugacucag

SEQ ID NO: 494264 - RNA, 64 nt, hsa
gauauauuuauaguucacuuuuggguuuuuauacccacgguaggauucugcauuccagcauuaa

SEQ ID NO: 494265 - RNA, 64 nt, hsa
uccaagacaaagaugaacccauacaugaucagcuccacgguaauuuuuagggacucaggagaau

SEQ ID NO: 494266 - RNA, 64 nt, hsa
gcgcuggccccagcauggagggaagcccugugggccacgguaggcuagaagggaauucgagcug

SEQ ID NO: 494267 - RNA, 64 nt, hsa
aagguucugcccgggaaggucaccagcaccaacaccacgguagugccugaaauuucaccauugc

SEQ ID NO: 494268 - RNA, 64 nt, hsa
aggcucccuaucauuauauauagaguuucuuuuuccacgguagucagugacuuaaccugaauug

SEQ ID NO: 494269 - RNA, 64 nt, hsa
ggcaauucuuugcugcgugggcuucucugugcucccacgguaggauguuuaguagcaccccugg

SEQ ID NO: 494270 - RNA, 64 nt, hsa
aaaacgaguuagaccagugauguaccgcgcuucuccacgguagaggcguguucucaguuuagca

SEQ ID NO: 494271 - RNA, 64 nt, hsa
caacagagccaaggccuugggagcagcagugcuaccacgguaauggacagaguuaucgaggcac

SEQ ID NO: 494272 - RNA, 64 nt, hsa
auucuuccuuagacuuacuuuuguaaaaauguccccacgguacuuacuccccacugauggacca

SEQ ID NO: 494273 - RNA, 64 nt, hsa
ugacuagaaauuaguacaugcccacagcuggcucccacgguagccaggagaauuaucuauaggu

SEQ ID NO: 494274 - RNA, 64 nt, hsa
cuguggcugguagacaccaagcugcugugacugaccacgguaccacgggcugccacagccccug

SEQ ID NO: 494275 - RNA, 64 nt, hsa
uucauuggcagcccccuaggacugcacgcuggccccacgguaacccccccucccccaccaacau

SEQ ID NO: 494276 - RNA, 64 nt, hsa
cucuccguagagagccugaaaaacugccccaaugccacgguaaaggcgaggaagucuuggcugg

SEQ ID NO: 494277 - RNA, 64 nt, hsa
gaaauaaguuauuggccgcgcgccucccuucaguccacgguacuacccgggccuccccucgucc

SEQ ID NO: 494278 - RNA, 64 nt, hsa
ccuuuucaucuguuucagaguaaguucaauuucaccacgguaaacugggauguuuucaaaagug

SEQ ID NO: 494279 - RNA, 64 nt, hsa
uaagacuuuuuuuccauuuuugugcuaauuuauuccacgguagcucucacaccagcgggccagu

SEQ ID NO: 494280 - RNA, 64 nt, hsa
gggacagugaugccaacucaaacacgugccuucuccacgguaucuccuggccaggcugcuggga

SEQ ID NO: 494281 - RNA, 64 nt, hsa
cugucccuucuccccgcuucaaaauaaguguaauccacgguagcagccacacuuccuuuagaag

SEQ ID NO: 494282 - RNA, 64 nt, hsa
gucccaccgggagccucccccucagaugaucucuccacgguagcacuugaccuuuucgacgcuu

SEQ ID NO: 494283 - RNA, 64 nt, hsa
ugggagcauagcaugaagugaugcacauauuucaccacgguaucauguacuucauggccagugu

SEQ ID NO: 494284 - RNA, 64 nt, hsa
auugugcagacacugaguuuuuagaaaaacauauccacgguaaccggucccuggcaauucuguu

SEQ ID NO: 494285 - RNA, 64 nt, hsa
uugaucuacuugccucauuucccuaucuucucccccacgguauccuaaacuuuagacuucccac

SEQ ID NO: 494286 - RNA, 64 nt, hsa
cagccgccggugcuguugacccaagggccgugguccacgguacuugaagaagccagagcccaca

SEQ ID NO: 494287 - RNA, 64 nt, hsa
ccuucucccauagaccccuuucuucuccccuuccccacgguaggaacauagcguguuuauauuu

SEQ ID NO: 494288 - RNA, 64 nt, hsa
acuucgaaggccacacacuccugcuucauaggccccacgguaagugaguucacaccuagaacac

SEQ ID NO: 494289 - RNA, 64 nt, hsa
cgggcuucagccagaccugcugagaccuagguugccacgguaacagccaaagacaucaacccaa

SEQ ID NO: 494290 - RNA, 64 nt, hsa
aauuuauuuuaaaacaagggcuagcuucaagcaugacuguuaauggcuccucugugacaaaaca

SEQ ID NO: 494291 - RNA, 64 nt, hsa
uauuaaugaguauuuccuuucuccauaagugcaggacuguuacucacuacuaaacucuaccaag

SEQ ID NO: 494292 - RNA, 64 nt, hsa
augcucagacagaagggacuguggucgcuccuccgacuguuauccagguuccaagccuagaggc

SEQ ID NO: 494293 - RNA, 64 nt, hsa
gcucagacacagaagggacugcagucgugccucugacuguuaucccgguuccaagccuagagga

SEQ ID NO: 494294 - RNA, 64 nt, hsa
uuguuuuaagacuuccacacaccaaggcuacaaugacuguuaaccuggaggaagucucugguau

SEQ ID NO: 494295 - RNA, 64 nt, hsa
uauaaauuaagcauaaaauauguaaccaggaaaagacuguuaacauuacauuuaugcaaauuaa

SEQ ID NO: 494296 - RNA, 64 nt, hsa; identical to SEQ ID NO: 293628

SEQ ID NO: 494297 - RNA, 64 nt, hsa; identical to SEQ ID NO: 293629

SEQ ID NO: 494298 - RNA, 64 nt, hsa; identical to SEQ ID NO: 293630

SEQ ID NO: 494299 - RNA, 64 nt, hsa; identical to SEQ ID NO: 293631

SEQ ID NO: 494300 - RNA, 64 nt, hsa; identical to SEQ ID NO: 293632

SEQ ID NO: 494301 - RNA, 64 nt, hsa; identical to SEQ ID NO: 293633

SEQ ID NO: 494302 - RNA, 64 nt, hsa; identical to SEQ ID NO: 293634

SEQ ID NO: 494303 - RNA, 64 nt, hsa; identical to SEQ ID NO: 293635

SEQ ID NO: 494304 - RNA, 64 nt, hsa; identical to SEQ ID NO: 293636

SEQ ID NO: 494305 - RNA, 64 nt, hsa; identical to SEQ ID NO: 293637

SEQ ID NO: 494306 - RNA, 64 nt, hsa; identical to SEQ ID NO: 293638

SEQ ID NO: 494307 - RNA, 64 nt, hsa; identical to SEQ ID NO: 293639

SEQ ID NO: 494308 - RNA, 64 nt, hsa; identical to SEQ ID NO: 293640

SEQ ID NO: 494309 - RNA, 64 nt, hsa; identical to SEQ ID NO: 293641

SEQ ID NO: 494310 - RNA, 64 nt, hsa; identical to SEQ ID NO: 293642

SEQ ID NO: 494311 - RNA, 64 nt, hsa; identical to SEQ ID NO: 293643

SEQ ID NO: 494312 - RNA, 64 nt, hsa; identical to SEQ ID NO: 293644

SEQ ID NO: 494313 - RNA, 64 nt, hsa; identical to SEQ ID NO: 293645

SEQ ID NO: 494314 - RNA, 64 nt, hsa; identical to SEQ ID NO: 293646

SEQ ID NO: 494315 - RNA, 64 nt, hsa; identical to SEQ ID NO: 293647

SEQ ID NO: 494316 - RNA, 64 nt, hsa; identical to SEQ ID NO: 293648

SEQ ID NO: 494317 - RNA, 64 nt, hsa; identical to SEQ ID NO: 293643

SEQ ID NO: 494318 - RNA, 64 nt, hsa; identical to SEQ ID NO: 293650

SEQ ID NO: 494319 - RNA, 64 nt, hsa; identical to SEQ ID NO: 293651

SEQ ID NO: 494320 - RNA, 64 nt, hsa; identical to SEQ ID NO: 293652

SEQ ID NO: 494321 - RNA, 64 nt, hsa; identical to SEQ ID NO: 293653

SEQ ID NO: 494322 - RNA, 64 nt, hsa; identical to SEQ ID NO: 293654

SEQ ID NO: 494323 - RNA, 64 nt, hsa; identical to SEQ ID NO: 293655

SEQ ID NO: 494324 - RNA, 64 nt, hsa; identical to SEQ ID NO: 293656

SEQ ID NO: 494325 - RNA, 64 nt, hsa; identical to SEQ ID NO: 293644

SEQ ID NO: 494326 - RNA, 64 nt, hsa; identical to SEQ ID NO: 293658

SEQ ID NO: 494327 - RNA, 64 nt, hsa; identical to SEQ ID NO: 293659

SEQ ID NO: 494328 - RNA, 64 nt, hsa; identical to SEQ ID NO: 293660

SEQ ID NO: 494329 - RNA, 64 nt, hsa; identical to SEQ ID NO: 293661

SEQ ID NO: 494330 - RNA, 64 nt, hsa; identical to SEQ ID NO: 293662

SEQ ID NO: 494331 - RNA, 64 nt, hsa; identical to SEQ ID NO: 293663

SEQ ID NO: 494332 - RNA, 64 nt, hsa; identical to SEQ ID NO: 293664

SEQ ID NO: 494333 - RNA, 64 nt, hsa; identical to SEQ ID NO: 293665

SEQ ID NO: 494334 - RNA, 64 nt, hsa; identical to SEQ ID NO: 293666

SEQ ID NO: 494335 - RNA, 64 nt, hsa; identical to SEQ ID NO: 293667

SEQ ID NO: 494336 - RNA, 64 nt, hsa; identical to SEQ ID NO: 293668

SEQ ID NO: 494337 - RNA, 64 nt, hsa; identical to SEQ ID NO: 293669

SEQ ID NO: 494338 - RNA, 64 nt, hsa; identical to SEQ ID NO: 293670

SEQ ID NO: 494339 - RNA, 64 nt, hsa; identical to SEQ ID NO: 293671

SEQ ID NO: 494340 - RNA, 64 nt, hsa; identical to SEQ ID NO: 293672

SEQ ID NO: 494341 - RNA, 64 nt, hsa; identical to SEQ ID NO: 293673

SEQ ID NO: 494342 - RNA, 64 nt, hsa; identical to SEQ ID NO: 293674

SEQ ID NO: 494343 - RNA, 64 nt, hsa; identical to SEQ ID NO: 293675

SEQ ID NO: 494344 - RNA, 64 nt, hsa; identical to SEQ ID NO: 293676

SEQ ID NO: 494345 - RNA, 64 nt, hsa; identical to SEQ ID NO: 293677

SEQ ID NO: 494346 - RNA, 64 nt, hsa; identical to SEQ ID NO: 293678

SEQ ID NO: 494347 - RNA, 64 nt, hsa; identical to SEQ ID NO: 293679

SEQ ID NO: 494348 - RNA, 64 nt, hsa; identical to SEQ ID NO: 293680

SEQ ID NO: 494349 - RNA, 64 nt, hsa; identical to SEQ ID NO: 293681

SEQ ID NO: 494350 - RNA, 64 nt, hsa; identical to SEQ ID NO: 293682

SEQ ID NO: 494351 - RNA, 64 nt, hsa; identical to SEQ ID NO: 293683

SEQ ID NO: 494352 - RNA, 64 nt, hsa; identical to SEQ ID NO: 293684

SEQ ID NO: 494353 - RNA, 64 nt, hsa; identical to SEQ ID NO: 293685

SEQ ID NO: 494354 - RNA, 64 nt, hsa
acucaguucuuggcugccguccuguggcagcuuaauggaacaaaaauuacagacuuuggugaac

SEQ ID NO: 494355 - RNA, 64 nt, hsa
aucauuguuaaacuuuguaaaguauuuaagguacauggaacacacgggaagucugguagcucag

SEQ ID NO: 494356 - RNA, 61 nt, hsa
uaccagagaguauuguguagugcucucugcaauggaacaugugauuucaggguugccgcag

SEQ ID NO: 494357 - RNA, 64 nt, hsa
agggucagugugagcagcuaacauccuaccucaaauggaacaggauuuuuugaugcuuugcucu

SEQ ID NO: 494358 - RNA, 64 nt, hsa
cagucaucccuuaagacgcacuggaaaucacacaauggaacaacacucagaaaugcggaauacc

SEQ ID NO: 494359 - RNA, 64 nt, hsa
cccagaagauuauguacugagagaauccugaagaauggaacagcuguagaaagccuucagugcu

SEQ ID NO: 494360 - RNA, 64 nt, hsa
gaugguauuggcagaggaacagacacauacgucaauggaacagaugagagaacccagaaauaaa

SEQ ID NO: 494361 - RNA, 64 nt, hsa
auaaagggaugacgcaaggaguuccuuugugcugauggaacaguucuauaugauuaugaugauu

SEQ ID NO: 494362 - RNA, 64 nt, hsa
agagaaauuaugugugucauguggucuucugaaaauggaacaccauucuucagagcacacgucu

SEQ ID NO: 494363 - RNA, 64 nt, hsa
uuauccucuuaaccuucucuucccagugaacuuuauggaacauuuaauuuaguacaauuaagua

SEQ ID NO: 494364 - RNA, 64 nt, hsa
gguauuauauuuuaaccuuuuacauuauuguuauuaauguuaguaauauauuguuauguuuucu

SEQ ID NO: 494365 - RNA, 64 nt, hsa
uuuuggggcaugcacuuucuuuccuuucucaaaauaauguuauauguggccacacugauguuca

SEQ ID NO: 494366 - RNA, 64 nt, hsa
gcacaucuauuaggauccuuaaauauucauuacuuaauguuaaauuaacauucuguguagggag

SEQ ID NO: 494367 - RNA, 64 nt, hsa
uccuggaaaaaugacaucaucaaaguauaguugauaauguuauaaaggaugauuuuaaaaauag

SEQ ID NO: 494368 - RNA, 64 nt, hsa
uagucacaauguuuuugugguuugaaguuuaguuuaauguuagugcagugacgggaaauacaca

SEQ ID NO: 494369 - RNA, 64 nt, hsa
uuauaagcuuugaguaucuuacagcuugccuuuuuaauguuagucacaauguuuuugugguuug

SEQ ID NO: 494370 - RNA, 64 nt, hsa
ggcauuauauaugauuaaacacuucagaacuuucuaauguuaucaggaguauuuugagggagau

SEQ ID NO: 494371 - RNA, 64 nt, hsa
ggcaucccuucuguauguaacaaaaagacauucauaauguuaggaagaugauaaaaauucgcuc

SEQ ID NO: 494372 - RNA, 64 nt, hsa
caguccguugcugaaaaugauuauaagcccugcauaauguuaagcuuuauugugauuacgugua

SEQ ID NO: 494373 - RNA, 64 nt, hsa
cuaucagagccucucccacaccacuauaguguaauaauguuauuauuacucuacacugaaacgu

SEQ ID NO: 494374 - RNA, 64 nt, hsa
uuuauuauguaauugauaaaauggugauguguauuaauguuaguucaaccauauauuuauacug

SEQ ID NO: 494375 - RNA, 64 nt, hsa
uaauuuaaauauuaguauuugguacaugaaggcuuaauguuaaguuuccuuuaaugauccacaa

SEQ ID NO: 494376 - RNA, 64 nt, hsa
cuaucauaaucacaucaggucugcuuuuugcuuuuaauguuaacuaaugaaguuccagagaugg

SEQ ID NO: 494377 - RNA, 64 nt, hsa
uuuuauaagccacagagacaaaccagaaacggaauaauguuacuuuggaugcuuuauuuuuuug

SEQ ID NO: 494378 - RNA, 64 nt, hsa
aacauguccuaauucuucuguccugagaagcauguaauguuaauguuauaucauauguauauau

SEQ ID NO: 494379 - RNA, 64 nt, hsa
uccuaauucuucuguccugagaagcauguaauguuaauguuauaucauauguauauauauauau

SEQ ID NO: 494380 - RNA, 64 nt, hsa
ugauuuuguguugauccaaauuugcauagcuguuuaauguuaagucaugacaauuuauuuuucu

SEQ ID NO: 494381 - RNA, 64 nt, hsa
auuuaacagaaaaacacaaaauuucaaccauucuuaauguuacguccuccccccacccccuucu

SEQ ID NO: 494382 - RNA, 64 nt, hsa
aauaaaaggauaauuacuuaauguuaauacacaguaauguuauuaucuauguauuguagacaau

SEQ ID NO: 494383 - RNA, 64 nt, hsa
cuaauguaggauaaagaauaaaaggauaauuacuuaauguuaauacacaguaauguuauuaucu

SEQ ID NO: 494384 - RNA, 64 nt, hsa
caggugcuauuguuacucuuacgaauauuuucaguaauguuauuuucuucuaagugaaauuucu

SEQ ID NO: 494385 - RNA, 64 nt, hsa
caaccauauuuagcagugcaguugaguuguguguuaauguuagacuaucccuuugugagugaca

SEQ ID NO: 494386 - RNA, 64 nt, hsa
auguuaaauagaugagauuauggaauguguauauuaauguuaaaaauuguaccuugaucaaugu

SEQ ID NO: 494387 - RNA, 64 nt, hsa
gggagaaaaaaauaacaacaacaaaggccuguguuaauguuaaauagaugagauuauggaaugu

SEQ ID NO: 494388 - RNA, 64 nt, hsa
uaaucacgaauguaguaauauuucaugauuguaauaauguuacaugaucauggguguggcauuc

SEQ ID NO: 494389 - RNA, 64 nt, hsa
ucuuaauucaacauuugaagaugugccuuuuggguaauguuaaucacgaauguaguaauauuuc

SEQ ID NO: 494390 - RNA, 64 nt, hsa
ugcauuucagaauauuagccaguaccagcuuugguaauguuagcaguucuggagcuuaauuuuc

SEQ ID NO: 494391 - RNA, 64 nt, hsa
cucgagcccagggcuagaaguugaaacucacuaguaauguuaaacaccauuuuuuuuuucuuuu

SEQ ID NO: 494392 - RNA, 64 nt, hsa
caguuacaaaggaauuuggaugauaauuauaacuuaauguuagagaugguaaagcugcacuuac

SEQ ID NO: 494393 - RNA, 64 nt, hsa
auauacuauuauuagaauaguagaggauaaaagauaauguuauccaguuacaaaggaauuugga

SEQ ID NO: 494394 - RNA, 64 nt, hsa
uugagauuuugaggugugcacaaggugguaagauaaagggcauaugagcuucaaaacuaaugcu

SEQ ID NO: 494395 - RNA, 64 nt, hsa
uuuccugguugcagauaacgaacuaagguugccuaaagggcagaucugcccucuccaugucuuc

SEQ ID NO: 494396 - RNA, 64 nt, hsa
augguacaaccuuuauucuuuuccaaaauaaaacaaagggcacagcaucuguagucagccgaca

SEQ ID NO: 494397 - RNA, 64 nt, hsa
auguaaugcaacuacccaaaacaagccugguaggaaagggcaagucuuuaggucuuuguaagaa

SEQ ID NO: 494398 - RNA, 64 nt, hsa
uagccuggcaacagagcaagacuccgucucaaaaaaagggcaauaaaugcccucucugaauguu

SEQ ID NO: 494399 - RNA, 64 nt, hsa
gccaagaaaaggcauggagacagcgaacuagaagaaagggcaagaaggaaauagccaccgucua

SEQ ID NO: 494400 - RNA, 64 nt, hsa
uuauggaaaggguuugagauagaugauuuuugggaaagggcaaaaugugucagaugcccuaguu

SEQ ID NO: 494401 - RNA, 64 nt, hsa
uaaucugaauaagacaauaugugaugaauauaagaaagggcaaaaaauucauuugaaccaguuu

SEQ ID NO: 494402 - RNA, 64 nt, hsa
caucuuugccaaaagcuaagcaguggugaacugaaaagggcauauugccccaagguuacacuga

SEQ ID NO: 494403 - RNA, 64 nt, hsa
ucguuggcagauuaucuucugaugacacagaaugaaagggcaucucagccucucugaacuuugu

SEQ ID NO: 494404 - RNA, 64 nt, hsa
ggggccucaaagggcagguuuaggcagaaaagaaaaagggcauuccagcuggggcaugugcaaa

SEQ ID NO: 494405 - RNA, 64 nt, hsa
cacgccccagaggagagagauggaguggggccucaaagggcagguuuaggcagaaaagaaaaag

SEQ ID NO: 494406 - RNA, 64 nt, hsa
ggauguuuggaugcggcugguaggcagggaagagaaagggcaccccagcgggggcaugugugga

SEQ ID NO: 494407 - RNA, 64 nt, hsa
agaagcagauggagaggucccauuaccugcaaagaaagggcacucaggcagcccuuugcaaucg

SEQ ID NO: 494408 - RNA, 64 nt, hsa
agcagggcugaauccccuucacaguguuaacacaaaagggcaucaccaucccacgaugucugaa

SEQ ID NO: 494409 - RNA, 64 nt, hsa
agacggucucaaucuaaaagcacuucaaggggucaaagggcaaccagcuugggugcuaccucag

SEQ ID NO: 494410 - RNA, 64 nt, hsa
ugucuuugcucacccucauccccaaacuacuugaaaagggcauuuggcaccacucucugaaaca

SEQ ID NO: 494411 - RNA, 64 nt, hsa
gcuauccuuccccucaccccucagcccaggagggaaagggcauuuucuuuuucaucuuugaaag

SEQ ID NO: 494412 - RNA, 64 nt, hsa
augcacagcaggcuccccauagcuuugucaccacaaagggcacuguucuauucacagcaccucc

SEQ ID NO: 494413 - RNA, 64 nt, hsa
auuugaauuuagggugauuuuaaagaacagugagaaagggcauacauccacagauucacuuugu

SEQ ID NO: 494414 - RNA, 64 nt, hsa
ggcacuaaacucagauugacuaaauaaaaaguacaaagggcacauauacgugacagaauuguac

SEQ ID NO: 494415 - RNA, 64 nt, hsa
agcugcagauaacucaaagccaucccuuuuuucuaaagggcacauugagaaugucacccauuug

SEQ ID NO: 494416 - RNA, 64 nt, hsa
uucccugauguccuuguuuaaacgauaauaagaaaaagggcaacuccauuuguugagggucuuu

SEQ ID NO: 494417 - RNA, 64 nt, hsa
cauguaauauccauauuaguuuuuucuugguagacaacuggaagguuuucuuuuuuuucgucua

SEQ ID NO: 494418 - RNA, 64 nt, hsa
gcuaaaaaugcagauucucaggcuuucucuagaccaacuggaucagaagcucugggggugaggc

SEQ ID NO: 494419 - RNA, 64 nt, hsa
aucuaauuuuaggaggaccaaauucaguggauggcaacuggaacauugauuguaaggccaguga

SEQ ID NO: 494420 - RNA, 64 nt, hsa
gaacauugauuguaaggccagugaaguuuucacccaacuggaauuugauggaaagaagguuugu

SEQ ID NO: 494421 - RNA, 64 nt, hsa
aacaggugcuccccugugcuguuacuccuucugccaacuggaagcagauggugaccaggcucug

SEQ ID NO: 494422 - RNA, 64 nt, hsa
cagaccaaggauaacuuucaaauguaugcuuaagcaacuggauggauaaugaugccauugagug

SEQ ID NO: 494423 - RNA, 64 nt, hsa
accugaaggcuugggccagagcucaacagcuacucaacuggaggggugagggggauaaggucug

SEQ ID NO: 494424 - RNA, 64 nt, hsa
auuugaaaaguauuauucucucuucucuuuguuucaacuggauuccuuuggaaaaccaaacuag

SEQ ID NO: 494425 - RNA, 64 nt, hsa; identical to SEQ ID NO: 154801

SEQ ID NO: 494426 - RNA, 64 nt, hsa; identical to SEQ ID NO: 154802

SEQ ID NO: 494427 - RNA, 64 nt, hsa; identical to SEQ ID NO: 154803

SEQ ID NO: 494428 - RNA, 64 nt, hsa; identical to SEQ ID NO: 154804

SEQ ID NO: 494429 - RNA, 64 nt, hsa; identical to SEQ ID NO: 154805

SEQ ID NO: 494430 - RNA, 64 nt, hsa; identical to SEQ ID NO: 154806

SEQ ID NO: 494431 - RNA, 64 nt, hsa; identical to SEQ ID NO: 154807

SEQ ID NO: 494432 - RNA, 64 nt, hsa; identical to SEQ ID NO: 154808

SEQ ID NO: 494433 - RNA, 64 nt, hsa; identical to SEQ ID NO: 154809

SEQ ID NO: 494434 - RNA, 64 nt, hsa; identical to SEQ ID NO: 154810

SEQ ID NO: 494435 - RNA, 64 nt, hsa; identical to SEQ ID NO: 154811

SEQ ID NO: 494436 - RNA, 64 nt, hsa; identical to SEQ ID NO: 154812

SEQ ID NO: 494437 - RNA, 64 nt, hsa; identical to SEQ ID NO: 154813

SEQ ID NO: 494438 - RNA, 64 nt, hsa; identical to SEQ ID NO: 154814

SEQ ID NO: 494439 - RNA, 64 nt, hsa; identical to SEQ ID NO: 154815

SEQ ID NO: 494440 - RNA, 64 nt, hsa; identical to SEQ ID NO: 154816

SEQ ID NO: 494441 - RNA, 64 nt, hsa; identical to SEQ ID NO: 154817

SEQ ID NO: 494442 - RNA, 64 nt, hsa; identical to SEQ ID NO: 154818

SEQ ID NO: 494443 - RNA, 64 nt, hsa; identical to SEQ ID NO: 154819

SEQ ID NO: 494444 - RNA, 64 nt, hsa; identical to SEQ ID NO: 154820

SEQ ID NO: 494445 - RNA, 64 nt, hsa; identical to SEQ ID NO: 154821

SEQ ID NO: 494446 - RNA, 64 nt, hsa; identical to SEQ ID NO: 154822

SEQ ID NO: 494447 - RNA, 64 nt, hsa; identical to SEQ ID NO: 154823

SEQ ID NO: 494448 - RNA, 64 nt, hsa; identical to SEQ ID NO: 154824

SEQ ID NO: 494449 - RNA, 64 nt, hsa; identical to SEQ ID NO: 154825

SEQ ID NO: 494450 - RNA, 64 nt, hsa; identical to SEQ ID NO: 154826

SEQ ID NO: 494451 - RNA, 64 nt, hsa; identical to SEQ ID NO: 154827

SEQ ID NO: 494452 - RNA, 64 nt, hsa; identical to SEQ ID NO: 154828

SEQ ID NO: 494453 - RNA, 64 nt, hsa; identical to SEQ ID NO: 154829

SEQ ID NO: 494454 - RNA, 64 nt, hsa; identical to SEQ ID NO: 154830

SEQ ID NO: 494455 - RNA, 64 nt, hsa; identical to SEQ ID NO: 154831

SEQ ID NO: 494456 - RNA, 64 nt, hsa; identical to SEQ ID NO: 154832

SEQ ID NO: 494457 - RNA, 64 nt, hsa; identical to SEQ ID NO: 154833

SEQ ID NO: 494458 - RNA, 64 nt, hsa; identical to SEQ ID NO: 154834

SEQ ID NO: 494459 - RNA, 64 nt, hsa; identical to SEQ ID NO: 154835

SEQ ID NO: 494460 - RNA, 64 nt, hsa; identical to SEQ ID NO: 154836

SEQ ID NO: 494461 - RNA, 64 nt, hsa; identical to SEQ ID NO: 154837

SEQ ID NO: 494462 - RNA, 64 nt, hsa; identical to SEQ ID NO: 154838

SEQ ID NO: 494463 - RNA, 64 nt, hsa; identical to SEQ ID NO: 154839

SEQ ID NO: 494464 - RNA, 64 nt, hsa; identical to SEQ ID NO: 154840

SEQ ID NO: 494465 - RNA, 64 nt, hsa; identical to SEQ ID NO: 154841

SEQ ID NO: 494466 - RNA, 64 nt, hsa; identical to SEQ ID NO: 154842

SEQ ID NO: 494467 - RNA, 64 nt, hsa; identical to SEQ ID NO: 154843

SEQ ID NO: 494468 - RNA, 64 nt, hsa; identical to SEQ ID NO: 154844

SEQ ID NO: 494469 - RNA, 64 nt, hsa; identical to SEQ ID NO: 154845

SEQ ID NO: 494470 - RNA, 64 nt, hsa; identical to SEQ ID NO: 154846

SEQ ID NO: 494471 - RNA, 64 nt, hsa; identical to SEQ ID NO: 154847

SEQ ID NO: 494472 - RNA, 64 nt, hsa; identical to SEQ ID NO: 154848

SEQ ID NO: 494473 - RNA, 64 nt, hsa
uccaaacucaggaaguuugcagagagcagacagcuagagauaacucgggacccagaguuggucg

SEQ ID NO: 494474 - RNA, 64 nt, hsa
ggcuguauguauauuguucuuccuccuuagaauuuagagauacaagaguucuacuuagaacuuu

SEQ ID NO: 494475 - RNA, 64 nt, hsa
augaauauaaaaucuauaauucuauaugaauauauagagauauagaaacaucugaacugguaaa

SEQ ID NO: 494476 - RNA, 64 nt, hsa
auaaaauaugaaagcucuaaauuuaaaauaaauuuagagauagaaucaugguacauuauuguuu

SEQ ID NO: 494477 - RNA, 64 nt, hsa
augccuggcuaauuuuuuuuuuuuguauuuuuaguagagauaggcuuucaccuuguuagccagg

SEQ ID NO: 494478 - RNA, 64 nt, hsa
ggauggucucacguuuuguuuuuuuaacuuuuuguagagauaggguuucauuacauugcucagg

SEQ ID NO: 494479 - RNA, 63 nt, hsa
ggaccaaauuucuuagcucauaucauugcuuuaaacauagaaguaaaagaauacugcauguug

SEQ ID NO: 494480 - RNA, 63 nt, hsa
gcuugaguccaggaguuugagaugcgccugggcaacauagaaaccugugucuacaaaaaauuu

SEQ ID NO: 494481 - RNA, 63 nt, hsa
acugugaagacuuuguuauaccuuauuugcuacaacauagaucauaucauugcuacuuugacu

SEQ ID NO: 494482 - RNA, 63 nt, hsa
auauuaaaaggaagcggggaacauguauuuuuuaacauagaacagaagugacuucauucuuuu

SEQ ID NO: 494483 - RNA, 63 nt, hsa
uuugacucagugacaaucaucauauuggagcaaaacauagaacaaaaucacuaucucagaaau

SEQ ID NO: 494484 - RNA, 63 nt, hsa
aaaguuacuuuggguauccuguaauuuaguuguaacauagaaaaugaaaaaacaguuaaaaaa

SEQ ID NO: 494485 - RNA, 63 nt, hsa
gucaaaauggaggcauuugcugucuaauauucaaacauagaaagggagcugcuuuuaaagaau

SEQ ID NO: 494486 - RNA, 63 nt, hsa
cugagccacugaggaaccacacugugcugcggaaacauagacgugggggcauaggcucccacu

SEQ ID NO: 494487 - RNA, 63 nt, hsa
uuugagguaccaaacauaaccaaucugugcaacaacauagacugaccucaguacccaagagag

SEQ ID NO: 494488 - RNA, 63 nt, hsa
uuagcccaauggagaaaugaagcagaggaaggaaacauagaaagacaugggcuaucagggagg

SEQ ID NO: 494489 - RNA, 63 nt, hsa
uguagagagugggucacauuuguuagccacggaaacauagaaacauacacaaggccagaaaaa

SEQ ID NO: 494490 - RNA, 63 nt, hsa
ugagauuugaaggaaacaugcacaaaucuguaaaacauagaccuucgcuuuauuuuuguaagu

SEQ ID NO: 494491 - RNA, 63 nt, hsa
augcaguuuuuuuacuauuccaucaugaggaacaacauagauuccaugaucuuuuuaaugaca

SEQ ID NO: 494492 - RNA, 63 nt, hsa
guauuaucagaauggguauuauuaaaaaaucaaaacauagaugcuagugaggcugcagagaaa

SEQ ID NO: 494493 - RNA, 63 nt, hsa
cauaaaaaagaacaagacuguguccuuuacagcaacauagauggagcugaggcucuuauccua

SEQ ID NO: 494494 - RNA, 64 nt, hsa; identical to SEQ ID NO: 175154

SEQ ID NO: 494495 - RNA, 64 nt, hsa; identical to SEQ ID NO: 175155

SEQ ID NO: 494496 - RNA, 64 nt, hsa; identical to SEQ ID NO: 175156

SEQ ID NO: 494497 - RNA, 64 nt, hsa; identical to SEQ ID NO: 175157

SEQ ID NO: 494498 - RNA, 64 nt, hsa; identical to SEQ ID NO: 175158

SEQ ID NO: 494499 - RNA, 64 nt, hsa; identical to SEQ ID NO: 175159

SEQ ID NO: 494500 - RNA, 64 nt, hsa; identical to SEQ ID NO: 175160

SEQ ID NO: 494501 - RNA, 64 nt, hsa; identical to SEQ ID NO: 175161

SEQ ID NO: 494502 - RNA, 64 nt, hsa
uucaauggaaauuccaacagauuuuauugaaugaaacaagcagguguuuauauggaguagcaaa

SEQ ID NO: 494503 - RNA, 64 nt, hsa
ccacauggggcguacuauuuuuauugagcccaaaaacaagcaaaaccaaagaauauguagucua

SEQ ID NO: 494504 - RNA, 64 nt, hsa
uuucacuuaagugucuggcccgcaauacuguaggaacaagcaugaucuuguuacugugauauuu

SEQ ID NO: 494505 - RNA, 64 nt, hsa
uucccgagaguaaaucaucuuuccaauccagaggaacaagcaugucucucugccaagauccauc

SEQ ID NO: 494506 - RNA, 64 nt, hsa
aagugcuccucaccuguguggcccagauggcuccaacaagcaaaaggaaggaugcagugacucu

SEQ ID NO: 494507 - RNA, 64 nt, hsa
uuuuucuuaaaugcaagagcuucuacugacucuuaacaagcaugcuuacccaaauuuuguugca

SEQ ID NO: 494508 - RNA, 64 nt, hsa
cuugucuuccauuacaauuaacagucaaggauaaaacaagcacgcgcacaaucaaggagcugga

SEQ ID NO: 494509 - RNA, 64 nt, hsa
uccagaccuauugaaucucaaauucuggggcuuaaacaagcacauuccaaguuaagaaccaaug

SEQ ID NO: 494510 - RNA, 64 nt, hsa
uccuagaaaauguccuacugcccugcauuugacaaacaagcauccuuuacuaacaagagcagga

SEQ ID NO: 494511 - RNA, 64 nt, hsa
ugggcacaggcgaagccauuggaagcacuucaggaacaagcacacagcugugggacuugaacau

SEQ ID NO: 494512 - RNA, 64 nt, hsa
aauuuuaacccaaaugaauaacuaagaaauauaaaacaagcacaaaaucuuagggaagucauaa

SEQ ID NO: 494513 - RNA, 64 nt, hsa
ugggaagcagaacaacagaaggaacuuuaaaagcaacaagcaauuauguaccauauauacacug

SEQ ID NO: 494514 - RNA, 64 nt, hsa
caucccuggugucguauuuugccuguuaaaucguaacaagcaauaaacaacuuucacuuugcaa

SEQ ID NO: 494515 - RNA, 64 nt, hsa
guguuuagauuuauuuuuucaucucauuuuuaagaacaagcaguacgauuuguuuucuucaaca

SEQ ID NO: 494516 - RNA, 64 nt, hsa; identical to SEQ ID NO: 288556

SEQ ID NO: 494517 - RNA, 64 nt, hsa; identical to SEQ ID NO: 288557

SEQ ID NO: 494518 - RNA, 64 nt, hsa; identical to SEQ ID NO: 288558

SEQ ID NO: 494519 - RNA, 64 nt, hsa; identical to SEQ ID NO: 288559

SEQ ID NO: 494520 - RNA, 64 nt, hsa; identical to SEQ ID NO: 288560

SEQ ID NO: 494521 - RNA, 64 nt, hsa; identical to SEQ ID NO: 288561

SEQ ID NO: 494522 - RNA, 64 nt, hsa; identical to SEQ ID NO: 288562

SEQ ID NO: 494523 - RNA, 64 nt, hsa; identical to SEQ ID NO: 288563

SEQ ID NO: 494524 - RNA, 64 nt, hsa; identical to SEQ ID NO: 288564

SEQ ID NO: 494525 - RNA, 64 nt, hsa; identical to SEQ ID NO: 288565

SEQ ID NO: 494526 - RNA, 64 nt, hsa
gcaccuggcucucggcugaggauugucaccccaagucuuccagcugguggaucugggcccagca

SEQ ID NO: 494527 - RNA, 64 nt, hsa
ggaccugcccggugaugcuguugauuucucaaaggucuuccaaaacucaacagagccagaagua

SEQ ID NO: 494528 - RNA, 64 nt, hsa
gcagagaucucaucaauuagcucuucucugcaaggucuuccacuauuucugucugucuuccaua

SEQ ID NO: 494529 - RNA, 64 nt, hsa
cucuucucugcaaggucuuccacuauuucugucugucuuccauaucaagccuggaugcagcugc

SEQ ID NO: 494530 - RNA, 64 nt, hsa
ucucagggagcagucuuccaucaugcugaauuuugucuuccaggagcugccccuauggggcggg

SEQ ID NO: 494531 - RNA, 64 nt, hsa
cggccaauccgcaucucagcccucucagggagcagucuuccaucaugcugaauuuugucuucca

SEQ ID NO: 494532 - RNA, 64 nt, hsa
gcaguacccgggaaccccaacaguugguugucuugucuuccagggugcaggucacugagugacu

SEQ ID NO: 494533 - RNA, 64 nt, hsa
gggugcguagggacggugguacccagaugcccaagucuuccaggcaauaccuggcucaggccca

SEQ ID NO: 494534 - RNA, 64 nt, hsa
auucaugauucaguguagaauguauagacuuuaugucuuccaaguuuaaaaaaagagacagggu

SEQ ID NO: 494535 - RNA, 64 nt, hsa
ugggacuacggggucgccacugcacccagccugugucuuccagcucuaaucagaaagcugcuug

SEQ ID NO: 494536 - RNA, 64 nt, hsa
aggcccaacugugagcaaggagcacaagccacaagucuuccagaggaugcuugauuccaguggu

SEQ ID NO: 494537 - RNA, 64 nt, hsa
gguuuccagucaugagcguuagacugacuuguuugucuuccauuccauuguuuugaaacucagu

SEQ ID NO: 494538 - RNA, 64 nt, hsa
guugagagaugauuaaaaauaauaauaauaaagugucuuccauuguuaaaugaaguguuugggg

SEQ ID NO: 494539 - RNA, 64 nt, hsa
auguagcuauuuauuaaaugcccuggguucuuuagucuuccaagggagggccucgcgcccauuc

SEQ ID NO: 494540 - RNA, 64 nt, hsa
auuguuaucuuuuggugacacccuuaaauuuuaagucuuccagucuuccaugugaacuuuaggc

SEQ ID NO: 494541 - RNA, 64 nt, hsa
cuuuuggugacacccuuaaauuuuaagucuuccagucuuccaugugaacuuuaggcccaaaguu

SEQ ID NO: 494542 - RNA, 64 nt, hsa; identical to SEQ ID NO: 205933

SEQ ID NO: 494543 - RNA, 64 nt, hsa; identical to SEQ ID NO: 205934

SEQ ID NO: 494544 - RNA, 64 nt, hsa; identical to SEQ ID NO: 205935

SEQ ID NO: 494545 - RNA, 64 nt, hsa; identical to SEQ ID NO: 205936

SEQ ID NO: 494546 - RNA, 64 nt, hsa; identical to SEQ ID NO: 205937

SEQ ID NO: 494547 - RNA, 64 nt, hsa; identical to SEQ ID NO: 205938

SEQ ID NO: 494548 - RNA, 64 nt, hsa; identical to SEQ ID NO: 205939

SEQ ID NO: 494549 - RNA, 64 nt, hsa; identical to SEQ ID NO: 205940

SEQ ID NO: 494550 - RNA, 64 nt, hsa; identical to SEQ ID NO: 205941

SEQ ID NO: 494551 - RNA, 64 nt, hsa; identical to SEQ ID NO: 205942

SEQ ID NO: 494552 - RNA, 64 nt, hsa; identical to SEQ ID NO: 205943

SEQ ID NO: 494553 - RNA, 64 nt, hsa; identical to SEQ ID NO: 205944

SEQ ID NO: 494554 - RNA, 64 nt, hsa; identical to SEQ ID NO: 205945

SEQ ID NO: 494555 - RNA, 64 nt, hsa; identical to SEQ ID NO: 205946

SEQ ID NO: 494556 - RNA, 64 nt, hsa; identical to SEQ ID NO: 205947

SEQ ID NO: 494557 - RNA, 64 nt, hsa; identical to SEQ ID NO: 205948

SEQ ID NO: 494558 - RNA, 64 nt, hsa; identical to SEQ ID NO: 205949

SEQ ID NO: 494559 - RNA, 64 nt, hsa; identical to SEQ ID NO: 205950

SEQ ID NO: 494560 - RNA, 64 nt, hsa; identical to SEQ ID NO: 205951

SEQ ID NO: 494561 - RNA, 64 nt, hsa; identical to SEQ ID NO: 205952

SEQ ID NO: 494562 - RNA, 64 nt, hsa; identical to SEQ ID NO: 205953

SEQ ID NO: 494563 - RNA, 64 nt, hsa; identical to SEQ ID NO: 205954

SEQ ID NO: 494564 - RNA, 64 nt, hsa; identical to SEQ ID NO: 205955

SEQ ID NO: 494565 - RNA, 64 nt, hsa; identical to SEQ ID NO: 205956

SEQ ID NO: 494566 - RNA, 64 nt, hsa; identical to SEQ ID NO: 205957

SEQ ID NO: 494567 - RNA, 64 nt, hsa; identical to SEQ ID NO: 205958

SEQ ID NO: 494568 - RNA, 64 nt, hsa; identical to SEQ ID NO: 205959

SEQ ID NO: 494569 - RNA, 64 nt, hsa; identical to SEQ ID NO: 205960

SEQ ID NO: 494570 - RNA, 64 nt, hsa; identical to SEQ ID NO: 205961

SEQ ID NO: 494571 - RNA, 64 nt, hsa; identical to SEQ ID NO: 205962

SEQ ID NO: 494572 - RNA, 64 nt, hsa; identical to SEQ ID NO: 205963

SEQ ID NO: 494573 - RNA, 64 nt, hsa; identical to SEQ ID NO: 205964

SEQ ID NO: 494574 - RNA, 64 nt, hsa; identical to SEQ ID NO: 205965

SEQ ID NO: 494575 - RNA, 64 nt, hsa; identical to SEQ ID NO: 205966

SEQ ID NO: 494576 - RNA, 64 nt, hsa; identical to SEQ ID NO: 205967

SEQ ID NO: 494577 - RNA, 64 nt, hsa; identical to SEQ ID NO: 205968

SEQ ID NO: 494578 - RNA, 64 nt, hsa; identical to SEQ ID NO: 205969

SEQ ID NO: 494579 - RNA, 64 nt, hsa; identical to SEQ ID NO: 205970

SEQ ID NO: 494580 - RNA, 64 nt, hsa; identical to SEQ ID NO: 205971

SEQ ID NO: 494581 - RNA, 64 nt, hsa; identical to SEQ ID NO: 205972

SEQ ID NO: 494582 - RNA, 64 nt, hsa; identical to SEQ ID NO: 205973

SEQ ID NO: 494583 - RNA, 64 nt, hsa; identical to SEQ ID NO: 205974

SEQ ID NO: 494584 - RNA, 64 nt, hsa; identical to SEQ ID NO: 205975

SEQ ID NO: 494585 - RNA, 64 nt, hsa; identical to SEQ ID NO: 205976

SEQ ID NO: 494586 - RNA, 64 nt, hsa; identical to SEQ ID NO: 205977

SEQ ID NO: 494587 - RNA, 64 nt, hsa; identical to SEQ ID NO: 205978

SEQ ID NO: 494588 - RNA, 64 nt, hsa; identical to SEQ ID NO: 205979

SEQ ID NO: 494589 - RNA, 64 nt, hsa; identical to SEQ ID NO: 205980

SEQ ID NO: 494590 - RNA, 64 nt, hsa; identical to SEQ ID NO: 205981

SEQ ID NO: 494591 - RNA, 64 nt, hsa; identical to SEQ ID NO: 205982

SEQ ID NO: 494592 - RNA, 64 nt, hsa; identical to SEQ ID NO: 205983

SEQ ID NO: 494593 - RNA, 54 nt, hsa; identical to SEQ ID NO: 205984

SEQ ID NO: 494594 - RNA, 64 nt, hsa; identical to SEQ ID NO: 205985

SEQ ID NO: 494595 - RNA, 64 nt, hsa; identical to SEQ ID NO: 205986

SEQ ID NO: 494596 - RNA, 64 nt, hsa; identical to SEQ ID NO: 205987

SEQ ID NO: 494597 - RNA, 64 nt, hsa; identical to SEQ ID NO: 205988

SEQ ID NO: 494598 - RNA, 64 nt, hsa; identical to SEQ ID NO: 205989

SEQ ID NO: 494599 - RNA, 64 nt, hsa
aaagaaauaucauuaccaaugaaauguguuugaguucaguaagaauuauucaaaugccuagaaa

SEQ ID NO: 494600 - RNA, 64 nt, hsa
gaaaagauagcuuuuaauugugguauauauaaucuucaguaacaauacauacugaauacgcugu

SEQ ID NO: 494601 - RNA, 64 nt, hsa
aauugcuuuccuuccccgccuuugacaugaggccuucaguaaagagcuacagaacaugaguaca

SEQ ID NO: 494602 - RNA, 64 nt, hsa
gcccuguauucucaacagggaugcaaauugguucuucaguaaggauaaaaaaaaaucacaagca

SEQ ID NO: 494603 - RNA, 64 nt, hsa
gcaguuuuaauguuuacaguuuaagauacucauuuucaguaacuaguguuaaagauuuuuaucu

SEQ ID NO: 494604 - RNA, 64 nt, hsa
cauaguuuuucaacugcaaaaaucaugucaucucuucaguaacuguuaaaguguaauucucugc

SEQ ID NO: 494605 - RNA, 64 nt, hsa
agugccgaacccugaauuuaacauaugguagacauucaguaaauguuuguugaaugaaugcaug

SEQ ID NO: 494606 - RNA, 64 nt, hsa
uaccaacuaugugacuuuguccaagucauuuaacuucaguaaaccucgguaugacugaaaaggg

SEQ ID NO: 494607 - RNA, 64 nt, hsa
uuggguuuuagaucucuuuucauuugucaaccuuuucaguaaagcccucuguuacaucacugug

SEQ ID NO: 494608 - RNA, 64 nt, hsa
uccagaagccagcaguauuucaguaucacaguguuucaguaauuugccuccaugauucuagugc

SEQ ID NO: 494609 - RNA, 64 nt, hsa
uaucacuaaauaugaaacugggccaaggggaaaauucaguaaguuagcguuaaauggaaguaaa

SEQ ID NO: 494610 - RNA, 64 nt, hsa
auggcagucacugcauuguacauuauuccaguucuucaguaauucuguuuaaacugugauuuuc

SEQ ID NO: 494611 - RNA, 64 nt, hsa
cugugguuccuggggugcccuccacugcccucuguucaguaacagggccuugcuaaucggguug

SEQ ID NO: 494612 - RNA, 64 nt, hsa
cacagguguccccagcccacuggaucagaaagaguucaguaagaccggaagcuccugguauggg

SEQ ID NO: 494613 - RNA, 64 nt, hsa
aauuaccuacuguauuuguuucuuuguuuauauuuucaguaagcccuggggaauauagcaugga

SEQ ID NO: 494614 - RNA, 64 nt, hsa
agcaguauuauuagcauaagcugcauacguaauauucaguaacugccauauuauauaacaaauu

SEQ ID NO: 494615 - RNA, 64 nt, hsa
acuuaacauucgguuuuaucagccagcaguauucuucaguaaauaaagaauggaauugcugaau

SEQ ID NO: 494616 - RNA, 64 nt, hsa
aauguaaucauugaaccucgagucacuguaaaaguucaguaauugcuuauuguauuaguuuuag

SEQ ID NO: 494617 - RNA, 64 nt, hsa
auuaagaccuaaguucauuuauacuuacaaguuauaguuuaaaauauuauuguaaauacccuag

SEQ ID NO: 494618 - RNA, 64 nt, hsa
caaguuauaguuuaaaauauuauuguaaauacccuaguuuaauaaacaccuuucuuuuuagguc

SEQ ID NO: 494619 - RNA, 64 nt, hsa
acaaaccaauuauaagugagaauacuguuuuccuuaguuuaauuaauacaauguuauguuuuuu

SEQ ID NO: 494620 - RNA, 64 nt, hsa
uuaaaugcaccaaagauuuuuaguagguauuaaauaguuuaaaagacuuuaaauucuuucuugc

SEQ ID NO: 494621 - RNA, 64 nt, hsa
guuaguuuagcuacuauguaacuuuuucagggaauaguuuaagcuuuauucauucaugcaauac

SEQ ID NO: 494622 - RNA, 64 nt, hsa
auccuuccccuuuuuucuaaauuugaaauagcuuuaguuuaaaaaaaaauccucccuucccccu

SEQ ID NO: 494623 - RNA, 64 nt, hsa
gaaaauggugauauagaccucagagcuguuaucuuaguuuaaagauuguauauguacuguacua

SEQ ID NO: 494624 - RNA, 64 nt, hsa
cgauuuuuagcaaaaaagaaaaaaaaaaggcacauaguuuaaaaaguuucucauuuugugcaau

SEQ ID NO: 494625 - RNA, 64 nt, hsa
aauagugugauuuucaagacuucaaauacaaauuuaguuuaaguguuugaacaacuauaugcac

SEQ ID NO: 494626 - RNA, 64 nt, hsa
gauuuuucuauuguguaauucuuggugggcucuguaguuuaauaauaagaaaaaggccauuuca

SEQ ID NO: 494627 - RNA, 64 nt, hsa
ucucugugucucaaugccugggacuggagguugauaguuuaaguguguucuuaccgccuccuuu

SEQ ID NO: 494628 - RNA, 64 nt, hsa
ugaacuauuaaaauaaaauauuauauuuaacccuuaguuuaagaagaagucaauaugcuuauuu

SEQ ID NO: 494629 - RNA, 64 nt, hsa
cugguuuuuaacaagcuguuuguucaucuauauuuaguuuaaaauagguaguauuaucuuucug

SEQ ID NO: 494630 - RNA, 64 nt, hsa
auuucuuaaaacauuucccugagccaguaaacaguaguuuaaucauuggucuuuucaaaacuag

SEQ ID NO: 494631 - RNA, 64 nt, hsa
auuuuguuuguucuaagaggauugaaaaucaguuuaguuuaaaugucuuucuguuaggccuuuc

SEQ ID NO: 494632 - RNA, 64 nt, hsa
caguucuuuuuaauggggucaauaauggacauucuaguuuaaggugguugauggauuuagccau

SEQ ID NO: 494633 - RNA, 64 nt, hsa
ggaggccuaauuuguagauugugaaagcagcuuuuaguuuaacuuauucacagaccccuuauaa

SEQ ID NO: 494634 - RNA, 64 nt, hsa
uuuguuuuuuuuuuaugguuaaaaguaacuuuuguaguuuaaaaaaaucuuuccucuuucauau

SEQ ID NO: 494635 - RNA, 64 nt, hsa
ugcgguuuauuuauucuuuaacugucuguuuuaguaguuuaaugauuaugaaaaauguaucugu

SEQ ID NO: 494636 - RNA, 64 nt, hsa
uuauuauuuuguaacuuuacaguuaaacuaguuuuaguuuaaaaagaaaaaaugcagggugauu

SEQ ID NO: 494637 - RNA, 64 nt, hsa
cuuuaaacacuuuucgugaagaaauuuugcacaguaguuuaaaucuuuuguuaaugcuccuccg

SEQ ID NO: 494638 - RNA, 64 nt, hsa
uaacuuuuauaacaaauuauuagcuuugaucuuguaguuuaaaauugcagggaacugggguaau

SEQ ID NO: 494639 - RNA, 64 nt, hsa
uuucuuuaacuuaauugcuauguuuugacauuuuuaguuuaaaaaccuuguauaucuuguuuug

SEQ ID NO: 494640 - RNA, 64 nt, hsa
gaggcccuaucuuuugcauccuacauuaauuaucuaguuuaauuaaucuguaaugcuuucgaua

SEQ ID NO: 494641 - RNA, 64 nt, hsa
auuacuaaccuuuaauuuaaucaaucauguacuuuaguuuaauguauaaagauccucuagaaaa

SEQ ID NO: 494642 - RNA, 64 nt, hsa
aaaggucccaggaucacuuuuaagggauuuuuauuaguuuaaagguaaauaaagucagcugaau

SEQ ID NO: 494643 - RNA, 64 nt, hsa
cauguuuguguugcuacagcuuuugugggaaauuuaguuuaaaggcagcucuugguguaccuua

SEQ ID NO: 494644 - RNA, 64 nt, hsa
aaguguugaguaaagaggcuaaauaaaaugagacuaguuuaauauagagagaaaaauaccuuua

SEQ ID NO: 494645 - RNA, 64 nt, hsa
aguuaaucuuugaaaacucauacagugguauugcuaguuuaaaaugagucacuuacuucauauc

SEQ ID NO: 494646 - RNA, 64 nt, hsa
aaaugugucuuguauuaucauaaguuagauguuuuaguuuaaaaaucagaaagacauucuuagu

SEQ ID NO: 494647 - RNA, 64 nt, hsa
uucugaaauaaaacauuuuaaaauauaaauccuguaguuuaaaaggaagaaauggugggaagga

SEQ ID NO: 494648 - RNA, 64 nt, hsa
agagcuacucaugauuauuuguguuucuaauuuauaguuuaaguuuauuuguaaaaaguuaaaa

SEQ ID NO: 494649 - RNA, 64 nt, hsa
auaugauaaauuauguucugauauccuccuacaguaguuuaaauugacagaaaaauuugaaugu

SEQ ID NO: 494650 - RNA, 64 nt, hsa
uuauuuagccaaugcaaaucuguuuuaaaacaaauaguuuaaaaaaagaacaaguuuuuaaggg

SEQ ID NO: 494651 - RNA, 64 nt, hsa
gaccuuuuuuggauagucaaauauaagagauaaauaguuuaauuuuuucagaccuuuuuuggau

SEQ ID NO: 494652 - RNA, 64 nt, hsa
gaccuuuuuuggauaguccaauauuagagauaaauaguuuaauuuuuucagauauaaugccagu

SEQ ID NO: 494653 - RNA, 64 nt, hsa
ggugcuauaaccccuugggacacucauccagacuucucugaagcagaaaaccugagcuccccac

SEQ ID NO: 494654 - RNA, 64 nt, hsa
guguaccuaaucucaccaucucuucacuucuagcucucugaaacaagggucacacuacucagag

SEQ ID NO: 494655 - RNA, 64 nt, hsa
aacuauaaaagugcaaugacuaagauccuucacuucucugaaaguaaggcccuagaugccucag

SEQ ID NO: 494656 - RNA, 64 nt, hsa
ugcuggucuccaggcugacaaggauucaaaguugucucugaaacuccucuuugucauacugcac

SEQ ID NO: 494657 - RNA, 64 nt, hsa
cacuguggcuucaagcaccucuguucauagagcgucucugaaauugagucucggucaugacuua

SEQ ID NO: 494658 - RNA, 64 nt, hsa
ccuuuauuuaagauucacuuauuagucugcuguuucucugaaaaauuuuagagcuagguauagu

SEQ ID NO: 494659 - RNA, 64 nt, hsa
ccuaugggguuuaugaaaaauacuuggggaucauucucugaauggucuaaggaagcgguagcca

SEQ ID NO: 494660 - RNA, 64 nt, hsa
ugucacugugaggcccuacuagguguaagcauucucucugaauuuuaauuuccucucauuaaaa

SEQ ID NO: 494661 - RNA, 64 nt, hsa
aaauaauucuguucaucauuucacuccgugcaguucucugaauugagagauguaccucuuaaac

SEQ ID NO: 494662 - RNA, 64 nt, hsa
uugcaauaccugucaccaugcagccgcugauaguucucugaacuaaaaggacuaauuguacuuu

SEQ ID NO: 494663 - RNA, 64 nt, hsa
auugcgagcuugggaauuagacuuuggagucuuuucucugaagucaccaggccaggggucagga

SEQ ID NO: 494664 - RNA, 64 nt, hsa
auauacauaacaccaaucagaccguguggauuuuucucugaauugacugauuuuguuuuuuucu

SEQ ID NO: 494665 - RNA, 64 nt, hsa
uguguuugaaauuauguccaugaaaucacagggaucucugaaauaucuuuaggaaacuugaaau

SEQ ID NO: 494666 - RNA, 64 nt, hsa
ucuguaaacacucugaucuuccuauuccacugagucucugaagggaauagggcugguagugggu

SEQ ID NO: 494667 - RNA, 64 nt, hsa
uuuugaaaaugauuuaaaguguuuuccuuaauguucucugaaaacaaguuucuuuuguaguuuu

SEQ ID NO: 494668 - RNA, 64 nt, hsa
uguuggguguggguggucuccaaggccacgcugcucucugaauugauuuuuugaguuuuguuug

SEQ ID NO: 494669 - RNA, 64 nt, hsa
aacuccugucucugugagaauguauacuuuaugcucucugaaauguaugacacccagcuuuaaa

SEQ ID NO: 494670 - RNA, 64 nt, hsa
uuucuuuaaaaugcaagcagugagaaauaagaccucucugaauuaguagcucuaaacuguuaac

SEQ ID NO: 494671 - RNA, 64 nt, hsa
ccacaacacagaacgauguugaccuguuaaguauucucugaaacauggccaaaaugcauuuuau

SEQ ID NO: 494672 - RNA, 64 nt, hsa
cugggggucaggacagggccugauuugagccuccucucugaagaugauuuggccgagcggaagg

SEQ ID NO: 494673 - RNA, 64 nt, hsa
uuggacaggaggugcugaggcuggcugcaccugcucucugaagacgccuuccucucuagguuca

SEQ ID NO: 494674 - RNA, 64 nt, hsa
uucuugauguccaggguagauaaagggucgaaucucucugaagaacugccaccuggucaucagc

SEQ ID NO: 494675 - RNA, 64 nt, hsa
cacucacccugcuagcuuugcccuugacucgucuucucugaaccucagccucgugcauugccug

SEQ ID NO: 494676 - RNA, 64 nt, hsa
gaaacauuuucuuucauuccaguggccuuagucaucucugaagaaauacuuacuugauuuuuuu

SEQ ID NO: 494677 - RNA, 64 nt, hsa
acuuccucgcccuccuccacccgagaugccagagucucugaagaagaagcuuggguuaacucag

SEQ ID NO: 494678 - RNA, 64 nt, hsa
gaggccaggaaaaaaaaaaaaaagacucccuggaucucugaauauaugcaaaaagaaggcccca

SEQ ID NO: 494679 - RNA, 64 nt, hsa
uggguguuguauagauccaguugcacuaaauuccucucugaaucuuggcugcuggagccauuca

SEQ ID NO: 494680 - RNA, 64 nt, hsa
gauaaauuuuguagcugguacacucuggccugggucucugaauucagccugucaccgauggcug

SEQ ID NO: 494681 - RNA, 64 nt, hsa
agguccuugaucuuuucuuuagauugaaagucugucucugaacacaauuauuuguaaaaguuag

SEQ ID NO: 494682 - RNA, 64 nt, hsa
gcuaaucaggaaauaaacuugacuuuucuauuuuucucugaagcuuuacaggacauacucccac

SEQ ID NO: 494683 - RNA, 64 nt, hsa
cauuaagaagauaaauccaguuaucagcuuccugucucugaaguuuggaucauuuuauagaucc

SEQ ID NO: 494684 - RNA, 64 nt, hsa
ccucuugucuuucuucccugcuuugcugcuuugcucucugaaaccuacauuccgucaguuuccg

SEQ ID NO: 494685 - RNA, 64 nt, hsa
uggccuacacagagaaccguucguguugggcuucucucugaacgccccgaaccuugcaucaagg

SEQ ID NO: 494686 - RNA, 64 nt, hsa
aauucacccuacauuccucuccucuucacuagccucucugaagguguccuggccagcccuggag

SEQ ID NO: 494687 - RNA, 64 nt, hsa
caaccuggaauggagacuuuuaucuacuucucucucucugaagaugucaaaucgugguuuagau

SEQ ID NO: 494688 - RNA, 64 nt, hsa
aacuacugcuuuagaaugaagucguauaauaaagucucugaaaaggccuuauucagaauaagca

SEQ ID NO: 494689 - RNA, 64 nt, hsa
gauucacuuuugcuucuggggcuggcaaaaaccuucucugaacccacacaccaaguucguaguu

SEQ ID NO: 494690 - RNA, 64 nt, hsa
cgucuuagccauuccguccugcuccccagcucacucucugaagcacacaucauuggcuuuccua

SEQ ID NO: 494691 - RNA, 64 nt, hsa
ggagaggacucagauuuccuggaggcaaagucuaucucugaaacuccaugaagacuuuugcagc

SEQ ID NO: 494692 - RNA, 64 nt, hsa
ccagcuccuaccucugaccccaacuucucuuugaucucugaauccccucugacuccaacuucuc

SEQ ID NO: 494693 - RNA, 64 nt, hsa
gaggcuucugaccuuugauccgcuaggccccccaucucugaacccuagagccccgcuuucccuc

SEQ ID NO: 494694 - RNA, 64 nt, hsa
aaagaauuuggagaugguucugcccacucugguuucucugaaaaaacgagguaauucccugagc

SEQ ID NO: 494695 - RNA, 64 nt, hsa
cuuccuuggucccuucagggaagcccucaacucaucucugaacuuagaaucucauccuuagggc

SEQ ID NO: 494696 - RNA, 64 nt, hsa
caacaaaggcuacccuuugaccaaaugucuuucucugcaacauggcuucggccuaaaauaugca

SEQ ID NO: 494697 - RNA, 64 nt, hsa
uuaaccgacugaaaucacuuugggauauuuuuuccugcaacacuggaaaguuuuaguuuuuuaa

SEQ ID NO: 494698 - RNA, 64 nt, hsa
uaugcuguuuagcacaauuucuauugagucuuaccugcaacaaugaaccuuaaagauuuuuuua

SEQ ID NO: 494699 - RNA, 64 nt, hsa
guucuguguuguuuccuuagaccugugguguccgcugcaacagcuacuagccacguguagcuaa

SEQ ID NO: 494700 - RNA, 64 nt, hsa
ucagccaguccccccguuuggggucccugacuuccugcaacaauguccugcaggaaaaguuuuu

SEQ ID NO: 494701 - RNA, 64 nt, hsa
augagaaagaaagggacaggcucuggcuuguuaucugcaacaggaauauguccuuaaggcacaa

SEQ ID NO: 494702 - RNA, 64 nt, hsa
ccaggcuggagugcaguggugggaucucagcucacugcaacauccgccucugggguucaaguga

SEQ ID NO: 494703 - RNA, 64 nt, hsa
cacuagcacuacgauaguguuagauggggaaauacugcaacauguccaguuggccagaucacuu

SEQ ID NO: 494704 - RNA, 64 nt, hsa
cagguuccuaagacuucaguccuggucugcucaggaauugaagauguaaggaauugaagauagg

SEQ ID NO: 494705 - RNA, 64 nt, hsa
caguccuggucugcucaggaauugaagauguaaggaauugaagauaggagagauaccuugaaaa

SEQ ID NO: 494706 - RNA, 64 nt, hsa
uuuagcuuuuucuuuucuuugaacaauucggcaugaauugaaaccagguuuuccuguggaaagu

SEQ ID NO: 494707 - RNA, 64 nt, hsa
ccuccagacuacuuuaaaugucucugcucugacugaauugaaggaauuguaaguuucaguugcu

SEQ ID NO: 494708 - RNA, 64 nt, hsa
auugaagguugauauuuuauguggaagaacauuugaauugaauucagaauuuuucugaaggugu

SEQ ID NO: 494709 - RNA, 64 nt, hsa
ugucaacgucuuguugaaaacaaaaaucaagaaagaauugaaauacugugccggcuuucacugg

SEQ ID NO: 494710 - RNA, 64 nt, hsa
aaaaacauucuguugcaaacagugguguugcauugaauugaacuuuggcaaugagaacacagca

SEQ ID NO: 494711 - RNA, 64 nt, hsa
uuuaaugcaggcagguguguaauaaauuauuuuugaauugaacauuaaaauucugcuucuuaaa

SEQ ID NO: 494712 - RNA, 64 nt, hsa
gcauuugagaauucuuaaauaugaaauuuauucagaauugaagauggugaccuauucagagccu

SEQ ID NO: 494713 - RNA, 64 nt, hsa
ucuagcuuucuuuaugauguuucugauaauacgagaauugaaaacuuuaccuucucuuguacau

SEQ ID NO: 494714 - RNA, 64 nt, hsa
gucacucaucuaccagauucugccuauguaaaaugaauugaaaaacaauuuucuguaaucuuuu

SEQ ID NO: 494715 - RNA, 64 nt, hsa
caagauauuauuaauuuuuauuuauuuuucuugggaauugaaaaaaauugaaauaaauaaaaau

SEQ ID NO: 494716 - RNA, 64 nt, hsa
auggcaguguuaucucaucucugggcuuuucugggaauugaaguaucucuccuuaaccccaauu

SEQ ID NO: 494717 - RNA, 64 nt, hsa
uguagauuuucugcauagaucccauuuuuguacagaauugaaugggauggaauagguaagcaaa

SEQ ID NO: 494718 - RNA, 52 nt, hsa
ccaauaaagcagaaacaugacugaauugaauugguagaugaaaaaaaccugg

SEQ ID NO: 494719 - RNA, 64 nt, hsa
uaauagauuuuaauguuaauuuauauucauuguagaauugaauuuccagugaccuguaauuuca

SEQ ID NO: 494720 - RNA, 64 nt, hsa
ccaguugcauuuuauaauacuugagugacuaacugaauugaaaccuauuacaauuaauaggguu

SEQ ID NO: 494721 - RNA, 64 nt, hsa
agucugauugaaaaaccuuaaaagacaauauacagaauugaauacuguagaauucuguuucuuu

SEQ ID NO: 494722 - RNA, 64 nt, hsa
aucaaugagacagaaaguuaacaaggauauccaggaauugaacacagcucugcaccaagcggac

SEQ ID NO: 494723 - RNA, 64 nt, hsa
cauccccaucaagcuaccaaugacuuucuucacagaauugaaaaacacuacuuuaaaguucaua

SEQ ID NO: 494724 - RNA, 64 nt, hsa
gucagaauugaauuauagaacacccaguuguucagaauugaauuguagaacacccaauuggugu

SEQ ID NO: 494725 - RNA, 64 nt, hsa
uggagucugcacuaacuuggagaaguuagugucagaauugaauuauagaacacccaguuguuca

SEQ ID NO: 494726 - RNA, 64 nt, hsa
ggggccacauauuuucagucauuucuucccuguugaauugaagcaaaucagauuuucugugggg

SEQ ID NO: 494727 - RNA, 64 nt, hsa
acuguuuuauggaauaaagucacuugaucagaaggaauugaaacaauagaucauuuuguuaccu

SEQ ID NO: 494728 - RNA, 64 nt, hsa
ccugcaaagaugguuuuauuaguacccuggucauuuuguucaaggaaggguuauauugcauucu

SEQ ID NO: 494729 - RNA, 64 nt, hsa
cuugcccaauaaaaacgcuacauuguguguauuuuuuguucagcuaagaauuggaaaaguauuu

SEQ ID NO: 494730 - RNA, 64 nt, hsa
aagcugcuucuugacuaguauagcucggugacccuuuguucaaccgcugagguuugauuucuua

SEQ ID NO: 494731 - RNA, 64 nt, hsa
uauuaccauuuuuaaugauguuguguguccucccuuuguucaguggacgguuaaaccuuccccc

SEQ ID NO: 494732 - RNA, 64 nt, hsa
gucugacuuaacuacauacaucuucugcugguguuuuguucaaucuggaagaaugacuguauca

SEQ ID NO: 494733 - RNA, 64 nt, hsa
uguucuuuucucaaauucaguuaaaaugguuuacuuuguucaaguuagugguaggaaacauugc

SEQ ID NO: 494734 - RNA, 64 nt, hsa
aggauuuauucugugaauuguuuguuucuguguguuuguucagcguauucauucacucacucgu

SEQ ID NO: 494735 - RNA, 64 nt, hsa
ucuauuuugcauaugaaaguuuguauuuaacuuuuuuguucauuaaaaaccuuacugauauggu

SEQ ID NO: 494736 - RNA, 64 nt, hsa
uuaugaaggaaggcuugguuuaauaaagacugauuuuguucaguguuauauguuagcugauaca

SEQ ID NO: 494737 - RNA, 64 nt, hsa
auuuuguucaguguuauauguuagcugauacauauuuguucauuuaugugauugcaguacuuua

SEQ ID NO: 494738 - RNA, 64 nt, hsa
aaaauuuuaguaacaauuguuuauuuugaggguauuuguucauaacauuaaaacaauaaagggc

SEQ ID NO: 494739 - RNA, 64 nt, hsa
augaggucauauuaaagaacagcaacuguuaauguuuguucacaaauucagaaaucuaauagga

SEQ ID NO: 494740 - RNA, 64 nt, hsa
uuuuuuuguucauacuuuggcugugaugucacaguuuguucagugagguaugaugugcugcugg

SEQ ID NO: 494741 - RNA, 64 nt, hsa
aguguucuguucacuuuuccggggcacaaguuuuuuuguucauacuuuggcugugaugucacag

SEQ ID NO: 494742 - RNA, 64 nt, hsa
uuguaguuuguucauucauccauccaccuguucauuuguucauccauguauucuaacauuucua

SEQ ID NO: 494743 - RNA, 64 nt, hsa
aguaccucauagggcuccugccugaucuuuguaguuuguucauucauccauccaccuguucauu

SEQ ID NO: 494744 - RNA, 64 nt, hsa
auuuccucuggcagcuggugcugugggcaacuguuuuguucaaucggguuucuuuucuuuuugc

SEQ ID NO: 494745 - RNA, 64 nt, hsa
uggcauugcaacuguggcauaguuacaauuucuguuuguucaucacauuuaaaauuggaagaga

SEQ ID NO: 494746 - RNA, 64 nt, hsa
aaaguguacugcuuuaugguaaaaguguuuuucauuuguucauuguuuucauuauuugugauca

SEQ ID NO: 494747 - RNA, 64 nt, hsa
gaauccaaagaaaaacagaagaauaauucauggauuuguucauuguucuuuccaacugaaggca

SEQ ID NO: 494748 - RNA, 64 nt, hsa
ccuccauuuguccacaagaugguguuuaaaacaauuuguucagaagaacugagcaaacuaacag

SEQ ID NO: 494749 - RNA, 64 nt, hsa
aacauauucaguuuucaguagaagaacuuaaaaauuuguucacauuacaugaaaguucagauug

SEQ ID NO: 494750 - RNA, 64 nt, hsa
gagcucuuaaaaaacugugcaaucaccccugccuuuuguucaacucuauaaagguaagugcaua

SEQ ID NO: 494751 - RNA, 64 nt, hsa
caaguuauauguucuugucuaauccauguagcuuuuuguucaaugacuugaucaucugcuuccu

SEQ ID NO: 494752 - RNA, 64 nt, hsa
auaccuguucauuuggaauuuaaugcuugacuucuuuguucauuuuggaucuaaacuucucuuu

SEQ ID NO: 494753 - RNA, 64 nt, hsa
auguagcccaggccaauuuauaacuaaaucucuauuuguucagaugaugcuucuaaaacagcau

SEQ ID NO: 494754 - RNA, 64 nt, hsa
uuuggagaaagaacacuaacacauguacuugugauuuguucauguuauauuaaaacuugagauu

SEQ ID NO: 494755 - RNA, 64 nt, hsa
cucaggcuggaauugggaaaauaugcaggugacauuuguucauucucuaaucccauccucucac

SEQ ID NO: 494756 - RNA, 64 nt, hsa
guaaggaucaggggugauaggggagagcaauuacuuuguucacuguaugcacccgcgggggccu

SEQ ID NO: 494757 - RNA, 64 nt, hsa
uaacaacugucacuuuguuucgccacauguagaguuuguucagcuauuuuccagauaucucccc

SEQ ID NO: 494758 - RNA, 64 nt, hsa
auugggaaagaugaauuuucagcagaaaacauuguuuguucacuuucaaagagugauaguuucu

SEQ ID NO: 494759 - RNA, 64 nt, hsa
guguccucaauauuuuaaaacaauguugacauguuuuguucaagucagcaagcucuaugugagu

SEQ ID NO: 494760 - RNA, 64 nt, hsa
uagaucgcuucaagccuauacugauggccuuagcuuuguucagucauuguaacugggauuguug

SEQ ID NO: 494761 - RNA, 64 nt, hsa
uuaauuucuugggagcaaaugaguauuuguugcauuuguucaauuuguuguauauggugaauau

SEQ ID NO: 494762 - RNA, 64 nt, hsa
aacucccaauugaugugaccacacucuucuuaauuuuguucacaguaaaaacacuuuuuugagu

SEQ ID NO: 494763 - RNA, 64 nt, hsa
cugugagcauuuugccguauauccugcccugccauuuguucacuuuuuaaacuaaaauaggaac

SEQ ID NO: 494764 - RNA, 64 nt, hsa
agaugccuggaagugguauuuugaggugaaagaguuuguucauuuugaagauauuucugucucu

SEQ ID NO: 494765 - RNA, 64 nt, hsa
auaaaccaauauugugaaaaauagcaacuauucauuuguucacaacaugcguauuuauagagua

SEQ ID NO: 494766 - RNA, 64 nt, hsa
ucaaagggagucagucccuaauuuacagguuuccuuuguucacuuucuagauguguacuuuuga

SEQ ID NO: 494767 - RNA, 64 nt, hsa
auauuuuaagauacauacuaucuaaaaguagaauuuuguucagcauugacuuuuauaauuccca

SEQ ID NO: 494768 - RNA, 64 nt, hsa
gccagcaagagacaguguucagauguggaugauauuuguucaauaugucaagcugaauuucaga

SEQ ID NO: 494769 - RNA, 64 nt, hsa
uaguugacauaaguaaauuuauuuauugagucaauuuguucagguaaguacuagggaagcuuua

SEQ ID NO: 494770 - RNA, 64 nt, hsa
uauuagaggaaaccucugaagcaguugcucaaacuuuguucaauaucagggaauuuauauugaa

SEQ ID NO: 494771 - RNA, 64 nt, hsa
uugcaguuugagaagugaauuaaccuuacaucccuuuguucagauaccuuaaaaguuacuuuau

SEQ ID NO: 494772 - RNA, 64 nt, hsa
cguucccauuccuguguuaccaccuuccucccgauuuguucaccuauuuugugcuuuaaaucuc

SEQ ID NO: 494773 - RNA, 64 nt, hsa
cuuccucugaucuggggucuguuuuguucauuacuuuguucacuccuucuuccauuuauucauu

SEQ ID NO: 494774 - RNA, 64 nt, hsa
agaaagccaucucuuccucugaucuggggucuguuuuguucauuacuuuguucacuccuucuuc

SEQ ID NO: 494775 - RNA, 64 nt, hsa
agaaaugacucagaaucucagacaaaauguauuauuuguucaauuuuaauuuugcuacuacauu

SEQ ID NO: 494776 - RNA, 64 nt, hsa
ucuggcagugucgaaaauaguaggagccuaaaacuuuguucaaugaguaagauguagauuugga

SEQ ID NO: 494777 - RNA, 64 nt, hsa; identical to SEQ ID NO: 49935

SEQ ID NO: 494778 - RNA, 64 nt, hsa; identical to SEQ ID NO: 49936

SEQ ID NO: 494779 - RNA, 64 nt, hsa; identical to SEQ ID NO: 49937

SEQ ID NO: 494780 - RNA, 64 nt, hsa; identical to SEQ ID NO: 49938

SEQ ID NO: 494781 - RNA, 64 nt, hsa; identical to SEQ ID NO: 49939

SEQ ID NO: 494782 - RNA, 64 nt, hsa; identical to SEQ ID NO: 49940

SEQ ID NO: 494783 - RNA, 64 nt, hsa; identical to SEQ ID NO: 49941

SEQ ID NO: 494784 - RNA, 64 nt, hsa; identical to SEQ ID NO: 49942

SEQ ID NO: 494785 - RNA, 64 nt, hsa; identical to SEQ ID NO: 49943

SEQ ID NO: 494786 - RNA, 64 nt, hsa; identical to SEQ ID NO: 49944

SEQ ID NO: 494787 - RNA, 64 nt, hsa; identical to SEQ ID NO: 49945

SEQ ID NO: 494788 - RNA, 64 nt, hsa; identical to SEQ ID NO: 49946

SEQ ID NO: 494789 - RNA, 64 nt, hsa; identical to SEQ ID NO: 49947

SEQ ID NO: 494790 - RNA, 64 nt, hsa; identical to SEQ ID NO: 49948

SEQ ID NO: 494791 - RNA, 64 nt, hsa; identical to SEQ ID NO: 49949

SEQ ID NO: 494792 - RNA, 64 nt, hsa; identical to SEQ ID NO: 49950

SEQ ID NO: 494793 - RNA, 64 nt, hsa; identical to SEQ ID NO: 49951

SEQ ID NO: 494794 - RNA, 64 nt, hsa; identical to SEQ ID NO: 49952

SEQ ID NO: 494795 - RNA, 64 nt, hsa; identical to SEQ ID NO: 49953

SEQ ID NO: 494796 - RNA, 64 nt, hsa; identical to SEQ ID NO: 49954

SEQ ID NO: 494797 - RNA, 64 nt, hsa; identical to SEQ ID NO: 49955

SEQ ID NO: 494798 - RNA, 64 nt, hsa; identical to SEQ ID NO: 49956

SEQ ID NO: 494799 - RNA, 64 nt, hsa; identical to SEQ ID NO: 49957

SEQ ID NO: 494800 - RNA, 64 nt, hsa; identical to SEQ ID NO: 49958

SEQ ID NO: 494801 - RNA, 64 nt, hsa; identical to SEQ ID NO: 49959

SEQ ID NO: 494802 - RNA, 64 nt, hsa; identical to SEQ ID NO: 49960

SEQ ID NO: 494803 - RNA, 64 nt, hsa; identical to SEQ ID NO: 49961

SEQ ID NO: 494804 - RNA, 64 nt, hsa; identical to SEQ ID NO: 49962

SEQ ID NO: 494805 - RNA, 64 nt, hsa; identical to SEQ ID NO: 49963

SEQ ID NO: 494806 - RNA, 64 nt, hsa; identical to SEQ ID NO: 49964

SEQ ID NO: 494807 - RNA, 64 nt, hsa; identical to SEQ ID NO: 49965

SEQ ID NO: 494808 - RNA, 64 nt, hsa; identical to SEQ ID NO: 49966

SEQ ID NO: 494809 - RNA, 64 nt, hsa; identical to SEQ ID NO: 49967

SEQ ID NO: 494810 - RNA, 64 nt, hsa; identical to SEQ ID NO: 49968

SEQ ID NO: 494811 - RNA, 64 nt, hsa; identical to SEQ ID NO: 49969

SEQ ID NO: 494812 - RNA, 64 nt, hsa; identical to SEQ ID NO: 49970

SEQ ID NO: 494813 - RNA, 64 nt, hsa; identical to SEQ ID NO: 49971

SEQ ID NO: 494814 - RNA, 64 nt, hsa; identical to SEQ ID NO: 49972

SEQ ID NO: 494815 - RNA, 64 nt, hsa; identical to SEQ ID NO: 49973

SEQ ID NO: 494816 - RNA, 64 nt, hsa; identical to SEQ ID NO: 49974

SEQ ID NO: 494817 - RNA, 64 nt, hsa; identical to SEQ ID NO: 49975

SEQ ID NO: 494818 - RNA, 64 nt, hsa; identical to SEQ ID NO: 49976

SEQ ID NO: 494819 - RNA, 64 nt, hsa; identical to SEQ ID NO: 49977

SEQ ID NO: 494820 - RNA, 64 nt, hsa; identical to SEQ ID NO: 49978

SEQ ID NO: 494821 - RNA, 64 nt, hsa; identical to SEQ ID NO: 49979

SEQ ID NO: 494822 - RNA, 64 nt, hsa; identical to SEQ ID NO: 49980

SEQ ID NO: 494823 - RNA, 64 nt, hsa; identical to SEQ ID NO: 49981

SEQ ID NO: 494824 - RNA, 64 nt, hsa; identical to SEQ ID NO: 49982

SEQ ID NO: 494825 - RNA, 64 nt, hsa; identical to SEQ ID NO: 49983

SEQ ID NO: 494826 - RNA, 64 nt, hsa; identical to SEQ ID NO: 49984

SEQ ID NO: 494827 - RNA, 64 nt, hsa; identical to SEQ ID NO: 49985

SEQ ID NO: 494828 - RNA, 64 nt, hsa; identical to SEQ ID NO: 49986

SEQ ID NO: 494829 - RNA, 64 nt, hsa; identical to SEQ ID NO: 49987

SEQ ID NO: 494830 - RNA, 64 nt, hsa; identical to SEQ ID NO: 49988

SEQ ID NO: 494831 - RNA, 64 nt, hsa; identical to SEQ ID NO: 49989

SEQ ID NO: 494832 - RNA, 64 nt, hsa; identical to SEQ ID NO: 49990

SEQ ID NO: 494833 - RNA, 64 nt, hsa; identical to SEQ ID NO: 49991

SEQ ID NO: 494834 - RNA, 64 nt, hsa; identical to SEQ ID NO: 49992

SEQ ID NO: 494835 - RNA, 64 nt, hsa; identical to SEQ ID NO: 49993

SEQ ID NO: 494836 - RNA, 64 nt, hsa; identical to SEQ ID NO: 49994

SEQ ID NO: 494837 - RNA, 64 nt, hsa; identical to SEQ ID NO: 49995

SEQ ID NO: 494838 - RNA, 64 nt, hsa; identical to SEQ ID NO: 49996

SEQ ID NO: 494839 - RNA, 58 nt, hsa; identical to SEQ ID NO: 49997

SEQ ID NO: 494840 - RNA, 50 nt, hsa; identical to SEQ ID NO: 49998

SEQ ID NO: 494841 - RNA, 64 nt, hsa; identical to SEQ ID NO: 49999

SEQ ID NO: 494842 - RNA, 64 nt, hsa; identical to SEQ ID NO: 50000

SEQ ID NO: 494843 - RNA, 64 nt, hsa; identical to SEQ ID NO: 50001

SEQ ID NO: 494844 - RNA, 64 nt, hsa; identical to SEQ ID NO: 50002

SEQ ID NO: 494845 - RNA, 64 nt, hsa; identical to SEQ ID NO: 50003

SEQ ID NO: 494846 - RNA, 64 nt, hsa; identical to SEQ ID NO: 50004

SEQ ID NO: 494847 - RNA, 64 nt, hsa; identical to SEQ ID NO: 50005

SEQ ID NO: 494848 - RNA, 64 nt, hsa; identical to SEQ ID NO: 50006

SEQ ID NO: 494849 - RNA, 64 nt, hsa; identical to SEQ ID NO: 50007

SEQ ID NO: 494850 - RNA, 64 nt, hsa; identical to SEQ ID NO: 50008

SEQ ID NO: 494851 - RNA, 64 nt, hsa; identical to SEQ ID NO: 50009

SEQ ID NO: 494852 - RNA, 64 nt, hsa; identical to SEQ ID NO: 50010

SEQ ID NO: 494853 - RNA, 64 nt, hsa; identical to SEQ ID NO: 50011

SEQ ID NO: 494854 - RNA, 64 nt, hsa; identical to SEQ ID NO: 50012

SEQ ID NO: 494855 - RNA, 64 nt, hsa; identical to SEQ ID NO: 50013

SEQ ID NO: 494856 - RNA, 64 nt, hsa; identical to SEQ ID NO: 50014

SEQ ID NO: 494857 - RNA, 64 nt, hsa; identical to SEQ ID NO: 50015

SEQ ID NO: 494858 - RNA, 64 nt, hsa; identical to SEQ ID NO: 50016

SEQ ID NO: 494859 - RNA, 64 nt, hsa; identical to SEQ ID NO: 50017

SEQ ID NO: 494860 - RNA, 64 nt, hsa; identical to SEQ ID NO: 50018

SEQ ID NO: 494861 - RNA, 64 nt, hsa; identical to SEQ ID NO: 50019

SEQ ID NO: 494862 - RNA, 64 nt, hsa; identical to SEQ ID NO: 50020

SEQ ID NO: 494863 - RNA, 64 nt, hsa; identical to SEQ ID NO: 50021

SEQ ID NO: 494864 - RNA, 64 nt, hsa; identical to SEQ ID NO: 50022

SEQ ID NO: 494865 - RNA, 64 nt, hsa; identical to SEQ ID NO: 50023

SEQ ID NO: 494866 - RNA, 64 nt, hsa; identical to SEQ ID NO: 50024

SEQ ID NO: 494867 - RNA, 64 nt, hsa; identical to SEQ ID NO: 50025

SEQ ID NO: 494868 - RNA, 64 nt, hsa; identical to SEQ ID NO: 50026

SEQ ID NO: 494869 - RNA, 64 nt, hsa; identical to SEQ ID NO: 50027

SEQ ID NO: 494870 - RNA, 64 nt, hsa; identical to SEQ ID NO: 50028

SEQ ID NO: 494871 - RNA, 64 nt, hsa; identical to SEQ ID NO: 50029

SEQ ID NO: 494872 - RNA, 64 nt, hsa; identical to SEQ ID NO: 50030

SEQ ID NO: 494873 - RNA, 64 nt, hsa; identical to SEQ ID NO: 50031

SEQ ID NO: 494874 - RNA, 64 nt, hsa; identical to SEQ ID NO: 50032

SEQ ID NO: 494875 - RNA, 64 nt, hsa; identical to SEQ ID NO: 50033

SEQ ID NO: 494876 - RNA, 64 nt, hsa; identical to SEQ ID NO: 50034

SEQ ID NO: 494877 - RNA, 64 nt, hsa; identical to SEQ ID NO: 50035

SEQ ID NO: 494878 - RNA, 64 nt, hsa; identical to SEQ ID NO: 50036

SEQ ID NO: 494879 - RNA, 64 nt, hsa; identical to SEQ ID NO: 50037

SEQ ID NO: 494880 - RNA, 64 nt, hsa; identical to SEQ ID NO: 50038

SEQ ID NO: 494881 - RNA, 64 nt, hsa; identical to SEQ ID NO: 50039

SEQ ID NO: 494882 - RNA, 64 nt, hsa; identical to SEQ ID NO: 50040

SEQ ID NO: 494883 - RNA, 64 nt, hsa; identical to SEQ ID NO: 50041

SEQ ID NO: 494884 - RNA, 64 nt, hsa; identical to SEQ ID NO: 50042

SEQ ID NO: 494885 - RNA, 64 nt, hsa; identical to SEQ ID NO: 50043

SEQ ID NO: 494886 - RNA, 64 nt, hsa; identical to SEQ ID NO: 50044

SEQ ID NO: 494887 - RNA, 64 nt, hsa; identical to SEQ ID NO: 50045

SEQ ID NO: 494888 - RNA, 64 nt, hsa; identical to SEQ ID NO: 50046

SEQ ID NO: 494889 - RNA, 64 nt, hsa; identical to SEQ ID NO: 50047

SEQ ID NO: 494890 - RNA, 64 nt, hsa; identical to SEQ ID NO: 50048

SEQ ID NO: 494891 - RNA, 64 nt, hsa; identical to SEQ ID NO: 50049

SEQ ID NO: 494892 - RNA, 64 nt, hsa; identical to SEQ ID NO: 50050

SEQ ID NO: 494893 - RNA, 64 nt, hsa; identical to SEQ ID NO: 50051

SEQ ID NO: 494894 - RNA, 64 nt, hsa; identical to SEQ ID NO: 50052

SEQ ID NO: 494895 - RNA, 64 nt, hsa; identical to SEQ ID NO: 50053

SEQ ID NO: 494896 - RNA, 64 nt, hsa; identical to SEQ ID NO: 50054

SEQ ID NO: 494897 - RNA, 64 nt, hsa; identical to SEQ ID NO: 50055

SEQ ID NO: 494898 - RNA, 64 nt, hsa; identical to SEQ ID NO: 50056

SEQ ID NO: 494899 - RNA, 64 nt, hsa; identical to SEQ ID NO: 50057

SEQ ID NO: 494900 - RNA, 64 nt, hsa; identical to SEQ ID NO: 50058

SEQ ID NO: 494901 - RNA, 64 nt, hsa; identical to SEQ ID NO: 50059

SEQ ID NO: 494902 - RNA, 64 nt, hsa; identical to SEQ ID NO: 50060

SEQ ID NO: 494903 - RNA, 64 nt, hsa; identical to SEQ ID NO: 50061

SEQ ID NO: 494904 - RNA, 64 nt, hsa; identical to SEQ ID NO: 50062

SEQ ID NO: 494905 - RNA, 64 nt, hsa; identical to SEQ ID NO: 50063

SEQ ID NO: 494906 - RNA, 64 nt, hsa; identical to SEQ ID NO: 50064

SEQ ID NO: 494907 - RNA, 64 nt, hsa; identical to SEQ ID NO: 50065

SEQ ID NO: 494908 - RNA, 64 nt, hsa; identical to SEQ ID NO: 50066

SEQ ID NO: 494909 - RNA, 64 nt, hsa; identical to SEQ ID NO: 50067

SEQ ID NO: 494910 - RNA, 64 nt, hsa; identical to SEQ ID NO: 50068

SEQ ID NO: 494911 - RNA, 64 nt, hsa; identical to SEQ ID NO: 50069

SEQ ID NO: 494912 - RNA, 64 nt, hsa; identical to SEQ ID NO: 50070

SEQ ID NO: 494913 - RNA, 64 nt, hsa; identical to SEQ ID NO: 50071

SEQ ID NO: 494914 - RNA, 64 nt, hsa; identical to SEQ ID NO: 50072

SEQ ID NO: 494915 - RNA, 64 nt, hsa; identical to SEQ ID NO: 50073

SEQ ID NO: 494916 - RNA, 64 nt, hsa; identical to SEQ ID NO: 50074

SEQ ID NO: 494917 - RNA, 64 nt, hsa; identical to SEQ ID NO: 50075

SEQ ID NO: 494918 - RNA, 64 nt, hsa; identical to SEQ ID NO: 50076

SEQ ID NO: 494919 - RNA, 64 nt, hsa; identical to SEQ ID NO: 50077

SEQ ID NO: 494920 - RNA, 64 nt, hsa; identical to SEQ ID NO: 50078

SEQ ID NO: 494921 - RNA, 64 nt, hsa; identical to SEQ ID NO: 50079

SEQ ID NO: 494922 - RNA, 64 nt, hsa; identical to SEQ ID NO: 50080

SEQ ID NO: 494923 - RNA, 64 nt, hsa; identical to SEQ ID NO: 50081

SEQ ID NO: 494924 - RNA, 64 nt, hsa; identical to SEQ ID NO: 50082

SEQ ID NO: 494925 - RNA, 64 nt, hsa; identical to SEQ ID NO: 50083

SEQ ID NO: 494926 - RNA, 64 nt, hsa; identical to SEQ ID NO: 50084

SEQ ID NO: 494927 - RNA, 64 nt, hsa; identical to SEQ ID NO: 50085

SEQ ID NO: 494928 - RNA, 64 nt, hsa; identical to SEQ ID NO: 50086

SEQ ID NO: 494929 - RNA, 64 nt, hsa; identical to SEQ ID NO: 50087

SEQ ID NO: 494930 - RNA, 64 nt, hsa; identical to SEQ ID NO: 50088

SEQ ID NO: 494931 - RNA, 64 nt, hsa; identical to SEQ ID NO: 50089

SEQ ID NO: 494932 - RNA, 64 nt, hsa; identical to SEQ ID NO: 50090

SEQ ID NO: 494933 - RNA, 64 nt, hsa; identical to SEQ ID NO: 50091

SEQ ID NO: 494934 - RNA, 64 nt, hsa; identical to SEQ ID NO: 50092

SEQ ID NO: 494935 - RNA, 63 nt, hsa; identical to SEQ ID NO: 50093

SEQ ID NO: 494936 - RNA, 64 nt, hsa; identical to SEQ ID NO: 50094

SEQ ID NO: 494937 - RNA, 64 nt, hsa; identical to SEQ ID NO: 50095

SEQ ID NO: 494938 - RNA, 64 nt, hsa; identical to SEQ ID NO: 50096

SEQ ID NO: 494939 - RNA, 64 nt, hsa; identical to SEQ ID NO: 50097

SEQ ID NO: 494940 - RNA, 64 nt, hsa; identical to SEQ ID NO: 50098

SEQ ID NO: 494941 - RNA, 64 nt, hsa; identical to SEQ ID NO: 50099

SEQ ID NO: 494942 - RNA, 64 nt, hsa; identical to SEQ ID NO: 50100

SEQ ID NO: 494943 - RNA, 64 nt, hsa; identical to SEQ ID NO: 50101

SEQ ID NO: 494944 - RNA, 64 nt, hsa; identical to SEQ ID NO: 50102

SEQ ID NO: 494945 - RNA, 64 nt, hsa; identical to SEQ ID NO: 50103

SEQ ID NO: 494946 - RNA, 64 nt, hsa; identical to SEQ ID NO: 50104

SEQ ID NO: 494947 - RNA, 64 nt, hsa; identical to SEQ ID NO: 50105

SEQ ID NO: 494948 - RNA, 64 nt, hsa; identical to SEQ ID NO: 50106

SEQ ID NO: 494949 - RNA, 64 nt, hsa; identical to SEQ ID NO: 50107

SEQ ID NO: 494950 - RNA, 64 nt, hsa; identical to SEQ ID NO: 50108

SEQ ID NO: 494951 - RNA, 64 nt, hsa; identical to SEQ ID NO: 50109

SEQ ID NO: 494952 - RNA, 64 nt, hsa; identical to SEQ ID NO: 50110

SEQ ID NO: 494953 - RNA, 64 nt, hsa; identical to SEQ ID NO: 50111

SEQ ID NO: 494954 - RNA, 64 nt, hsa; identical to SEQ ID NO: 50112

SEQ ID NO: 494955 - RNA, 64 nt, hsa; identical to SEQ ID NO: 50113

SEQ ID NO: 494956 - RNA, 64 nt, hsa; identical to SEQ ID NO: 50114

SEQ ID NO: 494957 - RNA, 64 nt, hsa; identical to SEQ ID NO: 50115

SEQ ID NO: 494958 - RNA, 64 nt, hsa; identical to SEQ ID NO: 50116

SEQ ID NO: 494959 - RNA, 64 nt, hsa; identical to SEQ ID NO: 50117

SEQ ID NO: 494960 - RNA, 64 nt, hsa; identical to SEQ ID NO: 50118

SEQ ID NO: 494961 - RNA, 64 nt, hsa; identical to SEQ ID NO: 50119

SEQ ID NO: 494962 - RNA, 64 nt, hsa; identical to SEQ ID NO: 50120

SEQ ID NO: 494963 - RNA, 64 nt, hsa; identical to SEQ ID NO: 50121

SEQ ID NO: 494964 - RNA, 64 nt, hsa; identical to SEQ ID NO: 382199

SEQ ID NO: 494965 - RNA, 64 nt, hsa; identical to SEQ ID NO: 382200

SEQ ID NO: 494966 - RNA, 64 nt, hsa; identical to SEQ ID NO: 382201

SEQ ID NO: 494967 - RNA, 57 nt, hsa; identical to SEQ ID NO: 382202

SEQ ID NO: 494968 - RNA, 64 nt, hsa; identical to SEQ ID NO: 382203

SEQ ID NO: 494969 - RNA, 64 nt, hsa; identical to SEQ ID NO: 382204

SEQ ID NO: 494970 - RNA, 64 nt, hsa; identical to SEQ ID NO: 382205

SEQ ID NO: 494971 - RNA, 64 nt, hsa; identical to SEQ ID NO: 382206

SEQ ID NO: 494972 - RNA, 64 nt, hsa; identical to SEQ ID NO: 382207

SEQ ID NO: 494973 - RNA, 64 nt, hsa; identical to SEQ ID NO: 382208

SEQ ID NO: 494974 - RNA, 64 nt, hsa; identical to SEQ ID NO: 382209

SEQ ID NO: 494975 - RNA, 64 nt, hsa; identical to SEQ ID NO: 382210

SEQ ID NO: 494976 - RNA, 64 nt, hsa; identical to SEQ ID NO: 382211

SEQ ID NO: 494977 - RNA, 64 nt, hsa; identical to SEQ ID NO: 382212

SEQ ID NO: 494978 - RNA, 64 nt, hsa; identical to SEQ ID NO: 382213

SEQ ID NO: 494979 - RNA, 64 nt, hsa; identical to SEQ ID NO: 382214

SEQ ID NO: 494980 - RNA, 64 nt, hsa; identical to SEQ ID NO: 382215

SEQ ID NO: 494981 - RNA, 64 nt, hsa; identical to SEQ ID NO: 382216

SEQ ID NO: 494982 - RNA, 64 nt, hsa; identical to SEQ ID NO: 382217

SEQ ID NO: 494983 - RNA, 64 nt, hsa; identical to SEQ ID NO: 382218

SEQ ID NO: 494984 - RNA, 64 nt, hsa; identical to SEQ ID NO: 382219

SEQ ID NO: 494985 - RNA, 64 nt, hsa; identical to SEQ ID NO: 382220

SEQ ID NO: 494986 - RNA, 64 nt, hsa; identical to SEQ ID NO: 382221

SEQ ID NO: 494987 - RNA, 64 nt, hsa; identical to SEQ ID NO: 382222

SEQ ID NO: 494988 - RNA, 63 nt, hsa; identical to SEQ ID NO: 382223

SEQ ID NO: 494989 - RNA, 64 nt, hsa; identical to SEQ ID NO: 382224

SEQ ID NO: 494990 - RNA, 64 nt, hsa; identical to SEQ ID NO: 382225

SEQ ID NO: 494991 - RNA, 64 nt, hsa; identical to SEQ ID NO: 382226

SEQ ID NO: 494992 - RNA, 64 nt, hsa; identical to SEQ ID NO: 382227

SEQ ID NO: 494993 - RNA, 64 nt, hsa; identical to SEQ ID NO: 382228

SEQ ID NO: 494994 - RNA, 64 nt, hsa; identical to SEQ ID NO: 382229

SEQ ID NO: 494995 - RNA, 64 nt, hsa; identical to SEQ ID NO: 382230

SEQ ID NO: 494996 - RNA, 64 nt, hsa; identical to SEQ ID NO: 382231

SEQ ID NO: 494997 - RNA, 64 nt, hsa; identical to SEQ ID NO: 382232

SEQ ID NO: 494998 - RNA, 64 nt, hsa; identical to SEQ ID NO: 382233

SEQ ID NO: 494999 - RNA, 64 nt, hsa; identical to SEQ ID NO: 382234

SEQ ID NO: 495000 - RNA, 64 nt, hsa; identical to SEQ ID NO: 382235

SEQ ID NO: 495001 - RNA, 64 nt, hsa; identical to SEQ ID NO: 382236

SEQ ID NO: 495002 - RNA, 64 nt, hsa; identical to SEQ ID NO: 382237

SEQ ID NO: 495003 - RNA, 64 nt, hsa
gucgauuauuuaagcauaaaauaaauuguguuaaacucuucaccuaucugugcucuacagucuc

SEQ ID NO: 495004 - RNA, 64 nt, hsa
cuagaagaggagggagggauucugggugggggugacucuucacugauucuuguauauuagcaau

SEQ ID NO: 495005 - RNA, 64 nt, hsa
augcuggcuugggcagcauccccuugaacucuucacucuucaaaugccugacuagggagccaug

SEQ ID NO: 495006 - RNA, 64 nt, hsa
uuaugagaugcuggcuugggcagcauccccuugaacucuucacucuucaaaugccugacuaggg

SEQ ID NO: 495007 - RNA, 64 nt, hsa
aaauuagccacuuuuaaaaugagaaaacugugucacucuucaauuuuuuuauaagccauugagg

SEQ ID NO: 495008 - RNA, 64 nt, hsa
guggggaaaucauggauuacuuaaaaauuaauugacucuucauauggaaaaauaauaucuccca

SEQ ID NO: 495009 - RNA, 64 nt, hsa
ccuaggggccucugcccuuugauguccuugagcuacucuucagcucuggaaguuguggacaaac

SEQ ID NO: 495010 - RNA, 64 nt, hsa
cacacugcugggggaaagggaaaggaaaucagcaacucuucaaucccaaccugcgcugugauuu

SEQ ID NO: 495011 - RNA, 64 nt, hsa
uuuauaaaaauucaugucuguauuucaggagcaaacucuucaggcuccuuuuuuauaaacuggu

SEQ ID NO: 495012 - RNA, 64 nt, hsa
cccuggaaggacagcaaggcagcuccccagccucacucuucacuccugauugaggcccggguuu

SEQ ID NO: 495013 - RNA, 64 nt, hsa
ccugugaaaguuuguuauuuucugaguagacauucuuauagaguauugucuuuaaaaucagauu

SEQ ID NO: 495014 - RNA, 64 nt, hsa
uuuuuauguuuucuaauuuaaaaauuaauauuuucuuauagauauugugcaauaaagcugaagu

SEQ ID NO: 495015 - RNA, 64 nt, hsa
uacugugccaggcacugauaagccagugguaagggaaacacagcucuaaccucaccucauucuc

SEQ ID NO: 495016 - RNA, 64 nt, hsa
uacauugagccaaguuuguauagcaagaauuugggaaacacagauggccugagauaagcaguac

SEQ ID NO: 495017 - RNA, 64 nt, hsa
guagccuugacaaauuuuaccuuaaaaccaaaaugaaacacaaaaauuaauccuuaauaaugau

SEQ ID NO: 495018 - RNA, 64 nt, hsa
uuuuauuggaagaguauuaacuggugccucuucugaaacacaccaacccauauuccucugcucc

SEQ ID NO: 495019 - RNA, 64 nt, hsa
uauguuucucuaagauuuccuuugguuguauuuagaaacacaaauaguuuuauaaucaggauug

SEQ ID NO: 495020 - RNA, 64 nt, hsa
cauaugcuucuaaauaucuaaacucauuaacauggaaacacacacacaggagcuacaguacaua

SEQ ID NO: 495021 - RNA, 64 nt, hsa
uauaguaauucaggcucuaauuagcugagggaaugaaacacacaaaaaucacugaauuccuaag

SEQ ID NO: 495022 - RNA, 64 nt, hsa
ggcuauaacaugucuuucagcauuaggcuuuuaagaaacacaggguuuuguauucuuuacuaaa

SEQ ID NO: 495023 - RNA, 64 nt, hsa
uacaagcaagacugggaccuuagaaaucauuguagaaacacaguuuugaaagaaaaauaccaug

SEQ ID NO: 495024 - RNA, 64 nt, hsa
cucggacaucuacaacccugcaacuuuguacagagaaacacaaucagcucuuucugcaugugcu

SEQ ID NO: 495025 - RNA, 64 nt, hsa
ugaaaucagacaccaauggacugguuugugggcagaaacacacacacucgcacucucgcucacg

SEQ ID NO: 495026 - RNA, 64 nt, hsa
uggagucuguucuguguugauuugacugccaugagaaacacaggggaaaccugaugaggagaag

SEQ ID NO: 495027 - RNA, 64 nt, hsa
ugugcuguccccauguucccgcugugauuuggcagaaacacaauaggcuucuccuugugugauc

SEQ ID NO: 495028 - RNA, 64 nt, hsa
aaaguucauuauuuucauccaaaagacuuucacagaaacacauuacucacagccauguauaucu

SEQ ID NO: 495029 - RNA, 64 nt, hsa
aaagaugaccacaaggggcccaaaacagaaaagagaaacacaagcucaccucuuggagcugcuu

SEQ ID NO: 495030 - RNA, 64 nt, hsa
cgaccugauuauuuagguauuuguaugugaaagagaaacacauauuuagaaacacagcaaggga

SEQ ID NO: 495031 - RNA, 64 nt, hsa
agguauuuguaugugaaagagaaacacauauuuagaaacacagcaagggagauuuugaauaaag

SEQ ID NO: 495032 - RNA, 64 nt, hsa
uuaugcacuuaggaagugcuaaauuuuaaaagcugaaacacaacagaauucuaagaaauauagu

SEQ ID NO: 495033 - RNA, 64 nt, hsa
uauagucaucuaccaccugcgguccuggccggacgaaacacacguguugcaucucaaggaaaag

SEQ ID NO: 495034 - RNA, 64 nt, hsa
ccagcucuaucuuuguguuuacaucauggcaauggaaacacaauuuaaguauuaauacaggaug

SEQ ID NO: 495035 - RNA, 64 nt, hsa
ucuuggaggagccgaucuugaaauccauugccaagaaacacagucgaagcccaggccaggucgc

SEQ ID NO: 495036 - RNA, 64 nt, hsa
aaccaccgacagaaagaaagaaacacaaaaacaugaaacacagugguagcaccacuucugauga

SEQ ID NO: 495037 - RNA, 64 nt, hsa
gucacaacccucaggaaccaccgacagaaagaaagaaacacaaaaacaugaaacacagugguag

SEQ ID NO: 495038 - RNA, 64 nt, hsa
uuucucuaaaacauuuaugcccuugcuuuggcuagaaacacauuaacugguuuacucauugaga

SEQ ID NO: 495039 - RNA, 64 nt, hsa
cccauucuucauaucaauuuuguauaaauauauagaaacacacacacagccucagacuuacaaa

SEQ ID NO: 495040 - RNA, 64 nt, hsa
caguuuaauaguaacuuuauuuauuuaaaaaaaagaaacacaauuaguuacuguuaaacugaua

SEQ ID NO: 495041 - RNA, 64 nt, hsa
augcucuuguugacuuccagcagaugggaugggggaaacacagcaguucuugguaaaguccuuu

SEQ ID NO: 495042 - RNA, 64 nt, hsa
aagaaguucucugaaaugucagcaaguaaguucugaaacacaucaugcaugaguaggaauaaaa

SEQ ID NO: 495043 - RNA, 64 nt, hsa
ugccacugcccgagcuggugcauuacagagaggagaaacacaucuucccuagaggguuccugua

SEQ ID NO: 495044 - RNA, 64 nt, hsa
uccuguagaccuagggaggaccuuaucugugcgugaaacacaccaggcugugggccucaaggac

SEQ ID NO: 495045 - RNA, 64 nt, hsa
aaaugauuuuagccuuugcaaauguuaaccaugugaaacacauuuucaguauaaguaugcguua

SEQ ID NO: 495046 - RNA, 64 nt, hsa
aaaccucuugcuugugugcaaaaguuccuaaaaggaaacacaaguaaugccuauccauuacuag

SEQ ID NO: 495047 - RNA, 64 nt, hsa
uuuuugucauguaauuuauuaacuaacuauuacagaaacacagcuaagaauaucaaguauuucu

SEQ ID NO: 495048 - RNA, 64 nt, hsa
cagguguuaugcacuccauccaucauaacuguaugaaacacauuucauauguaaauaaacgugg

SEQ ID NO: 495049 - RNA, 64 nt, hsa
acaugacccuuguggcacagaugcccacguaugugaaacacacauggacaugugucccagccac

SEQ ID NO: 495050 - RNA, 64 nt, hsa
uccaaccuguggcgcugcagcagggcaggaaggggaaacacagcugaugaacuguggugccaca

SEQ ID NO: 495051 - RNA, 64 nt, hsa
ucuagaggugaagauagagacauagagaggcugugaaacacacauacagcccuguuaggucuuu

SEQ ID NO: 495052 - RNA, 64 nt, hsa
uuagucuagguaaagaaaaaaaaaaaaaggucaugaaacacaaauguccucaacugucaucauu

SEQ ID NO: 495053 - RNA, 64 nt, hsa; identical to SEQ ID NO: 299149

SEQ ID NO: 495054 - RNA, 64 nt, hsa; identical to SEQ ID NO: 299150

SEQ ID NO: 495055 - RNA, 64 nt, hsa; identical to SEQ ID NO: 299151

SEQ ID NO: 495056 - RNA, 64 nt, hsa; identical to SEQ ID NO: 299152

SEQ ID NO: 495057 - RNA, 64 nt, hsa; identical to SEQ ID NO: 299153

SEQ ID NO: 495058 - RNA, 64 nt, hsa; identical to SEQ ID NO: 299154

SEQ ID NO: 495059 - RNA, 64 nt, hsa; identical to SEQ ID NO: 299155

SEQ ID NO: 495060 - RNA, 64 nt, hsa; identical to SEQ ID NO: 299156

SEQ ID NO: 495061 - RNA, 64 nt, hsa; identical to SEQ ID NO: 299157

SEQ ID NO: 495062 - RNA, 64 nt, hsa; identical to SEQ ID NO: 299158

SEQ ID NO: 495063 - RNA, 64 nt, hsa; identical to SEQ ID NO: 299159

SEQ ID NO: 495064 - RNA, 64 nt, hsa; identical to SEQ ID NO: 299160

SEQ ID NO: 495065 - RNA, 64 nt, hsa; identical to SEQ ID NO: 299161

SEQ ID NO: 495066 - RNA, 64 nt, hsa; identical to SEQ ID NO: 299162

SEQ ID NO: 495067 - RNA, 64 nt, hsa; identical to SEQ ID NO: 299163

SEQ ID NO: 495068 - RNA, 64 nt, hsa; identical to SEQ ID NO: 299164

SEQ ID NO: 495069 - RNA, 64 nt, hsa; identical to SEQ ID NO: 299165

SEQ ID NO: 495070 - RNA, 64 nt, hsa; identical to SEQ ID NO: 299166

SEQ ID NO: 495071 - RNA, 64 nt, hsa; identical to SEQ ID NO: 299167

SEQ ID NO: 495072 - RNA, 64 nt, hsa; identical to SEQ ID NO: 299168

SEQ ID NO: 495073 - RNA, 64 nt, hsa; identical to SEQ ID NO: 299169

SEQ ID NO: 495074 - RNA, 64 nt, hsa; identical to SEQ ID NO: 299170

SEQ ID NO: 495075 - RNA, 64 nt, hsa; identical to SEQ ID NO: 299171

SEQ ID NO: 495076 - RNA, 64 nt, hsa; identical to SEQ ID NO: 299172

SEQ ID NO: 495077 - RNA, 64 nt, hsa; identical to SEQ ID NO: 299173

SEQ ID NO: 495078 - RNA, 64 nt, hsa; identical to SEQ ID NO: 299174

SEQ ID NO: 495079 - RNA, 64 nt, hsa; identical to SEQ ID NO: 299175

SEQ ID NO: 495080 - RNA, 64 nt, hsa; identical to SEQ ID NO: 299176

SEQ ID NO: 495081 - RNA, 64 nt, hsa; identical to SEQ ID NO: 299177

SEQ ID NO: 495082 - RNA, 64 nt, hsa; identical to SEQ ID NO: 299178

SEQ ID NO: 495083 - RNA, 64 nt, hsa; identical to SEQ ID NO: 299179

SEQ ID NO: 495084 - RNA, 64 nt, hsa; identical to SEQ ID NO: 299180

SEQ ID NO: 495085 - RNA, 64 nt, hsa; identical to SEQ ID NO: 299181

SEQ ID NO: 495086 - RNA, 64 nt, hsa; identical to SEQ ID NO: 299182

SEQ ID NO: 495087 - RNA, 64 nt, hsa; identical to SEQ ID NO: 299183

SEQ ID NO: 495088 - RNA, 64 nt, hsa; identical to SEQ ID NO: 299184

SEQ ID NO: 495089 - RNA, 64 nt, hsa; identical to SEQ ID NO: 299185

SEQ ID NO: 495090 - RNA, 64 nt, hsa; identical to SEQ ID NO: 299186

SEQ ID NO: 495091 - RNA, 64 nt, hsa; identical to SEQ ID NO: 299187

SEQ ID NO: 495092 - RNA, 64 nt, hsa; identical to SEQ ID NO: 299188

SEQ ID NO: 495093 - RNA, 64 nt, hsa; identical to SEQ ID NO: 299189

SEQ ID NO: 495094 - RNA, 64 nt, hsa; identical to SEQ ID NO: 299190

SEQ ID NO: 495095 - RNA, 64 nt, hsa; identical to SEQ ID NO: 299191

SEQ ID NO: 495096 - RNA, 64 nt, hsa; identical to SEQ ID NO: 299192

SEQ ID NO: 495097 - RNA, 64 nt, hsa; identical to SEQ ID NO: 299193

SEQ ID NO: 495098 - RNA, 64 nt, hsa; identical to SEQ ID NO: 299194

SEQ ID NO: 495099 - RNA, 64 nt, hsa; identical to SEQ ID NO: 299195

SEQ ID NO: 495100 - RNA, 64 nt, hsa; identical to SEQ ID NO: 299196

SEQ ID NO: 495101 - RNA, 64 nt, hsa; identical to SEQ ID NO: 299197

SEQ ID NO: 495102 - RNA, 64 nt, hsa; identical to SEQ ID NO: 299198

SEQ ID NO: 495103 - RNA, 64 nt, hsa; identical to SEQ ID NO: 299199

SEQ ID NO: 495104 - RNA, 64 nt, hsa; identical to SEQ ID NO: 299200

SEQ ID NO: 495105 - RNA, 64 nt, hsa; identical to SEQ ID NO: 299201

SEQ ID NO: 495106 - RNA, 64 nt, hsa; identical to SEQ ID NO: 299202

SEQ ID NO: 495107 - RNA, 64 nt, hsa; identical to SEQ ID NO: 299203

SEQ ID NO: 495108 - RNA, 64 nt, hsa; identical to SEQ ID NO: 299204

SEQ ID NO: 495109 - RNA, 64 nt, hsa; identical to SEQ ID NO: 299205

SEQ ID NO: 495110 - RNA, 64 nt, hsa; identical to SEQ ID NO: 299206

SEQ ID NO: 495111 - RNA, 64 nt, hsa; identical to SEQ ID NO: 299207

SEQ ID NO: 495112 - RNA, 64 nt, hsa; identical to SEQ ID NO: 299208

SEQ ID NO: 495113 - RNA, 64 nt, hsa; identical to SEQ ID NO: 299209

SEQ ID NO: 495114 - RNA, 62 nt, hsa
uuccuuucaacuuaguugacauacgugccuuaaaaaggaaaacuaguguugcuauugugcau

SEQ ID NO: 495115 - RNA, 62 nt, hsa
aaacuaguguugcuauugugcauuuacuagaaaaaaggaauugguuguuuagggcacacugu

SEQ ID NO: 495116 - RNA, 62 nt, hsa
auuuuaagaugccuuaaaaaucuuaaagucacaaaaggaaaaagguuuuuaacauuuacaug

SEQ ID NO: 495117 - RNA, 62 nt, hsa
ucaauauauacccuucucuaaacugugcggguaaaaggaaugacuguccuugagagaaccau

SEQ ID NO: 495118 - RNA, 62 nt, hsa
uuugcacuguguucauauuaauccucuuuuaaaaaaggaaauauacagaagacaaacauugu

SEQ ID NO: 495119 - RNA, 62 nt, hsa
ggaagggaaguuagacaagcuuuggggaagagaaaaggaauauaguccauuuccaaaggagc

SEQ ID NO: 495120 - RNA, 62 nt, hsa
ugagugacagagcaagacuguaucucaaaggaaaaaggaaacuaggccaggcgugguggcuc

SEQ ID NO: 495121 - RNA, 62 nt, hsa
acaaaaaaaaaaagcuuuaaaaaaaaaagaaaaaaaggaaaagguuuuuagcucauuugccu

SEQ ID NO: 495122 - RNA, 62 nt, hsa
agugguugcuccaggauuacucccuccuccaaaaaaggaaucaaauccacgaguggaaaagc

SEQ ID NO: 495123 - RNA, 62 nt, hsa
aaggaaacuucaaacaauauagaauuaaauguaaaaggaagcacuccuguguacagaugcga

SEQ ID NO: 495124 - RNA, 62 nt, hsa
cagagggaaagggguacacugagggagaaaggaaaaggaaacuucaaacaauauagaauuaa

SEQ ID NO: 495125 - RNA, 62 nt, hsa
aaaaaaaaaaaaaaaggaaaaaggaaaaaaaaaaaaggaaaaccagaagcccugcugucugu

SEQ ID NO: 495126 - RNA, 62 nt, hsa
uaugcuuucuucuuaaaaaaaaaaaaaaaggaaaaaggaaaaaaaaaaaaggaaaaccagaa

SEQ ID NO: 495127 - RNA, 62 nt, hsa
caaccucuaugcuuucuucuuaaaaaaaaaaaaaaaggaaaaaggaaaaaaaaaaaaggaaa

SEQ ID NO: 495128 - RNA, 62 nt, hsa
uaguucaggaaguuuuguuuuguguuuuaaauaaaaggaaagagcaaguuugcucagucaag

SEQ ID NO: 495129 - RNA, 62 nt, hsa
guagggaaaaacuuuugcccgacugauuuuuaaaaaggaaaaaaaaaauguuuuacuaugug

SEQ ID NO: 495130 - RNA, 62 nt, hsa
uucauguauauaagcuauuucuugauccauuuaaaaggaauuguacauuguguagaaaaaaa

SEQ ID NO: 495131 - RNA, 62 nt, hsa
uuccugcuuugguuaccuuuccuuuccccuuuaaaaggaauuagcuauagaacugcuuugua

SEQ ID NO: 495132 - RNA, 62 nt, hsa
auauaaauuaaaugagacgagacaugucgaccaaaaggaaugugugggucuuguuuggaucc

SEQ ID NO: 495133 - RNA, 62 nt, hsa
cugaauacuuguuuuauagaaaaugcauggagaaaaggaauuuguuuaaauaacauuauggg

SEQ ID NO: 495134 - RNA, 62 nt, hsa
ucaguaucacagauuauucauaagaaauugagaaaaggaacaaucagaaguugcaaaagaug

SEQ ID NO: 495135 - RNA, 62 nt, hsa
cuuaaaauagcuuccaauaaguaacuuagaccaaaaggaaaaaugaagugccccaggagaag

SEQ ID NO: 495136 - RNA, 62 nt, hsa
gggccaaauagaguuuuuauauuuguuaugauaaaaggaaguagaugugaaaaagccuaaga

SEQ ID NO: 495137 - RNA, 62 nt, hsa
auaaaaggaaguagaugugaaaaagccuaagaaaaaggaaauuggacaguuuugauacaaac

SEQ ID NO: 495138 - RNA, 62 nt, hsa
gguuuuaaacgacuuuuguuugcggggcuuuuaaaaggaaaaccgaauuagguccacuucaa

SEQ ID NO: 495139 - RNA, 62 nt, hsa
cuguuuguguuauuucagaugauucaaauaucaaaaggaagauucuuccauuaaauugccuu

SEQ ID NO: 495140 - RNA, 62 nt, hsa
gucauagcucauuacucuaccaccaagaaccuaaaaggaauuagaauacagcagaauuggcc

SEQ ID NO: 495141 - RNA, 62 nt, hsa
ucauuuggaagacuuuagacucuauuaauuuuaaaaggaauauuuauuagccauaugcagaa

SEQ ID NO: 495142 - RNA, 62 nt, hsa
uugauggugauuguauuguauuccuuuaaucaaaaaggaaacacaauauucuaaguaucuuu

SEQ ID NO: 495143 - RNA, 62 nt, hsa
uagagacauuuuuauuuaugaauauuuauacaaaaaggaauucugucaagaugacugcucua

SEQ ID NO: 495144 - RNA, 57 nt, hsa; identical to SEQ ID NO: 210489

SEQ ID NO: 495145 - RNA, 62 nt, hsa
aaggcccugcuuuuuuucuuaaaaguacuuuaaaaaggaaauuuguuuguauuuuuuauuua

SEQ ID NO: 495146 - RNA, 62 nt, hsa
gccucugcucuccugggagacaaagcaauaauaaaaggaaguguuuguaaucccagcacuuu

SEQ ID NO: 495147 - RNA, 62 nt, hsa
aaacaaauaaauuuuaaaaauaaauaaauaauaaaaggaaguguuagacaauguaaugccag

SEQ ID NO: 495148 - RNA, 62 nt, hsa
auaccuugcagaggaaaggugggagagaggaaaaaaggaaauucuauagaaaucuauauauu

SEQ ID NO: 495149 - RNA, 62 nt, hsa
ggauggagagaaguaucagcacccagaagagaaaaaggaauuuaaaacaaaaaccacagagg

SEQ ID NO: 495150 - RNA, 62 nt, hsa
gucucccuucugacauuuccuaggaagcuaggaaaaggaaagugaaggaauggucuaaagaa

SEQ ID NO: 495151 - RNA, 62 nt, hsa
ugugacugagaaaaguuuaaugccggcaugguaaaaggaagcugucucccuucugacauuuc

SEQ ID NO: 495152 - RNA, 62 nt, hsa
auuugggucugccauugacagaaugucaaauaaaaaggaauuagcuagaauaugaccauuaa

SEQ ID NO: 495153 - RNA, 62 nt, hsa
aguuaccaucgcaaaggaaagguuauuccaguaaaaggaaauaguuuucucaaccauuuaaa

SEQ ID NO: 495154 - RNA, 62 nt, hsa
gcugagcugcuuguuuaaaaaaaaaaaaaaggaaaaggaaaaagcaugacauuguguaucga

SEQ ID NO: 495155 - RNA, 62 nt, hsa
caaaucgcugagcugcuuguuuaaaaaaaaaaaaaaggaaaaggaaaaagcaugacauugug

SEQ ID NO: 495156 - RNA, 62 nt, hsa
cacaacgauuacucgaagaugacugcaaagguaaaaggaaaauaaaaguguauugcacaaug

SEQ ID NO: 495157 - RNA, 62 nt, hsa
aauacacucagguggucuuauuuauuggcaacaaaaggaauuuucuauccagaagccuauuu

SEQ ID NO: 495158 - RNA, 62 nt, hsa
gaaaguuugucaucauuugaaaaaggaaauauaaaaggaacaaccauauagccaaccugugg

SEQ ID NO: 495159 - RNA, 62 nt, hsa
caauuuaauugggaaaguuugucaucauuugaaaaaggaaauauaaaaggaacaaccauaua

SEQ ID NO: 495160 - RNA, 62 nt, hsa
gaauaaggaucacugagaauuuaaaaaaauaaaaaaggaaguaaaaauuuuacaauuaggag

SEQ ID NO: 495161 - RNA, 62 nt, hsa
accagcuuucauaauuuuuaauugucaaaaccaaaaggaaucagaauaaggaucacugagaa

SEQ ID NO: 495162 - RNA, 62 nt, hsa
agaccauaagcaaacugguuauuuaaaauguaaaaaggaauaugaaagucuuauuaaaacac

SEQ ID NO: 495163 - RNA, 62 nt, hsa
acuauuuggcaacuacugggacucuucagcacaaaaggaauagaucuaugauugacccugau

SEQ ID NO: 495164 - RNA, 62 nt, hsa
ggaccauacagugauuuaccauuuugauaauuaaaaggaaaaaaaaaggaagacucucacug

SEQ ID NO: 495165 - RNA, 62 nt, hsa
ugauuuaccauuuugauaauuaaaaggaaaaaaaaaggaagacucucacuguaaaaacagcu

SEQ ID NO: 495166 - RNA, 62 nt, hsa
ccacaaaaucaauaaaagauguuuuugagaaaaaaaggaagaaaccaacucauucagaaggc

SEQ ID NO: 495167 - RNA, 62 nt, hsa
uuucugaucaccuuagaaauggcaguaagcccaaaaggaagaauuaugcugguaguaaaugg

SEQ ID NO: 495168 - RNA, 62 nt, hsa
aauagauguguguuuaauggaauugaagucugaaaaggaaguaguuauuuuagcagaaaauu

SEQ ID NO: 495169 - RNA, 62 nt, hsa
ugaauuauuuuucuccaaauugagacucucagaaaaggaagauugaauuagcguguuuuuug

SEQ ID NO: 495170 - RNA, 62 nt, hsa
cuaugaggaugugcugguuuguugaaucaaacaaaaggaaauguuguggaauauuuuuccaa

SEQ ID NO: 495171 - RNA, 62 nt, hsa
acaaggucaaaaaauagaugcaggcugaaaagaaaaggaagugggcuaagaugggaaaaaua

SEQ ID NO: 495172 - RNA, 62 nt, hsa
ggucaacauagugagacacugucucuaccaaaaaaaggaaggaagggacacauaucaaacug

SEQ ID NO: 495173 - RNA, 62 nt, hsa
gagagugugguuacgaaauacguuaggaggacaaaaggaauguguaagucuuuaaugccgau

SEQ ID NO: 495174 - RNA, 62 nt, hsa
agcauggagaaaacccgguacgcucaaaaagaaaaaggaaaaaaaaaaaucccaucacccac

SEQ ID NO: 495175 - RNA, 62 nt, hsa
auuuggacauuuuaauuguuuaaaaauuguacaaaaggaaaaaauuagaauaaguacuggcg

SEQ ID NO: 495176 - RNA, 62 nt, hsa
gagggcgguucuuuuuuuagauauuguuccuaaaaaggaauaaaugcauacaccuguuuguc

SEQ ID NO: 495177 - RNA, 62 nt, hsa
gaguauuuuugauuuuucuacuuuuuguugaaaaaaggaauuuguacucugugcauuggaug

SEQ ID NO: 495178 - RNA, 62 nt, hsa
ggggcgggccaaccccgagaaugaagauuggaaaaaggaaaaaaaaaaaaacacgucaaaag

SEQ ID NO: 495179 - RNA, 62 nt, hsa
agccgaugggggcaguggcguuaagugguggaaaaaggaaaguauauauguuagaguuuuga

SEQ ID NO: 495180 - RNA, 62 nt, hsa
ccagcuugggcaacagagcaagauccugucucaaaaggaaaaagaaaacaggaccuaggugu

SEQ ID NO: 495181 - RNA, 62 nt, hsa
gaucauucaguuggauuuucccaaugaagaggaaaaggaaaguaguuauuccuagcuccauu

SEQ ID NO: 495182 - RNA, 62 nt, hsa
cacagggcuugagcuuucugucauuugacuuuaaaaggaaguuucauucauauuuauccucu

SEQ ID NO: 495183 - RNA, 62 nt, hsa
guguuuucucuuggacauacuaaaaaauaccuaaaaggaagcuuagaugggcugugacacaa

SEQ ID NO: 495184 - RNA, 62 nt, hsa
caugacaguugcccuuucaaagcaggaggaagaaaaggaagaaagaaaaacuguuucaucau

SEQ ID NO: 495185 - RNA, 62 nt, hsa
gauucagcuuguaauaaucuuugagccacaccaaaaggaaugccaagggcucucuaaauuua

SEQ ID NO: 495186 - RNA, 62 nt, hsa
uagcaagcaugaauuuuucacccaagagugaaaaaaggaaaaucuaccauggcuugaaguua

SEQ ID NO: 495187 - RNA, 62 nt, hsa
guggcagguacuaugaauguaauucauaauuuaaaaggaaaacuaaaaacuauuuugauuug

SEQ ID NO: 495188 - RNA, 62 nt, hsa
uuaucacacugauguguucaacuguuuaugggaaaaggaaacuaggaugguuuuauuuguga

SEQ ID NO: 495189 - RNA, 62 nt, hsa
gcgcagagcagagugcugaguaaagaugucagaaaaggaaagcaauggucugguacaagucu

SEQ ID NO: 495190 - RNA, 62 nt, hsa
acuauugggguaugauguuugggucaguugauaaaaggaaaccuuuucaugccuuuagaugu

SEQ ID NO: 495191 - RNA, 62 nt, hsa
auauauauauauauauauauauauauaaauuaaaaaggaaagaaaacuaacaaccaaccaac

SEQ ID NO: 495192 - RNA, 62 nt, hsa
accuagaacuucaaaauguucguauucuauucaaaaggaaauauauauauauauauauauau

SEQ ID NO: 495193 - RNA, 62 nt, hsa
aaaggaauuuuccuguuaaauuaaacauuggcaaaaggaaauggaauaguauaaacacugau

SEQ ID NO: 495194 - RNA, 62 nt, hsa
ugaccuuuggugaucuucuuaggaacuucaagaaaaggaauuuuccuguuaaauuaaacauu

SEQ ID NO: 495195 - RNA, 62 nt, hsa
uucguaaaacuugcgugucuuuuaaaaauaauaaaaggaagaugaguauuuaugaagaauau

SEQ ID NO: 495196 - RNA, 62 nt, hsa
gguaaaacuuagauguccuuguaaaagaauaaaaaaggaauugcagugcaacaaaguacgug

SEQ ID NO: 495197 - RNA, 62 nt, hsa
cuauuauaauaaaaggugaggacuccuuguaaaaaaggaaauguuccacagagucaaucuaa

SEQ ID NO: 495198 - RNA, 62 nt, hsa
caaaugcacaagcaaaaagaugcuugauacacaaaaggaacucuggagagaaaacuacagcu

SEQ ID NO: 495199 - RNA, 62 nt, hsa
uauuacauaagaaacaauggacccaagagaagaaaaggaagaaagaaagguuuuuugguuuu

SEQ ID NO: 495200 - RNA, 62 nt, hsa
auuuuaggcucaaaaauuaaagcuaacacaggaaaaggaacuguacuggcuauuacauaaga

SEQ ID NO: 495201 - RNA, 62 nt, hsa
uaaaaugacuguuuucucucucuauggaaauaaaaaggaaaaaaaaaaaggaaacuuuuuuu

SEQ ID NO: 495202 - RNA, 62 nt, hsa
uucucucucuauggaaauaaaaaggaaaaaaaaaaaggaaacuuuuuuuguuugcucuugca

SEQ ID NO: 495203 - RNA, 62 nt, hsa
gauuggcaagacauguauuuaaacaauaaacuaaaaggaaauaaucuccacguacuaccauc

SEQ ID NO: 495204 - RNA, 62 nt, hsa
uuucuucaaaggcuuguuaaaccaaucauguuaaaaggaaauucuugguuuugguuuguugu

SEQ ID NO: 495205 - RNA, 62 nt, hsa
uuuuguuuggccuugcauugccuugguaaaguaaaaggaaacaguacacuuggagcuaggaa

SEQ ID NO: 495206 - RNA, 62 nt, hsa
ccuugaaccacauauaccaauuauaauuuuggaaaaggaauuaagccucacggaacaaugga

SEQ ID NO: 495207 - RNA, 62 nt, hsa
aaaacugacaaugcaugcuacuguucucuuucaaaaggaagagcaaccguguugaauacuaa

SEQ ID NO: 495208 - RNA, 62 nt, hsa
gucagcuguagguggcaaaggugcccuuauaaaaaaggaaacuggcuuuucaaaaugggcua

SEQ ID NO: 495209 - RNA, 62 nt, hsa
caaaagugcagcaggagaacucuuuucccugaaaaaggaaaaauauugaacucaaugauagc

SEQ ID NO: 495210 - RNA, 62 nt, hsa
cggucaguuaugucaauguuucauggucaauaaaaaggaaguugcaaauugugauuuaagca

SEQ ID NO: 495211 - RNA, 62 nt, hsa
uauauccucuguauaaaaugagguuucaguacaaaaggaaccaugggugacccugcgauauc

SEQ ID NO: 495212 - RNA, 62 nt, hsa
cgugauugguugguuuguagcacuaaggucuaaaaaggaaaaccauaaaagacaucagauua

SEQ ID NO: 495213 - RNA, 62 nt, hsa
cagggaggaugggauuaguggaagcuuaauggaaaaggaaaguuaugauccuccaagacccu

SEQ ID NO: 495214 - RNA, 62 nt, hsa
caaucucuuauacuagugggacaaaagggagaaaaaggaagcaagauaaauggguauguagg

SEQ ID NO: 495215 - RNA, 62 nt, hsa
ugauacuuuaaaagccaaggugcccauauggaaaaaggaaauauacgaagagucaucaacuu

SEQ ID NO: 495216 - RNA, 62 nt, hsa
caguaucugccacugggauaaaguccuacuaaaaaaggaacgguaaauguacccuaaugauu

SEQ ID NO: 495217 - RNA, 62 nt, hsa
caugaucuaaugcagaugacuaggcuuuuuccaaaaggaagacagacccucagacaccaaaa

SEQ ID NO: 495218 - RNA, 62 nt, hsa
caggcaauauuccagcuauggagcuagcuuuaaaaaggaacaguaaaaauauuaaucgguua

SEQ ID NO: 495219 - RNA, 62 nt, hsa
ccagccggggugacagaagagaccuugucucgaaaaggaaucugaaaacaauggaaccaugc

SEQ ID NO: 495220 - RNA, 62 nt, hsa
augcugcuuccuauuggagcccagaaaaaaggaaaaggaaaguuuaggcuuucuuuguccuu

SEQ ID NO: 495221 - RNA, 62 nt, hsa
uuguaaaugcugcuuccuauuggagcccagaaaaaaggaaaaggaaaguuuaggcuuucuuu

SEQ ID NO: 495222 - RNA, 62 nt, hsa
uaagaaccagaaaaauaauuaaucucucuggaaaaaggaaagcuaaagaagacuaugauacc

SEQ ID NO: 495223 - RNA, 62 nt, hsa
guaacuugaaggcagcacagaggugagggauuaaaaggaaaggcagauuuugaaaucugacu

SEQ ID NO: 495224 - RNA, 62 nt, hsa
agugacaucugauuggcagaugagcuuauuucaaaaggaaggguggcuuugcauuucuugug

SEQ ID NO: 495225 - RNA, 62 nt, hsa
uuaggaauccuagcacuugucucaggacucugaaaaggaacggcuuccucauuccuugucuu

SEQ ID NO: 495226 - RNA, 62 nt, hsa
agcauccuuaagauuuaaaaaaaaaaaaaaaaaaaaggaaaaaaaagugauggaagccguaa

SEQ ID NO: 495227 - RNA, 62 nt, hsa
ucuugucuauuuuuucucuucauguuguaacaaaaaggaaaaaagaaaaaaaaaucccaucc

SEQ ID NO: 495228 - RNA, 61 nt, hsa; identical to SEQ ID NO: 210573

SEQ ID NO: 495229 - RNA, 62 nt, hsa
aaaaagucuguacuaauuucaauauggcucuuaaaaggaaugacagagaaauaggauacaag

SEQ ID NO: 495230 - RNA, 62 nt, hsa
ccaaaggauuuaagaguuuuguuguuguuaauaaaaggaauacuccuuuuccuuuuggauca

SEQ ID NO: 495231 - RNA, 62 nt, hsa
guuaguguaucaguaagaaacagaccuaguuuaaaaggaauaaucaacaauuuuauaaagga

SEQ ID NO: 495232 - RNA, 62 nt, hsa
cccgucccuuaaaaagacaaaaaaaauaaggcaaaaggaaagcaacuaagacacuggacuau

SEQ ID NO: 495233 - RNA, 62 nt, hsa
auaaauaccuggcaaaacuaaauaaauuaccaaaaaggaaaaaaaauccaccaaaccaugau

SEQ ID NO: 495234 - RNA, 62 nt, hsa
gaggugccuccgaauuagaaaucagaauaaguaaaaggaacguucacucacaggguacgcuc

SEQ ID NO: 495235 - RNA, 62 nt, hsa
aaaagaagagaaaaaauuaagaaaaaaaucaaaaaaggaagaaaacuaaaaaaaaaaaaaau

SEQ ID NO: 495236 - RNA, 62 nt, hsa
agcaccuuuuaaaccugcugcacauuggacucaaaaggaaaacuggaccaacaauaauugag

SEQ ID NO: 495237 - RNA, 62 nt, hsa
uuuggauuuuauuccaaaccuugcuguaauauaaaaggaaguuuacaagacaugauauugcu

SEQ ID NO: 495238 - RNA, 62 nt, hsa
ucaccuguguggcccagauggcuccaacaagcaaaaggaaggaugcagugacucuugcugcc

SEQ ID NO: 495239 - RNA, 62 nt, hsa
aguauguuauugaaaguuucuauuugguugauaaaaggaacaauuuuuucccacuuuugaug

SEQ ID NO: 495240 - RNA, 62 nt, hsa
augucauugguauaugguggcuguuuaccaauaaaaggaaaaaauucauuaaccgguugcuu

SEQ ID NO: 495241 - RNA, 62 nt, hsa
cuuccuugucucaugaaaaccuaaauauaaaaaaaaggaaaauacuggaguuuuuauuucuc

SEQ ID NO: 495242 - RNA, 62 nt, hsa
agacaguuauuccauaaagcauuuguauaauuaaaaggaaaacagaaaaaggaaaaguaggc

SEQ ID NO: 495243 - RNA, 62 nt, hsa
uaaagcauuuguauaauuaaaaggaaaacagaaaaaggaaaaguaggcaaaugugaaaauag

SEQ ID NO: 495244 - RNA, 62 nt, hsa
uuuuaaaaaucuaccuguuccugacuuaaaacaaaaggaaagaaacuaccuuuuuauaaugc

SEQ ID NO: 495245 - RNA, 62 nt, hsa
gagguauuguaagcuuuccauuuucuauaagaaaaaggaaaaguugaggggggggcauuagu

SEQ ID NO: 495246 - RNA, 62 nt, hsa
gaaaaauaauuuuaaguaaagaaaaaagaaaaaaaaggaagacuaaacagaaaccagaacug

SEQ ID NO: 495247 - RNA, 62 nt, hsa
gggaggggagcugguuuccuggugaacuuucuaaaaggaaaaauaauuuuaaguaaagaaaa

SEQ ID NO: 495248 - RNA, 62 nt, hsa
gagaggagagucuuacggagggcugggagcuuaaaaggaaaacaauguccuuacuuguaaac

SEQ ID NO: 495249 - RNA, 62 nt, hsa
uuuaugauaccaaaaaaauuacaguuuuguuuaaaaggaaauguugauguuuucaacuccaa

SEQ ID NO: 495250 - RNA, 55 nt, hsa; identical to SEQ ID NO: 210595

SEQ ID NO: 495251 - RNA, 62 nt, hsa
cgucucgugaguccgacccagacauccaaacuaaaaggaagucauccagucuauucacagaa

SEQ ID NO: 495252 - RNA, 62 nt, hsa
acauggcauuuucuagcuguguccuuauacauaaaaggaaaaagguagcucucucgagucuc

SEQ ID NO: 495253 - RNA, 62 nt, hsa
uuuuauauacugaacugccauagaugcuggaaaaaaggaacugauguuuucagcauauuuuc

SEQ ID NO: 495254 - RNA, 62 nt, hsa
uccuguuuuucccccuuugaaaaacucaggaaaaaaggaagauugaacuaauaaaauuuuau

SEQ ID NO: 495255 - RNA, 62 nt, hsa
cacauacacauauauacuggaaccuauaguagaaaaggaaacuaguagggccaaaaaaaaaa

SEQ ID NO: 495256 - RNA, 62 nt, hsa
cuuuuggauuaggguacaauauuagagcucuaaaaaggaauaguagaauaacuuagcucagc

SEQ ID NO: 495257 - RNA, 62 nt, hsa
cuuuugguuaggggacaauauuagagcuuuuaaaaaggaaggguagacucacuuagcucagc

SEQ ID NO: 495258 - RNA, 62 nt, hsa
gaugaagauuauaacuguuuauuuaccuaauuaaaaggaaaggcagugccaaauaugagagg

SEQ ID NO: 495259 - RNA, 62 nt, hsa
uuuuaauuagucaaacuaaauuaaggcucauuaaaaggaaaggaacuacugggaaauuaugc

SEQ ID NO: 495260 - RNA, 62 nt, hsa
ucaccccugccuuuuguucaacucuauaaaggaaaaggaauguagcucaacuugugauaaaa

SEQ ID NO: 495261 - RNA, 62 nt, hsa
aaaaagugggaaggugaugcuguucuuauuguaaaaggaaagucauuuauauuaaagaauuu

SEQ ID NO: 495262 - RNA, 62 nt, hsa
uaaugcuccucuuucaggguaauaaaguggggaaaaggaacgucuucucaaugcaagaacau

SEQ ID NO: 495263 - RNA, 62 nt, hsa
caugagcuuguucagagugaggggcauagugaaaaaggaacagccaugccucaaaaucaaau

SEQ ID NO: 495264 - RNA, 62 nt, hsa
caaggacuguuucagugugagucagaaugugaaaaaggaauaaaaaauacuguugggcucaa

SEQ ID NO: 495265 - RNA, 62 nt, hsa
acauguauugacaacaguuuuauaauuuaauaaaaaggaauacauugcaauccguaauuuuc

SEQ ID NO: 495266 - RNA, 62 nt, hsa
gguuugaggggcuggggagugggaggggggagaaaaggaauguauuuaaacaauuuccgaug

SEQ ID NO: 495267 - RNA, 62 nt, hsa
caagaaauuuaaagaaucaaaacgaugguuugaaaaggaaaccuaugauacaugcaggagaa

SEQ ID NO: 495268 - RNA, 62 nt, hsa
uuuaagaacuauuuuaaaguguuccagacccaaaaaggaaaaauaaaaaaaaaggaauauuu

SEQ ID NO: 495269 - RNA, 62 nt, hsa
aguguuccagacccaaaaaggaaaaauaaaaaaaaaggaauauuuguacccaacagcuagaa

SEQ ID NO: 495270 - RNA, 62 nt, hsa
aagaaaaaaugaaaaaaaaaggaaaaaaagaaaaaaggaaaaaaacaguuugaacacaaagg

SEQ ID NO: 495271 - RNA, 62 nt, hsa
uuugaaaucuuaaaaaaagaaaaaaugaaaaaaaaaggaaaaaaagaaaaaaggaaaaaaac

SEQ ID NO: 495272 - RNA, 62 nt, hsa
auaguuuaagaaauuuuuuuuuuaaauaaaaaaaaaggaaaagaggaagacuggacaaaaca

SEQ ID NO: 495273 - RNA, 62 nt, hsa
ugcauccuucuugcuuauacguuaaguuacauaaaaggaaaacaaaauuauguggugugaaa

SEQ ID NO: 495274 - RNA, 62 nt, hsa
aaauaaaagggaaaaaaaagaaaaaagaaacaaaaaggaacuucuuauaguugucuuuugug

SEQ ID NO: 495275 - RNA, 62 nt, hsa
uuucauugagaauuaugauguuauaaaaaggaaaaaggaagaaugucgucuacugcagucua

SEQ ID NO: 495276 - RNA, 62 nt, hsa
caaagcauuucauugagaauuaugauguuauaaaaaggaaaaaggaagaaugucgucuacug

SEQ ID NO: 495277 - RNA, 62 nt, hsa
uucaauuucugagaaaaugaggcagagcauggaaaaggaauaggaaggagaaauuaauugag

SEQ ID NO: 495278 - RNA, 62 nt, hsa
uggaggaagaaaaacuguccuuccuucuccaaaaaaggaaaaauuauaauaauauaaaugac

SEQ ID NO: 495279 - RNA, 62 nt, hsa
ccaaaacauauauacagauuguuggcauuugcaaaaggaagcaucaauaguggacccagagg

SEQ ID NO: 495280 - RNA, 62 nt, hsa
ugcaugcacuaauaaaacugguuguuuaauuuaaaaggaauauauaagacuuuacccauguu

SEQ ID NO: 495281 - RNA, 62 nt, hsa
gcuaauguguuguaaacaagauucuaaauuuaaaaaggaaaacaaaacaaacuuguucuuug

SEQ ID NO: 495282 - RNA, 62 nt, hsa
auccugaggcugaugaauugugaaaauuccucaaaaggaaauuaugcuggucaucacaggaa

SEQ ID NO: 495283 - RNA, 62 nt, hsa
aucaccuacuuucaugcagguguauaaucuugaaaaggaaaaaugcuuccauguugaagcca

SEQ ID NO: 495284 - RNA, 62 nt, hsa
aaacuuuccaaacuuuugcaugagaaacuagaaaaaggaauguaugccacguaacuggauua

SEQ ID NO: 495285 - RNA, 62 nt, hsa
ugugagguuuauacuauuucugguuuuuaaccaaaaggaaaucaucuggaagcaggaggcaa

SEQ ID NO: 495286 - RNA, 62 nt, hsa
aaagguugacauauuccaaaacccuucuuuuuaaaaggaaaaaggauggagagaaggaugga

SEQ ID NO: 495287 - RNA, 62 nt, hsa
ugaauaagaugauagacgagaauuuuuuuuaaaaaaggaauuuaaaggaaucuugugcaacu

SEQ ID NO: 495288 - RNA, 62 nt, hsa
agguguugccuauugcugugcuuauaaaaugaaaaaggaaauugaggacacuuuugcaaaug

SEQ ID NO: 495289 - RNA, 61 nt, hsa
uuuuucacuuugcucucaauuaaagucuauucaaaaggaaaguggcaagauuccaucagcu

SEQ ID NO: 495290 - RNA, 62 nt, hsa
uuucaagucugacucuccacuccuccucacuaaaaaggaaacuucaguugaucuucuucauc

SEQ ID NO: 495291 - RNA, 62 nt, hsa
uaucuggggaaaaaaaacuuuuuuuuaaauuaaaaaggaaaauaaaagauauugaggucuuc

SEQ ID NO: 495292 - RNA, 62 nt, hsa
uguuucuaaacuuucgcuacuauaaaaccaaaaaaaggaauugagauuucaccaaccccagu

SEQ ID NO: 495293 - RNA, 62 nt, hsa
ccacagcagaagagccauucaucucauaaacaaaaaggaagaggaaagaaugaggaaggacc

SEQ ID NO: 495294 - RNA, 62 nt, hsa
ggcugaccagcuggcccaggauuucacagucgaaaaggaagccaccacugaugccucccacu

SEQ ID NO: 495295 - RNA, 62 nt, hsa
cuugauaaauuugccuauaaaguuuuauaaagaaaaggaauauuuuguuuucauaaagagga

SEQ ID NO: 495296 - RNA, 62 nt, hsa
gucacuaaaguauccugacaaguuccuaggaaaaaaggaauaaaguuuuuuuccuuaaaaaa

SEQ ID NO: 495297 - RNA, 62 nt, hsa
agaacuacauuuuucuuauugccuugaaaguuaaaaggaaagcagauuucuucagugacuuu

SEQ ID NO: 495298 - RNA, 62 nt, hsa
uuucuuacauauacaucuuaguugauuauuaaaaaaggaaaaauaugguuuccagagaaaag

SEQ ID NO: 495299 - RNA, 62 nt, hsa
uaucuagggucuguaaccguuuugguuugagaaaaaggaaaggccccuugucacauccucua

SEQ ID NO: 495300 - RNA, 62 nt, hsa
cauauuuuagugggagccagacuauaaggaauaaaaggaaaaacuuucuuccucucucucca

SEQ ID NO: 495301 - RNA, 62 nt, hsa
uacuauauacagccaguaaauacaugcuuaacaaaaggaaugagccugaaguucauaaagaa

SEQ ID NO: 495302 - RNA, 62 nt, hsa
aguucauaaagaauacauaucaauauucuuauaaaaggaauauaugaagauggcuuugauac

SEQ ID NO: 495303 - RNA, 62 nt, hsa
auaguggauaauagacaaagugaaaacauuuaaaaaggaagagaaacuucagccuuucuaag

SEQ ID NO: 495304 - RNA, 62 nt, hsa
gaaaaaagauaaaguagaaaaagaaaaaagugaaaaggaaacaacuagcaaaaagaauagcc

SEQ ID NO: 495305 - RNA, 62 nt, hsa
auuaugaaaaucuaacacucaagauaguuucuaaaaggaaaucaguaguuaaggauaccuga

SEQ ID NO: 495306 - RNA, 62 nt, hsa
cuaagacauuucugaauguagaccauuuuccaaaaaggaaacuuuauuuucaaaaaccuaau

SEQ ID NO: 495307 - RNA, 62 nt, hsa
uuaauauuuguucaaguagagaaugaagauaaaaaaggaauuugaggccagguauggggugu

SEQ ID NO: 495308 - RNA, 62 nt, hsa
aauaucaaaaauugcuauuguauaguuugccuaaaaggaaguuggagugaauaucaucuuug

SEQ ID NO: 495309 - RNA, 62 nt, hsa
uguuuguuuuugugugguaaacugauauuuaaaaaaggaaaggagaaaaaucacgacuacug

SEQ ID NO: 495310 - RNA, 62 nt, hsa
gaguagcaacagcuggucauauacccuaucccaaaaggaagaacugucuugaacaagaugaa

SEQ ID NO: 495311 - RNA, 62 nt, hsa
cauuggaauuuauauuaaaagacaaguuauuaaaaaggaaagguucuauucauaaucagggu

SEQ ID NO: 495312 - RNA, 62 nt, hsa
cuuucauaaauuuuauggcaugucuucuauuuaaaaggaaaagaauaaguauucuugcaucu

SEQ ID NO: 495313 - RNA, 62 nt, hsa
cacuuuucauucacuugaaagcuuaagugggaaaaaggaagaugauugucaggggaaaaacu

SEQ ID NO: 495314 - RNA, 62 nt, hsa
gaaacaaggacaauuuguguuggaugguauucaaaaggaauuuuuuaaaacauuaagcaaca

SEQ ID NO: 495315 - RNA, 62 nt, hsa
auuugcaaauugcaauaaaacacauuuuagaaaaaaggaaccuucaauuauuagcuuuguuu

SEQ ID NO: 495316 - RNA, 62 nt, hsa
ccacucgcuuggauuucugacacaguuuacaaaaaaggaaaaaggcacugcuccuauuuucc

SEQ ID NO: 495317 - RNA, 62 nt, hsa
caauuggcagccucucacuacucuuucuggcuaaaaggaaucuaaucuuguugaggguagag

SEQ ID NO: 495318 - RNA, 62 nt, hsa
gcagaacagccagagggggcaggaggggaccaaaaaggaaaaugaggacgugcagcagcauu

SEQ ID NO: 495319 - RNA, 62 nt, hsa
aaacuaauuuagucaucagagauacuuuccuaaaaaggaaaaauaaaaaacaaaauggugcc

SEQ ID NO: 495320 - RNA, 62 nt, hsa
ugggaaauauuaugacaguugacuuuaagaucaaaaggaagggaagaccugaaagucauuug

SEQ ID NO: 495321 - RNA, 62 nt, hsa
aagaccagauccuuagagaaguuugugguauaaaaaggaaguggggacagauucgcagcaca

SEQ ID NO: 495322 - RNA, 62 nt, hsa
acuucucuuccucccucauggaagaugcaaguaaaaggaaaugcaaguaaccaccuggguua

SEQ ID NO: 495323 - RNA, 62 nt, hsa
uauuuucuuauuucacuuuuacaccuaucuuuaaaaggaauuuaaauuuuguuuauauacau

SEQ ID NO: 495324 - RNA, 62 nt, hsa
uacauuaacuaaaucaguacaaguuuggggugaaaaggaaauuuuuaauccaucucaaaugu

SEQ ID NO: 495325 - RNA, 62 nt, hsa; identical to SEQ ID NO: 210670

SEQ ID NO: 495326 - RNA, 62 nt, hsa
uaagucaagugcaaggacuuaacuugcguuugaaaaggaauuagagggucagaaacacccag

SEQ ID NO: 495327 - RNA, 62 nt, hsa
cccgcuuagccuuuacauuccucuccaccgacaaaaggaaggggaaacucaaucagcaggac

SEQ ID NO: 495328 - RNA, 62 nt, hsa
acauucacugcacacguguacagcggaguacgaaaaggaacguuguccacaggggauuuaug

SEQ ID NO: 495329 - RNA, 62 nt, hsa
uaaaacauuuuaaaauauaaauccuguaguuuaaaaggaagaaauggugggaaggaaaagua

SEQ ID NO: 495330 - RNA, 62 nt, hsa
acuaauauaugugagaguacuuaguugaaacaaaaaggaauuuuaguagacaguauuauauu

SEQ ID NO: 495331 - RNA, 62 nt, hsa
ccacagacacaguuaaagcaaaaggaaacaauaaaaggaaugucugcaugcuauuuuaaucu

SEQ ID NO: 495332 - RNA, 62 nt, hsa
gcacuuaaaaauaccacagacacaguuaaagcaaaaggaaacaauaaaaggaaugucugcau

SEQ ID NO: 495333 - RNA, 62 nt, hsa
gguaccuugaaaauccaaaagccaucucaaguaaaaggaauaaaugugucaugcuuuuuaaa

SEQ ID NO: 495334 - RNA, 62 nt, hsa
uugcuaugcagacagggaagggaauuucacuuaaaaggaaggucauuuggagaugugaagau

SEQ ID NO: 495335 - RNA, 62 nt, hsa
auuacccccccacuaugcccucauuuuuuuaaaaaaggaaaaaaaaaagaaacuggguucca

SEQ ID NO: 495336 - RNA, 62 nt, hsa
aauaaaaaaauaaauaaaaauaaaaaaaauaaaaaaggaaaaaaaaaaaagaagaaacaaga

SEQ ID NO: 495337 - RNA, 62 nt, hsa
ccugcucacacuccagaauuaaauucuauugaaaaaggaaaaucagcaauucagcaaaaaau

SEQ ID NO: 495338 - RNA, 62 nt, hsa
uaaugacagauguucuguuuuuauaaccuaccaaaaggaaacuagaggcuucuuggugaaga

SEQ ID NO: 495339 - RNA, 62 nt, hsa
ccauccuaggcaacagagugauacgcuguuuaaaaaggaaaaaauccuucccuagagcuagu

SEQ ID NO: 495340 - RNA, 62 nt, hsa
cagagugagacuccaucucaacagaaggaaaaaaaaggaaaauaggagaagguggaaauggg

SEQ ID NO: 495341 - RNA, 62 nt, hsa
acaaaguccaaaagucacuuuugaaugugaacaaaaggaagaaaaucaaggaaagaaugagu

SEQ ID NO: 495342 - RNA, 62 nt, hsa
uuuuacagaugcaaacagcuauaauuuugcaaaaaaggaaaauaacucuccugaacaucuaa

SEQ ID NO: 495343 - RNA, 62 nt, hsa
agggagagcuaccaaauuguuuuuuucuuuuuaaaaggaaguuuaauguccguuguaucaca

SEQ ID NO: 495344 - RNA, 62 nt, hsa
agcuuguucuuguauugugaccuuuuuuaaaaaaaaggaacugagguucagaaugauuaagg

SEQ ID NO: 495345 - RNA, 62 nt, hsa
aaaagaaaggacauugaguuuuaacagaagggaaaaggaaagaagaaaagauuuuugcagaa

SEQ ID NO: 495346 - RNA, 62 nt, hsa
ugagcagaacaaaucgucaggugccuggagcaaaaaggaaaaaaaaaaaagaaaggacauug

SEQ ID NO: 495347 - RNA, 62 nt, hsa
uggcucuuuuuuuaaaagaugcgcucuaccugaaaaggaaauuggauuuuagaacuggaugu

SEQ ID NO: 495348 - RNA, 62 nt, hsa
auaaaaccucuugcuugugugcaaaaguuccuaaaaggaaacacaaguaaugccuauccauu

SEQ ID NO: 495349 - RNA, 62 nt, hsa
cgacagccccaaucuucccgucuuuaugagagaaaaggaaaaaggaaucaaagguggaagaa

SEQ ID NO: 495350 - RNA, 62 nt, hsa
cccaaucuucccgucuuuaugagagaaaaggaaaaaggaaucaaagguggaagaaaaaaaaa

SEQ ID NO: 495351 - RNA, 62 nt, hsa
agugucuuaauguggaaguuaacccuuaccaaaaaaggaaguuggcaaaaacagccuucuag

SEQ ID NO: 495352 - RNA, 62 nt, hsa
uuucuuuugcauggacaugggccagguuuuucaaaaggaauauaaacaggaucucaaacuug

SEQ ID NO: 495353 - RNA, 62 nt, hsa
caugguaagccuuagcagcaaacauucuuccuaaaaggaagacuucauuuucucaagaaaug

SEQ ID NO: 495354 - RNA, 62 nt, hsa
uuuuuguauauuguugagaaagaaacacuaacaaaaggaacaacgaguaauuuauaaaauug

SEQ ID NO: 495355 - RNA, 62 nt, hsa
uguucauacagugaauaaagaucuaucaaaggaaaaggaaacugagaccgaaaacuuagggu

SEQ ID NO: 495356 - RNA, 62 nt, hsa
ugauuuuuccccccuaauaucugcucucuuucaaaaggaauaauucaaaagacuuaggacaa

SEQ ID NO: 495357 - RNA, 62 nt, hsa
ccauccauacaauggaguauuacacagccauaaaaaggaaugaagcagugauccccacuaca

SEQ ID NO: 495358 - RNA, 62 nt, hsa
cuagauucucucucucaaaaaaaaaaaaaaaaaaaaggaaagaaagaaagaaaagaaaagaa

SEQ ID NO: 495359 - RNA, 62 nt, hsa
ucagacuaggaacaaguugauaccaaaaccugaaaaggaaacuacagaaugggaaagucaua

SEQ ID NO: 495360 - RNA, 62 nt, hsa
aaaacucaaucaauguaauucaguauuuuaacaaaaggaaugaaaaauuaucaucucaauag

SEQ ID NO: 495361 - RNA, 62 nt, hsa
guugagggaaugaauaaguauuuccgucaagaaaaaggaaacaacaaaauaaaaccaaccca

SEQ ID NO: 495362 - RNA, 62 nt, hsa
uauuauugucauuaguauuagugaauucacguaaaaggaagaucuguagacauaauaaaugu

SEQ ID NO: 495363 - RNA, 62 nt, hsa
agggacuacaucguuggcuuuugaccuugcugaaaaggaacauauaauuguauggaugguag

SEQ ID NO: 495364 - RNA, 62 nt, hsa
ucauauguucuaaaaugacuagcaaugguuuaaaaaggaagaagaguggaagugaagaaggu

SEQ ID NO: 495365 - RNA, 62 nt, hsa
auuaauagguugcuaauuauuuaucacugcuaaaaaggaaaaaaggcauaaaaugaccuucu

SEQ ID NO: 495366 - RNA, 62 nt, hsa
uagaugaggacaugagaauaauucaggagaacaaaaggaaacacagaacaugcaaaaggccu

SEQ ID NO: 495367 - RNA, 62 nt, hsa
ugaucaaggaagggcugucacuuuagagguucaaaaggaagugccucaaagcaaaggcaagc

SEQ ID NO: 495368 - RNA, 62 nt, hsa
ccugcugggucuuaacaagcauaaaaaggaaaaaaaggaaacucaggcaaagggauccauau

SEQ ID NO: 495369 - RNA, 62 nt, hsa
acguccauuccugcugggucuuaacaagcauaaaaaggaaaaaaaggaaacucaggcaaagg

SEQ ID NO: 495370 - RNA, 62 nt, hsa
uaauuggagauccugaacaccaaaguaagccuaaaaggaaucuuugaggaaaaaagccuucu

SEQ ID NO: 495371 - RNA, 62 nt, hsa
auggaucacagaccugaaucuguuguguugguaaaaggaaucaacaccuuuacauugcucaa

SEQ ID NO: 495372 - RNA, 62 nt, hsa
auuaaaaacccaaagaaccagcucauguuuggaaaaggaaucuuccacugaaacauuuggau

SEQ ID NO: 495373 - RNA, 62 nt, hsa
cuuuuccucaggaaauucggcaagacuuggagaaaaggaaagcuccaucaaagaggaccccc

SEQ ID NO: 495374 - RNA, 62 nt, hsa
uuaagcauaugugcuuucgcagcugauaauauaaaaggaaaucccacagucuagauauagcc

SEQ ID NO: 495375 - RNA, 62 nt, hsa
uauuaugagugggggacuggugacuuuauaugaaaaggaaggaagagugaccuaagcuagca

SEQ ID NO: 495376 - RNA, 62 nt, hsa
aagaacauaagaacucaaggagaacauaagagaaaaggaaaccuguuacagaaaagacaaga

SEQ ID NO: 495377 - RNA, 62 nt, hsa
ugaaaaaaaaaaacagucaauauggauuuagaaaaaggaacaccugaugaagaaaaggagag

SEQ ID NO: 495378 - RNA, 62 nt, hsa
aagaaaggccagagaaagagcaguccaagcauaaaaggaaaaagaguuaugaagauacagau

SEQ ID NO: 495379 - RNA, 62 nt, hsa
aaagucaacugaaucuuuuauucauagaaaugaaaaggaaaauaaaaacuguggcugaccaa

SEQ ID NO: 495380 - RNA, 62 nt, hsa
aaauacuguuucuucuauccaacucucuuaugaaaaggaacucuguauuuucuauuagccau

SEQ ID NO: 495381 - RNA, 62 nt, hsa
uccuuacguccugagccgguuuaagucuguggaaaaggaagcacgggagaaauccacguaac

SEQ ID NO: 495382 - RNA, 62 nt, hsa
ccauccacugucuuugacaccuagaagguggaaaaaggaaagagauuugagaagugagagag

SEQ ID NO: 495383 - RNA, 64 nt, hsa; identical to SEQ ID NO: 212638

SEQ ID NO: 495384 - RNA, 64 nt, hsa; identical to SEQ ID NO: 212639

SEQ ID NO: 495385 - RNA, 64 nt, hsa; identical to SEQ ID NO: 212640

SEQ ID NO: 495386 - RNA, 64 nt, hsa; identical to SEQ ID NO: 212641

SEQ ID NO: 495387 - RNA, 64 nt, hsa; identical to SEQ ID NO: 212642

SEQ ID NO: 495388 - RNA, 64 nt, hsa; identical to SEQ ID NO: 212643

SEQ ID NO: 495389 - RNA, 64 nt, hsa; identical to SEQ ID NO: 212644

SEQ ID NO: 495390 - RNA, 64 nt, hsa; identical to SEQ ID NO: 212645

SEQ ID NO: 495391 - RNA, 64 nt, hsa; identical to SEQ ID NO: 212646

SEQ ID NO: 495392 - RNA, 64 nt, hsa; identical to SEQ ID NO: 212647

SEQ ID NO: 495393 - RNA, 64 nt, hsa; identical to SEQ ID NO: 212648

SEQ ID NO: 495394 - RNA, 64 nt, hsa; identical to SEQ ID NO: 212649

SEQ ID NO: 495395 - RNA, 64 nt, hsa; identical to SEQ ID NO: 212650

SEQ ID NO: 495396 - RNA, 64 nt, hsa; identical to SEQ ID NO: 212651

SEQ ID NO: 495397 - RNA, 64 nt, hsa; identical to SEQ ID NO: 212652

SEQ ID NO: 495398 - RNA, 64 nt, hsa; identical to SEQ ID NO: 212653

SEQ ID NO: 495399 - RNA, 64 nt, hsa; identical to SEQ ID NO: 212654

SEQ ID NO: 495400 - RNA, 64 nt, hsa; identical to SEQ ID NO: 212655

SEQ ID NO: 495401 - RNA, 64 nt, hsa; identical to SEQ ID NO: 212656

SEQ ID NO: 495402 - RNA, 64 nt, hsa; identical to SEQ ID NO: 212657

SEQ ID NO: 495403 - RNA, 64 nt, hsa; identical to SEQ ID NO: 212658

SEQ ID NO: 495404 - RNA, 64 nt, hsa; identical to SEQ ID NO: 212659

SEQ ID NO: 495405 - RNA, 64 nt, hsa; identical to SEQ ID NO: 212660

SEQ ID NO: 495406 - RNA, 64 nt, hsa; identical to SEQ ID NO: 212661

SEQ ID NO: 495407 - RNA, 64 nt, hsa; identical to SEQ ID NO: 212662

SEQ ID NO: 495408 - RNA, 64 nt, hsa; identical to SEQ ID NO: 212663

SEQ ID NO: 495409 - RNA, 64 nt, hsa; identical to SEQ ID NO: 212664

SEQ ID NO: 495410 - RNA, 64 nt, hsa; identical to SEQ ID NO: 212665

SEQ ID NO: 495411 - RNA, 64 nt, hsa; identical to SEQ ID NO: 212666

SEQ ID NO: 495412 - RNA, 62 nt, hsa; identical to SEQ ID NO: 212667

SEQ ID NO: 495413 - RNA, 64 nt, hsa; identical to SEQ ID NO: 212668

SEQ ID NO: 495414 - RNA, 64 nt, hsa; identical to SEQ ID NO: 212669

SEQ ID NO: 495415 - RNA, 64 nt, hsa; identical to SEQ ID NO: 212670

SEQ ID NO: 495416 - RNA, 64 nt, hsa; identical to SEQ ID NO: 212671

SEQ ID NO: 495417 - RNA, 64 nt, hsa; identical to SEQ ID NO: 212672

SEQ ID NO: 495418 - RNA, 64 nt, hsa; identical to SEQ ID NO: 212673

SEQ ID NO: 495419 - RNA, 64 nt, hsa; identical to SEQ ID NO: 212674

SEQ ID NO: 495420 - RNA, 64 nt, hsa; identical to SEQ ID NO: 212675

SEQ ID NO: 495421 - RNA, 64 nt, hsa; identical to SEQ ID NO: 212676

SEQ ID NO: 495422 - RNA, 64 nt, hsa; identical to SEQ ID NO: 212677

SEQ ID NO: 495423 - RNA, 64 nt, hsa; identical to SEQ ID NO: 212678

SEQ ID NO: 495424 - RNA, 64 nt, hsa; identical to SEQ ID NO: 212679

SEQ ID NO: 495425 - RNA, 64 nt, hsa; identical to SEQ ID NO: 53018

SEQ ID NO: 495426 - RNA, 64 nt, hsa; identical to SEQ ID NO: 53019

SEQ ID NO: 495427 - RNA, 64 nt, hsa; identical to SEQ ID NO: 53020

SEQ ID NO: 495428 - RNA, 64 nt, hsa; identical to SEQ ID NO: 53021

SEQ ID NO: 495429 - RNA, 64 nt, hsa; identical to SEQ ID NO: 53022

SEQ ID NO: 495430 - RNA, 64 nt, hsa; identical to SEQ ID NO: 53023

SEQ ID NO: 495431 - RNA, 64 nt, hsa; identical to SEQ ID NO: 53024

SEQ ID NO: 495432 - RNA, 64 nt, hsa; identical to SEQ ID NO: 53025

SEQ ID NO: 495433 - RNA, 64 nt, hsa; identical to SEQ ID NO: 53026

SEQ ID NO: 495434 - RNA, 64 nt, hsa; identical to SEQ ID NO: 53027

SEQ ID NO: 495435 - RNA, 64 nt, hsa; identical to SEQ ID NO: 53028

SEQ ID NO: 495436 - RNA, 64 nt, hsa; identical to SEQ ID NO: 53029

SEQ ID NO: 495437 - RNA, 64 nt, hsa; identical to SEQ ID NO: 53030

SEQ ID NO: 495438 - RNA, 64 nt, hsa; identical to SEQ ID NO: 53031

SEQ ID NO: 495439 - RNA, 64 nt, hsa; identical to SEQ ID NO: 53032

SEQ ID NO: 495440 - RNA, 64 nt, hsa; identical to SEQ ID NO: 53033

SEQ ID NO: 495441 - RNA, 64 nt, hsa; identical to SEQ ID NO: 53034

SEQ ID NO: 495442 - RNA, 64 nt, hsa; identical to SEQ ID NO: 53035

SEQ ID NO: 495443 - RNA, 64 nt, hsa; identical to SEQ ID NO: 53036

SEQ ID NO: 495444 - RNA, 64 nt, hsa; identical to SEQ ID NO: 53037

SEQ ID NO: 495445 - RNA, 64 nt, hsa; identical to SEQ ID NO: 53038

SEQ ID NO: 495446 - RNA, 64 nt, hsa; identical to SEQ ID NO: 53039

SEQ ID NO: 495447 - RNA, 64 nt, hsa; identical to SEQ ID NO: 53040

SEQ ID NO: 495448 - RNA, 64 nt, hsa; identical to SEQ ID NO: 53041

SEQ ID NO: 495449 - RNA, 64 nt, hsa; identical to SEQ ID NO: 53042

SEQ ID NO: 495450 - RNA, 64 nt, hsa; identical to SEQ ID NO: 53043

SEQ ID NO: 495451 - RNA, 64 nt, hsa; identical to SEQ ID NO: 53044

SEQ ID NO: 495452 - RNA, 64 nt, hsa; identical to SEQ ID NO: 53045

SEQ ID NO: 495453 - RNA, 64 nt, hsa; identical to SEQ ID NO: 53046

SEQ ID NO: 495454 - RNA, 64 nt, hsa; identical to SEQ ID NO: 53047

SEQ ID NO: 495455 - RNA, 64 nt, hsa; identical to SEQ ID NO: 53048

SEQ ID NO: 495456 - RNA, 64 nt, hsa; identical to SEQ ID NO: 53049

SEQ ID NO: 495457 - RNA, 64 nt, hsa; identical to SEQ ID NO: 53050

SEQ ID NO: 495458 - RNA, 64 nt, hsa; identical to SEQ ID NO: 53051

SEQ ID NO: 495459 - RNA, 64 nt, hsa; identical to SEQ ID NO: 53052

SEQ ID NO: 495460 - RNA, 64 nt, hsa; identical to SEQ ID NO: 53053

SEQ ID NO: 495461 - RNA, 64 nt, hsa; identical to SEQ ID NO: 53054

SEQ ID NO: 495462 - RNA, 64 nt, hsa; identical to SEQ ID NO: 53055

SEQ ID NO: 495463 - RNA, 64 nt, hsa; identical to SEQ ID NO: 53056

SEQ ID NO: 495464 - RNA, 64 nt, hsa; identical to SEQ ID NO: 53057

SEQ ID NO: 495465 - RNA, 64 nt, hsa; identical to SEQ ID NO: 53058

SEQ ID NO: 495466 - RNA, 64 nt, hsa; identical to SEQ ID NO: 53059

SEQ ID NO: 495467 - RNA, 64 nt, hsa
uaaaauguuagaggaaacuuucacaugaauaauuuuugucaaauuuuaucaugguauaauuugu

SEQ ID NO: 495468 - RNA, 64 nt, hsa
aaaaauaaaaagaaauuacaaaagaaauuauggauuugucaauguaaguauuugucauaucuga

SEQ ID NO: 495469 - RNA, 64 nt, hsa
uuugucaaacagcucuuugugccccuaucuuuguuuugucaaauguagaucaguuaauaaacau

SEQ ID NO: 495470 - RNA, 64 nt, hsa
ggggaauacuauuguucgauaccugggauuugacuuugucaaacagcucuuugugccccuaucu

SEQ ID NO: 495471 - RNA, 64 nt, hsa
uuaagaugucuguaaauuuaacuuuuauuaaaguuuugucaaucuuugugaaauagugguugug

SEQ ID NO: 495472 - RNA, 64 nt, hsa
cuuucuuagucacaacaaaaucacacaugucaucuuugucaagggcauaaauauaucauucaua

SEQ ID NO: 495473 - RNA, 64 nt, hsa
aaacugcuggaaguucuuccacagucaggucaauuuugucaaacccuucucuguacccauacag

SEQ ID NO: 495474 - RNA, 64 nt, hsa
uguuccaauacucguuuugccucuauuuuucuuguuugucaaauaguaaaugauauuugcccuu

SEQ ID NO: 495475 - RNA, 64 nt, hsa
cugccagugguaauacgauuuuuuaagaaggcaguuugucaauuuuaaucuuguggauaccuuu

SEQ ID NO: 495476 - RNA, 64 nt, hsa
aaauguuuucacuguaggaaucacaaaauaaguuuuugucaaaauaacuguuguugaacguuau

SEQ ID NO: 495477 - RNA, 64 nt, hsa
auauguacagaagaaaaaaaguugaucauagcuuuuugucaaguagcauguuucccauucacag

SEQ ID NO: 495478 - RNA, 64 nt, hsa
ggagauuucuuguugcucaaaaaaugagcucgcauuugucaaugacaguuucuuuuuucuuacu

SEQ ID NO: 495479 - RNA, 64 nt, hsa
gauauuccccccacuuaagacuguguauucuaguuuugucaaacuguagaaaugaugaugugga

SEQ ID NO: 495480 - RNA, 64 nt, hsa
ggaaaccacaauuugucaaauauguuugccauaauuugucaauaaagcugaaaacuuuuguaaa

SEQ ID NO: 495481 - RNA, 64 nt, hsa
ccauguguaagcuucucuaaauaggaaaccacaauuugucaaauauguuugccauaauuuguca

SEQ ID NO: 495482 - RNA, 64 nt, hsa
uguuaaaacauaaacacauuuccauucauggauauuugucaacagauuuaaagaaaaccacagu

SEQ ID NO: 495483 - RNA, 64 nt, hsa
ucucagguucaaggcuacaacaaaaaucaccaucuuugucaaacuuuggagagggaaaaucuuc

SEQ ID NO: 495484 - RNA, 64 nt, hsa
cucgucggaguugggcaaggggccgcuggcugccuuugucaaaacuaagguaaccauuuggacc

SEQ ID NO: 495485 - RNA, 64 nt, hsa
ccucgugggagaccugcgccagaggauggacaaguuugucaagaaucgaggggcacaggagauu

SEQ ID NO: 495486 - RNA, 64 nt, hsa
guacaaaauguaaaauguauaagucaucucacuuuuugucaagacauuaaaccaucuuagaucg

SEQ ID NO: 495487 - RNA, 64 nt, hsa
aaaaaguuacauggagcuuuacaucuuaacuuucuuugucaauuuaaaugcaauguauaaaaag

SEQ ID NO: 495488 - RNA, 64 nt, hsa
gguuugucaacacaaagacauggaagauuagagguuugucaacacaaagacacaggaagaaugg

SEQ ID NO: 495489 - RNA, 64 nt, hsa
gagguuugucaacaaaaagacauggaagguuagguuugucaacacaaagacauggaagauuaga

SEQ ID NO: 495490 - RNA, 64 nt, hsa
gguuugucaacacaaagacauggaagguuagagguuugucaacaaaaagacauggaagguuagg

SEQ ID NO: 495491 - RNA, 64 nt, hsa
ugggauagggucagaugcaccacccauggagagguuugucaacacaaagacauggaagguuaga

SEQ ID NO: 495492 - RNA, 64 nt, hsa
uuuuuagacagcaaaaacuaucugaagauuuccauuugucaaaaaguaaugauuucuugauaau

SEQ ID NO: 495493 - RNA, 64 nt, hsa
uaauuuauauuccauuuacauaaggauacacuuauuugucaagcucagcacaaucuguaaauuu

SEQ ID NO: 495494 - RNA, 64 nt, hsa
agcaggacuucagaaagggccuuguguuuauagcuuugucaaguaaauuuggacgcagcuggag

SEQ ID NO: 495495 - RNA, 64 nt, hsa
cauaugcacacacaugugcaaacauagccacuuuuuugucaagaguuacccuuuggggcuccuu

SEQ ID NO: 495496 - RNA, 64 nt, hsa
ucuuauccuaguauuugggaagagaaggaauaaauuugucaaaacuaggugagaaaauagagca

SEQ ID NO: 495497 - RNA, 64 nt, hsa
cauggcagcaagugucaugcaguuauuuucugaauuugucaaagaggcaguaguuucuaacccc

SEQ ID NO: 495498 - RNA, 64 nt, hsa
cuugcaagcacuugauaucucuccucuugcugacuuugucaacauagacauauagugaaaugau

SEQ ID NO: 495499 - RNA, 64 nt, hsa
ugauagucaaggcucuuagucucauuuuuuacucuuugucaagagaaauggaaaauaagaguac

SEQ ID NO: 495500 - RNA, 64 nt, hsa; identical to SEQ ID NO: 105615

SEQ ID NO: 495501 - RNA, 64 nt, hsa; identical to SEQ ID NO: 105616

SEQ ID NO: 495502 - RNA, 64 nt, hsa; identical to SEQ ID NO: 105617

SEQ ID NO: 495503 - RNA, 64 nt, hsa; identical to SEQ ID NO: 105618

SEQ ID NO: 495504 - RNA, 64 nt, hsa; identical to SEQ ID NO: 105619

SEQ ID NO: 495505 - RNA, 64 nt, hsa; identical to SEQ ID NO: 105620

SEQ ID NO: 495506 - RNA, 64 nt, hsa; identical to SEQ ID NO: 105621

SEQ ID NO: 495507 - RNA, 64 nt, hsa; identical to SEQ ID NO: 105622

SEQ ID NO: 495508 - RNA, 64 nt, hsa; identical to SEQ ID NO: 105623

SEQ ID NO: 495509 - RNA, 64 nt, hsa; identical to SEQ ID NO: 105624

SEQ ID NO: 495510 - RNA, 64 nt, hsa
uuuuuuucuuucuaugguagugggguuuacuucugaggauaaaauauuuugaaaaagcucuguc

SEQ ID NO: 495511 - RNA, 64 nt, hsa
uacugugagccaaugccuuuuggaaguaaugguggaggauaauaugauuaaagggaacaugcuu

SEQ ID NO: 495512 - RNA, 62 nt, hsa
gaucuguugccuaaacuaaagcuuaaaaguuuaguaaaaaucgucugggcacaguggcucac

SEQ ID NO: 495513 - RNA, 62 nt, hsa
caagacucugucucaaaaaaaaaaaaaaauuuaguaaaaaucaaugguaagcuaaaauaagu

SEQ ID NO: 495514 - RNA, 62 nt, hsa
aauggaaauugguaaauggacaaaagcuagcuaguaaaaaggacgacccagcaacaugcuuu

SEQ ID NO: 495515 - RNA, 62 nt, hsa
ugcccuuaaacccauuuagaaaauaacuacaaaguaaaaauguagaggaaauagaaauguau

SEQ ID NO: 495516 - RNA, 62 nt, hsa
cuaaagguauuugauuugaucuguuagcuuccaguaaaaauauuuguuuuuaguaaaaacaa

SEQ ID NO: 495517 - RNA, 62 nt, hsa
ucuguuagcuuccaguaaaaauauuuguuuuuaguaaaaacaaauuuaaauauauuuacaug

SEQ ID NO: 495518 - RNA, 62 nt, hsa
uuacacccagagcagauacucauaaaguauaaaguaaaaacuuuuaaccauuauuaaacaga

SEQ ID NO: 495519 - RNA, 62 nt, hsa
gauauacauagucauuuuuccucuaugguagaaguaaaaaaaaaaaaaaaggacauagcaac

SEQ ID NO: 495520 - RNA, 62 nt, hsa
gaaaauagauaccaugguuugugcaauuauguaguaaaaaaggcaaaucuuuucaccucugg

SEQ ID NO: 495521 - RNA, 62 nt, hsa
augauuaugcuuuguggcuauccaucaacauaaguaaaaaaaaaaaaaaaacacuucaacuc

SEQ ID NO: 495522 - RNA, 62 nt, hsa
guuuucuauccuccuucaguguuaaaguagaaaguaaaaagaguaucuuauacaugcaugaa

SEQ ID NO: 495523 - RNA, 62 nt, hsa
caaugguaaguaucuaaacauagaaaagggacaguaaaaauaugguuuuauaaucuucuggg

SEQ ID NO: 495524 - RNA, 62 nt, hsa
ggcauaaccaaaaaagcaaaacuuguaaacagaguaaaaaucuuuaauauuucuaaagacau

SEQ ID NO: 495525 - RNA, 62 nt, hsa
ggaauacuaaggacaauuauuuuuauagacaaaguaaaaagacagauauuuaagaggcauaa

SEQ ID NO: 495526 - RNA, 62 nt, hsa
cagagaaggcauguggauuauaagauuugucuaguaaaaauuguaauugaauauguuuaaau

SEQ ID NO: 495527 - RNA, 62 nt, hsa
uuuaaauauaaugcaucuuccuuugucugcuuaguaaaaaauuucauuucauaauuuuggca

SEQ ID NO: 495528 - RNA, 62 nt, hsa
uugcagcugauuccaguuuauaauagaucccuaguaaaaagcuuugauucaacacaauuguu

SEQ ID NO: 495529 - RNA, 62 nt, hsa
aaaccaaguuuacuucaguauguuaaugauguaguaaaaauauuuauugaaaggugaauucg

SEQ ID NO: 495530 - RNA, 62 nt, hsa
aauauauuaaaaauauaaacaauguucaggagaguaaaaauucauauaaagugcaauugcac

SEQ ID NO: 495531 - RNA, 62 nt, hsa
cacuuaaauccaguggggaaaaaaagguuaacaguaaaaauuucuuccacguaauucaauuu

SEQ ID NO: 495532 - RNA, 62 nt, hsa
aauuguaccacuccuugaagaacuacaggcacaguaaaaaaaauauggcguauuaugugaac

SEQ ID NO: 495533 - RNA, 62 nt, hsa
aauauuuguguaucuaaauauagaaaagguacaguaaaaauauggucuacuaaggaaacacu

SEQ ID NO: 495534 - RNA, 62 nt, hsa
cauuuuaagaaaaaggugaaaaucauuuggggaguaaaaaaaugaaaaagcugaaacgagua

SEQ ID NO: 495535 - RNA, 62 nt, hsa
uacaucugugaaaaagauaaugugaaauaaacaguaaaaaaaaaaaguauguugauggcagu

SEQ ID NO: 495536 - RNA, 62 nt, hsa
uggaccaccaggaaggucguuucacauucuguaguaaaaauaccccuacaaucauuuuggua

SEQ ID NO: 495537 - RNA, 62 nt, hsa
uugauuggugauuagguggugguagagaagcaaguaaaaaggcuaaauggaagggcaaguuu

SEQ ID NO: 495538 - RNA, 62 nt, hsa
uuuuaaaauacauuguauauauguguaugcacaguaaaaauggaaacuauauugaccuaaau

SEQ ID NO: 495539 - RNA, 62 nt, hsa
gaaguucuauaacaauuauguuucaugcuuaaaguaaaaauucccagaguuuaguuuagaaa

SEQ ID NO: 495540 - RNA, 62 nt, hsa
auuuacugaugcuuuauguuaccaaaacauacaguaaaaaaguagaaauuuaugaaauacuu

SEQ ID NO: 495541 - RNA, 62 nt, hsa
uuucuuuucuauuguagaaggaaauaaauaggaguaaaaagaccauuguaguaaauaaguuc

SEQ ID NO: 495542 - RNA, 62 nt, hsa
guguuuauacugcaccuugguuguugaugucaaguaaaaaaaagauuguuuuguaacacaua

SEQ ID NO: 495543 - RNA, 62 nt, hsa
uaaagaauuguauugaauucuuuuuagaucaaaguaaaaauaggucagcagagauuucaguu

SEQ ID NO: 495544 - RNA, 62 nt, hsa
uaaagaauuguacugaauucuuuuuagaucacaguaaaaauagguuggcagagauuucaguu

SEQ ID NO: 495545 - RNA, 62 nt, hsa
uucuaucuucccaauaacccagagguacaucaaguaaaaacacuuuugcaaagagccaguca

SEQ ID NO: 495546 - RNA, 62 nt, hsa
guucuauaagugaaaagcauuauguacuugaaaguaaaaaucagggcaauauaagacuuaau

SEQ ID NO: 495547 - RNA, 62 nt, hsa
uauguggaagcuaaaaaaauugauaucauagaaguaaaaaauaaaacagaggauacuacagg

SEQ ID NO: 495548 - RNA, 62 nt, hsa
ugagacucugucucuacaaaaaaauuuuaaaaaguaaaaauuagcugggcgugguggcacau

SEQ ID NO: 495549 - RNA, 62 nt, hsa
ccaacaauucaugagcaacaguauauacacugaguaaaaauauaaaauaguaaaauuucacu

SEQ ID NO: 495550 - RNA, 62 nt, hsa
uuuaacauuuuguccucuuuucagugaaacagaguaaaaauauucaucuaccauuacuguua

SEQ ID NO: 495551 - RNA, 62 nt, hsa
aaaggacaugcccacugaauucagguccuuugaguaaaaaaaaaaucuucugcugcacauuu

SEQ ID NO: 495552 - RNA, 62 nt, hsa
aacgaauccuccuacuugagacacuguagaaaaguaaaaauuguugcuucuguuuuguuuua

SEQ ID NO: 495553 - RNA, 62 nt, hsa
guugggaauaaagggguagcccgacagugguaaguaaaaauguaguacuccauuguuuuugc

SEQ ID NO: 495554 - RNA, 62 nt, hsa
uuuggaaagaaguucauugaagauaaagcaaaaguaaaaaaaaaaaaaaaaaaaacaagggg

SEQ ID NO: 495555 - RNA, 62 nt, hsa
uuccagcuauggagcuagcuuuaaaaaggaacaguaaaaauauuaaucgguuagcugggugg

SEQ ID NO: 495556 - RNA, 62 nt, hsa
ccacacccggcacaucuucauucuuuuuauguaguaaaaaguauaaggccacacaugguuua

SEQ ID NO: 495557 - RNA, 62 nt, hsa
guaaagucauauaaaagguuauaccacuauuuaguaaaaaguuuuaguuuggugcuguuaau

SEQ ID NO: 495558 - RNA, 62 nt, hsa
caaagcuuuaaauauaaauuucagagugcuucaguaaaaagcuacuauauauuguuguuugu

SEQ ID NO: 495559 - RNA, 62 nt, hsa
guaaggauuucuuuaaauagcauuuuugcaccaguaaaaauagauaacuuagaacucagucu

SEQ ID NO: 495560 - RNA, 62 nt, hsa
cagucacauuagguaugucaucaucuuuagucaguaaaaaccuuguaaugaggaguaguaaa

SEQ ID NO: 495561 - RNA, 62 nt, hsa
cugcuguccuuuuaggaauauguucaaugcaaaguaaaaaaauaugaauuguccccaauccc

SEQ ID NO: 495562 - RNA, 62 nt, hsa
aauaacuaaugcuaagaaaugcugaaaaucaaaguaaaaaauuaaagcccauaaggccagaa

SEQ ID NO: 495563 - RNA, 62 nt, hsa
gggacauccagucccuuugauagauaaugcugaguaaaaaaugagaugaaagacauuuguuu

SEQ ID NO: 495564 - RNA, 62 nt, hsa
ucuuuaugauauuguauuucucuaccucuaacaguaaaaauuccauucaacccuuaaagcuc

SEQ ID NO: 495565 - RNA, 62 nt, hsa
cuuuugaagaauuuauauuuggaaaguaaaaaaguaaaaaaauaaaucauccaacuucuuug

SEQ ID NO: 495566 - RNA, 62 nt, hsa
ucuacugucuuuugaagaauuuauauuuggaaaguaaaaaaguaaaaaaauaaaucauccaa

SEQ ID NO: 495567 - RNA, 62 nt, hsa
ccucuaucucuguacuccuauaugaagagaacaguaaaaaaaauuacugguauuuauuuggu

SEQ ID NO: 495568 - RNA, 62 nt, hsa
gcaaagcaaaacaauaaacuagcagaagaacuaguaaaaauacaagcagauuccucuacuga

SEQ ID NO: 495569 - RNA, 62 nt, hsa
guuuggaagaagaacaagaauuccacaugagaaguaaaaacaguuuacaguacucagcaaaa

SEQ ID NO: 495570 - RNA, 62 nt, hsa
uugugggguaauugcuuaaauuuacauaucaaaguaaaaaaguagugccuguauuccaugug

SEQ ID NO: 495571 - RNA, 62 nt, hsa
gguagagaguguugaaauucaauaccaaauacaguaaaaacaaauguaaauaaaagaaaaca

SEQ ID NO: 495572 - RNA, 62 nt, hsa
acuaaugucuuuuauuuauuauauuaugauaaaguaaaaauuucacuugcauuaagucuaaa

SEQ ID NO: 495573 - RNA, 62 nt, hsa
cagucaaucagauaagaaguauacuuugauuaaguaaaaaaaaucccuauucuuggaaaaua

SEQ ID NO: 495574 - RNA, 62 nt, hsa
aaagguuguggaaauguuucagauuaaaugauaguaaaaacaccugacaacuaaacauagua

SEQ ID NO: 495575 - RNA, 62 nt, hsa
aauuuauagacaguuaaauuuauagacaguuaaguaaaaauggauaauuuauagacagauaa

SEQ ID NO: 495576 - RNA, 62 nt, hsa
acauauuagugacuugaaucuucauaaguuaaaguaaaaaacagcaaaaaaccuagaucuuu

SEQ ID NO: 495577 - RNA, 62 nt, hsa
aaaaaacacuguggauaaugacaaaaagcauaaguaaaaauauuugagaaaaauaaaguaca

SEQ ID NO: 495578 - RNA, 62 nt, hsa
uguguaaaacugucccugcagauugagcaggaaguaaaaacaaauggaaaugcuucggauag

SEQ ID NO: 495579 - RNA, 62 nt, hsa
uuuggaacuuucuguaucucuuaggaggaacaaguaaaaaccaaaugguuacauugugcugc

SEQ ID NO: 495580 - RNA, 62 nt, hsa
aguaaaaaugaauuacacuguaucuuauaugaaguaaaaaauaaaucagaggugagaauauu

SEQ ID NO: 495581 - RNA, 62 nt, hsa
guacuguuuagaugggagaaaccucuagagagaguaaaaaugaauuacacuguaucuuauau

SEQ ID NO: 495582 - RNA, 62 nt, hsa
gugucucaggauagcacaggccaagguaggggaguaaaaaggaggucaggcaaaagggagga

SEQ ID NO: 495583 - RNA, 62 nt, hsa
gcgacugcugauuuaccgauguauuuaauguaaguaaaaaaaggaaaaaaagaaaagggcau

SEQ ID NO: 495584 - RNA, 62 nt, hsa
aaucuugaaugauacgauuaugcccaauauuaaguaaaaaauauaagaaaagguuaucuuaa

SEQ ID NO: 495585 - RNA, 62 nt, hsa
augccuucaucuguucagucaucuccaaaaacaguaaaaauaaccacuuuuuguugggcaau

SEQ ID NO: 495586 - RNA, 62 nt, hsa
cauauuguaagaacuguuaauaaaaguugucaaguaaaaagcgcuauaucuaaaaagacuuu

SEQ ID NO: 495587 - RNA, 62 nt, hsa
aaauaaguguaucagcagguuuuaucaugaucaguaaaaauguuccaaaugcuucugcucca

SEQ ID NO: 495588 - RNA, 62 nt, hsa
ucuuucuagauuuuugaaaucaaaaaguuuucaguaaaaaguuucuuacuuuauuuuauuau

SEQ ID NO: 495589 - RNA, 62 nt, hsa
aaaguuucuuacuuuauuuuauuauauuagguaguaaaaaauguaggguuauuuaccauaac

SEQ ID NO: 495590 - RNA, 62 nt, hsa
uucccuuuguguuaauaauuuaguuuuaagacaguaaaaauaaacguguuuauauugaaugg

SEQ ID NO: 495591 - RNA, 62 nt, hsa
guauaaauguuuuuaaguauaaauccuacuagaguaaaaauuaggugugaaaauaggaaaau

SEQ ID NO: 495592 - RNA, 62 nt, hsa
cagccuggucaacauggugaaaucuugucucuaguaaaaauacaaaaauauaugaaaucuca

SEQ ID NO: 495593 - RNA, 62 nt, hsa
caaguucccuucucuuugccagccauguguacaguaaaaagcaggcaacauagugucagcca

SEQ ID NO: 495594 - RNA, 61 nt, hsa
gacuaauacucuuuuugucgcauuauauacccaguaaaaaagaaaagagaacauaagcaaa

SEQ ID NO: 495595 - RNA, 62 nt, hsa
cauuuuucuguucauauauacaugcgugucucaguaaaaauuauaaaaugggggauaauuau

SEQ ID NO: 495596 - RNA, 62 nt, hsa
aaaaccaaaauuauaggauuuuuuucuuuuuuaguaaaaaccuguauaaaaaccaaaauuau

SEQ ID NO: 495597 - RNA, 62 nt, hsa
aaaaaccaaaauuauaggauuuuuucuuuuuuaguaaaaaccuauaugaaaaccaaaauuau

SEQ ID NO: 495598 - RNA, 62 nt, hsa
aaaaccaaaauuauaggauuuuuuucuuuuuuaguaaaaaccuauauaaaaaccaaaauuau

SEQ ID NO: 495599 - RNA, 62 nt, hsa
aaaaaccaaaauuauaggauuuuuucuuuuuuaguaaaaaccgguaucaaaaccaaaauuau

SEQ ID NO: 495600 - RNA, 62 nt, hsa
uaaauauuucggggguaauagagccacuggugaguaaaaaccuauauaaaaaccaaaauuau

SEQ ID NO: 495601 - RNA, 62 nt, hsa
acuucaggaaguaaaauuauuugaaguuucuuaguaaaaaguaauuagguauaauuccaaau

SEQ ID NO: 495602 - RNA, 62 nt, hsa
ucgaagauuuuuuaaaaauaauauuguuaaucaguaaaaaaaaaaaauauuuuugaucuaaa

SEQ ID NO: 495603 - RNA, 62 nt, hsa
augaggcuguucaucccagcacugucuaagcuaguaaaaauuggaaacaauuuaaguaucua

SEQ ID NO: 495604 - RNA, 62 nt, hsa
aaagcuauucauuaugcguugugaagucagaaaguaaaaaaggguagauagaaguauucgaa

SEQ ID NO: 495605 - RNA, 64 nt, hsa
uuuuauaacaaagucacggguaucuuuagguucagggaacuagacuaggucauucguguaaaug

SEQ ID NO: 495606 - RNA, 64 nt, hsa
uacagucuuagguuaaaguauucuaaugaaguaugggaacuaaauugcugguuuucuaagauaa

SEQ ID NO: 495607 - RNA, 64 nt, hsa
ugcaucaauuauaccagggauguauaguaagucagggaacuaauauaaaugaugacagucaugg

SEQ ID NO: 495608 - RNA, 64 nt, hsa
augaagucucuuauuucaauuaccuaguguuguugggaacuaauugaacagcuacaguaaaaga

SEQ ID NO: 495609 - RNA, 64 nt, hsa
cauacucacacggggcaggggggagggggaaacggggaacuauagcaauauuuaaagaugcuuu

SEQ ID NO: 495610 - RNA, 64 nt, hsa
gagguaaugucagagcuccaucagcccggacagugggaacuaacuggugcauuccccacacuua

SEQ ID NO: 495611 - RNA, 64 nt, hsa; identical to SEQ ID NO: 167727

SEQ ID NO: 495612 - RNA, 64 nt, hsa; identical to SEQ ID NO: 167728

SEQ ID NO: 495613 - RNA, 64 nt, hsa; identical to SEQ ID NO: 167729

SEQ ID NO: 495614 - RNA, 64 nt, hsa; identical to SEQ ID NO: 167730

SEQ ID NO: 495615 - RNA, 64 nt, hsa; identical to SEQ ID NO: 167731

SEQ ID NO: 495616 - RNA, 64 nt, hsa; identical to SEQ ID NO: 167732

SEQ ID NO: 495617 - RNA, 64 nt, hsa; identical to SEQ ID NO: 167733

SEQ ID NO: 495618 - RNA, 55 nt, hsa; identical to SEQ ID NO: 167734

SEQ ID NO: 495619 - RNA, 64 nt, hsa; identical to SEQ ID NO: 167735

SEQ ID NO: 495620 - RNA, 64 nt, hsa; identical to SEQ ID NO: 167736

SEQ ID NO: 495621 - RNA, 64 nt, hsa; identical to SEQ ID NO: 167737

SEQ ID NO: 495622 - RNA, 64 nt, hsa; identical to SEQ ID NO: 167738

SEQ ID NO: 495623 - RNA, 64 nt, hsa; identical to SEQ ID NO: 167739

SEQ ID NO: 495624 - RNA, 64 nt, hsa; identical to SEQ ID NO: 167740

SEQ ID NO: 495625 - RNA, 64 nt, hsa; identical to SEQ ID NO: 167741

SEQ ID NO: 495626 - RNA, 64 nt, hsa; identical to SEQ ID NO: 167742

SEQ ID NO: 495627 - RNA, 64 nt, hsa; identical to SEQ ID NO: 167743

SEQ ID NO: 495628 - RNA, 64 nt, hsa; identical to SEQ ID NO: 167744

SEQ ID NO: 495629 - RNA, 64 nt, hsa; identical to SEQ ID NO: 167745

SEQ ID NO: 495630 - RNA, 64 nt, hsa; identical to SEQ ID NO: 167746

SEQ ID NO: 495631 - RNA, 64 nt, hsa; identical to SEQ ID NO: 167747

SEQ ID NO: 495632 - RNA, 64 nt, hsa; identical to SEQ ID NO: 167748

SEQ ID NO: 495633 - RNA, 64 nt, hsa; identical to SEQ ID NO: 167749

SEQ ID NO: 495634 - RNA, 64 nt, hsa; identical to SEQ ID NO: 167749

SEQ ID NO: 495635 - RNA, 64 nt, hsa; identical to SEQ ID NO: 167751

SEQ ID NO: 495636 - RNA, 64 nt, hsa; identical to SEQ ID NO: 167752

SEQ ID NO: 495637 - RNA, 64 nt, hsa; identical to SEQ ID NO: 165166

SEQ ID NO: 495638 - RNA, 64 nt, hsa; identical to SEQ ID NO: 165167

SEQ ID NO: 495639 - RNA, 64 nt, hsa; identical to SEQ ID NO: 165168

SEQ ID NO: 495640 - RNA, 64 nt, hsa; identical to SEQ ID NO: 165169

SEQ ID NO: 495641 - RNA, 64 nt, hsa; identical to SEQ ID NO: 165170

SEQ ID NO: 495642 - RNA, 64 nt, hsa; identical to SEQ ID NO: 165171

SEQ ID NO: 495643 - RNA, 64 nt, hsa; identical to SEQ ID NO: 165172

SEQ ID NO: 495644 - RNA, 64 nt, hsa; identical to SEQ ID NO: 165173

SEQ ID NO: 495645 - RNA, 64 nt, hsa; identical to SEQ ID NO: 165174

SEQ ID NO: 495646 - RNA, 64 nt, hsa; identical to SEQ ID NO: 165175

SEQ ID NO: 495647 - RNA, 64 nt, hsa; identical to SEQ ID NO: 165176

SEQ ID NO: 495648 - RNA, 64 nt, hsa; identical to SEQ ID NO: 165177

SEQ ID NO: 495649 - RNA, 64 nt, hsa; identical to SEQ ID NO: 165178

SEQ ID NO: 495650 - RNA, 64 nt, hsa; identical to SEQ ID NO: 165179

SEQ ID NO: 495651 - RNA, 64 nt, hsa; identical to SEQ ID NO: 165180

SEQ ID NO: 495652 - RNA, 64 nt, hsa; identical to SEQ ID NO: 165181

SEQ ID NO: 495653 - RNA, 64 nt, hsa; identical to SEQ ID NO: 165182

SEQ ID NO: 495654 - RNA, 64 nt, hsa; identical to SEQ ID NO: 165183

SEQ ID NO: 495655 - RNA, 64 nt, hsa; identical to SEQ ID NO: 347916

SEQ ID NO: 495656 - RNA, 64 nt, hsa; identical to SEQ ID NO: 347917

SEQ ID NO: 495657 - RNA, 64 nt, hsa; identical to SEQ ID NO: 347918

SEQ ID NO: 495658 - RNA, 64 nt, hsa; identical to SEQ ID NO: 347919

SEQ ID NO: 495659 - RNA, 64 nt, hsa; identical to SEQ ID NO: 347920

SEQ ID NO: 495660 - RNA, 64 nt, hsa; identical to SEQ ID NO: 347921

SEQ ID NO: 495661 - RNA, 64 nt, hsa; identical to SEQ ID NO: 347922

SEQ ID NO: 495662 - RNA, 64 nt, hsa; identical to SEQ ID NO: 347923

SEQ ID NO: 495663 - RNA, 64 nt, hsa; identical to SEQ ID NO: 347924

SEQ ID NO: 495664 - RNA, 64 nt, hsa; identical to SEQ ID NO: 347925

SEQ ID NO: 495665 - RNA, 64 nt, hsa; identical to SEQ ID NO: 107849

SEQ ID NO: 495666 - RNA, 64 nt, hsa; identical to SEQ ID NO: 107850

SEQ ID NO: 495667 - RNA, 64 nt, hsa; identical to SEQ ID NO: 107851

SEQ ID NO: 495668 - RNA, 64 nt, hsa; identical to SEQ ID NO: 107852

SEQ ID NO: 495669 - RNA, 64 nt, hsa; identical to SEQ ID NO: 107853

SEQ ID NO: 495670 - RNA, 64 nt, hsa; identical to SEQ ID NO: 107854

SEQ ID NO: 495671 - RNA, 64 nt, hsa; identical to SEQ ID NO: 107855

SEQ ID NO: 495672 - RNA, 64 nt, hsa; identical to SEQ ID NO: 107856

SEQ ID NO: 495673 - RNA, 64 nt, hsa; identical to SEQ ID NO: 107857

SEQ ID NO: 495674 - RNA, 64 nt, hsa; identical to SEQ ID NO: 107858

SEQ ID NO: 495675 - RNA, 64 nt, hsa; identical to SEQ ID NO: 107859

SEQ ID NO: 495676 - RNA, 64 nt, hsa; identical to SEQ ID NO: 107860

SEQ ID NO: 495677 - RNA, 64 nt, hsa; identical to SEQ ID NO: 107861

SEQ ID NO: 495678 - RNA, 64 nt, hsa; identical to SEQ ID NO: 107862

SEQ ID NO: 495679 - RNA, 64 nt, hsa; identical to SEQ ID NO: 107863

SEQ ID NO: 495680 - RNA, 63 nt, hsa; identical to SEQ ID NO: 107864

SEQ ID NO: 495681 - RNA, 64 nt, hsa; identical to SEQ ID NO: 107865

SEQ ID NO: 495682 - RNA, 64 nt, hsa; identical to SEQ ID NO: 107866

SEQ ID NO: 495683 - RNA, 64 nt, hsa; identical to SEQ ID NO: 107867

SEQ ID NO: 495684 - RNA, 64 nt, hsa; identical to SEQ ID NO: 107868

SEQ ID NO: 495685 - RNA, 64 nt, hsa; identical to SEQ ID NO: 107869

SEQ ID NO: 495686 - RNA, 64 nt, hsa; identical to SEQ ID NO: 107870

SEQ ID NO: 495687 - RNA, 64 nt, hsa; identical to SEQ ID NO: 107871

SEQ ID NO: 495688 - RNA, 64 nt, hsa; identical to SEQ ID NO: 107872

SEQ ID NO: 495689 - RNA, 64 nt, hsa; identical to SEQ ID NO: 107873

SEQ ID NO: 495690 - RNA, 64 nt, hsa; identical to SEQ ID NO: 107874

SEQ ID NO: 495691 - RNA, 64 nt, hsa; identical to SEQ ID NO: 107875

SEQ ID NO: 495692 - RNA, 64 nt, hsa; identical to SEQ ID NO: 107876

SEQ ID NO: 495693 - RNA, 64 nt, hsa; identical to SEQ ID NO: 107877

SEQ ID NO: 495694 - RNA, 64 nt, hsa; identical to SEQ ID NO: 107878

SEQ ID NO: 495695 - RNA, 64 nt, hsa; identical to SEQ ID NO: 107879

SEQ ID NO: 495696 - RNA, 64 nt, hsa; identical to SEQ ID NO: 107880

SEQ ID NO: 495697 - RNA, 64 nt, hsa; identical to SEQ ID NO: 107881

SEQ ID NO: 495698 - RNA, 64 nt, hsa; identical to SEQ ID NO: 107882

SEQ ID NO: 495699 - RNA, 64 nt, hsa; identical to SEQ ID NO: 107883

SEQ ID NO: 495700 - RNA, 64 nt, hsa; identical to SEQ ID NO: 107884

SEQ ID NO: 495701 - RNA, 64 nt, hsa; identical to SEQ ID NO: 107885

SEQ ID NO: 495702 - RNA, 64 nt, hsa; identical to SEQ ID NO: 107886

SEQ ID NO: 495703 - RNA, 64 nt, hsa; identical to SEQ ID NO: 107887

SEQ ID NO: 495704 - RNA, 64 nt, hsa; identical to SEQ ID NO: 107888

SEQ ID NO: 495705 - RNA, 64 nt, hsa; identical to SEQ ID NO: 107889

SEQ ID NO: 495706 - RNA, 64 nt, hsa; identical to SEQ ID NO: 107890

SEQ ID NO: 495707 - RNA, 64 nt, hsa; identical to SEQ ID NO: 107891

SEQ ID NO: 495708 - RNA, 64 nt, hsa; identical to SEQ ID NO: 107892

SEQ ID NO: 495709 - RNA, 64 nt, hsa; identical to SEQ ID NO: 107893

SEQ ID NO: 495710 - RNA, 64 nt, hsa; identical to SEQ ID NO: 107894

SEQ ID NO: 495711 - RNA, 64 nt, hsa; identical to SEQ ID NO: 107895

SEQ ID NO: 495712 - RNA, 64 nt, hsa; identical to SEQ ID NO: 107896

SEQ ID NO: 495713 - RNA, 64 nt, hsa; identical to SEQ ID NO: 107897

SEQ ID NO: 495714 - RNA, 64 nt, hsa; identical to SEQ ID NO: 107898

SEQ ID NO: 495715 - RNA, 64 nt, hsa; identical to SEQ ID NO: 107899

SEQ ID NO: 495716 - RNA, 64 nt, hsa; identical to SEQ ID NO: 107900

SEQ ID NO: 495717 - RNA, 64 nt, hsa; identical to SEQ ID NO: 107901

SEQ ID NO: 495718 - RNA, 64 nt, hsa; identical to SEQ ID NO: 107902

SEQ ID NO: 495719 - RNA, 64 nt, hsa; identical to SEQ ID NO: 107903

SEQ ID NO: 495720 - RNA, 64 nt, hsa; identical to SEQ ID NO: 107904

SEQ ID NO: 495721 - RNA, 64 nt, hsa; identical to SEQ ID NO: 107905

SEQ ID NO: 495722 - RNA, 64 nt, hsa; identical to SEQ ID NO: 107906

SEQ ID NO: 495723 - RNA, 64 nt, hsa; identical to SEQ ID NO: 107907

SEQ ID NO: 495724 - RNA, 64 nt, hsa; identical to SEQ ID NO: 107908

SEQ ID NO: 495725 - RNA, 64 nt, hsa; identical to SEQ ID NO: 107909

SEQ ID NO: 495726 - RNA, 64 nt, hsa; identical to SEQ ID NO: 107910

SEQ ID NO: 495727 - RNA, 64 nt, hsa; identical to SEQ ID NO: 107911

SEQ ID NO: 495728 - RNA, 64 nt, hsa; identical to SEQ ID NO: 107912

SEQ ID NO: 495729 - RNA, 64 nt, hsa; identical to SEQ ID NO: 107913

SEQ ID NO: 495730 - RNA, 64 nt, hsa; identical to SEQ ID NO: 107914

SEQ ID NO: 495731 - RNA, 64 nt, hsa; identical to SEQ ID NO: 107915

SEQ ID NO: 495732 - RNA, 64 nt, hsa; identical to SEQ ID NO: 107916

SEQ ID NO: 495733 - RNA, 64 nt, hsa; identical to SEQ ID NO: 107917

SEQ ID NO: 495734 - RNA, 64 nt, hsa; identical to SEQ ID NO: 107918

SEQ ID NO: 495735 - RNA, 64 nt, hsa; identical to SEQ ID NO: 107919

SEQ ID NO: 495736 - RNA, 64 nt, hsa; identical to SEQ ID NO: 107920

SEQ ID NO: 495737 - RNA, 64 nt, hsa; identical to SEQ ID NO: 107921

SEQ ID NO: 495738 - RNA, 64 nt, hsa; identical to SEQ ID NO: 107922

SEQ ID NO: 495739 - RNA, 64 nt, hsa; identical to SEQ ID NO: 107923

SEQ ID NO: 495740 - RNA, 64 nt, hsa; identical to SEQ ID NO: 107924

SEQ ID NO: 495741 - RNA, 64 nt, hsa; identical to SEQ ID NO: 107925

SEQ ID NO: 495742 - RNA, 64 nt, hsa; identical to SEQ ID NO: 107926

SEQ ID NO: 495743 - RNA, 64 nt, hsa; identical to SEQ ID NO: 107927

SEQ ID NO: 495744 - RNA, 64 nt, hsa; identical to SEQ ID NO: 107928

SEQ ID NO: 495745 - RNA, 64 nt, hsa; identical to SEQ ID NO: 107929

SEQ ID NO: 495746 - RNA, 64 nt, hsa; identical to SEQ ID NO: 107930

SEQ ID NO: 495747 - RNA, 64 nt, hsa; identical to SEQ ID NO: 107931

SEQ ID NO: 495748 - RNA, 64 nt, hsa; identical to SEQ ID NO: 107932

SEQ ID NO: 495749 - RNA, 64 nt, hsa; identical to SEQ ID NO: 107933

SEQ ID NO: 495750 - RNA, 64 nt, hsa; identical to SEQ ID NO: 266283

SEQ ID NO: 495751 - RNA, 64 nt, hsa; identical to SEQ ID NO: 266284

SEQ ID NO: 495752 - RNA, 64 nt, hsa; identical to SEQ ID NO: 266285

SEQ ID NO: 495753 - RNA, 64 nt, hsa; identical to SEQ ID NO: 266286

SEQ ID NO: 495754 - RNA, 64 nt, hsa; identical to SEQ ID NO: 266287

SEQ ID NO: 495755 - RNA, 64 nt, hsa; identical to SEQ ID NO: 266288

SEQ ID NO: 495756 - RNA, 64 nt, hsa; identical to SEQ ID NO: 266289

SEQ ID NO: 495757 - RNA, 64 nt, hsa; identical to SEQ ID NO: 266290

SEQ ID NO: 495758 - RNA, 64 nt, hsa; identical to SEQ ID NO: 266291

SEQ ID NO: 495759 - RNA, 64 nt, hsa; identical to SEQ ID NO: 266292

SEQ ID NO: 495760 - RNA, 64 nt, hsa; identical to SEQ ID NO: 266293

SEQ ID NO: 495761 - RNA, 64 nt, hsa; identical to SEQ ID NO: 266294

SEQ ID NO: 495762 - RNA, 64 nt, hsa; identical to SEQ ID NO: 266295

SEQ ID NO: 495763 - RNA, 64 nt, hsa; identical to SEQ ID NO: 266296

SEQ ID NO: 495764 - RNA, 64 nt, hsa; identical to SEQ ID NO: 266297

SEQ ID NO: 495765 - RNA, 64 nt, hsa; identical to SEQ ID NO: 266298

SEQ ID NO: 495766 - RNA, 64 nt, hsa; identical to SEQ ID NO: 266299

SEQ ID NO: 495767 - RNA, 64 nt, hsa; identical to SEQ ID NO: 266300

SEQ ID NO: 495768 - RNA, 64 nt, hsa; identical to SEQ ID NO: 266301

SEQ ID NO: 495769 - RNA, 64 nt, hsa; identical to SEQ ID NO: 266302

SEQ ID NO: 495770 - RNA, 64 nt, hsa; identical to SEQ ID NO: 266303

SEQ ID NO: 495771 - RNA, 64 nt, hsa; identical to SEQ ID NO: 266304

SEQ ID NO: 495772 - RNA, 64 nt, hsa; identical to SEQ ID NO: 266305

SEQ ID NO: 495773 - RNA, 64 nt, hsa; identical to SEQ ID NO: 266306

SEQ ID NO: 495774 - RNA, 64 nt, hsa; identical to SEQ ID NO: 266307

SEQ ID NO: 495775 - RNA, 64 nt, hsa; identical to SEQ ID NO: 266308

SEQ ID NO: 495776 - RNA, 64 nt, hsa; identical to SEQ ID NO: 266309

SEQ ID NO: 495777 - RNA, 64 nt, hsa; identical to SEQ ID NO: 266310

SEQ ID NO: 495778 - RNA, 64 nt, hsa; identical to SEQ ID NO: 266311

SEQ ID NO: 495779 - RNA, 64 nt, hsa; identical to SEQ ID NO: 266312

SEQ ID NO: 495780 - RNA, 64 nt, hsa; identical to SEQ ID NO: 266313

SEQ ID NO: 495781 - RNA, 64 nt, hsa; identical to SEQ ID NO: 266314

SEQ ID NO: 495782 - RNA, 64 nt, hsa; identical to SEQ ID NO: 266315

SEQ ID NO: 495783 - RNA, 64 nt, hsa; identical to SEQ ID NO: 266316

SEQ ID NO: 495784 - RNA, 64 nt, hsa; identical to SEQ ID NO: 266317

SEQ ID NO: 495785 - RNA, 64 nt, hsa; identical to SEQ ID NO: 266318

SEQ ID NO: 495786 - RNA, 64 nt, hsa; identical to SEQ ID NO: 266319

SEQ ID NO: 495787 - RNA, 64 nt, hsa; identical to SEQ ID NO: 266320

SEQ ID NO: 495788 - RNA, 64 nt, hsa; identical to SEQ ID NO: 266321

SEQ ID NO: 495789 - RNA, 64 nt, hsa; identical to SEQ ID NO: 266322

SEQ ID NO: 495790 - RNA, 64 nt, hsa; identical to SEQ ID NO: 266323

SEQ ID NO: 495791 - RNA, 64 nt, hsa; identical to SEQ ID NO: 266324

SEQ ID NO: 495792 - RNA, 64 nt, hsa; identical to SEQ ID NO: 266325

SEQ ID NO: 495793 - RNA, 64 nt, hsa; identical to SEQ ID NO: 266326

SEQ ID NO: 495794 - RNA, 64 nt, hsa; identical to SEQ ID NO: 266327

SEQ ID NO: 495795 - RNA, 64 nt, hsa; identical to SEQ ID NO: 266328

SEQ ID NO: 495796 - RNA, 64 nt, hsa; identical to SEQ ID NO: 266329

SEQ ID NO: 495797 - RNA, 64 nt, hsa; identical to SEQ ID NO: 266330

SEQ ID NO: 495798 - RNA, 64 nt, hsa
ggagcgcaaggcugccgucgaggaggacaccucccugucggagagugaggggccccgccagccc

SEQ ID NO: 495799 - RNA, 64 nt, hsa
gcugguggucuucaaggggcucaugaguaacaaccugucggagcuggacaccaagauccaggag

SEQ ID NO: 495800 - RNA, 64 nt, hsa; identical to SEQ ID NO: 235935

SEQ ID NO: 495801 - RNA, 64 nt, hsa; identical to SEQ ID NO: 235936

SEQ ID NO: 495802 - RNA, 64 nt, hsa; identical to SEQ ID NO: 235937

SEQ ID NO: 495803 - RNA, 64 nt, hsa; identical to SEQ ID NO: 235938

SEQ ID NO: 495804 - RNA, 64 nt, hsa; identical to SEQ ID NO: 235939

SEQ ID NO: 495805 - RNA, 64 nt, hsa; identical to SEQ ID NO: 235940

SEQ ID NO: 495806 - RNA, 64 nt, hsa; identical to SEQ ID NO: 235941

SEQ ID NO: 495807 - RNA, 64 nt, hsa; identical to SEQ ID NO: 235942

SEQ ID NO: 495808 - RNA, 64 nt, hsa; identical to SEQ ID NO: 235943

SEQ ID NO: 495809 - RNA, 64 nt, hsa; identical to SEQ ID NO: 235944

SEQ ID NO: 495810 - RNA, 64 nt, hsa; identical to SEQ ID NO: 235945

SEQ ID NO: 495811 - RNA, 64 nt, hsa; identical to SEQ ID NO: 235946

SEQ ID NO: 495812 - RNA, 64 nt, hsa; identical to SEQ ID NO: 235947

SEQ ID NO: 495813 - RNA, 64 nt, hsa; identical to SEQ ID NO: 235948

SEQ ID NO: 495814 - RNA, 64 nt, hsa; identical to SEQ ID NO: 235949

SEQ ID NO: 495815 - RNA, 64 nt, hsa; identical to SEQ ID NO: 235950

SEQ ID NO: 495816 - RNA, 64 nt, hsa; identical to SEQ ID NO: 235951

SEQ ID NO: 495817 - RNA, 64 nt, hsa; identical to SEQ ID NO: 235952

SEQ ID NO: 495818 - RNA, 64 nt, hsa; identical to SEQ ID NO: 235953

SEQ ID NO: 495819 - RNA, 64 nt, hsa; identical to SEQ ID NO: 235954

SEQ ID NO: 495820 - RNA, 64 nt, hsa; identical to SEQ ID NO: 235955

SEQ ID NO: 495821 - RNA, 64 nt, hsa; identical to SEQ ID NO: 235956

SEQ ID NO: 495822 - RNA, 64 nt, hsa; identical to SEQ ID NO: 235957

SEQ ID NO: 495823 - RNA, 64 nt, hsa; identical to SEQ ID NO: 235958

SEQ ID NO: 495824 - RNA, 64 nt, hsa; identical to SEQ ID NO: 235959

SEQ ID NO: 495825 - RNA, 64 nt, hsa; identical to SEQ ID NO: 235960

SEQ ID NO: 495826 - RNA, 64 nt, hsa; identical to SEQ ID NO: 235961

SEQ ID NO: 495827 - RNA, 64 nt, hsa; identical to SEQ ID NO: 235962

SEQ ID NO: 495828 - RNA, 64 nt, hsa; identical to SEQ ID NO: 235963

SEQ ID NO: 495829 - RNA, 64 nt, hsa; identical to SEQ ID NO: 235964

SEQ ID NO: 495830 - RNA, 64 nt, hsa; identical to SEQ ID NO: 235965

SEQ ID NO: 495831 - RNA, 64 nt, hsa; identical to SEQ ID NO: 235966

SEQ ID NO: 495832 - RNA, 64 nt, hsa; identical to SEQ ID NO: 235967

SEQ ID NO: 495833 - RNA, 64 nt, hsa; identical to SEQ ID NO: 235968

SEQ ID NO: 495834 - RNA, 64 nt, hsa; identical to SEQ ID NO: 235969

SEQ ID NO: 495835 - RNA, 64 nt, hsa; identical to SEQ ID NO: 235970

SEQ ID NO: 495836 - RNA, 64 nt, hsa; identical to SEQ ID NO: 235971

SEQ ID NO: 495837 - RNA, 64 nt, hsa; identical to SEQ ID NO: 235972

SEQ ID NO: 495838 - RNA, 64 nt, hsa; identical to SEQ ID NO: 235973

SEQ ID NO: 495839 - RNA, 64 nt, hsa; identical to SEQ ID NO: 235974

SEQ ID NO: 495840 - RNA, 58 nt, hsa; identical to SEQ ID NO: 235975

SEQ ID NO: 495841 - RNA, 64 nt, hsa; identical to SEQ ID NO: 235976

SEQ ID NO: 495842 - RNA, 64 nt, hsa; identical to SEQ ID NO: 235977

SEQ ID NO: 495843 - RNA, 64 nt, hsa; identical to SEQ ID NO: 235978

SEQ ID NO: 495844 - RNA, 64 nt, hsa; identical to SEQ ID NO: 235979

SEQ ID NO: 495845 - RNA, 64 nt, hsa; identical to SEQ ID NO: 235980

SEQ ID NO: 495846 - RNA, 64 nt, hsa; identical to SEQ ID NO: 235981

SEQ ID NO: 495847 - RNA, 64 nt, hsa; identical to SEQ ID NO: 235981

SEQ ID NO: 495848 - RNA, 64 nt, hsa; identical to SEQ ID NO: 235983

SEQ ID NO: 495849 - RNA, 64 nt, hsa; identical to SEQ ID NO: 235984

SEQ ID NO: 495850 - RNA, 64 nt, hsa; identical to SEQ ID NO: 235985

SEQ ID NO: 495851 - RNA, 64 nt, hsa; identical to SEQ ID NO: 235986

SEQ ID NO: 495852 - RNA, 64 nt, hsa; identical to SEQ ID NO: 235987

SEQ ID NO: 495853 - RNA, 64 nt, hsa; identical to SEQ ID NO: 235988

SEQ ID NO: 495854 - RNA, 64 nt, hsa; identical to SEQ ID NO: 235989

SEQ ID NO: 495855 - RNA, 64 nt, hsa; identical to SEQ ID NO: 235990

SEQ ID NO: 495856 - RNA, 64 nt, hsa; identical to SEQ ID NO: 235991

SEQ ID NO: 495857 - RNA, 64 nt, hsa; identical to SEQ ID NO: 235992

SEQ ID NO: 495858 - RNA, 64 nt, hsa
uuuaucguuuuuguauuuucaugaaaauaccauuuaguaagaauaccacaucaaauaagaaaua

SEQ ID NO: 495859 - RNA, 64 nt, hsa
auuaaggggaagaaugaaagcuguuccuugguccuaguaagaagacaaacugcuucccuuacuu

SEQ ID NO: 495860 - RNA, 64 nt, hsa
gccuuauacaguaguacacuguacuuguuuuuaguaguaagaccuacuuucccacuauauguag

SEQ ID NO: 495861 - RNA, 64 nt, hsa
auaaaagguugauuugguugguucccaugaaaguuaguaagaugcccuuuuaaauauaaggauc

SEQ ID NO: 495862 - RNA, 64 nt, hsa
cugccaggacacuuuuguguuugcccaggacuccuaguaagaauugaaucuugagggaguaaug

SEQ ID NO: 495863 - RNA, 64 nt, hsa
ucuuuuuuaaaauuuuaauuagauuuccuuuuccuaguaagaguugaugucugcuagugguauu

SEQ ID NO: 495864 - RNA, 64 nt, hsa; identical to SEQ ID NO: 43762

SEQ ID NO: 495865 - RNA, 64 nt, hsa; identical to SEQ ID NO: 43763

SEQ ID NO: 495866 - RNA, 64 nt, hsa; identical to SEQ ID NO: 43764

SEQ ID NO: 495867 - RNA, 64 nt, hsa; identical to SEQ ID NO: 43765

SEQ ID NO: 495868 - RNA, 64 nt, hsa; identical to SEQ ID NO: 43766

SEQ ID NO: 495869 - RNA, 64 nt, hsa; identical to SEQ ID NO: 43767

SEQ ID NO: 495870 - RNA, 64 nt, hsa; identical to SEQ ID NO: 43768

SEQ ID NO: 495871 - RNA, 64 nt, hsa; identical to SEQ ID NO: 43769

SEQ ID NO: 495872 - RNA, 64 nt, hsa; identical to SEQ ID NO: 43770

SEQ ID NO: 495873 - RNA, 64 nt, hsa; identical to SEQ ID NO: 43771

SEQ ID NO: 495874 - RNA, 64 nt, hsa; identical to SEQ ID NO: 43772

SEQ ID NO: 495875 - RNA, 64 nt, hsa; identical to SEQ ID NO: 43773

SEQ ID NO: 495876 - RNA, 64 nt, hsa; identical to SEQ ID NO: 43774

SEQ ID NO: 495877 - RNA, 64 nt, hsa; identical to SEQ ID NO: 43775

SEQ ID NO: 495878 - RNA, 64 nt, hsa; identical to SEQ ID NO: 43776

SEQ ID NO: 495879 - RNA, 64 nt, hsa; identical to SEQ ID NO: 43777

SEQ ID NO: 495880 - RNA, 64 nt, hsa; identical to SEQ ID NO: 43778

SEQ ID NO: 495881 - RNA, 64 nt, hsa; identical to SEQ ID NO: 43779

SEQ ID NO: 495882 - RNA, 64 nt, hsa; identical to SEQ ID NO: 43780

SEQ ID NO: 495883 - RNA, 64 nt, hsa; identical to SEQ ID NO: 43781

SEQ ID NO: 495884 - RNA, 64 nt, hsa; identical to SEQ ID NO: 43782

SEQ ID NO: 495885 - RNA, 63 nt, hsa
ucuuacgacacagauccacccacauguugcucuuaucuggaauuugggacaaagcaaugcaca

SEQ ID NO: 495886 - RNA, 63 nt, hsa
uggggggagucaugcccaggggaggagacuuuuuaucuggaggggagagaaggauucuagggg

SEQ ID NO: 495887 - RNA, 63 nt, hsa
gaaaacuagacagaaacucaucuauauauucuguaucuggaguuccguuuugaauauuaacug

SEQ ID NO: 495888 - RNA, 63 nt, hsa
aaacaaaugaaacaaguaaaggaagaaagaagguaucuggaaagaaauagagaagaacuagua

SEQ ID NO: 495889 - RNA, 63 nt, hsa
acaggguacaacccccugcugcacacgcuagcauaucuggaaccuacuaugaaaaugaaagga

SEQ ID NO: 495890 - RNA, 63 nt, hsa
aggucaguguuccuugugcugucauuucccuuauaucuggaauuugucagcauuccugaaaac

SEQ ID NO: 495891 - RNA, 63 nt, hsa
aauauuuuguucuuauuugccagagccaaauuuuaucuggaaguugagacuuaaaaaauacuu

SEQ ID NO: 495892 - RNA, 63 nt, hsa
gaacacccggaaagacugaaagaauacauuuuauaucuggauuuuuacaaauaaagauggcua

SEQ ID NO: 495893 - RNA, 63 nt, hsa
gcagaacaaacagugaaacuuucuaaaauauucuaucuggaauagggacaggggaucuuuuau

SEQ ID NO: 495894 - RNA, 63 nt, hsa
gaauagaagaaaaaaguugcagguugaauuaucuaucuggauauuacuagaguuguaaaacac

SEQ ID NO: 495895 - RNA, 63 nt, hsa
ggcaucgcaaacugcccccgggcgcaucuggcuuaucuggagaccugggagcuugaggcucau

SEQ ID NO: 495896 - RNA, 63 nt, hsa
ccaaggacuaagcuuccauagaaauacacuuuguaucuggaccucaaaauuaugggaacauuu

SEQ ID NO: 495897 - RNA, 63 nt, hsa
aaagccucuucauccaggucaguucaggaaguauaucuggaguaccugcucuguuuuuggcug

SEQ ID NO: 495898 - RNA, 63 nt, hsa
caaaguugccuaguugauguaacaguggaaaguuaucuggaaauaguauuuugaacuuuaagc

SEQ ID NO: 495899 - RNA, 58 nt, hsa
aggaggaagacgaggauuaaauuucauuuaucuggaaaauuuuguaugaguucuugaa

SEQ ID NO: 495900 - RNA, 63 nt, hsa
gucaauauuaaauacagacacuaaguuauaguauaucuggacaagccaacuuguaaauacacc

SEQ ID NO: 495901 - RNA, 63 nt, hsa
gccucaugugugaaauaaauuuuuaaaaagauuuaucuggauuuagagaauuuuagaucaaca

SEQ ID NO: 495902 - RNA, 63 nt, hsa
ccccuccuuuuacucaacuaacuacucaacucauaucuggagagaaaaccuaggaguuucuca

SEQ ID NO: 495903 - RNA, 63 nt, hsa
aaguucagaguaugcaggcucauaacuuuaggcuaucuggaauuuuucuaauggacaaaucac

SEQ ID NO: 495904 - RNA, 63 nt, hsa
gcuggguuacugcugcuuuuggugcucucaccuuaucuggaagaucugcaaacauuaccuaaa

SEQ ID NO: 495905 - RNA, 63 nt, hsa
cagaggagcccaucucccaucuccccagcucccuaucuggaggauaguuggauaguuacgugu

SEQ ID NO: 495906 - RNA, 63 nt, hsa
aaugguuguauagauauguauauaugguucacauaucuggaucuguguauuugauuuuguacu

SEQ ID NO: 495907 - RNA, 63 nt, hsa
aggauggagcaagggcgaauauaggcauagacauaucuggagcgcaaggauugagaggcccug

SEQ ID NO: 495908 - RNA, 63 nt, hsa
ccucaccgcucccagcaacugaaaggacaacacuaucuggagccacccacugaaagggcugca

SEQ ID NO: 495909 - RNA, 63 nt, hsa
acuuuauguccugaagcugacccgaggucuuccuaucuggaaugacuagagggagccaagagg

SEQ ID NO: 495910 - RNA, 63 nt, hsa
uauucuuauuuuuguaaucagucauuggcuucuuaucuggaugaaggcuuuuggaggagaacc

SEQ ID NO: 495911 - RNA, 63 nt, hsa
uguuguuagauuaauguauuuguugcuucccuuuaucuggaauguggcauuagcuuuuuuauu

SEQ ID NO: 495912 - RNA, 63 nt, hsa
uauccugagacuuugacaccagauguagauauuuaucuggagcuggaaagaaaaauucuuuuu

SEQ ID NO: 495913 - RNA, 63 nt, hsa
ggauguauuaguuauuuacuuaaauguuuauaauaucuggauuuuuuuuguuuuguuacucau

SEQ ID NO: 495914 - RNA, 63 nt, hsa
uuuaaaauaauaaaucugccauaaaaugcauuauaucuggagacuugcacuuguauggaugaa

SEQ ID NO: 495915 - RNA, 63 nt, hsa
aaacucugaagaaagcucugacucucaggaaguuaucuggaaagauaccuggauguuuacugc

SEQ ID NO: 495916 - RNA, 63 nt, hsa
cagaaugaggcuaaacauggguuauacaaaggguaucuggaaacugaagagcaacuuguuaga

SEQ ID NO: 495917 - RNA, 63 nt, hsa
gguuaacuuuuacacaguucugaguacuguuaauaucuggaaaguaucuugagauaucagugg

SEQ ID NO: 495918 - RNA, 63 nt, hsa
ucauugaaaguuaauuuucuuugcauuuuaaaauaucuggauuaugaagaaaaagugaugaaa

SEQ ID NO: 495919 - RNA, 63 nt, hsa
auagcacagauuccuuugccccuuuuaucuccuuaucuggauaugauaagugguuaugagggu

SEQ ID NO: 495920 - RNA, 63 nt, hsa
aaucacguuaaugguauaauuuuuuuuuuuuaauaucuggagaacauuaauaacaaguuaaau

SEQ ID NO: 495921 - RNA, 50 nt, hsa
aauuugaaaugcaagcauaauaucuggaaaauuugcugccugccuucuac

SEQ ID NO: 495922 - RNA, 63 nt, hsa
uguaauacuuaauuaaaauaaugauggaagagcuaucuggagauuaugaguaagcugauuuga

SEQ ID NO: 495923 - RNA, 63 nt, hsa
gucucuucauuuauuacugcuugucuguuguuauaucuggauuaucaaaagcaauagugcacc

SEQ ID NO: 495924 - RNA, 63 nt, hsa
cuguugugagugcccuuuccuggaagguguuuuuaucuggaagauagaauccaaguauuuaua

SEQ ID NO: 495925 - RNA, 63 nt, hsa
gguguucaauaagggaauacugauugugcauuguaucuggauagcaugccuaauugugcauuu

SEQ ID NO: 495926 - RNA, 63 nt, hsa
aguuccaguccuggccagucauucccugauugguaucuggagacagaaaccuaaugggaagug

SEQ ID NO: 495927 - RNA, 63 nt, hsa
aauuaggaucauuuucugucuguuuuaaucauguaucuggaauagggucgggaaggguuugug

SEQ ID NO: 495928 - RNA, 63 nt, hsa
uucuccuuccccuagccuauugggcuuugcagauaucuggaguguuuuaaagucaauuauuuu

SEQ ID NO: 495929 - RNA, 63 nt, hsa
ucuguucuauuauagagacuuuuaucuaugcccuaucuggauucuacuuauuuauaauuuaag

SEQ ID NO: 495930 - RNA, 63 nt, hsa
uauaccaagauggagaucuugacuucuugaauauaucuggacugguaaaaucuugaugaggcu

SEQ ID NO: 495931 - RNA, 63 nt, hsa
ggggguacaacgucuauuuuuugccuuucuugauaucuggagauuucuagaguggaucucuua

SEQ ID NO: 495932 - RNA, 63 nt, hsa
gcuuacuucacuauugaacacuauucuguucacuaucuggaguaaauaaagaagcuuauuaaa

SEQ ID NO: 495933 - RNA, 63 nt, hsa
uauguaagauuaaccuacucuggacauuucauauaucuggaaucaugugauaucucuuuugug

SEQ ID NO: 495934 - RNA, 63 nt, hsa
ccaaugcuuguucacuguuccucugucauacuguaucuggaaugcuuuguaauacuugcaugc

SEQ ID NO: 495935 - RNA, 63 nt, hsa
uaauguggaugaucaggauuaaaucaagauauauaucuggaaccucuuauaaauggagcacuu

SEQ ID NO: 495936 - RNA, 63 nt, hsa
aagacaauucaucucauugugaguggaaguaguuaucuggaauaaaaaaagaagauaccuauu

SEQ ID NO: 495937 - RNA, 63 nt, hsa
uacaccuuuuuuauagaugauuuguuuaaauuauaucuggaaaauagaguugauuuacuuuca

SEQ ID NO: 495938 - RNA, 63 nt, hsa
aaggaacagaaauuauugcaucuguggaacauauaucuggaguuacuauacuuuacugaagag

SEQ ID NO: 495939 - RNA, 63 nt, hsa
guuucaaguguucagcagaccucucugguaacauaucuggaauauuguuguuguuuuuuaacc

SEQ ID NO: 495940 - RNA, 63 nt, hsa
uauuugcgagucauauauaugauaaggggcuuguaucuggaauauauaaauaacucuuauaac

SEQ ID NO: 495941 - RNA, 63 nt, hsa
aucaucuucaggaagcaaguccauaacaugacauaucuggauuuugugcuuagaaccuuaaau

SEQ ID NO: 495942 - RNA, 63 nt, hsa
caaauccauccugcacuucuacaguuuagaaaguaucuggacucagaauaaauguaauauuua

SEQ ID NO: 495943 - RNA, 63 nt, hsa
uaacaucauagccacagaaaucaagugccagucuaucuggaauccauguuguauugcagauaa

SEQ ID NO: 495944 - RNA, 63 nt, hsa
aagaguccaguguaaccagcuuaguaaccagaguaucuggauuacccaggaagguugagcugc

SEQ ID NO: 495945 - RNA, 63 nt, hsa
auauccaucagaaaaaugacacacaaaacaaaauaucuggaccuuuacagaagacguuugcug

SEQ ID NO: 495946 - RNA, 63 nt, hsa
aagcucuaaaacagugucauugauuaaaaagaauaucuggaauguagccccacucuuugagug

SEQ ID NO: 495947 - RNA, 63 nt, hsa
aauaaguauguguguaccguaaagaauauaucuuaucuggagcucagccucaaucaugucuua

SEQ ID NO: 495948 - RNA, 63 nt, hsa
aauucagaagacuacuauaugugagaggcgugauaucuggauggaaguugggcuggaugaucu

SEQ ID NO: 495949 - RNA, 63 nt, hsa
aacagugucauacauauuuguucuccauugauauaucuggagaaaucaaugcuacagccuaua

SEQ ID NO: 495950 - RNA, 63 nt, hsa
uuugguuguuccuaaagcuugcccuuugaguauuaucuggagaacccaagcugucucuggauu

SEQ ID NO: 495951 - RNA, 58 nt, hsa
aguuaucucagaauuguuaacgugaauauaucuggaugggggguuuuguaaauaauga

SEQ ID NO: 495952 - RNA, 63 nt, hsa
gggagacuguggccugaacaggagauuuuauuauaucuggagacccugagagacccugagacc

SEQ ID NO: 495953 - RNA, 63 nt, hsa
aagagccgucaucagugucucacuugugauuuuuaucuggaaaaggaagaaacaccccagcac

SEQ ID NO: 495954 - RNA, 63 nt, hsa
uuucuuagacuacauuuagagaacuguggccguuaucuggaaguaaccauuugcacuggaguu

SEQ ID NO: 495955 - RNA, 63 nt, hsa
auuauuauucuuauuaauaacauguuggccuauuaucuggaugucccuugccuagagcaggaa

SEQ ID NO: 495956 - RNA, 63 nt, hsa
gaguguauuggggauuuuguuauauuuuguuuuuaucuggauuguuuuuguccuagguuuggg

SEQ ID NO: 495957 - RNA, 63 nt, hsa
ggggauagaaaacaaaguaccuaugaaacgggauaucuggauuuuacuugcaguggcuuccac

SEQ ID NO: 495958 - RNA, 63 nt, hsa
caaauugcuuaacacuugguuccaguuccugccuaucuggaguuuaaaugcguaauacaccau

SEQ ID NO: 495959 - RNA, 63 nt, hsa
auggucuccuuccgcaagucuuuuuaauccucauaucuggaguacaaggguagaccucuggcu

SEQ ID NO: 495960 - RNA, 63 nt, hsa
uguuugcaaugcauggaacugucaaaggauucguaucuggaauacauuaaagaagcaaaagaa

SEQ ID NO: 495961 - RNA, 63 nt, hsa
acacagaugagauauucuacacauuaaucuacuuaucuggaaucacuuugccucuaaaggcca

SEQ ID NO: 495962 - RNA, 63 nt, hsa
accacuugcuaagcagaagauccugcagacccuuaucuggaggaggaagagaagcaggagaga

SEQ ID NO: 495963 - RNA, 63 nt, hsa
uacuagauacacugcaaacuacaguggggauuuuaucuggacaucccaccaucaaagaucuug

SEQ ID NO: 495964 - RNA, 63 nt, hsa
cuaguaaauucugaaugcuuuuccacguagacuuaucuggaaugugaacacaacucuuugguu

SEQ ID NO: 495965 - RNA, 63 nt, hsa
uaaaaugaagugaguaaaauacugggaugacguuaucuggagcccaagaaagauggcucauuu

SEQ ID NO: 495966 - RNA, 63 nt, hsa
ggauauggagccacauccacuuccaccccuugguaucuggacccacguguucuuccuacugag

SEQ ID NO: 495967 - RNA, 63 nt, hsa
acaccggcugcagaugggacagccagcccugccuaucuggacaggccccugcagccucugucc

SEQ ID NO: 495968 - RNA, 63 nt, hsa
cugacacuuaagacuugggaagccugacauuucuaucuggacagugugacuaucuuaugucag

SEQ ID NO: 495969 - RNA, 63 nt, hsa
uaauugcccuguauuccgaaggguaauauaauuuaucuggauggaaauuuuaaagaugaaucc

SEQ ID NO: 495970 - RNA, 63 nt, hsa
aagccucagccugaaugugaguggcaaguggcuuaucuggagccaccugcccaagucuuacua

SEQ ID NO: 495971 - RNA, 63 nt, hsa
agauagagcucauuuuacuccaccuaaucguuauaucuggauauacccauuuucugcaucuuc

SEQ ID NO: 495972 - RNA, 63 nt, hsa
uuucuuaugauuuccuuuaaaggcaccaaaucuuaucuggaaauaaauuguuauggaggggcu

SEQ ID NO: 495973 - RNA, 63 nt, hsa
ggacccaguuuugcgugguugguuuuuauuaauuaucuggauaacagcaaaaaaacugaaaau

SEQ ID NO: 495974 - RNA, 63 nt, hsa
auauccaagagggagaaugaaacuuccugggcuuaucuggauucuucugggcuauagaucuca

SEQ ID NO: 495975 - RNA, 63 nt, hsa
aagugccauuucauuauuugauuaucaccaaauuaucuggaaauaauugggacauuguaacuu

SEQ ID NO: 495976 - RNA, 63 nt, hsa
aucagaguucccaagaaaggaaaccuuuucuuguaucuggauucaaauuuauuuccaauguuu

SEQ ID NO: 495977 - RNA, 63 nt, hsa
accuuucuuccucaugugguguaauuacagcccuaucuggagacagcgaauacagcaaacaga

SEQ ID NO: 495978 - RNA, 63 nt, hsa
gccgucuguccccagcucccguggccacacagcuaucuggaggcuuugcagggagucgugggu

SEQ ID NO: 495979 - RNA, 63 nt, hsa
aagcuccauuugccaguuuaaggaaggaaacacuaucuggaaaaguaccuuauugauagugga

SEQ ID NO: 495980 - RNA, 63 nt, hsa
ugaguaucuguuuuuccucaggcacaucauuuuuaucuggaaagacuuuucuagcugcaauuu

SEQ ID NO: 495981 - RNA, 63 nt, hsa
uaccuuugugugucucuagaagagaaaagcaucuaucuggagauauaaauguguauguaaaua

SEQ ID NO: 495982 - RNA, 63 nt, hsa
ggaccacgcuucagucaaaggcauacaaguaucuaucuggacuucccugcuagcacuuccaaa

SEQ ID NO: 495983 - RNA, 63 nt, hsa
aaaguauagacuuagaaauaucaaaguaagagcuaucuggauaaauauauagauauugagugc

SEQ ID NO: 495984 - RNA, 63 nt, hsa
uccuccaaccucuuaccuuagaugcauccugguuaucuggaagcaugggaaagaaggcuacuu

SEQ ID NO: 495985 - RNA, 63 nt, hsa
gauugcugguagguguguuguuuugaaguguuuuaucuggauuuagcaugugaagaucccuuu

SEQ ID NO: 495986 - RNA, 63 nt, hsa
aucaaauguucaaaaauacggagcagugccuaguaucuggagagcagcacuaccauuuauucu

SEQ ID NO: 495987 - RNA, 63 nt, hsa
gaagaacucuugacuauuuagauucuaguuaaauaucuggaauccuagcagucacuacauuau

SEQ ID NO: 495988 - RNA, 63 nt, hsa
uucuccuucuucuccuucuuccacaaagacccauaucuggagaagguguacaacuuucaaaca

SEQ ID NO: 495989 - RNA, 63 nt, hsa
ucuuugcaaaugucuuucucucaaugaagagcauaucuggacgacugugcaaugcugugugcu

SEQ ID NO: 495990 - RNA, 63 nt, hsa
cucagcaagcccuacagagcuguggaggauugcuaucuggaggccuuccagcugcugucuucu

SEQ ID NO: 495991 - RNA, 63 nt, hsa
cucuccucugcccaggggagggaguguggacaguaucuggaaguucugggauucagguuguua

SEQ ID NO: 495992 - RNA, 63 nt, hsa
ggcccaaccacaggagcugccaguauccagcaguaucuggaccacaggcaaagaaaaccacua

SEQ ID NO: 495993 - RNA, 63 nt, hsa
agcuaucauuucuuuuccaaaauuacuucucucuaucuggaauuuaauuaaucgaaaugaauu

SEQ ID NO: 495994 - RNA, 63 nt, hsa
uagauugagcgccacgacagcugugccuacgacuaucuggaggugcgcgacgggcacagugag

SEQ ID NO: 495995 - RNA, 63 nt, hsa
uuuugaaugcuggauucaaaaaaaaaaaaaaguuaucuggacagcuucuuugagacuauuuaa

SEQ ID NO: 495996 - RNA, 63 nt, hsa
auggguugugucuagaauuaaguggagggcagcuaucuggaguuaacuugcaagcauauuggu

SEQ ID NO: 495997 - RNA, 63 nt, hsa
uaaagaugugaagaccacagucuuggguuuucauaucuggagaagacuauuugccaugacguu

SEQ ID NO: 495998 - RNA, 63 nt, hsa
auaaaacaucagaaccagcuaagggaaaagaaauaucuggaguacauuaaaagugugaaagaa

SEQ ID NO: 495999 - RNA, 63 nt, hsa
ugaucagaucuauauaagugggaauacagcauauaucuggauauucuuauaguuaucuuuuua

SEQ ID NO: 496000 - RNA, 63 nt, hsa
ugaaaugauaauuuguaaaauaacacuuagugauaucuggaaauaauaauucaauuaagcaac

SEQ ID NO: 496001 - RNA, 63 nt, hsa
accacaccugaaaaugucucaaaucuccaggaguaucuggaaugcauuuguuuccaugaguga

SEQ ID NO: 496002 - RNA, 63 nt, hsa
ugugacauuaaaacaacaacaauaagaucuuccuaucuggaggguacagaggugaauggcuuu

SEQ ID NO: 496003 - RNA, 63 nt, hsa
cucugcuguguauuaaaugucaaaaucugaauauaucuggauauguacuaaucaaauaauaau

SEQ ID NO: 496004 - RNA, 63 nt, hsa
aaggacgucgaugaguacaaacugaaagaccacuaucuggaguuugagguguguugcacccaa

SEQ ID NO: 496005 - RNA, 63 nt, hsa
aagcaggaacaguggguuugugucucaccugaguaucuggaauuuuauuuuuucaaguaaaau

SEQ ID NO: 496006 - RNA, 63 nt, hsa
gacaguucuguugaguuggaagaauuggcaaaauaucuggaccauuaagaaaacggauuuugu

SEQ ID NO: 496007 - RNA, 63 nt, hsa
aucuggagaccacaaguaccacuccuauucuguuaucuggacuagaauuuucaaucaaugugu

SEQ ID NO: 496008 - RNA, 63 nt, hsa
ugaagaaaaguauuuuugucugacaguggaauauaucuggagaccacaaguaccacuccuauu

SEQ ID NO: 496009 - RNA, 63 nt, hsa
aagacauugaaggaccaauuuagacuuagcaguuaucuggagacaucugagagaauauuuuua

SEQ ID NO: 496010 - RNA, 63 nt, hsa
cucucuccuagguuguauuuaaauuugacugaauaucuggauggcuaagaacagacauuuauc

SEQ ID NO: 496011 - RNA, 63 nt, hsa
gugaaggaugcuggaaggguaaggauuuaggaauaucuggagagaaagagagccugcaguuau

SEQ ID NO: 496012 - RNA, 63 nt, hsa
gaauucagaauucuuaggcaaccuucauaccuuuaucuggaaaaugccuucucuccagacaau

SEQ ID NO: 496013 - RNA, 63 nt, hsa
ggguugacauuuagaacuuuaagucucacccauuaucuggaauauugugauucuguuuauucu

SEQ ID NO: 496014 - RNA, 63 nt, hsa
gcaggugguucagcgagccacggcagcccccuguaucuggauuguaaugugaaucuuuagggu

SEQ ID NO: 496015 - RNA, 63 nt, hsa
gcagaaacucagggaggggcuuggggcccauuguaucuggagagccuggauuccucuuggcag

SEQ ID NO: 496016 - RNA, 63 nt, hsa
auaaaaauuuacuauuuccuuuauauacuuguuuaucuggacugccaguaaaacaaaugugua

SEQ ID NO: 496017 - RNA, 63 nt, hsa
ucuuuagauauuauuugaaaugcuggcacugucuaucuggaucccagggcuugaacuaggauu

SEQ ID NO: 496018 - RNA, 63 nt, hsa
gcuuuguggcaaugaccuugaacugagagccuguaucuggauuuagcacuugaaagaucuaac

SEQ ID NO: 496019 - RNA, 63 nt, hsa
auuugcucaagacguccaacugucucucugacuuaucuggaaguauuucuuuuugugaagcca

SEQ ID NO: 496020 - RNA, 63 nt, hsa
aguuuugaacuuuuaacccuuucuacccagagcuaucuggaauguugaugacuuuuuauacug

SEQ ID NO: 496021 - RNA, 63 nt, hsa
uauaauaugcuuguaaaggcugagggugagcuguaucuggaugccuuuuuacaauuugauuuu

SEQ ID NO: 496022 - RNA, 63 nt, hsa
uauuaccuaaugaaagugaugacauauuuuuuauaucuggaaugagccuguugggaucgcauu

SEQ ID NO: 496023 - RNA, 63 nt, hsa
cacaucuuccaccagcaccuuacugcccaggccuaucuggaagccaccucaccaaggaccuug

SEQ ID NO: 496024 - RNA, 63 nt, hsa
uuuaugugcaaaaucuguuauagcuuuaaaauauaucuggaacuuuuuagauuauuccaagcc

SEQ ID NO: 496025 - RNA, 63 nt, hsa
uucuauucaucuaaguaauauggugaaaauauuuaucuggaauuuauguuguuuaguguuaua

SEQ ID NO: 496026 - RNA, 63 nt, hsa
gucacaagcacacugaugcuccuuaagauuguuuaucuggagcccacauaguguggaacaaaa

SEQ ID NO: 496027 - RNA, 63 nt, hsa
ugugacacuuuuaaaaucauccguaugucaguguaucuggauacacgaggaaaaggaaagagu

SEQ ID NO: 496028 - RNA, 63 nt, hsa
cugcccucugaauauauggugaggagaaugggguaucuggaaaaggaaaaugaucuggauaaa

SEQ ID NO: 496029 - RNA, 63 nt, hsa
gugauaacucaugagaaguacugauaggaccuuuaucuggauaugguccuauagguuauucug

SEQ ID NO: 496030 - RNA, 63 nt, hsa
aucaaguuguacuguauuagauaaucagcaguguaucuggaguauguuuaaagagaacaguuc

SEQ ID NO: 496031 - RNA, 63 nt, hsa
aucagaggaguaggagagaggaaacauuugacuuaucuggaaaagcaaaauguacuuaagaau

SEQ ID NO: 496032 - RNA, 63 nt, hsa
aacucuuuaugcaacuugguuaauagaaucuacuaucuggaagauaaaugaaggauuuuaaua

SEQ ID NO: 496033 - RNA, 63 nt, hsa
guauucugaaagucacauagcacacaguaauguuaucuggaagcucuguuuuuguuuacauuu

SEQ ID NO: 496034 - RNA, 63 nt, hsa
augaucccgccucuguaggggcauggcugcuauuaucuggaaauuaggaauuggaugcaucau

SEQ ID NO: 496035 - RNA, 63 nt, hsa
uugaugccaguuaucaugcugccacuacaucguuaucuggaggcaacuucuggugguuuuuuu

SEQ ID NO: 496036 - RNA, 63 nt, hsa
auguacucuuuaacagaaauugcuuuuaaaaaauaucuggaacuaucuuuaaaaaaacuuuau

SEQ ID NO: 496037 - RNA, 63 nt, hsa
cguaauaaagaugaccuggaccccugcccccacuaucuggaguuuuccaugcuggccaagauc

SEQ ID NO: 496038 - RNA, 63 nt, hsa
ugucaggaauauugguuugaaaagcuguuggccuaucuggaguuuggccuuguuaaccuagua

SEQ ID NO: 496039 - RNA, 63 nt, hsa
agucucgugagaauauacuuagaaaaucacacuuaucuggaaauucaauaagucauauuaaaa

SEQ ID NO: 496040 - RNA, 63 nt, hsa
augaagaagaggaggaugugaaacucuuaaguauaucuggaaagcagucugccccuggaggug

SEQ ID NO: 496041 - RNA, 63 nt, hsa
cucaaaguuuaagagcauuuagccaucgcuuuuuaucuggaaccucucagauaccucuaaaac

SEQ ID NO: 496042 - RNA, 63 nt, hsa
uacucccacauacuuacccacauguacacagaguaucuggagaauaaaacccaaauucaaaaa

SEQ ID NO: 496043 - RNA, 63 nt, hsa
uuucagauauuuauuuuugcacagaaaacacauuaucuggagagaaagaaaggagaauuuuug

SEQ ID NO: 496044 - RNA, 63 nt, hsa
uuucucacuguagcugcuggcagcccugugccauaucuggacucuaguugucaguaucugagu

SEQ ID NO: 496045 - RNA, 63 nt, hsa
uauuuuuccuuuaggucaaaauaaugucacugcuaucuggauaaauuauaaguucauauauuu

SEQ ID NO: 496046 - RNA, 63 nt, hsa
uauuuccuggagcaccagggcuaaauggggagcuaucuggaaacucuagauuuucugucauac

SEQ ID NO: 496047 - RNA, 63 nt, hsa
gccagugcaucuugggggaaagggcuccaguguuaucuggaccaguuccuucauuuucaggug

SEQ ID NO: 496048 - RNA, 63 nt, hsa
ggagauuaaaaaaaaagaaagaaaaugcuuccuuaucuggaagccuuucuggauuaauccagu

SEQ ID NO: 496049 - RNA, 63 nt, hsa
acuagagaugggauuugggggugaauuugucaauaucuggauuuuaauccagacaucucugcu

SEQ ID NO: 496050 - RNA, 63 nt, hsa
cuuuccugagcuagccaacaagagcaggaguaguaucuggaaacuuuccccuuuguuuagggg

SEQ ID NO: 496051 - RNA, 63 nt, hsa
ggccaaaggaggcagcgggaacaggcugcuugcuaucuggaaagaugacauauuugugccaug

SEQ ID NO: 496052 - RNA, 63 nt, hsa
cuuccuguuucugcaugaucagucuguauguacuaucuggaaagauaacacauacuccagcca

SEQ ID NO: 496053 - RNA, 63 nt, hsa
ggagccgaggaggacggcgugggcccuguccuguaucuggaauuccugggaaggcuggcugcu

SEQ ID NO: 496054 - RNA, 63 nt, hsa
aguucauaaacacagagcuguuuguguccccuguaucuggaaugccauuaugacccacuacau

SEQ ID NO: 496055 - RNA, 63 nt, hsa
uuccccacacuacauaucaguauuuucuaucuguaucuggacaaugcaguagaaauuauaaca

SEQ ID NO: 496056 - RNA, 63 nt, hsa
uaguaggaagaauuacaauuucuuuaaaucauuuaucuggauuuuuauguuuuauuagcauuu

SEQ ID NO: 496057 - RNA, 63 nt, hsa
uuguugcuugaggcacagaguuauaaaguaacauaucuggaauuugaaaucagaucuguuuag

SEQ ID NO: 496058 - RNA, 63 nt, hsa
gaagaaaccuggggacuuaguuagguagauuaauaucuggagcuccucgagggaccaaaucuc

SEQ ID NO: 496059 - RNA, 63 nt, hsa
ugucuuuaaaauaacauguaaacuucaauguucuaucuggaagcagaauaaaauauuuacaua

SEQ ID NO: 496060 - RNA, 63 nt, hsa
aacuguggaaggcacacugagcaaguuuucaccuaucuggaaaaaaaaaaauaugagauugga

SEQ ID NO: 496061 - RNA, 63 nt, hsa
caugcuaaaguuaccuucucuuuguuuuuugcauaucuggaauuacaccuuuaaagacugaua

SEQ ID NO: 496062 - RNA, 63 nt, hsa
uagaaauggcuguugcguauuggaaauuaguguuaucuggaagguuuaaauuuuuagaucucu

SEQ ID NO: 496063 - RNA, 63 nt, hsa
gaaguugaaccaguugguucuagaugaaccaauuaucuggaaaaugaaagaaccagaguugga

SEQ ID NO: 496064 - RNA, 63 nt, hsa
uucuccccugugagaaauaaugcaauuucuaauuaucuggauguucguugaaaauauauuaga

SEQ ID NO: 496065 - RNA, 63 nt, hsa
ucugcagaagaaauuuauuuuaaauuguuuaaauaucuggaaauacuuuuagcuaucauuuau

SEQ ID NO: 496066 - RNA, 63 nt, hsa
uucccaccacccacucuccucugccucaguaaguaucuggaggaagaaaacaggugaaagaag

SEQ ID NO: 496067 - RNA, 63 nt, hsa
uugagcaaaacauugauguaucuucucaagaucuaucuggacagacggccagagaguaugcug

SEQ ID NO: 496068 - RNA, 63 nt, hsa
auguagaggaaggcucaaaggagucaacauuuauaucuggaagggacaagucaugccuugggc

SEQ ID NO: 496069 - RNA, 63 nt, hsa
acacauggugucagauauggggucccgcaccuauaucuggaugaagagguagaaacucuggac

SEQ ID NO: 496070 - RNA, 63 nt, hsa
aagcacucauuuaaaaaucaucauguuuggaccuaucuggaccucucagcacuguaaaauagu

SEQ ID NO: 496071 - RNA, 63 nt, hsa
cuaucuagugaauaaaaaaauuaguuugaaagauaucuggagaaaucgcauucauaaaacaau

SEQ ID NO: 496072 - RNA, 63 nt, hsa
ugugacugcagcuauggccuuguuugcuuaguuuaucuggaauucuguuauaauuucugaacu

SEQ ID NO: 496073 - RNA, 63 nt, hsa
ccaccaacuucugugccuccucagauggggauuuaucuggaucucugugguuccuucucagcc

SEQ ID NO: 496074 - RNA, 63 nt, hsa
aaaaacccugcacuuugaacaaucagcuguugcuaucuggaacuaaacagaacuaugaguaaa

SEQ ID NO: 496075 - RNA, 63 nt, hsa
aaauguuuuuuguuuuuuuuuuuaaucuugaguuaucuggauauugccuugacuccauuucau

SEQ ID NO: 496076 - RNA, 63 nt, hsa
uacagacgugagccaccgugccuggccuggaauuaucuggacuuucaaagaagauggcauuau

SEQ ID NO: 496077 - RNA, 63 nt, hsa
uguaauuuauuaaaaaccuuauuuacaaggaauuaucuggacuuuuuuuuuuuuuuuuuuuuu

SEQ ID NO: 496078 - RNA, 63 nt, hsa
aaguacaagggagaauacccauuuucauucagcuaucuggaguaaaauaucaaguacuuccuu

SEQ ID NO: 496079 - RNA, 63 nt, hsa
ccauggggcacugacagagaaaugaaauaguuuuaucuggaaaauuccagagcuauuauuuac

SEQ ID NO: 496080 - RNA, 63 nt, hsa
ucaaggaacauagcuuacaaaugcaucaguguguaucuggagagcauccuaacugcauuucaa

SEQ ID NO: 496081 - RNA, 63 nt, hsa
cacagacaaagugacaucagaaggcugagcacuuaucuggaucauuuggucaguuugguaauu

SEQ ID NO: 496082 - RNA, 63 nt, hsa
guuuugcaagauguuuguggaaauguucauuuguaucuggaucucuguuaugugccauuuuuc

SEQ ID NO: 496083 - RNA, 63 nt, hsa
auuuagcggauuguggacuuaagauucaaccucuaucuggagaggugaaaacacaaaggcuua

SEQ ID NO: 496084 - RNA, 63 nt, hsa
ugaguggccccacauggggcucugagcaggcuguaucuggauucuggcaauaaaaguacucug

SEQ ID NO: 496085 - RNA, 63 nt, hsa
guuucccagguggagcucauguuugugauccucuaucuggacagcucuccagaauccuguguu

SEQ ID NO: 496086 - RNA, 63 nt, hsa
ggauucauacuugagaaauagugcaaagaugcuuaucuggaacuguguucuggugaaagaacc

SEQ ID NO: 496087 - RNA, 63 nt, hsa
ugggucccccugguuguuguagcagcuuaacuguaucuggagccaggaccugaacucgcaccu

SEQ ID NO: 496088 - RNA, 63 nt, hsa
accuuacuuucauuguaaauaagccugucuuccuaucuggauuuuuugugugcauacauauuc

SEQ ID NO: 496089 - RNA, 63 nt, hsa
cacccauugccccgggaaccguuucugcuguacuaucuggauacuaaaauguuacggaaguag

SEQ ID NO: 496090 - RNA, 63 nt, hsa
cagaucguauuucagucugucagggguuaucuguaucuggagguuccacuguugcuucagucu

SEQ ID NO: 496091 - RNA, 63 nt, hsa
cuggaggugugaaggugcuguaucccggaaaucuaucuggacccuggacugcagugcaggaga

SEQ ID NO: 496092 - RNA, 63 nt, hsa
ggaggcagagagagccagccccuacccucagaguaucuggaccucagagaccauguugugcca

SEQ ID NO: 496093 - RNA, 63 nt, hsa
aucaaaaaacuaccuaucugguacuaugcuuuuuaucuggaugaugaaauaaucuguacaaca

SEQ ID NO: 496094 - RNA, 63 nt, hsa
gccuccuggaggcugugggugugggggauucuguaucuggauuccguaucacuccaaguggag

SEQ ID NO: 496095 - RNA, 63 nt, hsa
caaaguuuacagauguuuuuaauucuaguauuuuaucuggaacaacuuguagcagcuauauau

SEQ ID NO: 496096 - RNA, 63 nt, hsa
ccucauggcccaccuccaacccacuuuccucaguaucuggagagggaagggaagucaggcuug

SEQ ID NO: 496097 - RNA, 63 nt, hsa
cggauuuauucccuuuuaaagaauuuuugcccauaucuggaagggcacuauauuuuugggagg

SEQ ID NO: 496098 - RNA, 63 nt, hsa
aacucccaguucccagaaaagacuuaaaacuaguaucuggagauuccaaguccuuuaaaagga

SEQ ID NO: 496099 - RNA, 63 nt, hsa
ucuuuauaaaugucauuuuacaaauuaugugauuaucuggaagcucuaagaugagagcaaaug

SEQ ID NO: 496100 - RNA, 63 nt, hsa
uaacuuuccuggacuguguuucgcauucggcguuaucuggaaaguggacugaacggaaucaag

SEQ ID NO: 496101 - RNA, 63 nt, hsa
aggggagagcuugaccuccaucuagguuucuuuuaucuggagaaaaagaacacuuuugaacua

SEQ ID NO: 496102 - RNA, 63 nt, hsa
ggcuggauugcagccacccaugguggcucagaauaucuggauuggagaggcauaagguugaaa

SEQ ID NO: 496103 - RNA, 63 nt, hsa
aauauuaaauugaaaucuucauuucaauuuuauuaucuggaaagggcacuggauugcucugca

SEQ ID NO: 496104 - RNA, 63 nt, hsa
agggccuggcuuccgugcucuggcuuuguaacuuaucuggaagggaaagcacaugccuucacg

SEQ ID NO: 496105 - RNA, 63 nt, hsa
ucauauuuuguaauauuucauuuguuaaguuuauaucuggauauaauguucuuuuuaaacaag

SEQ ID NO: 496106 - RNA, 63 nt, hsa
gguaauuuuugauuuccuaaagugcacugagguuaucuggaagauuggguguauuuuuuggug

SEQ ID NO: 496107 - RNA, 63 nt, hsa
aguagguaucccuccaugcccuucuguaauaaauaucuggaaaaaacauuaaacaauaggcaa

SEQ ID NO: 496108 - RNA, 63 nt, hsa
uacauuuucccuuccauuuaaaaugucuugggauaucuggaucaguaauaaaauauuucaaag

SEQ ID NO: 496109 - RNA, 63 nt, hsa
ucacgcugacgcuggccgauacucaggguaugcuaucuggaggccuggacacugucacacuca

SEQ ID NO: 496110 - RNA, 63 nt, hsa
auauccuuuaucacaggauuuguuuuuggaggcuaucuggauuuuaaccugcacuugauauaa

SEQ ID NO: 496111 - RNA, 63 nt, hsa
aggagacuuuacaaaccuuuguuucaacuuucuuaucuggaaauaauaucauuuauaaaggga

SEQ ID NO: 496112 - RNA, 63 nt, hsa
gaaaaugguauuuggaauuccgaauugacagguuaucuggaacaaaggagcuucuuuuuuuuu

SEQ ID NO: 496113 - RNA, 63 nt, hsa
gcagguaagugacacucccuguccuagucggucuaucuggacuugcccuugucuguucguggu

SEQ ID NO: 496114 - RNA, 63 nt, hsa
aaauagcauuuggcaagucuauaggauucuuccuaucuggaaauucuauuuuguuagagugcg

SEQ ID NO: 496115 - RNA, 63 nt, hsa
uggggacagggagggaugggggucccugaugaauaucuggagaccucgacagccugcccuagg

SEQ ID NO: 496116 - RNA, 63 nt, hsa
aggaggcucuggaggacaaucuaggaccuacauuaucuggacuguaugcuggucauuucuaga

SEQ ID NO: 496117 - RNA, 63 nt, hsa
aggagguuccgggagacaauuuagggcugaugcuaucuggacugucugccaaucauuuuuaga

SEQ ID NO: 496118 - RNA, 63 nt, hsa
aggaucuuuucaugugcuuguuaggcauuuguguaucuggaaaaauauucaagucuuuuuuuu

SEQ ID NO: 496119 - RNA, 63 nt, hsa
ccuagugacuuccccugggagccgcauuuucacuaucuggaaaaugggcucaaugcaaaggug

SEQ ID NO: 496120 - RNA, 63 nt, hsa
aucuggcccaaaacacaaauuuauauucucacauaucuggaggcuggaagucugagaucagag

SEQ ID NO: 496121 - RNA, 63 nt, hsa
auaauuucugaagucuauacacaggagaugauauaucuggaauguccuuuuguucauacaaaa

SEQ ID NO: 496122 - RNA, 63 nt, hsa
uggggacagggagggaugggagucccugcugaauaucuggagacccugacagguugcccuggg

SEQ ID NO: 496123 - RNA, 63 nt, hsa
cacguuaccauaucaagcugaaaaugucaccacuaucuggagaguuggacauguuuuauugag

SEQ ID NO: 496124 - RNA, 63 nt, hsa
acuggagaagacuccacgcccuuccagcuuugguaucuggagauuuccagggccccucgccgc

SEQ ID NO: 496125 - RNA, 63 nt, hsa
aaaauuuaaggaaauauauuauuuguuagucuguaucuggagcuuuuuaaaauuauguuauua

SEQ ID NO: 496126 - RNA, 63 nt, hsa
caggauaaacauugcuguauguuacaguaaagcuaucuggagagaacacauaaaugauuuugg

SEQ ID NO: 496127 - RNA, 63 nt, hsa
aucuugcaacagaggccagccacguaagauauauaucuggacucucuuguauuauaggauuuu

SEQ ID NO: 496128 - RNA, 63 nt, hsa
agagaugccucuuuaacacuugaaauucauuucuaucuggauacagaggcagauuuuucuuca

SEQ ID NO: 496129 - RNA, 63 nt, hsa
gacacuaagcuauuaauacggcuugucuuaagauaucuggaggcaugcucugaaauccuauau

SEQ ID NO: 496130 - RNA, 63 nt, hsa
uugcucccggcaagcgcuucugcugaaaguucauaucuggagccugaugucuuaacgaauaaa

SEQ ID NO: 496131 - RNA, 63 nt, hsa
uuuugugucuggcuugcugaguguaaaaguuguuaucuggacgaucugucucucugcuccaaa

SEQ ID NO: 496132 - RNA, 63 nt, hsa
ccgucucgcucaucaucaccgacauguccuucuuaucuggaaagagcacggaaaugcagcggc

SEQ ID NO: 496133 - RNA, 63 nt, hsa
gggcugggcgggccagcuggggaagcauuugacuaucuggaacuugugugugccuccucaggu

SEQ ID NO: 496134 - RNA, 63 nt, hsa
gccuccccgagccucagccccaagcugauuucuuaucuggaaaugguacacugaauucucugg

SEQ ID NO: 496135 - RNA, 63 nt, hsa
gggugguggagaagcagaaggagcaaucaagcuuaucuggauauuucuuucuuuauuuauuuu

SEQ ID NO: 496136 - RNA, 63 nt, hsa
uuuucaguuuuuuuuuaaaaaacguacucuuauuaucuggaacauagaaauauaaaagguaac

SEQ ID NO: 496137 - RNA, 63 nt, hsa
uauugaguuacuagggagguucuuaaauccucauaucuggaaacuugugacguuuugacaccu

SEQ ID NO: 496138 - RNA, 63 nt, hsa
uaugaaauuucauggaugaauuuuccagaccuauaucuggagugagaggcccccacccuuggg

SEQ ID NO: 496139 - RNA, 63 nt, hsa
cauguuaccauaucaagcugaaaaugucaccacuaucuggagauuucgacguguuuuccucuc

SEQ ID NO: 496140 - RNA, 63 nt, hsa
aauuuccauuucucccuguuauuuuaguugccuuaucuggagagacguggaggugauuuucuu

SEQ ID NO: 496141 - RNA, 63 nt, hsa
uauugaguuacuagggagguucuuaaauccucauaucuggaaacuugugaaguuuugacaccu

SEQ ID NO: 496142 - RNA, 63 nt, hsa
acugaacccauuguuucuuucugaagagacuuuccuuucaaggcuucccauggguccgcgcca

SEQ ID NO: 496143 - RNA, 63 nt, hsa
cauccaugaugaccauccucauagcucagaucuccuuucaaaguaguggcuuucuggauggua

SEQ ID NO: 496144 - RNA, 63 nt, hsa
ggacaaacagcauugggaggccuuaguccugcuccuuucaauuccauccuguaaagaacagga

SEQ ID NO: 496145 - RNA, 63 nt, hsa
cccaggucuccucacucaaagucccuucgccaaccuuucaaugcccagcccugacaccugccc

SEQ ID NO: 496146 - RNA, 63 nt, hsa
cccugccuguuuuccccaaaguggaaaggaaggccuuucaaaccagagugucucacuccccuc

SEQ ID NO: 496147 - RNA, 63 nt, hsa
ggauggauauaugaaguaaggugagauccuuaaccuuucaaaauuuucggguuccagggagac

SEQ ID NO: 496148 - RNA, 63 nt, hsa
ggggcaaaacaacacuuugucagugcuuuugaaccuuucaauauuguagcaugcuugaggagu

SEQ ID NO: 496149 - RNA, 63 nt, hsa
guucauagccaggaaacccagcucagcaaacucccuuucaaagcugugugaccggcugggcau

SEQ ID NO: 496150 - RNA, 63 nt, hsa
aguagaaagaguucaugaagaggcccuccucugccuuucaaaaggcuggucaccuacacaugu

SEQ ID NO: 496151 - RNA, 63 nt, hsa
guuuaauuuugcuuuuuuuuuuuuuuuuuuuuuccuuucaacuuaguugacauacgugccuua

SEQ ID NO: 496152 - RNA, 63 nt, hsa
acucaauauuccaaauguuuuuuuuuccuuccuccuuucaaaagaguucuuaacccaauuagg

SEQ ID NO: 496153 - RNA, 63 nt, hsa
cagaccauuaguuacuauggauuuauuuuuuuuccuuucaaacacgguaaggaaacaaucuau

SEQ ID NO: 496154 - RNA, 63 nt, hsa
aguaauuuucuucucauucuucuaaaacuacugccuuucaaagugcacacacacgcguccaca

SEQ ID NO: 496155 - RNA, 63 nt, hsa
ggguuacagagagccuccucagaucuguuugugccuuucaaaaguacugggggcagauucuca

SEQ ID NO: 496156 - RNA, 63 nt, hsa
agaaguauuuggauauagggaaagaaugaagugccuuucaaguacauuaaaaaucaguuaaga

SEQ ID NO: 496157 - RNA, 63 nt, hsa
cugaaaaugaaacccuaucuuucacuuuacauuccuuucaauccaacugaucaaaacugguac

SEQ ID NO: 496158 - RNA, 63 nt, hsa
uugguaagacaacaaccucccagugauaugccaccuuucaauuuuccuuuuguggcaaugauu

SEQ ID NO: 496159 - RNA, 63 nt, hsa
aggauuucuaugcauucauuauaauuuguuauuccuuucaauauccuuguauuucaaaucuuc

SEQ ID NO: 496160 - RNA, 63 nt, hsa
uaucauggaaaacuaauuuuucccagagaauuuccuuucaaaccucccaguaucuauaugauc

SEQ ID NO: 496161 - RNA, 63 nt, hsa
augucauugaaagccuuauuacgcuuuucagauccuuucaauaaacaagacuuguagaaaaua

SEQ ID NO: 496162 - RNA, 63 nt, hsa
augugugaauucugcaacuagccaaggcuaguuccuuucaauuccauuuaaaaaacaaaaacc

SEQ ID NO: 496163 - RNA, 63 nt, hsa
aagugaguuugcagaaaccuuggggaaaagggcccuuucaaagaaguggauaagagggaggag

SEQ ID NO: 496164 - RNA, 63 nt, hsa
aaggaagaaaugcguuuagaucuuggaugcagaccuuucaaaggguuaaauguaaccauaugg

SEQ ID NO: 496165 - RNA, 63 nt, hsa
uuccugauuccucggcgcaaaggagacguuuauccuuucaaauuccugccuucccccucccuu

SEQ ID NO: 496166 - RNA, 63 nt, hsa
aauucguaguaaaugaugcuucgguuugauggaccuuucaacguuauuuauugaauauguauu

SEQ ID NO: 496167 - RNA, 63 nt, hsa
caacagguuucagugaugaggaggacaacacugccuuucaaacuuuuuacugaucucuuagau

SEQ ID NO: 496168 - RNA, 63 nt, hsa
caagguuuacuuugguaugguucucagcacaaaccuuucaaguauguuguuucuuuggaaaau

SEQ ID NO: 496169 - RNA, 63 nt, hsa
ucccacacccccuccuacccucucuccuguaccccuuucaaucuggacuugcccaggucuucu

SEQ ID NO: 496170 - RNA, 63 nt, hsa
cccagauagacagggcuggcucugcugccccaaccuuucaaggaggaaaccagacaccugaga

SEQ ID NO: 496171 - RNA, 63 nt, hsa
cuguaaauuuggcuucuguugucaccuucaccuccuuucaagguaacuguacugggccauguu

SEQ ID NO: 496172 - RNA, 63 nt, hsa
gagacgccguucuuccugucucagcuuggccagccuuucaacaauguucucuaguuucaagcu

SEQ ID NO: 496173 - RNA, 63 nt, hsa
agaagaaauuguguuaaaauagaaguguuucauccuuucaaaaccauuucagugauguuuaua

SEQ ID NO: 496174 - RNA, 63 nt, hsa
auguggauaauauuaugacauuuuucaaaaaucccuuucaaguuauguuuugucuuuuuuacu

SEQ ID NO: 496175 - RNA, 63 nt, hsa
uucuacacgauccuauuaagaauaaugugaugcccuuucaaugcaacuuuucauauuuaguuu

SEQ ID NO: 496176 - RNA, 63 nt, hsa
aauuauggaagaagaguauacgaccuucccuucccuuucaagcauaaguccaaauagacucuc

SEQ ID NO: 496177 - RNA, 63 nt, hsa
ucuucaccuauaagacggggaaaauaauaccacccuuucaagauuguugagauaaauaaguga

SEQ ID NO: 496178 - RNA, 63 nt, hsa
uucaccugauugaaauuggaaauggucuugucaccuuucaacuucgaggacuggaauuccgag

SEQ ID NO: 496179 - RNA, 63 nt, hsa
cuagaaucuggaacugucaccaugaugaauggcccuuucaaugcauaguuacagaaauuccug

SEQ ID NO: 496180 - RNA, 63 nt, hsa
auuuauuuuugacguauaauguaguauaucaauccuuucaaacuauuuagauaaccacuugau

SEQ ID NO: 496181 - RNA, 63 nt, hsa
uguuuuaugauguuguauagcaaucgcuuuuuaccuuucaaaguuccggguaaaaauguguua

SEQ ID NO: 496182 - RNA, 63 nt, hsa
uaaacucagacuucgcuuuuuuugugagacuauccuuucaauauuuuuauaaacuuuugugug

SEQ ID NO: 496183 - RNA, 63 nt, hsa
acuaagacauauuuccuuucacuuggcaggauuccuuucaaaauggaaucugaguauuagaca

SEQ ID NO: 496184 - RNA, 63 nt, hsa
cauguaaaauauguaaauucuaguaccugaaauccuuucaacagauuuuuauauagcaacugc

SEQ ID NO: 496185 - RNA, 63 nt, hsa
uuguugauuguaguaauuucuauuugcacugugccuuucaacuccagaaacauucugaagaug

SEQ ID NO: 496186 - RNA, 63 nt, hsa
cauucggcuaacgagggauuacuuuggccaaaaccuuucaaaggauaugcagaaagaugguag

SEQ ID NO: 496187 - RNA, 63 nt, hsa
auuucuguaaacauauuucugaaauauuuuuugccuuucaagcgacagaugccucauuuugug

SEQ ID NO: 496188 - RNA, 63 nt, hsa
uagcaaacacggaagaauuuuaaaaugagcucuccuuucaacccuuguuaacaagugccuaaa

SEQ ID NO: 496189 - RNA, 63 nt, hsa
acuaaucaauuuuuauuauuggaauaguuuuaaccuuucaaauacauguucuguccuggagca

SEQ ID NO: 496190 - RNA, 63 nt, hsa
guugacaugugcuuuggggcuuuuacaccaguuccuuucaaugguuugcaaggaagccacagc

SEQ ID NO: 496191 - RNA, 63 nt, hsa
gaccgcugacguucccaagugacagauccagggccuuucaaacauccccaaagucauggccau

SEQ ID NO: 496192 - RNA, 63 nt, hsa
ccucuuaaagcugccuguaguuaggaaauaaaaccuuucaaauuucacauccaccucugacuu

SEQ ID NO: 496193 - RNA, 63 nt, hsa
guaaaggcagccuuuaaaacauagcaauaugcaccuuucaacuuuacaucauguccugaacaa

SEQ ID NO: 496194 - RNA, 63 nt, hsa
aaaaauaauuccuuuuuuguuuuuguuugucugccuuucaaagugagacaagguggacaccaa

SEQ ID NO: 496195 - RNA, 63 nt, hsa
uuguggggggacacaaccaaaccauaucagcauccuuucaagaauauuagauaauuggagcug

SEQ ID NO: 496196 - RNA, 63 nt, hsa
gagcuaaucugauacacuuuugauaauauaaugccuuucaaauuaguuaccaaaucauaaaca

SEQ ID NO: 496197 - RNA, 63 nt, hsa
uuguggacuuccugccuuguucuuugauucagcccuuucaaacaugcuuaccucgagugaccc

SEQ ID NO: 496198 - RNA, 63 nt, hsa
cagcaagcaauccccaaccuuucacugcaaugaccuuucaaugcaauaaaagcuuauugucca

SEQ ID NO: 496199 - RNA, 63 nt, hsa
caauucuugaauuccuuggggauuuuuuacugcccuuucaaagcacuuaaguguuagaucuaa

SEQ ID NO: 496200 - RNA, 63 nt, hsa
cuucauaauaauaaaacaacucauguuagagacccuuucaacaugaaagguuuguaguugaga

SEQ ID NO: 496201 - RNA, 63 nt, hsa
aaaugcccggagauuccaaguggcagacauuucccuuucaauuuauggcccauuaaaagcucu

SEQ ID NO: 496202 - RNA, 63 nt, hsa
cuauugguuauguuaguaucacauuacuucuagccuuucaauuacuccauguuuuauuuaaua

SEQ ID NO: 496203 - RNA, 63 nt, hsa
aggaagaaagucgcuuuugacggauugugguguccuuucaaauuagcuuauuucacaaauauc

SEQ ID NO: 496204 - RNA, 63 nt, hsa
uuguucuacagcaagaauauucauaaaaguaucccuuucaaaugccuuugagaagaauagaag

SEQ ID NO: 496205 - RNA, 63 nt, hsa
aaaaaaaaauucacacugccagcguuaacaguuccuuucaaaggagaaugaaucaugauggca

SEQ ID NO: 496206 - RNA, 63 nt, hsa
cuacucauagucugagucauaaaacaucauuugccuuucaauuuauaccuuccaagugaauau

SEQ ID NO: 496207 - RNA, 63 nt, hsa
uugacaugcuuugcaaaucuggauuccaauggaccuuucaaaaccacaacaaaaccucaguuu

SEQ ID NO: 496208 - RNA, 63 nt, hsa
cgugacuaucacagcacuuggucugggaaaguaccuuucaacaacaguuaagccaaaagguac

SEQ ID NO: 496209 - RNA, 63 nt, hsa
cuuucugaauucuugcuuguacauuuuuuuuuaccuuucaaagguuuuuaauuauuuuuguuu

SEQ ID NO: 496210 - RNA, 63 nt, hsa
ccauuucccuucucuuucccauagauucccccaccuuucaaacugguuuguauuuauuucaaa

SEQ ID NO: 496211 - RNA, 63 nt, hsa
gguugucucugaaccaggagagaagguacuauaccuuucaaauccccagggcagacacacccc

SEQ ID NO: 496212 - RNA, 63 nt, hsa
ucuuacaguuuuuacucaugauaaaucuuaucaccuuucaaaaauugauuguggugccucagg

SEQ ID NO: 496213 - RNA, 63 nt, hsa
agaacuaauaaaugcaccuuaauggucaguguuccuuucaaacaugugaguucuuuaacaaaa

SEQ ID NO: 496214 - RNA, 63 nt, hsa
gaagcuggugagccaguggccauuagauaaauaccuuucaagugugagcuuagacgucaaccc

SEQ ID NO: 496215 - RNA, 63 nt, hsa
aaaaaaaaaaaaagcuugaucucuaucagacuuccuuucaacuguccuccccuccaagcagac

SEQ ID NO: 496216 - RNA, 63 nt, hsa
ggaaaaaaauaaaaaauauauaguggacaguaaccuuucaaucaaaacucaguaucauaagua

SEQ ID NO: 496217 - RNA, 63 nt, hsa
gugaagcugaugccuaggaacuuuuaaagggauccuuucaaaaggaucacuuagcaaacacau

SEQ ID NO: 496218 - RNA, 63 nt, hsa
uuuuuuuuuaaguucaguucucccuuauggcugccuuucaaacaaguaccuuuuaucugaugc

SEQ ID NO: 496219 - RNA, 63 nt, hsa
gccaggauuuuuucagcuggaaagauacgccauccuuucaaacccucaugacugacaaaaacu

SEQ ID NO: 496220 - RNA, 63 nt, hsa
uaaaacaaaaauuucuagguauuugcuuuauuaccuuucaaauauuuacuguugcuuggcccc

SEQ ID NO: 496221 - RNA, 63 nt, hsa
uuuuauguaggaguuuuaaauguguguuuuuuuccuuucaagucuuacaaagcuaagacuuuu

SEQ ID NO: 496222 - RNA, 63 nt, hsa
aaagaguaaggguaaaaaagauaaaguccugaaccuuucaaaauggaaaauuaauucuaaacu

SEQ ID NO: 496223 - RNA, 63 nt, hsa
gccucuacugggucuauauugugaaucauccugccuuucaaauuuguuucauaauuguuagau

SEQ ID NO: 496224 - RNA, 63 nt, hsa
acuggaagggacccuggagcccugggaccacccccuuucaagucccaaacacugaguccucug

SEQ ID NO: 496225 - RNA, 63 nt, hsa
accaugaugcugggguuaccucacaguccccacccuuucaaaguugacauauggccaucccau

SEQ ID NO: 496226 - RNA, 63 nt, hsa
uuuuaagcaaggcauggggaacagggaauagaaccuuucaaagagguugcccagagaaaagcu

SEQ ID NO: 496227 - RNA, 63 nt, hsa
aaagcaaaaaaauaaaaccacaauugagauuugccuuucaaacccucagguuugccucuaacc

SEQ ID NO: 496228 - RNA, 63 nt, hsa
gcuaucuuuuuuagaaacuauuagaaaugacucccuuucaaagucaaucuuuggaaaauauug

SEQ ID NO: 496229 - RNA, 63 nt, hsa
cagucauucugaaaggaccuuucccuguacuuaccuuucaacaugcuucaaucuuaucaacgc

SEQ ID NO: 496230 - RNA, 63 nt, hsa
acauucuguuaagauaucccucaugacaguugcccuuucaaagcaggaggaagaaaaggaaga

SEQ ID NO: 496231 - RNA, 63 nt, hsa
uaaaugcagcuaagucauacauucauuuugacuccuuucaaugucacacacauaguauugauc

SEQ ID NO: 496232 - RNA, 63 nt, hsa
gauugcuuugaaaacaugacucaauaaaaguuuccuuucaauuuaaacacugaagccgcucug

SEQ ID NO: 496233 - RNA, 63 nt, hsa
aaugcuucuagaguuuuauagccuggacugcuaccuuucaaagcuuggagggaagccgugaau

SEQ ID NO: 496234 - RNA, 63 nt, hsa
acuguccacccucauuucugccagcgcauguguccuuucaaggggaaaaugugaagcugaacc

SEQ ID NO: 496235 - RNA, 63 nt, hsa
auuuuuuaaaaaagaaauagucaguguuuuccuccuuucaaccgagacuauuucuggauugug

SEQ ID NO: 496236 - RNA, 63 nt, hsa
acuguuuguugcauuucaguaaaagcagaauaaccuuucaaaauaauaacaggcugggugcaa

SEQ ID NO: 496237 - RNA, 63 nt, hsa
uuauucuguauaaaacugucuuuuaagaauuauccuuucaaaauaaaaauguuauuguuucac

SEQ ID NO: 496238 - RNA, 63 nt, hsa
aguauagagagaauagugaaaaauuaaucuugcccuuucaagccuuauacaguaguacacugu

SEQ ID NO: 496239 - RNA, 63 nt, hsa
ucaaguaucugugguuucaugccccucucuauaccuuucaaagaacuccugaagcaacuuaac

SEQ ID NO: 496240 - RNA, 63 nt, hsa
uuacauuugcuaaacagacaguuaauaucaaauccuuucaauauucugggaacccagggaagu

SEQ ID NO: 496241 - RNA, 63 nt, hsa
aaacguuaacaaaccccaucgugguccauggagccuuucaaaaugggugcccuggaggggccu

SEQ ID NO: 496242 - RNA, 63 nt, hsa
uaucaguaagucaaaucuguuugaauuauaauuccuuucaaauaguuuugcuauuuaauuuau

SEQ ID NO: 496243 - RNA, 63 nt, hsa
uuguggaauauggcaauagcauuguucuucuccccuuucaaauugccuuucuugaccuuaugc

SEQ ID NO: 496244 - RNA, 63 nt, hsa
aauccccaaagacauuaucuguggucuuuuuuuccuuucaagcucagccugugugccugaugu

SEQ ID NO: 496245 - RNA, 63 nt, hsa
guacaaaagaaaaccaagauuuugauaugaccaccuuucaacacuuuuuacugcaacuagagu

SEQ ID NO: 496246 - RNA, 63 nt, hsa
gggaucaccacuauauuuuguuuugauuuuuaaccuuucaacauuuuccuaaugauuugcaga

SEQ ID NO: 496247 - RNA, 63 nt, hsa
uuaaagagaaaaaucucauauaauuugucauaaccuuucaauaaauaaaacuguuaaaucaug

SEQ ID NO: 496248 - RNA, 63 nt, hsa
uauuuccuauguuacauuucuuuugucuauuuuccuuucaaaauugguauuuuuguugggcuc

SEQ ID NO: 496249 - RNA, 63 nt, hsa
gcaaggagcaucgaaauuugagauacccaggacccuuucaagcaagaauggccaaaaagccuu

SEQ ID NO: 496250 - RNA, 63 nt, hsa
aacuaccauuauguuuuaguacuaagggauauaccuuucaauaaaguuaaugaaauucaaucc

SEQ ID NO: 496251 - RNA, 63 nt, hsa
cuccauucaguuuuaucuccaucaauaaaguggccuuucaaaaagaaucuuccucuugcucuc

SEQ ID NO: 496252 - RNA, 63 nt, hsa
ccacauccgugcugugucauuguugcucugcuuccuuucaaugugucagugccuggggggagg

SEQ ID NO: 496253 - RNA, 63 nt, hsa
cacauggcagcauuucccuuuuccccuccuuugccuuucaagagcagggccugggcaaggcca

SEQ ID NO: 496254 - RNA, 63 nt, hsa
ggcagcagggcagaggugcaccaggaguaaaaaccuuucaaaaaagagguguggcuuuccuca

SEQ ID NO: 496255 - RNA, 63 nt, hsa
ccuuggauguaggauuucagggaggcuagaaaaccuuucaauuggaaguuggaccucaggccu

SEQ ID NO: 496256 - RNA, 63 nt, hsa
aaggagaaaaaaaaauauggugagaagcucgcuccuuucaacuuguuugguacugacagcuga

SEQ ID NO: 496257 - RNA, 63 nt, hsa
guuguguaauguuuguauauuucugagccagauccuuucaaagauugccuuuuuauaaaauug

SEQ ID NO: 496258 - RNA, 63 nt, hsa
auacauccuuuuagcaaaagacuggaauuuuauccuuucaacuucaagaacuuuggaaaugca

SEQ ID NO: 496259 - RNA, 63 nt, hsa
ucugagugugguaauugugccucuagcacccagccuuucaaagcccaccugaaaccugggggu

SEQ ID NO: 496260 - RNA, 63 nt, hsa
aauucuuuuggcacacuauuaaaugcaaaaacuccuuucaaaacaaaaaagaacuaccuuaua

SEQ ID NO: 496261 - RNA, 63 nt, hsa
ccccugcucauugguggauguuaaaccaauauuccuuucaacugcugccugcuagggaaaaac

SEQ ID NO: 496262 - RNA, 63 nt, hsa
cuccuggucauugguggauguuaaacccauauuccuuucaacugcugccugcuagggaaaacu

SEQ ID NO: 496263 - RNA, 63 nt, hsa
aaaaugcaggcucuauuguuuucaauuuagcagccuuucaaauguauaugguucuggccacau

SEQ ID NO: 496264 - RNA, 63 nt, hsa
uaaggugcuauauucccucagagcucacaaaugccuuucaauucuuucccugaccuccuuucc

SEQ ID NO: 496265 - RNA, 63 nt, hsa
uuuggcugcaggauuaaguaaugaugagucuucccuuucaacuguuguuaaaucugagacauc

SEQ ID NO: 496266 - RNA, 63 nt, hsa
ugauggcgauucccucucacccgggacucucccccuuucaaggaaagugaaccuuuaaaguaa

SEQ ID NO: 496267 - RNA, 63 nt, hsa
ucacuaccaaacucagcccuucuuggaauacagccuuucaagcagaggacagaaggguccuuc

SEQ ID NO: 496268 - RNA, 63 nt, hsa
gaacaggaagguauguccugucaguaucuuaacccuuucaacaagacauuuaccuauuugucu

SEQ ID NO: 496269 - RNA, 63 nt, hsa
cuaacacauuacauuucaaaaacuauuuugguaccuuucaaauacaguguuuaaauuaaaaua

SEQ ID NO: 496270 - RNA, 63 nt, hsa
uuauaugcuuguguaacaggaacaaaguaacagccuuucaauucauauacugccuuguguuca

SEQ ID NO: 496271 - RNA, 63 nt, hsa
uggaaaaccguuauagacccaauaacaacuaaaccuuucaaaagaaaauauuuucuauuauga

SEQ ID NO: 496272 - RNA, 63 nt, hsa
ccagccagaagagggaccaccuguaaagcaaguccuuucaaguuucacugcacaucccaaacc

SEQ ID NO: 496273 - RNA, 63 nt, hsa
uaaacagaagugaaucagacuuuucuccagcuaccuuucaaaauaauaaauuauuugucucaa

SEQ ID NO: 496274 - RNA, 63 nt, hsa
gccgcauccccaaccaauccacagccuggaguaccuuucaaggucaaagugcauggccagcuc

SEQ ID NO: 496275 - RNA, 63 nt, hsa
acaccccuccguuccgcuagccuacccugucagccuuucaauaaaaguuaugcacaaauguga

SEQ ID NO: 496276 - RNA, 63 nt, hsa
cgggucggaggagacaaacucuuuggaaauaacccuuucaagacuuucuuuucugccguuaaa

SEQ ID NO: 496277 - RNA, 63 nt, hsa
aauuagaaaccaccaucuaaccucuaacuagguccuuucaacuuuaaccaaguauuuucuuug

SEQ ID NO: 496278 - RNA, 63 nt, hsa
cgcuauucagaugcagagcacugcagcauccagccuuucaaagcugacucuucucaaucaucu

SEQ ID NO: 496279 - RNA, 63 nt, hsa
accaagaacaguugagcucucucagggccuuccccuuucaacaauuuaguugaaugacucccu

SEQ ID NO: 496280 - RNA, 63 nt, hsa
aucaauggcuuuauuuuuaaccuauaaauaaccccuuucaauauaccugguuuuuacagcauu

SEQ ID NO: 496281 - RNA, 63 nt, hsa
uuagcaggacuuaauuuucuuaauuuauucuuuccuuucaauuauagugacauagaguaguug

SEQ ID NO: 496282 - RNA, 63 nt, hsa
uuaauggaguuaaaauguuuaugguaauuguaaccuuucaaaugaguuacgugaaaagagcau

SEQ ID NO: 496283 - RNA, 63 nt, hsa
cagaagcgagaugccauugccaacuguuuuauuccuuucaacaacugcauugugaauaaacuu

SEQ ID NO: 496284 - RNA, 63 nt, hsa
guacaaccugaaaaauguuaaggcuuauugaaaccuuucaaguaggggaugguacauuuauuu

SEQ ID NO: 496285 - RNA, 63 nt, hsa
ugccauguaauugaaauauauagauuauuguaaccuuucaaccugaaaaucaagcaguaugag

SEQ ID NO: 496286 - RNA, 63 nt, hsa
ccuuuggcuuuucgugaagacauauuuccccagccuuucaacuguaaacuccuuuaguaccau

SEQ ID NO: 496287 - RNA, 63 nt, hsa
guagcaaaaaucaugaaaaacacuucaacguguccuuucaaucauccaauuaaauguggguag

SEQ ID NO: 496288 - RNA, 63 nt, hsa
ugucuuuuuccucuuaauguaucagcaugcuacccuuucaaacucaaauuuucauuuuaacug

SEQ ID NO: 496289 - RNA, 63 nt, hsa
ggugggcuccagggcgggaggcaagcccccuugccuuucaaacuggaaaccccagagaaaacg

SEQ ID NO: 496290 - RNA, 63 nt, hsa
ucuuauggaaacugauuuauaucuuuuuuaugaccuuucaaaaguaaaauacuaugcauaauc

SEQ ID NO: 496291 - RNA, 63 nt, hsa
cagcuuugaaggcuggauucuaucuacauaaguccuuucaauuccaccagggccagagcagcu

SEQ ID NO: 496292 - RNA, 63 nt, hsa
uaagagaggauucuuuucauccuaaaucuuuuaccuuucaaucuuuguaucuauuauuacacg

SEQ ID NO: 496293 - RNA, 63 nt, hsa
agauuaaaaauuagcugcguguaguagcauaugccuuucaacguagcuacucaggaggcugag

SEQ ID NO: 496294 - RNA, 63 nt, hsa
uuuuuaaaucaaacugaaaacaaaaagcuuuaaccuuucaacagaauuuuuaaaaaggcaguu

SEQ ID NO: 496295 - RNA, 63 nt, hsa
auaaaauaucuauuugaauaaauuaugagcuauccuuucaaacagcuauuggcaaguuuuaaa

SEQ ID NO: 496296 - RNA, 63 nt, hsa
gggaaagcauuuucuauaucaauuguguuuaaaccuuucaagaagguuauuuagcuagcuuag

SEQ ID NO: 496297 - RNA, 63 nt, hsa
uaaaaacuuggaccucauccucaauuauuuucuccuuucaacucuguugacccucugucuggu

SEQ ID NO: 496298 - RNA, 63 nt, hsa
aaguguuuuaucuggauuuagcaugugaagaucccuuucaauuauuaagguauaauaggcugu

SEQ ID NO: 496299 - RNA, 63 nt, hsa
auuugccuguauguuuuguggguuuuuuuuuuuccuuucaagauguuuucuauuucuaaauua

SEQ ID NO: 496300 - RNA, 63 nt, hsa
uacccuauaaaucucaacagcuuaggaugugucccuuucaacucagacuuuucauuuuagaga

SEQ ID NO: 496301 - RNA, 63 nt, hsa
uacuuuagcauaaaaaauguugaguuaucaccaccuuucaauuccauggaccugauuuuucca

SEQ ID NO: 496302 - RNA, 63 nt, hsa
cuacugauuucuguuuuugugaucucugacuuuccuuucaaauuuuuacugagaauaucgaaa

SEQ ID NO: 496303 - RNA, 63 nt, hsa
cugcuagcaaccacacugaagagaucgaugccuccuuucaagcuagccaaguuuucugcgagc

SEQ ID NO: 496304 - RNA, 63 nt, hsa
aauuaacuuugacuccuggaaguauugagucuuccuuucaaggaccauaagguacaucaguua

SEQ ID NO: 496305 - RNA, 63 nt, hsa
accucccggguuccagggauucuccugccucacccuuucaaguagcugggauuacagguaccu

SEQ ID NO: 496306 - RNA, 63 nt, hsa
uuuuaaaaaccugaagcuuuuuugguggcaggaccuuucaauaaauauuuauuuggucaaaau

SEQ ID NO: 496307 - RNA, 63 nt, hsa
agcucaaguugaauuuucuuuccagccaguuacccuuucaaccuacccauacuuuguacaacu

SEQ ID NO: 496308 - RNA, 63 nt, hsa
uauucacgcaguuacucgcuuccauuuuuaugaccuuucaacuauagguaauaacucuuagag

SEQ ID NO: 496309 - RNA, 63 nt, hsa
guauuucucuauacguauugguacuugaagauuccuuucaaaagaaauccagcguuuuccuaa

SEQ ID NO: 496310 - RNA, 63 nt, hsa
cucagacuuucauauuucuguguugcugagaugccuuucaaugcaaucgucugggcucgugga

SEQ ID NO: 496311 - RNA, 63 nt, hsa
uuauucccagcacuguuucaggcaagaacuuucccuuucaacuucaggcucauuuucuucuca

SEQ ID NO: 496312 - RNA, 63 nt, hsa
uaauaauuaguugcugcaguacucauaaugagcccuuucaaggaauagauguaaauuacccuu

SEQ ID NO: 496313 - RNA, 63 nt, hsa
acuuguugguguggaucuauuggcugaucuaugccuuucaacuagaaaauucuaaugauuggc

SEQ ID NO: 496314 - RNA, 63 nt, hsa
gagcaggcuuguggcagccugauucggggcugaccuuucaaacccagaggguugcugguccug

SEQ ID NO: 496315 - RNA, 63 nt, hsa
ucuucucagguugccaggaaauguuucucuaacccuuucaaaaguguuuguaaaccaaguuca

SEQ ID NO: 496316 - RNA, 63 nt, hsa
guauaucacaauuugggugaaaaacuuaaguacccuuucaaacuauuuauaugaggaagucac

SEQ ID NO: 496317 - RNA, 63 nt, hsa
ucauguacccaguguuaacucuuuguuguugucccuuucaaauauggauaacucugugaacag

SEQ ID NO: 496318 - RNA, 63 nt, hsa
aauguucccucaaauagcacggggaagcaacugccuuucaaggguaauugaggcugaaugaau

SEQ ID NO: 496319 - RNA, 63 nt, hsa
ucauucaaucuguuuuuuuaaauguuauuuuugccuuucaauguaaucaauuggauuaacaau

SEQ ID NO: 496320 - RNA, 63 nt, hsa
uucuucauuggaugugaucugaacuuuuuuucuccuuucaacauacuuaggcuguggagugca

SEQ ID NO: 496321 - RNA, 63 nt, hsa
agauaaaguugaaaucauagaagaugcaaaugaccuuucaaaaucaacacaauguguucugaa

SEQ ID NO: 496322 - RNA, 63 nt, hsa
gggcuuaauaagcagccguuugcuaaugugcuuccuuucaaaggguuggaccuuuaaauugcu

SEQ ID NO: 496323 - RNA, 63 nt, hsa
ccacaccuccagagcagugggacuuccuccugcccuuucaaagaauaaccacagcucagaaga

SEQ ID NO: 496324 - RNA, 63 nt, hsa
gauaucaguugaaugccuuauauuguauacauuccuuucaaauaaagaccuugagaaaacagc

SEQ ID NO: 496325 - RNA, 63 nt, hsa
uaccaaacuuaacuggauuaauauaccaaugauccuuucaaauuauaugacauaaacuuauuu

SEQ ID NO: 496326 - RNA, 63 nt, hsa
uucuacugauuguaagucagaauuucuuuuaucccuuucaaaucaguuucuacauguuuaagu

SEQ ID NO: 496327 - RNA, 63 nt, hsa
uucuggugguagacugguagugagcagcaaaugccuuucaagaaaauagguggcagcuucacu

SEQ ID NO: 496328 - RNA, 63 nt, hsa
cuggugagggcuggcccuaaacauccaccuaauccuuucaaaucagcccggcaaaagcuagac

SEQ ID NO: 496329 - RNA, 63 nt, hsa
ucaaauaugaucagagaauuguggaaaagacauccuuucaauguaaugaaauugauaguacca

SEQ ID NO: 496330 - RNA, 63 nt, hsa
ugagcuuuaaaaacuugaaaaacaguuuguaagccuuucaacagcagcaucaaccuacguggu

SEQ ID NO: 496331 - RNA, 63 nt, hsa
aacuccugaccucaggugauucgccugccucggccuuucaaagugcugggauuacagacauga

SEQ ID NO: 496332 - RNA, 63 nt, hsa
aggcucucauuuccugugucuuguauauucaguccuuucaauacguccaccuggaggcucacc

SEQ ID NO: 496333 - RNA, 63 nt, hsa
acagauuucuauuuuugucaaaacuucaugguuccuuucaagaucuuuuuugccaaaacauuu

SEQ ID NO: 496334 - RNA, 63 nt, hsa
ugacuuuuacacacauucacacaagaaaaaaauccuuucaaaauucuuaaaucuucuguuccu

SEQ ID NO: 496335 - RNA, 63 nt, hsa
uccuuugaaagagcuccaaauugguggcauuauccuuucaaaaucucagggauuugggaugaa

SEQ ID NO: 496336 - RNA, 63 nt, hsa
aggcuccacuuggucugugagaugcuagaacucccuuucaacagaauucacuuguggcuauug

SEQ ID NO: 496337 - RNA, 63 nt, hsa
gaugacucuucuuaucacacuugcaaaugaaugccuuucaaacauugagacugcuagaaccaa

SEQ ID NO: 496338 - RNA, 63 nt, hsa
aaaucuagauuuauaccauuuuuuaaagucccaccuuucaauguuuaauaaaacaaaaagaga

SEQ ID NO: 496339 - RNA, 63 nt, hsa
uucacuauucauuuagguuuuuauacuccaccuccuuucaaaaaagauuuaagauguacgaca

SEQ ID NO: 496340 - RNA, 63 nt, hsa
cuaacugggaccuugaacaagucagcaucucugccuuucaaaaugaaggaacauuguucucua

SEQ ID NO: 496341 - RNA, 63 nt, hsa
gguggccuuuucuggguuaucuucugaucauggccuuucaacccaacaagggcccuucccugc

SEQ ID NO: 496342 - RNA, 63 nt, hsa
uucuuauugcaaagcuucagucagagccauuacccuuucaagccccuggucagguauuauuau

SEQ ID NO: 496343 - RNA, 63 nt, hsa
aaagccuaaauugggaaacaguuguuagcaaacccuuucaaccaucuaaaugaaaacacacaa

SEQ ID NO: 496344 - RNA, 63 nt, hsa
aaaacaggauaaucgugguguaaaugaguguuuccuuucaaaguccacugcagagcuuuuauc

SEQ ID NO: 496345 - RNA, 63 nt, hsa
aggauccacuuggucugugagaugcuagaacucccuuucaacagaauucacuuguggcuauua

SEQ ID NO: 496346 - RNA, 63 nt, hsa
uuaaauugguuuacaugaaaguggauuaaaaggccuuucaaaagaauggguuugaaaaaccuc

SEQ ID NO: 496347 - RNA, 63 nt, hsa
ggaaaaacaaaccuaaaauagaaauacagucagccuuucaaauccauggguucuguguccgug

SEQ ID NO: 496348 - RNA, 63 nt, hsa
agauuguggguuucccaucccccugacuuuaccccuuucaagccugggguugucuauacccac

SEQ ID NO: 496349 - RNA, 63 nt, hsa
gcaaacugcuuuuccauuaauggagaauucaugccuuucaagcauuuuaaauaugacaauauu

SEQ ID NO: 496350 - RNA, 63 nt, hsa
gcuauguuaaguugucuuauuaaguaauugaguccuuucaaugucuucuugagguauguauug

SEQ ID NO: 496351 - RNA, 63 nt, hsa
caacacuacucacucaguagcuagcagccccuuccuuucaacugggaguguuauuagaaugaa

SEQ ID NO: 496352 - RNA, 63 nt, hsa
caccugccccuuucuuucaaucccacgcuguuuccuuucaaaguucugggaggacgaacucac

SEQ ID NO: 496353 - RNA, 63 nt, hsa
uuacuuuuucauguauauccaggcuauaaauauccuuucaaaucauguucuuauaccuaauuu

SEQ ID NO: 496354 - RNA, 63 nt, hsa
gauggacaaugcaugggguggucuuuauuuuucccuuucaaauaaaacacuagucagguaccg

SEQ ID NO: 496355 - RNA, 63 nt, hsa
gcucuuaaaggagaucaccucuuaaaggacccaccuuucaaugccauuacacuggcaauuuaa

SEQ ID NO: 496356 - RNA, 63 nt, hsa
acaguauaacuaaacaugauauaucagcuuuugccuuucaauuuaucaaucucuuaaagagaa

SEQ ID NO: 496357 - RNA, 63 nt, hsa
acuugugucaauauuaaagauagcugagaagcaccuuucaaauggcacagucccucuucaaga

SEQ ID NO: 496358 - RNA, 63 nt, hsa
auagccaaugauuuuaucccccagaauccuucaccuuucaaggaguuauuuaacaaugagccc

SEQ ID NO: 496359 - RNA, 63 nt, hsa
ugaucaaaucugcuuuucaaaguuuaucaauacccuuucaaaaauauauuuaaaaucuuugaa

SEQ ID NO: 496360 - RNA, 63 nt, hsa
aagcacccaccaggcaggcuacaagugaggcuaccuuucaaacuacauugcccacccugaagg

SEQ ID NO: 496361 - RNA, 63 nt, hsa
ggucaaguaaucugcucuuuauccgcguuuaccccuuucaacucccuuacaccaugucaaacu

SEQ ID NO: 496362 - RNA, 63 nt, hsa
uucagaauuaaaacugcccuuaauuuuaauauaccuuucaaucggccacuggccauuuuuuuc

SEQ ID NO: 496363 - RNA, 63 nt, hsa
gaucccagagagcagcuucagugacaaacauauccuuucaagacagaaagagacaggagacau

SEQ ID NO: 496364 - RNA, 63 nt, hsa
uuuucuuugcaaaaccccuccacaaaagcaaauccuuucaagaauggcaugggcauucuguau

SEQ ID NO: 496365 - RNA, 63 nt, hsa
gagaaagaagaaaauggcugcccauuucaguacccuuucaaagguaucucugccuaggaacau

SEQ ID NO: 496366 - RNA, 63 nt, hsa
cauauauuccuccuggcuuccuuacaaaacaagccuuucaaacaaucauuguccucaggaaag

SEQ ID NO: 496367 - RNA, 63 nt, hsa
uuuugaucuucuuguuuucugacuuggaaguauccuuucaaaaaaacucuuaagauaucuagg

SEQ ID NO: 496368 - RNA, 63 nt, hsa
uuuagacaaugaaaauuaucaagagauaauuuaccuuucaauuaugauaaauagaugugauug

SEQ ID NO: 496369 - RNA, 63 nt, hsa
uauauaacuaaucuguuaacgguuuuugaaaaaccuuucaaauuauuugaauaaucuucauau

SEQ ID NO: 496370 - RNA, 63 nt, hsa
aucaaaagagcucuaaauuuguaauuucuuucuccuuucaaaaaaugucuacuuuguuuuggu

SEQ ID NO: 496371 - RNA, 63 nt, hsa
aacuccuguccucaagugauccucccaccucagccuuucaaagugcuggaauuacagguguga

SEQ ID NO: 496372 - RNA, 63 nt, hsa
agguugguucuuccuguuauucucucuggcuuuccuuucaacccacuuauuuucagaggccuc

SEQ ID NO: 496373 - RNA, 63 nt, hsa
uguucuguucugcugccuuuuacguuuucuuguccuuucaaaaguguucuugaaagaaacaaa

SEQ ID NO: 496374 - RNA, 63 nt, hsa
cugcaggcagauggaccggaggguuuucugcuuccuuucaaccagauaacuuccuaaguggag

SEQ ID NO: 496375 - RNA, 63 nt, hsa
aagaccuuuuuucaccguuaccuaauuuuuuccccuuucaagaauuuuuuuuuuuuuuggugu

SEQ ID NO: 496376 - RNA, 63 nt, hsa
cagcguugacacagccgugacuuacaauuaaacccuuucaauuacaguacagauucugugugc

SEQ ID NO: 496377 - RNA, 63 nt, hsa
auugaccacgagucucacuucaguuucccaguuccuuucaaccucuuucugauagauuuccuc

SEQ ID NO: 496378 - RNA, 63 nt, hsa
aacuaauuggaaacacucuuccccuucuguuccccuuucaaaaauaaaacaaaauauugcauu

SEQ ID NO: 496379 - RNA, 63 nt, hsa
ugugauggugguaagccuucaaagaaagaaaggccuuucaagaaucaaacuugauaauaauga

SEQ ID NO: 496380 - RNA, 63 nt, hsa
ccuaaauaagggugguggacuaucuugaagaacccuuucaacucuaaaaauugacccuaucaa

SEQ ID NO: 496381 - RNA, 63 nt, hsa
auuuuaagugacagugccauaguuuggacaguaccuuucaaugauuaauuuuaauagccugug

SEQ ID NO: 496382 - RNA, 63 nt, hsa
uuauauguaaucaccuaugucagagaaagaaaaccuuucaaccaaaugauugguucaaaagga

SEQ ID NO: 496383 - RNA, 63 nt, hsa
uaaaauagcauuaggucuaucuagccaccaccaccuuucaacuuuuuaucacucacaaguagu

SEQ ID NO: 496384 - RNA, 63 nt, hsa
acauccucugauucuaggugugguguugacuguccuuucaaggaaaaacuugcaauagaggga

SEQ ID NO: 496385 - RNA, 63 nt, hsa
uagaaaacacacuuccugcaccaacaccaauacccuuucaaaagaguugucugcaacauuuuu

SEQ ID NO: 496386 - RNA, 63 nt, hsa
cuuuuaagguuucaacaaauuucauugcacuuuccuuucaauaaaguuguugcauucccaauu

SEQ ID NO: 496387 - RNA, 63 nt, hsa
uuuucaauaccuguuuucauauacaauuacaaaccuuucaaaccuguauuccuucuuuauacu

SEQ ID NO: 496388 - RNA, 63 nt, hsa
gacucauccugugacuuuguaaccacacucauuccuuucaaacacagaggaggaauuauugcu

SEQ ID NO: 496389 - RNA, 63 nt, hsa
uugaauaauaagcaggauguuggccaccaggugccuuucaaauuuagaaacuaauugacuuua

SEQ ID NO: 496390 - RNA, 63 nt, hsa
uugucaaaguguggucugggggggccucaagagccuuucaaggguauucuaggucaaagcugu

SEQ ID NO: 496391 - RNA, 63 nt, hsa
guuucucccauuuagaauaucuagcauguaaggccuuucaauauuaauauaagcccaauauca

SEQ ID NO: 496392 - RNA, 63 nt, hsa
cagauauauaagcagauaagcacagauuauuguccuuucaaguuaagaguauauaaucuggac

SEQ ID NO: 496393 - RNA, 63 nt, hsa
cacuauauaaaacccaacagcuucaacuauugcccuuucaacaguuuugccacugaccggaua

SEQ ID NO: 496394 - RNA, 63 nt, hsa
auuccuugaagaugugagauuuaaaaauuuuucccuuucaauguuguuauguauucuacuggu

SEQ ID NO: 496395 - RNA, 63 nt, hsa
cuuucaugcaguuuguuugaaguuaaguggaauccuuucaaaugacgagcugcagagaacuca

SEQ ID NO: 496396 - RNA, 63 nt, hsa
uuuguguuuauacugggccagguccugguagaaccuuucaacaaacaaccaaacaaaaagaaa

SEQ ID NO: 496397 - RNA, 63 nt, hsa
guuuugguucacaaaaguaauuauucuugggugccuuucaagaaaauuaaaaauacuacucac

SEQ ID NO: 496398 - RNA, 63 nt, hsa
aguggggccugccuggucucuagaggguugcugccuuucaagcggugccuaagaaguuauuuu

SEQ ID NO: 496399 - RNA, 63 nt, hsa
gguucaguauuuucuuuuuaguauaacuuacauccuuucaaauaagucuuugcccucaugaag

SEQ ID NO: 496400 - RNA, 63 nt, hsa
ggagcaggugaauaaaggaucucuauaacagauccuuucaaaagaagaguuuuagagaaaaua

SEQ ID NO: 496401 - RNA, 63 nt, hsa
cagaugguuucuuuuuguaaagaguuccguuugccuuucaauuuuuagagaaaauaaagacug

SEQ ID NO: 496402 - RNA, 63 nt, hsa
uaggaucuguuuuuucaucgaggucucggguauccuuucaaagauagugagaagcagacacug

SEQ ID NO: 496403 - RNA, 63 nt, hsa
ugcagucuuuacacccacagcucugcccuuuucccuuucaaccucuccuccgcugucaugccu

SEQ ID NO: 496404 - RNA, 63 nt, hsa
gucuggaaggacugaaaccuggucauacccaguccuuucaaggggccucuuuucuacuaauaa

SEQ ID NO: 496405 - RNA, 63 nt, hsa
gagacaggaauguaaggauuggcaacuguguuaccuuucaaguuuaucucaauaaccagguca

SEQ ID NO: 496406 - RNA, 63 nt, hsa
gccccuggugaugugagcagggaccugccugccccuuucaaccuuuccccucaccuuuuuuga

SEQ ID NO: 496407 - RNA, 63 nt, hsa
caugugagugaauuccuggauaaagcaagauuuccuuucaauaaacgcugucacccaauggga

SEQ ID NO: 496408 - RNA, 63 nt, hsa
ugaucaguauaaauuuucuugguguauccuuuuccuuucaacacagugcagauaagaguugaa

SEQ ID NO: 496409 - RNA, 63 nt, hsa
ucugcucuucuggaaacaaagggcucaagcaccccuuucaacccugugacugggguccucccu

SEQ ID NO: 496410 - RNA, 63 nt, hsa
gugggaguugccacacugccccaacagugauucccuuucaaagagcugugcuuccuaaacauu

SEQ ID NO: 496411 - RNA, 63 nt, hsa
agggcagggaguuugggcuugguuuugaacuuuccuuucaauguagcaaagcauuccuaguua

SEQ ID NO: 496412 - RNA, 63 nt, hsa
gauggaaagauggguacguuguccuguauccagccuuucaacagaugucuggccagacgaaga

SEQ ID NO: 496413 - RNA, 63 nt, hsa
aacuugaaugaacugcuggggcagugguaugugccuuucaacuugauaauuugggggacauuu

SEQ ID NO: 496414 - RNA, 63 nt, hsa
uguauugauuuuauuaacuaccgugaguccggcccuuucaagcauggaaggagccugcgguuu

SEQ ID NO: 496415 - RNA, 63 nt, hsa
aaauuuucugcuuggaccucuuugguucucuccccuuucaagugagcaacaccacaaugacug

SEQ ID NO: 496416 - RNA, 63 nt, hsa
augcacucacacacugaagaaacaaggaagaugccuuucaagccucacugggccucucuggga

SEQ ID NO: 496417 - RNA, 63 nt, hsa
uaaaaauacaaagaaugguguggccaccuccucccuuucaagcuagggcagcagguagcucuu

SEQ ID NO: 496418 - RNA, 63 nt, hsa
gggaggggaagggaucagguguguuguccugggccuuucaaccuugcgggcugugcugaguuc

SEQ ID NO: 496419 - RNA, 63 nt, hsa
cgccgucugucuccucuagcuuaccgcuucucaccuuucaaccccaucuguggccuuugucca

SEQ ID NO: 496420 - RNA, 63 nt, hsa
ucugugagaaauaauagaugauaugauuuauuaccuuucaauuauauuuuucucaguuauacu

SEQ ID NO: 496421 - RNA, 63 nt, hsa
uguccuccccagcaccuuagggccaggggcuuaccuuucaaccucuagagagaccagcugccu

SEQ ID NO: 496422 - RNA, 63 nt, hsa
acuuccucaucugaaaacacagaacauacugacccuuucaaguacuuagucauuuuccugaaa

SEQ ID NO: 496423 - RNA, 63 nt, hsa
aagugguaguuuaaaaaguggauuuuuaaagugccuuucaauugucugugaacgucuaaagga

SEQ ID NO: 496424 - RNA, 63 nt, hsa
cccauauuuguguccucgccagcucuuuggccaccuuucaagccccaguguucaagcucagag

SEQ ID NO: 496425 - RNA, 63 nt, hsa
acauauggaaaagcccaugcguggaguuccccuccuuucaacauugcaacaacaguaacaaca

SEQ ID NO: 496426 - RNA, 63 nt, hsa
caggccuuuguuucuucggcuaaagguacaguuccuuucaagagguaacagcacugggaucca

SEQ ID NO: 496427 - RNA, 63 nt, hsa
uaccaaauauuuuggccucagaauuaucugauuccuuucaauuccagaaagaccuuacucuuc

SEQ ID NO: 496428 - RNA, 63 nt, hsa
ggugguagagcaaaaaaacccaaacacgauaaaccuuucaaaagacuuucuaaggaugauauu

SEQ ID NO: 496429 - RNA, 63 nt, hsa
gaaguguggguugcgccaacaauuccccuggucccuuucaaccuguuuaguucaacucaagcc

SEQ ID NO: 496430 - RNA, 63 nt, hsa
gccuuuuucuaggaacugucagaaauccucaugccuuucaagacuucugugaaugacuugaau

SEQ ID NO: 496431 - RNA, 63 nt, hsa
agaagaggcuucuggaguuucgaggccauaccuccuuucaagagcuuuggauuuggggcgacu

SEQ ID NO: 496432 - RNA, 63 nt, hsa
uugcauuauuuuaaaaaguucagaguugaaaugccuuucaaccauuuccuucuguggucauuu

SEQ ID NO: 496433 - RNA, 63 nt, hsa
uuuuuuaacauuuuaaguuuaacagauuguauuccuuucaaguuucuauacuugcuuaagcaa

SEQ ID NO: 496434 - RNA, 63 nt, hsa
gcacgugaaguuugcaaaaugcuuuaaggccuuccuuucaaagcauaguccuuuuggagccgu

SEQ ID NO: 496435 - RNA, 63 nt, hsa
cuguaaucuguucuuaugcucauuuuguauuuuccuuucaacuccaggaauauccuugagcau

SEQ ID NO: 496436 - RNA, 63 nt, hsa
uguucaaaagaauugacuaguuaucccugaggcccuuucaaacaugaucaaagauuucccaau

SEQ ID NO: 496437 - RNA, 63 nt, hsa
uacccaagaagacuguuuauugugaagcauuuaccuuucaaaaaaucauuacauuucuauuuc

SEQ ID NO: 496438 - RNA, 63 nt, hsa
gcaaugugggaaagucuucagaucugucaagaaccuuucaauuuaugaaaggacacacacugg

SEQ ID NO: 496439 - RNA, 63 nt, hsa
aguaacaugggaaagcuuucaaucauuuuaguuccuuucaaauacaugaaagaacucaucaug

SEQ ID NO: 496440 - RNA, 63 nt, hsa
cggacuucauuuuguacugugggcugugcuggcccuuucaagguuuuucaagaguugguuuug

SEQ ID NO: 496441 - RNA, 63 nt, hsa
agaacuuugaauguuugcauacuuguggauguaccuuucaaauauguuugucuuguguaucau

SEQ ID NO: 496442 - RNA, 63 nt, hsa
ugggccccugcuggccgccacucuccgggcucuccuuucaaaaagccacgucgugcugcugcu

SEQ ID NO: 496443 - RNA, 63 nt, hsa
ugcuacacauccagccaucacaugcagauaauuccuuucaaaaacagcagaaagaggcucguu

SEQ ID NO: 496444 - RNA, 63 nt, hsa
gucccuuucgaguuaacauuacagccacagugaccuuucaaaaaugcaaauuaaguuacucuu

SEQ ID NO: 496445 - RNA, 63 nt, hsa
guaaaugugggaaagccuuucauaauuuuuauuccuuucaaaaucaugaaauaucucacacug

SEQ ID NO: 496446 - RNA, 63 nt, hsa
caucauccccccauggauccuuucaguaaaaacccuuucaauuuccaaaauaucacugccuaa

SEQ ID NO: 496447 - RNA, 63 nt, hsa
aacucuuggauucaagcgauccucccaccuuggccuuucaagaugcugggauuacagacauga

SEQ ID NO: 496448 - RNA, 63 nt, hsa
uagaagcugcccaaauucugugguuuggggccuccuuucaaaaccagcaauggccaaucaguc

SEQ ID NO: 496449 - RNA, 63 nt, hsa
guagagaggaagggaacuccacugugugacaguccuuucaaucugccccuuuucagcccuacu

SEQ ID NO: 496450 - RNA, 63 nt, hsa
agcagaacauuccagaacccguuguggaaaaacccuuucaagaagcuguuuuaagaggcucgg

SEQ ID NO: 496451 - RNA, 63 nt, hsa
aacauaacucuaucagaagaaaacuguuguuugccuuucaaccuuguuuuacaguucugcagu

SEQ ID NO: 496452 - RNA, 63 nt, hsa
uguuuaaacgcugcuuaaagucgcaacugggccccuuucaagaaauuuugcucuaccaggaaa

SEQ ID NO: 496453 - RNA, 63 nt, hsa
cuguaggccuucacacagggaaggaagcccuacccuuucaacuccuguuggagugagaguuuc

SEQ ID NO: 496454 - RNA, 63 nt, hsa
aauuccuaugaugaaauuuuaaauuaaugggcaccuuucaacaucauuugcuuccuuaucuac

SEQ ID NO: 496455 - RNA, 63 nt, hsa
aaugaagacuuuaaaucagucaguaguacuuuaccuuucaaggcauuaguaaauuacuugcaa

SEQ ID NO: 496456 - RNA, 63 nt, hsa
guggagggggucugggcccacccuucacaacugccuuucaaggacaguucagacaaagggccc

SEQ ID NO: 496457 - RNA, 63 nt, hsa
augaguggaccuaaauauguuaauuccuuuucaccuuucaaaacggacagccccuugaacauu

SEQ ID NO: 496458 - RNA, 63 nt, hsa
uacucacagcuuguaaauuacaacagaaagguuccuuucaaauaguagagcugcaccuaaaga

SEQ ID NO: 496459 - RNA, 63 nt, hsa
cugcuggcguuggcugugauccuggaaugaggcccuuucaaaagcgucauccacaccaaaggc

SEQ ID NO: 496460 - RNA, 63 nt, hsa
cuaauguuagggcuuaauuuucucaaagccugaccuuucaaauccaugaugaaugccaucagu

SEQ ID NO: 496461 - RNA, 63 nt, hsa
gucaagcuccacuugaagcucacucaguaauauccuuucaauguguuuuauauuguuuugacu

SEQ ID NO: 496462 - RNA, 63 nt, hsa
gcucugucuucacggcaugugcuuucucaggaaccuuucaagcggccagaaccccugcgaauc

SEQ ID NO: 496463 - RNA, 63 nt, hsa
acgggaagaugccaguugacugaaaauucaaagccuuucaauuugaagugaccuaggugggag

SEQ ID NO: 496464 - RNA, 63 nt, hsa
gcucuguccucauggcauguacuuucucaggaaccuuucaagcggccagaaccccugcgaauc

SEQ ID NO: 496465 - RNA, 63 nt, hsa
gaggagaacugacaggguuuggcuugcaguuucccuuucaaauaugugacagagaucucacag

SEQ ID NO: 496466 - RNA, 63 nt, hsa
ucuuuaaagaaugcugcuuuuuauucuccuaacccuuucaagugggugcagacuucucguuag

SEQ ID NO: 496467 - RNA, 63 nt, hsa
gggugguccuguugcguggagaucuccucugguccuuucaaagggaaacgcuguugaaccuug

SEQ ID NO: 496468 - RNA, 63 nt, hsa
agaggccagugcgguagccuuugucccuucaugccuuucaauucugagugggaggaaaagcaa

SEQ ID NO: 496469 - RNA, 63 nt, hsa
gaaaagacagucaaaugggguggggguucuuuaccuuucaaaugaauagaaacuucuuauaag

SEQ ID NO: 496470 - RNA, 63 nt, hsa
acagaaaaaccagaggcagcuucuuugccaagaccuuucaaagccauuuuaggcuguuagggg

SEQ ID NO: 496471 - RNA, 63 nt, hsa
cauguucuguuccuccuccucaugcauuuccagccuuucaacccuccccgacucugcggcucc

SEQ ID NO: 496472 - RNA, 63 nt, hsa
uugcacugagaccccugccagagaggagaaaacccuuucaagggaaauuuuaaucuaaaagga

SEQ ID NO: 496473 - RNA, 63 nt, hsa
cuuuuuauauaauguuuuauauauauauuuuuuccuuucaaaucagacgaugagacuagaagg

SEQ ID NO: 496474 - RNA, 63 nt, hsa
uaugaauuacacuaccauguguuuuguaucuucccuuucaagugaugauguuaaaugaaggua

SEQ ID NO: 496475 - RNA, 63 nt, hsa
ccccccaauuuccugcgggcggguacaaaggacccuuucaaugucccuggaguugggagggag

SEQ ID NO: 496476 - RNA, 63 nt, hsa
ccagaaguggccuagaaaugccaacuucacuuaccuuucaaaagaaaggugauuccuaucacu

SEQ ID NO: 496477 - RNA, 63 nt, hsa
ucacaacuucucugcacacaagcuucuaaaauuccuuucaaauaaaguuacuuuaauauuuuu

SEQ ID NO: 496478 - RNA, 63 nt, hsa
uguguggaaggaguguauagcagagaggaaaucccuuucaacagagucagcugcuaacugauu

SEQ ID NO: 496479 - RNA, 63 nt, hsa
gguaagagacaagguucugauugugaaacagagccuuucaaauugaaguguagauugauuuaa

SEQ ID NO: 496480 - RNA, 63 nt, hsa
cauuccagggaugcaaaaugugcuaguccaugaccuuucaauggaaagcuuaggugccugcgu

SEQ ID NO: 496481 - RNA, 63 nt, hsa
ugauuacuuucaauucaguaugcagugaaauugccuuucaagggcagcgugcagcagaauuug

SEQ ID NO: 496482 - RNA, 63 nt, hsa
uaaaaaaaaguuuagauguugccuuuacaguugccuuucaauucaguguuauacuguguguag

SEQ ID NO: 496483 - RNA, 63 nt, hsa
cugcagacacaaaaugaguagucauccugucucccuuucaauagggaucugaacagguguuuu

SEQ ID NO: 496484 - RNA, 63 nt, hsa
ccuuuauuggaaugcauguuuucauugccuucuccuuucaaaguguacguuuguguguucauc

SEQ ID NO: 496485 - RNA, 63 nt, hsa
uuuaauagaguaagguaaagaagauauuaagucccuuucaaaauggaaaauuaauucuaaacu

SEQ ID NO: 496486 - RNA, 63 nt, hsa; identical to SEQ ID NO: 496485

SEQ ID NO: 496487 - RNA, 63 nt, hsa
aucuggcucaugguaccuguucuucuauccaaaccuuucaauucaugcuaccugauucauuua

SEQ ID NO: 496488 - RNA, 64 nt, hsa
cccauccucuuacuccuuucaugucccauuucagacagaguaaccauuaacaaaaaagaagaga

SEQ ID NO: 496489 - RNA, 64 nt, hsa
uccucccucaccuucuccaaaucuaggugaaaucacagaguacaaaacgugagaaugcugaaug

SEQ ID NO: 496490 - RNA, 64 nt, hsa
ucuggccgauuuuuuuuuuuuuuuuuuuuuugagacagaguagcucucugccagccaggcugga

SEQ ID NO: 496491 - RNA, 64 nt, hsa
ucuaacucauuguagggauuuuauacucaacuauacagaguauccaccaaaguccuaaucuaaa

SEQ ID NO: 496492 - RNA, 64 nt, hsa
aaaugcuuaugcuuguguauauguauaaauuaauacagaguacguuaaaagcaaaaagauguau

SEQ ID NO: 496493 - RNA, 64 nt, hsa
aguauuguucuauuuuuguuuacaaacauggaaaacagaguauuucuggcagcugugguacaaa

SEQ ID NO: 496494 - RNA, 64 nt, hsa
ucuuuggggccccuggauguuuuuguggauuuuuacagaguauuuauaucugcacagcguguau

SEQ ID NO: 496495 - RNA, 64 nt, hsa
uggauauuauuucuccaccuaaaucacugaguuuacagaguaauaauguguugcucuggacauu

SEQ ID NO: 496496 - RNA, 64 nt, hsa; identical to SEQ ID NO: 233668

SEQ ID NO: 496497 - RNA, 64 nt, hsa; identical to SEQ ID NO: 233669

SEQ ID NO: 496498 - RNA, 64 nt, hsa; identical to SEQ ID NO: 233670

SEQ ID NO: 496499 - RNA, 64 nt, hsa; identical to SEQ ID NO: 233671

SEQ ID NO: 496500 - RNA, 64 nt, hsa; identical to SEQ ID NO: 233672

SEQ ID NO: 496501 - RNA, 64 nt, hsa; identical to SEQ ID NO: 233673

SEQ ID NO: 496502 - RNA, 64 nt, hsa
cuugauuaacuuauaaaauguuagaggaaacuuucacaugaauaauuuuugucaaauuuuauca

SEQ ID NO: 496503 - RNA, 64 nt, hsa
agacucuccucaaagaaaugacuugcugucaucccacaugaacuccugauguuuuuucuacaaa

SEQ ID NO: 496504 - RNA, 64 nt, hsa
gagcugauuuuaauggccacaucuaaucucauuucacaugaaagaagaaguauauuuuagaaau

SEQ ID NO: 496505 - RNA, 64 nt, hsa
aguacagcugaaauucagaggacccauaagaguucacaugaaaaaaaucaauuuauuugaaaag

SEQ ID NO: 496506 - RNA, 64 nt, hsa
cgaguucaggcagaccuggaagcuguucagcucucacaugaauaucgacauuacagaugacugc

SEQ ID NO: 496507 - RNA, 64 nt, hsa
cuacaaaaauacaacaugcaauuccugauccguucacaugaaugcaaaccugaaggcuaugaau

SEQ ID NO: 496508 - RNA, 64 nt, hsa
aaaggggacuagaguggaagauucccuauuuaaacacaugaagcucuggguccuagccuuuuuu

SEQ ID NO: 496509 - RNA, 64 nt, hsa
aguauguacaaagguaaccaucacuccuuaaauccacaugaaaacuacuguaacugaucaugua

SEQ ID NO: 496510 - RNA, 64 nt, hsa
ugaaaugacucauagauaauacaaucuacuuacacacaugaauuucuuaaaaaaaucaauuuaa

SEQ ID NO: 496511 - RNA, 64 nt, hsa
uauguccaaaguggaacucuccaucuaccucccucacaugaaccuguuccucucucaggaucug

SEQ ID NO: 496512 - RNA, 64 nt, hsa
auuucaugugcagacgugccucuguguaaauguacacaugaacuucaugugggcuuaauuuucu

SEQ ID NO: 496513 - RNA, 64 nt, hsa
uggguugacuggaaaggaauggaaaauauaguaacacaugaaaaaaugcuacuccaaucugaau

SEQ ID NO: 496514 - RNA, 64 nt, hsa
uaauuaauuguuugaguacauucuuucaacacuacacaugaaugaauccaaucuuauaaccuug

SEQ ID NO: 496515 - RNA, 64 nt, hsa
aucaugcuguauaaagcaauaacaauugauugaccacaugaaaguguggccugcacuauauucu

SEQ ID NO: 496516 - RNA, 64 nt, hsa
gaagucauacuagcccaaccaacauggcagcuaacacaugaaugaggccaaucaagaccagaag

SEQ ID NO: 496517 - RNA, 64 nt, hsa
acauguugagugagcaugcuggagaaugagagaccacaugaagcagaaacaugcuuuccuagcu

SEQ ID NO: 496518 - RNA, 64 nt, hsa
gaaagccuucaaccagaagagugcgcugcaggugcacaugaagaagcacacgggggagcggccc

SEQ ID NO: 496519 - RNA, 64 nt, hsa
caugggcuucacgcagaagagcaacaugaagcugcacaugaagcgggcgcacagcuaugcuggu

SEQ ID NO: 496520 - RNA, 64 nt, hsa
gggaaaacuuacuugucuccuuuagguuuucaagcacaugaaaguacucacacuggagauaaac

SEQ ID NO: 496521 - RNA, 64 nt, hsa
ggaaaaaccuacauaucuucuguagguuuucaagcacaugaaagaacucacacuggagaaaaac

SEQ ID NO: 496522 - RNA, 64 nt, hsa
gggaaacccuucauuuaccgccauucugcucgagcacaugaaaggaaucacacuguacagaaac

SEQ ID NO: 496523 - RNA, 64 nt, hsa
uuuuuuuccauguccgauucacacgcuacacacccacaugaacacauucgaacuucgaaggcca

SEQ ID NO: 496524 - RNA, 64 nt, hsa
uacgcuucaguuuuuccacauuguccacggccagcacaugaaagcaucacuucuuuuuuauguu

SEQ ID NO: 496525 - RNA, 64 nt, hsa
uagauuuagauuugaguaaaugccaaucacuuuacacaugaaggugggugggacuuuccuucca

SEQ ID NO: 496526 - RNA, 62 nt, hsa
aacggaagcaggaugaauaaagaaagggagagcacaugaagcuuugcuaauuauaaccccuc

SEQ ID NO: 496527 - RNA, 64 nt, hsa
uaagugaagaaagacucuauaggcuuuuacacagcacaugaagcaguaauccagaaagaaggaa

SEQ ID NO: 496528 - RNA, 64 nt, hsa
uaaauaugugaaauauuaugaucugaacuuagcacacaugaagcaacauuucuuugcuacacag

SEQ ID NO: 496529 - RNA, 64 nt, hsa
caacuacccaaccccaccauggccaggacaugugcaaugccagccccuucuugucuuggcacau

SEQ ID NO: 496530 - RNA, 64 nt, hsa
uggugcaggagcaguucugcuauuuccaaucagucaaugccacucuccacaacaacaaugaaaa

SEQ ID NO: 496531 - RNA, 62 nt, hsa
auaugaaaaaaaauaaacacagaugaaagcugcccaaugccauguccgcgcccagcugcaug

SEQ ID NO: 496532 - RNA, 64 nt, hsa
ugagacucgcaggaguccccaucuguagcacaggcaaugccagugccaugcugcagccucagaa

SEQ ID NO: 496533 - RNA, 64 nt, hsa
acccacuguggccuggcaucgcaucguggugugucaaugccacaaaaucguguguccguggaac

SEQ ID NO: 496534 - RNA, 64 nt, hsa
gucuccauuuggauaaaaggaaccaaccaacaaacaaugccaucacuggaauuucccaccgcuu

SEQ ID NO: 496535 - RNA, 64 nt, hsa
acauuugagccuagaccugaagggugagccaucaagcuaagacaauuggggaagagcauuccag

SEQ ID NO: 496536 - RNA, 64 nt, hsa
uucauagaaauuauacaaagagaauuggggagacagcuaagaagaaaacaaagaaauaaagcag

SEQ ID NO: 496537 - RNA, 64 nt, hsa
agccaagugguucccaugcccacugagcccagcaagcuaagauccacuggcuuggaauucuccc

SEQ ID NO: 496538 - RNA, 64 nt, hsa
agcuaaaggagcauguucuaacccaaugcaaggaagcuaagaaccuugaaaaaagguuagagga

SEQ ID NO: 496539 - RNA, 64 nt, hsa
acauacaauacacuaacauuaacaauagcugaugagcuaagaaaaaaaaaaagucugugcauag

SEQ ID NO: 496540 - RNA, 64 nt, hsa; identical to SEQ ID NO: 396681

SEQ ID NO: 496541 - RNA, 64 nt, hsa; identical to SEQ ID NO: 396682

SEQ ID NO: 496542 - RNA, 64 nt, hsa; identical to SEQ ID NO: 396683

SEQ ID NO: 496543 - RNA, 64 nt, hsa; identical to SEQ ID NO: 396684

SEQ ID NO: 496544 - RNA, 64 nt, hsa
cuuuuuuuuuguaacuuguucccuuauaccuccuugauugaauaccagacagccuagaccucag

SEQ ID NO: 496545 - RNA, 64 nt, hsa
ugcggcgcccgcagcggaggagguuuucaguggcugauugaaacucacugcaaaaucaccacga

SEQ ID NO: 496546 - RNA, 64 nt, hsa
ugauggacguucuguaauagaaaaccugaaacgaugauugaaugggaaaaagagacuacaaaau

SEQ ID NO: 496547 - RNA, 64 nt, hsa
uccugguuauauacaaaugugacccgugauaaugugauugaacacuuuaguaaugcaaaauaac

SEQ ID NO: 496548 - RNA, 64 nt, hsa
cacugucagaucacuguucuuuucuuucuuuuugugauugaaaagccuauacuacaauuugaag

SEQ ID NO: 496549 - RNA, 64 nt, hsa
guuuugcuuugcauuuuagguucagauuaugacuugauugaaauaaaugugccuauacauucau

SEQ ID NO: 496550 - RNA, 64 nt, hsa
ugccuuuaggcuguucuuugagguaucaaugaagugauugaauuucaauaccuuaauucagugc

SEQ ID NO: 496551 - RNA, 64 nt, hsa
ugcauuaaaugccaaaaaaaaaauacauuaucagugauugaaacguuuacauguacccaaaaac

SEQ ID NO: 496552 - RNA, 64 nt, hsa
ugguuuaauauauauuuuuaaaacauuucacuagugauugaauucuacuuuugccaucugaauu

SEQ ID NO: 496553 - RNA, 64 nt, hsa
gaucuuauuagaggucagugcuaaguacccaucuugauugaaguuagcucagauguggagauuc

SEQ ID NO: 496554 - RNA, 64 nt, hsa
ugggcaagugauugaaaauaguaaaugcuuugugugauugaaucugauuggacauuuucuucag

SEQ ID NO: 496555 - RNA, 64 nt, hsa
uaauuucuuacuaaacauuuuguuauugggcaagugauugaaaauaguaaaugcuuugugugau

SEQ ID NO: 496556 - RNA, 64 nt, hsa
uuaggaacuuugaggcugaguugagcuucugagaugauugaauguuggaaugaaucuguugugu

SEQ ID NO: 496557 - RNA, 64 nt, hsa
ugagauaggaaucuguuggaaggauuugaacaggugauugaauauguuaggaacuuugaggcug

SEQ ID NO: 496558 - RNA, 64 nt, hsa
guuucuuguuucuacuugucaguuuuguuaaaggugauugaauauaaguaaccaugacuuguaa

SEQ ID NO: 496559 - RNA, 64 nt, hsa
cuacuuccaguccuuagguuagaugaaaaguaggugauugaaggagaggauugaggguggaagg

SEQ ID NO: 496560 - RNA, 64 nt, hsa
uuuauguucacacaggaauuugguuuacugcuuuguaaauaaaaggaaaaacuccggguauaug

SEQ ID NO: 496561 - RNA, 64 nt, hsa
ggggcuuuuuuagguuuuggggcauuuguuuuuuguaaauaagaugauuaugcuuuguggcuau

SEQ ID NO: 496562 - RNA, 57 nt, hsa
acuucugcauggaacucugagcaagauguaaauaaaauuaaaagguggauggcaaga

SEQ ID NO: 496563 - RNA, 64 nt, hsa
guauaugagcuucaaauaagcaccuuuuuauuauguaaauaaauaaaaguuaucuguaucccca

SEQ ID NO: 496564 - RNA, 64 nt, hsa
ucuuuuuaugaccuguuugccuuuuagaaaauugguaaauaaagcaaguauauuuuuauuuuua

SEQ ID NO: 496565 - RNA, 64 nt, hsa
gagccuucuuuuuaauauauucccgaagagauauguaaauaagcucucagaguuucugugauga

SEQ ID NO: 496566 - RNA, 64 nt, hsa
agaauucagauauacuuuaucuuuuuaaaaaaguguaaauaaaaucaaagaauguaaagucuau

SEQ ID NO: 496567 - RNA, 64 nt, hsa
aauaggguaaguaaauauagccaccuguuaacauguaaauaagcauaauuuguuccaaagaugg

SEQ ID NO: 496568 - RNA, 64 nt, hsa
cagcugauauuaguagcuuugcaacccugauagaguaaauaaauuuuaugggcgggugccaaau

SEQ ID NO: 496569 - RNA, 64 nt, hsa
acauuuuaaaagcaauuguauuaguaagaacuuuguaaauaaauaccuaaaacccaaguguauu

SEQ ID NO: 496570 - RNA, 64 nt, hsa
cuguuuuuaugaauuuuuuuaucuagacaauaauguaaauaaagaacucaccaucucuguucau

SEQ ID NO: 496571 - RNA, 64 nt, hsa
augggguacguuuggcaguucacuccauuaggggguaaauaauuuaugaccauucaucuguuuu

SEQ ID NO: 496572 - RNA, 64 nt, hsa
aaccuuuggugccuuuucucucuucuuuaccugaguaaauaauuggcaccugccuucuuucucc

SEQ ID NO: 496573 - RNA, 64 nt, hsa
uuuuaaacauuugcuuuauuauuguuuucuucugguaaauaauaaauauaacagaaguguuaac

SEQ ID NO: 496574 - RNA, 64 nt, hsa
aaagaugguaaaaugacuucauucuauagccauuguaaauaagaauuugcuauugaugaaagaa

SEQ ID NO: 496575 - RNA, 64 nt, hsa
uuguaaccaauaauaaaaaugaauguuuuuauaaguaaauaacuuauuuuucauauggcuaaag

SEQ ID NO: 496576 - RNA, 64 nt, hsa
ucaaaagaacuauuuaaaacucuugaaaacucauguaaauaaaaaucauagggugaaaauugua

SEQ ID NO: 496577 - RNA, 64 nt, hsa
aaagguggaggcauuguaaaaaggaaauagugauguaaauaaacauguucucuuucaaguaugc

SEQ ID NO: 496578 - RNA, 64 nt, hsa
uuuucucuccucaugauguaccuuauuuucuuagguaaauaauuccaaacucucaucgggucau

SEQ ID NO: 496579 - RNA, 64 nt, hsa
uuaacuggucagucauucacaauaagcuaugaggguaaauaaauauguguuauaacaaguaaac

SEQ ID NO: 496580 - RNA, 64 nt, hsa
uaaaaaaaaagccuaucaguauuaugggcaauauguaaauaaauaaauguaauauuucauccuu

SEQ ID NO: 496581 - RNA, 64 nt, hsa
ucaaaaaguuuacauuaauuauucaguguugugaguaaauaaaaaugugugcucuuuacuguuu

SEQ ID NO: 496582 - RNA, 64 nt, hsa
aguacccucuugagguaggaaaugcucugugaugguaaauaaaauuggagcagacagaaaagau

SEQ ID NO: 496583 - RNA, 64 nt, hsa
aauguguauuuauuguuaauucuuaaaauaguguguaaauaaaauaacaucagugugcuuuaaa

SEQ ID NO: 496584 - RNA, 64 nt, hsa
agaaauguuaaauauuuuaugaguuuagaauauaguaaauaaaaggugauguaaaugaaugcug

SEQ ID NO: 496585 - RNA, 64 nt, hsa
aaccauauugugacaagagaugagccucuguacuguaaauaagaaaugaaguagagaaauguua

SEQ ID NO: 496586 - RNA, 64 nt, hsa
ggacuucugucauaauucuugcugagucaagaguguaaauaaaagaaauggcaggacucauauu

SEQ ID NO: 496587 - RNA, 64 nt, hsa
acugauauuacuaaaguacauuauguuuacucaaguaaauaauuuucuccccaugguacacucu

SEQ ID NO: 496588 - RNA, 64 nt, hsa
uuaccauauuuuaagaacuuuaagacgauuaauuguaaauaauuuauuugauuggugcaguucu

SEQ ID NO: 496589 - RNA, 64 nt, hsa
aaaacagaggguauuauuuguuuuuaaagcuuuuguaaauaaaggcuucaaaauguuuucuuau

SEQ ID NO: 496590 - RNA, 64 nt, hsa
agacaaaaauugugcuuucauaguugcuacaaagguaaauaauggagagauuugguacaaaaca

SEQ ID NO: 496591 - RNA, 64 nt, hsa
uuaauuguuuccaaguugcaucaaagaugaauugguaaauaauggaaaugaguagugauaugaa

SEQ ID NO: 496592 - RNA, 64 nt, hsa
acguaccccaguaaaaccauucaaucaauaauugguaaauaauauuuuaaaauuguuuuuaauc

SEQ ID NO: 496593 - RNA, 64 nt, hsa
aguuuauuauagucuguacuucaguucucaucuuguaaauaaugcuuaacauaaacuuguacuu

SEQ ID NO: 496594 - RNA, 64 nt, hsa
augauacugaauuguuauguaaacaucauaaauaguaaauaaugauucaaugugaauuuuaaaa

SEQ ID NO: 496595 - RNA, 64 nt, hsa
ucuaaaaaaugaaguguauuaaguaaauaaauaaguaaauaaccaaccaacccugaggaacauc

SEQ ID NO: 496596 - RNA, 64 nt, hsa
cccuaaagcugcucuaaaaaaugaaguguauuaaguaaauaaauaaguaaauaaccaaccaacc

SEQ ID NO: 496597 - RNA, 64 nt, hsa
guaccaguuucaugaaguaugucuuuggguuuuuguaaauaauuuuaacucaaauaaaauugcu

SEQ ID NO: 496598 - RNA, 64 nt, hsa
uuugcuuuugcuuuuuuguugaaugauuccaaucguaaauaaagcuuuuaauaauuuugugaau

SEQ ID NO: 496599 - RNA, 64 nt, hsa
cacugaacguaucagaauacauggaugaauugggguaaauaagguuuuaauucagaucuagaag

SEQ ID NO: 496600 - RNA, 64 nt, hsa
ggcuuccacauaagguuaaacaaacuaggugcuuguaaauaauuuauuacaguuuacucuaucg

SEQ ID NO: 496601 - RNA, 64 nt, hsa
ggguuauaugccuaaacccuuaugccacauagugguaaauaauuaugaaaaauggucuguucau

SEQ ID NO: 496602 - RNA, 64 nt, hsa
uggugugacacuuuggagcaaaaaccuugcagugguaaauaaaaaauuuccaacagggucagcu

SEQ ID NO: 496603 - RNA, 64 nt, hsa
cugugccucccucugucuguuuucacuugaauggguaaauaaccagcagcuagguuuugaauuc

SEQ ID NO: 496604 - RNA, 64 nt, hsa
acaaauguugcauagagauaauagaacauugcuuguaaauaauucagcagauuuguaauauauu

SEQ ID NO: 496605 - RNA, 64 nt, hsa
aaagauacaucugauauuuucuauauagagcacaguaaauaaguuuuuucauuguguagaaaua

SEQ ID NO: 496606 - RNA, 64 nt, hsa
ccuaccccuuccuguccugccuccucaucaguguguaaauaauuugcacugaaacguggauaca

SEQ ID NO: 496607 - RNA, 64 nt, hsa
gaaacguggauacagagccacgaguuuggauguuguaaauaaaacuauuuauugugcugggucc

SEQ ID NO: 496608 - RNA, 64 nt, hsa
gucauuauuauuugaguuaugcuguuguuuagggguaaauaacaguaaauaauuaauaauaaua

SEQ ID NO: 496609 - RNA, 64 nt, hsa
uuugaguuaugcuguuguuuagggguaaauaacaguaaauaauuaauaauaauaauaauaauaa

SEQ ID NO: 496610 - RNA, 64 nt, hsa
uuuuuaccucaauuguugauaucaaucaucaauuguaaauaaauaauugccaaggcaaauaaau

SEQ ID NO: 496611 - RNA, 64 nt, hsa
uauuuaaaggcuucuaagaagcguauaccuaacuguaaauaaauguauguauagcauauguaca

SEQ ID NO: 496612 - RNA, 64 nt, hsa
aaauuccuagaaaacugcuugaugacaauaaaaaguaaauaaaagcacugcuaccuucuuugau

SEQ ID NO: 496613 - RNA, 64 nt, hsa
caccuaaaaugaaaacaguaaccuucuauauacuguaaauaaagacugaaagcuuuugcuauuu

SEQ ID NO: 496614 - RNA, 64 nt, hsa
acaaaaugcacacuuuauaguuucaagauuuucaguaaauaaaaucuguccauuccuaccugga

SEQ ID NO: 496615 - RNA, 64 nt, hsa
acuuuagaaagauguuaauguacauaaauagaguguaaauaaaauaguguugauguacugaaau

SEQ ID NO: 496616 - RNA, 64 nt, hsa
auaaaagaaccccaagcaugcaucuuucauguguguaaauaauucauuucugggcuaauuucaa

SEQ ID NO: 496617 - RNA, 64 nt, hsa
ggcaaagcugugggagucuugaaaugucacaguaguaaauaacuuauuacuuuuugacaaguuc

SEQ ID NO: 496618 - RNA, 64 nt, hsa
cucuuggaguaacaagaauuuggaaacaggagaaguaaauaaauaagguugccuuuuucaaauu

SEQ ID NO: 496619 - RNA, 64 nt, hsa
accgugugaacucuuuggagguuuugcauuuuagguaaauaacugucuguacucuuggaguaac

SEQ ID NO: 496620 - RNA, 64 nt, hsa
aaauguagcuuauuuuuaggauuuaaaucacuaaguaaauaaguauccuugccaagugaucaug

SEQ ID NO: 496621 - RNA, 64 nt, hsa
caaaaugcuuaacuuuaucucuuaauuucuaaagguaaauaaccuagguucagcuuuugcuuaa

SEQ ID NO: 496622 - RNA, 64 nt, hsa
agcuaaaaaaaagcaaggguuugucauagagggaaccucuaaauaauuucagggguaggggaga

SEQ ID NO: 496623 - RNA, 64 nt, hsa
guuugacaauugaauuuguuuucugugaauucuaaccucuaaaggcaugcuuagaggucaagga

SEQ ID NO: 496624 - RNA, 64 nt, hsa
gacuaaccucuaacaagagauuuauggucaguuaaccucuaaauaugaacuuuccacucuaacc

SEQ ID NO: 496625 - RNA, 64 nt, hsa
aacuucagcuuaaccagucagaaacuaccgacuaaccucuaacaagagauuuauggucaguuaa

SEQ ID NO: 496626 - RNA, 64 nt, hsa
gguucacauuuccaaaccuuuuugauuuccccugaccucuaauggcuggauccuauuuuucuac

SEQ ID NO: 496627 - RNA, 64 nt, hsa
ccucuggaugguggugaaccugaagcaugcuuuaaccucuaagacugucuaacacgcguuucau

SEQ ID NO: 496628 - RNA, 64 nt, hsa; identical to SEQ ID NO: 81671

SEQ ID NO: 496629 - RNA, 64 nt, hsa; identical to SEQ ID NO: 81672

SEQ ID NO: 496630 - RNA, 64 nt, hsa; identical to SEQ ID NO: 81673

SEQ ID NO: 496631 - RNA, 64 nt, hsa; identical to SEQ ID NO: 81674

SEQ ID NO: 496632 - RNA, 64 nt, hsa; identical to SEQ ID NO: 81675

SEQ ID NO: 496633 - RNA, 64 nt, hsa; identical to SEQ ID NO: 81676

SEQ ID NO: 496634 - RNA, 64 nt, hsa; identical to SEQ ID NO: 284841

SEQ ID NO: 496635 - RNA, 64 nt, hsa; identical to SEQ ID NO: 284842

SEQ ID NO: 496636 - RNA, 64 nt, hsa; identical to SEQ ID NO: 284843

SEQ ID NO: 496637 - RNA, 64 nt, hsa; identical to SEQ ID NO: 284844

SEQ ID NO: 496638 - RNA, 64 nt, hsa; identical to SEQ ID NO: 284845

SEQ ID NO: 496639 - RNA, 64 nt, hsa; identical to SEQ ID NO: 284846

SEQ ID NO: 496640 - RNA, 64 nt, hsa
uguacuugcuauauugaggaugaaguuuucuauggugggacacuaaauauaaagcuauauagag

SEQ ID NO: 496641 - RNA, 64 nt, hsa
aaagcgucaguuaggcacaccugcaggccccucggugggacagcggcggccuuggaguuaggag

SEQ ID NO: 496642 - RNA, 64 nt, hsa
ggugcuccucgcgggguggacuugggagugugcagugggacagggggcugcagggguccugcca

SEQ ID NO: 496643 - RNA, 64 nt, hsa
ucugagacaugagccuugggauguggcagcaucagugggacaagauggacacugggccacccuc

SEQ ID NO: 496644 - RNA, 64 nt, hsa
auucauuuguuaaaaauaccuaagagcaauuauagugggacaucuaagguccucuguaaacagu

SEQ ID NO: 496645 - RNA, 64 nt, hsa
aguauaaugacauuuagaagauuacuuugggcuggugggacaugcugugaauuuagauuacaaa

SEQ ID NO: 496646 - RNA, 64 nt, hsa
ucuucaguggcuccucugacaagaccaucaaggugugggacacauguaccaccuacaaguguca

SEQ ID NO: 496647 - RNA, 64 nt, hsa
ucuacagcggcucugcagacugcaccaucauugugugggacauccagaaccugcagaaggugaa

SEQ ID NO: 496648 - RNA, 64 nt, hsa
uugucuguggcaccuacgagaaccucauccacgugugggacauugaguccaaggagcaggugcg

SEQ ID NO: 496649 - RNA, 64 nt, hsa
ggcuguuuggugugugacccagcaagggcccugugugggacagcaggagggaggcgucgggggc

SEQ ID NO: 496650 - RNA, 64 nt, hsa
aaaggcacuccaagugcauccuccacuggcaacagugggacaauugcccccgacggcggcaccg

SEQ ID NO: 496651 - RNA, 64 nt, hsa
auucucuauaccaagauaugcuaggaguaggaugaugauucaaagugguaacccaaauucauaa

SEQ ID NO: 496652 - RNA, 64 nt, hsa
ugguccuaacuuucuguuauuuuagaauguuaacaugauucacauuauacuuucucuuaguuaa

SEQ ID NO: 496653 - RNA, 64 nt, hsa
guacucuuauauguaccauugguugauaauuauaaugauucauuuggacuugaagaaagauugu

SEQ ID NO: 496654 - RNA, 64 nt, hsa
guccccaggcacaguaucugaaucacuggggauuaugauucacccucuuuggagaacaugcucu

SEQ ID NO: 496655 - RNA, 64 nt, hsa
ugucacgagaauagcacgggaaagacuggcccccaugauucaauuaccucccccugggucuguc

SEQ ID NO: 496656 - RNA, 64 nt, hsa
uaucacaagaauagcaugggaaagacuggcccccaugauucaauuaccuccccuugggucucuc

SEQ ID NO: 496657 - RNA, 64 nt, hsa
cuaugauugacccugauuuuaauugugaaauuauaugauucauauauuuuaugaaucagaauaa

SEQ ID NO: 496658 - RNA, 64 nt, hsa
ugaaacccuaaauauguuuacauaccauuaagauaugauucauguaacaauguuaaauuaauua

SEQ ID NO: 496659 - RNA, 64 nt, hsa
caaaaaguaauguauaucuguaauauauaaucaaaugauucauuuuucuguuagacuaggcaaa

SEQ ID NO: 496660 - RNA, 64 nt, hsa
cauguuguauuaguaaauuauuagaauccaauuaaugauucaauuaacauauaucuuauccaau

SEQ ID NO: 496661 - RNA, 64 nt, hsa
uuaagaaaauauucuaacauuugauaauuuugaaaugauucaucuuucagaaauaaaaguauga

SEQ ID NO: 496662 - RNA, 64 nt, hsa
ucccuuuggacaaaugcauuuaguggugguagaaaugauucaccagguccaauguuguucacca

SEQ ID NO: 496663 - RNA, 64 nt, hsa
caaaucuugauugugauaagccccccuggaggauaugauucacuuuaugugauucaucuuauuc

SEQ ID NO: 496664 - RNA, 64 nt, hsa
uuuucugugaguccuauaaaaagcaaggauaugcaugauucagggaaugaagaaucacaggcuu

SEQ ID NO: 496665 - RNA, 64 nt, hsa
agaccgucucagacacgcacagugggccugcugcaugauucacacccagucccugccacagacc

SEQ ID NO: 496666 - RNA, 64 nt, hsa; identical to SEQ ID NO: 496665

SEQ ID NO: 496667 - RNA, 64 nt, hsa
uauggcaaauggauaaaauauuguggcaucaacuacuuuuaaaguagaaaagcuauccauuuua

SEQ ID NO: 496668 - RNA, 64 nt, hsa
uugaaauaaagccucuuaaaaugaaaaaucauauacuuuuaacaucacuuuuaagcuaauaaau

SEQ ID NO: 496669 - RNA, 64 nt, hsa
cucuuaaaaugaaaaaucauauacuuuuaacaucacuuuuaagcuaauaaauauaagaauucuu

SEQ ID NO: 496670 - RNA, 64 nt, hsa
auauaauagaguaagauacacuuuuuagcagugaacuuuuaaaaaauucuuuuacuuuuaacuu

SEQ ID NO: 496671 - RNA, 64 nt, hsa
acuuuuuagcagugaacuuuuaaaaaauucuuuuacuuuuaacuucuugucaaucaaaguaucc

SEQ ID NO: 496672 - RNA, 64 nt, hsa
cacugcaugaauaaaauuauuccuuuguauuuuuacuuuuaaaugucuucuguauucacuuaua

SEQ ID NO: 496673 - RNA, 64 nt, hsa
caauauuuccucaugugaucacaauuugcaguaaacuuuuaauuaaaugcucaucugguaacuc

SEQ ID NO: 496674 - RNA, 64 nt, hsa
cccagagcagauacucauaaaguauaaaguaaaaacuuuuaaccauuauuaaacagagaacuug

SEQ ID NO: 496675 - RNA, 64 nt, hsa
cagaaaauacaagauuuacauaaaggucauuucaacuuuuaagguuaccagugauuguauaaaa

SEQ ID NO: 496676 - RNA, 64 nt, hsa
aaaucucaacuauaaccaguuuagcuuuuuccuuacuuuuaaaauaaaauuuuuuacuuuuaac

SEQ ID NO: 496677 - RNA, 64 nt, hsa
uagcuuuuuccuuacuuuuaaaauaaaauuuuuuacuuuuaacuauuuuuuuaguuaauauuuu

SEQ ID NO: 496678 - RNA, 64 nt, hsa
ccuuuuaagccagguuacauucuaaaaauucuuaacuuuuaacauaauauuuuauaccaaagcc

SEQ ID NO: 496679 - RNA, 64 nt, hsa
caugaacugccaggcccggccaaaauaaugcaccacuuuuaacagaacagacagaugaggacag

SEQ ID NO: 496680 - RNA, 64 nt, hsa
uaguuuuauuaugcaguuaaaucuguaucaguggacuuuuaaaacuugguacuacuacuaaauc

SEQ ID NO: 496681 - RNA, 64 nt, hsa
aauacuaauucauuuuaucacuuucauugguaaaacuuuuaaauucaacaccugaaaaucauga

SEQ ID NO: 496682 - RNA, 64 nt, hsa
aaauaauaggccauaggacuuuugguagguuuaaacuuuuaauucuguauuucaugauuauaag

SEQ ID NO: 496683 - RNA, 64 nt, hsa
augugauuacagguagaggccuucuaggugagacacuuuuaagguacacugcauuuugcaaaaa

SEQ ID NO: 496684 - RNA, 64 nt, hsa
ugagguacuguuagucuguuagucuuucaaauugacuuuuaaaaauacauaucuuuaugauuuu

SEQ ID NO: 496685 - RNA, 64 nt, hsa
cauuuuugugauuuuuaaagauuauuuagugcuaacuuuuaaugguuucuuaaauuuuuugcaa

SEQ ID NO: 496686 - RNA, 64 nt, hsa
uuaaaaaguguguuugguuauuaauauauaugagacuuuuaaagaaaguuauauaacuacauag

SEQ ID NO: 496687 - RNA, 64 nt, hsa
cuuacuuaaaguagcaaagucauggauuguauugacuuuuaaaaauauaguaaaagucauauuu

SEQ ID NO: 496688 - RNA, 64 nt, hsa
ucugagaauaaauaggcauaugauacccacuuggacuuuuaacaaaaguaaaggaauaaauuug

SEQ ID NO: 496689 - RNA, 64 nt, hsa
guuaacuagucauuugacuggaaaaaaauaaaauacuuuuaaauggacaugguuuuauuuuuaa

SEQ ID NO: 496690 - RNA, 64 nt, hsa
uagacuuucaaaaugagugauuuguuagcuugguacuuuuaaguuugugguacagauccuccaa

SEQ ID NO: 496691 - RNA, 64 nt, hsa
caaaugaucuguucugcacugagccaagcaaguuacuuuuaaaacugguggcaccacucauuug

SEQ ID NO: 496692 - RNA, 64 nt, hsa
cuuccuuaacauuuauacauuguuuuaagaaaaaacuuuuaaaaauauuucuuauagucuccua

SEQ ID NO: 496693 - RNA, 64 nt, hsa
ucucagcucugagggucuuugugaguucccaccaacuuuuaauuauucaugcccuugaccaugu

SEQ ID NO: 496694 - RNA, 64 nt, hsa
ggguaucagauuaaacaccgaauucagccacuggacuuuuaaaaguacuuaagaugguuuaucu

SEQ ID NO: 496695 - RNA, 64 nt, hsa
aauugcugcugccuucauuuuagguucagcaguuacuuuuaacuaccuuaauuuauugccagaa

SEQ ID NO: 496696 - RNA, 64 nt, hsa
uuuguuuggaagaagugaacuggacuacuuuaaaacuuuuaaggguuuucuauguucuuccuac

SEQ ID NO: 496697 - RNA, 64 nt, hsa
acuaauuuauacuuaucugaagguuacaaauuagacuuuuaaauuuucuuuguaguugguggug

SEQ ID NO: 496698 - RNA, 64 nt, hsa
uuauagaaauuugugauccuauauacaauauaggacuuuuaaaguugugacauucuggcuuuuu

SEQ ID NO: 496699 - RNA, 64 nt, hsa
accuguuugucaaagcuuguuuaaauuauaaaacacuuuuaauuauauauaugaggcaaaagaa

SEQ ID NO: 496700 - RNA, 64 nt, hsa
agaaaaaagucucuccccaagggcagccuuuguuacuuuuaaauauuuucuguuauuacaagug

SEQ ID NO: 496701 - RNA, 64 nt, hsa
auauuuucuguuauuacaagugcucuaauugugaacuuuuaaauaaaauacuauuaagagguaa

SEQ ID NO: 496702 - RNA, 64 nt, hsa
cccugcuguuuaaauuucccgcauauuccaauucacuuuuaaaaaauaccauuugaauuuguau

SEQ ID NO: 496703 - RNA, 64 nt, hsa
aaaaaaacaacuggguagagggugggagggauuuacuuuuaagaggcaaaaugugaguaaauug

SEQ ID NO: 496704 - RNA, 64 nt, hsa
agcauugaaacuuuuguagcaaucuggucuauagacuuuuaacucaagaagcuaaggcuagacu

SEQ ID NO: 496705 - RNA, 64 nt, hsa
aauuguuaucuuauucuuuuuaucuuuaguagacacuuuuaaaagaaaagacaaguuuguugug

SEQ ID NO: 496706 - RNA, 64 nt, hsa
acauuuuccugugcauuaaccucugcaugugaaaacuuuuaacaguuacugaacuauguaaaua

SEQ ID NO: 496707 - RNA, 64 nt, hsa
aauggggucugugggcuaguuaaaauagaaauaaacuuuuaaaauauccacagaauugauauug

SEQ ID NO: 496708 - RNA, 64 nt, hsa
gucauugaauuguagguuuccuuuuuuuuucuuuacuuuuaaauuuuaacuuuuaaaaucuauu

SEQ ID NO: 496709 - RNA, 64 nt, hsa
gguuuccuuuuuuuuucuuuacuuuuaaauuuuaacuuuuaaaaucuauuucauuucuuaguua

SEQ ID NO: 496710 - RNA, 64 nt, hsa
cauuugcucaagaauuuuuuccgucaaauugugaacuuuuaauucuugcauuguaauuggcugu

SEQ ID NO: 496711 - RNA, 64 nt, hsa
guuuauguuaaaccuuaauuuuuuuucuguaaucacuuuuaacacugcuaauagaaauuauguu

SEQ ID NO: 496712 - RNA, 64 nt, hsa
uauuggguaaagacgucuaaacuuguuugaugugacuuuuaauuuuaaauacggguaacaaucu

SEQ ID NO: 496713 - RNA, 64 nt, hsa
uucugcacagagcauaaugugaaguuuuauaccuacuuuuaaaauucugcuuuccagaaacaaa

SEQ ID NO: 496714 - RNA, 64 nt, hsa
cauaccagauugucagugaagcugaugccuaggaacuuuuaaagggauccuuucaaaaggauca

SEQ ID NO: 496715 - RNA, 64 nt, hsa
ccuuucaaaaggaucacuuagcaaacacauguugacuuuuaacugauguaugaauauuaauacu

SEQ ID NO: 496716 - RNA, 64 nt, hsa
uauauguguuguggaagugaguacacuaucauccacuuuuaaugacagaaaguuauaaacuuac

SEQ ID NO: 496717 - RNA, 64 nt, hsa
uaaauagaagaaaucaugaguaaaauuggaaaacacuuuuaacugaaaaaaacaaaagcacaac

SEQ ID NO: 496718 - RNA, 64 nt, hsa
uucaugcguuuaaucauugucucuucauuuuaagacuuuuaauacaaaugucauuuuuaaagaa

SEQ ID NO: 496719 - RNA, 64 nt, hsa
gaaaguaaccauccuucuggcaaaguaggauggcacuuuuaaguuuuucuuccuuuuuucccuc

SEQ ID NO: 496720 - RNA, 64 nt, hsa
ggaaaggagucuuuaucuuggggagcaaaagcugacuuuuaaacuugaccccugcuguuuuuaa

SEQ ID NO: 496721 - RNA, 64 nt, hsa
uaugcuccaucccauucacuucugcauuccuguaacuuuuaaucccuauguuugucucacuuuu

SEQ ID NO: 496722 - RNA, 64 nt, hsa
cuuaaaucuuucuucaaaucucccacaaguauauacuuuuaaauuauggaguauuuuaagucua

SEQ ID NO: 496723 - RNA, 64 nt, hsa
aggucuaaaauacuacauugucacuguaagcuauacuuuuaaaauauuuauuuuuuuuaaagua

SEQ ID NO: 496724 - RNA, 64 nt, hsa
caaaauagucauuaugggcucaaauagaaagaagacuuuuaaguuuuaauccaguuuaucuguu

SEQ ID NO: 496725 - RNA, 64 nt, hsa
agauauuauguauaucuucuagccuuuauucuguacuuuuaauguacauauuucugucuugcgu

SEQ ID NO: 496726 - RNA, 64 nt, hsa
uauguauuuuaaaauaaggggaagagucauuuucacuuuuaaacuacuauuuuucuuuccaagu

SEQ ID NO: 496727 - RNA, 64 nt, hsa
auguaauaaucauuuuagaauuaaaauuuauucuacuuuuaaauaaauuaugaauauuaaaggu

SEQ ID NO: 496728 - RNA, 64 nt, hsa
agugauuuuuaguaaccuuuaaaaauguauaaugacuuuuaaaauuuguagaauugaaaagacg

SEQ ID NO: 496729 - RNA, 64 nt, hsa
aguaaauauuaauaaauggauacacauucaaaauacuuuuaaaaaaaagaaaauguuaccaguu

SEQ ID NO: 496730 - RNA, 64 nt, hsa
uugguugaauuuuuggauauauuauguugauuuaacuuuuaaaauguuguuuaaaagugugaag

SEQ ID NO: 496731 - RNA, 64 nt, hsa
uauuuuaauucugcuauagaaaacaauugccuucacuuuuaaggaguaauuugaauauuaauaa

SEQ ID NO: 496732 - RNA, 64 nt, hsa
aacuuuuaccgacuccaaaaaucucaggaauuaaacuuuuaacaguuacagcaauaaagaauag

SEQ ID NO: 496733 - RNA, 64 nt, hsa
cuagccuaaccuucaacauaaaauaaugaagagaacuuuuaaacuuuuuuaugaauuccuaaac

SEQ ID NO: 496734 - RNA, 64 nt, hsa
acaaagggauuaaagaccuaaauaugaagacaaaacuuuuaaaugagaaucuauaagguuauuu

SEQ ID NO: 496735 - RNA, 64 nt, hsa
uuuccauucuugcuagucagaguaaguaggcagcacuuuuaaaaauaugugaacucaaauauug

SEQ ID NO: 496736 - RNA, 64 nt, hsa
uuuuauugauuucagauuuucacaggcacauucuacuuuuaaucagaaauauauuuaauaagua

SEQ ID NO: 496737 - RNA, 64 nt, hsa
cauuuuguuaaaaaaaaaaaaaaaaaagcacauaacuuuuaacacuagaaucagcccgcaagau

SEQ ID NO: 496738 - RNA, 64 nt, hsa
ggaucuaaauauucagguuuuaagccugcugcaaacuuuuaaaauauuaugauagauucuguac

SEQ ID NO: 496739 - RNA, 64 nt, hsa
uguccuaauuuagaauuucccucaaaucugagggacuuuuaagaaaugcuaacagauuuuucug

SEQ ID NO: 496740 - RNA, 64 nt, hsa
guagaaauauuauucaguaaacaauaaugugugaacuuuuaagauggauaauagggcauggacu

SEQ ID NO: 496741 - RNA, 64 nt, hsa
uaucuauacauguuguauguacaaauauccuacuacuuuuaaucugauuuuucuucaggauuau

SEQ ID NO: 496742 - RNA, 64 nt, hsa
uuacuuuguuaguacauuuuuuagugucacacugacuuuuaaaauuugaaugauauauagacuu

SEQ ID NO: 496743 - RNA, 64 nt, hsa
agauccauaaacuuuuaaagaagccucaaaacauacuuuuaaagcauuaagcuuuaaagugcua

SEQ ID NO: 496744 - RNA, 64 nt, hsa
gggcuccgacuccagcucugggcaagauccauaaacuuuuaaagaagccucaaaacauacuuuu

SEQ ID NO: 496745 - RNA, 64 nt, hsa
aagcaagaagaaaaacucagagaauauaaaaucaacuuuuaaaauugugugcucucuucuucac

SEQ ID NO: 496746 - RNA, 64 nt, hsa
uacuaaccgugacuacaacaaaaauucuugauugacuuuuaaaguuauuuccuggcauucuggu

SEQ ID NO: 496747 - RNA, 64 nt, hsa
aaguuuccuacuggcagcagauuuuguaagaauuacuuuuaagaauuucauucuuuuuguaugg

SEQ ID NO: 496748 - RNA, 64 nt, hsa
uggaaggcaaacagguuuacaaaucaauucugugacuuuuaaaaaguugacaauguugucagau

SEQ ID NO: 496749 - RNA, 64 nt, hsa
uuuacgucuccuucacugaagggcuagaguuuuaacuuuuaauuuuuuauauuuaaauguagac

SEQ ID NO: 496750 - RNA, 64 nt, hsa
uuuaauuuuuuauauuuaaauguagacuuuugacacuuuuaaaaaacaaaaaaagacaagagag

SEQ ID NO: 496751 - RNA, 64 nt, hsa
ucauuuuuguccaguguuuuucuuuuuaagaugaacuuuuaaagaaccuugcgauuugcacaua

SEQ ID NO: 496752 - RNA, 64 nt, hsa
auuuuucucuccaacauauuuuacaauaaaagcaacuuuuaauuguauagauauauauuucccc

SEQ ID NO: 496753 - RNA, 64 nt, hsa
uuacguaccauauuuguaacuaucaacuuuuaaaacuuuuaacguuuuuguuacaugcauugua

SEQ ID NO: 496754 - RNA, 64 nt, hsa
agaaaauuguuacguaccauauuuguaacuaucaacuuuuaaaacuuuuaacguuuuuguuaca

SEQ ID NO: 496755 - RNA, 64 nt, hsa
gcugucauaguuaauugaccauaauuagcaauauacuuuuaaagugggaaagcugaaugacacu

SEQ ID NO: 496756 - RNA, 64 nt, hsa
gcaauauacuuuuaaagugggaaagcugaaugacacuuuuaagacaaugaacauuaucaaaaca

SEQ ID NO: 496757 - RNA, 64 nt, hsa
uuauguucuuaaucucuugcuaauaaugauuuuuacuuuuaagucacuuuuggguucacuagug

SEQ ID NO: 496758 - RNA, 64 nt, hsa
cuauuugggccuuuccuuuucuuuuuaaacagaaacuuuuaaugaacuguucucuuaacauuga

SEQ ID NO: 496759 - RNA, 64 nt, hsa
auuaagcuacuauauaaaacaauuguuuacguguacuuuuaacuuuuaaaaguacuuaauuaac

SEQ ID NO: 496760 - RNA, 64 nt, hsa
uacuauauaaaacaauuguuuacguguacuuuuaacuuuuaaaaguacuuaauuaacauauguu

SEQ ID NO: 496761 - RNA, 64 nt, hsa
gugugcuaacagaaauaaguugcaguauggucguacuuuuaacucuaguauccuuugcuugcuu

SEQ ID NO: 496762 - RNA, 64 nt, hsa
cuaucaugggggggcauguuuugacauuaaauugacuuuuaagaaaaacaugucacuaaccuga

SEQ ID NO: 496763 - RNA, 64 nt, hsa
acaugucacuaaccugaagcucagccacacagugacuuuuaagguuuuauuuagacuuuacugu

SEQ ID NO: 496764 - RNA, 64 nt, hsa
ucucuacaugacauauugagauuuuuuuuaaucaacuuuuaagauagugauguucuguucuaaa

SEQ ID NO: 496765 - RNA, 64 nt, hsa
uuaaauaggauucuuagaaguauguccucauagaacuuuuaauacuuaaggcuuuguaaaaacu

SEQ ID NO: 496766 - RNA, 64 nt, hsa
cucuucugggcauuuaagcugguauguuagugcuacuuuuaagauuguggagucugaguuaaua

SEQ ID NO: 496767 - RNA, 64 nt, hsa
gagacuagaguaucuaguuuuuaguauuuaaacuacuuuuaauuauuuauauugauacucucug

SEQ ID NO: 496768 - RNA, 64 nt, hsa
gcugauauucagcaaauuucuaaguuuauggugaacuuuuaacucaauguguaaauagaucugg

SEQ ID NO: 496769 - RNA, 64 nt, hsa
uaguguuuuucaaaucuuuaacaucauuuuuucaacuuuuaagauauaauaucaacuauucuaa

SEQ ID NO: 496770 - RNA, 64 nt, hsa
aagccugacagaagcacaaggaacaguuugauacacuuuuaaaagguucugaaaacaaagcugu

SEQ ID NO: 496771 - RNA, 64 nt, hsa
aucccaaaccuaaucuuuuuaaaagauagaagauacuuuuaagacaacuuggccauuauuuuac

SEQ ID NO: 496772 - RNA, 64 nt, hsa
uuugcccugaguauuaaagcuagcuuagcaaaauacuuuuaaaaacauauugguaaaugauacc

SEQ ID NO: 496773 - RNA, 64 nt, hsa
gaauacaggcuuucuagagaucuuuuucauuaauacuuuuaaauaccuuucagguaguuacauc

SEQ ID NO: 496774 - RNA, 64 nt, hsa
auuuauggauuuuuagcuuugaggaaaaaccaugacuuuuaacaaauuuuuauggguuauaugc

SEQ ID NO: 496775 - RNA, 64 nt, hsa
uuugaguuuauuaaagauugacauuuuaaguacaacuuuuaaggacuaauuacugugauggaca

SEQ ID NO: 496776 - RNA, 64 nt, hsa
guguucuccucccuuuauaaauuuuauucauaggacuuuuaaaaggcuugugcuaucuuuccag

SEQ ID NO: 496777 - RNA, 64 nt, hsa
gcuuccauguugaagccagauuuucuguaguaaaacuuuuaaauauuauuuuaaaagaaauaug

SEQ ID NO: 496778 - RNA, 64 nt, hsa
auacuagcccuuuuuauauauuuacacaagcaaaacuuuuaaauauuugaauugacaguuacau

SEQ ID NO: 496779 - RNA, 64 nt, hsa
cccuuggucuuuuaauuaaaagaaauuccaacugacuuuuaaacuuuguucuuguccaaaguug

SEQ ID NO: 496780 - RNA, 64 nt, hsa
uucuguccucuugccuuuuacuuaaauuccucugacuuuuaaaaauggugacacucuuaucgua

SEQ ID NO: 496781 - RNA, 64 nt, hsa
acucugguuggaaaugccauuguuuuggggacagacuuuuaaaaugcccuugugucucccagug

SEQ ID NO: 496782 - RNA, 64 nt, hsa
uaagguucuaaacuguguuacagauacuuguaagacuuuuaaaaucagaguaaguauguucuua

SEQ ID NO: 496783 - RNA, 64 nt, hsa
ugaaauagaaauaguucuuuaaaaauauuucucuacuuuuaaaacaagauacuuaauauuuuua

SEQ ID NO: 496784 - RNA, 64 nt, hsa
uuguuacuccuguauguaguaguguaagcaugugacuuuuaacaccauuugguuugaaacuaau

SEQ ID NO: 496785 - RNA, 64 nt, hsa
cauacauguuguuaaguaccuaauguuuugcugaacuuuuaaaaguuaauuuccaaaauguaua

SEQ ID NO: 496786 - RNA, 64 nt, hsa
cuacuacauuggcgcuauucuuaggacuucugcaacuuuuaaagucuuacuugucuuucuuguu

SEQ ID NO: 496787 - RNA, 64 nt, hsa
agauuauguacaaguaacaucuaaauaaaauuacacuuuuaacccuaagagguuuugcuuauua

SEQ ID NO: 496788 - RNA, 64 nt, hsa
aagucuuuugacauggauauugugaaugguaugaacuuuuaaaccauauuauugaugaugaaaa

SEQ ID NO: 496789 - RNA, 64 nt, hsa
ugccuucuacugauaccggggcaccuccucugguacuuuuaaguguuuuguuaauuauauuuac

SEQ ID NO: 496790 - RNA, 64 nt, hsa
accagcuuuuaaugguggaccuauagaauccaguacuuuuaauggugggaauuuacaguagaag

SEQ ID NO: 496791 - RNA, 64 nt, hsa
gaagugcugaugaguuauauuuauugaaaacccaacuuuuaaggaagugcuaagaucagucacc

SEQ ID NO: 496792 - RNA, 64 nt, hsa
auucuuaguuccagugauaacuguucuaguuacuacuuuuaaguauguaaauacuagaaaggua

SEQ ID NO: 496793 - RNA, 64 nt, hsa
ucuuuggagaauguauuuuuguauuuauaaaucaacuuuuaaaaacugucucauucaaaaggga

SEQ ID NO: 496794 - RNA, 64 nt, hsa
ggauuacaggcgugagccacugugcccagcccuaacuuuuaauguacaucacacacacacucac

SEQ ID NO: 496795 - RNA, 64 nt, hsa
ggauuacaggugugauccaccgcaccuggcccuaacuuuuaauauacaacacacacacacacac

SEQ ID NO: 496796 - RNA, 64 nt, hsa
uucuuccuaaaaauugagagguuuccuuuuauuaacuuuuaaaauaaagaaauaaguaguuuca

SEQ ID NO: 496797 - RNA, 64 nt, hsa
ucugucaacaugagggaccuaucuauguauguugacuuuuaacaucaaaauuggauuuguguca

SEQ ID NO: 496798 - RNA, 64 nt, hsa
cuggcacaugugccagcugaauuuaaaauauaauacuuuuaaaaagaaaauuauuacauccuuu

SEQ ID NO: 496799 - RNA, 64 nt, hsa
gauauaaaggaagaauaagucacuguaaaacagaacuuuuaaaugaagcuuaaauuacucaauu

SEQ ID NO: 496800 - RNA, 64 nt, hsa
auauuguaacuuucauuagaaauaaguugcuuugacuuuuaaaaaugacauaguuagauuauuu

SEQ ID NO: 496801 - RNA, 64 nt, hsa
uuuuuacuuagauacuaauaaaauacauuuagaaacuuuuaaagucaugaaaaagcauuaaccu

SEQ ID NO: 496802 - RNA, 64 nt, hsa
aaguaucauuacauauaggaaaacaauaauuuuaacuuuuaagguugaaaagacaauagcccaa

SEQ ID NO: 496803 - RNA, 64 nt, hsa
ucacuggggggaggggggaaggugaauuaugguaacuuuuaaugaucuauucaggcaguagagc

SEQ ID NO: 496804 - RNA, 64 nt, hsa
ccuaaaagacacuaccagucaccuuugauucgcgacuuuuaauuuaugauuauacuuagccucc

SEQ ID NO: 496805 - RNA, 64 nt, hsa
ggaaaccagacaaagcauugacuuuuaaauguagacuuuuaaaauaaacuguuuucuuuuggaa

SEQ ID NO: 496806 - RNA, 64 nt, hsa
gcaacagcccuaugggaaaccagacaaagcauugacuuuuaaauguagacuuuuaaaauaaacu

SEQ ID NO: 496807 - RNA, 64 nt, hsa
acuccuuguuugucccauucauauaugaaaauagacuuuuaaaacuguccaacacuaaugguuu

SEQ ID NO: 496808 - RNA, 64 nt, hsa
uuauuccucacuagcuggguuaccaucuucaggcacuuuuaacaucuggcauucggaauggaaa

SEQ ID NO: 496809 - RNA, 64 nt, hsa
uauggaguguaguaguaguguguacagguagaaaacuuuuaaauacagcaugcagguguuucag

SEQ ID NO: 496810 - RNA, 64 nt, hsa
cauugcuuaauguuuuaagcuuaauagccuuugcacuuuuaaaauaaaaaccaaguaugcaaau

SEQ ID NO: 496811 - RNA, 64 nt, hsa
uuuugaaauaccuggaaaugcaguuuuaauaugaacuuuuaagacagaugucucuuacaugauc

SEQ ID NO: 496812 - RNA, 64 nt, hsa
aaguucaaauucgagaagauuuaacucaaguggaacuuuuaacucguuugaccuccaaaccauu

SEQ ID NO: 496813 - RNA, 64 nt, hsa
uuuugauacuugucuauccuucauagugcccucuacuuuuaaaggguuuauauguugaaaaacu

SEQ ID NO: 496814 - RNA, 64 nt, hsa
ccuccuagauucauuauucuuucauucugguuucacuuuuaaaauaaauggcaacuuggcacac

SEQ ID NO: 496815 - RNA, 64 nt, hsa
gaaagaugugacagugcuuuugacaacaccuaaaacuuuuaaacauaaaaaaucauacugguga

SEQ ID NO: 496816 - RNA, 64 nt, hsa
agaaaacuucuacaagugugaacaguguggcaaaacuuuuaaugaaugcucacaccuuauugca

SEQ ID NO: 496817 - RNA, 64 nt, hsa
cuuagaguggucuguuacguuuuuuaaaaauaaaacuuuuaauuaagggagacuauguuauuuu

SEQ ID NO: 496818 - RNA, 64 nt, hsa
caaagugcacuuucucuggggccuuuuaggccauacuuuuaauuuuguuauuugauacuacugg

SEQ ID NO: 496819 - RNA, 64 nt, hsa
uugaggaaaacauuaacuccuggauuucagcuucacuuuuaaccugcagacuaaauuucuuucu

SEQ ID NO: 496820 - RNA, 64 nt, hsa
ucugcauaaccaguauuagcauuagaaauuagccacuuuuaaaaugagaaaacugugucacucu

SEQ ID NO: 496821 - RNA, 64 nt, hsa
agcacuggaggaaaaauaauugacaaauauuuauacuuuuaaauuguuuugaacuguauuuaca

SEQ ID NO: 496822 - RNA, 64 nt, hsa
acauuaacagcuggggaggagggaaaagcuucagacuuuuaaacuagcaaaacaguuauuucuc

SEQ ID NO: 496823 - RNA, 64 nt, hsa
aacuaaaaauuagaacagcucccuagaauugugaacuuuuaagagucugacuagaaauuugcaa

SEQ ID NO: 496824 - RNA, 64 nt, hsa
gucugacuagaaauuugcaacuuauaaaaaaguuacuuuuaaaaauauaaguuagggcuaggca

SEQ ID NO: 496825 - RNA, 64 nt, hsa
agcuuaaaauggcauucucuagcaaagagauuagacuuuuaaauaacucuuauaaaacagguug

SEQ ID NO: 496826 - RNA, 64 nt, hsa
cagcaaaaaguagaaguaucaaauaaaaagggcaacuuuuaaaauauuaagccugaagacuucu

SEQ ID NO: 496827 - RNA, 64 nt, hsa
ucauauuugacugggcgugcagaauaacuucuuaacuuuuaacuaucagaguuugauuaauaaa

SEQ ID NO: 496828 - RNA, 64 nt, hsa
guaauuuuguguauucuuauuuacuuaacauuuuacuuuuaauuauguaaauuugguuagaaaa

SEQ ID NO: 496829 - RNA, 64 nt, hsa
aaucaaaaugugaucuaguguaaugaaauaaaaugugaucuaguguaauggaagaccuuugaga

SEQ ID NO: 496830 - RNA, 64 nt, hsa
aaggaauacauuuucaaaaugcaguaaucaaaaugugaucuaguguaaugaaauaaaaugugau

SEQ ID NO: 496831 - RNA, 64 nt, hsa
ugaaagcuuaagaaaacuuggaaaauucuauuuugugaucuagucaagccacaguuaucaaagg

SEQ ID NO: 496832 - RNA, 64 nt, hsa
uuguacauguaucuugaucauuuauaaagccacugugaucuauaaaucaagaaaauccauuguc

SEQ ID NO: 496833 - RNA, 64 nt, hsa
ucucacuaaacuuuacccaaaaacuaaaucucuaauauggcaaaaauggcuagacacccauuuu

SEQ ID NO: 496834 - RNA, 64 nt, hsa
ugucuguaccuaacgcccuauuuuugcaauggcuauauggcaagaaagcugguaaacuauuugu

SEQ ID NO: 496835 - RNA, 64 nt, hsa
gcauuuuauauaaaaaugcacaccuuuaaucucuauauggcagcauauacauauauauauauaa

SEQ ID NO: 496836 - RNA, 64 nt, hsa
auauauauauauaaaaugcacacuuuuaaucucuauauggcagcauuuuugaggcuuuauaucu

SEQ ID NO: 496837 - RNA, 64 nt, hsa
ugggguacauaauaugaguauauauucaugcaauauauggcauauuuugauacaagaauacagu

SEQ ID NO: 496838 - RNA, 64 nt, hsa
uucauacuggagggaacuccugugacugugaagaauauggcaaagccuuuaauaaauucucaau

SEQ ID NO: 496839 - RNA, 64 nt, hsa
guuuauaauauaagcaacauuuagcuaguuguuuugaagacacccaguacuaaguaauauuguu

SEQ ID NO: 496840 - RNA, 64 nt, hsa
ugucugaaguuucuuuggaaacucugcaaugcacugaagacaucuguaauaugauguuaccaaa

SEQ ID NO: 496841 - RNA, 64 nt, hsa
agaguuucuguggauauauuugcacagauaucuuugaagacacaaacacucaccugggacguug

SEQ ID NO: 496842 - RNA, 64 nt, hsa
aaauguauauaauucaaacagagcaucuuguaacugaagacacaccauaucuaugauaucgcau

SEQ ID NO: 496843 - RNA, 64 nt, hsa
uuaguggaggagggagaaccauauuuauuuauaaugaagacaucuaagaucccuaugaugaaug

SEQ ID NO: 496844 - RNA, 64 nt, hsa
guguucuguuggcaagccacagugcucccuugacugaagacauuuccagguagauuucucagcc

SEQ ID NO: 496845 - RNA, 64 nt, hsa
gguguuuuaaagaaaugcagggaggcaauguuucugaagacauuuucuguuuauaagagaguag

SEQ ID NO: 496846 - RNA, 64 nt, hsa
uuucuauuaaauaucaauuaguaaguauagcuaaugaagacauauaaugaaaguaauuuuaugc

SEQ ID NO: 496847 - RNA, 64 nt, hsa
gagucucuaagauugagaggucugaguuagccaaugaagacaucugagauccuauccaagauuu

SEQ ID NO: 496848 - RNA, 64 nt, hsa
aggaauccccucacagugggcgacagaucugaagugaagacaggagaugaugagaaaagcucac

SEQ ID NO: 496849 - RNA, 64 nt, hsa
cugccugcacucccuggccuugcccgucgugugcugaagacauguuucaagaaccgcauuucgg

SEQ ID NO: 496850 - RNA, 64 nt, hsa
gccggagggaggcacuagucaccgacagcggccuugaagacagagcaaagcgcccacccagguc

SEQ ID NO: 496851 - RNA, 64 nt, hsa
auaaaaaaagauauaguauuaaugccuguauuuaugaagacagggccauugcacugcugcuaug

SEQ ID NO: 496852 - RNA, 64 nt, hsa
cucagaggccaaaucuguaaaaucaaaaugagguugaagacaauuagugaaaguaauguuauag

SEQ ID NO: 496853 - RNA, 64 nt, hsa
auaaaugaaauuugcaaaaucacuuagcagcaacugaagacaauuaucaaccacguggagaaaa

SEQ ID NO: 496854 - RNA, 64 nt, hsa
guguucucacaguguggggcagccguccuucuaaugaagacaaugauauugacacugucccucu

SEQ ID NO: 496855 - RNA, 64 nt, hsa
gaaggaauuguggauggaagacaagcagaaaagcugaagacaauaguuccucagacagaccuca

SEQ ID NO: 496856 - RNA, 64 nt, hsa
agauggcucugcacgaaggagaaccacgcauuuaugaagacauccaggacuacgaggcggccaa

SEQ ID NO: 496857 - RNA, 64 nt, hsa
ggcucuaucagccccuguaccccacacugcccucugaagacaacacaggcuccugcuuccaccu

SEQ ID NO: 496858 - RNA, 64 nt, hsa
uuaccucacugggaauguguuuugaaaaugaauuugaagacaagccaacaaacccugcacucca

SEQ ID NO: 496859 - RNA, 64 nt, hsa
ucaguaugggguuucccucuggaaaaagaaaaucugaagacauuacaguugccuauugccucuu

SEQ ID NO: 496860 - RNA, 64 nt, hsa
ccaguugcacaaauggguaacuaucaggaauaucugaagacauuggcuucuccacugcgagaga

SEQ ID NO: 496861 - RNA, 64 nt, hsa
aacuccuggccucaagugauccuccaguuuccaucucccuaagagcugggauuacaggugugag

SEQ ID NO: 496862 - RNA, 64 nt, hsa
gggggcuucugcccugacugggaagggugccuggcucccuaaaacaaugucaaagccaguccug

SEQ ID NO: 496863 - RNA, 64 nt, hsa
uagguuagcuagcucucccccaauaaaaauaccacuaucagaguagaaacaagguagacauuuc

SEQ ID NO: 496864 - RNA, 64 nt, hsa
aguuagaagcauguugucaacuaaagacaacaaacuaucagauucauucauucagugaagcagc

SEQ ID NO: 496865 - RNA, 64 nt, hsa
ucuuaucacuuauaguuaguaauguacaccuacucuaucagagaaaaacaggaaaggcucgaaa

SEQ ID NO: 496866 - RNA, 64 nt, hsa
uguagagggaaggaacagaggcccugggcccuuccuaucagaaggacauggugaaggcugggaa

SEQ ID NO: 496867 - RNA, 64 nt, hsa; identical to SEQ ID NO: 358626

SEQ ID NO: 496868 - RNA, 64 nt, hsa; identical to SEQ ID NO: 358627

SEQ ID NO: 496869 - RNA, 64 nt, hsa; identical to SEQ ID NO: 358628

SEQ ID NO: 496870 - RNA, 64 nt, hsa; identical to SEQ ID NO: 358629

SEQ ID NO: 496871 - RNA, 64 nt, hsa; identical to SEQ ID NO: 134304

SEQ ID NO: 496872 - RNA, 64 nt, hsa; identical to SEQ ID NO: 134305

SEQ ID NO: 496873 - RNA, 64 nt, hsa; identical to SEQ ID NO: 134306

SEQ ID NO: 496874 - RNA, 64 nt, hsa; identical to SEQ ID NO: 134307

SEQ ID NO: 496875 - RNA, 64 nt, hsa; identical to SEQ ID NO: 134308

SEQ ID NO: 496876 - RNA, 64 nt, hsa; identical to SEQ ID NO: 134309

SEQ ID NO: 496877 - RNA, 64 nt, hsa; identical to SEQ ID NO: 134310

SEQ ID NO: 496878 - RNA, 64 nt, hsa; identical to SEQ ID NO: 134311

SEQ ID NO: 496879 - RNA, 64 nt, hsa; identical to SEQ ID NO: 134312

SEQ ID NO: 496880 - RNA, 64 nt, hsa; identical to SEQ ID NO: 134313

SEQ ID NO: 496881 - RNA, 64 nt, hsa; identical to SEQ ID NO: 134314

SEQ ID NO: 496882 - RNA, 64 nt, hsa; identical to SEQ ID NO: 134315

SEQ ID NO: 496883 - RNA, 64 nt, hsa; identical to SEQ ID NO: 134316

SEQ ID NO: 496884 - RNA, 64 nt, hsa; identical to SEQ ID NO: 134317

SEQ ID NO: 496885 - RNA, 64 nt, hsa; identical to SEQ ID NO: 134318

SEQ ID NO: 496886 - RNA, 64 nt, hsa; identical to SEQ ID NO: 134319

SEQ ID NO: 496887 - RNA, 64 nt, hsa; identical to SEQ ID NO: 134320

SEQ ID NO: 496888 - RNA, 64 nt, hsa; identical to SEQ ID NO: 134321

SEQ ID NO: 496889 - RNA, 64 nt, hsa; identical to SEQ ID NO: 134322

SEQ ID NO: 496890 - RNA, 64 nt, hsa; identical to SEQ ID NO: 134323

SEQ ID NO: 496891 - RNA, 64 nt, hsa; identical to SEQ ID NO: 134324

SEQ ID NO: 496892 - RNA, 64 nt, hsa; identical to SEQ ID NO: 134325

SEQ ID NO: 496893 - RNA, 64 nt, hsa; identical to SEQ ID NO: 134326

SEQ ID NO: 496894 - RNA, 64 nt, hsa; identical to SEQ ID NO: 134327

SEQ ID NO: 496895 - RNA, 64 nt, hsa; identical to SEQ ID NO: 134328

SEQ ID NO: 496896 - RNA, 64 nt, hsa; identical to SEQ ID NO: 134329

SEQ ID NO: 496897 - RNA, 64 nt, hsa; identical to SEQ ID NO: 134330

SEQ ID NO: 496898 - RNA, 64 nt, hsa; identical to SEQ ID NO: 134331

SEQ ID NO: 496899 - RNA, 64 nt, hsa; identical to SEQ ID NO: 134332

SEQ ID NO: 496900 - RNA, 64 nt, hsa; identical to SEQ ID NO: 134333

SEQ ID NO: 496901 - RNA, 64 nt, hsa; identical to SEQ ID NO: 134334

SEQ ID NO: 496902 - RNA, 64 nt, hsa; identical to SEQ ID NO: 134335

SEQ ID NO: 496903 - RNA, 64 nt, hsa; identical to SEQ ID NO: 134336

SEQ ID NO: 496904 - RNA, 64 nt, hsa; identical to SEQ ID NO: 134337

SEQ ID NO: 496905 - RNA, 64 nt, hsa; identical to SEQ ID NO: 134338

SEQ ID NO: 496906 - RNA, 64 nt, hsa; identical to SEQ ID NO: 134339

SEQ ID NO: 496907 - RNA, 64 nt, hsa; identical to SEQ ID NO: 134340

SEQ ID NO: 496908 - RNA, 64 nt, hsa; identical to SEQ ID NO: 134341

SEQ ID NO: 496909 - RNA, 64 nt, hsa; identical to SEQ ID NO: 134342

SEQ ID NO: 496910 - RNA, 64 nt, hsa; identical to SEQ ID NO: 134343

SEQ ID NO: 496911 - RNA, 64 nt, hsa; identical to SEQ ID NO: 134344

SEQ ID NO: 496912 - RNA, 64 nt, hsa; identical to SEQ ID NO: 134345

SEQ ID NO: 496913 - RNA, 64 nt, hsa; identical to SEQ ID NO: 134346

SEQ ID NO: 496914 - RNA, 64 nt, hsa; identical to SEQ ID NO: 134347

SEQ ID NO: 496915 - RNA, 64 nt, hsa; identical to SEQ ID NO: 134348

SEQ ID NO: 496916 - RNA, 64 nt, hsa; identical to SEQ ID NO: 134349

SEQ ID NO: 496917 - RNA, 64 nt, hsa; identical to SEQ ID NO: 134350

SEQ ID NO: 496918 - RNA, 64 nt, hsa; identical to SEQ ID NO: 134351

SEQ ID NO: 496919 - RNA, 64 nt, hsa; identical to SEQ ID NO: 134352

SEQ ID NO: 496920 - RNA, 64 nt, hsa; identical to SEQ ID NO: 134353

SEQ ID NO: 496921 - RNA, 64 nt, hsa; identical to SEQ ID NO: 134354

SEQ ID NO: 496922 - RNA, 64 nt, hsa; identical to SEQ ID NO: 134355

SEQ ID NO: 496923 - RNA, 64 nt, hsa; identical to SEQ ID NO: 134356

SEQ ID NO: 496924 - RNA, 64 nt, hsa; identical to SEQ ID NO: 134357

SEQ ID NO: 496925 - RNA, 64 nt, hsa; identical to SEQ ID NO: 134358

SEQ ID NO: 496926 - RNA, 64 nt, hsa; identical to SEQ ID NO: 134359

SEQ ID NO: 496927 - RNA, 64 nt, hsa; identical to SEQ ID NO: 134360

SEQ ID NO: 496928 - RNA, 64 nt, hsa; identical to SEQ ID NO: 134361

SEQ ID NO: 496929 - RNA, 64 nt, hsa; identical to SEQ ID NO: 134362

SEQ ID NO: 496930 - RNA, 64 nt, hsa; identical to SEQ ID NO: 134363

SEQ ID NO: 496931 - RNA, 64 nt, hsa; identical to SEQ ID NO: 134364

SEQ ID NO: 496932 - RNA, 64 nt, hsa; identical to SEQ ID NO: 134365

SEQ ID NO: 496933 - RNA, 64 nt, hsa; identical to SEQ ID NO: 134366

SEQ ID NO: 496934 - RNA, 64 nt, hsa; identical to SEQ ID NO: 134367

SEQ ID NO: 496935 - RNA, 64 nt, hsa; identical to SEQ ID NO: 134368

SEQ ID NO: 496936 - RNA, 64 nt, hsa; identical to SEQ ID NO: 134369

SEQ ID NO: 496937 - RNA, 64 nt, hsa; identical to SEQ ID NO: 134370

SEQ ID NO: 496938 - RNA, 64 nt, hsa; identical to SEQ ID NO: 134371

SEQ ID NO: 496939 - RNA, 64 nt, hsa; identical to SEQ ID NO: 134372

SEQ ID NO: 496940 - RNA, 64 nt, hsa; identical to SEQ ID NO: 134373

SEQ ID NO: 496941 - RNA, 64 nt, hsa; identical to SEQ ID NO: 134374

SEQ ID NO: 496942 - RNA, 64 nt, hsa; identical to SEQ ID NO: 134375

SEQ ID NO: 496943 - RNA, 64 nt, hsa; identical to SEQ ID NO: 134376

SEQ ID NO: 496944 - RNA, 64 nt, hsa; identical to SEQ ID NO: 134377

SEQ ID NO: 496945 - RNA, 64 nt, hsa; identical to SEQ ID NO: 134378

SEQ ID NO: 496946 - RNA, 64 nt, hsa; identical to SEQ ID NO: 134379

SEQ ID NO: 496947 - RNA, 64 nt, hsa; identical to SEQ ID NO: 134380

SEQ ID NO: 496948 - RNA, 64 nt, hsa; identical to SEQ ID NO: 134381

SEQ ID NO: 496949 - RNA, 64 nt, hsa; identical to SEQ ID NO: 134382

SEQ ID NO: 496950 - RNA, 64 nt, hsa; identical to SEQ ID NO: 134383

SEQ ID NO: 496951 - RNA, 64 nt, hsa; identical to SEQ ID NO: 134384

SEQ ID NO: 496952 - RNA, 64 nt, hsa; identical to SEQ ID NO: 134385

SEQ ID NO: 496953 - RNA, 64 nt, hsa; identical to SEQ ID NO: 134386

SEQ ID NO: 496954 - RNA, 64 nt, hsa; identical to SEQ ID NO: 134387

SEQ ID NO: 496955 - RNA, 64 nt, hsa; identical to SEQ ID NO: 134388

SEQ ID NO: 496956 - RNA, 64 nt, hsa; identical to SEQ ID NO: 134389

SEQ ID NO: 496957 - RNA, 64 nt, hsa; identical to SEQ ID NO: 134390

SEQ ID NO: 496958 - RNA, 64 nt, hsa; identical to SEQ ID NO: 134391

SEQ ID NO: 496959 - RNA, 64 nt, hsa; identical to SEQ ID NO: 134392

SEQ ID NO: 496960 - RNA, 64 nt, hsa; identical to SEQ ID NO: 134393

SEQ ID NO: 496961 - RNA, 64 nt, hsa; identical to SEQ ID NO: 134394

SEQ ID NO: 496962 - RNA, 64 nt, hsa; identical to SEQ ID NO: 134395

SEQ ID NO: 496963 - RNA, 64 nt, hsa; identical to SEQ ID NO: 134396

SEQ ID NO: 496964 - RNA, 64 nt, hsa; identical to SEQ ID NO: 134397

SEQ ID NO: 496965 - RNA, 64 nt, hsa; identical to SEQ ID NO: 134398

SEQ ID NO: 496966 - RNA, 64 nt, hsa; identical to SEQ ID NO: 134399

SEQ ID NO: 496967 - RNA, 64 nt, hsa; identical to SEQ ID NO: 134400

SEQ ID NO: 496968 - RNA, 64 nt, hsa; identical to SEQ ID NO: 134401

SEQ ID NO: 496969 - RNA, 64 nt, hsa; identical to SEQ ID NO: 134402

SEQ ID NO: 496970 - RNA, 64 nt, hsa; identical to SEQ ID NO: 134403

SEQ ID NO: 496971 - RNA, 64 nt, hsa; identical to SEQ ID NO: 134404

SEQ ID NO: 496972 - RNA, 64 nt, hsa; identical to SEQ ID NO: 134405

SEQ ID NO: 496973 - RNA, 64 nt, hsa; identical to SEQ ID NO: 134406

SEQ ID NO: 496974 - RNA, 64 nt, hsa; identical to SEQ ID NO: 134407

SEQ ID NO: 496975 - RNA, 64 nt, hsa; identical to SEQ ID NO: 134408

SEQ ID NO: 496976 - RNA, 64 nt, hsa; identical to SEQ ID NO: 134409

SEQ ID NO: 496977 - RNA, 64 nt, hsa; identical to SEQ ID NO: 134410

SEQ ID NO: 496978 - RNA, 64 nt, hsa; identical to SEQ ID NO: 134411

SEQ ID NO: 496979 - RNA, 64 nt, hsa; identical to SEQ ID NO: 134412

SEQ ID NO: 496980 - RNA, 64 nt, hsa; identical to SEQ ID NO: 134413

SEQ ID NO: 496981 - RNA, 64 nt, hsa; identical to SEQ ID NO: 134414

SEQ ID NO: 496982 - RNA, 64 nt, hsa; identical to SEQ ID NO: 134415

SEQ ID NO: 496983 - RNA, 64 nt, hsa; identical to SEQ ID NO: 134416

SEQ ID NO: 496984 - RNA, 64 nt, hsa; identical to SEQ ID NO: 134417

SEQ ID NO: 496985 - RNA, 64 nt, hsa; identical to SEQ ID NO: 134418

SEQ ID NO: 496986 - RNA, 64 nt, hsa; identical to SEQ ID NO: 134419

SEQ ID NO: 496987 - RNA, 64 nt, hsa; identical to SEQ ID NO: 134420

SEQ ID NO: 496988 - RNA, 64 nt, hsa; identical to SEQ ID NO: 134421

SEQ ID NO: 496989 - RNA, 64 nt, hsa; identical to SEQ ID NO: 134422

SEQ ID NO: 496990 - RNA, 64 nt, hsa; identical to SEQ ID NO: 134423

SEQ ID NO: 496991 - RNA, 64 nt, hsa; identical to SEQ ID NO: 134424

SEQ ID NO: 496992 - RNA, 64 nt, hsa; identical to SEQ ID NO: 134425

SEQ ID NO: 496993 - RNA, 64 nt, hsa; identical to SEQ ID NO: 134426

SEQ ID NO: 496994 - RNA, 64 nt, hsa; identical to SEQ ID NO: 134427

SEQ ID NO: 496995 - RNA, 64 nt, hsa; identical to SEQ ID NO: 134428

SEQ ID NO: 496996 - RNA, 64 nt, hsa; identical to SEQ ID NO: 134429

SEQ ID NO: 496997 - RNA, 64 nt, hsa; identical to SEQ ID NO: 134430

SEQ ID NO: 496998 - RNA, 64 nt, hsa; identical to SEQ ID NO: 134431

SEQ ID NO: 496999 - RNA, 64 nt, hsa; identical to SEQ ID NO: 134432

SEQ ID NO: 497000 - RNA, 64 nt, hsa; identical to SEQ ID NO: 134433

SEQ ID NO: 497001 - RNA, 64 nt, hsa; identical to SEQ ID NO: 134434

SEQ ID NO: 497002 - RNA, 64 nt, hsa; identical to SEQ ID NO: 134435

SEQ ID NO: 497003 - RNA, 64 nt, hsa; identical to SEQ ID NO: 134436

SEQ ID NO: 497004 - RNA, 64 nt, hsa; identical to SEQ ID NO: 134437

SEQ ID NO: 497005 - RNA, 64 nt, hsa; identical to SEQ ID NO: 134438

SEQ ID NO: 497006 - RNA, 64 nt, hsa; identical to SEQ ID NO: 134439

SEQ ID NO: 497007 - RNA, 64 nt, hsa; identical to SEQ ID NO: 134440

SEQ ID NO: 497008 - RNA, 64 nt, hsa; identical to SEQ ID NO: 134441

SEQ ID NO: 497009 - RNA, 64 nt, hsa; identical to SEQ ID NO: 134442

SEQ ID NO: 497010 - RNA, 64 nt, hsa; identical to SEQ ID NO: 134443

SEQ ID NO: 497011 - RNA, 64 nt, hsa; identical to SEQ ID NO: 134444

SEQ ID NO: 497012 - RNA, 64 nt, hsa; identical to SEQ ID NO: 134445

SEQ ID NO: 497013 - RNA, 64 nt, hsa; identical to SEQ ID NO: 134446

SEQ ID NO: 497014 - RNA, 64 nt, hsa; identical to SEQ ID NO: 134447

SEQ ID NO: 497015 - RNA, 64 nt, hsa; identical to SEQ ID NO: 134448

SEQ ID NO: 497016 - RNA, 64 nt, hsa; identical to SEQ ID NO: 134449

SEQ ID NO: 497017 - RNA, 64 nt, hsa; identical to SEQ ID NO: 134450

SEQ ID NO: 497018 - RNA, 64 nt, hsa; identical to SEQ ID NO: 134451

SEQ ID NO: 497019 - RNA, 64 nt, hsa; identical to SEQ ID NO: 134452

SEQ ID NO: 497020 - RNA, 64 nt, hsa; identical to SEQ ID NO: 134453

SEQ ID NO: 497021 - RNA, 64 nt, hsa; identical to SEQ ID NO: 134454

SEQ ID NO: 497022 - RNA, 64 nt, hsa; identical to SEQ ID NO: 134455

SEQ ID NO: 497023 - RNA, 64 nt, hsa; identical to SEQ ID NO: 134456

SEQ ID NO: 497024 - RNA, 64 nt, hsa; identical to SEQ ID NO: 134457

SEQ ID NO: 497025 - RNA, 64 nt, hsa; identical to SEQ ID NO: 151176

SEQ ID NO: 497026 - RNA, 64 nt, hsa; identical to SEQ ID NO: 151177

SEQ ID NO: 497027 - RNA, 64 nt, hsa; identical to SEQ ID NO: 151178

SEQ ID NO: 497028 - RNA, 64 nt, hsa; identical to SEQ ID NO: 151179

SEQ ID NO: 497029 - RNA, 64 nt, hsa; identical to SEQ ID NO: 151180

SEQ ID NO: 497030 - RNA, 64 nt, hsa; identical to SEQ ID NO: 151181

SEQ ID NO: 497031 - RNA, 64 nt, hsa; identical to SEQ ID NO: 151182

SEQ ID NO: 497032 - RNA, 64 nt, hsa; identical to SEQ ID NO: 151183

SEQ ID NO: 497033 - RNA, 64 nt, hsa; identical to SEQ ID NO: 151184

SEQ ID NO: 497034 - RNA, 64 nt, hsa; identical to SEQ ID NO: 151185

SEQ ID NO: 497035 - RNA, 64 nt, hsa; identical to SEQ ID NO: 151186

SEQ ID NO: 497036 - RNA, 64 nt, hsa; identical to SEQ ID NO: 151187

SEQ ID NO: 497037 - RNA, 64 nt, hsa; identical to SEQ ID NO: 238553

SEQ ID NO: 497038 - RNA, 64 nt, hsa; identical to SEQ ID NO: 238554

SEQ ID NO: 497039 - RNA, 64 nt, hsa; identical to SEQ ID NO: 238555

SEQ ID NO: 497040 - RNA, 64 nt, hsa; identical to SEQ ID NO: 238556

SEQ ID NO: 497041 - RNA, 61 nt, hsa; identical to SEQ ID NO: 238557

SEQ ID NO: 497042 - RNA, 64 nt, hsa; identical to SEQ ID NO: 238558

SEQ ID NO: 497043 - RNA, 64 nt, hsa; identical to SEQ ID NO: 238559

SEQ ID NO: 497044 - RNA, 64 nt, hsa; identical to SEQ ID NO: 238560

SEQ ID NO: 497045 - RNA, 64 nt, hsa; identical to SEQ ID NO: 238561

SEQ ID NO: 497046 - RNA, 64 nt, hsa; identical to SEQ ID NO: 238562

SEQ ID NO: 497047 - RNA, 64 nt, hsa; identical to SEQ ID NO: 238563

SEQ ID NO: 497048 - RNA, 64 nt, hsa; identical to SEQ ID NO: 238564

SEQ ID NO: 497049 - RNA, 64 nt, hsa; identical to SEQ ID NO: 238565

SEQ ID NO: 497050 - RNA, 64 nt, hsa; identical to SEQ ID NO: 238566

SEQ ID NO: 497051 - RNA, 64 nt, hsa; identical to SEQ ID NO: 238567

SEQ ID NO: 497052 - RNA, 64 nt, hsa; identical to SEQ ID NO: 238568

SEQ ID NO: 497053 - RNA, 64 nt, hsa; identical to SEQ ID NO: 238569

SEQ ID NO: 497054 - RNA, 64 nt, hsa; identical to SEQ ID NO: 238570

SEQ ID NO: 497055 - RNA, 64 nt, hsa; identical to SEQ ID NO: 238571

SEQ ID NO: 497056 - RNA, 64 nt, hsa; identical to SEQ ID NO: 238572

SEQ ID NO: 497057 - RNA, 64 nt, hsa; identical to SEQ ID NO: 238573

SEQ ID NO: 497058 - RNA, 64 nt, hsa; identical to SEQ ID NO: 238574

SEQ ID NO: 497059 - RNA, 64 nt, hsa; identical to SEQ ID NO: 238575

SEQ ID NO: 497060 - RNA, 64 nt, hsa; identical to SEQ ID NO: 238576

SEQ ID NO: 497061 - RNA, 64 nt, hsa; identical to SEQ ID NO: 238577

SEQ ID NO: 497062 - RNA, 64 nt, hsa; identical to SEQ ID NO: 238578

SEQ ID NO: 497063 - RNA, 64 nt, hsa; identical to SEQ ID NO: 238579

SEQ ID NO: 497064 - RNA, 64 nt, hsa; identical to SEQ ID NO: 238580

SEQ ID NO: 497065 - RNA, 64 nt, hsa; identical to SEQ ID NO: 238581

SEQ ID NO: 497066 - RNA, 64 nt, hsa; identical to SEQ ID NO: 238582

SEQ ID NO: 497067 - RNA, 64 nt, hsa; identical to SEQ ID NO: 238583

SEQ ID NO: 497068 - RNA, 64 nt, hsa; identical to SEQ ID NO: 238584

SEQ ID NO: 497069 - RNA, 64 nt, hsa; identical to SEQ ID NO: 238585

SEQ ID NO: 497070 - RNA, 64 nt, hsa; identical to SEQ ID NO: 238586

SEQ ID NO: 497071 - RNA, 64 nt, hsa; identical to SEQ ID NO: 238587

SEQ ID NO: 497072 - RNA, 64 nt, hsa; identical to SEQ ID NO: 238588

SEQ ID NO: 497073 - RNA, 64 nt, hsa; identical to SEQ ID NO: 238589

SEQ ID NO: 497074 - RNA, 64 nt, hsa; identical to SEQ ID NO: 238590

SEQ ID NO: 497075 - RNA, 64 nt, hsa; identical to SEQ ID NO: 238591

SEQ ID NO: 497076 - RNA, 64 nt, hsa; identical to SEQ ID NO: 238592

SEQ ID NO: 497077 - RNA, 64 nt, hsa; identical to SEQ ID NO: 238593

SEQ ID NO: 497078 - RNA, 51 nt, hsa; identical to SEQ ID NO: 238594

SEQ ID NO: 497079 - RNA, 64 nt, hsa; identical to SEQ ID NO: 238595

SEQ ID NO: 497080 - RNA, 64 nt, hsa; identical to SEQ ID NO: 238596

SEQ ID NO: 497081 - RNA, 64 nt, hsa; identical to SEQ ID NO: 238597

SEQ ID NO: 497082 - RNA, 64 nt, hsa; identical to SEQ ID NO: 238598

SEQ ID NO: 497083 - RNA, 64 nt, hsa; identical to SEQ ID NO: 238599

SEQ ID NO: 497084 - RNA, 64 nt, hsa; identical to SEQ ID NO: 238600

SEQ ID NO: 497085 - RNA, 64 nt, hsa; identical to SEQ ID NO: 238601

SEQ ID NO: 497086 - RNA, 64 nt, hsa; identical to SEQ ID NO: 238602

SEQ ID NO: 497087 - RNA, 64 nt, hsa; identical to SEQ ID NO: 238603

SEQ ID NO: 497088 - RNA, 64 nt, hsa; identical to SEQ ID NO: 238604

SEQ ID NO: 497089 - RNA, 64 nt, hsa; identical to SEQ ID NO: 238605

SEQ ID NO: 497090 - RNA, 64 nt, hsa; identical to SEQ ID NO: 238606

SEQ ID NO: 497091 - RNA, 64 nt, hsa; identical to SEQ ID NO: 238607

SEQ ID NO: 497092 - RNA, 64 nt, hsa; identical to SEQ ID NO: 238608

SEQ ID NO: 497093 - RNA, 64 nt, hsa; identical to SEQ ID NO: 238609

SEQ ID NO: 497094 - RNA, 64 nt, hsa; identical to SEQ ID NO: 238610

SEQ ID NO: 497095 - RNA, 64 nt, hsa; identical to SEQ ID NO: 238611

SEQ ID NO: 497096 - RNA, 64 nt, hsa; identical to SEQ ID NO: 238612

SEQ ID NO: 497097 - RNA, 64 nt, hsa; identical to SEQ ID NO: 238613

SEQ ID NO: 497098 - RNA, 64 nt, hsa; identical to SEQ ID NO: 238614

SEQ ID NO: 497099 - RNA, 64 nt, hsa; identical to SEQ ID NO: 238615

SEQ ID NO: 497100 - RNA, 64 nt, hsa; identical to SEQ ID NO: 238616

SEQ ID NO: 497101 - RNA, 64 nt, hsa; identical to SEQ ID NO: 238617

SEQ ID NO: 497102 - RNA, 64 nt, hsa; identical to SEQ ID NO: 238618

SEQ ID NO: 497103 - RNA, 64 nt, hsa; identical to SEQ ID NO: 238619

SEQ ID NO: 497104 - RNA, 64 nt, hsa; identical to SEQ ID NO: 238620

SEQ ID NO: 497105 - RNA, 64 nt, hsa; identical to SEQ ID NO: 238621

SEQ ID NO: 497106 - RNA, 64 nt, hsa; identical to SEQ ID NO: 238622

SEQ ID NO: 497107 - RNA, 64 nt, hsa; identical to SEQ ID NO: 238623

SEQ ID NO: 497108 - RNA, 64 nt, hsa; identical to SEQ ID NO: 238624

SEQ ID NO: 497109 - RNA, 64 nt, hsa; identical to SEQ ID NO: 238625

SEQ ID NO: 497110 - RNA, 64 nt, hsa; identical to SEQ ID NO: 238626

SEQ ID NO: 497111 - RNA, 64 nt, hsa; identical to SEQ ID NO: 238627

SEQ ID NO: 497112 - RNA, 64 nt, hsa; identical to SEQ ID NO: 238628

SEQ ID NO: 497113 - RNA, 64 nt, hsa; identical to SEQ ID NO: 238629

SEQ ID NO: 497114 - RNA, 64 nt, hsa
gugagcucuuccuaucccucuccuaacugccagcccccuaaaagcacuccugcuuaaucuucaa

SEQ ID NO: 497115 - RNA, 64 nt, hsa
uuaaauccuuuuaccuuuuuuuuuucuugguaauccccuaaaauaacaguaugugggauauuga

SEQ ID NO: 497116 - RNA, 64 nt, hsa
ucgccaaaauguguuuuccaucuaugucccgauuccccuaaauuuugccuaaaauucaguaugu

SEQ ID NO: 497117 - RNA, 64 nt, hsa
gcccauuuaaguggauuaauauucuacaugugugccccuaaagacacauuuacucaauauugga

SEQ ID NO: 497118 - RNA, 64 nt, hsa
uaauaaucucuucuauuuauagcuauugguaguuccccuaaauucugacgauagaaauuuuuau

SEQ ID NO: 497119 - RNA, 64 nt, hsa
acauauauauuacauuuauagcuauguaguaguuccccuaaauucuuguaaaaauaaauuuuua

SEQ ID NO: 497120 - RNA, 64 nt, hsa
gaauuugagcaggucucauagguugagcaauuucccccuaaaccaacugaaggcuaaaaagcaa

SEQ ID NO: 497121 - RNA, 64 nt, hsa
uuuacuuuuuugguacuauaaaagcuuucugccaccccuaaacuccaggggggacaauaugugc

SEQ ID NO: 497122 - RNA, 64 nt, hsa
gcaaguuuacuuucauuccuuccuauguuuuaauccccuaaaauucucccuguagucaauguuc

SEQ ID NO: 497123 - RNA, 64 nt, hsa
uggggaggaugcuacuuuacuggaguugagacacccccuaaaauucucacccucagcuauuuug

SEQ ID NO: 497124 - RNA, 64 nt, hsa
gcagagcauugucaccgcaggugcucaugcugcuccccuaaagccaggcucaggagaagccagu

SEQ ID NO: 497125 - RNA, 64 nt, hsa
gaucugcccccuaguucagguccaaauucaccuuccccuaaaccccaagcuucccaacagauca

SEQ ID NO: 497126 - RNA, 64 nt, hsa
ugaggagagaggaggaaaagucuuccuaauugugccccuaaagagcauccugauaccauucuau

SEQ ID NO: 497127 - RNA, 64 nt, hsa
aauuugaugaaauuuacuguaggaacuaaacuaugccauaaaacaauagcuuucuaguucauuu

SEQ ID NO: 497128 - RNA, 64 nt, hsa
cugugcaaacaagugagucaccccuuugaucccagccauaaaguaccugggaugaaagaaguuu

SEQ ID NO: 497129 - RNA, 64 nt, hsa
cugacaaaugagaaacaauaaauacugauuauuggccauaaagugguauuaaaacuggaucucu

SEQ ID NO: 497130 - RNA, 64 nt, hsa
agguuguuuauucauucagauuagauagacuggagccauaaaguuaauuugcaccuagcuuuuu

SEQ ID NO: 497131 - RNA, 64 nt, hsa
ccccaaaucuggccauaaacuggccccaaaacuggccauaaacaaaauaucugcagcacuguga

SEQ ID NO: 497132 - RNA, 64 nt, hsa
aaucucugguguugggaacaggcccccaaaucuggccauaaacuggccccaaaacuggccauaa

SEQ ID NO: 497133 - RNA, 64 nt, hsa
auagaaaaaggcuugcguguucguugaguaaucauuguuucauuuucauuuuuacgagaguuug

SEQ ID NO: 497134 - RNA, 64 nt, hsa
aaauguacuguauucaaaaggaugugaauguguauuguuucagaaccuaauaaauacaaugacg

SEQ ID NO: 497135 - RNA, 64 nt, hsa
agcaugucccagucacugcagcaacgccuuguguuuguuucauuuuuuuaaaacccacacaaag

SEQ ID NO: 497136 - RNA, 64 nt, hsa
uaauagauguaaguuuacacuuugaaaggaaaucuuguuucaauguuuauuauaaaagccuugc

SEQ ID NO: 497137 - RNA, 64 nt, hsa
uccgucauuuugcauuacuuguauccacucauguuuguuucauaauaauugcauuuucuuagaa

SEQ ID NO: 497138 - RNA, 64 nt, hsa
uuagaaaaagauaaguauuauuucauguauuuuuuuguuucauuaauauguacacaaauguaca

SEQ ID NO: 497139 - RNA, 64 nt, hsa
ucuauacuuugguccauaauuugauuugauaugauuguuucauuuauaauuugcccaaauacau

SEQ ID NO: 497140 - RNA, 64 nt, hsa
guuaucuugcuuuuaucaauauauagcuaaguuuuuguuucauuuugauuuuuuuuuuuagcca

SEQ ID NO: 497141 - RNA, 64 nt, hsa
auugcugcaauguauuuucuugcuuauauuaaaguuguuucaucaguauaaucugaguccggug

SEQ ID NO: 497142 - RNA, 64 nt, hsa
gauaaaugcuucuaccaaaguaaaacucugugaguuguuucagggcagaauguaccagccaguc

SEQ ID NO: 497143 - RNA, 64 nt, hsa
auucuauguuaauuacaacugcuauauagacauuuuguuucaaaugaaacuuuaaaagacugaa

SEQ ID NO: 497144 - RNA, 64 nt, hsa
acuguuacugaaauugguauuuguuugaagggucuuguuucacauuuguauuaauaauuguuua

SEQ ID NO: 497145 - RNA, 64 nt, hsa
aauugucccugauuuuauuuucuuuuagggaaaauuguuucauaaaugugacacugauaaagcc

SEQ ID NO: 497146 - RNA, 64 nt, hsa
auuuuagcacuguuaaagcacgaauugguaacaguuguuucauaaaugagcacuguugugauaa

SEQ ID NO: 497147 - RNA, 64 nt, hsa
cuucacaagucagcauuaaucuuucuuuuaaaacuuguuucauuuaugaucauguagagagcca

SEQ ID NO: 497148 - RNA, 64 nt, hsa
auaaaaaagggaaacuguuuucacaagcuguucuuuguuucauaauuggauucaucaaucccgu

SEQ ID NO: 497149 - RNA, 64 nt, hsa
uccuuuuuauuacagaggugggucacuguuuaccuuguuucaggggugggagaaacuccuuucc

SEQ ID NO: 497150 - RNA, 64 nt, hsa
uacagcagggcucuggggaacuggaaaaggggguuuguuucauuaucugguuuuauuaagcaga

SEQ ID NO: 497151 - RNA, 64 nt, hsa
auuguuuaaaugccuaaaaguuuugagauaaguuuuguuucaauuagaaaaggaaauagguuuu

SEQ ID NO: 497152 - RNA, 64 nt, hsa
caauagugauuuuuguaucagaaucuuguccaaguuguuucauugauuuaguaaguguucugcu

SEQ ID NO: 497153 - RNA, 64 nt, hsa
uccuauuaccuuucugaggcuggcuuuccagcaauuguuucaaaggaaaauagauccccuuaaa

SEQ ID NO: 497154 - RNA, 64 nt, hsa
cuauaauugaauggauauuccuauggaaaauuuuuuguuucaaaauacaggaaaaacauuccua

SEQ ID NO: 497155 - RNA, 64 nt, hsa
gucuacccacccucccuucuagcagauuuugauuuuguuucaauuuauaacuuacacuuugaac

SEQ ID NO: 497156 - RNA, 64 nt, hsa
guauagcuuuguaauuuaaauuggagcuuuuagcuuguuucauggaacuauacaacuugugggu

SEQ ID NO: 497157 - RNA, 64 nt, hsa
gaggaaauuugaacaaguuggaaaaaaacaauuuuuguuucaauucuaagaaacacuugcagcu

SEQ ID NO: 497158 - RNA, 64 nt, hsa
auuaccauggaacgccuaauaaagcaaaaugugguuguuucaggggugugucuguauugagaug

SEQ ID NO: 497159 - RNA, 64 nt, hsa
aauaaaaacuuaauacaaauguaauuuguuaauauuguuucauguuuuauguguagaucuaaua

SEQ ID NO: 497160 - RNA, 64 nt, hsa
cuuagguaaacuuauuuauuuaugcuauuuugcuuuguuucauuuuuuaaggacaagaucagga

SEQ ID NO: 497161 - RNA, 64 nt, hsa
uaaacugaccccaugaccaacugagaauuuauuuuuguuucauugguuguuucacagaauuaga

SEQ ID NO: 497162 - RNA, 64 nt, hsa
augaccaacugagaauuuauuuuuguuucauugguuguuucacagaauuagaacacacacgacu

SEQ ID NO: 497163 - RNA, 64 nt, hsa
gucauaaauuguacauaucuguaagcuaguauauuuguuucacuguuuguaauauuuaagaaau

SEQ ID NO: 497164 - RNA, 64 nt, hsa
aacucccacugauagugccuguuagaucuccuguuuguuucaguuggcagaacauuuacuggcc

SEQ ID NO: 497165 - RNA, 64 nt, hsa
ugcuaccaagaagaugugaaccugaggaugcaucuuguuucauaagaaggaaggcaggugaaua

SEQ ID NO: 497166 - RNA, 64 nt, hsa
cuuuaacuguagugccuccuaauaagcaguauguuuguuucauugugagauugcaguucuguau

SEQ ID NO: 497167 - RNA, 64 nt, hsa
uuuguuuuuuguuuuuuuuuuuuaaucaagaccauuguuucauguuaaugcagcugcugagaag

SEQ ID NO: 497168 - RNA, 64 nt, hsa
gauauccugccaaaugcccucuuaucuagaauuuuuguuucauuuuguuuaauuuucuggggug

SEQ ID NO: 497169 - RNA, 64 nt, hsa
caaaacagcuguuauaaaugaauauuauguguaauuguuucaaacauccauuuucuuugugaac

SEQ ID NO: 497170 - RNA, 64 nt, hsa
uaauuguuguaacauugucuuucuuuuuuuucuuuuguuucaugauuuugauuuuuaaaauuau

SEQ ID NO: 497171 - RNA, 64 nt, hsa
aaaacaaaucacaaaagcagcauuagacauugccuuguuucauuaaucuuguuucagagcuuua

SEQ ID NO: 497172 - RNA, 64 nt, hsa
aagcagcauuagacauugccuuguuucauuaaucuuguuucagagcuuuagcugccugaggaga

SEQ ID NO: 497173 - RNA, 64 nt, hsa
agacauuaaauguaaacuuaaaaauguuuagaucuuguuucaaacuuuacaauagcauucuuca

SEQ ID NO: 497174 - RNA, 64 nt, hsa
ugacuacuuguauggcauuagcuuucacagaaaauuguuucacuuaaaacuguggauuggccua

SEQ ID NO: 497175 - RNA, 64 nt, hsa
aucauuuuuacugugucucauguuuuguauauuuuuguuucaucaacuaagaugcacuguaaca

SEQ ID NO: 497176 - RNA, 64 nt, hsa
aggcuguuuaucacaugcauaaaauuaaauauuuuuguuucaaagaaacaucucaauacacuua

SEQ ID NO: 497177 - RNA, 64 nt, hsa
ugugccaagacuguauuuauauuucauacuuauauuguuucauccuuauauuggaaugauuaua

SEQ ID NO: 497178 - RNA, 64 nt, hsa
aaucacuuuuaaauaauguguugcauuuacacaguuguuucaugcugucuuuagaguuaggugc

SEQ ID NO: 497179 - RNA, 64 nt, hsa
uguacagacauacauuuaugcacauucacgcuguuuguuucauauauacaggcauaaaauagag

SEQ ID NO: 497180 - RNA, 64 nt, hsa
ugaaauuauacagauagaguuccauauauuguauuuguuucaaugguaaauccuuuuggaacau

SEQ ID NO: 497181 - RNA, 64 nt, hsa
cuguacaguuuguagccagguuaagcauuugguauuguuucauuuacaauuugggacuaagaug

SEQ ID NO: 497182 - RNA, 64 nt, hsa
uuuuguuuuguuugguguuuuguuccugucuucauuguuucagguauuucuuuaccccucugga

SEQ ID NO: 497183 - RNA, 64 nt, hsa
aaauauguaauuuuagaaaauaauuuaaaagguuuuguuucaguuuguaagauuucuuuucugg

SEQ ID NO: 497184 - RNA, 64 nt, hsa
ccaaauaauuagcaguccuucguagugucaguuuuuguuucagccuuccuuauggguaugcugu

SEQ ID NO: 497185 - RNA, 64 nt, hsa
ugguuugacuguuuucuuguauauggauauccaauuguuucacacaauuuuuuugaaaagaaua

SEQ ID NO: 497186 - RNA, 64 nt, hsa
cacagccugcaaaugacuucauuuggaagucugauuguuucaguugccugacaaauacuacacu

SEQ ID NO: 497187 - RNA, 64 nt, hsa
auuccacagccuggucaggagggaaggaccucacuuguuucaucaaauggagugguuuaaaacu

SEQ ID NO: 497188 - RNA, 64 nt, hsa
ccaggcgcaggugcugagaauaagaaugcucaguuuguuucagccuuaguuggugccuccuuag

SEQ ID NO: 497189 - RNA, 64 nt, hsa
ugugaaauguauuuuauuuucuuuauuuguauucuuguuucauuuuuuaauauguugugaacau

SEQ ID NO: 497190 - RNA, 64 nt, hsa
ucuagagaaacaaguuuuaugguucuguuuucauuuguuucauuuuuugaaauucaggaauaca

SEQ ID NO: 497191 - RNA, 64 nt, hsa
uguuuauaggugauuaucauucugugacagucccuuguuucaacaggcagcagggguguucagu

SEQ ID NO: 497192 - RNA, 64 nt, hsa
aagugcagaaagccagaggacuagagccaaaaacuuguuucagaaagauaggagauagcucugu

SEQ ID NO: 497193 - RNA, 64 nt, hsa
aaguacagaaagccagaggacuagauccaaagacuuguuucagaaagaugagagagaacucugu

SEQ ID NO: 497194 - RNA, 64 nt, hsa
augugcagaaagccagaggacuagaggccaagacuuguuucagaaagauggaagagaguucuuu

SEQ ID NO: 497195 - RNA, 64 nt, hsa
ggaaagagcauaguuuaacaucuugagaaauuugggacauaaaguuuucaugguagacaguuca

SEQ ID NO: 497196 - RNA, 64 nt, hsa
cccaggaagggaugaucaggagaggcuucccugaggacauaauguguaagagaggugagaagug

SEQ ID NO: 497197 - RNA, 64 nt, hsa
uauuuggguauccuggguuugaguguuaggggauggacauaaaggaaaaagagugaugagaaga

SEQ ID NO: 497198 - RNA, 64 nt, hsa
caguaaccccacugcacaggcacacgaugcucugggacauaacuggugccuggaaaucaccaug

SEQ ID NO: 497199 - RNA, 64 nt, hsa
caccccuguacccagccaccuuccugacugggaaggacauaaaagguuuaaugucagggucaaa

SEQ ID NO: 497200 - RNA, 64 nt, hsa
uuugaguauuuuguaauuuuuuugaaauauuuguggacauaaauaaaaccaagcuacacuacaa

SEQ ID NO: 497201 - RNA, 64 nt, hsa
aagaccccaaagcacuggcuguugccuugaacugggacauaaagaagacggagacuguucagga

SEQ ID NO: 497202 - RNA, 64 nt, hsa
caguuuaauuccagccuuacccauugacucaaggggacauaaaccacgagagugacagucaucu

SEQ ID NO: 497203 - RNA, 64 nt, hsa
gaauucuaguauucuguauucaaaaaaucaucuuggacauaauuaauauuauaguaagcugcau

SEQ ID NO: 497204 - RNA, 64 nt, hsa
caaggcuguuugcugggugucccacaaguuggguggacauaaaugagucaagugacaacaggag

SEQ ID NO: 497205 - RNA, 64 nt, hsa
gcuaauaaaacaugcugagguugagauaaagacgggacauaaggggaaaauucauuccauagag

SEQ ID NO: 497206 - RNA, 64 nt, hsa
uccucaaguaagggggaacuccugcuuugggcugggacauaaguuuuucugcuuucagacgcaa

SEQ ID NO: 497207 - RNA, 64 nt, hsa
accacaggugucucauugcugccauuucuccugaggacauaaucacuuggucaccuuggacccu

SEQ ID NO: 497208 - RNA, 64 nt, hsa
cugagacaucaggguggcgacucuauagacucuaggacauaaauuagaggucuccaaaaucgga

SEQ ID NO: 497209 - RNA, 64 nt, hsa
ugaggccgcccgccgcccccggggccccuuugauggacauaaaggcucuuuucagagccaccua

SEQ ID NO: 497210 - RNA, 64 nt, hsa
aaaagaggaaggguuucuugucccgggaagcaacggacauaaucuguucccagccauggccuuc

SEQ ID NO: 497211 - RNA, 64 nt, hsa
ugcauagaauuuaagugauugauuuaaaaaaacuggacauaaacuaagucuaagaagagggcuu

SEQ ID NO: 497212 - RNA, 64 nt, hsa
aagagcaaaucuguaugauaacauuuuuuccucuggacauaagacauaacaguaacacgaugua

SEQ ID NO: 497213 - RNA, 64 nt, hsa
ugaugguaacaguaagugauuuggguagaggagaggacauaaauaaauacaugguuguuaaagc

SEQ ID NO: 497214 - RNA, 64 nt, hsa
cauuaacaaucaagauguaaaagugauccauguuggacauaauugaguuuuuaaaucaguuuau

SEQ ID NO: 497215 - RNA, 64 nt, hsa
uaaauccagcauguuuuauuuaauuuugauuucaggacauaaagaucuggucccugaugaagaa

SEQ ID NO: 497216 - RNA, 64 nt, hsa
uuggacagcuuucacaaguaacaggauuagggaaggacauaauguauuuaagaauaagugaagg

SEQ ID NO: 497217 - RNA, 64 nt, hsa
uaacuuagaaggauugaacuucuuugaauuuacuggacauaacauuuucagaauaguuggucau

SEQ ID NO: 497218 - RNA, 64 nt, hsa
ugaaacaagcaacagauggauagucuguccaaauggacauaagacagacagcaguuucccuggu

SEQ ID NO: 497219 - RNA, 64 nt, hsa
uacacuauuggcucaagaauguuauaaugcuaagggacauaaguuggcaaccacuugguuuuug

SEQ ID NO: 497220 - RNA, 64 nt, hsa
gcuugauugcuucuuuauaguagucccuguaaguggacauaaauguggcuauuugauguuaaug

SEQ ID NO: 497221 - RNA, 64 nt, hsa
cacugcccaggaggcaguggcgggcuccccgaugggacauaaaaccucaccgaagauggaugcu

SEQ ID NO: 497222 - RNA, 64 nt, hsa
ucauccagugcaaguuugaugcaagaauguauuaggacauaaaauagaggcugaccuuaaaagg

SEQ ID NO: 497223 - RNA, 64 nt, hsa
uuacugcgagcagcauguaaucuuuuuucuuccuggacauaaagauagcuugaguaaacuguuc

SEQ ID NO: 497224 - RNA, 64 nt, hsa
gccaagccuggagcccguccaggcuuuucauuaaggacauaauauuuacgucuaacagaccuuu

SEQ ID NO: 497225 - RNA, 64 nt, hsa
cgggguuaugcaauguggcugcuuugacuguacuggacauaaaaauaaguaaaauguucuucau

SEQ ID NO: 497226 - RNA, 64 nt, hsa
aaucuguacaaaaugguccuauuuuugugaagagggacauaagauaaaaugauguuauacauca

SEQ ID NO: 497227 - RNA, 64 nt, hsa
cacacucuucuuaugacucuuguuagcgauucaaggacauaaaucuucauucuuuucuggcaca

SEQ ID NO: 497228 - RNA, 64 nt, hsa
auggcauuuaauuucaaccuaaauacugacugcuggacauaaaucacagaaaauuuaacuuaag

SEQ ID NO: 497229 - RNA, 64 nt, hsa
uguaaaacucagauauugucaugauguuucacuuggacauaagacuuauuaauguggucacuua

SEQ ID NO: 497230 - RNA, 64 nt, hsa
gcaguguucuuuuugacaauuugucaagauuuagggacauaaaaugaucuugcaggucguaaac

SEQ ID NO: 497231 - RNA, 64 nt, hsa
auuuccagauggcccacucucuuccauaucacaaggacauaaacacuccuucuuucagccccac

SEQ ID NO: 497232 - RNA, 64 nt, hsa
aaggguaacuucuucuuuauuaaagcaaauaacuggacauaaucuuaaaggauuccaccuccau

SEQ ID NO: 497233 - RNA, 64 nt, hsa
ucauuuuucuuuuuuucuuucccucuuccccuuuggacauaacuuucuguugaagcuguucuuu

SEQ ID NO: 497234 - RNA, 64 nt, hsa
auaggcccagaaagguauaagagacucuuugaauggacauaaaaauucugcuuguuaagaacaa

SEQ ID NO: 497235 - RNA, 64 nt, hsa
ucaucaaaaccuugugacauucccuugguacauaggacauaaaacacagaggcauugcuauuug

SEQ ID NO: 497236 - RNA, 64 nt, hsa
uuccuuugugccacugagucguucccuggccagaggacauaaauggugcugguaggagguuauc

SEQ ID NO: 497237 - RNA, 64 nt, hsa
augcaaguuaauguacauuauacaugcguguaagggacauaaauggaggggugugaacuuuggu

SEQ ID NO: 497238 - RNA, 64 nt, hsa
ugaucacacacaguggacgaguaugugcaaacauggacauaauaguucacuuacaaaugugauu

SEQ ID NO: 497239 - RNA, 64 nt, hsa
uuggcagcuucaagaagagaagaccuucuugccaggacauaaaaugauacccuccucugggagc

SEQ ID NO: 497240 - RNA, 64 nt, hsa
gagauuccagcagguggcgcuggagggagucaggggacauaauggccuccuuguucacuuuuua

SEQ ID NO: 497241 - RNA, 64 nt, hsa
uguccaucccuggauagcuauuugcacgaaucauggacauaaauccaaguugaagaagaucaac

SEQ ID NO: 497242 - RNA, 64 nt, hsa
gugaagcaaaucuucaaaaucaguagacauuucuggacauaaaacacagaugaggaaagggcuu

SEQ ID NO: 497243 - RNA, 64 nt, hsa
guaagaaauuuauaaaguuuugcuuuuaaaacguggacauaacucauuuuucuaguuuuugaca

SEQ ID NO: 497244 - RNA, 64 nt, hsa
ggugguuuaggauuucaacauaugaauuuuggaaggacauaagcauucaacccccugcacaugu

SEQ ID NO: 497245 - RNA, 64 nt, hsa
ucaccagcugccucagaugacaaaugaggcuaauggacauaaucuacaguguccuuuuucacuu

SEQ ID NO: 497246 - RNA, 64 nt, hsa
ggugauguccuguaaacacucagcuguucagauuggacauaacugacuuaguucuucccuucuc

SEQ ID NO: 497247 - RNA, 63 nt, hsa
acaacaaugaggauuuuugaaagacaauccaggggacauaauagcagugugcaugcaggcagg

SEQ ID NO: 497248 - RNA, 64 nt, hsa
uuuuuggucugaguaggcuuguauugguacccuaggacauaaaaaucacauauaucauguuuca

SEQ ID NO: 497249 - RNA, 64 nt, hsa
gggugagauuaaggugcagggccugggggcaggaggacauaagguauagccauaaaucauaacc

SEQ ID NO: 497250 - RNA, 64 nt, hsa
uaauuuauuaauugcuuugagcacaacuuuaagaggacauaaugggguccuggccaucccacaa

SEQ ID NO: 497251 - RNA, 64 nt, hsa
uuuacaaaaugauuuaauauguaaucaugugucaggacauaaauuuugucacuugggacaguag

SEQ ID NO: 497252 - RNA, 64 nt, hsa
uuauguuucaauggugugugucuuuuuacuaucaggacauaaauagggcaauccacuucuuuau

SEQ ID NO: 497253 - RNA, 64 nt, hsa
guaccugcuggaagaauucuagcaugcuacuuggggacauaauuucagugggaaauaugccacu

SEQ ID NO: 497254 - RNA, 64 nt, hsa
uaagagcauuuuuguggguaaaaaaaaaaccuguggacauaaugaauuuugagacauugauugg

SEQ ID NO: 497255 - RNA, 64 nt, hsa
cacacuuuuuacuuguauagaugauuuuuggcuuggacauaaaagccaagccacccauuugcuu

SEQ ID NO: 497256 - RNA, 64 nt, hsa
acuuaaacauaaagaaauaggcacuauacaauggggacauaaaaaaagaaaaucaaagaaggau

SEQ ID NO: 497257 - RNA, 64 nt, hsa
ucauuaacagugccuuacugugcaaggcaccaaaggacauaaauacguacuugcaaagauucca

SEQ ID NO: 497258 - RNA, 64 nt, hsa
agggguaaauuauccuaguuaccaaguccuauuuggacauaaagaaaauccuacuuauagaaaa

SEQ ID NO: 497259 - RNA, 64 nt, hsa
uggcaaagccuuuaaccgaucuucaacccuuauuggacauaagagaauucauacuggagagaaa

SEQ ID NO: 497260 - RNA, 64 nt, hsa
cugagucugguccauugcuaccccaauucucuggggacauaaaaccaggcuggaaagggaccag

SEQ ID NO: 497261 - RNA, 64 nt, hsa
uuuaucuguauaaguguuuuauaugcauauuuuuggacauaaacaguuuauguaaaauuaguaa

SEQ ID NO: 497262 - RNA, 64 nt, hsa
guacuaaaacaguauuaucuuuugaauaucguagggacauaaguauauacauguuauccaauca

SEQ ID NO: 497263 - RNA, 64 nt, hsa
aaauuaaacuuaguggggaaaaguggccauguuuggacauaaauaaaugguauucacacuguau

SEQ ID NO: 497264 - RNA, 64 nt, hsa
ggcgagggaggcucuguaugaaacagaagagcagggacauaaaggaaaaugucaguguuuacau

SEQ ID NO: 497265 - RNA, 64 nt, hsa
uauauuuuaaaucagaaguaugggucagaucaugggacauaacuucuuagaauauauauauaca

SEQ ID NO: 497266 - RNA, 64 nt, hsa
aaaauguccauucuguagauuagaggugaugucaggacauaaaugagguuaauguaauauuaca

SEQ ID NO: 497267 - RNA, 64 nt, hsa
gaggcuguuagucuaauccaacaugguguccuuuggacauaagagauaccagcaaugugugcac

SEQ ID NO: 497268 - RNA, 64 nt, hsa
cucgaggagccacauuuuccuccuuuguguuaggggacauaacaagcucugcugggcuugaggg

SEQ ID NO: 497269 - RNA, 64 nt, hsa
aauuuagguuuccccuaagauguuauuauguuagggacauaacacuuuugggagguuguugugg

SEQ ID NO: 497270 - RNA, 64 nt, hsa
uaaccauuguuuggauuuggaaguacucugcaguggacauaagcauugggccauaguuuguuaa

SEQ ID NO: 497271 - RNA, 64 nt, hsa
uaaauaggccucagauucagcagugacauaacaaggacauaauguaagauaauaaaguagguuu

SEQ ID NO: 497272 - RNA, 64 nt, hsa
cuuggcggagcuaaggagaucuuauucuaccaugggacauaaggagcauccacugcacaaaccc

SEQ ID NO: 497273 - RNA, 64 nt, hsa
gcaauaauagaagauuaugaaggauuucuauggaggacauaaaugcugcaucuuucauaaucuc

SEQ ID NO: 497274 - RNA, 64 nt, hsa
cgcggccuccgcgaagcguuggcggggagcccaaggacauaacaaauuaaaagcaugaaggaga

SEQ ID NO: 497275 - RNA, 64 nt, hsa
ccuacaagcucaagccauacauaaaaggaccuugggacauaagaaccaaugauugugcauaagu

SEQ ID NO: 497276 - RNA, 64 nt, hsa
ugugucuuuuuuuuuuuuuuuaauguaucuuaaaggacauaaaauuuaaaaacuuaaauauugu

SEQ ID NO: 497277 - RNA, 64 nt, hsa
agaguugacagaagcaggccagcgaggaggugugggacauaauagccugagugcuuggguuacc

SEQ ID NO: 497278 - RNA, 64 nt, hsa
gccuuagcuucuggcuuuuaauuuugccagcuaaggacauaaaacaaaaauaaacaaacaaaaa

SEQ ID NO: 497279 - RNA, 64 nt, hsa
aucaagggugacaccugcgacgcaaguaccaggaggacauaaccgcuguggccuguuggagaac

SEQ ID NO: 497280 - RNA, 64 nt, hsa
augaaagacauuaugccugccuaaacaaaaagcaggacauaaccuagcucugaauacaugccac

SEQ ID NO: 497281 - RNA, 64 nt, hsa
gucuggaaacuagguuuaaaauaagugugcacuuggacauaaagacuggagaaauaaacacuga

SEQ ID NO: 497282 - RNA, 64 nt, hsa
cagugaaucacaaugcauuuacccccacugacuuggacauaagugaaaacuagccagaagucuc

SEQ ID NO: 497283 - RNA, 64 nt, hsa
ugaucaauguuaaauguaagcaccccugaucccaggacauaaggaaagaugcccaauuguacuu

SEQ ID NO: 497284 - RNA, 64 nt, hsa
cuauaguuuaauacucagaggggguuggguuuggggacauaaagccucugacucaaacuccucc

SEQ ID NO: 497285 - RNA, 64 nt, hsa
agaggaucgagccauugaaagcucauuaccaguaggacauaauuuuuggcucucccuauucaca

SEQ ID NO: 497286 - RNA, 64 nt, hsa
cugcccucuacugaugagacuuccugcugccuuuggacauaacuaagccaggaaacuuuaaaag

SEQ ID NO: 497287 - RNA, 64 nt, hsa
aaauauccaaguuguccuugaauugucuaaccauggacauaaacaguugucucccuucuacugu

SEQ ID NO: 497288 - RNA, 64 nt, hsa
caacccauaaucauguaaaugcucauuuucuuuaggacauaaagagagcccuagggugcucuga

SEQ ID NO: 497289 - RNA, 64 nt, hsa
uuuuugaaaaagaaaacacuuaaaaugaucauuaggacauaacagacuaggccagacauagcau

SEQ ID NO: 497290 - RNA, 64 nt, hsa
acagagaagggaaagcagucuguucugaacauagggacauaaguucauucaugccaaguaucuu

SEQ ID NO: 497291 - RNA, 64 nt, hsa
acaacauuaauuaacaauuuuacgucaugucccuggacauaaaaguuuaguuaguauuaaauuu

SEQ ID NO: 497292 - RNA, 64 nt, hsa
aucaugagcaacagaaaagcaguagaauccuaaaggacauaacaguuguuccguaacuagaagc

SEQ ID NO: 497293 - RNA, 64 nt, hsa
cauuuucucuaccuucccagcaguuugcugccauggacauaaauccccaaacccugaauuacaa

SEQ ID NO: 497294 - RNA, 64 nt, hsa
guaccacaguuugcuuaaccauucacccacuaaaggacauaagaguuguuuucaguuuuuugcc

SEQ ID NO: 497295 - RNA, 64 nt, hsa
cccuccuuccccagggcuccuucucagaaaccugggacauaaauuggccccugagucgauugcc

SEQ ID NO: 497296 - RNA, 64 nt, hsa
gauguauuagcuguucaucugcuacugguuggauggacauaacuauuguaacuauucaguauuu

SEQ ID NO: 497297 - RNA, 64 nt, hsa
uacuuuucaucauggaagccugucacuguauguaggacauaauagaacuugaucacuugaagcu

SEQ ID NO: 497298 - RNA, 64 nt, hsa
guaguauuuaauauauuagaugaaggacaacuuuggacauaacacugacuaggaguugagagcu

SEQ ID NO: 497299 - RNA, 64 nt, hsa
ggguucauggagugagugugcagagagugagugaggacauaaggaaggacaugucccacuccau

SEQ ID NO: 497300 - RNA, 64 nt, hsa
gcccaaaagaucaaggagucagccaggacccuguggacauaaagaaguuggaugccugguccca

SEQ ID NO: 497301 - RNA, 64 nt, hsa
aaaauacccaaagccaaaugcaguuccaaauaguggacauaaucucccagggaaaucugggcuc

SEQ ID NO: 497302 - RNA, 64 nt, hsa
cuuuauauauauuuaaaacaauuaguacugaauuggacauaaaaauauugacauucuaaggaga

SEQ ID NO: 497303 - RNA, 64 nt, hsa
acagcaaguaugggacagcagugucccagguaaaggacauaaauguuacaagugucugguccuu

SEQ ID NO: 497304 - RNA, 64 nt, hsa
gauaagagcaaguguaggcaaagguuuagaaaauggacauaaagucaaagaaugauggcaggua

SEQ ID NO: 497305 - RNA, 64 nt, hsa
gggaauuugaaauucuuguccucugugauaauuaggacauaacaagauuuuccauacuaaacau

SEQ ID NO: 497306 - RNA, 64 nt, hsa
gaggcugggugacgagaaaaucuagagacaugagggacauaaaugggccuggcagccucggcuc

SEQ ID NO: 497307 - RNA, 64 nt, hsa
uggacagauuuggcaauagcuuuguaagugauguggacauaauugccuacaauaaugaaaaccu

SEQ ID NO: 497308 - RNA, 64 nt, hsa
acgcuauaacuuauuguaaagaccuuggaaauguggacauaagcucuuucuuuccuuuuguuac

SEQ ID NO: 497309 - RNA, 64 nt, hsa
gggcucucugucccaguugggcagcucaccuuugggacauaagccuuugccccacaagcugugg

SEQ ID NO: 497310 - RNA, 64 nt, hsa
gucaucuuguggccuggagucgaggucuuggccaggacauaacaagcuguggucugggguaaca

SEQ ID NO: 497311 - RNA, 64 nt, hsa
uguucaaauuuauuuuaagagauagggagggaggggacauaaagggaaugcauacauugcuagu

SEQ ID NO: 497312 - RNA, 64 nt, hsa
ggugaaagcauuguuacuuacuuguggaagucggggacauaagaugauuuucacaucccagagc

SEQ ID NO: 497313 - RNA, 64 nt, hsa
aggauuuaaauuugaaccuggcuuucucacagcuggacauaauucuaggaaaauaaaauacuau

SEQ ID NO: 497314 - RNA, 64 nt, hsa
gcugucuggacacguccuuagcgccugggaaccaggacauaaaagcgccuccggagccgcccug

SEQ ID NO: 497315 - RNA, 64 nt, hsa
ucccuucuucuaacuaaauauaaaaagauccaggggacauaaauguggagauuaaauaaaggga

SEQ ID NO: 497316 - RNA, 64 nt, hsa
acagaagaaaaaggcuaagucccagcaauacaaaggacauaagaaaagugggucaccacguggu

SEQ ID NO: 497317 - RNA, 64 nt, hsa
ugcgggcuaggaggcuggaaagccauuuauccuaggacauaaacucagauuuugggggucaguu

SEQ ID NO: 497318 - RNA, 64 nt, hsa
aucaguugcaucugugauaauacaguacauauguggacauaaacagggaucaaauaaaggaggu

SEQ ID NO: 497319 - RNA, 64 nt, hsa
aauuccuagaagaaaacccaggaaaugccauucuggacauaagugcuggaaaagacuuaaugau

SEQ ID NO: 497320 - RNA, 64 nt, hsa
cacagauagcucagcugcgaccucuggccucuggggacauaaacggggcggcugggccagggcg

SEQ ID NO: 497321 - RNA, 64 nt, hsa
cauguugguuuaaaaauauuauugcuugcuacuuggacauaacuaauuuuuccuugugcauuua

SEQ ID NO: 497322 - RNA, 64 nt, hsa
uuuguggcaguguuuguuuuacugaauuguagaaggacauaaccguguuuucaguguuucuaug

SEQ ID NO: 497323 - RNA, 64 nt, hsa
auguuuguauacacauuugcauauacccacauggggacauaagcuaauuuuuuuacaggacaca

SEQ ID NO: 497324 - RNA, 64 nt, hsa
uaauuuuagguuauguuuuauauuaggcuacuggggacauaaacggucauaacuaaugacugua

SEQ ID NO: 497325 - RNA, 64 nt, hsa
auuaucauacugaaggaaauuuuccagaucauuaggacauaauacauguugagagugucucaac

SEQ ID NO: 497326 - RNA, 64 nt, hsa
aaauucaaaccuaaguugcuggacccuggugugaggacauaaaucuuccaaaguuuugccuauc

SEQ ID NO: 497327 - RNA, 64 nt, hsa
gcucaguaauuuugaacacugaaacauucaucuaggacauaauaacaaaguucaguauugacca

SEQ ID NO: 497328 - RNA, 64 nt, hsa
aaagguaaaaaguacauuuguauauuacauauauggacauaacuugugaaggaugaaagaaagu

SEQ ID NO: 497329 - RNA, 64 nt, hsa
gagagcccaaucucugcaugaauaacagaaagguggacauaaggaauuguaaaguauuuagaau

SEQ ID NO: 497330 - RNA, 64 nt, hsa
agccaagcaagaaguugaaguugccuagaccagaggacauaaguaucaugucuccuuuaacuag

SEQ ID NO: 497331 - RNA, 64 nt, hsa
cagauugggaaauccguucuauuuugugaauuugggacauaauaacagcaguggaguaaguauu

SEQ ID NO: 497332 - RNA, 64 nt, hsa
aaaauacaguuaaaaaaauguguaaguuuagauuggacauaauucucagguguacuguuaacau

SEQ ID NO: 497333 - RNA, 64 nt, hsa
uuaaauucaguacugauugguucagcauauccugggacauaaaaauacucacuacugggaaaaa

SEQ ID NO: 497334 - RNA, 64 nt, hsa
uucaaugucccuggaguugggagggaggaaugggggacauaaagccuguccugucucuauucua

SEQ ID NO: 497335 - RNA, 64 nt, hsa
uucuugaauauuugccaccaagugaaaaauguuaggacauaaacccuugccaggucccuuucau

SEQ ID NO: 497336 - RNA, 64 nt, hsa
aaagcaccacagcuacucaagaagaucaaauucaggacauaaacuuuauugaacauaauaacca

SEQ ID NO: 497337 - RNA, 64 nt, hsa
uucccugagacugcauggcucaggcguuaauaauggacauaaaaagucauaaaacguuagagcu

SEQ ID NO: 497338 - RNA, 63 nt, hsa
gacuucguugguuuuuuggagucuugguugugacuccaagagcagagugaggaagacccccaa

SEQ ID NO: 497339 - RNA, 63 nt, hsa
ggacuuuguuggcuuuuagaguguuggucaugacuccaagagcagagcagggaagagcccaag

SEQ ID NO: 497340 - RNA, 63 nt, hsa
auauugcgccugugugcguguguauaagucaagcuccaagaggcuccugaaugugacuggcgu

SEQ ID NO: 497341 - RNA, 63 nt, hsa
cuagguuuuccuuccaagcacccagcccuccugcuccaagagggauaaccugcaccccucccu

SEQ ID NO: 497342 - RNA, 63 nt, hsa
acaaauuuguucuuccugauaugauaacuaggucuccaagagaaaauagaaaggcugcuuuag

SEQ ID NO: 497343 - RNA, 63 nt, hsa
cgaccuccaguucucccugaugacaguagcugucuccaagagaaaaauccucacuuauuaacu

SEQ ID NO: 497344 - RNA, 63 nt, hsa
ugucaugcaguguugucccuuccuaccuucuuccuccaagagaguaucaugaaguaaacuaca

SEQ ID NO: 497345 - RNA, 63 nt, hsa
ggcucccuugggaaagcccugcuuugcuccaggcuccaagaucuccuggcuaagucagcaagu

SEQ ID NO: 497346 - RNA, 63 nt, hsa
cugcaucagccccugugagccuggcuucagugucuccaagaacuguaaccucggcaagugcca

SEQ ID NO: 497347 - RNA, 63 nt, hsa
cauccugguagcucuccugaugcucguuuuccgcuccaagagagaggugaaacggugagcgag

SEQ ID NO: 497348 - RNA, 63 nt, hsa
cccuuugagccuuacaucucauucacugucuuucuccaagaaaaguauuuugggcggacaguc

SEQ ID NO: 497349 - RNA, 63 nt, hsa
aaaaacuuuacaauacauuuauguugaauggaacuccaagaucucaccucuccauccaggaau

SEQ ID NO: 497350 - RNA, 63 nt, hsa
cucuugcguuuuggcccccauuugcucccugagcuccaagauaagaauggccccgagagaacu

SEQ ID NO: 497351 - RNA, 63 nt, hsa
acugggggcuucuccccaggagaccacgcugcccuccaagaccaggagcagcugugagcugga

SEQ ID NO: 497352 - RNA, 63 nt, hsa
uuccucuucuuugccgcggacucccuuuccugccuccaagaccuggugucucccacugugagc

SEQ ID NO: 497353 - RNA, 63 nt, hsa
aucauggaggagcggugagaacauggaaccggacuccaagaugacgaucuaaagacccgggag

SEQ ID NO: 497354 - RNA, 63 nt, hsa
agcugcuucggaacaccgucccuccuaugcacccuccaagacgugcagcagaugcaaaggguu

SEQ ID NO: 497355 - RNA, 63 nt, hsa
agcagccgggacccucuggagagcuuguuuucccuccaagaagagguuugagacaggcggcau

SEQ ID NO: 497356 - RNA, 63 nt, hsa
guuuagagaaaaaaaauuaaaaagaaacaaagucuccaagaaauaugggacuaugugaaaaga

SEQ ID NO: 497357 - RNA, 63 nt, hsa
gaacgccacaaagauacuccuugagaagagcaacuccaagacacauaauugucagauucacca

SEQ ID NO: 497358 - RNA, 63 nt, hsa
agugaauuuacuuuuuggguccagaaugacuuucuccaagaauuauaagaugaaaauuauaua

SEQ ID NO: 497359 - RNA, 63 nt, hsa
uaucuaauggagcaauuugucuuuugcuauauucuccaagauuaucucuuaagaccauaugcc

SEQ ID NO: 497360 - RNA, 63 nt, hsa
ugacaggagggagccugggaaaauaauuuuuuccuccaagauucucagauccagguuaggaaa

SEQ ID NO: 497361 - RNA, 63 nt, hsa
aaaacaaguuccuuagagguuguauucuuuauucuccaagaaucugucugaaacuuguacagc

SEQ ID NO: 497362 - RNA, 64 nt, hsa
ucacuccugagaaugggcuccuguuagaugggcacgggcggauuaauuuuagcaaaauguucug

SEQ ID NO: 497363 - RNA, 64 nt, hsa
acgccuguaaucccaacacuuugggaggccgaggcgggcggaucacgaggucagaucaagaaca

SEQ ID NO: 497364 - RNA, 64 nt, hsa
acaccuguaaucccagcacuuugggaggccgaggcgggcggaucacgaggucaggaguucgaga

SEQ ID NO: 497365 - RNA, 64 nt, hsa
acgccuguaaucucagcacuuugggaggcugaggcgggcggaucacaagguccagaguucaaga

SEQ ID NO: 497366 - RNA, 64 nt, hsa
ccauaaaggaugagccuggggucacagggggugucgggcggaggaaagugcaucccccagagcu

SEQ ID NO: 497367 - RNA, 64 nt, hsa
augccuguaaucccagcacuuugggaggcugaggcgggcggaucaccugaggucgggaguucga

SEQ ID NO: 497368 - RNA, 64 nt, hsa
acgccuguaaucccagcacuuugagagaccgaggcgggcggaucacgaggucaggagaucgaga

SEQ ID NO: 497369 - RNA, 64 nt, hsa
acgccuguaauccuagcacuuugggaggccaagacgggcggaucaccugaggugaggaguucaa

SEQ ID NO: 497370 - RNA, 64 nt, hsa
augccuguaaucccagcacuuugggaggccgaggcgggcggaucacgaggucaggagauugaga

SEQ ID NO: 497371 - RNA, 64 nt, hsa
acgacuauguguaaugcucuaagaccucucagcacgggcggaagaaacucccggagagcucacc

SEQ ID NO: 497372 - RNA, 64 nt, hsa
acggcuguaaucccaacacuuugggagucugaggcgggcggaucaugaggucaggagauuaaga

SEQ ID NO: 497373 - RNA, 64 nt, hsa
acgccugugaucccagcacuuugggaggccaagacgggcggaucaugaggucaagagaucaaga

SEQ ID NO: 497374 - RNA, 64 nt, hsa
acgccuguaaucccagcacuuugggaggccgaggcgggcggaucacgaggucaggagaucgaga

SEQ ID NO: 497375 - RNA, 64 nt, hsa
acaccugcaaucccagcacuuugggaggccgaggcgggcggaucaccugaggucagcaguucaa

SEQ ID NO: 497376 - RNA, 64 nt, hsa
acgccuauaaucccagcacuuugggaggccgaggcgggcggaucacgaggucaggagauugaga

SEQ ID NO: 497377 - RNA, 64 nt, hsa
acgccuguaaucccagcacuuugggaggccgaggcgggcggaucacaaggucaggagaucgaga

SEQ ID NO: 497378 - RNA, 64 nt, hsa
cacgccuguaauccaacacuuugagaggcugaggcgggcggaucaccugagucaggaguucgag

SEQ ID NO: 497379 - RNA, 64 nt, hsa
gcccgggcauccacguagggggcaggggcaggggcgggcggagggaggggaggggugaaaucca

SEQ ID NO: 497380 - RNA, 64 nt, hsa
ccgccuguaaucccagcacuuugggaggccgaggcgggcggaugaguugaggucgggaguuuga

SEQ ID NO: 497381 - RNA, 64 nt, hsa
augccuguaaucccagcacuuugggaggcugaggcgggcggaucaccugagguugggaguucga

SEQ ID NO: 497382 - RNA, 64 nt, hsa
accucaagaggggaggagcggggcugauccuggucgggcggaccugagucgggcagccgcucuc

SEQ ID NO: 497383 - RNA, 64 nt, hsa
acgccuguaaucccagcacuuugggaggccgaggcgggcggaugaccugaggucaggaguucaa

SEQ ID NO: 497384 - RNA, 64 nt, hsa
acgccuguaaucccagcacuuugggaggccaaggcgggcggaucaugaggucaggagaucgaga

SEQ ID NO: 497385 - RNA, 64 nt, hsa
aagccuguaaucccagcacuuugggaggccgaggcgggcggaucaugaggucaggaguucgaga

SEQ ID NO: 497386 - RNA, 64 nt, hsa
acgccuguaaucccagcacuuugggaggccgaggcgggcggaucaugaggucaggagaucgaga

SEQ ID NO: 497387 - RNA, 64 nt, hsa
aagcccugguccagcugggugcccccucgagcuccgggcggacucgcacacacucgugucaucc

SEQ ID NO: 497388 - RNA, 64 nt, hsa
acgccuguaaucccaacacuuugggaggcccaggcgggcggaucacgaggucaggagaucgaga

SEQ ID NO: 497389 - RNA, 64 nt, hsa; identical to SEQ ID NO: 497374

SEQ ID NO: 497390 - RNA, 64 nt, hsa
augccuguaaucccagcacguugggaggccaagucgggcggaucacaaggucaggagaucaagg

SEQ ID NO: 497391 - RNA, 64 nt, hsa
agaauacuucuggcagcacuuugggaggccaaggcgggcggaucacgaggucaggagaucgaga

SEQ ID NO: 497392 - RNA, 64 nt, hsa
gccuccggugcuguaaaacgcaggcgcugggccgcgggcggagcugaggacaggccuuggcugg

SEQ ID NO: 497393 - RNA, 64 nt, hsa
acgccgguaaucccagcacuuugggaggccgaggcgggcggaucacgaggucaggagaucgaga

SEQ ID NO: 497394 - RNA, 64 nt, hsa
acaccuguaaucccagcacuuuggggagcugaggcgggcggaucacgaggucaagagaucgaga

SEQ ID NO: 497395 - RNA, 64 nt, hsa
acuccuguaaucccagcacuuugggaggccgaggcgggcggaucaccaggucaggagaucaaga

SEQ ID NO: 497396 - RNA, 64 nt, hsa
aagccuguaaucccagcacuuugggaggccgaggcgggcggaucacuugagaccaggaguucga

SEQ ID NO: 497397 - RNA, 64 nt, hsa
guuuguuucuguuuucuuggguggggagcagggacgggcggagggaggagagcagguuucagau

SEQ ID NO: 497398 - RNA, 64 nt, hsa
acgccuguaaucccagcacuuugggaggccgaggcgggcggaucacaaagucaggacgagacca

SEQ ID NO: 497399 - RNA, 64 nt, hsa
acccccaaagugcagauuccggagcagacacauccgggcggagagacucagcagacaagugcug

SEQ ID NO: 497400 - RNA, 64 nt, hsa
acaccuguaaucccagcacuuugggagaccaaggcgggcggaucacuuaaagucaggaguccaa

SEQ ID NO: 497401 - RNA, 64 nt, hsa
acgccuguaaucccagcacuuugggaggccgagccgggcggaucaccuguggucaggaguuuga

SEQ ID NO: 497402 - RNA, 64 nt, hsa
cccccauccccacgcgggccgggcacgaccacaccgggcggaccgcuggacagacgcacccacu

SEQ ID NO: 497403 - RNA, 64 nt, hsa
augccuguaaucccagcauuuugggaggccaaggcgggcggaucacuugaggucaggagcucaa

SEQ ID NO: 497404 - RNA, 64 nt, hsa
acgccuguaaucccaacacuuuaggaguccaaggcgggcggaucacuugaggucaggaguucaa

SEQ ID NO: 497405 - RNA, 64 nt, hsa
gccgccacggccuggcuggugggaaggccggcagcgggcggaggggauccagccacuucccccu

SEQ ID NO: 497406 - RNA, 64 nt, hsa
acaccuguaaucccagcacuuugggaggccgaggcgggcggaucaccugaagucaggaguuuga

SEQ ID NO: 497407 - RNA, 64 nt, hsa
augccuguaaucccagcacuuugggaggccgaggcgggcggaucacaaggucaggagaucgaga

SEQ ID NO: 497408 - RNA, 64 nt, hsa
acgcuuguaaucccagcacuuugggaggccgaggcgggcggaucacgaggucaggaguucgaga

SEQ ID NO: 497409 - RNA, 64 nt, hsa
acgccuguaaucccagcacuuugggaggccgaggcgggcggaucaccugagguggggaguauga

SEQ ID NO: 497410 - RNA, 64 nt, hsa
augccuauaaucccagcacguugggaggcugaggcgggcggaucgguugagcucaggcguucgg

SEQ ID NO: 497411 - RNA, 64 nt, hsa
augccuguaaucccagcacuuugggaggccgaggcgggcggaucaccugaggccaggaguugga

SEQ ID NO: 497412 - RNA, 64 nt, hsa
gagagcgggcauccagagaggaguccugggagagcgggcggagcgagcgagggcccccggacug

SEQ ID NO: 497413 - RNA, 64 nt, hsa
acgccuguaaucccagcacuuugggaggccgaggcgggcggaucaugagguuaggagagcgaga

SEQ ID NO: 497414 - RNA, 64 nt, hsa
ccacugucaaucccagcacuuugggaggccuaggcgggcggaucaugaagucaagaguucgaga

SEQ ID NO: 497415 - RNA, 64 nt, hsa
accggccgggccuggcaccaaucugcgcugcggucgggcggagcuucuguuucucccagccaau

SEQ ID NO: 497416 - RNA, 64 nt, hsa
acgccuguaaucccagcacuuugggaggccgagacgggcggaucaccugaggucaggaguucga

SEQ ID NO: 497417 - RNA, 64 nt, hsa
acgccuguaaucccagcacuuugggaggccaaggcgggcggaucaccugaggucgggaguuuga

SEQ ID NO: 497418 - RNA, 64 nt, hsa
uggucacucagccgucgugagcgcaggcgcggggcgggcggagcgggaccccuggggcucuccc

SEQ ID NO: 497419 - RNA, 64 nt, hsa
acgccuguaaucccagcacuuugggaggcugaggcgggcggaucacgaggucaggagaucgaga

SEQ ID NO: 497420 - RNA, 64 nt, hsa
acaccuguaaucccagcacuuugggaggccgaggcgggcggaucacaaggucaggaguucgaga

SEQ ID NO: 497421 - RNA, 64 nt, hsa
acaccuguaaucccagcacuuugggaggccaaggcgggcggaucagcugaggucaggaguugga

SEQ ID NO: 497422 - RNA, 64 nt, hsa
ucgccuguaaucccagcacuuugggaggccgaggcgggcggaucagaccauccuggcuaacacg

SEQ ID NO: 497423 - RNA, 64 nt, hsa
cgugugggacugagucagcgguggcgaggagaggcgggcggauuuggggagggcccugaggacc

SEQ ID NO: 497424 - RNA, 51 nt, hsa
uucucgucagcugguguuagccgggcggaguguguuagucucuccagaggg

SEQ ID NO: 497425 - RNA, 64 nt, hsa
gggaccugcuccucacagagccccucccaaggaucgggcggaagcugcugggacccuccugggc

SEQ ID NO: 497426 - RNA, 64 nt, hsa
auuuuauuggagccccaucuccccagcgggcaggcgggcggagccuguauauauguauauacuc

SEQ ID NO: 497427 - RNA, 64 nt, hsa
cggcagugcacgcggcuuguugacuucgcagccccgggcggagccuucccgggcgggcguggga

SEQ ID NO: 497428 - RNA, 64 nt, hsa
cagcccugaggucgcgcgcagcgcgugcacagcgcgggcggaggcggcuccagguccggagggg

SEQ ID NO: 497429 - RNA, 64 nt, hsa
acgccuauaaucccagcacuuugggaggccgaggcgggcggaucacuaggucaggaaauggaga

SEQ ID NO: 497430 - RNA, 64 nt, hsa
augccuguaaucccagcacuuugggaggccaagacgggcggaucuuuugaggucgggaguugga

SEQ ID NO: 497431 - RNA, 64 nt, hsa
acgccuguaaucccaacacuuugggagcccgaggcgggcggaucacaaggucaggaguucgaga

SEQ ID NO: 497432 - RNA, 64 nt, hsa
caugguguaauccuaacacuuugggaggccaaggcgggcggauugccugagcucaggaguucaa

SEQ ID NO: 497433 - RNA, 64 nt, hsa
acgucuguaaucccagcacuuugggaggcugaggcgggcggaucaccugagguugggaguucaa

SEQ ID NO: 497434 - RNA, 64 nt, hsa
acaccuguaaucccagcacuuugggaggcugaggcgggcggaacaccugaggucagguguucga

SEQ ID NO: 497435 - RNA, 64 nt, hsa
cgacaccacuggccccggaugccucugccccucccgggcggaccuccugaggccuggaccccca

SEQ ID NO: 497436 - RNA, 63 nt, hsa
gcggcgggggcgccccgugacccgagcucggggcgggcggagcccgcguggccgaagcuggaa

SEQ ID NO: 497437 - RNA, 64 nt, hsa
accccugucaucccagcacuuugagaggccaaggcgggcggaucacuggaggucaggaguuuaa

SEQ ID NO: 497438 - RNA, 64 nt, hsa
augccuguaaucccagcacuuugggaggccgaggcgggcggaucacgaggucaggagaucgaga

SEQ ID NO: 497439 - RNA, 64 nt, hsa
cugcgccggccuccgucaugaaugccuuccgggccgggcggaaggggacgcgggcugugccuua

SEQ ID NO: 497440 - RNA, 64 nt, hsa
acgccuguaauccuagcaccuugggaggccgaggcgggcggaucacuugaggucaggaguucca

SEQ ID NO: 497441 - RNA, 64 nt, hsa
augccuguaaucccagcacuaugggaggccgagacgggcggaucacgaggucaggagacugaga

SEQ ID NO: 497442 - RNA, 64 nt, hsa
gaucccuaacagggcggcuucccagggcugcaggcgggcggagguuccaggagaugggacuuca

SEQ ID NO: 497443 - RNA, 64 nt, hsa
acgccuguaaucccagcacuuugggaggccgaagcgggcggaucaccugaggucgggaguucga

SEQ ID NO: 497444 - RNA, 64 nt, hsa
acgccuguaaucccagcacuuugggaggccgaggcgggcggaucaauaggucaggaaauccaga

SEQ ID NO: 497445 - RNA, 64 nt, hsa
uucagaccguucuccuguaaguucauuacaaacacgggcggaaggcacucaggcuuucguugga

SEQ ID NO: 497446 - RNA, 64 nt, hsa
acgccugcaaucccagcacuuugggagacugaggcgggcggaucaugaggucaggagaucgcga

SEQ ID NO: 497447 - RNA, 63 nt, hsa
acgcauguaaucccagcacuuugggaggccaaggcgggcggaucacgaggucaggaguucgag

SEQ ID NO: 497448 - RNA, 64 nt, hsa
augccuguaauccgagcacuuugggaggccaaggcgggcggaucacgaggucaggagaucgaga

SEQ ID NO: 497449 - RNA, 64 nt, hsa
acgccuguaaucccagcacuuugggaggccgaggcgggcggaucacgaggucaggaguucgaga

SEQ ID NO: 497450 - RNA, 64 nt, hsa
acgccuguaaucccagcaauuugggaguccgaggcgggcggaucacucgaggucaggaguucca

SEQ ID NO: 497451 - RNA, 64 nt, hsa
gcccuucagugcccugccuguacucgagcggcuccgggcggagaacaagucggcugugaguuuc

SEQ ID NO: 497452 - RNA, 64 nt, hsa
agggaggccagaccaagggaggcacgcgcgcugccgggcggacagaggcugaggcucacacccc

SEQ ID NO: 497453 - RNA, 64 nt, hsa; identical to SEQ ID NO: 134242

SEQ ID NO: 497454 - RNA, 64 nt, hsa; identical to SEQ ID NO: 134243

SEQ ID NO: 497455 - RNA, 64 nt, hsa; identical to SEQ ID NO: 134244

SEQ ID NO: 497456 - RNA, 64 nt, hsa; identical to SEQ ID NO: 134245

SEQ ID NO: 497457 - RNA, 52 nt, hsa; identical to SEQ ID NO: 134246

SEQ ID NO: 497458 - RNA, 64 nt, hsa; identical to SEQ ID NO: 134247

SEQ ID NO: 497459 - RNA, 64 nt, hsa; identical to SEQ ID NO: 134248

SEQ ID NO: 497460 - RNA, 64 nt, hsa; identical to SEQ ID NO: 134249

SEQ ID NO: 497461 - RNA, 64 nt, hsa; identical to SEQ ID NO: 134250

SEQ ID NO: 497462 - RNA, 64 nt, hsa; identical to SEQ ID NO: 134251

SEQ ID NO: 497463 - RNA, 64 nt, hsa; identical to SEQ ID NO: 134252

SEQ ID NO: 497464 - RNA, 64 nt, hsa; identical to SEQ ID NO: 134253

SEQ ID NO: 497465 - RNA, 64 nt, hsa; identical to SEQ ID NO: 134254

SEQ ID NO: 497466 - RNA, 64 nt, hsa; identical to SEQ ID NO: 134255

SEQ ID NO: 497467 - RNA, 64 nt, hsa; identical to SEQ ID NO: 134256

SEQ ID NO: 497468 - RNA, 64 nt, hsa; identical to SEQ ID NO: 134257

SEQ ID NO: 497469 - RNA, 64 nt, hsa; identical to SEQ ID NO: 134258

SEQ ID NO: 497470 - RNA, 64 nt, hsa; identical to SEQ ID NO: 134259

SEQ ID NO: 497471 - RNA, 64 nt, hsa; identical to SEQ ID NO: 134260

SEQ ID NO: 497472 - RNA, 64 nt, hsa; identical to SEQ ID NO: 134261

SEQ ID NO: 497473 - RNA, 64 nt, hsa; identical to SEQ ID NO: 134262

SEQ ID NO: 497474 - RNA, 64 nt, hsa; identical to SEQ ID NO: 134263

SEQ ID NO: 497475 - RNA, 64 nt, hsa; identical to SEQ ID NO: 134264

SEQ ID NO: 497476 - RNA, 64 nt, hsa; identical to SEQ ID NO: 134265

SEQ ID NO: 497477 - RNA, 64 nt, hsa; identical to SEQ ID NO: 134266

SEQ ID NO: 497478 - RNA, 64 nt, hsa; identical to SEQ ID NO: 134267

SEQ ID NO: 497479 - RNA, 64 nt, hsa; identical to SEQ ID NO: 134268

SEQ ID NO: 497480 - RNA, 64 nt, hsa; identical to SEQ ID NO: 134269

SEQ ID NO: 497481 - RNA, 64 nt, hsa; identical to SEQ ID NO: 97063

SEQ ID NO: 497482 - RNA, 64 nt, hsa; identical to SEQ ID NO: 97064

SEQ ID NO: 497483 - RNA, 64 nt, hsa; identical to SEQ ID NO: 97065

SEQ ID NO: 497484 - RNA, 64 nt, hsa; identical to SEQ ID NO: 97066

SEQ ID NO: 497485 - RNA, 64 nt, hsa; identical to SEQ ID NO: 97067

SEQ ID NO: 497486 - RNA, 64 nt, hsa; identical to SEQ ID NO: 97068

SEQ ID NO: 497487 - RNA, 64 nt, hsa; identical to SEQ ID NO: 97069

SEQ ID NO: 497488 - RNA, 64 nt, hsa; identical to SEQ ID NO: 97070

SEQ ID NO: 497489 - RNA, 64 nt, hsa; identical to SEQ ID NO: 97071

SEQ ID NO: 497490 - RNA, 64 nt, hsa; identical to SEQ ID NO: 97072

SEQ ID NO: 497491 - RNA, 64 nt, hsa; identical to SEQ ID NO: 97073

SEQ ID NO: 497492 - RNA, 64 nt, hsa; identical to SEQ ID NO: 97074

SEQ ID NO: 497493 - RNA, 64 nt, hsa; identical to SEQ ID NO: 97075

SEQ ID NO: 497494 - RNA, 64 nt, hsa; identical to SEQ ID NO: 97076

SEQ ID NO: 497495 - RNA, 64 nt, hsa; identical to SEQ ID NO: 97077

SEQ ID NO: 497496 - RNA, 64 nt, hsa; identical to SEQ ID NO: 97078

SEQ ID NO: 497497 - RNA, 64 nt, hsa; identical to SEQ ID NO: 97079

SEQ ID NO: 497498 - RNA, 64 nt, hsa; identical to SEQ ID NO: 97080

SEQ ID NO: 497499 - RNA, 64 nt, hsa; identical to SEQ ID NO: 97081

SEQ ID NO: 497500 - RNA, 64 nt, hsa; identical to SEQ ID NO: 97082

SEQ ID NO: 497501 - RNA, 64 nt, hsa; identical to SEQ ID NO: 97083

SEQ ID NO: 497502 - RNA, 64 nt, hsa; identical to SEQ ID NO: 97084

SEQ ID NO: 497503 - RNA, 64 nt, hsa; identical to SEQ ID NO: 97085

SEQ ID NO: 497504 - RNA, 64 nt, hsa; identical to SEQ ID NO: 97086

SEQ ID NO: 497505 - RNA, 64 nt, hsa; identical to SEQ ID NO: 97087

SEQ ID NO: 497506 - RNA, 64 nt, hsa; identical to SEQ ID NO: 326250

SEQ ID NO: 497507 - RNA, 64 nt, hsa; identical to SEQ ID NO: 326251

SEQ ID NO: 497508 - RNA, 64 nt, hsa; identical to SEQ ID NO: 326252

SEQ ID NO: 497509 - RNA, 64 nt, hsa; identical to SEQ ID NO: 326253

SEQ ID NO: 497510 - RNA, 64 nt, hsa; identical to SEQ ID NO: 326254

SEQ ID NO: 497511 - RNA, 64 nt, hsa; identical to SEQ ID NO: 326255

SEQ ID NO: 497512 - RNA, 64 nt, hsa; identical to SEQ ID NO: 326256

SEQ ID NO: 497513 - RNA, 64 nt, hsa; identical to SEQ ID NO: 326257

SEQ ID NO: 497514 - RNA, 64 nt, hsa; identical to SEQ ID NO: 326258

SEQ ID NO: 497515 - RNA, 64 nt, hsa; identical to SEQ ID NO: 326259

SEQ ID NO: 497516 - RNA, 64 nt, hsa; identical to SEQ ID NO: 326260

SEQ ID NO: 497517 - RNA, 64 nt, hsa; identical to SEQ ID NO: 326261

SEQ ID NO: 497518 - RNA, 64 nt, hsa; identical to SEQ ID NO: 326262

SEQ ID NO: 497519 - RNA, 64 nt, hsa; identical to SEQ ID NO: 326263

SEQ ID NO: 497520 - RNA, 64 nt, hsa; identical to SEQ ID NO: 326264

SEQ ID NO: 497521 - RNA, 64 nt, hsa; identical to SEQ ID NO: 326265

SEQ ID NO: 497522 - RNA, 64 nt, hsa; identical to SEQ ID NO: 326266

SEQ ID NO: 497523 - RNA, 64 nt, hsa; identical to SEQ ID NO: 326267

SEQ ID NO: 497524 - RNA, 64 nt, hsa; identical to SEQ ID NO: 326268

SEQ ID NO: 497525 - RNA, 64 nt, hsa; identical to SEQ ID NO: 326269

SEQ ID NO: 497526 - RNA, 64 nt, hsa; identical to SEQ ID NO: 326270

SEQ ID NO: 497527 - RNA, 64 nt, hsa; identical to SEQ ID NO: 326271

SEQ ID NO: 497528 - RNA, 64 nt, hsa; identical to SEQ ID NO: 326272

SEQ ID NO: 497529 - RNA, 64 nt, hsa; identical to SEQ ID NO: 326273

SEQ ID NO: 497530 - RNA, 64 nt, hsa; identical to SEQ ID NO: 326274

SEQ ID NO: 497531 - RNA, 64 nt, hsa; identical to SEQ ID NO: 326275

SEQ ID NO: 497532 - RNA, 64 nt, hsa; identical to SEQ ID NO: 326276

SEQ ID NO: 497533 - RNA, 64 nt, hsa; identical to SEQ ID NO: 326277

SEQ ID NO: 497534 - RNA, 64 nt, hsa; identical to SEQ ID NO: 326278

SEQ ID NO: 497535 - RNA, 64 nt, hsa; identical to SEQ ID NO: 326279

SEQ ID NO: 497536 - RNA, 64 nt, hsa; identical to SEQ ID NO: 326280

SEQ ID NO: 497537 - RNA, 64 nt, hsa; identical to SEQ ID NO: 326281

SEQ ID NO: 497538 - RNA, 64 nt, hsa; identical to SEQ ID NO: 326282

SEQ ID NO: 497539 - RNA, 64 nt, hsa; identical to SEQ ID NO: 326283

SEQ ID NO: 497540 - RNA, 64 nt, hsa; identical to SEQ ID NO: 326284

SEQ ID NO: 497541 - RNA, 64 nt, hsa; identical to SEQ ID NO: 326285

SEQ ID NO: 497542 - RNA, 64 nt, hsa; identical to SEQ ID NO: 326286

SEQ ID NO: 497543 - RNA, 64 nt, hsa; identical to SEQ ID NO: 326287

SEQ ID NO: 497544 - RNA, 64 nt, hsa; identical to SEQ ID NO: 326288

SEQ ID NO: 497545 - RNA, 64 nt, hsa; identical to SEQ ID NO: 326289

SEQ ID NO: 497546 - RNA, 64 nt, hsa; identical to SEQ ID NO: 326290

SEQ ID NO: 497547 - RNA, 64 nt, hsa; identical to SEQ ID NO: 326291

SEQ ID NO: 497548 - RNA, 64 nt, hsa; identical to SEQ ID NO: 326292

SEQ ID NO: 497549 - RNA, 64 nt, hsa; identical to SEQ ID NO: 326293

SEQ ID NO: 497550 - RNA, 64 nt, hsa
ccuuccaccuggaggcucccuugucucccagccccauguacaaagcucaccaagccccugccca

SEQ ID NO: 497551 - RNA, 64 nt, hsa
cagccccauguacaaagcucaccaagccccugcccauguacagcccccagacccucugcaauau

SEQ ID NO: 497552 - RNA, 64 nt, hsa
ugcaaacuacucuucuagugguuaaugcacuugacauguacaguauguuucccaugccguugug

SEQ ID NO: 497553 - RNA, 64 nt, hsa
guacaguauguuucccaugccguugugauuuugacauguacaguauguuuucaugccguuguga

SEQ ID NO: 497554 - RNA, 64 nt, hsa
ucagcuaugaauuacucuauauaguaucuauagccauguacauauuacagcaugacaagcucaa

SEQ ID NO: 497555 - RNA, 64 nt, hsa
cagucugacuaauaacugcuaauuugugauccaacauguacaguauguauauagugacauagcu

SEQ ID NO: 497556 - RNA, 64 nt, hsa
cugugccugggguccacagagccgggaggucacacauguacauccuggaagcugcccaaggugu

SEQ ID NO: 497557 - RNA, 64 nt, hsa
aaaacuguauuauauugccuuauuuauuuuuaaucauguacaauauucauguacaaauguuaga

SEQ ID NO: 497558 - RNA, 64 nt, hsa
auugccuuauuuauuuuuaaucauguacaauauucauguacaaauguuagagccauucggguag

SEQ ID NO: 497559 - RNA, 64 nt, hsa
ugaagauuaugcuguuuaugcaauaauuugugaacauguacagaguuuuauauaaauuuaaacc

SEQ ID NO: 497560 - RNA, 64 nt, hsa
guaucuuuguaacuauaaauagugcaugcucagccauguacacuguaaauagccuuuaccaaac

SEQ ID NO: 497561 - RNA, 64 nt, hsa
ccuuuuuuauacacauaauuaaaguguccauugacauguacagagaacuaacacuauuuuaugc

SEQ ID NO: 497562 - RNA, 64 nt, hsa
auuuuaugcaaauauuuuuuuguagaugaaaaagcauguacaguguucuguuuaauacucaucc

SEQ ID NO: 497563 - RNA, 64 nt, hsa
aaguuccuacacacggacgugugauacacacaugcauguacagguaagcacacauguacaagcu

SEQ ID NO: 497564 - RNA, 64 nt, hsa
gugugauacacacaugcauguacagguaagcacacauguacaagcuccuacaggcuugcucuca

SEQ ID NO: 497565 - RNA, 64 nt, hsa
uuaaaaguuguuuaauuuacuuggcauuuuaggacauguacaugaaacagugaaaaugagaucc

SEQ ID NO: 497566 - RNA, 64 nt, hsa
auuccgguuauuuaagucauuucugugauucuaucauguacaguuuccagaauugucacugugc

SEQ ID NO: 497567 - RNA, 64 nt, hsa
gucaugaaauacuuaacacaugugcacauguacacauguacauuuauaugcagugaauuguuac

SEQ ID NO: 497568 - RNA, 64 nt, hsa
aggcuugagucaugaaauacuuaacacaugugcacauguacacauguacauuuauaugcaguga

SEQ ID NO: 497569 - RNA, 64 nt, hsa
cuauuuggaagaagaaacuuucucuuguagugccucuugacaaagcacaauuucccgccuuuuu

SEQ ID NO: 497570 - RNA, 64 nt, hsa
cuguacuuuuucaaauaaugauguuuaaaaauuaucuugacauaagcgucauauaccuuugcaa

SEQ ID NO: 497571 - RNA, 64 nt, hsa
uauuuugaugaucagaggucuugaggucuugacaucuugacauauacacugaaaaaaauggggg

SEQ ID NO: 497572 - RNA, 64 nt, hsa
aaauaacuuauuuugaugaucagaggucuugaggucuugacaucuugacauauacacugaaaaa

SEQ ID NO: 497573 - RNA, 64 nt, hsa
uauuauagaagguucuuucauucaagaucaucauucuugacagacccauaaauauuuccuauaa

SEQ ID NO: 497574 - RNA, 64 nt, hsa
uucuuagcuuugguacugacaguuuucuuuugccucuugacauaauugguauauggaucugaua

SEQ ID NO: 497575 - RNA, 64 nt, hsa; identical to SEQ ID NO: 460733

SEQ ID NO: 497576 - RNA, 64 nt, hsa; identical to SEQ ID NO: 460734

SEQ ID NO: 497577 - RNA, 64 nt, hsa; identical to SEQ ID NO: 460735

SEQ ID NO: 497578 - RNA, 64 nt, hsa; identical to SEQ ID NO: 460736

SEQ ID NO: 497579 - RNA, 64 nt, hsa; identical to SEQ ID NO: 460737

SEQ ID NO: 497580 - RNA, 64 nt, hsa; identical to SEQ ID NO: 460738

SEQ ID NO: 497581 - RNA, 64 nt, hsa; identical to SEQ ID NO: 460739

SEQ ID NO: 497582 - RNA, 64 nt, hsa; identical to SEQ ID NO: 460740

SEQ ID NO: 497583 - RNA, 64 nt, hsa; identical to SEQ ID NO: 460741

SEQ ID NO: 497584 - RNA, 64 nt, hsa; identical to SEQ ID NO: 460742

SEQ ID NO: 497585 - RNA, 64 nt, hsa; identical to SEQ ID NO: 460743

SEQ ID NO: 497586 - RNA, 64 nt, hsa; identical to SEQ ID NO: 460744

SEQ ID NO: 497587 - RNA, 64 nt, hsa; identical to SEQ ID NO: 460745

SEQ ID NO: 497588 - RNA, 64 nt, hsa; identical to SEQ ID NO: 460746

SEQ ID NO: 497589 - RNA, 64 nt, hsa; identical to SEQ ID NO: 460747

SEQ ID NO: 497590 - RNA, 64 nt, hsa; identical to SEQ ID NO: 460748

SEQ ID NO: 497591 - RNA, 64 nt, hsa; identical to SEQ ID NO: 460749

SEQ ID NO: 497592 - RNA, 64 nt, hsa; identical to SEQ ID NO: 460750

SEQ ID NO: 497593 - RNA, 64 nt, hsa; identical to SEQ ID NO: 460751

SEQ ID NO: 497594 - RNA, 64 nt, hsa; identical to SEQ ID NO: 460752

SEQ ID NO: 497595 - RNA, 64 nt, hsa; identical to SEQ ID NO: 460753

SEQ ID NO: 497596 - RNA, 64 nt, hsa; identical to SEQ ID NO: 460754

SEQ ID NO: 497597 - RNA, 64 nt, hsa
guugccuugcuuaacucuaaagcuccauguccugggccuaaaaucguauaaaaucuggauuuuu

SEQ ID NO: 497598 - RNA, 64 nt, hsa
aauuaggaguugugcaacagcucuuuugagaggaggccuaaaggacaggagaaaaggucuucaa

SEQ ID NO: 497599 - RNA, 64 nt, hsa; identical to SEQ ID NO: 73772

SEQ ID NO: 497600 - RNA, 64 nt, hsa; identical to SEQ ID NO: 73773

SEQ ID NO: 497601 - RNA, 64 nt, hsa; identical to SEQ ID NO: 73774

SEQ ID NO: 497602 - RNA, 64 nt, hsa; identical to SEQ ID NO: 73775

SEQ ID NO: 497603 - RNA, 64 nt, hsa; identical to SEQ ID NO: 73776

SEQ ID NO: 497604 - RNA, 64 nt, hsa; identical to SEQ ID NO: 73777

SEQ ID NO: 497605 - RNA, 64 nt, hsa; identical to SEQ ID NO: 73778

SEQ ID NO: 497606 - RNA, 64 nt, hsa; identical to SEQ ID NO: 73779

SEQ ID NO: 497607 - RNA, 64 nt, hsa; identical to SEQ ID NO: 73780

SEQ ID NO: 497608 - RNA, 64 nt, hsa; identical to SEQ ID NO: 73781

SEQ ID NO: 497609 - RNA, 64 nt, hsa; identical to SEQ ID NO: 73782

SEQ ID NO: 497610 - RNA, 64 nt, hsa; identical to SEQ ID NO: 73783

SEQ ID NO: 497611 - RNA, 64 nt, hsa; identical to SEQ ID NO: 73784

SEQ ID NO: 497612 - RNA, 64 nt, hsa; identical to SEQ ID NO: 73785

SEQ ID NO: 497613 - RNA, 64 nt, hsa; identical to SEQ ID NO: 73786

SEQ ID NO: 497614 - RNA, 64 nt, hsa; identical to SEQ ID NO: 73787

SEQ ID NO: 497615 - RNA, 64 nt, hsa; identical to SEQ ID NO: 73788

SEQ ID NO: 497616 - RNA, 64 nt, hsa; identical to SEQ ID NO: 73789

SEQ ID NO: 497617 - RNA, 64 nt, hsa; identical to SEQ ID NO: 73790

SEQ ID NO: 497618 - RNA, 64 nt, hsa; identical to SEQ ID NO: 73791

SEQ ID NO: 497619 - RNA, 64 nt, hsa; identical to SEQ ID NO: 73792

SEQ ID NO: 497620 - RNA, 64 nt, hsa; identical to SEQ ID NO: 73793

SEQ ID NO: 497621 - RNA, 64 nt, hsa; identical to SEQ ID NO: 73794

SEQ ID NO: 497622 - RNA, 64 nt, hsa; identical to SEQ ID NO: 73795

SEQ ID NO: 497623 - RNA, 64 nt, hsa; identical to SEQ ID NO: 73796

SEQ ID NO: 497624 - RNA, 64 nt, hsa; identical to SEQ ID NO: 73797

SEQ ID NO: 497625 - RNA, 64 nt, hsa; identical to SEQ ID NO: 73798

SEQ ID NO: 497626 - RNA, 64 nt, hsa; identical to SEQ ID NO: 73799

SEQ ID NO: 497627 - RNA, 64 nt, hsa; identical to SEQ ID NO: 73800

SEQ ID NO: 497628 - RNA, 64 nt, hsa; identical to SEQ ID NO: 73801

SEQ ID NO: 497629 - RNA, 64 nt, hsa; identical to SEQ ID NO: 73802

SEQ ID NO: 497630 - RNA, 64 nt, hsa; identical to SEQ ID NO: 73803

SEQ ID NO: 497631 - RNA, 64 nt, hsa; identical to SEQ ID NO: 73804

SEQ ID NO: 497632 - RNA, 64 nt, hsa; identical to SEQ ID NO: 73805

SEQ ID NO: 497633 - RNA, 64 nt, hsa; identical to SEQ ID NO: 73806

SEQ ID NO: 497634 - RNA, 64 nt, hsa; identical to SEQ ID NO: 73807

SEQ ID NO: 497635 - RNA, 64 nt, hsa; identical to SEQ ID NO: 73808

SEQ ID NO: 497636 - RNA, 64 nt, hsa; identical to SEQ ID NO: 73809

SEQ ID NO: 497637 - RNA, 64 nt, hsa; identical to SEQ ID NO: 73810

SEQ ID NO: 497638 - RNA, 64 nt, hsa; identical to SEQ ID NO: 73811

SEQ ID NO: 497639 - RNA, 64 nt, hsa; identical to SEQ ID NO: 73812

SEQ ID NO: 497640 - RNA, 64 nt, hsa; identical to SEQ ID NO: 73813

SEQ ID NO: 497641 - RNA, 64 nt, hsa; identical to SEQ ID NO: 73814

SEQ ID NO: 497642 - RNA, 64 nt, hsa; identical to SEQ ID NO: 73815

SEQ ID NO: 497643 - RNA, 64 nt, hsa; identical to SEQ ID NO: 73816

SEQ ID NO: 497644 - RNA, 64 nt, hsa; identical to SEQ ID NO: 73817

SEQ ID NO: 497645 - RNA, 64 nt, hsa; identical to SEQ ID NO: 73818

SEQ ID NO: 497646 - RNA, 64 nt, hsa; identical to SEQ ID NO: 73819

SEQ ID NO: 497647 - RNA, 64 nt, hsa; identical to SEQ ID NO: 73820

SEQ ID NO: 497648 - RNA, 64 nt, hsa; identical to SEQ ID NO: 73821

SEQ ID NO: 497649 - RNA, 64 nt, hsa; identical to SEQ ID NO: 73822

SEQ ID NO: 497650 - RNA, 64 nt, hsa; identical to SEQ ID NO: 73823

SEQ ID NO: 497651 - RNA, 64 nt, hsa; identical to SEQ ID NO: 73824

SEQ ID NO: 497652 - RNA, 64 nt, hsa; identical to SEQ ID NO: 73825

SEQ ID NO: 497653 - RNA, 64 nt, hsa; identical to SEQ ID NO: 73826

SEQ ID NO: 497654 - RNA, 64 nt, hsa; identical to SEQ ID NO: 73827

SEQ ID NO: 497655 - RNA, 64 nt, hsa; identical to SEQ ID NO: 73828

SEQ ID NO: 497656 - RNA, 64 nt, hsa; identical to SEQ ID NO: 73829

SEQ ID NO: 497657 - RNA, 64 nt, hsa; identical to SEQ ID NO: 73830

SEQ ID NO: 497658 - RNA, 64 nt, hsa
cuaccuguauaugguaauguccaguuuuaaaaauauuggacaucuucaaucuuaaacauuucua

SEQ ID NO: 497659 - RNA, 64 nt, hsa
uagaaguucccccaauuacaaacugguuuuaaauauuggacauacugguuuuaauaccugcuuu

SEQ ID NO: 497660 - RNA, 64 nt, hsa
cccugcugcgagucacuccauuuaucuuaaagaaauuggacagcauaugaagauuggacaucac

SEQ ID NO: 497661 - RNA, 64 nt, hsa
cauuuaucuuaaagaaauuggacagcauaugaagauuggacaucacaugugaaugcaugauaug

SEQ ID NO: 497662 - RNA, 64 nt, hsa
ugcuugauaagcacauguggcuaguggcugcuauauuggacagcaugggccaccuguuucuaac

SEQ ID NO: 497663 - RNA, 64 nt, hsa
cuuucugcacaucuccauuuggaugcuaauguucauuggacauacuugaucuguauuuagauuu

SEQ ID NO: 497664 - RNA, 64 nt, hsa
auuuaaucaugcuucuuuugucuggguaauagacauuggacagauauuuuuaguucagauggug

SEQ ID NO: 497665 - RNA, 64 nt, hsa
aggaauguuuugcagcuuuguacaaguaacauaaauuggacaccucagaaugaaaguucauguu

SEQ ID NO: 497666 - RNA, 64 nt, hsa
caggucacaugcacguauguccagggcauggggguggcgugaagaggccuggucagggccuuua

SEQ ID NO: 497667 - RNA, 64 nt, hsa
gcucggaccugccguggagggugcccggcagacguggcgugagagggacggcucacgaggcuug

SEQ ID NO: 497668 - RNA, 64 nt, hsa
gccaauauucucuagaaugagcacaaaacaaaucgaauaacagcuaaacaaaucgaauaacagc

SEQ ID NO: 497669 - RNA, 64 nt, hsa
gcacaaaacaaaucgaauaacagcuaaacaaaucgaauaacagcuaaacgaaucgaauaacagc

SEQ ID NO: 497670 - RNA, 64 nt, hsa
cagcuaaacaaaucgaauaacagcuaaacgaaucgaauaacagcuuuuguacaucaacaucaag

SEQ ID NO: 497671 - RNA, 64 nt, hsa
aacugguauucaaaaaugaauaacagccaaaaaugaauaacagccauuugauuuauguuucccu

SEQ ID NO: 497672 - RNA, 64 nt, hsa
uugaaagcaguaauauuaacugguauucaaaaaugaauaacagccaaaaaugaauaacagccau

SEQ ID NO: 497673 - RNA, 64 nt, hsa
auuaucugugaaccauaauuuaaaaaucuuucuagaauaacaacagcagacuccacucuuguuu

SEQ ID NO: 497674 - RNA, 64 nt, hsa
ccucuuaguaaaagauaggcccacuuuauuccaagaauaacacuuagcacauaaacucuucuuc

SEQ ID NO: 497675 - RNA, 64 nt, hsa
uagauauauugguucaaauaaaauacauuaaaaugaauaacacuuuuuuguuuuuaaaauuguu

SEQ ID NO: 497676 - RNA, 64 nt, hsa
uguccuuuuguucauacaaaagaaaaaugaggaugaauaacaaguuuggcaaaaugaugguaac

SEQ ID NO: 497677 - RNA, 64 nt, hsa
uuccaaaguucagccaguuaucaguagauacaauaucuuuaaaugaacacacgaguguaugucu

SEQ ID NO: 497678 - RNA, 64 nt, hsa
uauacacaagugugcauauacaguuaaugaaacuaucuuuaaauguuauucaugcuauaaagag

SEQ ID NO: 497679 - RNA, 64 nt, hsa
ccugcccaucuuggaggugcauggcccaucagggaucuuuaaagugggagcaggaaaggcugcu

SEQ ID NO: 497680 - RNA, 64 nt, hsa
gaguucuuuggggcuuauuuucuggguaaggcucaucuuuaaaaacuggcuucagaggggagag

SEQ ID NO: 497681 - RNA, 64 nt, hsa
uaagcauguuuugguugcuaaagaaaaaagcauaaucuuuaaccgaguauaaguacuugcugug

SEQ ID NO: 497682 - RNA, 61 nt, hsa
guauagguuuaaagcccuaaaugccaugcguaucuuuaagaaauuuuaucuuuugaaacac

SEQ ID NO: 497683 - RNA, 64 nt, hsa
guaaguaauuugaauuggcagcuuucuuugcuaaaucuuuaaauucuguuaagauccucaagua

SEQ ID NO: 497684 - RNA, 64 nt, hsa
gaggcucccaucaugccauuuuuuguucauuuuaaucuuuaaaaaauaaaaauuaggcauauua

SEQ ID NO: 497685 - RNA, 64 nt, hsa
uaagucugggacgacaucuuuuauuuuuacaugaaucuuuaaacaauucugugagcaaaguuug

SEQ ID NO: 497686 - RNA, 64 nt, hsa
uugaaaaaucaucgaaauguauaaaaauugcaguaucuuuaaaaucaguaaaauggacuagcau

SEQ ID NO: 497687 - RNA, 64 nt, hsa
aauuugcaauuucaggaauuuaauuuauaggcagaucuuuaaauacagucaacuuacggugcac

SEQ ID NO: 497688 - RNA, 64 nt, hsa
aggaucuuuuguaaaugagacacauacaaaaaaaaucuuuaaugguuaauaggaugaaugggaa

SEQ ID NO: 497689 - RNA, 64 nt, hsa
ccauuuacuuuggucaauauuugaucuaaguugcaucuuuaauccugguggucuugccuucuga

SEQ ID NO: 497690 - RNA, 64 nt, hsa
ucuuugaaaaauaaaguuauguaagguuuuuuuuaucuuuaaauagcucuguggguuuuaacau

SEQ ID NO: 497691 - RNA, 64 nt, hsa
cgguugcauuuuuuucuguuuguuucaaucucuaaucuuuaagucagaaccuaauuguacagug

SEQ ID NO: 497692 - RNA, 64 nt, hsa
cuggccaucuuuuccucauguggaagaauuuucuaucuuuaauaaacuuuuucuuuguuuuuuu

SEQ ID NO: 497693 - RNA, 64 nt, hsa
ccucugcuuguauuuugcgaugaagaugugauacaucuuuaaaugaaaauauaccaaaauuuag

SEQ ID NO: 497694 - RNA, 64 nt, hsa
ucaucaguacgugagacaagcaguuaauaguaugaucuuuaaaguuuugacaauauaaaauaaa

SEQ ID NO: 497695 - RNA, 64 nt, hsa
auauauguuguauauuuuuaguuguaaagcaguaaucuuuaacuguagcauuccucuaauuaua

SEQ ID NO: 497696 - RNA, 64 nt, hsa
gucaacuuguaauuucuuugaagucauauguuuuaucuuuaaaauuauucuuauuuuaccugug

SEQ ID NO: 497697 - RNA, 64 nt, hsa
uguacauucucuuuguuuucauuuuccaaauauaaucuuuaauaaacuugauuuaguuucuugg

SEQ ID NO: 497698 - RNA, 64 nt, hsa
guuuauauaauauuuccacugugugacucuagugaucuuuaacauacacagaaugaucuacagu

SEQ ID NO: 497699 - RNA, 64 nt, hsa
gugaucuuuaacauacacagaaugaucuacagugaucuuuaacauacucagaaauaugaaaaau

SEQ ID NO: 497700 - RNA, 64 nt, hsa
gagauccgaaauaucauuuguggguuuugaaugcaucuuuaaagugcuuuaaaaaaaaguuuua

SEQ ID NO: 497701 - RNA, 64 nt, hsa
aggaauuagauuuugaagaugagcauauauuacuaucuuuaagcauuuaaaaauacuguucaca

SEQ ID NO: 497702 - RNA, 64 nt, hsa
agacaugguaagguggagaguaaaugcuugauaaaucuuuaagauaugucuugaaugauaauua

SEQ ID NO: 497703 - RNA, 64 nt, hsa
acacaaacuaauuuaaaguuuacuuaauaaugguaucuuuaaaauaauugacacaauugcaaaa

SEQ ID NO: 497704 - RNA, 64 nt, hsa
uaauauucuuaguaccacaagauaugucauagguaucuuuaaaugaaauucuuagcuggaaaag

SEQ ID NO: 497705 - RNA, 64 nt, hsa
ucaugaaagucauugguaggccauuagcauugauaucuuuaaaacaucuacccuaaaccaucug

SEQ ID NO: 497706 - RNA, 64 nt, hsa
gucuauaucaucuaucaauuuauuaagcaggucuaucuuuaauuuguuaucucaaaccagucug

SEQ ID NO: 497707 - RNA, 64 nt, hsa
gcaagucaaguaaguguggguagcaaaaacaauuaucuuuaaaaaaaaaaucacaucaguauag

SEQ ID NO: 497708 - RNA, 64 nt, hsa
ucuaguuuuucuuuaaaaggauaguuuaugaguaaucuuuaaaaccauuuccauaccaucugua

SEQ ID NO: 497709 - RNA, 64 nt, hsa
guuauuaccacauaguauuuuuauguuacccaucaucuuuaaaaacauuauaggcugggcaugg

SEQ ID NO: 497710 - RNA, 64 nt, hsa
uucagaauaccuaagcugcuucuuuaacauagagaucuuuaaaaagggaaggucaagcaaagaa

SEQ ID NO: 497711 - RNA, 64 nt, hsa
gguaauaugaucaaaguuaagcaauagugguaaaaucuuuaaaacuagauucuugcuucugaua

SEQ ID NO: 497712 - RNA, 64 nt, hsa
aaggacaaauccuguuaaagaaauauuguuaaaaaucuuuaaacccuguguauugaaagcacuc

SEQ ID NO: 497713 - RNA, 64 nt, hsa
cuagaauuaaaaccaaauuaugaccuuaugauaaaucuuuaaguauuggugugaauguuauuua

SEQ ID NO: 497714 - RNA, 64 nt, hsa
aacugcacuguugaucggugcuuuguguaaauacaucuuuaacauuuggguggagaggggccuu

SEQ ID NO: 497715 - RNA, 64 nt, hsa
augaucauauaccuuuuaaauaaggggaaauaguaucuuuaaaguuaaugucuagccaagaguu

SEQ ID NO: 497716 - RNA, 64 nt, hsa
gaauuugugaauauacuuguuaacacaucuaaauaucuuuaagucuuuggcaauguuauuguau

SEQ ID NO: 497717 - RNA, 64 nt, hsa
aagguuaauuauaaucuuuccuuauuucaacaagaucuuuaaaauuuuugugaauacuuaaaag

SEQ ID NO: 497718 - RNA, 64 nt, hsa
uacagcuuauuuuguaacuauuuuauaucucaauaucuuuaauauaaaucuuuuuacugagaga

SEQ ID NO: 497719 - RNA, 64 nt, hsa
uaaaauuuuuucuaagucuauacguuuuuaauucaucuuuaagauugagcuaaauuaucuacca

SEQ ID NO: 497720 - RNA, 64 nt, hsa
aaacguguaacagcucccuaugugaagaaacauuaucuuuaaagucaucugggaggugcaggua

SEQ ID NO: 497721 - RNA, 64 nt, hsa
uaauguauuaaguauuuaaguacuuucuaauaaaaucuuuaacaauaauaauguaaauuucaga

SEQ ID NO: 497722 - RNA, 64 nt, hsa
guugaagaucaaauucgugauaucucuauaucuaaucuuuaaaaaucagaaugcuaaugcugac

SEQ ID NO: 497723 - RNA, 64 nt, hsa
gaggacauggggaagaaucaaucuucaacagauaaucuuuaaguacagacccaggaauaucaga

SEQ ID NO: 497724 - RNA, 64 nt, hsa
auucaguaaaaugaugguuaacauguuuuaaaaaaucuuuaauggagaaguuaaauauuuggug

SEQ ID NO: 497725 - RNA, 64 nt, hsa
gacuacauaagcguuaaaaauuguguuuuucagaaucuuuaaaauauaagacagugcuaucuag

SEQ ID NO: 497726 - RNA, 64 nt, hsa
uaaagugagaaaaauauguuucguaaauauuugcaucuuuaauauuguuaguaaguaguaaaca

SEQ ID NO: 497727 - RNA, 64 nt, hsa
uuuaugaugcauugcacacccucuggggaaauugaucuuuaaauuuugagacaguauaaggaaa

SEQ ID NO: 497728 - RNA, 64 nt, hsa
uagaaugaagucuugaaaaaaacuuuauaaagacaucuuuaaucauuccaaaauuguguccguu

SEQ ID NO: 497729 - RNA, 64 nt, hsa
ggaugggauuuucguuauuuugcugggucagcuuaucuuuaauauauggacuauuccuauaaac

SEQ ID NO: 497730 - RNA, 64 nt, hsa
auucuaccuuuguaaacaauuggcuaaaagaaucaucuuuaagaaauuaagccauuuacauguu

SEQ ID NO: 497731 - RNA, 64 nt, hsa
aggaggcacugccccccuuuccugcccccuccucaucuuuaauaaagaccuggcuucucaucuu

SEQ ID NO: 497732 - RNA, 64 nt, hsa
ccccuccucaucuuuaauaaagaccuggcuucucaucuuuaauaaagaccuguuuguaacagaa

SEQ ID NO: 497733 - RNA, 64 nt, hsa
gauauauuauuucauccacagacauuucauacauaucuuuaaagcacaugacaacauuagaaaa

SEQ ID NO: 497734 - RNA, 64 nt, hsa
cuugcacguaaauuauuuuguacauguguaauauaucuuuaagguaaauuccuagaaguggaaa

SEQ ID NO: 497735 - RNA, 64 nt, hsa
acugcuggcugcuuuaaaaaaaaaaaaaaaggauccauuguaccguugucuucaucacugggaa

SEQ ID NO: 497736 - RNA, 64 nt, hsa
ggaaaagacauuuucauguuaaugagaauuuccaccauuguagagaauuuccuuccuacugaga

SEQ ID NO: 497737 - RNA, 64 nt, hsa
cacagauuugcuuuugguuaccgauuagaucuauccauuguagaauucauguaaauagaauacu

SEQ ID NO: 497738 - RNA, 64 nt, hsa
ccagguuacuugccaauauauagucauauugcugccauuguacuuaauuucuaaauauauaaaa

SEQ ID NO: 497739 - RNA, 64 nt, hsa
ugucuuacacauaaaagccacugcuuuuaacaucccauuguacauuuaacacauaaaugguguu

SEQ ID NO: 497740 - RNA, 64 nt, hsa
auuguacauuuaacacauaaaugguguuaacaucccauuguacauuuaacacauaaauggccau

SEQ ID NO: 497741 - RNA, 64 nt, hsa
ugggaggcagagguugcagugagccgggauugcgccauuguacuccagccugggugaagaagug

SEQ ID NO: 497742 - RNA, 64 nt, hsa
cuagaggcggaguuugcagugagccgagauagugccauuguacuccagcuugggcaacagagua

SEQ ID NO: 497743 - RNA, 64 nt, hsa
uuuuuuuuuugccacauucugcccuucccugaccccauuguaauaaccaacuccauauccaaag

SEQ ID NO: 497744 - RNA, 64 nt, hsa
caacuccauauccaaagggagguggugcucucagccauuguagaagaugguggcuuuaaccuga

SEQ ID NO: 497745 - RNA, 64 nt, hsa
ggugcuuacgaucuuuuuuguuuuccuuuccacuccauuguaucaauuuuuugaguaacuuuua

SEQ ID NO: 497746 - RNA, 64 nt, hsa
uauaaucugucuucuguccaagaucuccugguuuccauuguaagggauuuaaccaaaaucuugc

SEQ ID NO: 497747 - RNA, 64 nt, hsa
ggcuuccucuccagaauguggcuuugccugagcacagacagagucagcauggaaugcucuuggc

SEQ ID NO: 497748 - RNA, 64 nt, hsa
gcggauugaggcugcugggucagccuugaucgcacagacagagcuugugccggauuuggcccug

SEQ ID NO: 497749 - RNA, 64 nt, hsa
ucucuuaaagcggcaccaacgugagagagacaggcagacagacagaaagccagaggcuuaggga

SEQ ID NO: 497750 - RNA, 64 nt, hsa
uuaaagcggcaccaacgugagagagacaggcagacagacagaaagccagaggcuuagggaaacu

SEQ ID NO: 497751 - RNA, 64 nt, hsa
cauguacagacucuauaucucuauauauaauguacagacagacagagucccuucccucuuuaac

SEQ ID NO: 497752 - RNA, 64 nt, hsa
uacagacucuauaucucuauauauaauguacagacagacagagucccuucccucuuuaaccccc

SEQ ID NO: 497753 - RNA, 64 nt, hsa
ccugugcaaauuuuaaaaaggaacccuuuuccuccagacagauacagccccaaaccagggugca

SEQ ID NO: 497754 - RNA, 64 nt, hsa
gaagcugagaagaagcugaggauccucacaggagcagacagagaaaugugaagggugggguuuu

SEQ ID NO: 497755 - RNA, 64 nt, hsa
cagcaggacauaugggcaagcucugcaggacagacagacagacaaacccucugaucuaugaagu

SEQ ID NO: 497756 - RNA, 64 nt, hsa
ggaccagcaggacauaugggcaagcucugcaggacagacagacagacaaacccucugaucuaug

SEQ ID NO: 497757 - RNA, 64 nt, hsa
ucuuuggagucauggcacuguacgguuuuagugucagacagaccgggguucaaaucccagcucu

SEQ ID NO: 497758 - RNA, 64 nt, hsa
gucccaagcgaaggcuccucugcuugggauucuucagacagaagcugggccagcacuguggacu

SEQ ID NO: 497759 - RNA, 64 nt, hsa
gaccuccuaggccugauuguccugccagggugggcagacagacagauggaccggcccacacucc

SEQ ID NO: 497760 - RNA, 64 nt, hsa
uccuaggccugauuguccugccagggugggcagacagacagauggaccggcccacacucccaga

SEQ ID NO: 497761 - RNA, 64 nt, hsa
cccaggcagaccgauaaaaagaccuccagauaggcagacagacagauggaccaccaaccuggac

SEQ ID NO: 497762 - RNA, 64 nt, hsa
ggcagaccgauaaaaagaccuccagauaggcagacagacagauggaccaccaaccuggacagac

SEQ ID NO: 497763 - RNA, 64 nt, hsa
ucaggugggcuggcuggcugacagaccuucuggccagacagacuccuaaccaaccagauggacu

SEQ ID NO: 497764 - RNA, 64 nt, hsa
aagucccccaaaugaguacacaucuccagcuauucagacagauggacccccagcaaaucaggac

SEQ ID NO: 497765 - RNA, 64 nt, hsa
gaccuaucuaggcagaccccagccagacccccgccagacagacucccaaccagacugaccccuu

SEQ ID NO: 497766 - RNA, 64 nt, hsa
aucacagugccauuugaagggaaaggaguucagacagacagacguauuccccaaaaagggauac

SEQ ID NO: 497767 - RNA, 64 nt, hsa
uuuuaucacagugccauuugaagggaaaggaguucagacagacagacguauuccccaaaaaggg

SEQ ID NO: 497768 - RNA, 64 nt, hsa
uggcacuggccaggcuuggguggagccugugucccagacagauccccuaggccuaucugagacc

SEQ ID NO: 497769 - RNA, 64 nt, hsa
cggaaaagagaacagaagagaauccagaaguguucagacagaacuagggacaacagaggggccu

SEQ ID NO: 497770 - RNA, 64 nt, hsa
auuggaaaacuaaagaaguugagcaacuugaaugcagacagaaauaaauuaguguccuuaccaa

SEQ ID NO: 497771 - RNA, 64 nt, hsa
aucugacaaccagucccagccccugcuuacauuccagacagacacagacuacaccacaggagag

SEQ ID NO: 497772 - RNA, 64 nt, hsa
acggcucuggacccaggacagacagacagacagacagacagacacgcacacacacccaucucug

SEQ ID NO: 497773 - RNA, 64 nt, hsa
auugacggcucuggacccaggacagacagacagacagacagacagacagacagacagacacgca

SEQ ID NO: 497774 - RNA, 64 nt, hsa
aagaauugacggcucuggacccaggacagacagacagacagacagacagacagacagacagaca

SEQ ID NO: 497775 - RNA, 64 nt, hsa
gcugaagaauugacggcucuggacccaggacagacagacagacagacagacagacagacagaca

SEQ ID NO: 497776 - RNA, 64 nt, hsa
ugaggcugaagaauugacggcucuggacccaggacagacagacagacagacagacagacagaca

SEQ ID NO: 497777 - RNA, 64 nt, hsa
acuccccgcccgcccuccucugcccccucccccgcagacagacagacagacggacgggacagcg

SEQ ID NO: 497778 - RNA, 64 nt, hsa
cccgcccgcccuccucugcccccucccccgcagacagacagacagacggacgggacagcggccc

SEQ ID NO: 497779 - RNA, 64 nt, hsa
cccgcccuccucugcccccucccccgcagacagacagacagacggacgggacagcggcccggcc

SEQ ID NO: 497780 - RNA, 64 nt, hsa
gcuaaauugaucccaauuaaguuuuucugcuuagcagacagaagguauaauuuuuugacacccu

SEQ ID NO: 497781 - RNA, 64 nt, hsa
aaaggcuacuuauggccggucacaauccagcacucagacagagccaaggcaauauccucuugcc

SEQ ID NO: 497782 - RNA, 64 nt, hsa
aaggacaaggacaugagacaguggugauggccaucagacagagacuucaaaugcugauggaggg

SEQ ID NO: 497783 - RNA, 64 nt, hsa
ugagcagugcaguggaagucgggcacagagguagcagacagaugugaagcaguggugaaggcca

SEQ ID NO: 497784 - RNA, 64 nt, hsa
cugaauuaugggcaaaaccaugacuuucauugggcagacagagucuucuaagcccacagggauc

SEQ ID NO: 497785 - RNA, 64 nt, hsa
gugagaagaucccaaggugaagccugucaccacgcagacagaacugcccccuauuguagacagu

SEQ ID NO: 497786 - RNA, 64 nt, hsa
caucuccagacucuaccacuuacggacagacagacagacagacacacacacacacacacacaca

SEQ ID NO: 497787 - RNA, 64 nt, hsa
gguccaucuccagacucuaccacuuacggacagacagacagacagacacacacacacacacaca

SEQ ID NO: 497788 - RNA, 64 nt, hsa
cugugguccaucuccagacucuaccacuuacggacagacagacagacagacacacacacacaca

SEQ ID NO: 497789 - RNA, 64 nt, hsa
cuuuuuccaaacagggauauagaagugguggaagcagacagaagagguaagggaggcuaagugg

SEQ ID NO: 497790 - RNA, 64 nt, hsa
accauuaccucacucagugugaccuggagggggucagacagacgggagaguccagaaacagacc

SEQ ID NO: 497791 - RNA, 64 nt, hsa
uugguucuguguccauuuuccucugugccaaagacagacagacagaggcugagagaggcuguuc

SEQ ID NO: 497792 - RNA, 64 nt, hsa
uucuguguccauuuuccucugugccaaagacagacagacagaggcugagagaggcuguuccuga

SEQ ID NO: 497793 - RNA, 64 nt, hsa
gcuagcugaccuggagaugcugccugguggggaucagacagagauuggagagaagguacagagu

SEQ ID NO: 497794 - RNA, 64 nt, hsa
agugcuggugacgcacggcauuagcuuccugccccagacagacuucaucauugugcuagcugau

SEQ ID NO: 497795 - RNA, 64 nt, hsa
caagauguuggggcugccuggcgcccacuggagacagacagacagacgccugucccccgggacc

SEQ ID NO: 497796 - RNA, 64 nt, hsa
auguuggggcugccuggcgcccacuggagacagacagacagacgccugucccccgggaccgagg

SEQ ID NO: 497797 - RNA, 64 nt, hsa
agcagacacacauacagccugaaacagaccuggacagacagacacagccugaaacagacccgga

SEQ ID NO: 497798 - RNA, 64 nt, hsa
uggacagacagacacagccugaaacagacccggacagacagacacagccugaaacagacccaga

SEQ ID NO: 497799 - RNA, 64 nt, hsa
cagacagacacagccugaaacagacccagacaaacagacagacagacacagccugaaacagacc

SEQ ID NO: 497800 - RNA, 64 nt, hsa
cagacacagccugaaacagacccagacaaacagacagacagacacagccugaaacagacccaga

SEQ ID NO: 497801 - RNA, 64 nt, hsa
caaacagacagacagacacagccugaaacagacccagacagacagacagacagccugaaacaga

SEQ ID NO: 497802 - RNA, 64 nt, hsa
cagacagacagacacagccugaaacagacccagacagacagacagacagccugaaacagaccca

SEQ ID NO: 497803 - RNA, 64 nt, hsa
cagacagacacagccugaaacagacccagacagacagacagacagccugaaacagacccagaca

SEQ ID NO: 497804 - RNA, 64 nt, hsa
aacagacccagacacagccugaaacagauccggacagacagacagaaacagccugaaacagacc

SEQ ID NO: 497805 - RNA, 64 nt, hsa
gacccagacacagccugaaacagauccggacagacagacagaaacagccugaaacagacccaga

SEQ ID NO: 497806 - RNA, 64 nt, hsa
cggacagacagacagaaacagccugaaacagacccagacagacagacagacacagccugaaaca

SEQ ID NO: 497807 - RNA, 64 nt, hsa
cagacagacagaaacagccugaaacagacccagacagacagacagacacagccugaaacagacc

SEQ ID NO: 497808 - RNA, 64 nt, hsa
cagacagaaacagccugaaacagacccagacagacagacagacacagccugaaacagacccgga

SEQ ID NO: 497809 - RNA, 64 nt, hsa
cagacagacagacacagccugaaacagacccggacagacagacagacacagccugaaacagacc

SEQ ID NO: 497810 - RNA, 64 nt, hsa
cagacagacacagccugaaacagacccggacagacagacagacacagccugaaacagacccgga

SEQ ID NO: 497811 - RNA, 64 nt, hsa; identical to SEQ ID NO: 497809

SEQ ID NO: 497812 - RNA, 64 nt, hsa; identical to SEQ ID NO: 497810

SEQ ID NO: 497813 - RNA, 64 nt, hsa; identical to SEQ ID NO: 497809

SEQ ID NO: 497814 - RNA, 64 nt, hsa
cagacagacacagccugaaacagacccggacagacagacagacacagccugaaacagaccuaga

SEQ ID NO: 497815 - RNA, 64 nt, hsa
cagacagacagacacagccugaaacagaccuagacagacagacacagauugaaacagacccaga

SEQ ID NO: 497816 - RNA, 64 nt, hsa
cagacagacacagauugaaacagacccagacaaacagacagacacagccugaaacagacccaga

SEQ ID NO: 497817 - RNA, 64 nt, hsa
aacagacccagacacagccugaaacagacccggacagacagacagacacagccugaaacagacc

SEQ ID NO: 497818 - RNA, 64 nt, hsa
gacccagacacagccugaaacagacccggacagacagacagacacagccugaaacagacccaga

SEQ ID NO: 497819 - RNA, 64 nt, hsa
cggacagacagacagacacagccugaaacagacccagacagacagacagacacagccugaaaca

SEQ ID NO: 497820 - RNA, 64 nt, hsa
cagacagacagacacagccugaaacagacccagacagacagacagacacagccugaaacagacc

SEQ ID NO: 497821 - RNA, 64 nt, hsa
cagacagacacagccugaaacagacccagacagacagacagacacagccugaaacagacccaga

SEQ ID NO: 497822 - RNA, 64 nt, hsa
cagacagacagacagacacagccugaaacagacccagacagacagaccgacgcagccugaaaga

SEQ ID NO: 497823 - RNA, 64 nt, hsa
cagacagacagacacagccugaaacagacccagacagacagaccgacgcagccugaaagagacc

SEQ ID NO: 497824 - RNA, 64 nt, hsa
cagacagacagaccgacgcagccugaaagagacccagacagagagacaggcagacacagccuaa

SEQ ID NO: 497825 - RNA, 64 nt, hsa
cagacaggcagacguagucugaaacagaccugaacagacagacagacgcacacacacaacagau

SEQ ID NO: 497826 - RNA, 64 nt, hsa
caggcagacguagucugaaacagaccugaacagacagacagacgcacacacacaacagaugcgc

SEQ ID NO: 497827 - RNA, 64 nt, hsa
uaaagccaucucagugaagauaugcgugcacgcacagacagacagacacacacacacacacaca

SEQ ID NO: 497828 - RNA, 64 nt, hsa
gccaucucagugaagauaugcgugcacgcacagacagacagacacacacacacacacacacaca

SEQ ID NO: 497829 - RNA, 64 nt, hsa
caggaggagccuggccauggguccuugcccccgacagacagagcagcccccacccgggagccuu

SEQ ID NO: 497830 - RNA, 64 nt, hsa
uggaugagacuguccuggaggauccaccccggaacagacagaauggugucucucaggauggugc

SEQ ID NO: 497831 - RNA, 64 nt, hsa
ccugugggcuuuuuaccaccacugugcaggagaacagacagaggaaaugugucucccuccaagg

SEQ ID NO: 497832 - RNA, 64 nt, hsa
cuucauccugcccggaaugccagugcuccgagcucagacagaggaagcccugcagaaaguucca

SEQ ID NO: 497833 - RNA, 64 nt, hsa
guuacacaguuccaaaucuugggaaggggcuuuucagacagacuguuugcuuucugcugagaua

SEQ ID NO: 497834 - RNA, 64 nt, hsa
ccucaugucuacuguuaggugagggagucacagccagacagagaguauugcuggagggugagag

SEQ ID NO: 497835 - RNA, 64 nt, hsa
gccauuguccacauaacugaucacccauggcugccucuccuauuaucuauuaucacugaaacuu

SEQ ID NO: 497836 - RNA, 64 nt, hsa
guacuuauuauuggccauugaucuugaauuugcccucuccuagugcugcagucccacuucaaag

SEQ ID NO: 497837 - RNA, 64 nt, hsa
guuggugguauauuuuuccccucuuuuuuccuuccucuccuacaucucccuuuucccccgaucc

SEQ ID NO: 497838 - RNA, 64 nt, hsa
ucaaaguagugauggauucaguacuccucaaccacucuccuaaugauuggaacaaaagcaaaca

SEQ ID NO: 497839 - RNA, 64 nt, hsa
ccccuguaaauacuggaucaaugaaugaauaaaacucuccuaagaaucuccugagaaaugaacc

SEQ ID NO: 497840 - RNA, 64 nt, hsa
cauguugacauaaguuccuaccugacuaugcuuucucuccuaggagcuguccuggugggcccag

SEQ ID NO: 497841 - RNA, 64 nt, hsa
cucuaucucucucucuaucuccucucucucucuccucuccuaucucuccucucucucucuccua

SEQ ID NO: 497842 - RNA, 64 nt, hsa
ucucucucucuccucuccuaucucuccucucucucucuccuauacuaacuuguuucaaauugga

SEQ ID NO: 497843 - RNA, 64 nt, hsa
uuaauuaucuacagcuauuuuauuuuauuuaauucucuccuacaguacugggaccacuguaaac

SEQ ID NO: 497844 - RNA, 64 nt, hsa
cuggcuaugauagaaucucaucuaaucuugacaucucuccuaggggaagaauaucacaggcuaa

SEQ ID NO: 497845 - RNA, 64 nt, hsa
ccacuuuccagccuguuuccccaauuccucugugcucuccuagagcucugucugaauccucgca

SEQ ID NO: 497846 - RNA, 64 nt, hsa
uccuuggauuaggagaacagguguuccuccuccccucuccuagcagcccuaaugucugaccuag

SEQ ID NO: 497847 - RNA, 64 nt, hsa
ucugcagcagcaguggcucuucgauuaguuaaaacucuccuaggcugacacaucugggucucaa

SEQ ID NO: 497848 - RNA, 64 nt, hsa
agaauuugcuuuucaaaauggaaauaaauuccaacucuccuaagaggcauuuaauuaaggcucu

SEQ ID NO: 497849 - RNA, 64 nt, hsa
uuggcauaauuggugauccugaagaaagaggucucucuccuaagucucugucagaauugagcuu

SEQ ID NO: 497850 - RNA, 64 nt, hsa
ccuuguacuucguuaacacgaaucuguuucagagcucuccuaccuugcucacugccuuaaucag

SEQ ID NO: 497851 - RNA, 64 nt, hsa; identical to SEQ ID NO: 245168

SEQ ID NO: 497852 - RNA, 64 nt, hsa; identical to SEQ ID NO: 245169

SEQ ID NO: 497853 - RNA, 64 nt, hsa; identical to SEQ ID NO: 245170

SEQ ID NO: 497854 - RNA, 64 nt, hsa; identical to SEQ ID NO: 245171

SEQ ID NO: 497855 - RNA, 64 nt, hsa; identical to SEQ ID NO: 245172

SEQ ID NO: 497856 - RNA, 55 nt, hsa; identical to SEQ ID NO: 245173

SEQ ID NO: 497857 - RNA, 64 nt, hsa; identical to SEQ ID NO: 245174

SEQ ID NO: 497858 - RNA, 64 nt, hsa; identical to SEQ ID NO: 245175

SEQ ID NO: 497859 - RNA, 64 nt, hsa; identical to SEQ ID NO: 245176

SEQ ID NO: 497860 - RNA, 64 nt, hsa; identical to SEQ ID NO: 245177

SEQ ID NO: 497861 - RNA, 64 nt, hsa; identical to SEQ ID NO: 245178

SEQ ID NO: 497862 - RNA, 64 nt, hsa; identical to SEQ ID NO: 245179

SEQ ID NO: 497863 - RNA, 64 nt, hsa; identical to SEQ ID NO: 245180

SEQ ID NO: 497864 - RNA, 64 nt, hsa; identical to SEQ ID NO: 245181

SEQ ID NO: 497865 - RNA, 64 nt, hsa; identical to SEQ ID NO: 245182

SEQ ID NO: 497866 - RNA, 64 nt, hsa; identical to SEQ ID NO: 245183

SEQ ID NO: 497867 - RNA, 64 nt, hsa; identical to SEQ ID NO: 245184

SEQ ID NO: 497868 - RNA, 64 nt, hsa; identical to SEQ ID NO: 245185

SEQ ID NO: 497869 - RNA, 64 nt, hsa; identical to SEQ ID NO: 245186

SEQ ID NO: 497870 - RNA, 64 nt, hsa; identical to SEQ ID NO: 245187

SEQ ID NO: 497871 - RNA, 64 nt, hsa; identical to SEQ ID NO: 245188

SEQ ID NO: 497872 - RNA, 62 nt, hsa; identical to SEQ ID NO: 245189

SEQ ID NO: 497873 - RNA, 64 nt, hsa; identical to SEQ ID NO: 245190

SEQ ID NO: 497874 - RNA, 64 nt, hsa; identical to SEQ ID NO: 245191

SEQ ID NO: 497875 - RNA, 64 nt, hsa; identical to SEQ ID NO: 245192

SEQ ID NO: 497876 - RNA, 64 nt, hsa; identical to SEQ ID NO: 245193

SEQ ID NO: 497877 - RNA, 64 nt, hsa; identical to SEQ ID NO: 245194

SEQ ID NO: 497878 - RNA, 64 nt, hsa; identical to SEQ ID NO: 245195

SEQ ID NO: 497879 - RNA, 64 nt, hsa; identical to SEQ ID NO: 245196

SEQ ID NO: 497880 - RNA, 64 nt, hsa; identical to SEQ ID NO: 245197

SEQ ID NO: 497881 - RNA, 64 nt, hsa; identical to SEQ ID NO: 245198

SEQ ID NO: 497882 - RNA, 64 nt, hsa; identical to SEQ ID NO: 245199

SEQ ID NO: 497883 - RNA, 64 nt, hsa; identical to SEQ ID NO: 245200

SEQ ID NO: 497884 - RNA, 64 nt, hsa; identical to SEQ ID NO: 245201

SEQ ID NO: 497885 - RNA, 64 nt, hsa; identical to SEQ ID NO: 245202

SEQ ID NO: 497886 - RNA, 64 nt, hsa; identical to SEQ ID NO: 245203

SEQ ID NO: 497887 - RNA, 64 nt, hsa; identical to SEQ ID NO: 245204

SEQ ID NO: 497888 - RNA, 64 nt, hsa; identical to SEQ ID NO: 245205

SEQ ID NO: 497889 - RNA, 64 nt, hsa; identical to SEQ ID NO: 245206

SEQ ID NO: 497890 - RNA, 64 nt, hsa; identical to SEQ ID NO: 245207

SEQ ID NO: 497891 - RNA, 64 nt, hsa; identical to SEQ ID NO: 245208

SEQ ID NO: 497892 - RNA, 64 nt, hsa; identical to SEQ ID NO: 245209

SEQ ID NO: 497893 - RNA, 64 nt, hsa; identical to SEQ ID NO: 245210

SEQ ID NO: 497894 - RNA, 64 nt, hsa; identical to SEQ ID NO: 245211

SEQ ID NO: 497895 - RNA, 64 nt, hsa; identical to SEQ ID NO: 24125

SEQ ID NO: 497896 - RNA, 64 nt, hsa; identical to SEQ ID NO: 24126

SEQ ID NO: 497897 - RNA, 64 nt, hsa; identical to SEQ ID NO: 24127

SEQ ID NO: 497898 - RNA, 64 nt, hsa; identical to SEQ ID NO: 24128

SEQ ID NO: 497899 - RNA, 64 nt, hsa; identical to SEQ ID NO: 24129

SEQ ID NO: 497900 - RNA, 64 nt, hsa; identical to SEQ ID NO: 24130

SEQ ID NO: 497901 - RNA, 64 nt, hsa; identical to SEQ ID NO: 24131

SEQ ID NO: 497902 - RNA, 64 nt, hsa; identical to SEQ ID NO: 24132

SEQ ID NO: 497903 - RNA, 64 nt, hsa; identical to SEQ ID NO: 24133

SEQ ID NO: 497904 - RNA, 64 nt, hsa; identical to SEQ ID NO: 24134

SEQ ID NO: 497905 - RNA, 64 nt, hsa; identical to SEQ ID NO: 24135

SEQ ID NO: 497906 - RNA, 64 nt, hsa; identical to SEQ ID NO: 24136

SEQ ID NO: 497907 - RNA, 64 nt, hsa; identical to SEQ ID NO: 24137

SEQ ID NO: 497908 - RNA, 64 nt, hsa; identical to SEQ ID NO: 24138

SEQ ID NO: 497909 - RNA, 64 nt, hsa; identical to SEQ ID NO: 24139

SEQ ID NO: 497910 - RNA, 64 nt, hsa; identical to SEQ ID NO: 24140

SEQ ID NO: 497911 - RNA, 64 nt, hsa; identical to SEQ ID NO: 24141

SEQ ID NO: 497912 - RNA, 64 nt, hsa; identical to SEQ ID NO: 24142

SEQ ID NO: 497913 - RNA, 64 nt, hsa; identical to SEQ ID NO: 24143

SEQ ID NO: 497914 - RNA, 64 nt, hsa; identical to SEQ ID NO: 24144

SEQ ID NO: 497915 - RNA, 64 nt, hsa; identical to SEQ ID NO: 24145

SEQ ID NO: 497916 - RNA, 64 nt, hsa; identical to SEQ ID NO: 24146

SEQ ID NO: 497917 - RNA, 64 nt, hsa; identical to SEQ ID NO: 24147

SEQ ID NO: 497918 - RNA, 64 nt, hsa; identical to SEQ ID NO: 24148

SEQ ID NO: 497919 - RNA, 64 nt, hsa; identical to SEQ ID NO: 24149

SEQ ID NO: 497920 - RNA, 64 nt, hsa; identical to SEQ ID NO: 24150

SEQ ID NO: 497921 - RNA, 64 nt, hsa; identical to SEQ ID NO: 24151

SEQ ID NO: 497922 - RNA, 64 nt, hsa; identical to SEQ ID NO: 24152

SEQ ID NO: 497923 - RNA, 64 nt, hsa; identical to SEQ ID NO: 24153

SEQ ID NO: 497924 - RNA, 64 nt, hsa; identical to SEQ ID NO: 24154

SEQ ID NO: 497925 - RNA, 64 nt, hsa; identical to SEQ ID NO: 24155

SEQ ID NO: 497926 - RNA, 64 nt, hsa; identical to SEQ ID NO: 24156

SEQ ID NO: 497927 - RNA, 64 nt, hsa; identical to SEQ ID NO: 24157

SEQ ID NO: 497928 - RNA, 64 nt, hsa; identical to SEQ ID NO: 24158

SEQ ID NO: 497929 - RNA, 64 nt, hsa; identical to SEQ ID NO: 24159

SEQ ID NO: 497930 - RNA, 64 nt, hsa; identical to SEQ ID NO: 24160

SEQ ID NO: 497931 - RNA, 64 nt, hsa; identical to SEQ ID NO: 352337

SEQ ID NO: 497932 - RNA, 64 nt, hsa; identical to SEQ ID NO: 352338

SEQ ID NO: 497933 - RNA, 60 nt, hsa
gcacaguggaagugggagccugguccuuccccugcccauggagagcucuuuaagggaucc

SEQ ID NO: 497934 - RNA, 60 nt, hsa
ccagcccccaggugaggcuuccagcugggaccugcccagacaggcugagccugggcgugg

SEQ ID NO: 497935 - RNA, 60 nt, hsa
agcccugcccgccucuccccccacgcucaaccugcccacuuguccaggccuggccucuuu

SEQ ID NO: 497936 - RNA, 60 nt, hsa
gcucacucugccaugagaacaggacaccauccugcccagcccagacgggguugcuccugg

SEQ ID NO: 497937 - RNA, 60 nt, hsa
cggcucuggcccacugagccaccgcgcccuccugcccacgggaggacaagcaauaacucu

SEQ ID NO: 497938 - RNA, 60 nt, hsa
cuuaggaaccuucucccuucuugggucugcccugcccauacugagccugccaaagugccu

SEQ ID NO: 497939 - RNA, 60 nt, hsa
agcaggugugguggcucauggcguaaugggccugcccaaugcuuugggaggccaaggcag

SEQ ID NO: 497940 - RNA, 60 nt, hsa
uugugacugaaggggcacaccacugcccugccugcccacuuagccguccauggcaccagc

SEQ ID NO: 497941 - RNA, 60 nt, hsa
ucuaggguuguccugccccuuggcucuaucccugcccagaggugggaacuggaggagugg

SEQ ID NO: 497942 - RNA, 60 nt, hsa
ccacacauuauagucaugugccaccaccuuccugcccacaggccgagggacagggugagg

SEQ ID NO: 497943 - RNA, 60 nt, hsa
gaugugacauggcuucuccucagggcaaccccugcccaacccucauccccaucuucucag

SEQ ID NO: 497944 - RNA, 60 nt, hsa
ccuccugggaccacugccaccugcaagagcccugcccaggagauagaagaccuggacucc

SEQ ID NO: 497945 - RNA, 60 nt, hsa
gugaaaggagggugaggcugccgaugccuuccugcccagaaguggaugaugugggaguug

SEQ ID NO: 497946 - RNA, 60 nt, hsa
aacuguccaagcucucagccccacagggaaccugcccagagagcuuuaccuuucccaagc

SEQ ID NO: 497947 - RNA, 60 nt, hsa
accccugcccuggcagccuggaagaccgugccugcccagcccucgucaccacagggacuc

SEQ ID NO: 497948 - RNA, 60 nt, hsa
accaccccggggucucuggggaacugucaaccugcccacgggacauguacauuuccccuu

SEQ ID NO: 497949 - RNA, 60 nt, hsa
ccauuccuuucuaaguguguuuuauggcauccugcccacaaagaacucacagucugauua

SEQ ID NO: 497950 - RNA, 60 nt, hsa
cacagguugacuaguaucuguggguaccucccugcccagguuauucacucacaagccacc

SEQ ID NO: 497951 - RNA, 56 nt, hsa; identical to SEQ ID NO: 77590

SEQ ID NO: 497952 - RNA, 60 nt, hsa
cacaacggucagcacuccucucccagccccccugcccacuguucucaauaaaaugugagu

SEQ ID NO: 497953 - RNA, 60 nt, hsa
ggguuggggaccgaaaggacagggaugccgccugcccaguguuucugggccucacggugc

SEQ ID NO: 497954 - RNA, 60 nt, hsa
auccccccggccaccucucuacccguccagccugcccagacccucucagaggaacggggu

SEQ ID NO: 497955 - RNA, 60 nt, hsa
gcaaggggcaaggcugggccccuagcuuguccugcccauuccuccagguguugaucuuga

SEQ ID NO: 497956 - RNA, 60 nt, hsa
ucccuggcaacaggaaccugggcagcuuauccugcccacagguaagccccugggagcauc

SEQ ID NO: 497957 - RNA, 60 nt, hsa
uucccuguguggucccucccuucgugugccccugcccagccucuuggcaccuccuguuua

SEQ ID NO: 497958 - RNA, 60 nt, hsa
ggguuucaaacaagacaaaaggcauuccucccugcccaaucccagugcagucaaggccaa

SEQ ID NO: 497959 - RNA, 60 nt, hsa
auggcaccuuucccuucugaaagucugguuccugcccagugacccuuggccuugugagcc

SEQ ID NO: 497960 - RNA, 60 nt, hsa
ccagccccacacccucauuuauaccaauuaccugcccaguaacuguggacuuuugcuucc

SEQ ID NO: 497961 - RNA, 60 nt, hsa
ccuuuccuaugggcaaggcccagugcucuuccugcccaccagggaccauggagcaguggc

SEQ ID NO: 497962 - RNA, 60 nt, hsa
ccagacugcaauaacuggaggcgccuccuuccugcccacccuucgcucacgccccagcgc

SEQ ID NO: 497963 - RNA, 60 nt, hsa
acccugccaggucccgcgcaccaucccugcccugcccacgugguauugcugggcuccugg

SEQ ID NO: 497964 - RNA, 60 nt, hsa
uccugaucagcccguaucaucugaggccugccugcccacccugccacccuccccucccuu

SEQ ID NO: 497965 - RNA, 60 nt, hsa
uagaugccaacuggagggccagaccuguguccugcccauguccuccuugguggacguuuc

SEQ ID NO: 497966 - RNA, 60 nt, hsa
uucuguuuacucagagcugcuagagaccauccugcccauccgaguucugagauugggacu

SEQ ID NO: 497967 - RNA, 60 nt, hsa
cugcuaugauggugguauccgaggccuuucccugcccagucuggugccugccccacauug

SEQ ID NO: 497968 - RNA, 60 nt, hsa
ggggauccaagaccugagauaaagcaacagccugcccagaucccucuguucauccuaucc

SEQ ID NO: 497969 - RNA, 60 nt, hsa
ccugccauugccuccucuccauugcagacgccugcccaucaaguauuaccugcggcgacu

SEQ ID NO: 497970 - RNA, 60 nt, hsa
ggcucaacuucaccaagaugcauucucauaccugcccacagcuccauuuuggaggcaggc

SEQ ID NO: 497971 - RNA, 60 nt, hsa
cuuccucaccucucagccuccagaucccuuccugcccaucccuucccuacaaugcccacu

SEQ ID NO: 497972 - RNA, 60 nt, hsa
ugugaguggcaaguggcuuaucuggagccaccugcccaagucuuacuaaaaugcagcugu

SEQ ID NO: 497973 - RNA, 60 nt, hsa
ugaaagaaagcacauccaaagcauaguuuaccugcccacgaguucuggaaagguggccuu

SEQ ID NO: 497974 - RNA, 60 nt, hsa
acuuuaggaacacaguuggaggucaccucuccugcccagcucccgcacccugcguuuagg

SEQ ID NO: 497975 - RNA, 60 nt, hsa
caguaguacaagcuccccucagccagccugccugcccagcgaggcccccagguucaaggu

SEQ ID NO: 497976 - RNA, 60 nt, hsa
caccugguacagguagguggcgcucacguuccugcccaaaugcagcccaucggggaguca

SEQ ID NO: 497977 - RNA, 60 nt, hsa
uaauaccauccugcccauuguccuuaccguccugcccauacagacuguggcuccuuccuc

SEQ ID NO: 497978 - RNA, 60 nt, hsa
ggagauggcauagagaagaucuaauaccauccugcccauuguccuuaccguccugcccau

SEQ ID NO: 497979 - RNA, 60 nt, hsa
cugcaugggagagcugucccuccuucuccaccugcccaccgggacacucccccugcucuc

SEQ ID NO: 497980 - RNA, 60 nt, hsa
ugccucguccaggucucuaucucccaaagaccugcccaccuccugggcucucccagggaa

SEQ ID NO: 497981 - RNA, 60 nt, hsa
cgcacacaagacgggagucacccugugcuuccugcccaagauacugacccauugaacccc

SEQ ID NO: 497982 - RNA, 60 nt, hsa
ccucucuggccauugcagagcugcuggccuccugcccagguggaggguccuggggacggc

SEQ ID NO: 497983 - RNA, 60 nt, hsa
agccccaaggcuggggccacagcuccuaccccugcccagcagcccugagcucagcugcag

SEQ ID NO: 497984 - RNA, 60 nt, hsa
cccgaguagagggcaucccggagcccccagccugcccacuacauccagccuguggcuuug

SEQ ID NO: 497985 - RNA, 60 nt, hsa
cugagaggccuaauagggcagagauggaggccugcccagacuaggaggcagcggggauag

SEQ ID NO: 497986 - RNA, 60 nt, hsa
cccaccuccgcauccacccccguccgccauccugcccaccaccaggucgguucccgaggc

SEQ ID NO: 497987 - RNA, 60 nt, hsa
aagggcuucgggggagugguuacccugcucccugcccagugacaagcccuccuuuccccu

SEQ ID NO: 497988 - RNA, 60 nt, hsa
uuccccugggggcccuccuuuccccugcucccugcccagcuacggggcccuccuuucagc

SEQ ID NO: 497989 - RNA, 60 nt, hsa
uuguccuggugcccaggagcccuccagcccccugcccacagaagggaaggccugcagagg

SEQ ID NO: 497990 - RNA, 60 nt, hsa
agcagugaagguucuucucugugugggugcccugcccacccccuccuuugccuguguccu

SEQ ID NO: 497991 - RNA, 60 nt, hsa
aagugagggaaaaacguuaggugcuaaccaccugcccagaagaguggaucucacagccca

SEQ ID NO: 497992 - RNA, 60 nt, hsa
caggaacccaagccaccccggcuccccucgccugcccaggggccguggugacucacgggc

SEQ ID NO: 497993 - RNA, 60 nt, hsa
ggcugucccuguggacccgccauccaccguccugcccacgccgccucagccugccaccuc

SEQ ID NO: 497994 - RNA, 60 nt, hsa
acuggguucucuccuucuucuuccugcuguccugcccaagaacugagggucuccccggcc

SEQ ID NO: 497995 - RNA, 60 nt, hsa
cugcccugccagagacagacccaugcgcugccugcccaccgugccccuuuguccccaugu

SEQ ID NO: 497996 - RNA, 60 nt, hsa
caaugucuaccucugaagccuccuucccugccugcccaccccuccaugcuccacgcaggc

SEQ ID NO: 497997 - RNA, 60 nt, hsa
ugagacuauuugcugugggcucuccuccagccugcccagggcccacccagaugccucugg

SEQ ID NO: 497998 - RNA, 60 nt, hsa
ccgggcacaagaaaccagaguccugcccagccugcccauccccuucccagucagggcucc

SEQ ID NO: 497999 - RNA, 60 nt, hsa
guagucuuuccgggcacaagaaaccagaguccugcccagccugcccauccccuucccagu

SEQ ID NO: 498000 - RNA, 60 nt, hsa
cagcuguggcauccacuguggcaucuccguccugcccaccuucuuaagaggcgagaugga

SEQ ID NO: 498001 - RNA, 60 nt, hsa
caauuuaaaaugauccauggccacagggcuccugcccaggggcuugucaccuuccccucc

SEQ ID NO: 498002 - RNA, 60 nt, hsa
ccauaccgggccucuggcccagaccuaagcccugcccacaaagacuaauggaugccagug

SEQ ID NO: 498003 - RNA, 60 nt, hsa
caaguacagccacuguaaauaacccucgucccugcccaggaacccagacuggacuucagu

SEQ ID NO: 498004 - RNA, 60 nt, hsa
uuugccuccugaggcgcagcgcacuccuccccugcccaagccuacugccucccgcugccg

SEQ ID NO: 498005 - RNA, 60 nt, hsa
cggcgcugcucagcuugggcugguccagggccugcccaggcuggggcaccuuugccuccu

SEQ ID NO: 498006 - RNA, 60 nt, hsa
cagcugccccauucuuuuaacguuguagggccugcccauggagcggacccuccucuuugg

SEQ ID NO: 498007 - RNA, 60 nt, hsa
uuuuuaggccucacucccaucagaacccugccugcccaccugcaacucccccccaacaau

SEQ ID NO: 498008 - RNA, 60 nt, hsa
cugccgggcacaugcccgggggacgccugcccugcccagguggccuccuggcccgcccuc

SEQ ID NO: 498009 - RNA, 60 nt, hsa
cggccggccggaccucugagcacauaguguccugcccacccuaccagcuccuccagcccu

SEQ ID NO: 498010 - RNA, 60 nt, hsa
uguugcacgggagaacuuuccucacccgccccugcccagacagggugaggaaagggcucc

SEQ ID NO: 498011 - RNA, 60 nt, hsa
aaucaaguaucugagccagaugcugcgggaccugcccagcugcccgugugccuacccacu

SEQ ID NO: 498012 - RNA, 60 nt, hsa
ugggaaguagagauguggcggcuuucccacccugcccacagcaggcccuccugcccagcu

SEQ ID NO: 498013 - RNA, 60 nt, hsa
ggcuuucccacccugcccacagcaggcccuccugcccagcugcucuugucagcccucugg

SEQ ID NO: 498014 - RNA, 60 nt, hsa
ugcccagagugaccaagcagcaccagcaggccugcccaggaugcugaaagcagauuucuu

SEQ ID NO: 498015 - RNA, 60 nt, hsa
uugccccacuggugagaggaggaccuugugccugcccagagccugcaggacagcacgccu

SEQ ID NO: 498016 - RNA, 60 nt, hsa
ugcugcuugcucagaaacaacccgugcaucccugcccauggauucugcaggaccuagaag

SEQ ID NO: 498017 - RNA, 60 nt, hsa
ccugccugggggcuaugugcacuccagaccccugcccaggcucaggcccaugagguaugg

SEQ ID NO: 498018 - RNA, 60 nt, hsa
gcagaggccaggaggggaccuggugugucaccugcccaccaccuggcucaucccucaggc

SEQ ID NO: 498019 - RNA, 60 nt, hsa
cuauccugucuguccccaccccagcuguccccugcccagggagcuggcauaaaagcacga

SEQ ID NO: 498020 - RNA, 60 nt, hsa
gcugcuugagaacagagacugcuaccccauccugcccaugcaggcaggcucuugccagcc

SEQ ID NO: 498021 - RNA, 60 nt, hsa
agagggcagacgccacccuggacugcucucccugcccagcugggccucucuggccuauuc

SEQ ID NO: 498022 - RNA, 60 nt, hsa
ccuguccccgggacugagcugccaugccagccugcccacagcagccuccuagaguuagca

SEQ ID NO: 498023 - RNA, 60 nt, hsa
aguagugacacucaggauccaaaagcuagcccugcccaccccagccccuggaccugcuua

SEQ ID NO: 498024 - RNA, 60 nt, hsa
gagcucgccugcccugcuuggcucugaggaccugcccagcgcucaaagggaacggaagcc

SEQ ID NO: 498025 - RNA, 60 nt, hsa
acuugcccuagcaugaggcucugagagccaccugcccaccaaucuggugaggauaauggu

SEQ ID NO: 498026 - RNA, 60 nt, hsa
cccuccauuccggaccccaugggcccagccccugcccaucuaguugguuuggggacccug

SEQ ID NO: 498027 - RNA, 60 nt, hsa
cacccugugacugagccuguguccugucugccugcccagccaugcuccaucggcugugag

SEQ ID NO: 498028 - RNA, 60 nt, hsa
uggcagccgccaggcgagcaggcugcuuucccugcccagucaugcaccucccccucuggg

SEQ ID NO: 498029 - RNA, 60 nt, hsa
cuggcaaucagggccgcaguguguucugcgccugcccagagcugacuccugauuuaaccg

SEQ ID NO: 498030 - RNA, 60 nt, hsa
guggauccuugccaggcgucccugauccucccugcccaagucuuccuucgugagcuggcc

SEQ ID NO: 498031 - RNA, 60 nt, hsa
gcacagccucccucccuccagcaagcccucccugcccagaaggaauggguccaggugugg

SEQ ID NO: 498032 - RNA, 60 nt, hsa
aagcccacaagaucugagugaaaaaagucaccugcccaauaaagcuugacaagacacucg

SEQ ID NO: 498033 - RNA, 60 nt, hsa
agcccccagcuggaaguuaagagaaagucaccugcccaagaaacaccgagugaggccaua

SEQ ID NO: 498034 - RNA, 60 nt, hsa
cugcagacgcagggggacugcacaauuccaccugcccaggaccugacccuggcgugugcu

SEQ ID NO: 498035 - RNA, 60 nt, hsa
ggauggcucuggccucgguccucccccaacccugcccaagccagacagacagcaccugca

SEQ ID NO: 498036 - RNA, 60 nt, hsa
uaucagacgugcucccucccauccuccagcccugcccacccucccuccacuccucucaac

SEQ ID NO: 498037 - RNA, 60 nt, hsa
gacccugaccguguacauagcccuggugcuccugcccagccaccccucagaugcguucgc

SEQ ID NO: 498038 - RNA, 60 nt, hsa
cugccccucuguucucuccccucacauccuccugcccagcuccucacauacccacacauu

SEQ ID NO: 498039 - RNA, 60 nt, hsa
gcguuccuucgcacacugugauuuugcccuccugcccacgcagaccugcagcgggcaaag

SEQ ID NO: 498040 - RNA, 60 nt, hsa
gguuggcuucuucccaggccuugcaugggcccugcccacaagcacacccucaggccgagg

SEQ ID NO: 498041 - RNA, 60 nt, hsa
cagugggguuugaagcagaguucagggaacccugcccaagguccuccuguucagacauuc

SEQ ID NO: 498042 - RNA, 60 nt, hsa
gacugggccgggcccagggccucuggcuucccugcccaauccucccuggagaagggacau

SEQ ID NO: 498043 - RNA, 60 nt, hsa
accacuagcuaagcaagccaggagaagaccccugcccaaguggcucuugggacaacgugc

SEQ ID NO: 498044 - RNA, 60 nt, hsa
cagguguggaccggccgcagcccccacugaccugcccauguccagagggacuggacagcc

SEQ ID NO: 498045 - RNA, 57 nt, hsa; identical to SEQ ID NO: 77684

SEQ ID NO: 498046 - RNA, 60 nt, hsa
ucagaguggcgugagcugcccggcgccugcccugcccaagugaccagggaagugugugug

SEQ ID NO: 498047 - RNA, 60 nt, hsa
guggccagcgccagggcccaggccauguggccugcccagccucaaugucacuugguggcg

SEQ ID NO: 498048 - RNA, 60 nt, hsa
ugucuuucugucuguuuaccugucucccugccugcccaucugcaucuuuugcagcccacu

SEQ ID NO: 498049 - RNA, 60 nt, hsa
accccgaagcccaccugcaaucucccaccuccugcccaucccucucuugagggagcagca

SEQ ID NO: 498050 - RNA, 60 nt, hsa
agaggccugaagcggaagcaccacaucgucccugcccaucucacucucucccuugaugau

SEQ ID NO: 498051 - RNA, 60 nt, hsa
gccacaggcauaugguggagagggggguacccugcccaccuuggggugguggcaccagag

SEQ ID NO: 498052 - RNA, 60 nt, hsa
ugggaaggucucugaucacacagaagcagcccugcccagccuggucauuugcuguccgcu

SEQ ID NO: 498053 - RNA, 60 nt, hsa
gcagggaagugaaaggucccaggcacacacccugcccauugcagguggcucuuacagcuc

SEQ ID NO: 498054 - RNA, 60 nt, hsa
cauaauccagugggggugacugggugcacaccugcccaggugaacacagcggcugccagu

SEQ ID NO: 498055 - RNA, 60 nt, hsa
cauugguuauaauaacaguuaucaguaauuccugcccagaagacuuuuauuuauuuuuuu

SEQ ID NO: 498056 - RNA, 60 nt, hsa
acaucuggagauacaggcccaccccucaguccugcccacagagaggcuuggucggucucc

SEQ ID NO: 498057 - RNA, 60 nt, hsa
aggcccugcugaaguccagacccucccccuccugcccacugugcucuaaacccugcucag

SEQ ID NO: 498058 - RNA, 60 nt, hsa
gcugcauucccuggagacucacugcaaguuccugcccaggaggcugagggcaccccaucc

SEQ ID NO: 498059 - RNA, 60 nt, hsa
gucguacacggagacuggcagcgccgacguccugcccaccacgcacucccggagagcacg

SEQ ID NO: 498060 - RNA, 60 nt, hsa
gaagcagcacgugugagcugggccaggagcccugcccaccuccgugcagcugaccugccc

SEQ ID NO: 498061 - RNA, 60 nt, hsa
augcugauacacacuguuguuaggccugcaccugcccauccagaaagcagcagcugccuu

SEQ ID NO: 498062 - RNA, 60 nt, hsa
cuccggcucacacacgcccugccugcccucccugcccagcuguaaggaccgggggucucc

SEQ ID NO: 498063 - RNA, 60 nt, hsa
auaaacagacccccuucugcuccgcuuccuccugcccagccaggcaacacccucaaccgg

SEQ ID NO: 498064 - RNA, 60 nt, hsa
caaaugcugagcccugauccaaaguugucuccugcccaugagcaccacagucaggccuug

SEQ ID NO: 498065 - RNA, 60 nt, hsa
uuagcccacaauucuccauuucacuugaccccugcccaccucuccaaccuaacuggcuua

SEQ ID NO: 498066 - RNA, 60 nt, hsa
cacacccugauagcacaaucuccuuggggcccugcccaccuccaggccucucccaccuca

SEQ ID NO: 498067 - RNA, 60 nt, hsa
accgaggccaccgccccccccuccgcugccccugcccaccccgaggcagggcuggggcuu

SEQ ID NO: 498068 - RNA, 60 nt, hsa
accaguccucccagggaguccucgagucgcccugcccagagcccuggcaccagagacgcc

SEQ ID NO: 498069 - RNA, 60 nt, hsa
acaaacaaaccaaccagagggagaagagccccugcccacugcacucuuugguucucugcu

SEQ ID NO: 498070 - RNA, 60 nt, hsa
cgcuuguugaagaugaauucuugaauucugccugcccacccccggccagaucccuggagc

SEQ ID NO: 498071 - RNA, 60 nt, hsa
ugcugcaggcauggcugucuccugccccugccugcccaucuggccuauaccccagccgug

SEQ ID NO: 498072 - RNA, 60 nt, hsa
ccuucugugaccccgcugugguaaguccagccugcccagggcugcugagggcugccucuu

SEQ ID NO: 498073 - RNA, 60 nt, hsa
uggcucaggcuguaaaaguagcugagccauccugcccauuccuggagguccuacagguga

SEQ ID NO: 498074 - RNA, 60 nt, hsa
uauagacguauccaaugggaaaacagcggaccugcccagagcagggaggugucguggaac

SEQ ID NO: 498075 - RNA, 60 nt, hsa
caucgucucaacaccaccaaguuuguaggaccugcccaaguucuaguaguauucaaaacu

SEQ ID NO: 498076 - RNA, 60 nt, hsa
cuugccugguuccauauggcuccuuccagcccugcccaccaagugcagcucccacuuucc

SEQ ID NO: 498077 - RNA, 60 nt, hsa
ugcccaccaagugcagcucccacuuuccauccugcccauacgccccucuucccccgacau

SEQ ID NO: 498078 - RNA, 60 nt, hsa
cagagcuucagugagguuuccgagccucucccugcccauccucaccacugaggccacgac

SEQ ID NO: 498079 - RNA, 60 nt, hsa
accgcucuccaaggugugcuagcagugggcccugcccaacuucaggcagaacagggaggc

SEQ ID NO: 498080 - RNA, 60 nt, hsa
ggccugggagucgggcggccccggucaggcccugcccagagagcuccugguuccugaacu

SEQ ID NO: 498081 - RNA, 60 nt, hsa
acccacccgaggcucugcccaccgccuggaccugcccaccccugaaagacuggccccugg

SEQ ID NO: 498082 - RNA, 60 nt, hsa
agguuccuggcgcccugagguggcucagcaccugcccaggguaggccuggcaugaggggu

SEQ ID NO: 498083 - RNA, 60 nt, hsa
cagauggccugccuuuggcugagagggcuaccugcccagccccucccccaacaagaucuc

SEQ ID NO: 498084 - RNA, 60 nt, hsa
cccugguauguuuuucuuauagauguuagcccugcccaacagccagggcuacacuacaaa

SEQ ID NO: 498085 - RNA, 60 nt, hsa
agacagcccagagccugccgcuacccucggccugcccaccaccaagcaagcagcaagcaa

SEQ ID NO: 498086 - RNA, 60 nt, hsa
guuuuguaccagucccugcucucaggccacccugcccaggacccaggcccgccucccccu

SEQ ID NO: 498087 - RNA, 60 nt, hsa
gggccaagcgcuggccccucagcggugagcccugcccacucuuaccgagcaaggugggug

SEQ ID NO: 498088 - RNA, 60 nt, hsa
gaggacagagugcccuggggcauccaccuuccugcccaggggacguggcgcugucggugu

SEQ ID NO: 498089 - RNA, 60 nt, hsa
gccccuggcccugccucacugugaccugcuccugcccacgugcagcaccugucaccuuuu

SEQ ID NO: 498090 - RNA, 60 nt, hsa
ggcugcucucggacuccugaucucaggugaccugcccaccucggccucccgaagugcugg

SEQ ID NO: 498091 - RNA, 60 nt, hsa
gcugggcauaagcuucacaggacgggagaaccugcccaugguggacugucguucuccaca

SEQ ID NO: 498092 - RNA, 60 nt, hsa
ucuccgagccccaggcagcggugauucagcccugcccaaccugauucugaugacugcgga

SEQ ID NO: 498093 - RNA, 60 nt, hsa
gggcgccugcugagcacuuccgccccucacccugcccagccccugccaugagcucugggc

SEQ ID NO: 498094 - RNA, 60 nt, hsa
uguccccucucuccacacccagccccugcuccugcccaggcugcccugcccagcgccuca

SEQ ID NO: 498095 - RNA, 60 nt, hsa
acacccagccccugcuccugcccaggcugcccugcccagcgccucaucagccucugccuu

SEQ ID NO: 498096 - RNA, 60 nt, hsa
cuuccccaucaggcugggcucuggcagggaccugcccaggauggagaugagagaggguga

SEQ ID NO: 498097 - RNA, 50 nt, hsa; identical to SEQ ID NO: 77736

SEQ ID NO: 498098 - RNA, 60 nt, hsa
ccacgcacgccccgugcuguguuccugggcccugcccauggccucaauaaacucucugcu

SEQ ID NO: 498099 - RNA, 60 nt, hsa
aggugcuacccggagccccauucacccccaccugcccacuugggaaucugaggcagagga

SEQ ID NO: 498100 - RNA, 60 nt, hsa
auccuggccccaccagggccuugggcaaguccugcccaccauaggccucugcuaccugcc

SEQ ID NO: 498101 - RNA, 60 nt, hsa
ugcacuggaguugucucuuaccccacccucccugcccaucaacuguaucugauuucacua

SEQ ID NO: 498102 - RNA, 60 nt, hsa
gggaggagcgucucaagugaacagugggagccugcccaccuggcacugcacuggaguugu

SEQ ID NO: 498103 - RNA, 60 nt, hsa
gacuugaggggggucauauucccuccucagccugcccacgcacuggccuucccuccugcc

SEQ ID NO: 498104 - RNA, 60 nt, hsa
cucucugccuaccugccugagccauguucaccugcccacuuguccccugcugccugccca

SEQ ID NO: 498105 - RNA, 60 nt, hsa
cauguucaccugcccacuuguccccugcugccugcccaaacaccccaccauuggccuguc

SEQ ID NO: 498106 - RNA, 64 nt, hsa; identical to SEQ ID NO: 272692

SEQ ID NO: 498107 - RNA, 64 nt, hsa; identical to SEQ ID NO: 272693

SEQ ID NO: 498108 - RNA, 64 nt, hsa; identical to SEQ ID NO: 272694

SEQ ID NO: 498109 - RNA, 64 nt, hsa; identical to SEQ ID NO: 272695

SEQ ID NO: 498110 - RNA, 57 nt, hsa; identical to SEQ ID NO: 272696

SEQ ID NO: 498111 - RNA, 64 nt, hsa; identical to SEQ ID NO: 272697

SEQ ID NO: 498112 - RNA, 64 nt, hsa; identical to SEQ ID NO: 272698

SEQ ID NO: 498113 - RNA, 64 nt, hsa; identical to SEQ ID NO: 272699

SEQ ID NO: 498114 - RNA, 64 nt, hsa; identical to SEQ ID NO: 272700

SEQ ID NO: 498115 - RNA, 64 nt, hsa; identical to SEQ ID NO: 272701

SEQ ID NO: 498116 - RNA, 64 nt, hsa; identical to SEQ ID NO: 272702

SEQ ID NO: 498117 - RNA, 64 nt, hsa; identical to SEQ ID NO: 272703

SEQ ID NO: 498118 - RNA, 64 nt, hsa; identical to SEQ ID NO: 272704

SEQ ID NO: 498119 - RNA, 64 nt, hsa; identical to SEQ ID NO: 272705

SEQ ID NO: 498120 - RNA, 64 nt, hsa; identical to SEQ ID NO: 272706

SEQ ID NO: 498121 - RNA, 64 nt, hsa; identical to SEQ ID NO: 272707

SEQ ID NO: 498122 - RNA, 64 nt, hsa; identical to SEQ ID NO: 272708

SEQ ID NO: 498123 - RNA, 64 nt, hsa; identical to SEQ ID NO: 272709

SEQ ID NO: 498124 - RNA, 64 nt, hsa; identical to SEQ ID NO: 272710

SEQ ID NO: 498125 - RNA, 64 nt, hsa; identical to SEQ ID NO: 272711

SEQ ID NO: 498126 - RNA, 64 nt, hsa; identical to SEQ ID NO: 272712

SEQ ID NO: 498127 - RNA, 64 nt, hsa; identical to SEQ ID NO: 272713

SEQ ID NO: 498128 - RNA, 64 nt, hsa; identical to SEQ ID NO: 61300

SEQ ID NO: 498129 - RNA, 64 nt, hsa; identical to SEQ ID NO: 61301

SEQ ID NO: 498130 - RNA, 64 nt, hsa; identical to SEQ ID NO: 61302

SEQ ID NO: 498131 - RNA, 64 nt, hsa; identical to SEQ ID NO: 61303

SEQ ID NO: 498132 - RNA, 64 nt, hsa; identical to SEQ ID NO: 61304

SEQ ID NO: 498133 - RNA, 64 nt, hsa; identical to SEQ ID NO: 61305

SEQ ID NO: 498134 - RNA, 64 nt, hsa; identical to SEQ ID NO: 61306

SEQ ID NO: 498135 - RNA, 64 nt, hsa; identical to SEQ ID NO: 61307

SEQ ID NO: 498136 - RNA, 64 nt, hsa; identical to SEQ ID NO: 61308

SEQ ID NO: 498137 - RNA, 64 nt, hsa; identical to SEQ ID NO: 61309

SEQ ID NO: 498138 - RNA, 64 nt, hsa; identical to SEQ ID NO: 61310

SEQ ID NO: 498139 - RNA, 56 nt, hsa; identical to SEQ ID NO: 61311

SEQ ID NO: 498140 - RNA, 64 nt, hsa; identical to SEQ ID NO: 61312

SEQ ID NO: 498141 - RNA, 64 nt, hsa; identical to SEQ ID NO: 61313

SEQ ID NO: 498142 - RNA, 64 nt, hsa; identical to SEQ ID NO: 61314

SEQ ID NO: 498143 - RNA, 64 nt, hsa; identical to SEQ ID NO: 61315

SEQ ID NO: 498144 - RNA, 64 nt, hsa; identical to SEQ ID NO: 61316

SEQ ID NO: 498145 - RNA, 64 nt, hsa; identical to SEQ ID NO: 61317

SEQ ID NO: 498146 - RNA, 64 nt, hsa; identical to SEQ ID NO: 158971

SEQ ID NO: 498147 - RNA, 64 nt, hsa; identical to SEQ ID NO: 158972

SEQ ID NO: 498148 - RNA, 64 nt, hsa; identical to SEQ ID NO: 158973

SEQ ID NO: 498149 - RNA, 64 nt, hsa; identical to SEQ ID NO: 158974

SEQ ID NO: 498150 - RNA, 64 nt, hsa; identical to SEQ ID NO: 158975

SEQ ID NO: 498151 - RNA, 64 nt, hsa; identical to SEQ ID NO: 158976

SEQ ID NO: 498152 - RNA, 64 nt, hsa; identical to SEQ ID NO: 158977

SEQ ID NO: 498153 - RNA, 64 nt, hsa; identical to SEQ ID NO: 158978

SEQ ID NO: 498154 - RNA, 64 nt, hsa; identical to SEQ ID NO: 158979

SEQ ID NO: 498155 - RNA, 64 nt, hsa; identical to SEQ ID NO: 158980

SEQ ID NO: 498156 - RNA, 64 nt, hsa; identical to SEQ ID NO: 158981

SEQ ID NO: 498157 - RNA, 64 nt, hsa; identical to SEQ ID NO: 158982

SEQ ID NO: 498158 - RNA, 64 nt, hsa; identical to SEQ ID NO: 158983

SEQ ID NO: 498159 - RNA, 64 nt, hsa; identical to SEQ ID NO: 158984

SEQ ID NO: 498160 - RNA, 64 nt, hsa; identical to SEQ ID NO: 158985

SEQ ID NO: 498161 - RNA, 64 nt, hsa; identical to SEQ ID NO: 158986

SEQ ID NO: 498162 - RNA, 64 nt, hsa; identical to SEQ ID NO: 158987

SEQ ID NO: 498163 - RNA, 64 nt, hsa; identical to SEQ ID NO: 158988

SEQ ID NO: 498164 - RNA, 64 nt, hsa; identical to SEQ ID NO: 158989

SEQ ID NO: 498165 - RNA, 64 nt, hsa; identical to SEQ ID NO: 158990

SEQ ID NO: 498166 - RNA, 64 nt, hsa; identical to SEQ ID NO: 158991

SEQ ID NO: 498167 - RNA, 64 nt, hsa; identical to SEQ ID NO: 158992

SEQ ID NO: 498168 - RNA, 64 nt, hsa; identical to SEQ ID NO: 158993

SEQ ID NO: 498169 - RNA, 64 nt, hsa; identical to SEQ ID NO: 158994

SEQ ID NO: 498170 - RNA, 64 nt, hsa; identical to SEQ ID NO: 158995

SEQ ID NO: 498171 - RNA, 64 nt, hsa; identical to SEQ ID NO: 158996

SEQ ID NO: 498172 - RNA, 64 nt, hsa; identical to SEQ ID NO: 158997

SEQ ID NO: 498173 - RNA, 64 nt, hsa; identical to SEQ ID NO: 158998

SEQ ID NO: 498174 - RNA, 64 nt, hsa; identical to SEQ ID NO: 158999

SEQ ID NO: 498175 - RNA, 64 nt, hsa; identical to SEQ ID NO: 159000

SEQ ID NO: 498176 - RNA, 64 nt, hsa; identical to SEQ ID NO: 159001

SEQ ID NO: 498177 - RNA, 64 nt, hsa; identical to SEQ ID NO: 159002

SEQ ID NO: 498178 - RNA, 64 nt, hsa; identical to SEQ ID NO: 159003

SEQ ID NO: 498179 - RNA, 64 nt, hsa; identical to SEQ ID NO: 159004

SEQ ID NO: 498180 - RNA, 64 nt, hsa; identical to SEQ ID NO: 159005

SEQ ID NO: 498181 - RNA, 64 nt, hsa; identical to SEQ ID NO: 159006

SEQ ID NO: 498182 - RNA, 64 nt, hsa; identical to SEQ ID NO: 159007

SEQ ID NO: 498183 - RNA, 64 nt, hsa; identical to SEQ ID NO: 159008

SEQ ID NO: 498184 - RNA, 63 nt, hsa
caccugcucuuuggcuaagguggcaguguaccucuagaucaaccugggaacagucacaaggga

SEQ ID NO: 498185 - RNA, 63 nt, hsa
gcacagaggacaaaguuaauucaaaaagaggcgcuagaucaaggucacagcacugccuacacc

SEQ ID NO: 498186 - RNA, 63 nt, hsa
uuuuaaagggggaggggaaggcuuuaauguguucuagaucaauuuauaccuuccguaugacgu

SEQ ID NO: 498187 - RNA, 63 nt, hsa
agaaagaugggguuguuuuccaaaguuuaaguucuagaucacaauaucuuagcuuuuagcacu

SEQ ID NO: 498188 - RNA, 63 nt, hsa
cucugagagucuagauucucuggcuguaaggcucuagaucauaaggcuucaaaauguuaucuu

SEQ ID NO: 498189 - RNA, 63 nt, hsa
cucuaagaucuuagauucucugugucuaagauucuagaucagaugcuccaagauucuagauga

SEQ ID NO: 498190 - RNA, 64 nt, hsa
cacaccuuuuugaaaucugcccuacaaaauuuguuuggcuuaaacgucaaaagccgugacaauu

SEQ ID NO: 498191 - RNA, 64 nt, hsa
uuggcucuagaucuacauucuucaaaaaaaaaaauuggcuuaacuguuucaucuuuaaguagca

SEQ ID NO: 498192 - RNA, 64 nt, hsa
aagaauaggaauaguuccacaacauccuguaacauuggcuuaccuguauauuauaugccacccg

SEQ ID NO: 498193 - RNA, 64 nt, hsa
uguaauugugugccugacggcuguagcuacuaacuuggcuuacguugacuggcuacuaagggac

SEQ ID NO: 498194 - RNA, 64 nt, hsa
ucuuguguccaggcuggagugcaguggcacuaucuuggcuuacugcaaccuccaccuccugggu

SEQ ID NO: 498195 - RNA, 64 nt, hsa
ccaaaugguuuaguaguucuucacuuugcugugguuggcuuaagagguuugucuuuuguuuuug

SEQ ID NO: 498196 - RNA, 64 nt, hsa
uuuaaaaaauaaaaaauaagcuuaccuuggauucuuggcuuagaguagagguuuuuuuuaaguu

SEQ ID NO: 498197 - RNA, 64 nt, hsa
aagaaaucacagaagcauuucucaccaauacucuuuggcuuaaaauguucagcagaauugggca

SEQ ID NO: 498198 - RNA, 64 nt, hsa
cccugggagagaaaaacaugcuaaaggagguaucuuggcuuaauaauuccuuauagccaauauc

SEQ ID NO: 498199 - RNA, 64 nt, hsa
agcuuuccuucauaaaauagaaagaaaaaaacauuuggcuuauuuuucacuguagcuagucuuu

SEQ ID NO: 498200 - RNA, 64 nt, hsa
ggggagagauuuuucuuuuaagcccugcucuuucucugagaaccaaaagaugccuugaauauuu

SEQ ID NO: 498201 - RNA, 64 nt, hsa
acaggccagccuuggcacgaggggggccagggguucugagaagcgcugcccugugagagccacg

SEQ ID NO: 498202 - RNA, 64 nt, hsa
ccuugggagaggccaaagagccauucuagcaugaucugagaaaaccuuccugcagaggccagaa

SEQ ID NO: 498203 - RNA, 64 nt, hsa
cuaauuuuugccacgugucacaacuuuuccagucucugagaaggucccagccuuucucaaauau

SEQ ID NO: 498204 - RNA, 64 nt, hsa
gauucucuggucacagguuuuugcccagggaaauucugagaaauucacaauuucuuaccagaua

SEQ ID NO: 498205 - RNA, 64 nt, hsa
aagccagaguaugaaguggaaugaaugcuccuguucugagaagcacacuuguaacugcaucuuu

SEQ ID NO: 498206 - RNA, 64 nt, hsa
guuaagccauguagagacucguguccugagugggucugagaauuuggcaaagacuuacugguug

SEQ ID NO: 498207 - RNA, 64 nt, hsa
uauaccugccaaucacccaaagaaaauaauagcuucugagaaagcucaauucacuguagcaacu

SEQ ID NO: 498208 - RNA, 64 nt, hsa
ugucuucucagaaaccaccaaccuugaagugucuucugagaaaccaccaggcuugaagguaaug

SEQ ID NO: 498209 - RNA, 64 nt, hsa
aaacaaggauggagaaaaaucuaggacagugucuucugagaaaccaccaggcuugaagguaaug

SEQ ID NO: 498210 - RNA, 64 nt, hsa
gggaggugaggagcaacucugcccagccgccccgucugagaagugaggagacccuccgccuggc

SEQ ID NO: 498211 - RNA, 64 nt, hsa
aaguaaggagccccucugcccagcagccgccccgucugagaagugaggagccccucugcccagc

SEQ ID NO: 498212 - RNA, 53 nt, hsa
gucaagaaucauggaaguaaacaucugagaaaccuguugaagauuauuucauu

SEQ ID NO: 498213 - RNA, 64 nt, hsa
aaacucuucaguuaauucuuagauacacuaaaaaucugagaaacucuacauguaacuauuucuu

SEQ ID NO: 498214 - RNA, 64 nt, hsa
cagucucuucccugacagggcagcucagggaacuucugagaaguuaucugcagagagccccacc

SEQ ID NO: 498215 - RNA, 64 nt, hsa
gagcccucauccugcaggcagagccccucagugcucugagaaaccugcccugaacucaccgccu

SEQ ID NO: 498216 - RNA, 64 nt, hsa
acaaaaagccaggucuuagcgggcucuuagaaacucugagaauuuucuucagauucauugagag

SEQ ID NO: 498217 - RNA, 64 nt, hsa
uacuaccugacgggaggcacuuuucacuuugaugucugagaaucaguucaaggcauaugcagag

SEQ ID NO: 498218 - RNA, 64 nt, hsa
auagacacaucggcuguucacacguuccccgcaaucugagaacgaacaggaauggagagaggac

SEQ ID NO: 498219 - RNA, 64 nt, hsa
cugcucugguugaccugggcugguuuucccugucucugagaacuugagaccuagcuccgaguug

SEQ ID NO: 498220 - RNA, 64 nt, hsa
acagugucaucuaaauauuccgaauguuuggccuucugagaaaagagcuucuaguaauugaacc

SEQ ID NO: 498221 - RNA, 64 nt, hsa
guaaugugcauucaggugaauuuucagcugaggcucugagaacugguacucucaguguguucug

SEQ ID NO: 498222 - RNA, 64 nt, hsa
gucccaucucccagcgacuuccaauauucauguuucugagaauugugucccucuucagguuccc

SEQ ID NO: 498223 - RNA, 64 nt, hsa
agcuuaauaacaacacuuauugcaccugucucucucugagaacacggugugucucgacacguac

SEQ ID NO: 498224 - RNA, 64 nt, hsa
uuguuuagaauuacaaaauaguuuuuaaauauugucugagaaaagccaaaguuaaugcaaccua

SEQ ID NO: 498225 - RNA, 64 nt, hsa
caaauuuacaucaaagauaccugaaguguugguaucugagaauaucugucacuccucuuaucug

SEQ ID NO: 498226 - RNA, 64 nt, hsa
uguugguaucugagaauaucugucacuccucuuaucugagaagugaccuuuuauuuuuaagaug

SEQ ID NO: 498227 - RNA, 64 nt, hsa
uucugcuggggccaugaaggcagaagguuuagccucugagaagcccucuucuucccccaccccu

SEQ ID NO: 498228 - RNA, 64 nt, hsa
cucucugucugcaccagggaguaguacccccagcucugagaaagaggcggcauccccuaggcca

SEQ ID NO: 498229 - RNA, 64 nt, hsa
agcccugucugucuccaccccauccccucuugucucugagaaccauucucccaccccaaguucc

SEQ ID NO: 498230 - RNA, 64 nt, hsa
cuccccuggugucuguacuguguacacacaucccucugagaagcacaaggagacgacacgcgca

SEQ ID NO: 498231 - RNA, 64 nt, hsa
ucuucauauccuucaucagguguuuuaagaugucucugagaagccaucaaggcaaaagagaacu

SEQ ID NO: 498232 - RNA, 64 nt, hsa
gggggguguugugguuuuuuguuuuuguuuugcuucugagaaagcauuugccuuucuuccucuc

SEQ ID NO: 498233 - RNA, 64 nt, hsa
guuuucuauucucugagaagauaaguuuguauguucugagaauaaauacaugaauauuaagacu

SEQ ID NO: 498234 - RNA, 64 nt, hsa
cuuugucacugagugaaaucucuguuuucuauucucugagaagauaaguuuguauguucugaga

SEQ ID NO: 498235 - RNA, 64 nt, hsa
uaacagugcagauuccacguucuuguuccgauacucugagaagugccugauguugauguacuua

SEQ ID NO: 498236 - RNA, 64 nt, hsa
guguugaaauccugucaugaauccuugguagcucucugagaacagugaaguccagggaaaggca

SEQ ID NO: 498237 - RNA, 64 nt, hsa
cuugaguaugaguuauguuuagucacugucagcaucugagaacuuuaauaagcccuugagauau

SEQ ID NO: 498238 - RNA, 64 nt, hsa
uagggucugccugucuacauauuuuuuauuuuuuucugagaaauucugaacacauagaucucuu

SEQ ID NO: 498239 - RNA, 64 nt, hsa
gggaggugaggagcgucucugucuggccaccccgucugagaagugaggagaccuccgcccggca

SEQ ID NO: 498240 - RNA, 64 nt, hsa
gaagugaggagaccuccgcccggcagccgcccugucugagaagugaggagccccuccgcccggc

SEQ ID NO: 498241 - RNA, 64 nt, hsa
cugcccggggagcugcagagcagcagcaccuuucucugagaagagguccuugguugggucaagg

SEQ ID NO: 498242 - RNA, 64 nt, hsa
gccacccugcugcacuaggacuugguaagaugacucugagaaaaugcgagacucugauggaaug

SEQ ID NO: 498243 - RNA, 64 nt, hsa
aauauaaaguaggcauggcuucccaauggaaaucucugagaaugacaguggaguugugcaagca

SEQ ID NO: 498244 - RNA, 64 nt, hsa
aagggcugugccccaauggaaacugaguucauuuucugagaaagguuuggaugacugaaauauu

SEQ ID NO: 498245 - RNA, 64 nt, hsa
cagugaacagaaaggagcagagagcaagauuagaucugagaagaugcucuggggacugagccca

SEQ ID NO: 498246 - RNA, 64 nt, hsa
uggggcacucccagaccugccaugcaguuuauccucugagaauggaauuggaaaugaagaccua

SEQ ID NO: 498247 - RNA, 64 nt, hsa
acucaucuuuuuaaaguauaguuacugaacugauucugagaaaucuuuagagagaaaaaacuca

SEQ ID NO: 498248 - RNA, 64 nt, hsa
aguaaguaaaaggaccauagaggggaaccaggaaucugagaaucagcugugcucaauagccaac

SEQ ID NO: 498249 - RNA, 64 nt, hsa
gggcucuaaaaaaagccccaaaaggagaagaacaucugagaaccuccucggcccucccaguccc

SEQ ID NO: 498250 - RNA, 64 nt, hsa
uugagauuuuuaucucuugauucuucaaaagcauucugagaaggugagauaagcccugagucuc

SEQ ID NO: 498251 - RNA, 64 nt, hsa
gaauucuguaggcuaaaaauauucauguagcaaaucugagaauugaaaacugcagauaaccggc

SEQ ID NO: 498252 - RNA, 64 nt, hsa
ccucccucacugaauguagaaucguugccaaguuucugagaagugucgauucccuguuaacaug

SEQ ID NO: 498253 - RNA, 64 nt, hsa
ggugucucugagaauccaaacauccuggagaguaucugagaaccaaccaaguaaaagucucguu

SEQ ID NO: 498254 - RNA, 64 nt, hsa
cauuuccauggugcccagcugaggaccaggugucucugagaauccaaacauccuggagaguauc

SEQ ID NO: 498255 - RNA, 64 nt, hsa
uaaagaucacaccaauuuagaaugaauauuaaagucugagaaauuuacaaaagggacucuaugg

SEQ ID NO: 498256 - RNA, 64 nt, hsa
acacauggcacuuggaagaaaaagacccacugaaucugagaaaguacuuucugguggcaaauga

SEQ ID NO: 498257 - RNA, 64 nt, hsa; identical to SEQ ID NO: 141261

SEQ ID NO: 498258 - RNA, 64 nt, hsa; identical to SEQ ID NO: 141262

SEQ ID NO: 498259 - RNA, 64 nt, hsa; identical to SEQ ID NO: 141263

SEQ ID NO: 498260 - RNA, 64 nt, hsa; identical to SEQ ID NO: 141264

SEQ ID NO: 498261 - RNA, 64 nt, hsa; identical to SEQ ID NO: 141265

SEQ ID NO: 498262 - RNA, 64 nt, hsa; identical to SEQ ID NO: 141266

SEQ ID NO: 498263 - RNA, 64 nt, hsa; identical to SEQ ID NO: 141267

SEQ ID NO: 498264 - RNA, 64 nt, hsa; identical to SEQ ID NO: 141268

SEQ ID NO: 498265 - RNA, 64 nt, hsa; identical to SEQ ID NO: 141269

SEQ ID NO: 498266 - RNA, 64 nt, hsa; identical to SEQ ID NO: 141270

SEQ ID NO: 498267 - RNA, 64 nt, hsa; identical to SEQ ID NO: 141271

SEQ ID NO: 498268 - RNA, 64 nt, hsa; identical to SEQ ID NO: 141272

SEQ ID NO: 498269 - RNA, 64 nt, hsa; identical to SEQ ID NO: 141273

SEQ ID NO: 498270 - RNA, 64 nt, hsa; identical to SEQ ID NO: 141274

SEQ ID NO: 498271 - RNA, 64 nt, hsa; identical to SEQ ID NO: 141275

SEQ ID NO: 498272 - RNA, 64 nt, hsa; identical to SEQ ID NO: 141276

SEQ ID NO: 498273 - RNA, 64 nt, hsa; identical to SEQ ID NO: 141277

SEQ ID NO: 498274 - RNA, 64 nt, hsa; identical to SEQ ID NO: 141278

SEQ ID NO: 498275 - RNA, 64 nt, hsa; identical to SEQ ID NO: 141279

SEQ ID NO: 498276 - RNA, 56 nt, hsa; identical to SEQ ID NO: 141280

SEQ ID NO: 498277 - RNA, 64 nt, hsa; identical to SEQ ID NO: 141281

SEQ ID NO: 498278 - RNA, 64 nt, hsa; identical to SEQ ID NO: 141282

SEQ ID NO: 498279 - RNA, 64 nt, hsa; identical to SEQ ID NO: 141283

SEQ ID NO: 498280 - RNA, 64 nt, hsa; identical to SEQ ID NO: 141284

SEQ ID NO: 498281 - RNA, 64 nt, hsa; identical to SEQ ID NO: 141285

SEQ ID NO: 498282 - RNA, 64 nt, hsa; identical to SEQ ID NO: 141286

SEQ ID NO: 498283 - RNA, 64 nt, hsa; identical to SEQ ID NO: 141287

SEQ ID NO: 498284 - RNA, 64 nt, hsa; identical to SEQ ID NO: 141288

SEQ ID NO: 498285 - RNA, 64 nt, hsa; identical to SEQ ID NO: 141289

SEQ ID NO: 498286 - RNA, 64 nt, hsa; identical to SEQ ID NO: 141290

SEQ ID NO: 498287 - RNA, 64 nt, hsa; identical to SEQ ID NO: 141291

SEQ ID NO: 498288 - RNA, 64 nt, hsa; identical to SEQ ID NO: 141292

SEQ ID NO: 498289 - RNA, 64 nt, hsa; identical to SEQ ID NO: 141293

SEQ ID NO: 498290 - RNA, 64 nt, hsa; identical to SEQ ID NO: 141294

SEQ ID NO: 498291 - RNA, 64 nt, hsa; identical to SEQ ID NO: 141295

SEQ ID NO: 498292 - RNA, 64 nt, hsa; identical to SEQ ID NO: 141296

SEQ ID NO: 498293 - RNA, 64 nt, hsa; identical to SEQ ID NO: 141297

SEQ ID NO: 498294 - RNA, 64 nt, hsa; identical to SEQ ID NO: 141298

SEQ ID NO: 498295 - RNA, 64 nt, hsa; identical to SEQ ID NO: 141299

SEQ ID NO: 498296 - RNA, 50 nt, hsa; identical to SEQ ID NO: 141300

SEQ ID NO: 498297 - RNA, 64 nt, hsa; identical to SEQ ID NO: 141301

SEQ ID NO: 498298 - RNA, 64 nt, hsa; identical to SEQ ID NO: 141302

SEQ ID NO: 498299 - RNA, 64 nt, hsa; identical to SEQ ID NO: 141303

SEQ ID NO: 498300 - RNA, 64 nt, hsa; identical to SEQ ID NO: 141304

SEQ ID NO: 498301 - RNA, 64 nt, hsa; identical to SEQ ID NO: 141305

SEQ ID NO: 498302 - RNA, 64 nt, hsa; identical to SEQ ID NO: 141306

SEQ ID NO: 498303 - RNA, 64 nt, hsa; identical to SEQ ID NO: 141307

SEQ ID NO: 498304 - RNA, 64 nt, hsa; identical to SEQ ID NO: 141308

SEQ ID NO: 498305 - RNA, 64 nt, hsa; identical to SEQ ID NO: 141309

SEQ ID NO: 498306 - RNA, 64 nt, hsa; identical to SEQ ID NO: 141310

SEQ ID NO: 498307 - RNA, 64 nt, hsa; identical to SEQ ID NO: 141311

SEQ ID NO: 498308 - RNA, 64 nt, hsa; identical to SEQ ID NO: 141312

SEQ ID NO: 498309 - RNA, 64 nt, hsa; identical to SEQ ID NO: 141313

SEQ ID NO: 498310 - RNA, 64 nt, hsa; identical to SEQ ID NO: 141314

SEQ ID NO: 498311 - RNA, 64 nt, hsa; identical to SEQ ID NO: 141315

SEQ ID NO: 498312 - RNA, 64 nt, hsa; identical to SEQ ID NO: 141316

SEQ ID NO: 498313 - RNA, 64 nt, hsa; identical to SEQ ID NO: 141317

SEQ ID NO: 498314 - RNA, 64 nt, hsa; identical to SEQ ID NO: 141318

SEQ ID NO: 498315 - RNA, 64 nt, hsa; identical to SEQ ID NO: 141319

SEQ ID NO: 498316 - RNA, 64 nt, hsa; identical to SEQ ID NO: 141320

SEQ ID NO: 498317 - RNA, 64 nt, hsa
agaugggcgcucccgacacagcgcagacccaccaggaggaaagaggcccagcucucagcugacg

SEQ ID NO: 498318 - RNA, 64 nt, hsa
uccugguucucaccaggaaaacauccaaagcuuuggaggaaacaggcccugccccuggcuccuu

SEQ ID NO: 498319 - RNA, 64 nt, hsa
gagcuauuuauauauauuauuuuuuuuuaagaaaggaggaaaagaaaccaaaaguuuuuuuuaa

SEQ ID NO: 498320 - RNA, 64 nt, hsa
ugugcaauaugcccccugggucccaggagggucuggaggaaaacuggcuaucagaaccuccuga

SEQ ID NO: 498321 - RNA, 64 nt, hsa
aaaucauuaugucauuccauaaugacugaaucaaggaggaaaauaugguguuuggaauguuaga

SEQ ID NO: 498322 - RNA, 64 nt, hsa
acacgcccuauuuaaaaaagagcaguacauccugggaggaaaugaaacuaaagaacaguuagag

SEQ ID NO: 498323 - RNA, 64 nt, hsa
ccguguagacacuaaaccucaugcccuaaggacaggaggaaagacccucuguuuggagcauuau

SEQ ID NO: 498324 - RNA, 64 nt, hsa
aguuggguggacauaaaugagucaagugacaacaggaggaaauagacuuagacgaaagaaagga

SEQ ID NO: 498325 - RNA, 64 nt, hsa
guccuuguugauguuucuucuccuagccacacuuggaggaaaguugcagguggguugggcaggg

SEQ ID NO: 498326 - RNA, 64 nt, hsa
ugcugccaggauggagcagaggagcgccacacauggaggaaagccccuguaacguuaccuaccu

SEQ ID NO: 498327 - RNA, 64 nt, hsa
agugcuagagcuugaagccacucaagccaguuggggaggaaagggaugcggagguacccucuag

SEQ ID NO: 498328 - RNA, 64 nt, hsa
aaguaaggaagguacugcggacagugugggccagggaggaaaaccagagcacacaguuuuguca

SEQ ID NO: 498329 - RNA, 64 nt, hsa
aaucugcagcaugcuauagaaaguggggaggaagggaggaaaaauaauuacagucaaaauauuu

SEQ ID NO: 498330 - RNA, 64 nt, hsa
uuauaauauuuugugccuugaagggaaugucacaggaggaaaaggaagacuaaagccugcauac

SEQ ID NO: 498331 - RNA, 64 nt, hsa
cagagguucaugggacacaguuggaaagccacugggaggaaaugccucacuacaggggggccuc

SEQ ID NO: 498332 - RNA, 64 nt, hsa
agccccugacagaaaaaggaucucugagccuaaaggaggaaaagucccaccaacuaccagacca

SEQ ID NO: 498333 - RNA, 64 nt, hsa
agcuaagaggaggaaaaaaaggcugaaaaaauagggaggaaauuccuucaucagaacgacuuca

SEQ ID NO: 498334 - RNA, 64 nt, hsa
gggcaguaucuuccugaugucuucuuagcuaagaggaggaaaaaaaggcugaaaaaauagggag

SEQ ID NO: 498335 - RNA, 64 nt, hsa
uguaaaguggcccccugcggcccuagccugacccggaggaaaggaugguagauucuguuaacuc

SEQ ID NO: 498336 - RNA, 64 nt, hsa
aauuaaggucaagcccagaaagugauaagugcagggaggaaaagugcaaguccauuauguaaua

SEQ ID NO: 498337 - RNA, 64 nt, hsa
aaagaaauuccuauuugaaaugaauuccucauuuggaggaaaaaaagcaugcauucuagcacaa

SEQ ID NO: 498338 - RNA, 64 nt, hsa
gcugcaaguuagugaaacagcugucuccguaaauggaggaaauguggggaagccuuggaaugcc

SEQ ID NO: 498339 - RNA, 64 nt, hsa
aacuaaauuuuaaugaacgaaugaaugacagagaggaggaaaaaagaugaggauugcauacaug

SEQ ID NO: 498340 - RNA, 64 nt, hsa
auuuaaguggauugaauaacugagucuacauggaggaggaaaugcuagagaacagcaggucuaa

SEQ ID NO: 498341 - RNA, 64 nt, hsa
uaauguacaacugacacugccauuuuuccuuuuuggaggaaauggacauagauaaagaagauau

SEQ ID NO: 498342 - RNA, 64 nt, hsa
aaauuuguaaaauguaauuaauauucaaagaaaaggaggaaaaucuucauuuguuggaaaugaa

SEQ ID NO: 498343 - RNA, 64 nt, hsa
ucacccuagauuacucaauuucaggguuccuaguggaggaaagcccauuccagcuguugccugu

SEQ ID NO: 498344 - RNA, 64 nt, hsa
aaagaaaaggugcauuucaagaacuuggggggcaggaggaaagcacaauguuucuuagccagga

SEQ ID NO: 498345 - RNA, 64 nt, hsa
gaggagggagggggccuagggcucugacccaucuggaggaaaaccagaucggacuaaaaaagga

SEQ ID NO: 498346 - RNA, 64 nt, hsa
ggucccuggacuggggguugguguuuucuauagaggaggaaaggcccucccucacccugcuccc

SEQ ID NO: 498347 - RNA, 64 nt, hsa
gccucacccugggcccacagaccggccuuccuuuggaggaaaguguggccuggacugagggagg

SEQ ID NO: 498348 - RNA, 64 nt, hsa
ccuuccuuuggaggaaaguguggccuggacugagggaggaaaugagcgaguucccucugacacc

SEQ ID NO: 498349 - RNA, 64 nt, hsa
ccaggugacaggggcccugcuccucucugugguuggaggaaagaugagugaagggaucaacuuc

SEQ ID NO: 498350 - RNA, 64 nt, hsa
gaucuucugccaccaucagggacaaacgggggcaggaggaaagucacugaugcccagauguuug

SEQ ID NO: 498351 - RNA, 64 nt, hsa
cuaggccacuccuccaaaggaagucuaggagcugggaggaaaagaaaagaggggaaaaugaguu

SEQ ID NO: 498352 - RNA, 64 nt, hsa
caccaggcacgaacccaccugcugagagacccaaggaggaaaaacagacaaaaacagccucaca

SEQ ID NO: 498353 - RNA, 64 nt, hsa
aggugccccuaguucuuuguccugccucccagagggaggaaaagccccugggggcuucuggcuc

SEQ ID NO: 498354 - RNA, 64 nt, hsa
cuguccaaaccugugaccccaggccagggaacggggaggaaaccaaagaaaaccauuuucaggg

SEQ ID NO: 498355 - RNA, 64 nt, hsa
uugugaaauacaguauaccgcaguggcucuagguggaggaaaggaggaaaaagugcuuauuaug

SEQ ID NO: 498356 - RNA, 64 nt, hsa
uacaguauaccgcaguggcucuagguggaggaaaggaggaaaaagugcuuauuaugugcaacau

SEQ ID NO: 498357 - RNA, 64 nt, hsa
gaggaguuuucuccauaucaaaacgagggcugauggaggaaaaaggucaauaaggucaagggaa

SEQ ID NO: 498358 - RNA, 64 nt, hsa
cucgggaguccucuagcaggccuaagacaugugaggaggaaaaggaaaaaaagcaaaaagcaag

SEQ ID NO: 498359 - RNA, 64 nt, hsa
uguguggcuuggaggaaaugguacugcccaaauaggaggaaaacacagccucccugagccugca

SEQ ID NO: 498360 - RNA, 64 nt, hsa
auucaugugacuagcgccuggccuuguguggcuuggaggaaaugguacugcccaaauaggagga

SEQ ID NO: 498361 - RNA, 64 nt, hsa
gcaggucagcaguaagguuucaagguacaguuauggaggaaagaagaaaaugacacauugauaa

SEQ ID NO: 498362 - RNA, 64 nt, hsa
ucaugagaccggcucacuaucacaggaacagcauggaggaaaccgcccccaugauccaguuacc

SEQ ID NO: 498363 - RNA, 64 nt, hsa
ccuccauacacugaggcagaaacuugugucaguuggaggaaaauagacuugaguagucuuuggu

SEQ ID NO: 498364 - RNA, 64 nt, hsa
cuguuaaaugucaaccuagaccuggaccugggugggaggaaacuguagccugaguguccacagg

SEQ ID NO: 498365 - RNA, 64 nt, hsa
gccacagggcuagaagcacaggcccgucaccccaggaggaaaagcccagggucuggggcagcag

SEQ ID NO: 498366 - RNA, 64 nt, hsa
guggggcaggaacaggaagugacgggaaccuugaggaggaaacgccuguguuagggagagagug

SEQ ID NO: 498367 - RNA, 64 nt, hsa
ucuccacauagacucuugaaauagccauuucaggggaggaaaggguugggguuuucuuuguuug

SEQ ID NO: 498368 - RNA, 64 nt, hsa
aguuaaaaagcauuauacuguggguaaugaaaagggaggaaaaaaaaagaaggaaaaggaauua

SEQ ID NO: 498369 - RNA, 64 nt, hsa
caggagaaaauuaaaguguuuucuuuauaucagaggaggaaauaguagaggucagugaaggucu

SEQ ID NO: 498370 - RNA, 64 nt, hsa
ucuugcuguguguucuacaaaugcuguuauugugggaggaaaugcuagguuuuuguguguggac

SEQ ID NO: 498371 - RNA, 64 nt, hsa
acagccucuccaaguucagagugagauucugcauggaggaaaaaugacuaaggacugagccccc

SEQ ID NO: 498372 - RNA, 64 nt, hsa
gguuuugggguccaggccauuuuuuuuaccccuuggaggaaauaagaugagggagaaaggagaa

SEQ ID NO: 498373 - RNA, 64 nt, hsa
uuggaggaaauaagaugagggagaaaggagaaggggaggaaacuucuccccucccaccuucacc

SEQ ID NO: 498374 - RNA, 64 nt, hsa
uucuucuuggcuaauucuuggcagggaucuuucuggaggaaaagcuggggccagccagggcagg

SEQ ID NO: 498375 - RNA, 64 nt, hsa
uuccugagggccaggucgggggcaggcauggaggggaggaaaggcgucccucuuggcccucccc

SEQ ID NO: 498376 - RNA, 64 nt, hsa; identical to SEQ ID NO: 76873

SEQ ID NO: 498377 - RNA, 64 nt, hsa; identical to SEQ ID NO: 76874

SEQ ID NO: 498378 - RNA, 64 nt, hsa; identical to SEQ ID NO: 76875

SEQ ID NO: 498379 - RNA, 64 nt, hsa; identical to SEQ ID NO: 76876

SEQ ID NO: 498380 - RNA, 64 nt, hsa; identical to SEQ ID NO: 76877

SEQ ID NO: 498381 - RNA, 64 nt, hsa; identical to SEQ ID NO: 76878

SEQ ID NO: 498382 - RNA, 64 nt, hsa; identical to SEQ ID NO: 76879

SEQ ID NO: 498383 - RNA, 64 nt, hsa; identical to SEQ ID NO: 76880

SEQ ID NO: 498384 - RNA, 64 nt, hsa; identical to SEQ ID NO: 76881

SEQ ID NO: 498385 - RNA, 64 nt, hsa; identical to SEQ ID NO: 76882

SEQ ID NO: 498386 - RNA, 64 nt, hsa; identical to SEQ ID NO: 76883

SEQ ID NO: 498387 - RNA, 64 nt, hsa; identical to SEQ ID NO: 76884

SEQ ID NO: 498388 - RNA, 64 nt, hsa; identical to SEQ ID NO: 76885

SEQ ID NO: 498389 - RNA, 64 nt, hsa; identical to SEQ ID NO: 76886

SEQ ID NO: 498390 - RNA, 64 nt, hsa; identical to SEQ ID NO: 76887

SEQ ID NO: 498391 - RNA, 64 nt, hsa; identical to SEQ ID NO: 76888

SEQ ID NO: 498392 - RNA, 64 nt, hsa; identical to SEQ ID NO: 76889

SEQ ID NO: 498393 - RNA, 64 nt, hsa; identical to SEQ ID NO: 76890

SEQ ID NO: 498394 - RNA, 64 nt, hsa; identical to SEQ ID NO: 76891

SEQ ID NO: 498395 - RNA, 64 nt, hsa; identical to SEQ ID NO: 76892

SEQ ID NO: 498396 - RNA, 64 nt, hsa; identical to SEQ ID NO: 76893

SEQ ID NO: 498397 - RNA, 64 nt, hsa; identical to SEQ ID NO: 76894

SEQ ID NO: 498398 - RNA, 64 nt, hsa; identical to SEQ ID NO: 76895

SEQ ID NO: 498399 - RNA, 64 nt, hsa; identical to SEQ ID NO: 76896

SEQ ID NO: 498400 - RNA, 64 nt, hsa; identical to SEQ ID NO: 76897

SEQ ID NO: 498401 - RNA, 64 nt, hsa; identical to SEQ ID NO: 392288

SEQ ID NO: 498402 - RNA, 64 nt, hsa; identical to SEQ ID NO: 392289

SEQ ID NO: 498403 - RNA, 64 nt, hsa; identical to SEQ ID NO: 392290

SEQ ID NO: 498404 - RNA, 64 nt, hsa; identical to SEQ ID NO: 392291

SEQ ID NO: 498405 - RNA, 64 nt, hsa; identical to SEQ ID NO: 392292

SEQ ID NO: 498406 - RNA, 64 nt, hsa; identical to SEQ ID NO: 392293

SEQ ID NO: 498407 - RNA, 64 nt, hsa; identical to SEQ ID NO: 413813

SEQ ID NO: 498408 - RNA, 64 nt, hsa; identical to SEQ ID NO: 413814

SEQ ID NO: 498409 - RNA, 64 nt, hsa; identical to SEQ ID NO: 413815

SEQ ID NO: 498410 - RNA, 64 nt, hsa; identical to SEQ ID NO: 413816

SEQ ID NO: 498411 - RNA, 64 nt, hsa; identical to SEQ ID NO: 413817

SEQ ID NO: 498412 - RNA, 64 nt, hsa; identical to SEQ ID NO: 413818

SEQ ID NO: 498413 - RNA, 64 nt, hsa; identical to SEQ ID NO: 413819

SEQ ID NO: 498414 - RNA, 64 nt, hsa; identical to SEQ ID NO: 413820

SEQ ID NO: 498415 - RNA, 64 nt, hsa; identical to SEQ ID NO: 413821

SEQ ID NO: 498416 - RNA, 64 nt, hsa; identical to SEQ ID NO: 413822

SEQ ID NO: 498417 - RNA, 64 nt, hsa; identical to SEQ ID NO: 413823

SEQ ID NO: 498418 - RNA, 64 nt, hsa; identical to SEQ ID NO: 413824

SEQ ID NO: 498419 - RNA, 64 nt, hsa; identical to SEQ ID NO: 413825

SEQ ID NO: 498420 - RNA, 64 nt, hsa; identical to SEQ ID NO: 413826

SEQ ID NO: 498421 - RNA, 64 nt, hsa; identical to SEQ ID NO: 413827

SEQ ID NO: 498422 - RNA, 64 nt, hsa; identical to SEQ ID NO: 413828

SEQ ID NO: 498423 - RNA, 64 nt, hsa; identical to SEQ ID NO: 413829

SEQ ID NO: 498424 - RNA, 64 nt, hsa; identical to SEQ ID NO: 413830

SEQ ID NO: 498425 - RNA, 64 nt, hsa; identical to SEQ ID NO: 413831

SEQ ID NO: 498426 - RNA, 64 nt, hsa; identical to SEQ ID NO: 413832

SEQ ID NO: 498427 - RNA, 64 nt, hsa; identical to SEQ ID NO: 413833

SEQ ID NO: 498428 - RNA, 64 nt, hsa; identical to SEQ ID NO: 413834

SEQ ID NO: 498429 - RNA, 64 nt, hsa; identical to SEQ ID NO: 413835

SEQ ID NO: 498430 - RNA, 64 nt, hsa; identical to SEQ ID NO: 413836

SEQ ID NO: 498431 - RNA, 64 nt, hsa; identical to SEQ ID NO: 413837

SEQ ID NO: 498432 - RNA, 64 nt, hsa; identical to SEQ ID NO: 413838

SEQ ID NO: 498433 - RNA, 64 nt, hsa; identical to SEQ ID NO: 413839

SEQ ID NO: 498434 - RNA, 64 nt, hsa; identical to SEQ ID NO: 413840

SEQ ID NO: 498435 - RNA, 64 nt, hsa; identical to SEQ ID NO: 413841

SEQ ID NO: 498436 - RNA, 64 nt, hsa; identical to SEQ ID NO: 413842

SEQ ID NO: 498437 - RNA, 64 nt, hsa; identical to SEQ ID NO: 413843

SEQ ID NO: 498438 - RNA, 64 nt, hsa; identical to SEQ ID NO: 413844

SEQ ID NO: 498439 - RNA, 64 nt, hsa; identical to SEQ ID NO: 413845

SEQ ID NO: 498440 - RNA, 64 nt, hsa; identical to SEQ ID NO: 413846

SEQ ID NO: 498441 - RNA, 64 nt, hsa; identical to SEQ ID NO: 413847

SEQ ID NO: 498442 - RNA, 64 nt, hsa; identical to SEQ ID NO: 413848

SEQ ID NO: 498443 - RNA, 64 nt, hsa; identical to SEQ ID NO: 413849

SEQ ID NO: 498444 - RNA, 64 nt, hsa; identical to SEQ ID NO: 413850

SEQ ID NO: 498445 - RNA, 64 nt, hsa; identical to SEQ ID NO: 413851

SEQ ID NO: 498446 - RNA, 64 nt, hsa; identical to SEQ ID NO: 413852

SEQ ID NO: 498447 - RNA, 64 nt, hsa; identical to SEQ ID NO: 413853

SEQ ID NO: 498448 - RNA, 64 nt, hsa; identical to SEQ ID NO: 413854

SEQ ID NO: 498449 - RNA, 64 nt, hsa; identical to SEQ ID NO: 413855

SEQ ID NO: 498450 - RNA, 64 nt, hsa; identical to SEQ ID NO: 413856

SEQ ID NO: 498451 - RNA, 64 nt, hsa; identical to SEQ ID NO: 413857

SEQ ID NO: 498452 - RNA, 64 nt, hsa; identical to SEQ ID NO: 413858

SEQ ID NO: 498453 - RNA, 64 nt, hsa; identical to SEQ ID NO: 413859

SEQ ID NO: 498454 - RNA, 64 nt, hsa; identical to SEQ ID NO: 413860

SEQ ID NO: 498455 - RNA, 64 nt, hsa; identical to SEQ ID NO: 413861

SEQ ID NO: 498456 - RNA, 64 nt, hsa; identical to SEQ ID NO: 413862

SEQ ID NO: 498457 - RNA, 64 nt, hsa; identical to SEQ ID NO: 413863

SEQ ID NO: 498458 - RNA, 64 nt, hsa; identical to SEQ ID NO: 413864

SEQ ID NO: 498459 - RNA, 64 nt, hsa; identical to SEQ ID NO: 413865

SEQ ID NO: 498460 - RNA, 64 nt, hsa; identical to SEQ ID NO: 413866

SEQ ID NO: 498461 - RNA, 64 nt, hsa; identical to SEQ ID NO: 413867

SEQ ID NO: 498462 - RNA, 64 nt, hsa; identical to SEQ ID NO: 413868

SEQ ID NO: 498463 - RNA, 64 nt, hsa; identical to SEQ ID NO: 413869

SEQ ID NO: 498464 - RNA, 64 nt, hsa; identical to SEQ ID NO: 413870

SEQ ID NO: 498465 - RNA, 64 nt, hsa; identical to SEQ ID NO: 413871

SEQ ID NO: 498466 - RNA, 64 nt, hsa; identical to SEQ ID NO: 413872

SEQ ID NO: 498467 - RNA, 64 nt, hsa; identical to SEQ ID NO: 413873

SEQ ID NO: 498468 - RNA, 64 nt, hsa; identical to SEQ ID NO: 413874

SEQ ID NO: 498469 - RNA, 64 nt, hsa; identical to SEQ ID NO: 413875

SEQ ID NO: 498470 - RNA, 64 nt, hsa; identical to SEQ ID NO: 413876

SEQ ID NO: 498471 - RNA, 64 nt, hsa; identical to SEQ ID NO: 413877

SEQ ID NO: 498472 - RNA, 64 nt, hsa; identical to SEQ ID NO: 413878

SEQ ID NO: 498473 - RNA, 64 nt, hsa; identical to SEQ ID NO: 413879

SEQ ID NO: 498474 - RNA, 64 nt, hsa; identical to SEQ ID NO: 413880

SEQ ID NO: 498475 - RNA, 64 nt, hsa; identical to SEQ ID NO: 413881

SEQ ID NO: 498476 - RNA, 64 nt, hsa; identical to SEQ ID NO: 413882

SEQ ID NO: 498477 - RNA, 64 nt, hsa; identical to SEQ ID NO: 413883

SEQ ID NO: 498478 - RNA, 64 nt, hsa; identical to SEQ ID NO: 413884

SEQ ID NO: 498479 - RNA, 64 nt, hsa; identical to SEQ ID NO: 413885

SEQ ID NO: 498480 - RNA, 64 nt, hsa; identical to SEQ ID NO: 413886

SEQ ID NO: 498481 - RNA, 64 nt, hsa; identical to SEQ ID NO: 413887

SEQ ID NO: 498482 - RNA, 64 nt, hsa; identical to SEQ ID NO: 413888

SEQ ID NO: 498483 - RNA, 64 nt, hsa; identical to SEQ ID NO: 413889

SEQ ID NO: 498484 - RNA, 64 nt, hsa; identical to SEQ ID NO: 413890

SEQ ID NO: 498485 - RNA, 64 nt, hsa; identical to SEQ ID NO: 413891

SEQ ID NO: 498486 - RNA, 64 nt, hsa; identical to SEQ ID NO: 413892

SEQ ID NO: 498487 - RNA, 64 nt, hsa; identical to SEQ ID NO: 413893

SEQ ID NO: 498488 - RNA, 53 nt, hsa; identical to SEQ ID NO: 413894

SEQ ID NO: 498489 - RNA, 64 nt, hsa; identical to SEQ ID NO: 413895

SEQ ID NO: 498490 - RNA, 64 nt, hsa; identical to SEQ ID NO: 413896

SEQ ID NO: 498491 - RNA, 64 nt, hsa; identical to SEQ ID NO: 413897

SEQ ID NO: 498492 - RNA, 64 nt, hsa; identical to SEQ ID NO: 413898

SEQ ID NO: 498493 - RNA, 64 nt, hsa; identical to SEQ ID NO: 413899

SEQ ID NO: 498494 - RNA, 64 nt, hsa; identical to SEQ ID NO: 413900

SEQ ID NO: 498495 - RNA, 64 nt, hsa; identical to SEQ ID NO: 413901

SEQ ID NO: 498496 - RNA, 64 nt, hsa; identical to SEQ ID NO: 413902

SEQ ID NO: 498497 - RNA, 64 nt, hsa; identical to SEQ ID NO: 413903

SEQ ID NO: 498498 - RNA, 64 nt, hsa; identical to SEQ ID NO: 413904

SEQ ID NO: 498499 - RNA, 64 nt, hsa; identical to SEQ ID NO: 413905

SEQ ID NO: 498500 - RNA, 64 nt, hsa; identical to SEQ ID NO: 413906

SEQ ID NO: 498501 - RNA, 64 nt, hsa; identical to SEQ ID NO: 413907

SEQ ID NO: 498502 - RNA, 64 nt, hsa; identical to SEQ ID NO: 413908

SEQ ID NO: 498503 - RNA, 64 nt, hsa; identical to SEQ ID NO: 413909

SEQ ID NO: 498504 - RNA, 64 nt, hsa; identical to SEQ ID NO: 413910

SEQ ID NO: 498505 - RNA, 64 nt, hsa; identical to SEQ ID NO: 413911

SEQ ID NO: 498506 - RNA, 64 nt, hsa; identical to SEQ ID NO: 413912

SEQ ID NO: 498507 - RNA, 64 nt, hsa; identical to SEQ ID NO: 413913

SEQ ID NO: 498508 - RNA, 64 nt, hsa; identical to SEQ ID NO: 413914

SEQ ID NO: 498509 - RNA, 64 nt, hsa; identical to SEQ ID NO: 413915

SEQ ID NO: 498510 - RNA, 64 nt, hsa; identical to SEQ ID NO: 413916

SEQ ID NO: 498511 - RNA, 64 nt, hsa; identical to SEQ ID NO: 413917

SEQ ID NO: 498512 - RNA, 64 nt, hsa; identical to SEQ ID NO: 413918

SEQ ID NO: 498513 - RNA, 64 nt, hsa; identical to SEQ ID NO: 413919

SEQ ID NO: 498514 - RNA, 64 nt, hsa; identical to SEQ ID NO: 413920

SEQ ID NO: 498515 - RNA, 64 nt, hsa; identical to SEQ ID NO: 413921

SEQ ID NO: 498516 - RNA, 64 nt, hsa; identical to SEQ ID NO: 413922

SEQ ID NO: 498517 - RNA, 64 nt, hsa; identical to SEQ ID NO: 413923

SEQ ID NO: 498518 - RNA, 64 nt, hsa; identical to SEQ ID NO: 413924

SEQ ID NO: 498519 - RNA, 64 nt, hsa; identical to SEQ ID NO: 413925

SEQ ID NO: 498520 - RNA, 64 nt, hsa; identical to SEQ ID NO: 413926

SEQ ID NO: 498521 - RNA, 64 nt, hsa; identical to SEQ ID NO: 413927

SEQ ID NO: 498522 - RNA, 64 nt, hsa; identical to SEQ ID NO: 413928

SEQ ID NO: 498523 - RNA, 64 nt, hsa; identical to SEQ ID NO: 413928

SEQ ID NO: 498524 - RNA, 64 nt, hsa; identical to SEQ ID NO: 413930

SEQ ID NO: 498525 - RNA, 64 nt, hsa; identical to SEQ ID NO: 413931

SEQ ID NO: 498526 - RNA, 64 nt, hsa; identical to SEQ ID NO: 413932

SEQ ID NO: 498527 - RNA, 64 nt, hsa; identical to SEQ ID NO: 413933

SEQ ID NO: 498528 - RNA, 64 nt, hsa; identical to SEQ ID NO: 413934

SEQ ID NO: 498529 - RNA, 64 nt, hsa; identical to SEQ ID NO: 413935

SEQ ID NO: 498530 - RNA, 64 nt, hsa; identical to SEQ ID NO: 413936

SEQ ID NO: 498531 - RNA, 64 nt, hsa; identical to SEQ ID NO: 413937

SEQ ID NO: 498532 - RNA, 64 nt, hsa; identical to SEQ ID NO: 103765

SEQ ID NO: 498533 - RNA, 64 nt, hsa; identical to SEQ ID NO: 103766

SEQ ID NO: 498534 - RNA, 53 nt, hsa; identical to SEQ ID NO: 103767

SEQ ID NO: 498535 - RNA, 64 nt, hsa; identical to SEQ ID NO: 103768

SEQ ID NO: 498536 - RNA, 64 nt, hsa; identical to SEQ ID NO: 103769

SEQ ID NO: 498537 - RNA, 64 nt, hsa; identical to SEQ ID NO: 103770

SEQ ID NO: 498538 - RNA, 53 nt, hsa; identical to SEQ ID NO: 103771

SEQ ID NO: 498539 - RNA, 64 nt, hsa; identical to SEQ ID NO: 103772

SEQ ID NO: 498540 - RNA, 64 nt, hsa; identical to SEQ ID NO: 103773

SEQ ID NO: 498541 - RNA, 64 nt, hsa; identical to SEQ ID NO: 103774

SEQ ID NO: 498542 - RNA, 64 nt, hsa; identical to SEQ ID NO: 103775

SEQ ID NO: 498543 - RNA, 64 nt, hsa; identical to SEQ ID NO: 103776

SEQ ID NO: 498544 - RNA, 64 nt, hsa; identical to SEQ ID NO: 286003

SEQ ID NO: 498545 - RNA, 64 nt, hsa; identical to SEQ ID NO: 286004

SEQ ID NO: 498546 - RNA, 64 nt, hsa; identical to SEQ ID NO: 286005

SEQ ID NO: 498547 - RNA, 64 nt, hsa; identical to SEQ ID NO: 286006

SEQ ID NO: 498548 - RNA, 64 nt, hsa; identical to SEQ ID NO: 286007

SEQ ID NO: 498549 - RNA, 64 nt, hsa; identical to SEQ ID NO: 286008

SEQ ID NO: 498550 - RNA, 64 nt, hsa; identical to SEQ ID NO: 286009

SEQ ID NO: 498551 - RNA, 64 nt, hsa; identical to SEQ ID NO: 286010

SEQ ID NO: 498552 - RNA, 64 nt, hsa; identical to SEQ ID NO: 286011

SEQ ID NO: 498553 - RNA, 64 nt, hsa; identical to SEQ ID NO: 286012

SEQ ID NO: 498554 - RNA, 64 nt, hsa; identical to SEQ ID NO: 286013

SEQ ID NO: 498555 - RNA, 64 nt, hsa; identical to SEQ ID NO: 286014

SEQ ID NO: 498556 - RNA, 64 nt, hsa; identical to SEQ ID NO: 286015

SEQ ID NO: 498557 - RNA, 64 nt, hsa; identical to SEQ ID NO: 286016

SEQ ID NO: 498558 - RNA, 64 nt, hsa; identical to SEQ ID NO: 286017

SEQ ID NO: 498559 - RNA, 64 nt, hsa; identical to SEQ ID NO: 286018

SEQ ID NO: 498560 - RNA, 64 nt, hsa; identical to SEQ ID NO: 286019

SEQ ID NO: 498561 - RNA, 64 nt, hsa; identical to SEQ ID NO: 286020

SEQ ID NO: 498562 - RNA, 64 nt, hsa; identical to SEQ ID NO: 286021

SEQ ID NO: 498563 - RNA, 64 nt, hsa; identical to SEQ ID NO: 286022

SEQ ID NO: 498564 - RNA, 64 nt, hsa; identical to SEQ ID NO: 286023

SEQ ID NO: 498565 - RNA, 64 nt, hsa; identical to SEQ ID NO: 286024

SEQ ID NO: 498566 - RNA, 64 nt, hsa
ugucagauugauuugaaaggugugcagccugauuuaaaaccaaacccugaacccuuuuaaagaa

SEQ ID NO: 498567 - RNA, 64 nt, hsa
guuuuuugagauuaaaaaaaaaaaaucccugguuuaaaaccaacaaugaugccuagugaguaug

SEQ ID NO: 498568 - RNA, 64 nt, hsa
gucagcaagagccucuuugucucacuccaucauuuaaaaccaguauauucaguaguugaagaaa

SEQ ID NO: 498569 - RNA, 64 nt, hsa
uacuggggugggggaaucuaugcaaggaguaaaguaaaaccauccagaaucaaagcagcaacca

SEQ ID NO: 498570 - RNA, 64 nt, hsa
aaggacauacuucauaauauauaagugugcacuguaaaaccauccagccauuugacacccuuua

SEQ ID NO: 498571 - RNA, 64 nt, hsa
aauuuaucauguuuaaaaauuauucaagcacucuuaaaaccacuuaaacagccuccagucauaa

SEQ ID NO: 498572 - RNA, 64 nt, hsa
uugcuuccuugcuuuuauguuuguacacaacaccuaaaaccaguuuugcugcuauaauucuaua

SEQ ID NO: 498573 - RNA, 64 nt, hsa
aagaagucucuuaauucugaugcuagguuguuuuuaaaaccacuaugcaaagaacucaccacaa

SEQ ID NO: 498574 - RNA, 64 nt, hsa
aaaaagaggauuaaaucuaaaggaaagaaaaaauuaaaaccacccauaacuuuacucugaagca

SEQ ID NO: 498575 - RNA, 64 nt, hsa
uucuuucuguguguguguaagccacugcuuauaauaaaaccaacaauacccucagacugaaagg

SEQ ID NO: 498576 - RNA, 64 nt, hsa
ggagagagagcuugugcagggaaacucccauuuuuaaaaccaucagaucucaugaggcuuacua

SEQ ID NO: 498577 - RNA, 64 nt, hsa
ccuuaaggucauggucauauagcuaguuaucuuguaaaaccaauguuucuuaguucauacuuac

SEQ ID NO: 498578 - RNA, 64 nt, hsa
uauugagggcuacuaucugccuccacaauuuuauuaaaaccacuccaccuuuagacaaagguga

SEQ ID NO: 498579 - RNA, 64 nt, hsa
uauuaggauuuaaauuuaugccacaauuuaaaaauaaaaccagagguuauauacaauuuaaauu

SEQ ID NO: 498580 - RNA, 64 nt, hsa
agaaacaagauuguuugggauuggaaguaaagauuaaaaccaaaagaauuuguguuugucugau

SEQ ID NO: 498581 - RNA, 64 nt, hsa
agacaagaagacugucaggaagggucggagucuguaaaaccagcauacaguuuggcuuuuuuca

SEQ ID NO: 498582 - RNA, 64 nt, hsa
guuuaguaaguucagaaguagaaacaaacuuauuuaaaaccaucauuugaaaguuuaauucuuu

SEQ ID NO: 498583 - RNA, 64 nt, hsa
uacccuacagacuggccgagaccauaucaaguauuaaaaccauucuauacagcaaguaucguuu

SEQ ID NO: 498584 - RNA, 64 nt, hsa
uuuuugucucauuguguuauugucugacuaaaucuaaaaccaaacccauguugaaacuaguacu

SEQ ID NO: 498585 - RNA, 64 nt, hsa
ugagucucuuuuugguggcuaaguagaaucuuccuaaaaccauugucauaaaagcaguuaaagg

SEQ ID NO: 498586 - RNA, 64 nt, hsa
gaggagcugugggucaggaaucagagagaccugcuaaaaccagacagauauaaacaccaaagac

SEQ ID NO: 498587 - RNA, 64 nt, hsa
auuuccgggaauuauuauugaaagccuaugaauuuaaaaccagguuuaccauguaauuuguuuu

SEQ ID NO: 498588 - RNA, 64 nt, hsa
guggauaucuaaaaccagacccccaguggaugucuaaaaccacagauaauaacaaaccuuauac

SEQ ID NO: 498589 - RNA, 64 nt, hsa
uacccccuuauccacaggggauacaguggauaucuaaaaccagacccccaguggaugucuaaaa

SEQ ID NO: 498590 - RNA, 64 nt, hsa
aaugaguauugugaacuuucuaggaaauauucauuaaaaccauugaaauaaaaauaaauucaag

SEQ ID NO: 498591 - RNA, 64 nt, hsa
uggaagcuggugacuuuauuugcaaagcugugaauaaaaccacaaacucuaaaguagcacaagc

SEQ ID NO: 498592 - RNA, 64 nt, hsa
ugaaacacaaagcuuccaaucuuaaggaugugaauaaaaccaccaaauggcauuucuagacagu

SEQ ID NO: 498593 - RNA, 64 nt, hsa
auauggaaaacauuuugauaaaauuuuuuccuguuaaaaccaugaacauuggcuaugaugaaga

SEQ ID NO: 498594 - RNA, 64 nt, hsa
auauuuucaaacgaaacguaagagaagucaacaauaaaaccaagaaaagugaguauuuuuauac

SEQ ID NO: 498595 - RNA, 64 nt, hsa
cucaaccucuccccuuguacagaagccauuuuuguaaaaccacacugaccuaaauucagcugcc

SEQ ID NO: 498596 - RNA, 64 nt, hsa
aaugaaaagcaauacaacuuuaccauaaagccuuuaaaaccaguaacgugcugcucaaggacca

SEQ ID NO: 498597 - RNA, 64 nt, hsa
cucagagcuuuaaaaguaucuuuaacaauugucuuaaaaccagagaaucuuaaggucuaacugu

SEQ ID NO: 498598 - RNA, 64 nt, hsa
ugguacaagccuuggggacugaaaaaaaaaagauuaaaaccauuaaaaagaaacucauuuuuac

SEQ ID NO: 498599 - RNA, 64 nt, hsa
uauauauauuuagguaaaauagaucuaucguguuuaaaaccaaagaaaucaauggaacccuugc

SEQ ID NO: 498600 - RNA, 64 nt, hsa
ucaauuugagaaaauagaaauagauauuuuuaaauaaaaccauucacaguuuacuuugucuuga

SEQ ID NO: 498601 - RNA, 64 nt, hsa
auaauacagccuguugucuaaagccaaggagucauaaaaccaugagaaauaaauaggaaucaau

SEQ ID NO: 498602 - RNA, 64 nt, hsa
agagccugccaaggaccucauuuaguuuguguauuaaaaccaaaaagcuuuugucuuuaagaaa

SEQ ID NO: 498603 - RNA, 64 nt, hsa
guauuaaaaccaaaaagcuuuugucuuuaagaaauaaaaccauuuuuuuaagccccaaaagguu

SEQ ID NO: 498604 - RNA, 64 nt, hsa
acagcauugacaucaucuguaaaaccaucaucuguaaaaccaucuaugacaugaguuuugagaa

SEQ ID NO: 498605 - RNA, 64 nt, hsa
cuucagugauuuuaaacagcauugacaucaucuguaaaaccaucaucuguaaaaccaucuauga

SEQ ID NO: 498606 - RNA, 64 nt, hsa
uucagaaauguguauuuccauaauccagagguuguaaaaccacuaguguuuuagugguuacagc

SEQ ID NO: 498607 - RNA, 64 nt, hsa
cauuugugugugugugauuccacuuagaaauucuuaaaaccagauuuuucuuucauuccguuug

SEQ ID NO: 498608 - RNA, 64 nt, hsa
acaaaccuaguugcuaaaacuaccuguuguaaccuaaaaccaguuuuaucuaacagcuauuaaa

SEQ ID NO: 498609 - RNA, 64 nt, hsa
uaauggggaaaauagaaaauaacauuauuaaguguaaaaccagcaaaguacuuuuuuaauuaaa

SEQ ID NO: 498610 - RNA, 64 nt, hsa
uugaaacaauauuauuuugaaauuggcuuuaaaauaaaaccauucagauugaaauucuaauuag

SEQ ID NO: 498611 - RNA, 64 nt, hsa
cccucagauaucacaugguacacuugauuaguaauaaaaccagagaucaauuuaaauugcugau

SEQ ID NO: 498612 - RNA, 64 nt, hsa
gggcuuuacuaucuuuucaucucauuaauucaauuaaaaccauuaccuuaaaauuuuuuucuuu

SEQ ID NO: 498613 - RNA, 64 nt, hsa
uuuaacuagacugcguguuguuuuucccguauaauaaaaccaaagaauaguuugguucuucaaa

SEQ ID NO: 498614 - RNA, 64 nt, hsa
ucaucuuucuauucuguuucaugacugaauaauguaaaaccaguguuggcaauugguaucauca

SEQ ID NO: 498615 - RNA, 64 nt, hsa
gauuuuaaucuugaaguaguaggugguauagucauaaaaccauucauccccuucuugauuguau

SEQ ID NO: 498616 - RNA, 64 nt, hsa
auuuaagaaugauuaaaaauaagcuuuuacuuuuuaaaaccacuugagguuucauaaagcuugg

SEQ ID NO: 498617 - RNA, 64 nt, hsa
ugccuagaaagugguugaaggauucuugaugcccuaaaaccaucuuguaagcuaaauggucuug

SEQ ID NO: 498618 - RNA, 64 nt, hsa
auaauacuuuaauggaaugcuuuuuaaaaaaauauaaaaccaagguaaauuauuguuucaucuu

SEQ ID NO: 498619 - RNA, 64 nt, hsa
uuguuuuacugcuguuaaguuuguuauuuggguauaaaaccagauguuuacaccuguaaaucuu

SEQ ID NO: 498620 - RNA, 64 nt, hsa
aaugguguuuaacuaaugcugcuggcggacauccuaaaaccagaugcauccucagaggacgagu

SEQ ID NO: 498621 - RNA, 64 nt, hsa
cugggcaaaauaauauuaaauggauuaaagaaucuaaaaccagugggaaaacugucugauuucu

SEQ ID NO: 498622 - RNA, 64 nt, hsa
uuuuguggauucuaucaaagugauaagugauccuuaaaaccagccuucuaaaauaauugcauuc

SEQ ID NO: 498623 - RNA, 64 nt, hsa
cacuuugauguuaaaucuauugcuacuucaguuguaaaaccagccaaaaguuucuggaugaagg

SEQ ID NO: 498624 - RNA, 64 nt, hsa
uguucagguuaauccaagcaacacgcauuggguuuaaaaccagcaccgaggcccagugggggaa

SEQ ID NO: 498625 - RNA, 64 nt, hsa
cgugugguuagaucagcuuuguuacugaauuaccuaaaaccagaccacagcacagccagggagc

SEQ ID NO: 498626 - RNA, 64 nt, hsa
ugagcaguuugcauauauuuauuuaugaucuucuuaaaaccauuccaugaaauaggaacuguaa

SEQ ID NO: 498627 - RNA, 64 nt, hsa
ugguacugauucucaaaacaaggagcucauagucuaaaaccauuuuucuuucuuuuuuuucccc

SEQ ID NO: 498628 - RNA, 64 nt, hsa
cuacagcuuugaguuggaaagaagucacggguuguaaaaccauuuggauuuuuuuaaaacaaaa

SEQ ID NO: 498629 - RNA, 64 nt, hsa
uacagugauuucaauugcaccaugacuucuucacuaaaaccacaaaguccugcuuaaaacuaug

SEQ ID NO: 498630 - RNA, 64 nt, hsa
uuuuguucuuagaacugcucccauuucugggaacuaaaaccaguuuuauuugccccaccccuug

SEQ ID NO: 498631 - RNA, 64 nt, hsa
agaauauuggcccuuucuaaccuaugugcauaauuaaaaccagcuucauuuguugcuccgagag

SEQ ID NO: 498632 - RNA, 57 nt, hsa
cacuuguucuuaaagacuagagcagcgaacugcgacgaucacuuagagaaacaggcc

SEQ ID NO: 498633 - RNA, 64 nt, hsa
ccuagggcggggcugggugggagaugggagggccaacugcgagcugcuccacuucucagcucuc

SEQ ID NO: 498634 - RNA, 64 nt, hsa
cucuuuaguaaauuuagaacuguagaggcuaauaaacugcgaugagacauuuaagcucugcucc

SEQ ID NO: 498635 - RNA, 64 nt, hsa
cagucucuguccugugguagaccaucuuuuuguaaacugcgagcuuccucuucccuguacccuc

SEQ ID NO: 498636 - RNA, 64 nt, hsa
aauggaaggcaagaaacacgaaggaucaugugguaacugcgagagcuugcugaggggugggaga

SEQ ID NO: 498637 - RNA, 64 nt, hsa
ccucauuccaugccacuaugagucaacucaggaaaacugcgagugcauuugaggcuuaggggua

SEQ ID NO: 498638 - RNA, 64 nt, hsa
uucucucucacugccaucaaacuguaaaagauuaaacugcgaagucaagcucaacagauuauuu

SEQ ID NO: 498639 - RNA, 64 nt, hsa
aagauccauucucuauucccaguauaagggacgaaacugcgaacuccuuaaagcucuaucuagc

SEQ ID NO: 498640 - RNA, 64 nt, hsa
gggacuuuucugggagaacuuaaaggcccauaguaacugcgaaugaagcaauauaccacuaacc

SEQ ID NO: 498641 - RNA, 64 nt, hsa
agugggcccacaucagucaacgucagagaacuuaaacugcgaaaagacauuuugacaaaaacua

SEQ ID NO: 498642 - RNA, 64 nt, hsa
aaauagcacuuuuaauagcaaaaaaaggcacaucaacugcgaaguuauccuuaguuugcaaaug

SEQ ID NO: 498643 - RNA, 64 nt, hsa
aaagcgcccccucucgagaggcuggucccuggagaacugcgaacgagcugcagaaaaccagauu

SEQ ID NO: 498644 - RNA, 64 nt, hsa
gauuuaaaaauguguuuuguuucuacuauucagaaacugcgaacuagggaaagguugguaugaa

SEQ ID NO: 498645 - RNA, 64 nt, hsa
ggugccuuggcacccuugccuggaacucguuagcaacugcgagcagaagcuuuccagucacaca

SEQ ID NO: 498646 - RNA, 64 nt, hsa
uaggggguggauggagacacuucuaacuuuaauaaacugcgacugaacguggaauccuaguaaa

SEQ ID NO: 498647 - RNA, 64 nt, hsa
gcaaagaagcuacagccuggacuuaccaccacuaaacugcgagagaagcuaaacguguuuauuu

SEQ ID NO: 498648 - RNA, 64 nt, hsa
uuuuaugacuuccauuuggcaauuguugaauuauaacugcgacugaaacaaacagguucauaga

SEQ ID NO: 498649 - RNA, 64 nt, hsa
acauuaccaaaagcagggaacaaagcucuuauucaacugcgaauuccauagugggcucuggcuu

SEQ ID NO: 498650 - RNA, 64 nt, hsa
caagaagaacagauaacaaagcuguuaauacuuaaacugcgauauuucacuccuaaagaaauag

SEQ ID NO: 498651 - RNA, 64 nt, hsa
ucgugaaaagaauuacuauaagguacugugaaauaacugcgauuuugugagcaaaacauacuug

SEQ ID NO: 498652 - RNA, 64 nt, hsa
agugugugugacucaaagaucaagagugaggcuaaacugcgaccccaacaucacuuccuucaug

SEQ ID NO: 498653 - RNA, 64 nt, hsa
cggggucgguuuaauggaguguccacgcggagauaacugcgauauuggaacaccugugagagag

SEQ ID NO: 498654 - RNA, 64 nt, hsa
augcgacagugucagcacuggagucuucuugcugaacugcgaauaaagagaugugcuguuuaac

SEQ ID NO: 498655 - RNA, 64 nt, hsa
aacgccuuucggcuuugggcuuuuauuuuuuuggaacugcgaguggcuuaggucuagccucauu

SEQ ID NO: 498656 - RNA, 64 nt, hsa
cuggcauauacuaaacgcuaaauaaauacaugcuaacugcgaucauuacauuaccuuguuucau

SEQ ID NO: 498657 - RNA, 64 nt, hsa
caccgccaagcucugcgauguggcucagcagcgcaacugcgaggacaugauccagauguuccag

SEQ ID NO: 498658 - RNA, 64 nt, hsa
cugucucugccccccuuccccagccagcauccccaacugcgacugugaccuagagacuucaccc

SEQ ID NO: 498659 - RNA, 64 nt, hsa
gagugguuuucgcuuaaaggaaaaaaaaaucuaaaacugcgaagaauacuaaauguaguugaga

SEQ ID NO: 498660 - RNA, 64 nt, hsa
ccaggcucaaacaugucccccgugccacaaggcaaacugcgaugagcucacaguccaggucucu

SEQ ID NO: 498661 - RNA, 64 nt, hsa
accccaacaauguguguaucuuuugcacagcaaaaacugcgaggccagaacuaguuuaucugaa

SEQ ID NO: 498662 - RNA, 64 nt, hsa
aaaaaaaaaaaaagcuaucuugaaaauguuuuggaacugcgauaacugagaaacucuuaccagu

SEQ ID NO: 498663 - RNA, 64 nt, hsa
uccaggcaucuagguucuuuuuauuccuagauggaacugcgacuuccgagccauggaagggugg

SEQ ID NO: 498664 - RNA, 64 nt, hsa
cugagugacguacuucauccuccaaugacuggacaacugcgaugccuuuuccucccuuuuccug

SEQ ID NO: 498665 - RNA, 64 nt, hsa
gcugaccaucgcccaccgccucaacacaguucucaacugcgaucacguccugguuauggaaaau

SEQ ID NO: 498666 - RNA, 64 nt, hsa
aggcaaaguuuuacagagaggauacauuuaauaaaacugcgaggacaucaaagugguaaauacu

SEQ ID NO: 498667 - RNA, 64 nt, hsa
guucucccccuccugauuaaaaagggagaaagaaaacugcgauuuuauagcuggagaucugaac

SEQ ID NO: 498668 - RNA, 64 nt, hsa
cccgaagcucuugugaacugucuuggcugugagcaacugcgacaaaacauuuugaaggaaaauu

SEQ ID NO: 498669 - RNA, 64 nt, hsa
caguuuccuccccugugaaaugagaacacgggguaacugcgaucauugcacuugguguucacag

SEQ ID NO: 498670 - RNA, 64 nt, hsa
caggagccauugcucuccuagagggggucucagaaacugcgaggccaguuccuuggagggacau

SEQ ID NO: 498671 - RNA, 64 nt, hsa
agagugcuuauuuaaguguuaauacuuuuaagagaacugcgacgauuaauuguggaucuccccc

SEQ ID NO: 498672 - RNA, 64 nt, hsa
uguauuugauauuugugaucagugaucauuguucaacugcgaaauagaguguuugcuuuugaua

SEQ ID NO: 498673 - RNA, 64 nt, hsa
aauuacacugugcuuaaugacugauuuuuuuuuaaacugcgagucccuuaagaucacguuuguc

SEQ ID NO: 498674 - RNA, 64 nt, hsa
cuccuuucuuuaucucuaucucagaugguuguuuaacugcgaguuuaaauguguuuguccugga

SEQ ID NO: 498675 - RNA, 64 nt, hsa
acccgacucgguuucuggauauccuccgugggcgaacugcgagccccauucccagcucuucucc

SEQ ID NO: 498676 - RNA, 63 nt, hsa
aggcccugaucugcgcuguggcugucccuggacgugcugcagcccuccugucccuucccccca

SEQ ID NO: 498677 - RNA, 63 nt, hsa
ccgcuggggcggccggggcgggagagaaagguggugcugcagugguggcccuggggggccauu

SEQ ID NO: 498678 - RNA, 63 nt, hsa
gagccugaggccuuccagaaagcaggagcagcugugcugcaccccaugugggugaccaggucc

SEQ ID NO: 498679 - RNA, 63 nt, hsa
augcccguguaaaguaugugaaucgcaaggccugugcugcaugcgacagcguccgggguggug

SEQ ID NO: 498680 - RNA, 63 nt, hsa
uuaguuacauauguauacaugugccaugcuggugugcugcacccauuaacucgucauuuauca

SEQ ID NO: 498681 - RNA, 63 nt, hsa
uggguugguuccaagucuuugcuauugugaauagugcugcaauaaacauacgugugcaugugu

SEQ ID NO: 498682 - RNA, 63 nt, hsa
agccugcaggcuuuggaaguggcccugucacccgugcugcacgggauucacagccccagcccc

SEQ ID NO: 498683 - RNA, 63 nt, hsa
uucccgaguugucugccucuccucaaaugcugugugcugcaauuguccaggcgaugacaaugg

SEQ ID NO: 498684 - RNA, 63 nt, hsa
gauguggggagucuggaaacacccggcccacgcgugcugcagauguggggagcccggaaacac

SEQ ID NO: 498685 - RNA, 63 nt, hsa
gauguggggagccuggaaacacccggcccacgcgugcugcagauguggggagucuggaaacac

SEQ ID NO: 498686 - RNA, 63 nt, hsa
gauguggggagccuggaaacacccggcccacgcgugcugcagauguggggagccuggaaacac

SEQ ID NO: 498687 - RNA, 63 nt, hsa
gacguggggagccuggaaacacccggcccacgcgugcugcagauguggggagccuggaaacac

SEQ ID NO: 498688 - RNA, 63 nt, hsa
ccuggggggugugauuugugugcgugcuugcaugugcugcagguguaagagagugggagcagg

SEQ ID NO: 498689 - RNA, 63 nt, hsa
ccagagacucugaaacuauagaauaaagccucugugcugcacaacaaaggggcaggcucugcu

SEQ ID NO: 498690 - RNA, 63 nt, hsa
ccgcccagcuucucccugagggcccaccagccugugcugcauacccaccgcccagcuucuccc

SEQ ID NO: 498691 - RNA, 63 nt, hsa
gccccugcccugccucugagggcccaccagccugugcugcauacccaccgcccagcuucuccc

SEQ ID NO: 498692 - RNA, 63 nt, hsa
ucaggccagagugucucaaacuggacaagaaaugugcugcauugccgaguucuuauuuucacc

SEQ ID NO: 498693 - RNA, 63 nt, hsa
cuaggcccucuccuguugcucugucauccuaaugugcugcauccaccucauggaccaagaugg

SEQ ID NO: 498694 - RNA, 63 nt, hsa
ggggucugccccucccuucucaccucuggagcugugcugcacugcuucagcccagagggcccu

SEQ ID NO: 498695 - RNA, 63 nt, hsa
cucucaggcaugccccauucacagcugaagugggugcugcaacgucuugaacaaggcagaagu

SEQ ID NO: 498696 - RNA, 63 nt, hsa
guuuccuccugggaugcgugcaaggcagaccuggugcugcaaaggaaagggccugaggccuca

SEQ ID NO: 498697 - RNA, 63 nt, hsa
ccugugugugggguggugagggucuccccaccagugcugcaccccgcagcagcauacaggccu

SEQ ID NO: 498698 - RNA, 63 nt, hsa
guccucagggagggagugaccucgacccuggcugugcugcaagcugacuccagccuugguacu

SEQ ID NO: 498699 - RNA, 63 nt, hsa
agaccugccccaagggugaugcagaggccacaggugcugcacgcuccagcgcccacucuagac

SEQ ID NO: 498700 - RNA, 63 nt, hsa
ccgccguggcugggaagguucccugcagugccagugcugcagcagggagagcugggcagaagc

SEQ ID NO: 498701 - RNA, 63 nt, hsa
uuuagggccaccauggcgcagcgccuggugcgcgugcugcagaucugugcuggccacgugccc

SEQ ID NO: 498702 - RNA, 64 nt, hsa; identical to SEQ ID NO: 79940

SEQ ID NO: 498703 - RNA, 64 nt, hsa; identical to SEQ ID NO: 79941

SEQ ID NO: 498704 - RNA, 64 nt, hsa; identical to SEQ ID NO: 79942

SEQ ID NO: 498705 - RNA, 64 nt, hsa; identical to SEQ ID NO: 79943

SEQ ID NO: 498706 - RNA, 64 nt, hsa; identical to SEQ ID NO: 79944

SEQ ID NO: 498707 - RNA, 64 nt, hsa; identical to SEQ ID NO: 79945

SEQ ID NO: 498708 - RNA, 64 nt, hsa; identical to SEQ ID NO: 79946

SEQ ID NO: 498709 - RNA, 64 nt, hsa; identical to SEQ ID NO: 79947

SEQ ID NO: 498710 - RNA, 57 nt, hsa
uuuuagccaguauuugcccuuucuauccagccuuaugaauaauagcaguaaaaucac

SEQ ID NO: 498711 - RNA, 57 nt, hsa
guauacucuugaugguuagaacucuuacagccuuauuuauuuuuaaguuuguuacag

SEQ ID NO: 498712 - RNA, 57 nt, hsa
ucauuauaucuggcuuccuauaaacaacagccuuaauucagucaagacucccuuugg

SEQ ID NO: 498713 - RNA, 57 nt, hsa
cacuggugguuauuacagcaugguucccagccuuacagugucuaagugcuucucuug

SEQ ID NO: 498714 - RNA, 57 nt, hsa
uugcuauuuccacccauuuguuuucggcagccuuaaggcccucauucucauuucggg

SEQ ID NO: 498715 - RNA, 57 nt, hsa
aguuguuugggcuuuaacauccuuauucagccuuauccagguugguuuugcuguuga

SEQ ID NO: 498716 - RNA, 57 nt, hsa
ggcuagugugggggagggaggcuuccccagccuuaagagacccucucagcccaguga

SEQ ID NO: 498717 - RNA, 57 nt, hsa
caacccgggcacccucggcccucccugcagccuuaacauucucuuccccugcuccuc

SEQ ID NO: 498718 - RNA, 64 nt, hsa
cuucugccauuuuccuccuucacucguccugaaaaucugcaaguuacauaauaaaacuuuagau

SEQ ID NO: 498719 - RNA, 64 nt, hsa
gaaagaaaaaaaaaguuugcacuaauugagguacaucugcaagugagacuuuuugucaggaaaa

SEQ ID NO: 498720 - RNA, 64 nt, hsa
aacugaaaucaucuaaagaguuaaaauuucagugaucugcaauuaauuacauuguggaagauua

SEQ ID NO: 498721 - RNA, 64 nt, hsa
uaccauuuauguggcagaaguucuguucccuauaaucugcaaugcugaaguaucucuauucaau

SEQ ID NO: 498722 - RNA, 64 nt, hsa; identical to SEQ ID NO: 243856

SEQ ID NO: 498723 - RNA, 64 nt, hsa; identical to SEQ ID NO: 243857

SEQ ID NO: 498724 - RNA, 64 nt, hsa; identical to SEQ ID NO: 243858

SEQ ID NO: 498725 - RNA, 64 nt, hsa; identical to SEQ ID NO: 243859

SEQ ID NO: 498726 - RNA, 64 nt, hsa; identical to SEQ ID NO: 98228

SEQ ID NO: 498727 - RNA, 64 nt, hsa; identical to SEQ ID NO: 98229

SEQ ID NO: 498728 - RNA, 64 nt, hsa; identical to SEQ ID NO: 98230

SEQ ID NO: 498729 - RNA, 64 nt, hsa; identical to SEQ ID NO: 98231

SEQ ID NO: 498730 - RNA, 64 nt, hsa; identical to SEQ ID NO: 98232

SEQ ID NO: 498731 - RNA, 64 nt, hsa; identical to SEQ ID NO: 98233

SEQ ID NO: 498732 - RNA, 64 nt, hsa; identical to SEQ ID NO: 98234

SEQ ID NO: 498733 - RNA, 64 nt, hsa; identical to SEQ ID NO: 98235

SEQ ID NO: 498734 - RNA, 64 nt, hsa; identical to SEQ ID NO: 98236

SEQ ID NO: 498735 - RNA, 64 nt, hsa; identical to SEQ ID NO: 98237

SEQ ID NO: 498736 - RNA, 64 nt, hsa; identical to SEQ ID NO: 98238

SEQ ID NO: 498737 - RNA, 64 nt, hsa; identical to SEQ ID NO: 98239

SEQ ID NO: 498738 - RNA, 64 nt, hsa; identical to SEQ ID NO: 98240

SEQ ID NO: 498739 - RNA, 64 nt, hsa; identical to SEQ ID NO: 98241

SEQ ID NO: 498740 - RNA, 64 nt, hsa; identical to SEQ ID NO: 98242

SEQ ID NO: 498741 - RNA, 64 nt, hsa; identical to SEQ ID NO: 98243

SEQ ID NO: 498742 - RNA, 64 nt, hsa; identical to SEQ ID NO: 98244

SEQ ID NO: 498743 - RNA, 64 nt, hsa; identical to SEQ ID NO: 98245

SEQ ID NO: 498744 - RNA, 64 nt, hsa; identical to SEQ ID NO: 98246

SEQ ID NO: 498745 - RNA, 64 nt, hsa; identical to SEQ ID NO: 98247

SEQ ID NO: 498746 - RNA, 64 nt, hsa; identical to SEQ ID NO: 98248

SEQ ID NO: 498747 - RNA, 64 nt, hsa; identical to SEQ ID NO: 98249

SEQ ID NO: 498748 - RNA, 64 nt, hsa; identical to SEQ ID NO: 98250

SEQ ID NO: 498749 - RNA, 64 nt, hsa; identical to SEQ ID NO: 98251

SEQ ID NO: 498750 - RNA, 64 nt, hsa; identical to SEQ ID NO: 98252

SEQ ID NO: 498751 - RNA, 64 nt, hsa; identical to SEQ ID NO: 98253

SEQ ID NO: 498752 - RNA, 64 nt, hsa; identical to SEQ ID NO: 98254

SEQ ID NO: 498753 - RNA, 64 nt, hsa; identical to SEQ ID NO: 98255

SEQ ID NO: 498754 - RNA, 64 nt, hsa; identical to SEQ ID NO: 98256

SEQ ID NO: 498755 - RNA, 64 nt, hsa; identical to SEQ ID NO: 98257

SEQ ID NO: 498756 - RNA, 64 nt, hsa; identical to SEQ ID NO: 98258

SEQ ID NO: 498757 - RNA, 64 nt, hsa; identical to SEQ ID NO: 98259

SEQ ID NO: 498758 - RNA, 64 nt, hsa; identical to SEQ ID NO: 98260

SEQ ID NO: 498759 - RNA, 64 nt, hsa; identical to SEQ ID NO: 98261

SEQ ID NO: 498760 - RNA, 64 nt, hsa; identical to SEQ ID NO: 98262

SEQ ID NO: 498761 - RNA, 64 nt, hsa; identical to SEQ ID NO: 98263

SEQ ID NO: 498762 - RNA, 64 nt, hsa; identical to SEQ ID NO: 98264

SEQ ID NO: 498763 - RNA, 64 nt, hsa
cacacacgcucaaaccccuguccacauauacaaccauacauacuugcacauguguguucaugua

SEQ ID NO: 498764 - RNA, 64 nt, hsa
gcaaagcauacacacacacuccaauccauccaugcauacauagacacaagacacacacgcucaa

SEQ ID NO: 498765 - RNA, 64 nt, hsa
uuauaacuaaaaaucuuacuauaaugaaagaaaucauacauaaaaauguagccugccuuacaua

SEQ ID NO: 498766 - RNA, 64 nt, hsa
aaugccuuggauauuucuguguugucuuuccauucauacauaauuuuagguuaucauuauccuu

SEQ ID NO: 498767 - RNA, 64 nt, hsa
cuucuaauuauaguuugaaaauagauucccuacacauacauacauauguaugcacagauagggu

SEQ ID NO: 498768 - RNA, 64 nt, hsa
uaauuauaguuugaaaauagauucccuacacauacauacauauguaugcacagauagggucuug

SEQ ID NO: 498769 - RNA, 64 nt, hsa
aaaugaaacauuuugaguacugauggcauguuaucauacauaaaguaggucauuuaggaaaaaa

SEQ ID NO: 498770 - RNA, 64 nt, hsa
uucauuauucugauagauuguauacauauguacacauacauauacacauaugcacagucaaggu

SEQ ID NO: 498771 - RNA, 64 nt, hsa
uguauguauacacacauauacauauauauauacacauacauacacauacauacauacauacaua

SEQ ID NO: 498772 - RNA, 64 nt, hsa
cacacauauacauauauauauacacauacauacacauacauacauacauacauauauaucugau

SEQ ID NO: 498773 - RNA, 64 nt, hsa
cauauacauauauauauacacauacauacacauacauacauacauacauauauaucugauaaaa

SEQ ID NO: 498774 - RNA, 64 nt, hsa
uacauauauauauacacauacauacacauacauacauacauacauauauaucugauaaaauugu

SEQ ID NO: 498775 - RNA, 64 nt, hsa
uauauauauacacauacauacacauacauacauacauacauauauaucugauaaaauugugaug

SEQ ID NO: 498776 - RNA, 64 nt, hsa
acccacaccauacauacauacauauauauauacacauacauacaaaccugugugccaagugaca

SEQ ID NO: 498777 - RNA, 64 nt, hsa
uaauuuuuaagacuauguacccacaccauacauacauacauauauauauacacauacauacaaa

SEQ ID NO: 498778 - RNA, 64 nt, hsa
uggguaauuuuuaagacuauguacccacaccauacauacauacauauauauauacacauacaua

SEQ ID NO: 498779 - RNA, 64 nt, hsa
uuacuggguaauuuuuaagacuauguacccacaccauacauacauacauauauauauacacaua

SEQ ID NO: 498780 - RNA, 64 nt, hsa
ucagaucucuucuacuguauuacugaauagcauacauacauagacaauguucgccauucacuag

SEQ ID NO: 498781 - RNA, 64 nt, hsa
uaucucagaucucuucuacuguauuacugaauagcauacauacauagacaauguucgccauuca

SEQ ID NO: 498782 - RNA, 64 nt, hsa
ggccagagauuagagauuucacugauauuuuggacauacauaagaaacaucauuauaauuaaua

SEQ ID NO: 498783 - RNA, 56 nt, hsa
uucuuagaaucuggaauuaacagugucauacauauuuguucuccauugauauaucu

SEQ ID NO: 498784 - RNA, 64 nt, hsa
uauauauauauauauacauauauauacauacacacauacauauaauuuuuuuuuuuuuugagau

SEQ ID NO: 498785 - RNA, 64 nt, hsa
cacacacacacacacacacacacacacauacauacauacauauauauauauauauacauauaua

SEQ ID NO: 498786 - RNA, 64 nt, hsa
uacacacacacacacacacacacacacacacauacauacauacauauauauauauauauacaua

SEQ ID NO: 498787 - RNA, 64 nt, hsa
uauauacacacacacacacacacacacacacacacauacauacauacauauauauauauauaua

SEQ ID NO: 498788 - RNA, 64 nt, hsa
acacuugcaggagcagagcuggucaucgucuuagcauacauauccuacacugaguaaaccguaa

SEQ ID NO: 498789 - RNA, 64 nt, hsa
gucaucagcaugcuggguugucauggguuugcugcauacauaguucacccuaauuuauacuuac

SEQ ID NO: 498790 - RNA, 64 nt, hsa
acacauaauacaaacauacaugcaugcacacauacauacauauguauacacacacauaauuuga

SEQ ID NO: 498791 - RNA, 64 nt, hsa
aaauacacauaauacaaacauacaugcaugcacacauacauacauauguauacacacacauaau

SEQ ID NO: 498792 - RNA, 64 nt, hsa
uuauagagcugcaaaacacacacaugcguauagacauacauacauguacaccauacauagacaa

SEQ ID NO: 498793 - RNA, 64 nt, hsa
acacacaugcguauagacauacauacauguacaccauacauagacaagcaucauaaaggcacaa

SEQ ID NO: 498794 - RNA, 64 nt, hsa
aacugacauuccuuuaaaaauauaaauauaaauacauacauacauagauauauacccagacuug

SEQ ID NO: 498795 - RNA, 64 nt, hsa
gacauuccuuuaaaaauauaaauauaaauacauacauacauagauauauacccagacuugggug

SEQ ID NO: 498796 - RNA, 64 nt, hsa
uacuauuugaauagaaauguguauguauaauauacauacauacauaagcauauaugugugugug

SEQ ID NO: 498797 - RNA, 64 nt, hsa
auuugaauagaaauguguauguauaauauacauacauacauaagcauauaugugugugugugug

SEQ ID NO: 498798 - RNA, 64 nt, hsa
cuuugaacuauauguauguguauaaggguauacacauacauauauggcauauaacaaguguaca

SEQ ID NO: 498799 - RNA, 64 nt, hsa
cauauacacauaacaaguguagaaguauauauuacauacauacacucacucugucugguauagg

SEQ ID NO: 498800 - RNA, 64 nt, hsa
ugucucaaaaguauaaaaaacuuuaauacaaguacauacauauuauauauacacauacauauau

SEQ ID NO: 498801 - RNA, 64 nt, hsa
acuuuaauacaaguacauacauauuauauauacacauacauauauauacuauauauggaugaaa

SEQ ID NO: 498802 - RNA, 64 nt, hsa
acagagugagauucugucucaaaauaaauacauacauacauacaauaaaaccgaaugagcuggu

SEQ ID NO: 498803 - RNA, 64 nt, hsa
gacgacagagugagauucugucucaaaauaaauacauacauacauacaauaaaaccgaaugagc

SEQ ID NO: 498804 - RNA, 64 nt, hsa
cugaagaaauuauacguacauacacacauacauacauacauacaaauauauguauauauauucu

SEQ ID NO: 498805 - RNA, 64 nt, hsa
ugagcugaagaaauuauacguacauacacacauacauacauacauacaaauauauguauauaua

SEQ ID NO: 498806 - RNA, 64 nt, hsa
augcugagcugaagaaauuauacguacauacacacauacauacauacauacaaauauauguaua

SEQ ID NO: 498807 - RNA, 64 nt, hsa
ccuaacccauaguuuauauguauaugcacacauacauacauauauguuguguauaaauguacac

SEQ ID NO: 498808 - RNA, 64 nt, hsa
ccagccuaacccauaguuuauauguauaugcacacauacauacauauauguuguguauaaaugu

SEQ ID NO: 498809 - RNA, 64 nt, hsa
agaaauuuuauaaauguguauuucuguguauucacauacauauauauauacacacauauauaug

SEQ ID NO: 498810 - RNA, 64 nt, hsa
cauauauauauacacacauauauauguacauacacauacauacauauuaccauacugaagggaa

SEQ ID NO: 498811 - RNA, 64 nt, hsa
uauauauacacacauauauauguacauacacauacauacauauuaccauacugaagggaaaugg

SEQ ID NO: 498812 - RNA, 64 nt, hsa; identical to SEQ ID NO: 167088

SEQ ID NO: 498813 - RNA, 64 nt, hsa; identical to SEQ ID NO: 167089

SEQ ID NO: 498814 - RNA, 64 nt, hsa; identical to SEQ ID NO: 167090

SEQ ID NO: 498815 - RNA, 64 nt, hsa; identical to SEQ ID NO: 167091

SEQ ID NO: 498816 - RNA, 64 nt, hsa; identical to SEQ ID NO: 167092

SEQ ID NO: 498817 - RNA, 64 nt, hsa; identical to SEQ ID NO: 167093

SEQ ID NO: 498818 - RNA, 64 nt, hsa; identical to SEQ ID NO: 167094

SEQ ID NO: 498819 - RNA, 64 nt, hsa; identical to SEQ ID NO: 167095

SEQ ID NO: 498820 - RNA, 64 nt, hsa; identical to SEQ ID NO: 167096

SEQ ID NO: 498821 - RNA, 64 nt, hsa; identical to SEQ ID NO: 167097

SEQ ID NO: 498822 - RNA, 64 nt, hsa; identical to SEQ ID NO: 167098

SEQ ID NO: 498823 - RNA, 64 nt, hsa; identical to SEQ ID NO: 167099

SEQ ID NO: 498824 - RNA, 64 nt, hsa; identical to SEQ ID NO: 167100

SEQ ID NO: 498825 - RNA, 64 nt, hsa; identical to SEQ ID NO: 167101

SEQ ID NO: 498826 - RNA, 64 nt, hsa; identical to SEQ ID NO: 167102

SEQ ID NO: 498827 - RNA, 64 nt, hsa; identical to SEQ ID NO: 167103

SEQ ID NO: 498828 - RNA, 64 nt, hsa; identical to SEQ ID NO: 167104

SEQ ID NO: 498829 - RNA, 64 nt, hsa; identical to SEQ ID NO: 167105

SEQ ID NO: 498830 - RNA, 64 nt, hsa; identical to SEQ ID NO: 167106

SEQ ID NO: 498831 - RNA, 64 nt, hsa; identical to SEQ ID NO: 167107

SEQ ID NO: 498832 - RNA, 64 nt, hsa; identical to SEQ ID NO: 167108

SEQ ID NO: 498833 - RNA, 64 nt, hsa; identical to SEQ ID NO: 167109

SEQ ID NO: 498834 - RNA, 64 nt, hsa; identical to SEQ ID NO: 167110

SEQ ID NO: 498835 - RNA, 64 nt, hsa; identical to SEQ ID NO: 167111

SEQ ID NO: 498836 - RNA, 64 nt, hsa; identical to SEQ ID NO: 167112

SEQ ID NO: 498837 - RNA, 64 nt, hsa; identical to SEQ ID NO: 167113

SEQ ID NO: 498838 - RNA, 64 nt, hsa; identical to SEQ ID NO: 167114

SEQ ID NO: 498839 - RNA, 64 nt, hsa; identical to SEQ ID NO: 167115

SEQ ID NO: 498840 - RNA, 64 nt, hsa; identical to SEQ ID NO: 167116

SEQ ID NO: 498841 - RNA, 64 nt, hsa; identical to SEQ ID NO: 167117

SEQ ID NO: 498842 - RNA, 64 nt, hsa; identical to SEQ ID NO: 167118

SEQ ID NO: 498843 - RNA, 64 nt, hsa; identical to SEQ ID NO: 167119

SEQ ID NO: 498844 - RNA, 64 nt, hsa; identical to SEQ ID NO: 167120

SEQ ID NO: 498845 - RNA, 64 nt, hsa; identical to SEQ ID NO: 167121

SEQ ID NO: 498846 - RNA, 64 nt, hsa; identical to SEQ ID NO: 167122

SEQ ID NO: 498847 - RNA, 64 nt, hsa; identical to SEQ ID NO: 167123

SEQ ID NO: 498848 - RNA, 64 nt, hsa; identical to SEQ ID NO: 167124

SEQ ID NO: 498849 - RNA, 64 nt, hsa; identical to SEQ ID NO: 167125

SEQ ID NO: 498850 - RNA, 64 nt, hsa; identical to SEQ ID NO: 167126

SEQ ID NO: 498851 - RNA, 64 nt, hsa; identical to SEQ ID NO: 167127

SEQ ID NO: 498852 - RNA, 64 nt, hsa; identical to SEQ ID NO: 167128

SEQ ID NO: 498853 - RNA, 64 nt, hsa; identical to SEQ ID NO: 167129

SEQ ID NO: 498854 - RNA, 64 nt, hsa; identical to SEQ ID NO: 167130

SEQ ID NO: 498855 - RNA, 64 nt, hsa; identical to SEQ ID NO: 167131

SEQ ID NO: 498856 - RNA, 64 nt, hsa; identical to SEQ ID NO: 167132

SEQ ID NO: 498857 - RNA, 64 nt, hsa; identical to SEQ ID NO: 167133

SEQ ID NO: 498858 - RNA, 64 nt, hsa; identical to SEQ ID NO: 167134

SEQ ID NO: 498859 - RNA, 64 nt, hsa; identical to SEQ ID NO: 167135

SEQ ID NO: 498860 - RNA, 64 nt, hsa; identical to SEQ ID NO: 167136

SEQ ID NO: 498861 - RNA, 64 nt, hsa; identical to SEQ ID NO: 167137

SEQ ID NO: 498862 - RNA, 64 nt, hsa; identical to SEQ ID NO: 167138

SEQ ID NO: 498863 - RNA, 64 nt, hsa; identical to SEQ ID NO: 167139

SEQ ID NO: 498864 - RNA, 64 nt, hsa; identical to SEQ ID NO: 167140

SEQ ID NO: 498865 - RNA, 64 nt, hsa; identical to SEQ ID NO: 167141

SEQ ID NO: 498866 - RNA, 64 nt, hsa; identical to SEQ ID NO: 167142

SEQ ID NO: 498867 - RNA, 64 nt, hsa; identical to SEQ ID NO: 167143

SEQ ID NO: 498868 - RNA, 64 nt, hsa; identical to SEQ ID NO: 167144

SEQ ID NO: 498869 - RNA, 64 nt, hsa; identical to SEQ ID NO: 167145

SEQ ID NO: 498870 - RNA, 64 nt, hsa; identical to SEQ ID NO: 167146

SEQ ID NO: 498871 - RNA, 64 nt, hsa; identical to SEQ ID NO: 167147

SEQ ID NO: 498872 - RNA, 64 nt, hsa; identical to SEQ ID NO: 167148

SEQ ID NO: 498873 - RNA, 64 nt, hsa; identical to SEQ ID NO: 167149

SEQ ID NO: 498874 - RNA, 64 nt, hsa; identical to SEQ ID NO: 167150

SEQ ID NO: 498875 - RNA, 64 nt, hsa; identical to SEQ ID NO: 167151

SEQ ID NO: 498876 - RNA, 64 nt, hsa; identical to SEQ ID NO: 167152

SEQ ID NO: 498877 - RNA, 64 nt, hsa; identical to SEQ ID NO: 167153

SEQ ID NO: 498878 - RNA, 64 nt, hsa; identical to SEQ ID NO: 167154

SEQ ID NO: 498879 - RNA, 64 nt, hsa; identical to SEQ ID NO: 167155

SEQ ID NO: 498880 - RNA, 64 nt, hsa; identical to SEQ ID NO: 167156

SEQ ID NO: 498881 - RNA, 64 nt, hsa; identical to SEQ ID NO: 167157

SEQ ID NO: 498882 - RNA, 64 nt, hsa; identical to SEQ ID NO: 167158

SEQ ID NO: 498883 - RNA, 64 nt, hsa; identical to SEQ ID NO: 167159

SEQ ID NO: 498884 - RNA, 64 nt, hsa; identical to SEQ ID NO: 167160

SEQ ID NO: 498885 - RNA, 64 nt, hsa; identical to SEQ ID NO: 167161

SEQ ID NO: 498886 - RNA, 64 nt, hsa; identical to SEQ ID NO: 167162

SEQ ID NO: 498887 - RNA, 64 nt, hsa; identical to SEQ ID NO: 167163

SEQ ID NO: 498888 - RNA, 64 nt, hsa; identical to SEQ ID NO: 167164

SEQ ID NO: 498889 - RNA, 64 nt, hsa; identical to SEQ ID NO: 167165

SEQ ID NO: 498890 - RNA, 64 nt, hsa; identical to SEQ ID NO: 167166

SEQ ID NO: 498891 - RNA, 64 nt, hsa; identical to SEQ ID NO: 167167

SEQ ID NO: 498892 - RNA, 64 nt, hsa; identical to SEQ ID NO: 167168

SEQ ID NO: 498893 - RNA, 64 nt, hsa; identical to SEQ ID NO: 473932

SEQ ID NO: 498894 - RNA, 64 nt, hsa; identical to SEQ ID NO: 473933

SEQ ID NO: 498895 - RNA, 64 nt, hsa; identical to SEQ ID NO: 473934

SEQ ID NO: 498896 - RNA, 64 nt, hsa; identical to SEQ ID NO: 473935

SEQ ID NO: 498897 - RNA, 64 nt, hsa; identical to SEQ ID NO: 473936

SEQ ID NO: 498898 - RNA, 64 nt, hsa; identical to SEQ ID NO: 473937

SEQ ID NO: 498899 - RNA, 64 nt, hsa; identical to SEQ ID NO: 473938

SEQ ID NO: 498900 - RNA, 64 nt, hsa; identical to SEQ ID NO: 473939

SEQ ID NO: 498901 - RNA, 64 nt, hsa; identical to SEQ ID NO: 473940

SEQ ID NO: 498902 - RNA, 64 nt, hsa; identical to SEQ ID NO: 473941

SEQ ID NO: 498903 - RNA, 64 nt, hsa; identical to SEQ ID NO: 473942

SEQ ID NO: 498904 - RNA, 64 nt, hsa; identical to SEQ ID NO: 473943

SEQ ID NO: 498905 - RNA, 64 nt, hsa; identical to SEQ ID NO: 473944

SEQ ID NO: 498906 - RNA, 64 nt, hsa; identical to SEQ ID NO: 473945

SEQ ID NO: 498907 - RNA, 64 nt, hsa; identical to SEQ ID NO: 473946

SEQ ID NO: 498908 - RNA, 64 nt, hsa; identical to SEQ ID NO: 473947

SEQ ID NO: 498909 - RNA, 64 nt, hsa; identical to SEQ ID NO: 473948

SEQ ID NO: 498910 - RNA, 64 nt, hsa; identical to SEQ ID NO: 473949

SEQ ID NO: 498911 - RNA, 64 nt, hsa; identical to SEQ ID NO: 473950

SEQ ID NO: 498912 - RNA, 64 nt, hsa; identical to SEQ ID NO: 473951

SEQ ID NO: 498913 - RNA, 64 nt, hsa; identical to SEQ ID NO: 473952

SEQ ID NO: 498914 - RNA, 64 nt, hsa; identical to SEQ ID NO: 473953

SEQ ID NO: 498915 - RNA, 64 nt, hsa; identical to SEQ ID NO: 473954

SEQ ID NO: 498916 - RNA, 64 nt, hsa; identical to SEQ ID NO: 473955

SEQ ID NO: 498917 - RNA, 64 nt, hsa; identical to SEQ ID NO: 473956

SEQ ID NO: 498918 - RNA, 64 nt, hsa; identical to SEQ ID NO: 473957

SEQ ID NO: 498919 - RNA, 64 nt, hsa; identical to SEQ ID NO: 473958

SEQ ID NO: 498920 - RNA, 64 nt, hsa; identical to SEQ ID NO: 473959

SEQ ID NO: 498921 - RNA, 64 nt, hsa; identical to SEQ ID NO: 473960

SEQ ID NO: 498922 - RNA, 64 nt, hsa; identical to SEQ ID NO: 473961

SEQ ID NO: 498923 - RNA, 64 nt, hsa; identical to SEQ ID NO: 473962

SEQ ID NO: 498924 - RNA, 64 nt, hsa; identical to SEQ ID NO: 473963

SEQ ID NO: 498925 - RNA, 64 nt, hsa; identical to SEQ ID NO: 473964

SEQ ID NO: 498926 - RNA, 64 nt, hsa; identical to SEQ ID NO: 473965

SEQ ID NO: 498927 - RNA, 64 nt, hsa; identical to SEQ ID NO: 473966

SEQ ID NO: 498928 - RNA, 64 nt, hsa; identical to SEQ ID NO: 473967

SEQ ID NO: 498929 - RNA, 64 nt, hsa; identical to SEQ ID NO: 473968

SEQ ID NO: 498930 - RNA, 64 nt, hsa; identical to SEQ ID NO: 473969

SEQ ID NO: 498931 - RNA, 64 nt, hsa; identical to SEQ ID NO: 473970

SEQ ID NO: 498932 - RNA, 64 nt, hsa; identical to SEQ ID NO: 473971

SEQ ID NO: 498933 - RNA, 64 nt, hsa; identical to SEQ ID NO: 473972

SEQ ID NO: 498934 - RNA, 64 nt, hsa; identical to SEQ ID NO: 473973

SEQ ID NO: 498935 - RNA, 64 nt, hsa; identical to SEQ ID NO: 473974

SEQ ID NO: 498936 - RNA, 64 nt, hsa; identical to SEQ ID NO: 473975

SEQ ID NO: 498937 - RNA, 64 nt, hsa; identical to SEQ ID NO: 473976

SEQ ID NO: 498938 - RNA, 64 nt, hsa; identical to SEQ ID NO: 473977

SEQ ID NO: 498939 - RNA, 64 nt, hsa; identical to SEQ ID NO: 473978

SEQ ID NO: 498940 - RNA, 64 nt, hsa; identical to SEQ ID NO: 473979

SEQ ID NO: 498941 - RNA, 64 nt, hsa; identical to SEQ ID NO: 473980

SEQ ID NO: 498942 - RNA, 64 nt, hsa; identical to SEQ ID NO: 473981

SEQ ID NO: 498943 - RNA, 64 nt, hsa; identical to SEQ ID NO: 473982

SEQ ID NO: 498944 - RNA, 64 nt, hsa; identical to SEQ ID NO: 473983

SEQ ID NO: 498945 - RNA, 64 nt, hsa; identical to SEQ ID NO: 473984

SEQ ID NO: 498946 - RNA, 64 nt, hsa; identical to SEQ ID NO: 473985

SEQ ID NO: 498947 - RNA, 64 nt, hsa; identical to SEQ ID NO: 473986

SEQ ID NO: 498948 - RNA, 64 nt, hsa; identical to SEQ ID NO: 473987

SEQ ID NO: 498949 - RNA, 64 nt, hsa; identical to SEQ ID NO: 473988

SEQ ID NO: 498950 - RNA, 64 nt, hsa; identical to SEQ ID NO: 473989

SEQ ID NO: 498951 - RNA, 64 nt, hsa; identical to SEQ ID NO: 473990

SEQ ID NO: 498952 - RNA, 64 nt, hsa; identical to SEQ ID NO: 473991

SEQ ID NO: 498953 - RNA, 64 nt, hsa; identical to SEQ ID NO: 473992

SEQ ID NO: 498954 - RNA, 64 nt, hsa; identical to SEQ ID NO: 473993

SEQ ID NO: 498955 - RNA, 64 nt, hsa; identical to SEQ ID NO: 473994

SEQ ID NO: 498956 - RNA, 64 nt, hsa; identical to SEQ ID NO: 473995

SEQ ID NO: 498957 - RNA, 64 nt, hsa; identical to SEQ ID NO: 473996

SEQ ID NO: 498958 - RNA, 64 nt, hsa; identical to SEQ ID NO: 473997

SEQ ID NO: 498959 - RNA, 64 nt, hsa; identical to SEQ ID NO: 473998

SEQ ID NO: 498960 - RNA, 64 nt, hsa; identical to SEQ ID NO: 473999

SEQ ID NO: 498961 - RNA, 64 nt, hsa; identical to SEQ ID NO: 474000

SEQ ID NO: 498962 - RNA, 64 nt, hsa; identical to SEQ ID NO: 474001

SEQ ID NO: 498963 - RNA, 64 nt, hsa; identical to SEQ ID NO: 474002

SEQ ID NO: 498964 - RNA, 64 nt, hsa; identical to SEQ ID NO: 474003

SEQ ID NO: 498965 - RNA, 64 nt, hsa; identical to SEQ ID NO: 474004

SEQ ID NO: 498966 - RNA, 64 nt, hsa; identical to SEQ ID NO: 474005

SEQ ID NO: 498967 - RNA, 64 nt, hsa; identical to SEQ ID NO: 474006

SEQ ID NO: 498968 - RNA, 64 nt, hsa; identical to SEQ ID NO: 474007

SEQ ID NO: 498969 - RNA, 64 nt, hsa; identical to SEQ ID NO: 474008

SEQ ID NO: 498970 - RNA, 64 nt, hsa; identical to SEQ ID NO: 474009

SEQ ID NO: 498971 - RNA, 64 nt, hsa; identical to SEQ ID NO: 474010

SEQ ID NO: 498972 - RNA, 64 nt, hsa; identical to SEQ ID NO: 474011

SEQ ID NO: 498973 - RNA, 64 nt, hsa; identical to SEQ ID NO: 474012

SEQ ID NO: 498974 - RNA, 64 nt, hsa; identical to SEQ ID NO: 474013

SEQ ID NO: 498975 - RNA, 64 nt, hsa; identical to SEQ ID NO: 474014

SEQ ID NO: 498976 - RNA, 64 nt, hsa; identical to SEQ ID NO: 474015

SEQ ID NO: 498977 - RNA, 64 nt, hsa; identical to SEQ ID NO: 474016

SEQ ID NO: 498978 - RNA, 64 nt, hsa; identical to SEQ ID NO: 474017

SEQ ID NO: 498979 - RNA, 64 nt, hsa; identical to SEQ ID NO: 474018

SEQ ID NO: 498980 - RNA, 64 nt, hsa; identical to SEQ ID NO: 474019

SEQ ID NO: 498981 - RNA, 64 nt, hsa; identical to SEQ ID NO: 474020

SEQ ID NO: 498982 - RNA, 64 nt, hsa; identical to SEQ ID NO: 474021

SEQ ID NO: 498983 - RNA, 64 nt, hsa; identical to SEQ ID NO: 474022

SEQ ID NO: 498984 - RNA, 64 nt, hsa; identical to SEQ ID NO: 474023

SEQ ID NO: 498985 - RNA, 64 nt, hsa; identical to SEQ ID NO: 474024

SEQ ID NO: 498986 - RNA, 64 nt, hsa; identical to SEQ ID NO: 474025

SEQ ID NO: 498987 - RNA, 64 nt, hsa; identical to SEQ ID NO: 474026

SEQ ID NO: 498988 - RNA, 64 nt, hsa; identical to SEQ ID NO: 474027

SEQ ID NO: 498989 - RNA, 64 nt, hsa; identical to SEQ ID NO: 474028

SEQ ID NO: 498990 - RNA, 64 nt, hsa; identical to SEQ ID NO: 474029

SEQ ID NO: 498991 - RNA, 64 nt, hsa; identical to SEQ ID NO: 474030

SEQ ID NO: 498992 - RNA, 64 nt, hsa; identical to SEQ ID NO: 474031

SEQ ID NO: 498993 - RNA, 64 nt, hsa; identical to SEQ ID NO: 474032

SEQ ID NO: 498994 - RNA, 64 nt, hsa; identical to SEQ ID NO: 474033

SEQ ID NO: 498995 - RNA, 61 nt, hsa
aggccggaaaauugugcucuagaagaauaaaacugaaaaacucuagagaauuuuuuuuccc

SEQ ID NO: 498996 - RNA, 61 nt, hsa
agauuucuucuuugaaaggucaagaccgugaacugaaaaaaguguuggccuuuuugcggga

SEQ ID NO: 498997 - RNA, 61 nt, hsa
guauucugauugcccuucaucccaaguguuuacugaaaauuccauucuagauauucuuguu

SEQ ID NO: 498998 - RNA, 61 nt, hsa
auuuccaggggcacacaaugcuauugaaauuacugaaaacaaaauaucugacaucuuauuu

SEQ ID NO: 498999 - RNA, 61 nt, hsa
agguuuuuauauaaauagugaaauuugaauuacugaaaaccauguuaauuuuuagaacuca

SEQ ID NO: 499000 - RNA, 61 nt, hsa
aagaacuuuguuacacauauuuugauaaggcacugaaaauauaaaaggacugguaguuuac

SEQ ID NO: 499001 - RNA, 61 nt, hsa
uuaaguaucuuccauguuaauguguuaagagacugaaaauaccagccaucagaaacuggcc

SEQ ID NO: 499002 - RNA, 61 nt, hsa
gacaucaguuuuaaaucaauggagagaaaaaacugaaaaagaugcugcuaaguaguucucu

SEQ ID NO: 499003 - RNA, 61 nt, hsa
uuuuaugcuccuuuuuuuucgcacucuuaagacugaaaauuggcguugaguguuauaguga

SEQ ID NO: 499004 - RNA, 61 nt, hsa
agugugauuggacugccagccagguuaauaaacugaaaaaugugauuggcuuccucucgcc

SEQ ID NO: 499005 - RNA, 61 nt, hsa
auuuagacaauuaaaacauuucuaaagugagacugaaaauaauauagaaaaucucauugcu

SEQ ID NO: 499006 - RNA, 58 nt, hsa
ggcuucauaacggauucuaacggaagacacugaaaagcgccauggcuacuuauucugc

SEQ ID NO: 499007 - RNA, 61 nt, hsa
guaaagauggguuuuuaaugauacuaagauaacugaaaauaggcauauagauauauuccaa

SEQ ID NO: 499008 - RNA, 61 nt, hsa
caucuggccaacauggugaaacccugucucuacugaaaauaaaaaaaacuagcugggcaug

SEQ ID NO: 499009 - RNA, 61 nt, hsa
cuuuguaugauauuuauuaggaggaaagaggacugaaaauguucuuguguagaaacagaag

SEQ ID NO: 499010 - RNA, 61 nt, hsa
acuaaugaagaaaugaauaauaaauuuugacacugaaaaacauuuuauuaauaaagaauau

SEQ ID NO: 499011 - RNA, 61 nt, hsa
guauaguaugugcauaauggaaaguuaccuuacugaaaaaaaaaaaagaaggaaaaauaag

SEQ ID NO: 499012 - RNA, 61 nt, hsa
ucugauuuuucauugcucuauaauucuuuuuacugaaaauacuauguuaugaaugguauua

SEQ ID NO: 499013 - RNA, 61 nt, hsa
uuugaaaacguuacauuuuuuaaaucuuaaaacugaaaacuuguuuuuaguauuucuauuu

SEQ ID NO: 499014 - RNA, 61 nt, hsa
guucucuuauuuuaaagauacagugcuccccacugaaaauuaaaccuaaaaaaugucacau

SEQ ID NO: 499015 - RNA, 61 nt, hsa
gcuuuaucauggaccagaggaaaaccagaaaacugaaaacauuccucugucuuguggccag

SEQ ID NO: 499016 - RNA, 61 nt, hsa
ccauuucacuacuagaaauugacgcaagugaacugaaaacuuauguucacacaaaaacucg

SEQ ID NO: 499017 - RNA, 61 nt, hsa
uacuuuggcucuugugcauaaaaacaagaacacugaaaauugggaauaugcacaaacuugg

SEQ ID NO: 499018 - RNA, 61 nt, hsa
uugcaguagugugaaaauacauuuuuuacaaacugaaaauacaguagauaagcugucgaaa

SEQ ID NO: 499019 - RNA, 61 nt, hsa
uugauauuuuuguaacagaauauagcucuuaacugaaaauccagaaccagaaacauaaauc

SEQ ID NO: 499020 - RNA, 61 nt, hsa
aucuuuugacucuguauuuaaauucuaugauacugaaaauaaaggcauucuggaaaaauac

SEQ ID NO: 499021 - RNA, 61 nt, hsa
aauugcuggcugcuuuuacuuccugaccaagacugaaaaauuauuuacugaaaucuguaaa

SEQ ID NO: 499022 - RNA, 61 nt, hsa
gugugucauggugccucaucauucuggggagacugaaaauaccuucaucacugaccuggug

SEQ ID NO: 499023 - RNA, 61 nt, hsa
uccacccccaacucaugaaaagauucuauggacugaaaaagccccaggcugaaaggacugg

SEQ ID NO: 499024 - RNA, 61 nt, hsa
auauuuuuguuauauacaauauugcugaugaacugaaaauuaacaaguaaaaugcacaugc

SEQ ID NO: 499025 - RNA, 61 nt, hsa
aaacucaagcuggagaaaugaguccugauagacugaaaauugagcaaauggaagaagauac

SEQ ID NO: 499026 - RNA, 61 nt, hsa
acagcccugggagggggcuauuucucuccccacugaaaacauuucaaagcugaguuacuug

SEQ ID NO: 499027 - RNA, 61 nt, hsa
cagagguuuaauuugaaguuuauguucacacacugaaaacuuaguuuuuuuguugguagau

SEQ ID NO: 499028 - RNA, 61 nt, hsa
aaagccuccuggcaccaggccuuccugcucgacugaaaaaaauuuucucuuugaaaauccc

SEQ ID NO: 499029 - RNA, 61 nt, hsa
ucuuggaguuucagaaaugcuagcuuggacaacugaaaagucacaucacagcuggcauucu

SEQ ID NO: 499030 - RNA, 61 nt, hsa
gaccccgucucuaaaaauaaaauguaaaaucacugaaaaaaugaguguucggugaaacaag

SEQ ID NO: 499031 - RNA, 61 nt, hsa
ccccagaggcugcauugaggagacuccacagacugaaaagugaguuugcagaaaccuuggg

SEQ ID NO: 499032 - RNA, 61 nt, hsa
gaaccuaacuuucucuuauugguggguaauaacugaaaauaaagauuuauuuucaugcuca

SEQ ID NO: 499033 - RNA, 61 nt, hsa
uaaucauacuuccucugugagacaggccauaacugaaaaacucuuaaauauuuagcaauca

SEQ ID NO: 499034 - RNA, 61 nt, hsa
caauauuugucacuguucuauuagacuuuuuacugaaaaugaauaaugguguaaugguucu

SEQ ID NO: 499035 - RNA, 61 nt, hsa
auaauuggaguucauacugaugcccugaggcacugaaaaaaaaaaaaaucccaaagugccu

SEQ ID NO: 499036 - RNA, 61 nt, hsa
aauaauagaauaaaggguugaguaacuuagaacugaaaaugaucucuuuuaaaaagaaauu

SEQ ID NO: 499037 - RNA, 61 nt, hsa
auuaaguggggucacugaauuccauuuguggacugaaaaguauucaauccacuuuuggggu

SEQ ID NO: 499038 - RNA, 61 nt, hsa
uuuuuuuucuuuuuaagccauaauuggugauacugaaaacuuuggguucccauuuauccug

SEQ ID NO: 499039 - RNA, 61 nt, hsa
gaagagacuuagagaugcuaauggaauuuaaacugaaaaaaggagcccaaugaagcuaagc

SEQ ID NO: 499040 - RNA, 61 nt, hsa
gggacauaaguuuuucugcuuucagacgcaaacugaaaaauggcucuucuugggucuugag

SEQ ID NO: 499041 - RNA, 61 nt, hsa
ugccuaaccuuuuggagccuuagucucccagacugaaaaaggaagaggaugguauuacauc

SEQ ID NO: 499042 - RNA, 61 nt, hsa
uguuacucuuucucucuccaucagcuuccucacugaaaaugugcauuaagugccuuguaga

SEQ ID NO: 499043 - RNA, 61 nt, hsa
gggugugggacccucaccgaauucauugauuacugaaaauugaauguuuuuuggguccaca

SEQ ID NO: 499044 - RNA, 61 nt, hsa
cagcaucugguaugcagccaccaggacaaggacugaaaauaaugucuacaguccacagcuu

SEQ ID NO: 499045 - RNA, 61 nt, hsa
aucaaaguccagcaggcaaggacggccuucaacugaaaagacucaguguucccuuuccuac

SEQ ID NO: 499046 - RNA, 61 nt, hsa
accuguccuacccucaaagccauaugcaaauacugaaaagaaggccugaggggcugguccu

SEQ ID NO: 499047 - RNA, 61 nt, hsa
caguguuugacuagggaucaugaaauaauaaacugaaaaaaacuuuagaguucaguugauc

SEQ ID NO: 499048 - RNA, 61 nt, hsa
uugguggcucugauccauauggucaaaaaggacugaaaaauugugauguauuugauccugu

SEQ ID NO: 499049 - RNA, 61 nt, hsa
caaacauaggucugggcauuaaauuauacaaacugaaaauguguuacaagaaaaauaugag

SEQ ID NO: 499050 - RNA, 61 nt, hsa
guacuugggcuucagaaguaagagccaaccaacugaaaaccugagauggagauauguucaa

SEQ ID NO: 499051 - RNA, 61 nt, hsa
uugacgggaagagguacaucuuuuuuuccuuacugaaaacaaauauggauuaauugccuca

SEQ ID NO: 499052 - RNA, 61 nt, hsa
uuaaaauaagaaaaggagcacuuuaauuacaacugaaaaaucagauuguuuuguaguccuu

SEQ ID NO: 499053 - RNA, 61 nt, hsa
ugaaacgaugagaguaaguugcaaccuugugacugaaaacuugaaaagaguggagcaggug

SEQ ID NO: 499054 - RNA, 61 nt, hsa
ucucucaaagcuucaguuagacacacaguucacugaaaauucagucagucaaaaacuggaa

SEQ ID NO: 499055 - RNA, 61 nt, hsa
cuaaauuccccauucugucuaauaaaggaagacugaaaaaagguuuuaaagaacauaaaug

SEQ ID NO: 499056 - RNA, 61 nt, hsa
gagaagagaugcugccauuuaaccccuugguacugaaaaugagaaaauccccaacuaugca

SEQ ID NO: 499057 - RNA, 61 nt, hsa
ucugcuacuucacugucaucuucaauuuauuacugaaaaugauuccuggacaucaccaguc

SEQ ID NO: 499058 - RNA, 61 nt, hsa
ugcucaauugcucucccuugcucuuccccaaacugaaaauaccuacugcaggaucccucgg

SEQ ID NO: 499059 - RNA, 61 nt, hsa
auuaggaaaaacugaauuucccaacaggugaacugaaaaguuauuuuaacuauuauacaua

SEQ ID NO: 499060 - RNA, 61 nt, hsa
uuauggaaaaauaauucagaaucuaaacaccacugaaaacuuauaaaaaauguuuagauac

SEQ ID NO: 499061 - RNA, 61 nt, hsa
agagaaauccaucuuuucccaggucuccuucacugaaaacaaaaaucuacuuacauacacu

SEQ ID NO: 499062 - RNA, 61 nt, hsa
ugauuagaggagagagaacuugauucaagauacugaaaaauagagcugggacugagccugu

SEQ ID NO: 499063 - RNA, 61 nt, hsa
ugggucggucagugacauguagguaggaagcacugaaaauaguguucccagagcacuuugc

SEQ ID NO: 499064 - RNA, 61 nt, hsa
gggcauuuuacccuugcaguuuuacuaaaacacugaaaaauauuccaagcuucauauuaac

SEQ ID NO: 499065 - RNA, 61 nt, hsa
aaaaaaaucaagauuuaauuuuuuuauuuguacugaaaaacuaaucauaacuguuaauucu

SEQ ID NO: 499066 - RNA, 61 nt, hsa
acaacaaaaaaaaaucuuuauaagaaagagaacugaaaaguagcgugcuauucguccugua

SEQ ID NO: 499067 - RNA, 61 nt, hsa
gccugaccaacauggagaaacccccaucucuacugaaaauacagaauuagccaggcauggu

SEQ ID NO: 499068 - RNA, 61 nt, hsa
gagauuguuucaaauggguguaguagauauuacugaaaaccaaaaaagagugagauuguca

SEQ ID NO: 499069 - RNA, 61 nt, hsa
uuuccacuuccaguucuaguaaggaagaaaaacugaaaauguuuuaguuuauuacccagua

SEQ ID NO: 499070 - RNA, 61 nt, hsa
uucuugacaauuagauaccuauccuguaguuacugaaaaucuggguaguaaaucuacccaa

SEQ ID NO: 499071 - RNA, 61 nt, hsa
uacugagaaaaaucccuucagcucuaagaacacugaaaaauccaccgauuuuuuggguaag

SEQ ID NO: 499072 - RNA, 61 nt, hsa
caguugacaggucauccuugccaguuguauaacugaaaaaggacuuuucuaccagguauga

SEQ ID NO: 499073 - RNA, 61 nt, hsa
uugagauugauuggauucgaccucuuguugaacugaaaacuuaauuuuuucucuguauuuu

SEQ ID NO: 499074 - RNA, 61 nt, hsa
gcauuagcaaauauucaugcagcagcaguugacugaaaauuuauucuuaugagacguauag

SEQ ID NO: 499075 - RNA, 61 nt, hsa
uauauucucuaaauauuucuugaauuaaugaacugaaaaauguguguuaaaguugcuaagu

SEQ ID NO: 499076 - RNA, 61 nt, hsa
uauaacaacucuggauuacauuuuccucucaacugaaaacccucaguaaugcaaagaaagg

SEQ ID NO: 499077 - RNA, 61 nt, hsa
agcuaaaacccacucuaugagaaggaagauuacugaaaagcaugugacauauugcuacaaa

SEQ ID NO: 499078 - RNA, 61 nt, hsa
acuucugauuaaugcaaggggaaauuuuuauacugaaaacaaacaaacaaacuagcagcua

SEQ ID NO: 499079 - RNA, 61 nt, hsa
auuuuauaaaauguuuucuguauggcaauaaacugaaaacauggaucaacccuucuuuuga

SEQ ID NO: 499080 - RNA, 61 nt, hsa
guuagcuacuaugaauggugccagugaagacacugaaaaauaagugauuucaguaaccuuc

SEQ ID NO: 499081 - RNA, 61 nt, hsa
caguugugggaauaauuaucagagacaugcaacugaaaaugucucaccuuucaucuuuuuu

SEQ ID NO: 499082 - RNA, 61 nt, hsa
aaauugcaaauauaaacaaaagaaaaauccaacugaaaauaacacuaaguauuuuugaguu

SEQ ID NO: 499083 - RNA, 61 nt, hsa
acuaaauaaugacauaauccucagcugacugacugaaaaugugacuggacgcauucccugu

SEQ ID NO: 499084 - RNA, 61 nt, hsa
uuucuuauagcuaugugugguuucugggucaacugaaaaccuaccauuugcuuuucuauuc

SEQ ID NO: 499085 - RNA, 61 nt, hsa
ugaaaagaaauauggaggcuuuaaaccgcaaacugaaaaagcugaguagaacaaaggcagu

SEQ ID NO: 499086 - RNA, 61 nt, hsa
cuaaaagguauuuuuauaagcaguucaaguuacugaaaaccuuuuaaaccuuucugaaguu

SEQ ID NO: 499087 - RNA, 61 nt, hsa
acuuaucagaauccucguucuuuuucagacuacugaaaaaugacauuuacucuguuaaaug

SEQ ID NO: 499088 - RNA, 61 nt, hsa
agugcuuuuuauguauguugucuucuucaauacugaaaauuuguccuugguucuuaaaagc

SEQ ID NO: 499089 - RNA, 61 nt, hsa
guccgggaggugccugugguuugcacccaccacugaaaaagccgcggagaugcgcagcgcg

SEQ ID NO: 499090 - RNA, 61 nt, hsa
uguuuagaagggauggcuugaaaggaaggagacugaaaaacacucugagagcauacacugu

SEQ ID NO: 499091 - RNA, 61 nt, hsa
acugaggucucucuuggccuggaagaauaacacugaaaaaaccugacgcugcggucacuua

SEQ ID NO: 499092 - RNA, 61 nt, hsa
acuccagccggggugacagagugagacuccgacugaaaauaaauaaauaaauaaauaaaua

SEQ ID NO: 499093 - RNA, 61 nt, hsa
agcuacuuauucagauacugaagaccaacggacugaaaaaaagaacaaacauuagcuauuu

SEQ ID NO: 499094 - RNA, 61 nt, hsa
ggcccucucuagcaaaguuaugggcugcuuuacugaaaacagaauggaagcccugaaguca

SEQ ID NO: 499095 - RNA, 61 nt, hsa
gauaucagugugaaaagucuggggauuucaaacugaaaauccaaaagauaaguaaaugagu

SEQ ID NO: 499096 - RNA, 61 nt, hsa
agccuggccaacguggugaauccccgucucuacugaaaacacaaaaauuagacgggcaugg

SEQ ID NO: 499097 - RNA, 61 nt, hsa
gcuaagagguacauguggguauuuuggaguuacugaaaaauuauuuuugggauaagagaau

SEQ ID NO: 499098 - RNA, 61 nt, hsa
aguaggaaccagauagagaugaaaaggggccacugaaaagugaauuugauagcucagcauu

SEQ ID NO: 499099 - RNA, 61 nt, hsa
guaauuuacauauuuucuuucuguugaaauaacugaaaauguuaaaucuaccaguuuaugu

SEQ ID NO: 499100 - RNA, 61 nt, hsa
uugugaccacuugugaauggguguauggagaacugaaaaggguaucugcaugaaggcuccu

SEQ ID NO: 499101 - RNA, 61 nt, hsa
aaacuugaaaggucugaggaugauguagauuacugaaaaaugcaaauugcaaucauauaaa

SEQ ID NO: 499102 - RNA, 61 nt, hsa
aaugccucccucaaaggaccugcaggcagagacugaaaauugcagacagaggggcacgucu

SEQ ID NO: 499103 - RNA, 61 nt, hsa
uuucauaccaaugaaaucuuacuuuucagugacugaaaagauagaauuuauuugcuaauaa

SEQ ID NO: 499104 - RNA, 61 nt, hsa
guggggggaugguaagagaaaagagagaaacacugaaaagaaggaaagaugguuaaacauu

SEQ ID NO: 499105 - RNA, 61 nt, hsa
aggaaaaucacccagaaugcuucugcaagauacugaaaauucuccacugcauggacccugg

SEQ ID NO: 499106 - RNA, 61 nt, hsa
aucaguggcggaucaaaaccuacaagauucaacugaaaaguuggcaguuaugguuuucuuu

SEQ ID NO: 499107 - RNA, 61 nt, hsa
uugcacaacuagaacacaucccagaacaauuacugaaaagcugaaauuuaaugggugguga

SEQ ID NO: 499108 - RNA, 61 nt, hsa
ggauuaacccucuauagacagaauagauagcacugaaaaaaaaucucuaugagcuaaaugu

SEQ ID NO: 499109 - RNA, 61 nt, hsa
guugccaaacuuuggaaauguuaauguucagacugaaaaucuccacuacauguaacuuucu

SEQ ID NO: 499110 - RNA, 61 nt, hsa
uuuguuuuuaaaucaaacuguaaaacuuaaaacugaaaaauuuuauugguaggauuuauau

SEQ ID NO: 499111 - RNA, 61 nt, hsa
aacuccuuacucugaugucuguauauguugcacugaaaagguuaauauuuaauguuuuaau

SEQ ID NO: 499112 - RNA, 61 nt, hsa
aucuagugguucacacagagagagagagaguacugaaaaagcaacuccucuucuuagucuu

SEQ ID NO: 499113 - RNA, 61 nt, hsa
gacuucuacauuaaugauguauguguugcugacugaaaagcuauacugauuagaaaugucu

SEQ ID NO: 499114 - RNA, 61 nt, hsa
gucuucuaaggauggucuuccaggcuuuuaaacugaaaagcuuaauucagauaguagcuuu

SEQ ID NO: 499115 - RNA, 61 nt, hsa
acugugagcaacuuagaguaaaaauucgaaaacugaaaaauaaggcuaguguacuacaaaa

SEQ ID NO: 499116 - RNA, 61 nt, hsa
aagcgagguuguaaaaauuacaaguugcaugacugaaaaaaugcuuuagggggaaaaucag

SEQ ID NO: 499117 - RNA, 61 nt, hsa
gugcauuauaccaaagagcgaagucagugccacugaaaauacagaacccauuaauaucgug

SEQ ID NO: 499118 - RNA, 61 nt, hsa
ugcucucuuuaaaucaaguccuuuaauuaagacugaaaauauauaagcucagauuauuuaa

SEQ ID NO: 499119 - RNA, 61 nt, hsa
acccugauguaaagaucagucccaguuauaaacugaaaacagcuauuuacaaagcaguaaa

SEQ ID NO: 499120 - RNA, 61 nt, hsa
uauccacucggaccaucuguuaucucucuacacugaaaauaaaaccucuuccacccacccc

SEQ ID NO: 499121 - RNA, 61 nt, hsa
gauacgaucuugugaaaacacuguauuuucgacugaaaauuccacuuucuucaucuuguuu

SEQ ID NO: 499122 - RNA, 61 nt, hsa
cuagaaagucuacuugagcauguuguaaucaacugaaaaaucuggggggaaaaaaaaaaaa

SEQ ID NO: 499123 - RNA, 61 nt, hsa
uagaaaacuauuaacagugcggcuacaugguacugaaaaugcaggcauuacaccagcuguu

SEQ ID NO: 499124 - RNA, 61 nt, hsa
cucuaaaguugguguagcagcaguugaucagacugaaaaacgguuuuuagucucuggaaaa

SEQ ID NO: 499125 - RNA, 61 nt, hsa
guaucuuaaaagaaggaacuauaaacauugcacugaaaacuugcuuuaaagcuuuaccuga

SEQ ID NO: 499126 - RNA, 61 nt, hsa
uuggaauuaauaaguauugaaauguuuugaaacugaaaaaaaauuuuacagcuacugaauu

SEQ ID NO: 499127 - RNA, 61 nt, hsa
uggguccccuuuccauguauguuuucuugucacugaaaacaaacaacgcugaguuuaucaa

SEQ ID NO: 499128 - RNA, 61 nt, hsa
ugcuucaagucugugcaguugacuuggcuguacugaaaagugaacagcauggauuaacuca

SEQ ID NO: 499129 - RNA, 61 nt, hsa
uugugauguggcaauaaauuuuuuuuaaaaaacugaaaauacuuaggaaggauccgcauaa

SEQ ID NO: 499130 - RNA, 61 nt, hsa
aaaagguuacucaaguuguacuacccacauaacugaaaauauuggccauuuggccuuaucu

SEQ ID NO: 499131 - RNA, 61 nt, hsa
aggaacuugucaagagaucaugguucauguuacugaaaagacuuuaaggauuuguaagguu

SEQ ID NO: 499132 - RNA, 61 nt, hsa
aggcuggccaacaugguaaaacccugucucuacugaaaaacaacaaaaacaaaaacacaaa

SEQ ID NO: 499133 - RNA, 61 nt, hsa
aaaaaguaguuuguaaacucauuugugaucuacugaaaagagguuauauuaaagcaaauua

SEQ ID NO: 499134 - RNA, 61 nt, hsa
guuuauuuugaaucguuaacauuauuuaaagacugaaaauucauugcaauuagggaacgca

SEQ ID NO: 499135 - RNA, 61 nt, hsa
ugguuggagauugcuggcgaugugaugcugcacugaaaaaacuggucacacaaaauguuua

SEQ ID NO: 499136 - RNA, 61 nt, hsa
agaugauaaaggccagauuacaaauuacauuacugaaaacuucauucuuggguuaacagua

SEQ ID NO: 499137 - RNA, 61 nt, hsa
caggcuuucguagugauuagcuuacuaaggaacugaaaaugggccccuuguacaagcugag

SEQ ID NO: 499138 - RNA, 61 nt, hsa
agccuggccaacauagugaaaccccaucucuacugaaaauacaaaaauuagcugggugugg

SEQ ID NO: 499139 - RNA, 61 nt, hsa
uugauauguaagagauauucagaaugcucacacugaaaaugccucaacuuuuuaaagugua

SEQ ID NO: 499140 - RNA, 61 nt, hsa
aaaaacauuuuuacugcugcuuaguuuuuggacugaaaagauauuaaaacucaagaaggac

SEQ ID NO: 499141 - RNA, 61 nt, hsa
cuuggucugacuuguaccaauucuagcacccacugaaaaacaaguugaguagagaguguag

SEQ ID NO: 499142 - RNA, 61 nt, hsa
cauuagcuguuuguaaauaaugcauuugcauacugaaaaaggaaugccaccugccacaguu

SEQ ID NO: 499143 - RNA, 61 nt, hsa
uuucaaucaaaacucaguaucauaaguagagacugaaaacuugccguuauugauuguuguu

SEQ ID NO: 499144 - RNA, 61 nt, hsa
ccugcugucccauggagaaaaaguuuuaagcacugaaaaaauuugauuaauguauuuaaau

SEQ ID NO: 499145 - RNA, 61 nt, hsa
uuauuaguauugcuuuucauaauucugucucacugaaaaccuuauuugauggaagcaacau

SEQ ID NO: 499146 - RNA, 61 nt, hsa
guaaaaacaaaguuugggcucugaaaauuuaacugaaaaagauuuccuuguuuuuguaaua

SEQ ID NO: 499147 - RNA, 61 nt, hsa
uuuuuuaaaagccagucaaaacaaaaacuuuacugaaaauggacagaaauaggaaauggac

SEQ ID NO: 499148 - RNA, 61 nt, hsa
aguucuuuuuaaaaugacacuuaaaacaaucacugaaaacuugauccacaucacacccugu

SEQ ID NO: 499149 - RNA, 61 nt, hsa
ugaaauucaugaguuuauuuaugucuaaaacacugaaaacuguguccaauaucguucaguu

SEQ ID NO: 499150 - RNA, 61 nt, hsa
aaaucaugaguaaaauuggaaaacacuuuuaacugaaaaaaacaaaagcacaacaaaccaa

SEQ ID NO: 499151 - RNA, 61 nt, hsa
cuucuguuguaauaguccauggacaauauaaacugaaaaaugucagucugguuuauauaag

SEQ ID NO: 499152 - RNA, 61 nt, hsa
cacaccaucgaucauagcaccaccuaucagcacugaaaacucuuuuguaaguuguuuaaaa

SEQ ID NO: 499153 - RNA, 61 nt, hsa
ucucccaguuaugaaucagugggcaggauaaacugaaaacucccauuuacgugucugaauc

SEQ ID NO: 499154 - RNA, 61 nt, hsa
agaaaucucugaagaaaccaaaagagcugaaacugaaaaaagagcucccucccuuuuuuca

SEQ ID NO: 499155 - RNA, 61 nt, hsa
agccuuuaaacagcaguuuguaaacuaugcaacugaaaaacugaggaugauuguuagcucc

SEQ ID NO: 499156 - RNA, 61 nt, hsa
uagucauguccauucagacauaaccugaacuacugaaaagaucaauuuccagaagguuuau

SEQ ID NO: 499157 - RNA, 61 nt, hsa
uuuaaaaaaaaucuauaguuuccaauaaacaacugaaaaauuaucaugagauguguauuua

SEQ ID NO: 499158 - RNA, 61 nt, hsa
uagucaaugaacuggcugccacuuuaauauaacugaaaauucauuuugagaccaagcagga

SEQ ID NO: 499159 - RNA, 61 nt, hsa
acauccacuuaggaugauacaaagcaguguaacugaaaauguuucuuuuaauugauuuaaa

SEQ ID NO: 499160 - RNA, 61 nt, hsa
auaggaaucaacuuaacaaaacaagugcaagacugaaaacuacaaaauuggaaagaaauua

SEQ ID NO: 499161 - RNA, 61 nt, hsa
ucucugaauugacugauuuuguuuuuuucuuacugaaaauggaccugccuuucacugaauu

SEQ ID NO: 499162 - RNA, 61 nt, hsa
ggucuugaggucuugacaucuugacauauacacugaaaaaaauggggguuguauguaugug

SEQ ID NO: 499163 - RNA, 61 nt, hsa
cucccugcaguuggcuggguguuuaauagucacugaaaacucccagcccugcugcacacua

SEQ ID NO: 499164 - RNA, 61 nt, hsa
cuguacuuacuuuacaggaagaaauuuuaaaacugaaaacuaccugggaucauaguguuuc

SEQ ID NO: 499165 - RNA, 61 nt, hsa
aacuggacuugguuggcauuuuaguuuaaugacugaaaaaguagguugaaagcucucugua

SEQ ID NO: 499166 - RNA, 61 nt, hsa
cauuguugcagaguuaucuguacuuuguuuaacugaaaaaaauguagaaauauauguaaag

SEQ ID NO: 499167 - RNA, 61 nt, hsa
gugugagccucggccuggcuggccaggacacacugaaaagcagccuuuuucaccauggcaa

SEQ ID NO: 499168 - RNA, 61 nt, hsa
gacuggaccaagagcaggcaaagacacgggaacugaaaaacuccacaggguuuggagaaua

SEQ ID NO: 499169 - RNA, 61 nt, hsa
gaccgaaucucuuuucucuguaaaaauguagacugaaaagccauguguauuuuccuaugug

SEQ ID NO: 499170 - RNA, 61 nt, hsa
gcuuauuuagcacauuuugacacaauguugcacugaaaacccaggccacaaauguguccca

SEQ ID NO: 499171 - RNA, 61 nt, hsa
ggaagaaaaggggagggggaaggcaagaaucacugaaaaaucuuaaaucuguguuuucugg

SEQ ID NO: 499172 - RNA, 61 nt, hsa
cauugcuauuuaucaauagcaauaauuuugcacugaaaacuuuuuauaguucaaaaauuaa

SEQ ID NO: 499173 - RNA, 61 nt, hsa
uugcagguaucacagccuugcagaagaaccaacugaaaaaaaaauucucaggcuuuacagc

SEQ ID NO: 499174 - RNA, 61 nt, hsa
cauucuaccagcacaaggaaacauaggcagcacugaaaaaaaaaaaaaagcucauauuaau

SEQ ID NO: 499175 - RNA, 61 nt, hsa
aagccccuuauuuuuagccauaauuuugcauacugaaaauccaauaaucagaaaaguaauu

SEQ ID NO: 499176 - RNA, 61 nt, hsa
cauauacggcuuuggagacaaucaaguaacaacugaaaaugugaaaguaaccauaucugac

SEQ ID NO: 499177 - RNA, 61 nt, hsa
guguggucuuugggaggagucuaauacaaaaacugaaaaccuuugguccugggaauuuauu

SEQ ID NO: 499178 - RNA, 61 nt, hsa
uaucuagaguucucuaauuuucaugugagcuacugaaaaaaaugaaaaugucacucaagcu

SEQ ID NO: 499179 - RNA, 61 nt, hsa
aacuggaggggcucuagugcuaaauaauaguacugaaaauugauauuauuuuccuuuucuu

SEQ ID NO: 499180 - RNA, 61 nt, hsa
aagaaaggauugguacugcaacuguagguaaacugaaaaaaaauaagaaagaaagaguugg

SEQ ID NO: 499181 - RNA, 61 nt, hsa
gauucccuuguucauuuuugcugugaaaugcacugaaaaaaauccucaaaaugaguuauag

SEQ ID NO: 499182 - RNA, 61 nt, hsa
gauuuuccacaaagaaugugcuaaaauguccacugaaaacaaagccaagccucugcccugc

SEQ ID NO: 499183 - RNA, 61 nt, hsa
ccucaaacucaaauuaguaugccauuuucauacugaaaauuaaauauuuuuauggauuuua

SEQ ID NO: 499184 - RNA, 61 nt, hsa
uuuucuuccucuaccuccacauccccccaagacugaaaagagucacuaacucucuuuuccc

SEQ ID NO: 499185 - RNA, 61 nt, hsa
aguacuaauaaucccugaucugugugauuguacugaaaaaucaaaaacuauuuuauuauga

SEQ ID NO: 499186 - RNA, 61 nt, hsa
guuaugauuaagcuuaaacccuguuagcaaaacugaaaacugaaauguucucaauaucaac

SEQ ID NO: 499187 - RNA, 61 nt, hsa
acccaaagcccugguaaaagggauacacaggacugaaaagggaaucauuuuucacuguaca

SEQ ID NO: 499188 - RNA, 61 nt, hsa
ccaagucuucagcgagacccuugcauuagaaacugaaaacuguaaauacaaaauaaaauua

SEQ ID NO: 499189 - RNA, 61 nt, hsa
gaauuaaaugauaaacuuagagacugauuagacugaaaaugccuaaucgauauauauauuc

SEQ ID NO: 499190 - RNA, 61 nt, hsa
guuauguguaaaugccaccuauuaauacgggacugaaaacguuagagacacacugcauugc

SEQ ID NO: 499191 - RNA, 61 nt, hsa
cucagauuugugaugcuaggaacaugagcaaacugaaaauuacuaugcacuugucagaaac

SEQ ID NO: 499192 - RNA, 61 nt, hsa
uaaagacaauuugcaggggguugggagaaggacugaaaagguacauuaagugugcuguaag

SEQ ID NO: 499193 - RNA, 61 nt, hsa
uauauauaaucaauucaucaagccaguuauuacugaaaaaucauugaaaugagacaguuua

SEQ ID NO: 499194 - RNA, 61 nt, hsa
uguuggagaggggaaaaguugugcauaaagaacugaaaaggguucuggaguguucauucag

SEQ ID NO: 499195 - RNA, 61 nt, hsa
auuuccuaucacuauuucagugucagaacaaacugaaaauaauggcucguguuuauguuga

SEQ ID NO: 499196 - RNA, 61 nt, hsa
gccuaaugauguuaucuaggcaccauuggagacugaaaaaaaaaaaucccugcucuguaaa

SEQ ID NO: 499197 - RNA, 61 nt, hsa
guugccucauagcuuuguacagauuaugaggacugaaaauaauugggcauuuacccaucuu

SEQ ID NO: 499198 - RNA, 61 nt, hsa
uauuauauguauguauauuucaaaguaccacacugaaaauuagacauuuauuaaccaaauu

SEQ ID NO: 499199 - RNA, 61 nt, hsa
cauccugucucuggcuguggcccggcaaagcacugaaaaccccucuggucucagagacagu

SEQ ID NO: 499200 - RNA, 61 nt, hsa
cuauaauaccuaugccucagcaauacauagaacugaaaaaacagggcgggagugguaugug

SEQ ID NO: 499201 - RNA, 61 nt, hsa
cuuuagaaacacaagaguauagauuuuucucacugaaaagugagaguuacgcauugcagcc

SEQ ID NO: 499202 - RNA, 61 nt, hsa
guguaagccaaaggcccacagaggagcauauacugaaaagaaggcaguaucacagaauuua

SEQ ID NO: 499203 - RNA, 61 nt, hsa
uuucauucagaaucaaaauuaagaaaguuggacugaaaauaugaaaaaugcuuaacuauug

SEQ ID NO: 499204 - RNA, 61 nt, hsa
cugcccugcucagcagucaccauagcagcugacugaaaaucagcacugccugaguaguuuu

SEQ ID NO: 499205 - RNA, 61 nt, hsa
uuuugaucaguuuaacuugaaucacuaacugacugaaaauugaaugggcaaauaagugcuu

SEQ ID NO: 499206 - RNA, 61 nt, hsa
uaaagacaaaguaauucuauuaaaugaacuaacugaaaauaauaauuauaggaagugauua

SEQ ID NO: 499207 - RNA, 61 nt, hsa
uagaaccugucauacauucaugauaaguagcacugaaaaauuacucauucaaauuuccccu

SEQ ID NO: 499208 - RNA, 61 nt, hsa
cugguuuuuaagugcacugcacuucuggaauacugaaaaagaaugaaaacaauauguuaga

SEQ ID NO: 499209 - RNA, 61 nt, hsa
aaucucauuucuggacucuuuaaguuuuaccacugaaaaccagagucgauuuuucuccuaa

SEQ ID NO: 499210 - RNA, 61 nt, hsa
uuuauuucuucuaaaaaucuguauaccaggaacugaaaaucuuugaacagauauuaaaauc

SEQ ID NO: 499211 - RNA, 61 nt, hsa
accuaccuacugacaaguaaauuuauacaggacugaaaaccgccugaaaccugcugcaacu

SEQ ID NO: 499212 - RNA, 61 nt, hsa
augucucuauaugaaggaacuaaacuauuucacugaaaaaaaaaaaaagauuuuuucugga

SEQ ID NO: 499213 - RNA, 61 nt, hsa
aaagaaaguaacaagaugucuuuacacugacacugaaaauucauccauuuuagagccagga

SEQ ID NO: 499214 - RNA, 61 nt, hsa
ccugucuuaaauuccaaagcuuuacauuucaacugaaaaagaaacuagaaauguccuaauu

SEQ ID NO: 499215 - RNA, 61 nt, hsa
aauaaacaaggggagaaaauaaaacucaaggacugaaaaucaggagguguaauaaaauguu

SEQ ID NO: 499216 - RNA, 61 nt, hsa
guuucugacuggaaaaucuugucauucuaacacugaaaagugcacacgcaugacaaaaugu

SEQ ID NO: 499217 - RNA, 61 nt, hsa
uuuguggcuauaaaugauuauuuagaugaugacugaaaauguguauaaaguaauuaaaagu

SEQ ID NO: 499218 - RNA, 61 nt, hsa
auuaagaaucaucauuacauaacuuggugaaacugaaaaaguauaucauauggguacacaa

SEQ ID NO: 499219 - RNA, 61 nt, hsa
gcguagggacagauguauucauccugguguuacugaaaaacaggugugauccuguuacuga

SEQ ID NO: 499220 - RNA, 61 nt, hsa
acuccagagacuucugccaccuggccgccacacugaaaacuguccugcucagugccaaggu

SEQ ID NO: 499221 - RNA, 61 nt, hsa
uuuccaucaaaucaauguagagauaauguaaacugaaaaaaaaucugcaagauaauguaac

SEQ ID NO: 499222 - RNA, 61 nt, hsa
uaucagauauguuuuugcacuauuuuuuuuaacugaaaaagaaauaucuaagcuguacaug

SEQ ID NO: 499223 - RNA, 61 nt, hsa
uaagaauuaaaacugggaaauagaaacaugaacugaaaagucuugcaaugacaagagguuu

SEQ ID NO: 499224 - RNA, 61 nt, hsa
ccuaaaucaaagacuauuucaagucaacaacacugaaaacugcuuuucgccuccacucuua

SEQ ID NO: 499225 - RNA, 61 nt, hsa
uggugaagaauggacuuaauuaugcuaacaaacugaaaaaucuagacauagauccucugau

SEQ ID NO: 499226 - RNA, 61 nt, hsa
gaagaaacaagguuuucaguccccacagauaacugaaaauuauuuaaaccgcuaaaagaaa

SEQ ID NO: 499227 - RNA, 61 nt, hsa
ccaguauaugcuauucaaugaucuuagaaguacugaaaaaaaaagacguuuuuaaaacgua

SEQ ID NO: 499228 - RNA, 61 nt, hsa
auauugagcucuaaaugcaaaacucuuuuauacugaaaaaacacuuaaaguaguuuugugu

SEQ ID NO: 499229 - RNA, 61 nt, hsa
uggaauaaaggauguuuucuguuggacauguacugaaaauuaacacauguaguagccuuaa

SEQ ID NO: 499230 - RNA, 61 nt, hsa
gacauucagugaauuauuucaguggugacccacugaaaauuaauaaugguacuuaugauua

SEQ ID NO: 499231 - RNA, 61 nt, hsa
ugggacugcuuugagaaccaucuuucaaugcacugaaaagucaucugaaaaaauagcuucu

SEQ ID NO: 499232 - RNA, 61 nt, hsa
agacauuuuguuucaaaugaaacuuuaaaagacugaaaaauuuuguaaauagguuugauuc

SEQ ID NO: 499233 - RNA, 61 nt, hsa
uacuaaaucucuguuaauauucucucuuuuaacugaaaagggaugggauagaaggguuugc

SEQ ID NO: 499234 - RNA, 61 nt, hsa
ugagagguucuaaaaucaugaaacuuguuucacugaaaauuggacagauugccuguuucug

SEQ ID NO: 499235 - RNA, 61 nt, hsa
gauguggccaaccuuuguccauaugcaaaccacugaaaaaugaucuggauuucuauagcaa

SEQ ID NO: 499236 - RNA, 61 nt, hsa
aaaucugaacucucaaaagucuauuuuuuuaacugaaaauguaaauuuauaaauauauuca

SEQ ID NO: 499237 - RNA, 61 nt, hsa
cuguuacuaaguaaaaagcugucaaacauuuacugaaaauagaauuggccccauggcuuga

SEQ ID NO: 499238 - RNA, 61 nt, hsa
uauccuuuguauuuauaggcacaguuaucuuacugaaaaugcaugcauggugaauuaaaau

SEQ ID NO: 499239 - RNA, 61 nt, hsa
uuuuuuuuuuaaagcggguaaaagagaaaacacugaaaauugaauucuuaucuuccagagg

SEQ ID NO: 499240 - RNA, 61 nt, hsa
auccccuuucuacagugaguccacuacccucacugaaaaucauuuuguaccacuuacauuu

SEQ ID NO: 499241 - RNA, 61 nt, hsa
uagcucuuaaaacauacgaaguguugccuaaacugaaaauauuuaucuuuuauuuaaaauc

SEQ ID NO: 499242 - RNA, 61 nt, hsa
cugugcugaaauuugaagaccagauaaugaaacugaaaagcaaacaauuuuacugaaucug

SEQ ID NO: 499243 - RNA, 61 nt, hsa
gauucuuuauuccuauucgacacuggcuucuacugaaaaugaaacggauugcagagggaau

SEQ ID NO: 499244 - RNA, 61 nt, hsa
gcgaaaaaguauugaagauuagcuuuuaaaaacugaaaaaaaaaaaugaaugacucacaua

SEQ ID NO: 499245 - RNA, 61 nt, hsa
aaaggagggcaacuucuacucuucaaccucuacugaaaacacaaacaacaaagcagaagac

SEQ ID NO: 499246 - RNA, 61 nt, hsa
ugguugaauaauuauugaaaaaaagaacacgacugaaaaaguucaucugaugccucugagc

SEQ ID NO: 499247 - RNA, 61 nt, hsa
uggcuuuuccuccauuaauacauauaugaguacugaaaaauuaaguugcauagcugcuuug

SEQ ID NO: 499248 - RNA, 61 nt, hsa
guuucaccuguauugaaucagaaugccuucaacugaaaaaaacauauccaaaauaaugagg

SEQ ID NO: 499249 - RNA, 61 nt, hsa
aauugaaauaauuucaaauaacuguaaaggaacugaaaaucuucacagagaugaagugggg

SEQ ID NO: 499250 - RNA, 61 nt, hsa
uguaaugacuucacaaguuuuacgagggaaaacugaaaaaggaaguaauauaaauuuugug

SEQ ID NO: 499251 - RNA, 61 nt, hsa
guuaaacagcaggaaagcccauuaacuucguacugaaaaagcaacauacugugaugauacg

SEQ ID NO: 499252 - RNA, 61 nt, hsa
cuugcucugcuauaucuccacucugccucagacugaaaagcuaguccuaacgucuuugccu

SEQ ID NO: 499253 - RNA, 61 nt, hsa
uggggcaggggacuguuaggaugcauuauaaacugaaaagccuuuuuaaaauuuuauguau

SEQ ID NO: 499254 - RNA, 61 nt, hsa
guguuuaguuggauuaaucuuaccuaaaaguacugaaaaaugcuuuuuaguacuuuuucau

SEQ ID NO: 499255 - RNA, 61 nt, hsa
uuuaaauaagcgcuuuaaugaaaaugguuagacugaaaauaauuuugguccuuaaaaggag

SEQ ID NO: 499256 - RNA, 61 nt, hsa
uuggugauaaucaauuuugaaaauacaguggacugaaaagcaaauuuauucuuucgaagau

SEQ ID NO: 499257 - RNA, 61 nt, hsa
gccauacauuuuauccucauggaugugaugcacugaaaaguuaguugcucuccuuuuuucu

SEQ ID NO: 499258 - RNA, 61 nt, hsa
gggggaaagguaggaagaagagguaauuuuuacugaaaauuagggcaauguuggucgccuu

SEQ ID NO: 499259 - RNA, 61 nt, hsa
uagaguugcuccauucauauuggacugauggacugaaaacauugaugugauucuugaaagg

SEQ ID NO: 499260 - RNA, 61 nt, hsa
aaacuagcucuucagagaagccucggguaacacugaaaaacaaaacaaaacaaaacaaaaa

SEQ ID NO: 499261 - RNA, 61 nt, hsa
aauucuucuguugccuuuuucuuacagaaugacugaaaauuugaaagaaaagccuauaaaa

SEQ ID NO: 499262 - RNA, 61 nt, hsa
accaccagugaaauguguguguauacaauaaacugaaaaaaaaaacuagccuuuggcuugu

SEQ ID NO: 499263 - RNA, 61 nt, hsa
uucagggcauauuuuuucuucccaggaucaaacugaaaacauguuaaggcuauaguuuagc

SEQ ID NO: 499264 - RNA, 61 nt, hsa
acacuaaggucuccauauacuauuuuuuucuacugaaaacaauuuagaaagaagcuauugg

SEQ ID NO: 499265 - RNA, 61 nt, hsa
cgguuaaauuccauaugcuccaggaucuuugacugaaaaaaaaaaagaagaagaagaagga

SEQ ID NO: 499266 - RNA, 61 nt, hsa
caagguggccaaauuauuuguguaauagaaaacugaaaaucuaauauuaaaaauauggaac

SEQ ID NO: 499267 - RNA, 61 nt, hsa
aaaauguugcuuccacauuaacaaaacaaucacugaaaaacagcagauguuuaaauagauu

SEQ ID NO: 499268 - RNA, 61 nt, hsa
uggcugccauuuugccauagauuuccauauaacugaaaaacugaauugucacuuuaucuuu

SEQ ID NO: 499269 - RNA, 61 nt, hsa
aaauucaucuguaaauauucacagucuagucacugaaaaaugggaaaaccucuaccaugcc

SEQ ID NO: 499270 - RNA, 61 nt, hsa
augacuuugaaguaaaaccuuuuuucuugcuacugaaaaaaauggaguuguuuuggguggu

SEQ ID NO: 499271 - RNA, 61 nt, hsa
gaagauggcauccugugaaguccuucaccucacugaaaacaucuggaaggggaucccaccc

SEQ ID NO: 499272 - RNA, 61 nt, hsa
ccuucugagcugguggaauauuuuauuucagacugaaaacagagagcacucuccuugggaa

SEQ ID NO: 499273 - RNA, 61 nt, hsa
gguccuuggaagaccuauauucucuguaguuacugaaaaccgaaagucaauucuaauuauu

SEQ ID NO: 499274 - RNA, 61 nt, hsa
cauauucgaagugguugucucugcacuauuuacugaaaaguucauccuuuccccagugauu

SEQ ID NO: 499275 - RNA, 61 nt, hsa
uucaaagaaucaguguaagccacuaaaaggaacugaaaaccuaggugucacaauaaacagu

SEQ ID NO: 499276 - RNA, 61 nt, hsa
cugccaugaacuggaggccaggaaucuccucacugaaaauuacaguaugguaacuuugcaa

SEQ ID NO: 499277 - RNA, 61 nt, hsa
ugucuuuuacccccacaggguuccugagcucacugaaaagacuauugugccuuaggaaaag

SEQ ID NO: 499278 - RNA, 61 nt, hsa
gcuaaaacaggaugauugcuuuugucuguuuacugaaaaaugaguuuagaaaggcuagccc

SEQ ID NO: 499279 - RNA, 61 nt, hsa
uuuucacaccaucucagagguugaggagcauacugaaaauugcccuggggggugcugggug

SEQ ID NO: 499280 - RNA, 61 nt, hsa
gacuuuuguguauggguaguaaaucuagcucacugaaaaucagagugaaacgccuuuacau

SEQ ID NO: 499281 - RNA, 61 nt, hsa
ggaaggagaggggugcaacaggaccgccugcacugaaaacucacugcugccaugcccuggg

SEQ ID NO: 499282 - RNA, 59 nt, hsa
agacacugauauccaaauaaguugucuuuacugaaaaaugaagugaagacccauauaug

SEQ ID NO: 499283 - RNA, 61 nt, hsa
aaugaugugugauuggauggaauugaaucaaacugaaaaaguauuuccuuauagcuuaaug

SEQ ID NO: 499284 - RNA, 61 nt, hsa
gaaagaaaaauauagauuaaaauugcugggcacugaaaaggggugggaguuggaaaucaga

SEQ ID NO: 499285 - RNA, 61 nt, hsa
uccacucucaaguuuucuacuuugucuuugaacugaaaauaaacauggaucuagaaaacca

SEQ ID NO: 499286 - RNA, 61 nt, hsa
guuuccaacagcacuucucaccuauucaauaacugaaaaagacauuaccauagugcuuuac

SEQ ID NO: 499287 - RNA, 61 nt, hsa
cgugcacugagcugcaacuucuuacuucccuacugaaaauaagaaucugaauauaaauuug

SEQ ID NO: 499288 - RNA, 61 nt, hsa
uuuuauuaauuaucuggauaacagcaaaaaaacugaaaauaaagagagagagagaucuggg

SEQ ID NO: 499289 - RNA, 61 nt, hsa
ugaaucucguugaggccaaggaaugauccauacugaaaaaaugcugagccagccaucuuug

SEQ ID NO: 499290 - RNA, 61 nt, hsa
aaauggaaaacagucauauaaaugcuuacagacugaaaaaugucucauacauauuuugcag

SEQ ID NO: 499291 - RNA, 61 nt, hsa
guagcugaugugcaguugagaaaacuagaggacugaaaaaacaaauuuuaacuagcaaaug

SEQ ID NO: 499292 - RNA, 61 nt, hsa
ucuagcuuauauaaggucauuacauuuuuuaacugaaaaaccuaguuaccugauuauugca

SEQ ID NO: 499293 - RNA, 61 nt, hsa
acauugacacuaguauuauuuuacaaaacagacugaaaaagacauuagcaagcauagucua

SEQ ID NO: 499294 - RNA, 61 nt, hsa
ugaaacaaaagaggcauuuuucaauaaaacuacugaaaauuugacauggcauguuucuuuc

SEQ ID NO: 499295 - RNA, 52 nt, hsa
aagauugggaaggaaauuaaaaacugaaaauguacaauuaucauuuaggcua

SEQ ID NO: 499296 - RNA, 61 nt, hsa
uugaccuauuuauucauucuugauuaaaugcacugaaaaguaaagggucuguuugugucau

SEQ ID NO: 499297 - RNA, 61 nt, hsa
gacucauuugaacaaaaaucuaggccaaaauacugaaaagccuauguguuuuuuuaauugg

SEQ ID NO: 499298 - RNA, 61 nt, hsa
uacguuuucaugcugcuuauuguuuuauucuacugaaaaaaaugaauuucaagauucucaa

SEQ ID NO: 499299 - RNA, 61 nt, hsa
cuguuacacuuucucugaucugcugugauccacugaaaaugugcugggguuuguucugcug

SEQ ID NO: 499300 - RNA, 61 nt, hsa
uagaucauguuuacuucccaguggaaggagcacugaaaaccucuuaaagaaaaagcauuug

SEQ ID NO: 499301 - RNA, 61 nt, hsa
auagcaucuaguccaacuccuugauuguaaaacugaaaaacuaagguuauuugaauguucu

SEQ ID NO: 499302 - RNA, 61 nt, hsa
ugauccuguauugggcuguacuuacugugauacugaaaagcuguccugcugaagcagcuau

SEQ ID NO: 499303 - RNA, 61 nt, hsa
agaaaacauugauuugagcauagacgcagagacugaaaaaaaaauuuacuuugaucucugu

SEQ ID NO: 499304 - RNA, 61 nt, hsa
uguuuaaagacuuccacugcaauauauaaauacugaaaaugugauguucugcuuauuugga

SEQ ID NO: 499305 - RNA, 61 nt, hsa
ggauaggugccauuugguggugagaaugcugacugaaaaauagaaugaucaauuuaaucug

SEQ ID NO: 499306 - RNA, 61 nt, hsa
guagcaaggaauuggugguauuauggaccgaacugaaaauuuuauguugaagccauauccc

SEQ ID NO: 499307 - RNA, 61 nt, hsa
agacaguuauuuguuucuucugcaucuugcuacugaaaacaaaaacaaugaaaauauucau

SEQ ID NO: 499308 - RNA, 61 nt, hsa
gaaugaacaaagguaauaugucuagcacugcacugaaaaaggacuucugcauuucugacau

SEQ ID NO: 499309 - RNA, 61 nt, hsa
ggaauuuuuuuguacuguaauuuugaauggaacugaaaaauuaugcacgaauaaaguacuu

SEQ ID NO: 499310 - RNA, 61 nt, hsa
aaggauacaaggauuauuucaauguuacugcacugaaaaacguguauguauuagugugcua

SEQ ID NO: 499311 - RNA, 61 nt, hsa
uauugaucgugauaugacuuguuacuaggguacugaaaaaaaugucuaaggccuuuacaga

SEQ ID NO: 499312 - RNA, 61 nt, hsa
uggaauuuuuugaauaugccuuaauuuagaaacugaaaaauaucugguuauaucauucugg

SEQ ID NO: 499313 - RNA, 61 nt, hsa
gaggaggaacaaauuacaaguguacccaauaacugaaaauguuuuaacucacucucauuug

SEQ ID NO: 499314 - RNA, 61 nt, hsa
aauccucaaaccucacuaaacauaagauaauacugaaaacuuuacaaaccugaaugaugug

SEQ ID NO: 499315 - RNA, 61 nt, hsa
caauucucaaaucuuacuaaacaaaauuaauacugaaaauguuacaaaccagaaaaaugug

SEQ ID NO: 499316 - RNA, 61 nt, hsa
agaauuacaaugaauaauaauuugcuuugucacugaaaaccaccagugaagugcaauuugg

SEQ ID NO: 499317 - RNA, 61 nt, hsa
acgauggcgaggaagccagccccaaggaaacacugaaaacacauaucacgccaaugccgug

SEQ ID NO: 499318 - RNA, 61 nt, hsa
caucucaaaaaaaaaaaaaagaaagaaagaaacugaaaagugagguguggaacuccaggca

SEQ ID NO: 499319 - RNA, 61 nt, hsa
ugagguuuguaaacuguccuuuuuaaaucaaacugaaaacaaaaagcuuuaaccuuucaac

SEQ ID NO: 499320 - RNA, 61 nt, hsa
caauauaaaaacauucauuuggaauguacauacugaaaaauacagguuuuuuugaccaaaa

SEQ ID NO: 499321 - RNA, 61 nt, hsa
gauauaguuuuacuuuuaaacuguguacauaacugaaaaugugcuauacugcauacuuuuu

SEQ ID NO: 499322 - RNA, 61 nt, hsa
guuuaaaaauaaaguuccugauaauaaagugacugaaaauggcauccccaaagugucuccg

SEQ ID NO: 499323 - RNA, 61 nt, hsa
ugugaccaauucauuauaacauuuggauauuacugaaaauguaaggaagcaggaaaaauua

SEQ ID NO: 499324 - RNA, 61 nt, hsa
uagcuacugaauccugggggcgagugaaacuacugaaaauccgagugaugauguugugaau

SEQ ID NO: 499325 - RNA, 61 nt, hsa
cuaguauuugcacuuagcaaaauauuuaaaaacugaaaaaaaugugcaugaucugucacuu

SEQ ID NO: 499326 - RNA, 61 nt, hsa
aacauuuuggggcaguuuaaugugguaccaaacugaaaauaggagcuauuuauagauggag

SEQ ID NO: 499327 - RNA, 61 nt, hsa
guuaacuccuggacacaaguauauacugugcacugaaaaaauauccaucuacacagcaccc

SEQ ID NO: 499328 - RNA, 61 nt, hsa
uuacagugggcagguauuugcuuuugcuugcacugaaaauuaaauugcuaucaagaauaaa

SEQ ID NO: 499329 - RNA, 61 nt, hsa
agugagcagguauguguuugcuuuugcuugcacugaaaauuaaauugcuaucaagagcaaa

SEQ ID NO: 499330 - RNA, 61 nt, hsa
acguuuuggaagugauguauguuauuugaugacugaaaaugaacuguaaaugcuccuagag

SEQ ID NO: 499331 - RNA, 61 nt, hsa
auuugaggcuuuucuauauacuucucagagcacugaaaagaaaggaaggguuugcagagga

SEQ ID NO: 499332 - RNA, 61 nt, hsa
acagugauuuagguuuguaacauccggcaaaacugaaaaaaaaaaucuguaaacgcgaaaa

SEQ ID NO: 499333 - RNA, 60 nt, hsa
guccucuugccagcucauuuguuaauaaaauacugaaaacacucuuacggguugagucug

SEQ ID NO: 499334 - RNA, 61 nt, hsa
aaaccugcuuccaggcuacuuuggcagcagaacugaaaaaggcuuuuuuuccagauauaug

SEQ ID NO: 499335 - RNA, 60 nt, hsa
acuuggcugccauagcauaacaaugaagugacugaaaaauccagaauuucagauaaucua

SEQ ID NO: 499336 - RNA, 61 nt, hsa
gcucaugucuguuuugcuuuguuuuuaagacacugaaaagaaaagcuagaauuuauuuauu

SEQ ID NO: 499337 - RNA, 61 nt, hsa
caaagaaacuugugcuuuaccaaggggaauuacugaaaaaggugauuacuccugaagugag

SEQ ID NO: 499338 - RNA, 61 nt, hsa
cacuggaggucauuacugccauuaaauaauaacugaaaagacuauguagugaaauguauuu

SEQ ID NO: 499339 - RNA, 61 nt, hsa
augcuucaaaagaucuaagaaaugcaaauauacugaaaauugacauccucugaaaauucca

SEQ ID NO: 499340 - RNA, 61 nt, hsa
ucucacaagucaaaaaugaagauuuugcagcacugaaaaucuauuaaagcuccaaauuuua

SEQ ID NO: 499341 - RNA, 61 nt, hsa
ucaggaagagauuuaucuguauauacacauaacugaaaaccaaguuuaagcccaccaaugc

SEQ ID NO: 499342 - RNA, 61 nt, hsa
aacaucuuugccaaaagcuaagcaguggugaacugaaaagggcauauugccccaagguuac

SEQ ID NO: 499343 - RNA, 61 nt, hsa
agaaaggaauucauauggggaaguucggaaaacugaaaaagauucauguguaaagcuuuuu

SEQ ID NO: 499344 - RNA, 61 nt, hsa
uuugucauggcaaccagcuucugaaaagcccacugaaaauugccuguccugcugguaacug

SEQ ID NO: 499345 - RNA, 61 nt, hsa
aaaaauugaauucguuucugacauaccuuagacugaaaaacuguugguucauccagaagug

SEQ ID NO: 499346 - RNA, 61 nt, hsa
aguuuucuguauaugauauauauuaucuuauacugaaaaaaaauuccuuucagauuggggu

SEQ ID NO: 499347 - RNA, 61 nt, hsa
cuuaaaucugagggaccaugcuuugaaauagacugaaaauuaagggucaccaccuaauuuu

SEQ ID NO: 499348 - RNA, 61 nt, hsa
gaucccagaggagggaagaaaauuugcagugacugaaaacaguaaaaaaaaaaaaaaaaaa

SEQ ID NO: 499349 - RNA, 61 nt, hsa
uuggcuguaaucacuccucgccgugucuggcacugaaaauaaggaaaaaaaaccuacuacu

SEQ ID NO: 499350 - RNA, 61 nt, hsa
cuucuucccuccuccccccauuaauauguauacugaaaaaugugcauuugucugaggaauu

SEQ ID NO: 499351 - RNA, 61 nt, hsa
auagguuuuggggcuuccauaucaucaaaagacugaaaaauuauaauuuuagaauuaaacu

SEQ ID NO: 499352 - RNA, 61 nt, hsa
gaugugauacagaacaaaguguucguuuuugacugaaaauaguagaucagaaaucucaguu

SEQ ID NO: 499353 - RNA, 61 nt, hsa
uaguuuacaauuuuuaaaaaguucuuaaaauacugaaaaugcaguugacacuuguguaugg

SEQ ID NO: 499354 - RNA, 61 nt, hsa
accuuggaauuggaauuacuguaaacagccuacugaaaaugcauuuuuaucauguaacauu

SEQ ID NO: 499355 - RNA, 61 nt, hsa
caaagauuuacauugcugccaaaucauuucaacugaaaagaacaguauugcuuuguaauag

SEQ ID NO: 499356 - RNA, 61 nt, hsa
guuuuucugucauuguuaaauacacauuaucacugaaaaaauguagcuuuuaugugauaug

SEQ ID NO: 499357 - RNA, 61 nt, hsa
aaaaaaauaaugguaguaaagaaacugacaaacugaaaauaagaaaacaaaaaucaaaugc

SEQ ID NO: 499358 - RNA, 61 nt, hsa
ccuuuucauuuuauguuuuuguacucugcagacugaaaagacaaaguuuaucuuggccuua

SEQ ID NO: 499359 - RNA, 61 nt, hsa
guggauaacaaagauaucuuuucuuuagagaacugaaaagagagcagagaauauaacauga

SEQ ID NO: 499360 - RNA, 61 nt, hsa
gcucuuagcgguuauccacgaacuucgaccuacugaaaaggugguguugguauccaacuau

SEQ ID NO: 499361 - RNA, 61 nt, hsa
guuuccugcugacuacaacccucuccuguuuacugaaaaggagucaggaaaacuacaggug

SEQ ID NO: 499362 - RNA, 61 nt, hsa
auuuuguuuaaauaguaccacagagaaaacaacugaaaaaccacauuuuucuacauacagc

SEQ ID NO: 499363 - RNA, 61 nt, hsa
acauuuguacugagugguacaagccuuggggacugaaaaaaaaaagauuaaaaccauuaaa

SEQ ID NO: 499364 - RNA, 61 nt, hsa
aaauauuuuggucuagccacuaaacauaaugacugaaaaaaauuauuauuauaaaucacca

SEQ ID NO: 499365 - RNA, 61 nt, hsa
ugugccagcuaaaauugugugccauuuaaaaacugaaaauauuuuaaaauuauuugucuau

SEQ ID NO: 499366 - RNA, 61 nt, hsa
agugaaauauuguauaacaccauuuggaacuacugaaaagacaguggcuuuucuacaguac

SEQ ID NO: 499367 - RNA, 61 nt, hsa
uuccuaacaaugcaguauucucaauuguguuacugaaaaugcaacauuagcaaagaggugg

SEQ ID NO: 499368 - RNA, 61 nt, hsa
cagagauuagucuuagguuuccacguaagucacugaaaacaguaaaacaggcugcuuagau

SEQ ID NO: 499369 - RNA, 61 nt, hsa
gcaggcaaugugggacuuaaaaggcccaagcacugaaaauggaaccuggcgaaagcagagg

SEQ ID NO: 499370 - RNA, 61 nt, hsa
aagacaguuaaucagcauuauugugagagggacugaaaagaaauucuccauuaugaggaau

SEQ ID NO: 499371 - RNA, 61 nt, hsa
ucuuaguuauaauuagauugugaaucagccaacugaaaauccuuuuugcauauuucaaugu

SEQ ID NO: 499372 - RNA, 61 nt, hsa
uucuaacaagucauagguuaauauuuaagacacugaaaaaucuaagugauauaaaucagau

SEQ ID NO: 499373 - RNA, 61 nt, hsa
cagccuggccaacauggugaaacccuucucuacugaaaauacaaaaauuagccaggugugg

SEQ ID NO: 499374 - RNA, 61 nt, hsa
guugaauaaagaaacagaaaaaauagaacauacugaaaauaaucuaaguuccaaccauaga

SEQ ID NO: 499375 - RNA, 61 nt, hsa
auuuugagcuaauaauugcaaaaauuagaagacugaaaauggacccaugagaguauauuuu

SEQ ID NO: 499376 - RNA, 61 nt, hsa
aagcuugauuucagugcuuauugugucuucaacugaaaaauacaaucuguggauuaugacu

SEQ ID NO: 499377 - RNA, 61 nt, hsa
agccuagccaacaugacgaaaccccaucucuacugaaaauagaaaaaaaaaauuagccagg

SEQ ID NO: 499378 - RNA, 61 nt, hsa
gcuucuacggccaugagacugaucccuggccacugaaaagcuuuccugacaauaaaaaugu

SEQ ID NO: 499379 - RNA, 61 nt, hsa
acuggagaaaguuugucauccucauuuucaaacugaaaacuaaucaaauauagugccuauu

SEQ ID NO: 499380 - RNA, 61 nt, hsa
uaaguuauccaggacuccaagaaccauaguuacugaaaagggaguccugauacaucuaaua

SEQ ID NO: 499381 - RNA, 61 nt, hsa
agaaauacagcagacgaacauauuuauugguacugaaaagagacguaguaaauuaaauaga

SEQ ID NO: 499382 - RNA, 61 nt, hsa
guccuuuuauaggcaggcacuaguaacuaaaacugaaaacuaaguaaguuuauuuuugagg

SEQ ID NO: 499383 - RNA, 61 nt, hsa
guguagaauuacuguaauacuucugcaaucaacugaaaacuagagccuuuaaaugauuuca

SEQ ID NO: 499384 - RNA, 61 nt, hsa
cugguuugggggaggggacuggaaagcugagacugaaaaucaagagggaagaggugaggaa

SEQ ID NO: 499385 - RNA, 61 nt, hsa
ucagguccuaugaagaaagauacgguuucagacugaaaacauguuucacagguguuugcuu

SEQ ID NO: 499386 - RNA, 61 nt, hsa
uuauuacuguucagcaucaucuugguuauauacugaaaaucaaacacuuuacuacaguugu

SEQ ID NO: 499387 - RNA, 61 nt, hsa
cauuaaaauuuguaauugaaauguugcuuucacugaaaaagugucuugauguuucaguuau

SEQ ID NO: 499388 - RNA, 61 nt, hsa
aagugcuggugccagccuguuaccuguucucacugaaaagucuggcuaaugcucuugugua

SEQ ID NO: 499389 - RNA, 61 nt, hsa
augacuauaaaauguucaugagggacugaauacugaaaacugugaaauguacuaaauaaaa

SEQ ID NO: 499390 - RNA, 61 nt, hsa
aauagaaccaauuagguugaaaaugccccuuacugaaaaucuguauuaaaaauaaaauuaa

SEQ ID NO: 499391 - RNA, 61 nt, hsa
cauagagaaaugaagaugcuuaccugcaggaacugaaaacaucagccauggccaggccccc

SEQ ID NO: 499392 - RNA, 61 nt, hsa
acccuugaggaccaggagccuccauauccugacugaaaaccuuuucugagacuuagaguaa

SEQ ID NO: 499393 - RNA, 61 nt, hsa
aucuuugccaacauggugaaacuccaucucuacugaaaauacaaaaauuagcugggcgugg

SEQ ID NO: 499394 - RNA, 61 nt, hsa
agccugaccaacauggagaaacccagucucuacugaaaauacagaaaaguuagccaggcgu

SEQ ID NO: 499395 - RNA, 61 nt, hsa
uaugguuucaugaaauuggagcucuguauaaacugaaaaagacaaaauaaguaaagcacuu

SEQ ID NO: 499396 - RNA, 61 nt, hsa
ucauuuaaugauagacggaaaaugugugguuacugaaaacuguauaugauacagaauuuca

SEQ ID NO: 499397 - RNA, 61 nt, hsa
agccuggccaucauggugaaacccugucucuacugaaaauacaaaaauuagccgggcgugg

SEQ ID NO: 499398 - RNA, 61 nt, hsa
ugaguaaccaucaacacgauuaguuuacagaacugaaaaggaaucugagaucuguacugua

SEQ ID NO: 499399 - RNA, 61 nt, hsa
uuucuuuuuuaugugacauggagcacaaagaacugaaaauauguuuugagggagcaugaca

SEQ ID NO: 499400 - RNA, 61 nt, hsa
cauaguagguauauaugaguuuucacagaagacugaaaaauaaugcaugauauuuguuugu

SEQ ID NO: 499401 - RNA, 61 nt, hsa
aagucauuuaacuucaguaaaccucgguaugacugaaaagggaguuuucuguauggccguc

SEQ ID NO: 499402 - RNA, 61 nt, hsa
gauaaaacaccaugaaaauaaacuugaauaaacugaaaauggaccuuuuuuuuuuuaaugg

SEQ ID NO: 499403 - RNA, 61 nt, hsa
caggcuuuguuugagguccuguauauacagcacugaaaagagagauaaagucccugccugc

SEQ ID NO: 499404 - RNA, 61 nt, hsa
agauguaaggguuauuuagauauguucccucacugaaaaaucacucauucaaaauauuuaa

SEQ ID NO: 499405 - RNA, 61 nt, hsa
uuuaucucaaagcuuucacugaagggcuguaacugaaaauuauuaaauguuagucuuuagu

SEQ ID NO: 499406 - RNA, 61 nt, hsa
cugccaagcccagguugccucucaugaggcaacugaaaaaauccugugucuugauagcaug

SEQ ID NO: 499407 - RNA, 61 nt, hsa
cugucuaguacuugucuuauagguaaccaacacugaaaacuuuguagugaugacuaccaaa

SEQ ID NO: 499408 - RNA, 61 nt, hsa
agaauguguaucuguuggauauaaucagagaacugaaaaguaauuuaucaguaauuuuuaa

SEQ ID NO: 499409 - RNA, 61 nt, hsa
cugugcagggggcuggcuggauguucucuuuacugaaaagacaguggcaaggaaaagcaca

SEQ ID NO: 499410 - RNA, 61 nt, hsa
ccuucauagcuuuguuacaaugaaaccuugaacugaaaauauuuaauaaaauaaccuuuaa

SEQ ID NO: 499411 - RNA, 54 nt, hsa
uaaaaccuuuguaucuauaagaagacugaaaaccauggagauuauuuuuauugg

SEQ ID NO: 499412 - RNA, 61 nt, hsa
uuuaagugcuagggcuggucacacacaaccaacugaaaaagacuagagggauuaguacaaa

SEQ ID NO: 499413 - RNA, 61 nt, hsa
aauauugcuaauauaauagaugacaguggcaacugaaaacagucccagaaugaccccaucg

SEQ ID NO: 499414 - RNA, 61 nt, hsa
auaaggaguugguguaaucauuuuaaauuccacugaaaauuuaacaguauccccuucucau

SEQ ID NO: 499415 - RNA, 61 nt, hsa
aguguccaaaccuaguuucccaugaguugcgacugaaaaugugaaacgacacuguauugcu

SEQ ID NO: 499416 - RNA, 61 nt, hsa
uucagcacaacucauucuucagugccucaugacugaaaacaaaaaacaaaaaaacgaaagc

SEQ ID NO: 499417 - RNA, 61 nt, hsa
acuucagacuuuagccuguuuaguuuuaaggacugaaaaugguagguuugggcagaagaau

SEQ ID NO: 499418 - RNA, 61 nt, hsa
acaugggucugucauagaauggggacauuagacugaaaacugggacaacccccuuccuuau

SEQ ID NO: 499419 - RNA, 61 nt, hsa
cuccaugggaccccaaagaagcagauggaaaacugaaaaagaaaaccccucaagugagcca

SEQ ID NO: 499420 - RNA, 61 nt, hsa
aaauauaaaaauaaauauuguucugauuauuacugaaaagaugucagccauuucaaugucu

SEQ ID NO: 499421 - RNA, 61 nt, hsa
uuugaccucacagugacccuucccaaucagcacugaaaauaccaucaggccuaaucucaua

SEQ ID NO: 499422 - RNA, 61 nt, hsa
ucucauaccucugaccaacaggcuguucugcacugaaaagguucuucaucccuuuccaguu

SEQ ID NO: 499423 - RNA, 61 nt, hsa
aaauggcucuuuuugcaauaaguagauacauacugaaaaaaucuaaacuuacaauguuuau

SEQ ID NO: 499424 - RNA, 61 nt, hsa
guggaagauacacauguuugcauccuaagauacugaaaaaagggcaccuuugucacuugaa

SEQ ID NO: 499425 - RNA, 61 nt, hsa
uccuuggcgaaucgauaaucauugcauagugacugaaaagccuaagugcaaaaaaaaaaaa

SEQ ID NO: 499426 - RNA, 61 nt, hsa
cuuacuagaaaacuauuuucuaaauauuaacacugaaaauguuuuguuagcuuuuccuucu

SEQ ID NO: 499427 - RNA, 61 nt, hsa
cgggacuucccgaacuaauuuuuuuaaggauacugaaaaaugagagagaguggucgaaugc

SEQ ID NO: 499428 - RNA, 61 nt, hsa
gaggcccagacaggcucacucaagcucuuuaacugaaaagcaacaagccacuccaggacaa

SEQ ID NO: 499429 - RNA, 61 nt, hsa
uuuagccuaaguauaagaguccuacagauggacugaaaaaaaucagucugagaguauuagu

SEQ ID NO: 499430 - RNA, 61 nt, hsa
cuacaugcuggcaaaggugaaggaucagaggacugaaaaaugauucugcaacucucuuaaa

SEQ ID NO: 499431 - RNA, 61 nt, hsa
ccuccagacccacacucacagucugugaaaaacugaaaauccccuggugggcacucccugg

SEQ ID NO: 499432 - RNA, 61 nt, hsa
gccuuuuucuuugguugcuccuguggaaaauacugaaaagauuacuuuguuuuauuuuguu

SEQ ID NO: 499433 - RNA, 61 nt, hsa
guguuaaauaucagcuccuaauaagauguggacugaaaacacuaucacaacacuaugagaa

SEQ ID NO: 499434 - RNA, 61 nt, hsa
gccugccccucccccagcuguuuuuaaugaaacugaaaaaauagacuugaucccggcagga

SEQ ID NO: 499435 - RNA, 61 nt, hsa
uugaagggcagcaggcccaagugcugcucugacugaaaacugaguuaacaagaugaaaucu

SEQ ID NO: 499436 - RNA, 61 nt, hsa
acaugccuucuauauggaacauggcagaaagacugaaaaauaacaguaauuaauuguguaa

SEQ ID NO: 499437 - RNA, 61 nt, hsa
aaaugaaaacuguuugugaucuuccguauucacugaaaaauaaaugcuuguuuaguaucaa

SEQ ID NO: 499438 - RNA, 61 nt, hsa
ugcacaaggaaggaucuucagauauucaugcacugaaaaaugcuguuaucuuuuguuuuua

SEQ ID NO: 499439 - RNA, 61 nt, hsa
ccacagcauuuguacuguuccuuuuuaauauacugaaaauauaaaaggaaggguguguguu

SEQ ID NO: 499440 - RNA, 61 nt, hsa
auccuggcuaacacggugaaaccccgucucuacugaaaauacaaaaaauuagccaggcaug

SEQ ID NO: 499441 - RNA, 61 nt, hsa
auccuggcuaacauggugaaaccccgucucuacugaaaauacaaaaaauuagccgggugug

SEQ ID NO: 499442 - RNA, 61 nt, hsa
uguagccaucugagagaggaaaguuuaagugacugaaaauguagaauacuucaacgugcau

SEQ ID NO: 499443 - RNA, 61 nt, hsa
auaauguugugguuuguugccguugccaagaacugaaaacauaaaaaguuaaaaaaaauaa

SEQ ID NO: 499444 - RNA, 61 nt, hsa
aaaaguuugucuuugagauucaauguaaagaacugaaaacaauguauauguuguaaauauu

SEQ ID NO: 499445 - RNA, 61 nt, hsa
ccaaaugagcccaaauuccacuggcuccuccacugaaaacuacuaaaccgguggaaucuga

SEQ ID NO: 499446 - RNA, 61 nt, hsa
auguccccaaaguauuaaagaauuaaaugauacugaaaauuuguaugauucaaauuuguuu

SEQ ID NO: 499447 - RNA, 61 nt, hsa
agggaacgguagauuuauuccccaacucuuaacugaaaauguguuagacaagccacaaagu

SEQ ID NO: 499448 - RNA, 61 nt, hsa
cugggugacagagugagacuccaucucaaaaacugaaaauaaaaauaaaaauauguauucu

SEQ ID NO: 499449 - RNA, 61 nt, hsa
uuuuuaagcugaaaaggggauccuugaaaacacugaaaaccucuacaacaaucuucaggaa

SEQ ID NO: 499450 - RNA, 61 nt, hsa
uuucuuuuuaaaguuuuaaacgaauauuuugacugaaaaauuuuggcagucuuguaugcaa

SEQ ID NO: 499451 - RNA, 61 nt, hsa
cucauuuucaauuucuaaauuugcaggggauacugaaaaauacggcagguggccuaaggcu

SEQ ID NO: 499452 - RNA, 61 nt, hsa
gugggaugaaacauguuuuggggggggaugcacugaaaaucugagaacuauuuaccuauca

SEQ ID NO: 499453 - RNA, 61 nt, hsa
uccccucccuucaggaauaacuuauuggaaaacugaaaagaaucacugaauggaauguuca

SEQ ID NO: 499454 - RNA, 61 nt, hsa
cuugagaaaauuacuucauaaacauauggaaacugaaaauggacucucuuugugacaaaga

SEQ ID NO: 499455 - RNA, 61 nt, hsa
ugacuucauggaauggacauccuguauaagcacugaaaaacaacaacacaauaacacuaaa

SEQ ID NO: 499456 - RNA, 61 nt, hsa
aguguaccuguguacauaacucuguaaaaacacugaaaaauuauacuaacuuauuuauguu

SEQ ID NO: 499457 - RNA, 61 nt, hsa
augaaucugcucauguggagacuggcuauaaacugaaaaguguauuccaaauugcagaaca

SEQ ID NO: 499458 - RNA, 61 nt, hsa
acuacagaacagggcuaaauuagccaccaccacugaaaacucagccgaauuuuuuuauacc

SEQ ID NO: 499459 - RNA, 61 nt, hsa
caccacccccccgcccccccgaagccaugucacugaaaaggccugggggggaugguauaug

SEQ ID NO: 499460 - RNA, 61 nt, hsa
cucuuaagucccaguauaccucauuuuucauacugaaaaaaaaagcuuguggccaauggaa

SEQ ID NO: 499461 - RNA, 61 nt, hsa
caguucucaugagaacuugguaguaagcuaaacugaaaauaaggugggcuucacuggagaa

SEQ ID NO: 499462 - RNA, 61 nt, hsa
ugcgugggaccaugccugaacuccccgaauaacugaaaaauggcugaauauuuuuaugguu

SEQ ID NO: 499463 - RNA, 61 nt, hsa
aacaguucucauuacaaaggaccaauucagaacugaaaagcuaugcauaggacaaggaaga

SEQ ID NO: 499464 - RNA, 61 nt, hsa
agccuggccaacauggugaaacccuguagcuacugaaaauacaaaaauaagccaggcgugg

SEQ ID NO: 499465 - RNA, 61 nt, hsa
caguguagggaagacauuuguaauaaugaaaacugaaaauggaguaauugugaguaacuca

SEQ ID NO: 499466 - RNA, 61 nt, hsa
cuguuaacguauuugccaguuacgaaguuccacugaaaauuuuccuauuaauucuuaagua

SEQ ID NO: 499467 - RNA, 61 nt, hsa
ccagguuuuuagaucccacugagcccagcugacugaaaacaaggacagucagggugaaacu

SEQ ID NO: 499468 - RNA, 61 nt, hsa
gaaauuauauagcagauucuuuguugggaagacugaaaaaaauaaagauagguauaggaua

SEQ ID NO: 499469 - RNA, 61 nt, hsa
gugucugccagaguuuaguucuuuauaccuuacugaaaaaugccucguggucuucgcagag

SEQ ID NO: 499470 - RNA, 61 nt, hsa
cugggacugcucuggguuagguuuucuguggacugaaaaaucguguccuuuucucuaaaug

SEQ ID NO: 499471 - RNA, 61 nt, hsa
ugugaagcaaacaaaaaaaauuuguauguaaacugaaaauaagaaaauacauuagcaagcu

SEQ ID NO: 499472 - RNA, 61 nt, hsa
auuugcuucuaggcccauuauuuuuauuaaaacugaaaaaauuuaaacugaauuuuuugac

SEQ ID NO: 499473 - RNA, 61 nt, hsa
ucauaacuuuauggcuuaauaaauguaugacacugaaaagauuugagugugaaucuacuga

SEQ ID NO: 499474 - RNA, 61 nt, hsa
cuuugguggcuaaguuuuacuaaggaaaauaacugaaaagauuaaaagugagagcugaaaa

SEQ ID NO: 499475 - RNA, 61 nt, hsa
cuucucucagacugccuggccagccuggggcacugaaaauacggcucauguuaaugaguua

SEQ ID NO: 499476 - RNA, 61 nt, hsa
cugcaaagugcaauuucaacauguaccauuaacugaaaaucauacauaacugugauugaaa

SEQ ID NO: 499477 - RNA, 61 nt, hsa
ccugaagaaccaguccccccacccucauucuacugaaaaggaggggucuggguacuucuug

SEQ ID NO: 499478 - RNA, 61 nt, hsa
ccacugggucuaccaguaugcagguugggauacugaaaauuuccagaugagcucuucuuuc

SEQ ID NO: 499479 - RNA, 61 nt, hsa
ccuuuuauauauuauguuuuuacugaaauuaacugaaaaaauaugaaaccaaaaguacaaa

SEQ ID NO: 499480 - RNA, 61 nt, hsa
gcaccagaucaaguaguuuggacaucacccuacugaaaacuugcgauucuucuuaguuuuc

SEQ ID NO: 499481 - RNA, 61 nt, hsa
gcccacugaccaggaauuauuuaaccaacccacugaaaacuuguguguugagcagcucuga

SEQ ID NO: 499482 - RNA, 61 nt, hsa
acacacauucacccuaaggauccaauggaauacugaaaagaaaucacuuccuugaaaauuu

SEQ ID NO: 499483 - RNA, 61 nt, hsa
uagcucucugugaauguguuuuauccauucaacugaaaauugguaucaagaaaguccacug

SEQ ID NO: 499484 - RNA, 61 nt, hsa
cuggagccaaagaugacacaaggggaaggguacugaaaacaccauccauuugggaaagaag

SEQ ID NO: 499485 - RNA, 61 nt, hsa
augugauaacuauggaaaucaagauuaugugacugaaaaacauaaaggaagagacccaucu

SEQ ID NO: 499486 - RNA, 61 nt, hsa
cugguuaccucuuugcuggcugugacaacagacugaaaaaggauuggcacugucucacuug

SEQ ID NO: 499487 - RNA, 61 nt, hsa
aaaggagaaaaaucacgacuacuguuuacagacugaaaaauuauugcuuuuuauacuacug

SEQ ID NO: 499488 - RNA, 61 nt, hsa
ugucucuugguccacaguauuuggaaaggucacugaaaaugggucuuucagucuuggcauu

SEQ ID NO: 499489 - RNA, 61 nt, hsa
cagccaaagccuuaaaucaaacccacacacaacugaaaauugccuccuccaucucucaccu

SEQ ID NO: 499490 - RNA, 61 nt, hsa
cugggggagauggagauuugacuguuuaaaaacugaaaacagcgaggagucuuucuagaac

SEQ ID NO: 499491 - RNA, 61 nt, hsa
aaaauaagaaagcugagacugaggaggugaaacugaaaauaaaaagagaaaguucauccuc

SEQ ID NO: 499492 - RNA, 61 nt, hsa
acggagcugaccaucuuuaccugguccuggaacugaaaaacuguagcuugugugaaaauga

SEQ ID NO: 499493 - RNA, 61 nt, hsa
agcccaaccaacauggugaaacccugucuccacugaaaauacauaaaauuagccgggugca

SEQ ID NO: 499494 - RNA, 61 nt, hsa
ugagaaaggggcaggcaaaaugaagcuggccacugaaaacuguaagauggucaaaagcuga

SEQ ID NO: 499495 - RNA, 61 nt, hsa
agccuggccaacauggugaaaccccuucucuacugaaaauacaaaaauuagccagacguga

SEQ ID NO: 499496 - RNA, 61 nt, hsa
agccuggccaacauggugaaaccccaucucuacugaaaauacaaaaauuaggcauaguggu

SEQ ID NO: 499497 - RNA, 61 nt, hsa
uuaaagcugcuugcaaaguguuggugauuuuacugaaaacuuuugagaucuucauuuuaca

SEQ ID NO: 499498 - RNA, 61 nt, hsa
acacuuuaaaaauaugucuuuuuucaaucuaacugaaaaccuucuuaacuucuaauauauu

SEQ ID NO: 499499 - RNA, 61 nt, hsa
auuuauauaacugcauuuaagcaguaccaagacugaaaaaaaagguaauaaaugaaauguu

SEQ ID NO: 499500 - RNA, 61 nt, hsa
uuaauuauaaguguuauggcuaaaguuauuuacugaaaauuucaguaaaaugugugaaugu

SEQ ID NO: 499501 - RNA, 61 nt, hsa
uuucucuguaccucuaagaagaaagaaucuaacugaaaauaccaaaaaaaaaaaaaaaaaa

SEQ ID NO: 499502 - RNA, 61 nt, hsa
cuaacuuauuagacagcaagcaauauauaauacugaaaaaguauucagaaauggaaaauuu

SEQ ID NO: 499503 - RNA, 61 nt, hsa
uuagguugucuccaggccaugauggccuuacacugaaaaugucacauucuauuuuggguau

SEQ ID NO: 499504 - RNA, 61 nt, hsa
gcccauacuuuuggcuccucuaguaagaugcacugaaaacuuagccagaguuagguugucu

SEQ ID NO: 499505 - RNA, 61 nt, hsa
aaaagaauaaaaaguagcaguaaaauuauauacugaaaacaccaaaaauuuagaugccuua

SEQ ID NO: 499506 - RNA, 60 nt, hsa
auaagcagagaaaaaaaaaugugaauaaacuacugaaaacacuugguguuuuguguucaa

SEQ ID NO: 499507 - RNA, 61 nt, hsa
uucuuguuuccugauaauaaauguauuuaggacugaaaauacuccugaguacucccuuggc

SEQ ID NO: 499508 - RNA, 61 nt, hsa
ggaaaguaagaaaguuucauggauuagagugacugaaaaacauauccaguuagaaaauugu

SEQ ID NO: 499509 - RNA, 61 nt, hsa
agugcgauuucacagucuacugccuguuuccacugaaaacauuuuugucauauucuuguau

SEQ ID NO: 499510 - RNA, 61 nt, hsa
aucauucaaggauuauaguaauauuucauauacugaaaagugucucauaggaguccucuug

SEQ ID NO: 499511 - RNA, 61 nt, hsa
augaauaggcucugcuaacgugaugagacaaacugaaaauuauugcaagcauugacuauaa

SEQ ID NO: 499512 - RNA, 61 nt, hsa
accauucuacagaguuguacucaagacagauacugaaaaaaucuaauaccuucccuuguau

SEQ ID NO: 499513 - RNA, 61 nt, hsa
gacuauguugcaagucuguuucaucuaguaaacugaaaauuauugcuuaaucaaacugccg

SEQ ID NO: 499514 - RNA, 61 nt, hsa
ccauguaugaagccaaauauuaggcuuaaaaacugaaaaaucugguucauucuucagauau

SEQ ID NO: 499515 - RNA, 61 nt, hsa
uccucauggccucuaaauuaguauguagaacacugaaaaguucuuaacauuuuuguguaau

SEQ ID NO: 499516 - RNA, 61 nt, hsa
caaaccgaagacucuuugaagacaucguaacacugaaaaguacacuuucuacuaaagaugc

SEQ ID NO: 499517 - RNA, 61 nt, hsa
aucuuugaaaaaauuacccucuagcucuaacacugaaaauaauaauaaauuguagaucucu

SEQ ID NO: 499518 - RNA, 61 nt, hsa
acaaaauaaauugugaaaggaaguguaguugacugaaaacuacaguuguaauaagucuucc

SEQ ID NO: 499519 - RNA, 61 nt, hsa
caagccugaugguuugucuuauuucauucauacugaaaauucuuugcauauuuuuuuucug

SEQ ID NO: 499520 - RNA, 61 nt, hsa
gcagguaucacuuugauccuaugugggagcgacugaaaauagaaugagcuugguuaagcac

SEQ ID NO: 499521 - RNA, 61 nt, hsa
gaauugagauggccuuuuuuucacauuguagacugaaaagagacuuaaugguaugaugugu

SEQ ID NO: 499522 - RNA, 61 nt, hsa
aauguagcgggauuuuuaaggaaucagagagacugaaaaaaaaaaaaaaauuaaugauggu

SEQ ID NO: 499523 - RNA, 61 nt, hsa
cccacacacccuacaaguugaucaugcaggaacugaaaaccagucuucucccuguccccuc

SEQ ID NO: 499524 - RNA, 61 nt, hsa
uuuguuuaguauaaauugucauagcugguuuacugaaaacaaacacauuuaaaauugguuu

SEQ ID NO: 499525 - RNA, 61 nt, hsa
caccuaaagcuagaucucuuaaaaccaauuuacugaaaacuuguuugcuuaaaguuaauga

SEQ ID NO: 499526 - RNA, 61 nt, hsa
gcugcagccgagugaccuccauaaauacuggacugaaaaaacauuguaauacuacaaguau

SEQ ID NO: 499527 - RNA, 61 nt, hsa
auucacguuucaugaccaacugguaguuggcacugaaaaaacuuuucagggcugugugaau

SEQ ID NO: 499528 - RNA, 61 nt, hsa
uaauguauauguuucucuucaggcgcuaugaacugaaaaauauguuuucuuacuguuuaau

SEQ ID NO: 499529 - RNA, 61 nt, hsa
auuuguuaccaaaagugguucuacaaaugcuacugaaaaaaaucuggaaauuccuaauguc

SEQ ID NO: 499530 - RNA, 61 nt, hsa
gcugauguacaauaaccuugaggucccccauacugaaaacugaccaaggccugugcacagg

SEQ ID NO: 499531 - RNA, 61 nt, hsa
guggggaucuugcaaauuucuauucucuuuuacugaaaaagcaggggaugaguuccaucag

SEQ ID NO: 499532 - RNA, 61 nt, hsa
gccguugcaaucugcucaaaccuaacaccaaacugaaaacauaaauacugaccacuccuau

SEQ ID NO: 499533 - RNA, 61 nt, hsa
ucaacugcuguuauuagaagaaaaguacuguacugaaaauucagaaaaaaaaucucaaccu

SEQ ID NO: 499534 - RNA, 61 nt, hsa
cagccuggccaacaugugaaaccccgucuccacugaaaauagaaaaauuagcugggcaugg

SEQ ID NO: 499535 - RNA, 61 nt, hsa
uuuuuuaguaaucaagaaaggcuggaaaacuacugaaaaacugaucaagcuggacuugugc

SEQ ID NO: 499536 - RNA, 61 nt, hsa
augauuuauauaucacuuaguguguagagggacugaaaauauuuauuuuguuauaaauaau

SEQ ID NO: 499537 - RNA, 61 nt, hsa
acauuucuuaaaacacaugauaccagcagcaacugaaaaugaaugccgaauuugguacaca

SEQ ID NO: 499538 - RNA, 61 nt, hsa
uuaacuuuugaaaugugugagaguguuacuuacugaaaacugaaaggauaugacaugcugg

SEQ ID NO: 499539 - RNA, 61 nt, hsa
ugggauuguaggcaaacccaccuguggcaucacugaaaauaaauuugaucauaccuaagag

SEQ ID NO: 499540 - RNA, 61 nt, hsa
ccuuuuuugucacuuuuauccuuuuuuuaaaacugaaaauauuuuucucuugcuauuuaua

SEQ ID NO: 499541 - RNA, 61 nt, hsa
uuaaaauaagaaaaggagcacuuuaauuacaacugaaaaaucagauuguuuugcaguccuu

SEQ ID NO: 499542 - RNA, 61 nt, hsa
agugacacguuuggccagugacauuucaaucacugaaaaugugcucuacaucucguaugga

SEQ ID NO: 499543 - RNA, 61 nt, hsa
uaaugggaaagggccuggguguuacccauguacugaaaaugaacuuuuaccaacauggcua

SEQ ID NO: 499544 - RNA, 61 nt, hsa
aaugaaacccaguagauguuuguugaauugaacugaaaauuuauguggccagacacagugg

SEQ ID NO: 499545 - RNA, 61 nt, hsa
uggggacagaagguuuucaugaacucuuuuuacugaaaaugcccugcauuuaaaaauguuu

SEQ ID NO: 499546 - RNA, 61 nt, hsa
cgaaauaagaacccauuauuuccagugaguuacugaaaauacauuuuuaaagagaaaguac

SEQ ID NO: 499547 - RNA, 61 nt, hsa
gagcuauucugguaccuuccccauggaggacacugaaaaggcuggguuggggacagggagu

SEQ ID NO: 499548 - RNA, 61 nt, hsa
auaaauaccuucuauuuuuaauacaagcuccacugaaaaccaccuucguuuucaagguucu

SEQ ID NO: 499549 - RNA, 61 nt, hsa
ucccugacugucauagagaaucaucaucgccacugaaaaccaggcccuguugccuuuuaag

SEQ ID NO: 499550 - RNA, 61 nt, hsa
aucuuucauaagggcuguugcaaccauaugaacugaaaaaacacgcauuuuguaauccaaa

SEQ ID NO: 499551 - RNA, 61 nt, hsa
auuuucuuaguaguauauaaaagguaagaguacugaaaaauuaauaaaauugcaaguuaag

SEQ ID NO: 499552 - RNA, 61 nt, hsa
aggugcagaggcagcagaggauuggcauaaaacugaaaaggaguucugucugcaugagaaa

SEQ ID NO: 499553 - RNA, 61 nt, hsa
auacugucagaaguccagguauacugauaacacugaaaauucuauuagcaaccuucugggu

SEQ ID NO: 499554 - RNA, 61 nt, hsa
gccugaccaaacauggcgaaaccccaucuguacugaaaauacaaaaauuaggcaugguggu

SEQ ID NO: 499555 - RNA, 61 nt, hsa
gaaucagccagcaauauuuuaguugcaaaucacugaaaacccaacucaaagugacuuaagu

SEQ ID NO: 499556 - RNA, 61 nt, hsa
caucaugaaggcagaggcaugcacauuccucacugaaaaagaaaacacacacccacccaca

SEQ ID NO: 499557 - RNA, 61 nt, hsa
ccuucccccugacccugacuccuugaacgucacugaaaacggcagcuauugcaaggagugg

SEQ ID NO: 499558 - RNA, 61 nt, hsa
uucaagccuuacacaauagcagagaauauaaacugaaaaaauccauacaaauauuaaaaau

SEQ ID NO: 499559 - RNA, 61 nt, hsa
ggguucagaaaaggcaaacucaugaaaugccacugaaaagaacuuucaacacagcauacuu

SEQ ID NO: 499560 - RNA, 61 nt, hsa
ugagaagucaagauccucccuggaggacaggacugaaaaccuugccaagcuguacacaguu

SEQ ID NO: 499561 - RNA, 61 nt, hsa
ccuuuucucaucuuaccccuuuaugccaccuacugaaaagaaaaacaaauagcuagguuug

SEQ ID NO: 499562 - RNA, 61 nt, hsa
gauggaggaaugugggcaguuugacuucagcacugaaaaccucuccaccugggccaggguu

SEQ ID NO: 499563 - RNA, 61 nt, hsa
cuaucagggcaaaaucucacuggauuucuccacugaaaaccuacuugagguuucuggucug

SEQ ID NO: 499564 - RNA, 61 nt, hsa
gaguacagcgggagaaacacaaaauaguauaacugaaaacauuaacauucagacacacucc

SEQ ID NO: 499565 - RNA, 61 nt, hsa
uuuuuuaauguuaaauguguaacucaguauuacugaaaagguacccacauuuugaauagua

SEQ ID NO: 499566 - RNA, 61 nt, hsa
agccuggccaacaugaugaaauguugucucuacugaaaaugcaaaaauuagccagguauag

SEQ ID NO: 499567 - RNA, 61 nt, hsa
cuuuucccuuucauguucuuggaccuuuuguacugaaaauccaggcaucuagguucuuuuu

SEQ ID NO: 499568 - RNA, 61 nt, hsa
ugcacccagcgcuccauagacgccuuugugaacugaaaagagacuggcagagucccgagaa

SEQ ID NO: 499569 - RNA, 61 nt, hsa
aaaggcuaugcgauaugaauuucagaaauggacugaaaauggagagcuauguaacagauac

SEQ ID NO: 499570 - RNA, 61 nt, hsa
ggggauuucguguaaaugugaacacugacgaacugaaaagcuaacaccgacugcccgcccc

SEQ ID NO: 499571 - RNA, 61 nt, hsa
cauaugaugcaaaaaagguuuugugucauuaacugaaaaguagcagcuucucuauccagga

SEQ ID NO: 499572 - RNA, 61 nt, hsa
uuaccaaaauacuaaaacccaacaaaaugcaacugaaaaauaccuuccaaauuugccaaga

SEQ ID NO: 499573 - RNA, 61 nt, hsa
aucaucaggucuuaaaaaaaaauaaagguaaacugaaaagacaacuggcuacaaagaagga

SEQ ID NO: 499574 - RNA, 61 nt, hsa
ccauagaaacguuuuaauuuucaaugaagucacugaaaauccaacuccaggagcuauggca

SEQ ID NO: 499575 - RNA, 61 nt, hsa
aauauauuuaaaaauaagucaacaguaaaccacugaaaaaauauauguauauacacccaag

SEQ ID NO: 499576 - RNA, 61 nt, hsa
aacuuaaauuguauauuuugaaaaauaaaacacugaaaagaaaccaacaaaaaugaguugu

SEQ ID NO: 499577 - RNA, 61 nt, hsa
gcugguuuuuaaaugugcaucaagaaagacuacugaaaaguauuauuuuguaacuaagauu

SEQ ID NO: 499578 - RNA, 61 nt, hsa
uuuagaauguuuuuaugaguaaauuuaauguacugaaaauaaaaauuuuaaaaaaggcugu

SEQ ID NO: 499579 - RNA, 61 nt, hsa
cauuugaggucuagaucuaggcacuguggacacugaaaaacaguugggaaaucuuucgagc

SEQ ID NO: 499580 - RNA, 61 nt, hsa
guagucugggacugggcauuuaucuucucugacugaaaaucucuccuuggucuuaaggaaa

SEQ ID NO: 499581 - RNA, 61 nt, hsa
cacaagucucaagccucagugcuaaaguacuacugaaaaggaacuaggaaguuuggccaau

SEQ ID NO: 499582 - RNA, 61 nt, hsa
augacccagccaucuacaagaucugaauucuacugaaaauaucuagaaauguggaagagac

SEQ ID NO: 499583 - RNA, 61 nt, hsa
uuuuaauucuucccuuggauuaauauuuucuacugaaaagaaaugaaaucucaguuccacu

SEQ ID NO: 499584 - RNA, 61 nt, hsa
uuuuaaguaaccacucaaaacuuuucauuucacugaaaaaauaugaaaaaccaugacaaua

SEQ ID NO: 499585 - RNA, 61 nt, hsa
aaacuccaaagcuuugaacauucaugacugaacugaaaacaagccaugacuugagaaacaa

SEQ ID NO: 499586 - RNA, 61 nt, hsa
cuuggacuaguguaacuccuucaugcaauaaacugaaaagagccaugcugucuagucuuga

SEQ ID NO: 499587 - RNA, 61 nt, hsa
accagucaccagugcgauucuggauaaagccacugaaaauucgaaccaggaaauggaaccc

SEQ ID NO: 499588 - RNA, 61 nt, hsa
uuucagaacauguguuaauaguauauaugccacugaaaacuuagguccuguaucauacuuu

SEQ ID NO: 499589 - RNA, 61 nt, hsa
guaucauccgggcuccuuccgggcagaaacaacugaaaaugcacuucagacccacuuauuu

SEQ ID NO: 499590 - RNA, 61 nt, hsa
cugaucauuaucuccuucucuuugagaccugacugaaaaaauuaggugugcacaccuguaa

SEQ ID NO: 499591 - RNA, 61 nt, hsa
agggcccugugguuggacuucaccucucagcacugaaaacccaaaacccagcuggccuuaa

SEQ ID NO: 499592 - RNA, 61 nt, hsa
aaaaauaagacccaauauuggcaaagagacuacugaaaaaacauucccauacauugcgugu

SEQ ID NO: 499593 - RNA, 61 nt, hsa
aacuaaaaauagaugguucuuaauucaacuuacugaaaauuuccccaaacaauagcaaauc

SEQ ID NO: 499594 - RNA, 61 nt, hsa
aaucucuggccucaccccugcuggggguuggacugaaaacccuccuccccaauuugggggg

SEQ ID NO: 499595 - RNA, 61 nt, hsa
aauaauaacauaauaauaauaaaaauauaauacugaaaaggauuguucagggggaguuggg

SEQ ID NO: 499596 - RNA, 61 nt, hsa
auuuauugaccaauuuauuuuucagaaaugaacugaaaauuucgcuuuuauaguaggaagg

SEQ ID NO: 499597 - RNA, 61 nt, hsa
ccagaaaaaugugcucugcaguguccucccaacugaaaacaacagugacauguuugaaaag

SEQ ID NO: 499598 - RNA, 61 nt, hsa
acucggguggccugcgcuagcuucuuuugauacugaaaacuuuuaaggugggaggguggca

SEQ ID NO: 499599 - RNA, 61 nt, hsa
acgagcuuguucuuuguucuuugucacagggacugaaaaccucuccucauguucugcuuuc

SEQ ID NO: 499600 - RNA, 59 nt, hsa
auguaccaaaauaaaccucuauucuauuggcacugaaaauugaauaugauucuuauucu

SEQ ID NO: 499601 - RNA, 61 nt, hsa
gaaggcaagccuccccaacuuaagccauguaacugaaaaucuaauuauaggagcauuuguu

SEQ ID NO: 499602 - RNA, 61 nt, hsa
cagaguuguacagcagaagccucucuccuagacugaaaaugaaugugaaacuaggaaauaa

SEQ ID NO: 499603 - RNA, 61 nt, hsa
agggagaaaggagaaauuuugguuuuucaacacugaaaaaauacuaccuauaggaaagucu

SEQ ID NO: 499604 - RNA, 61 nt, hsa
gucgauggcaggaggggguuuugggugggccacugaaaagggguaccgaauagguugugug

SEQ ID NO: 499605 - RNA, 61 nt, hsa
cgcccaguguucugugaccacccguguagcuacugaaaauggcuggguaagcaagucaagg

SEQ ID NO: 499606 - RNA, 61 nt, hsa
uuuuuuaauuugagaauuuuuauuucuuuugacugaaaacacauuagaaccuaugaguaaa

SEQ ID NO: 499607 - RNA, 61 nt, hsa
aaaagcauggaaaggaagagaacugauuccuacugaaaauucaaauucuauuaccauucua

SEQ ID NO: 499608 - RNA, 61 nt, hsa
gacuacugcucacaaacgucgcaaagcagaaacugaaaacugguagguacacuuuccuacc

SEQ ID NO: 499609 - RNA, 61 nt, hsa
aaacaaaugugcccaccccacuuuccgcuuaacugaaaagcuuaaaauaaauuucugaauu

SEQ ID NO: 499610 - RNA, 61 nt, hsa
auucuucagaggcagggcuaagacuuucaagacugaaaagagacuagcauaaggagacuua

SEQ ID NO: 499611 - RNA, 61 nt, hsa
uuuaucugcugcuuuuuuuaaauaaaauuugacugaaaauguuuaauuggcauuuuuuaau

SEQ ID NO: 499612 - RNA, 61 nt, hsa
acucacuuuuauauacaagaaaaaccuuuccacugaaaaaucccucugauuuaaaaguaac

SEQ ID NO: 499613 - RNA, 61 nt, hsa
gaagagagaggaagaagucaaaccauaugaaacugaaaaaauaugacguacgaaauggaca

SEQ ID NO: 499614 - RNA, 61 nt, hsa
guauuuccauauugaagcagcuugaguuucuacugaaaaugagcccgaauuauuucacuau

SEQ ID NO: 499615 - RNA, 61 nt, hsa
auugaaaaaaaaaaagcacugaaaaccaauuacugaaaaaaaauugacagcuaguguuuuu

SEQ ID NO: 499616 - RNA, 61 nt, hsa
caccuucucaucagauugaaaaaaaaaaagcacugaaaaccaauuacugaaaaaaaauuga

SEQ ID NO: 499617 - RNA, 61 nt, hsa
uuauaguaggacuucuuugcauauguaugguacugaaaaaucuuaauauacaucuuuaauc

SEQ ID NO: 499618 - RNA, 61 nt, hsa
uuuacaugcagcagauaauuguucauaguggacugaaaacuaaugcaaggacuauggucuc

SEQ ID NO: 499619 - RNA, 61 nt, hsa
aaggagacagaaugcuuuguuccuuuaaaagacugaaaagcugaccuucaauggauugagg

SEQ ID NO: 499620 - RNA, 61 nt, hsa
guaucauuaaaaugguuaaguuuacauuugaacugaaaauauguauaaaaucuagcaauuc

SEQ ID NO: 499621 - RNA, 61 nt, hsa
aaagugguaauccucuucuaaaauagcaauaacugaaaaugaaaguguuaauuuuaccuug

SEQ ID NO: 499622 - RNA, 61 nt, hsa
aaguacccuaaaauugaaagguggucccuacacugaaaacgcacauaguuugucaaaagug

SEQ ID NO: 499623 - RNA, 61 nt, hsa
uuauuaaauaugcaaguuagaaauuaagucuacugaaaaauuuacauuuugagucagguuu

SEQ ID NO: 499624 - RNA, 61 nt, hsa
uaacugcuaaaucuuauuauaaggaaaccauacugaaaaccuuuccaagccucuuuuuucc

SEQ ID NO: 499625 - RNA, 61 nt, hsa
ucagcuucuuacaaauacauaagagacucacacugaaaaaaguuguaugaauauaaaaaug

SEQ ID NO: 499626 - RNA, 61 nt, hsa
ugguugcuuaauuguucugugauugaggaccacugaaaaauaagucuuaauaaauguuggu

SEQ ID NO: 499627 - RNA, 61 nt, hsa
aucucagaaaaaaaaaaaaaagauaauucauacugaaaagaaacucuacaaacuugaaaga

SEQ ID NO: 499628 - RNA, 61 nt, hsa
cccucucagcagacgcuucaugauaggaaggacugaaaagucuuguggacaccuggucuuu

SEQ ID NO: 499629 - RNA, 61 nt, hsa
acaagacaucagaacuuauuccucuugucuaacugaaaaugcaugccugaugaccaaacuc

SEQ ID NO: 499630 - RNA, 61 nt, hsa
uuacacuauugcccuaggcuugcuaggaaagacugaaaaaauuuuugugccuaacuuugug

SEQ ID NO: 499631 - RNA, 61 nt, hsa
cucauccacacaccuuucuuuacccagagccacugaaaacuauuuuuauaucauuggcuuu

SEQ ID NO: 499632 - RNA, 61 nt, hsa
ugucuuuucaucuguucaagaggagauugaaacugaaaacaaaaugagaacaacaaaaaaa

SEQ ID NO: 499633 - RNA, 61 nt, hsa
ggcaacauggugagaccucaucucuacaaaaacugaaaaauaaaaaacuuuuaaaaaaugu

SEQ ID NO: 499634 - RNA, 61 nt, hsa
acccuggccaacauggugaaaccuugucucuacugaaaauacaaaaaauuuagccaggugu

SEQ ID NO: 499635 - RNA, 61 nt, hsa
ggugaauauuuaugaaaaagucaacauuagaacugaaaauggaaauaaacugcuugaaaag

SEQ ID NO: 499636 - RNA, 61 nt, hsa
uagcaauaugauagauaauucagucugucauacugaaaaugacagcacuuuuaacaccuuu

SEQ ID NO: 499637 - RNA, 61 nt, hsa
aguagccuuaauaacguuaguuucaguaaguacugaaaaguauauaauacugccauccaua

SEQ ID NO: 499638 - RNA, 61 nt, hsa
augauucauuucaaaauccugagugagucugacugaaaaauacgagagaaaagagaguggu

SEQ ID NO: 499639 - RNA, 61 nt, hsa
uccaaaucuauuuuucucacguguuuaaaaaacugaaaagugacuacucagauauguugga

SEQ ID NO: 499640 - RNA, 61 nt, hsa
acaggacaucagaacuuauuccucuugucaaacugaaaaugcgugccugaugaccaaacuc

SEQ ID NO: 499641 - RNA, 61 nt, hsa
ugagauaauuggugucgggaguguugcagugacugaaaagcuucauaaggggcaguuggug

SEQ ID NO: 499642 - RNA, 61 nt, hsa
aggcagggcuggacucaggaacccacagcuuacugaaaaagccagaggccaugacugcccc

SEQ ID NO: 499643 - RNA, 61 nt, hsa
uaaugaccauuuccuggaaucaguuuauuauacugaaaacugggggugggaguagggagcu

SEQ ID NO: 499644 - RNA, 61 nt, hsa
gagaccuuccuagagugaaugaagguagaaaacugaaaagggaguaaauuaaggaaugauu

SEQ ID NO: 499645 - RNA, 61 nt, hsa
aaacuagcugaagccuuuucuuguuuuagcaacugaaaauuguacuuggucacuuuugugc

SEQ ID NO: 499646 - RNA, 61 nt, hsa
agugauaaacuaagucacauacagauaaagcacugaaaacaccacagugacccucccaccc

SEQ ID NO: 499647 - RNA, 61 nt, hsa
ugcuuuguauuguauauuacaaugaucaccgacugaaaauauuguuuuacaauaguucugu

SEQ ID NO: 499648 - RNA, 61 nt, hsa
cuguccuggaaacuguagaauugaauaaaucacugaaaauagaacacuucuuggaggcuuu

SEQ ID NO: 499649 - RNA, 61 nt, hsa
uccaaagcuccugaucuuucccaagauuguaacugaaaacugcugucucuuguuuuguucg

SEQ ID NO: 499650 - RNA, 61 nt, hsa
uugcaaacucaaucggggacuaaaauuucccacugaaaauguuaaacauuuuagauaacug

SEQ ID NO: 499651 - RNA, 61 nt, hsa
ccuguucuacugcaaaacacuggaaaaagagacugaaaaaaagcaauguacuguacauuug

SEQ ID NO: 499652 - RNA, 61 nt, hsa
gagccugaauuuuguugcuguuuugauuuguacugaaaaaugguaauuguugcuaaucuuc

SEQ ID NO: 499653 - RNA, 61 nt, hsa
ugagcaucucaaagaagucuguuaaaucaugacugaaaaaaaucaaucagauguaucuuca

SEQ ID NO: 499654 - RNA, 61 nt, hsa
aaucugaaacccuccuucuguggcaacuuguacugaaaaucuggugcucaauaaagaagcc

SEQ ID NO: 499655 - RNA, 61 nt, hsa
gagaccuggcccucaaaaaggugugaacaagacugaaaaggagguccguucagcuccgccu

SEQ ID NO: 499656 - RNA, 61 nt, hsa
uaagccuauuuccuauccauuuauagcuacuacugaaaaugacuacugaauuuuaucaaau

SEQ ID NO: 499657 - RNA, 61 nt, hsa
ugucccagaacugauguuuuuuuuuuaagguacugaaaagaaaugaaguugauguaugucc

SEQ ID NO: 499658 - RNA, 61 nt, hsa
ccaugaaccauuauaaaaucccaacauauauacugaaaauacugaaacugcuuugaaaauu

SEQ ID NO: 499659 - RNA, 61 nt, hsa
aucucuguuuuuccugucagagauuuaaaaaacugaaaagguauaccucaacccaaaaaua

SEQ ID NO: 499660 - RNA, 61 nt, hsa
agaauauguuuaauccauguauugguacuuuacugaaaaccagguuauauucuaaagaaga

SEQ ID NO: 499661 - RNA, 61 nt, hsa
aauuuuguuuuauagauaugauaggcaacagacugaaaaccauaaucuuuacuguauucua

SEQ ID NO: 499662 - RNA, 61 nt, hsa
cauagacuuuuaaacuucaaccaauguguuuacugaaaauaacaaauguuguaaauucccu

SEQ ID NO: 499663 - RNA, 61 nt, hsa
gucuuugaucgaaggaaaauagaucuaugagacugaaaaaccuauuugcuugauuaccauu

SEQ ID NO: 499664 - RNA, 61 nt, hsa
uuucaaauugaaaugacgguauaacacaucuacugaaaaagcaacgggaaaugugguccua

SEQ ID NO: 499665 - RNA, 61 nt, hsa
uaagaggaggagaaagcucucuauaccaaagacugaaaaaaaaaauccugucuguuuuugu

SEQ ID NO: 499666 - RNA, 61 nt, hsa
gauugauucaugauaauuguccuugacuaagacugaaaagacuaaugggaugccuuuuacu

SEQ ID NO: 499667 - RNA, 61 nt, hsa
uuccauuuuacuuaggaauaagcuuuuucgaacugaaaauucaugguaaaauaggauuucu

SEQ ID NO: 499668 - RNA, 61 nt, hsa
cguggcagggaaagcagcgugcggggaagucacugaaaagugcugccuaaggaaguuugga

SEQ ID NO: 499669 - RNA, 61 nt, hsa
uuccagaaaugaaauguaaauccauuuuuauacugaaaauguuacugaaagucacuuuuau

SEQ ID NO: 499670 - RNA, 61 nt, hsa
aauaggaaagauaacgggaagaugccaguugacugaaaauucaaagccuuucaauuugaag

SEQ ID NO: 499671 - RNA, 61 nt, hsa
aaaaaaaaaaaaccagacugaauuaauuuuaacugaaaauuucucuuauguuccaaguaca

SEQ ID NO: 499672 - RNA, 61 nt, hsa
guaaaagcccaguuugcuaggaggucugcuuacugaaaacaaggagaccuggggugggugu

SEQ ID NO: 499673 - RNA, 61 nt, hsa
aaaauuauuuucucuuaacaagacuuuuuguacugaaaacaauuuuuuugaaucuuucgua

SEQ ID NO: 499674 - RNA, 61 nt, hsa
aggaaauuuaaacucuaauuaugacagcuacacugaaaaauaauuguacugaaauuaacuu

SEQ ID NO: 499675 - RNA, 61 nt, hsa
aagacaccuucccggguggaagaaggaguucacugaaaacuuaucuuaaacugacccuucc

SEQ ID NO: 499676 - RNA, 61 nt, hsa
uaauuugaacuguacuggacccauaguuuuaacugaaaagggccaaacaaguggugucugu

SEQ ID NO: 499677 - RNA, 61 nt, hsa
gcggccuuagagguuucccuccuuccuuuccacugaaaagcacauggccuugggugacaaa

SEQ ID NO: 499678 - RNA, 61 nt, hsa
cauauacagcaggcaaagagacagaaaauuaacugaaaagcaguuuagagacugggggagg

SEQ ID NO: 499679 - RNA, 61 nt, hsa
cauauauaguagacaaagagccagaaaauuaacugaaaagcaguuuagacauugggggagg

SEQ ID NO: 499680 - RNA, 61 nt, hsa
caaagcuuuuuauuacuuuguaauuuaaaaaacugaaaaaaaaaaaacugaagaacuuugg

SEQ ID NO: 499681 - RNA, 61 nt, hsa
cacacucugccuccccacuucuccccccguuacugaaaaauaaccauuuuagugucaggcu

SEQ ID NO: 499682 - RNA, 61 nt, hsa
auguauauauuuuucaaggucuguuuuucuaacugaaaagcuaagggcuugauuccuagcc

SEQ ID NO: 499683 - RNA, 61 nt, hsa
uugguuugguuuggcuuugacuaauucugguacugaaaaguuagcuauacacacacacaca

SEQ ID NO: 499684 - RNA, 61 nt, hsa
uuaaguuuuaucguguaaauacauuagcuaaacugaaaaguauaaguaacaugcuuuguug

SEQ ID NO: 499685 - RNA, 61 nt, hsa
agacuguguucauguguaaagacugagcagaacugaaaaauuacuuauuggauauucauuc

SEQ ID NO: 499686 - RNA, 61 nt, hsa
cuugaaauuacuugaauuuucuugucuuaaaacugaaaaaaaaauguaguuacacguuaaa

SEQ ID NO: 499687 - RNA, 61 nt, hsa
caguuuguccucauaaacguuguagguugaaacugaaaaauaaguuaaaaugaucaaucaa

SEQ ID NO: 499688 - RNA, 61 nt, hsa
ugaaauuuaauucuauuuugauaaaacuaagacugaaaauaaccacuuguaaacauuccua

SEQ ID NO: 499689 - RNA, 61 nt, hsa
agccuggccaagauggugaaaccccgucucuacugaaaauacaaaaauuagccaggugugg

SEQ ID NO: 499690 - RNA, 61 nt, hsa
cacacauggcugaugucacauugaaaaugugacugaaaauuugaaaauucucucaauaaag

SEQ ID NO: 499691 - RNA, 61 nt, hsa
aacuuaaaaaguaguuagccaauaugcaaucacugaaaacuaugcaagagaaauuccaacc

SEQ ID NO: 499692 - RNA, 61 nt, hsa
uucuugcuguugaaaaaaggaacaaagcguuacugaaaagaagguaaccuuuguuggaugu

SEQ ID NO: 499693 - RNA, 61 nt, hsa
gaagcagauaucaacucacacuauucacacaacugaaaauauugggcaucaaauagauuag

SEQ ID NO: 499694 - RNA, 61 nt, hsa
ccuaggagcccuguaacucccaggagagaccacugaaaauacuggagcaacaaugccccug

SEQ ID NO: 499695 - RNA, 61 nt, hsa
agugauaaacuaacaaacaaauauaacaacaacugaaaaggcacucuaaauuguggcuggc

SEQ ID NO: 499696 - RNA, 61 nt, hsa
aucauuuuguggaugccaaaugaauaucaaaacugaaaacacauuuguugauauuugucuu

SEQ ID NO: 499697 - RNA, 61 nt, hsa
gauaugaguauccuuugcuuaucuuuguaguacugaaaauuugccgaaguaacuggcugug

SEQ ID NO: 499698 - RNA, 61 nt, hsa
aacauaucaguaaguuucuauauguaucaaaacugaaaaaauaguguuccaggcuaacaua

SEQ ID NO: 499699 - RNA, 61 nt, hsa
ugaucagcacuaccacauccaaacauaagucacugaaaaacacuuaauauuuaugaguugg

SEQ ID NO: 499700 - RNA, 61 nt, hsa
uuucuacaccuggaggaauguugcagaaagaacugaaaagguauaugaccggguaucagug

SEQ ID NO: 499701 - RNA, 61 nt, hsa
uuauagguugaagcacacauauuugcaguuuacugaaaaguagauuucuuaugugacuuuu

SEQ ID NO: 499702 - RNA, 61 nt, hsa
uuuaaaaaaugauuaucuuuuagagaaguauacugaaaaauguacaggugaaaugauaugu

SEQ ID NO: 499703 - RNA, 61 nt, hsa
uuucuuuguauuguguucuaccuucccuuucacugaaaaugaucacuucauuugauacugu

SEQ ID NO: 499704 - RNA, 61 nt, hsa
uuuaugaauaccaaauaaauagaccucuuguacugaaaacauauuugugacuuuaaucgug

SEQ ID NO: 499705 - RNA, 61 nt, hsa
acauuuuaaguuggauggugugcucuaaaauacugaaaaacaauagcccauauaccuaugu

SEQ ID NO: 499706 - RNA, 61 nt, hsa
ugcugaaaauugccuuucuguguuuauucaaacugaaaagcugagaccaagagcaaggaag

SEQ ID NO: 499707 - RNA, 61 nt, hsa
uguucuauugaaugccuuguuaacagccaacacugaaaacacugugagaauuuguuuucag

SEQ ID NO: 499708 - RNA, 61 nt, hsa
ggaauauguuacuuaaaacgugugcauucuuacugaaaauguuuucaaaggaagguaucag

SEQ ID NO: 499709 - RNA, 61 nt, hsa
acaauaaaaauccagucuuaauuccagauuuacugaaaaugucagaucauuuuguauuaau

SEQ ID NO: 499710 - RNA, 61 nt, hsa
aaaggccuguacauacuucucccaaagcgccacugaaaagauggcauagcuuaaaagauga

SEQ ID NO: 499711 - RNA, 61 nt, hsa
cuguccauuguuugaggauguuaccuacuaaacugaaaacauucauuccauaucuacuuac

SEQ ID NO: 499712 - RNA, 61 nt, hsa
aaaaauguaacaggggaaauuauauaccgugacugaaaacuagaguccuacuuacauaguu

SEQ ID NO: 499713 - RNA, 61 nt, hsa
uuuuauuuccaaaacaugcucuccuacuugaacugaaaaguaagagaaauaaauagaaucu

SEQ ID NO: 499714 - RNA, 61 nt, hsa
gaggugcacgggccaccauagucacacuggcacugaaaagaaagcguugcccuggugauuc

SEQ ID NO: 499715 - RNA, 61 nt, hsa
aagguggucgggcaaaguauugccaggagauacugaaaaucauccagaagcacugugauau

SEQ ID NO: 499716 - RNA, 63 nt, hsa
acaggccggaaaauugugcucuagaagaauaaaacugaaaaacucuagagaauuuuuuuuccc

SEQ ID NO: 499717 - RNA, 63 nt, hsa
aaagauuucuucuuugaaaggucaagaccgugaacugaaaaaaguguuggccuuuuugcggga

SEQ ID NO: 499718 - RNA, 63 nt, hsa
uuguauucugauugcccuucaucccaaguguuuacugaaaauuccauucuagauauucuuguu

SEQ ID NO: 499719 - RNA, 63 nt, hsa
uuauuuccaggggcacacaaugcuauugaaauuacugaaaacaaaauaucugacaucuuauuu

SEQ ID NO: 499720 - RNA, 63 nt, hsa
cuagguuuuuauauaaauagugaaauuugaauuacugaaaaccauguuaauuuuuagaacuca

SEQ ID NO: 499721 - RNA, 63 nt, hsa
ugaagaacuuuguuacacauauuuugauaaggcacugaaaauauaaaaggacugguaguuuac

SEQ ID NO: 499722 - RNA, 63 nt, hsa
gguuaaguaucuuccauguuaauguguuaagagacugaaaauaccagccaucagaaacuggcc

SEQ ID NO: 499723 - RNA, 63 nt, hsa
uugacaucaguuuuaaaucaauggagagaaaaaacugaaaaagaugcugcuaaguaguucucu

SEQ ID NO: 499724 - RNA, 63 nt, hsa
uauuuuaugcuccuuuuuuuucgcacucuuaagacugaaaauuggcguugaguguuauaguga

SEQ ID NO: 499725 - RNA, 63 nt, hsa
gcagugugauuggacugccagccagguuaauaaacugaaaaaugugauuggcuuccucucgcc

SEQ ID NO: 499726 - RNA, 63 nt, hsa
aaauuuagacaauuaaaacauuucuaaagugagacugaaaauaauauagaaaaucucauugcu

SEQ ID NO: 499727 - RNA, 58 nt, hsa; identical to SEQ ID NO: 499006

SEQ ID NO: 499728 - RNA, 63 nt, hsa
ggguaaagauggguuuuuaaugauacuaagauaacugaaaauaggcauauagauauauuccaa

SEQ ID NO: 499729 - RNA, 63 nt, hsa
accaucuggccaacauggugaaacccugucucuacugaaaauaaaaaaaacuagcugggcaug

SEQ ID NO: 499730 - RNA, 63 nt, hsa
cucuuuguaugauauuuauuaggaggaaagaggacugaaaauguucuuguguagaaacagaag

SEQ ID NO: 499731 - RNA, 63 nt, hsa
caacuaaugaagaaaugaauaauaaauuuugacacugaaaaacauuuuauuaauaaagaauau

SEQ ID NO: 499732 - RNA, 63 nt, hsa
ugguauaguaugugcauaauggaaaguuaccuuacugaaaaaaaaaaaagaaggaaaaauaag

SEQ ID NO: 499733 - RNA, 63 nt, hsa
cuucugauuuuucauugcucuauaauucuuuuuacugaaaauacuauguuaugaaugguauua

SEQ ID NO: 499734 - RNA, 63 nt, hsa
guuuugaaaacguuacauuuuuuaaaucuuaaaacugaaaacuuguuuuuaguauuucuauuu

SEQ ID NO: 499735 - RNA, 63 nt, hsa
auguucucuuauuuuaaagauacagugcuccccacugaaaauuaaaccuaaaaaaugucacau

SEQ ID NO: 499736 - RNA, 63 nt, hsa
gagcuuuaucauggaccagaggaaaaccagaaaacugaaaacauuccucugucuuguggccag

SEQ ID NO: 499737 - RNA, 63 nt, hsa
agccauuucacuacuagaaauugacgcaagugaacugaaaacuuauguucacacaaaaacucg

SEQ ID NO: 499738 - RNA, 63 nt, hsa
acuacuuuggcucuugugcauaaaaacaagaacacugaaaauugggaauaugcacaaacuugg

SEQ ID NO: 499739 - RNA, 63 nt, hsa
aauugcaguagugugaaaauacauuuuuuacaaacugaaaauacaguagauaagcugucgaaa

SEQ ID NO: 499740 - RNA, 63 nt, hsa
uauugauauuuuuguaacagaauauagcucuuaacugaaaauccagaaccagaaacauaaauc

SEQ ID NO: 499741 - RNA, 63 nt, hsa
ucaucuuuugacucuguauuuaaauucuaugauacugaaaauaaaggcauucuggaaaaauac

SEQ ID NO: 499742 - RNA, 63 nt, hsa
ggaauugcuggcugcuuuuacuuccugaccaagacugaaaaauuauuuacugaaaucuguaaa

SEQ ID NO: 499743 - RNA, 63 nt, hsa
uggugugucauggugccucaucauucuggggagacugaaaauaccuucaucacugaccuggug

SEQ ID NO: 499744 - RNA, 63 nt, hsa
ccuccacccccaacucaugaaaagauucuauggacugaaaaagccccaggcugaaaggacugg

SEQ ID NO: 499745 - RNA, 63 nt, hsa
acauauuuuuguuauauacaauauugcugaugaacugaaaauuaacaaguaaaaugcacaugc

SEQ ID NO: 499746 - RNA, 63 nt, hsa
auaaacucaagcuggagaaaugaguccugauagacugaaaauugagcaaauggaagaagauac

SEQ ID NO: 499747 - RNA, 63 nt, hsa
gcacagcccugggagggggcuauuucucuccccacugaaaacauuucaaagcugaguuacuug

SEQ ID NO: 499748 - RNA, 63 nt, hsa
aucagagguuuaauuugaaguuuauguucacacacugaaaacuuaguuuuuuuguugguagau

SEQ ID NO: 499749 - RNA, 63 nt, hsa
guaaagccuccuggcaccaggccuuccugcucgacugaaaaaaauuuucucuuugaaaauccc

SEQ ID NO: 499750 - RNA, 63 nt, hsa
ucucuuggaguuucagaaaugcuagcuuggacaacugaaaagucacaucacagcuggcauucu

SEQ ID NO: 499751 - RNA, 63 nt, hsa
gagaccccgucucuaaaaauaaaauguaaaaucacugaaaaaaugaguguucggugaaacaag

SEQ ID NO: 499752 - RNA, 63 nt, hsa
cuccccagaggcugcauugaggagacuccacagacugaaaagugaguuugcagaaaccuuggg

SEQ ID NO: 499753 - RNA, 63 nt, hsa
gugaaccuaacuuucucuuauugguggguaauaacugaaaauaaagauuuauuuucaugcuca

SEQ ID NO: 499754 - RNA, 63 nt, hsa
gauaaucauacuuccucugugagacaggccauaacugaaaaacucuuaaauauuuagcaauca

SEQ ID NO: 499755 - RNA, 63 nt, hsa
cacaauauuugucacuguucuauuagacuuuuuacugaaaaugaauaaugguguaaugguucu

SEQ ID NO: 499756 - RNA, 63 nt, hsa
caauaauuggaguucauacugaugcccugaggcacugaaaaaaaaaaaaaucccaaagugccu

SEQ ID NO: 499757 - RNA, 63 nt, hsa
guaauaauagaauaaaggguugaguaacuuagaacugaaaaugaucucuuuuaaaaagaaauu

SEQ ID NO: 499758 - RNA, 63 nt, hsa
ugauuaaguggggucacugaauuccauuuguggacugaaaaguauucaauccacuuuuggggu

SEQ ID NO: 499759 - RNA, 63 nt, hsa
cuuuuuuuuucuuuuuaagccauaauuggugauacugaaaacuuuggguucccauuuauccug

SEQ ID NO: 499760 - RNA, 63 nt, hsa
cagaagagacuuagagaugcuaauggaauuuaaacugaaaaaaggagcccaaugaagcuaagc

SEQ ID NO: 499761 - RNA, 63 nt, hsa
cugggacauaaguuuuucugcuuucagacgcaaacugaaaaauggcucuucuugggucuugag

SEQ ID NO: 499762 - RNA, 63 nt, hsa
acugccuaaccuuuuggagccuuagucucccagacugaaaaaggaagaggaugguauuacauc

SEQ ID NO: 499763 - RNA, 63 nt, hsa
cauguuacucuuucucucuccaucagcuuccucacugaaaaugugcauuaagugccuuguaga

SEQ ID NO: 499764 - RNA, 63 nt, hsa
gagggugugggacccucaccgaauucauugauuacugaaaauugaauguuuuuuggguccaca

SEQ ID NO: 499765 - RNA, 63 nt, hsa
agcagcaucugguaugcagccaccaggacaaggacugaaaauaaugucuacaguccacagcuu

SEQ ID NO: 499766 - RNA, 63 nt, hsa
agaucaaaguccagcaggcaaggacggccuucaacugaaaagacucaguguucccuuuccuac

SEQ ID NO: 499767 - RNA, 63 nt, hsa
uaaccuguccuacccucaaagccauaugcaaauacugaaaagaaggccugaggggcugguccu

SEQ ID NO: 499768 - RNA, 63 nt, hsa
aucaguguuugacuagggaucaugaaauaauaaacugaaaaaaacuuuagaguucaguugauc

SEQ ID NO: 499769 - RNA, 63 nt, hsa
cguugguggcucugauccauauggucaaaaaggacugaaaaauugugauguauuugauccugu

SEQ ID NO: 499770 - RNA, 63 nt, hsa
ggcaaacauaggucugggcauuaaauuauacaaacugaaaauguguuacaagaaaaauaugag

SEQ ID NO: 499771 - RNA, 63 nt, hsa
aaguacuugggcuucagaaguaagagccaaccaacugaaaaccugagauggagauauguucaa

SEQ ID NO: 499772 - RNA, 63 nt, hsa
uauugacgggaagagguacaucuuuuuuuccuuacugaaaacaaauauggauuaauugccuca

SEQ ID NO: 499773 - RNA, 63 nt, hsa
acuuaaaauaagaaaaggagcacuuuaauuacaacugaaaaaucagauuguuuuguaguccuu

SEQ ID NO: 499774 - RNA, 63 nt, hsa
ugugaaacgaugagaguaaguugcaaccuugugacugaaaacuugaaaagaguggagcaggug

SEQ ID NO: 499775 - RNA, 63 nt, hsa
ucucucucaaagcuucaguuagacacacaguucacugaaaauucagucagucaaaaacuggaa

SEQ ID NO: 499776 - RNA, 63 nt, hsa
agcuaaauuccccauucugucuaauaaaggaagacugaaaaaagguuuuaaagaacauaaaug

SEQ ID NO: 499777 - RNA, 63 nt, hsa
gggagaagagaugcugccauuuaaccccuugguacugaaaaugagaaaauccccaacuaugca

SEQ ID NO: 499778 - RNA, 63 nt, hsa
auucugcuacuucacugucaucuucaauuuauuacugaaaaugauuccuggacaucaccaguc

SEQ ID NO: 499779 - RNA, 63 nt, hsa
ggugcucaauugcucucccuugcucuuccccaaacugaaaauaccuacugcaggaucccucgg

SEQ ID NO: 499780 - RNA, 63 nt, hsa
uuauuaggaaaaacugaauuucccaacaggugaacugaaaaguuauuuuaacuauuauacaua

SEQ ID NO: 499781 - RNA, 63 nt, hsa
aauuauggaaaaauaauucagaaucuaaacaccacugaaaacuuauaaaaaauguuuagauac

SEQ ID NO: 499782 - RNA, 63 nt, hsa
agagagaaauccaucuuuucccaggucuccuucacugaaaacaaaaaucuacuuacauacacu

SEQ ID NO: 499783 - RNA, 63 nt, hsa
caugauuagaggagagagaacuugauucaagauacugaaaaauagagcugggacugagccugu

SEQ ID NO: 499784 - RNA, 63 nt, hsa
ucugggucggucagugacauguagguaggaagcacugaaaauaguguucccagagcacuuugc

SEQ ID NO: 499785 - RNA, 63 nt, hsa
aagggcauuuuacccuugcaguuuuacuaaaacacugaaaaauauuccaagcuucauauuaac

SEQ ID NO: 499786 - RNA, 63 nt, hsa
ccaaaaaaaucaagauuuaauuuuuuuauuuguacugaaaaacuaaucauaacuguuaauucu

SEQ ID NO: 499787 - RNA, 63 nt, hsa
aaacaacaaaaaaaaaucuuuauaagaaagagaacugaaaaguagcgugcuauucguccugua

SEQ ID NO: 499788 - RNA, 63 nt, hsa
cagccugaccaacauggagaaacccccaucucuacugaaaauacagaauuagccaggcauggu

SEQ ID NO: 499789 - RNA, 63 nt, hsa
cagagauuguuucaaauggguguaguagauauuacugaaaaccaaaaaagagugagauuguca

SEQ ID NO: 499790 - RNA, 62 nt, hsa
cuuuccacuuccaguucuaguaaggaagaaaaacugaaaauguuuuaguuuauuacccagua

SEQ ID NO: 499791 - RNA, 63 nt, hsa
uuuucuugacaauuagauaccuauccuguaguuacugaaaaucuggguaguaaaucuacccaa

SEQ ID NO: 499792 - RNA, 63 nt, hsa
aguacugagaaaaaucccuucagcucuaagaacacugaaaaauccaccgauuuuuuggguaag

SEQ ID NO: 499793 - RNA, 63 nt, hsa
aacaguugacaggucauccuugccaguuguauaacugaaaaaggacuuuucuaccagguauga

SEQ ID NO: 499794 - RNA, 63 nt, hsa
auuugagauugauuggauucgaccucuuguugaacugaaaacuuaauuuuuucucuguauuuu

SEQ ID NO: 499795 - RNA, 63 nt, hsa
uugcauuagcaaauauucaugcagcagcaguugacugaaaauuuauucuuaugagacguauag

SEQ ID NO: 499796 - RNA, 63 nt, hsa
uauauauucucuaaauauuucuugaauuaaugaacugaaaaauguguguuaaaguugcuaagu

SEQ ID NO: 499797 - RNA, 63 nt, hsa
aauauaacaacucuggauuacauuuuccucucaacugaaaacccucaguaaugcaaagaaagg

SEQ ID NO: 499798 - RNA, 63 nt, hsa
ugagcuaaaacccacucuaugagaaggaagauuacugaaaagcaugugacauauugcuacaaa

SEQ ID NO: 499799 - RNA, 63 nt, hsa
guacuucugauuaaugcaaggggaaauuuuuauacugaaaacaaacaaacaaacuagcagcua

SEQ ID NO: 499800 - RNA, 63 nt, hsa
uuauuuuauaaaauguuuucuguauggcaauaaacugaaaacauggaucaacccuucuuuuga

SEQ ID NO: 499801 - RNA, 63 nt, hsa
auguuagcuacuaugaauggugccagugaagacacugaaaaauaagugauuucaguaaccuuc

SEQ ID NO: 499802 - RNA, 63 nt, hsa
cucaguugugggaauaauuaucagagacaugcaacugaaaaugucucaccuuucaucuuuuuu

SEQ ID NO: 499803 - RNA, 63 nt, hsa
caaaauugcaaauauaaacaaaagaaaaauccaacugaaaauaacacuaaguauuuuugaguu

SEQ ID NO: 499804 - RNA, 63 nt, hsa
agacuaaauaaugacauaauccucagcugacugacugaaaaugugacuggacgcauucccugu

SEQ ID NO: 499805 - RNA, 63 nt, hsa
uguuucuuauagcuaugugugguuucugggucaacugaaaaccuaccauuugcuuuucuauuc

SEQ ID NO: 499806 - RNA, 63 nt, hsa
auugaaaagaaauauggaggcuuuaaaccgcaaacugaaaaagcugaguagaacaaaggcagu

SEQ ID NO: 499807 - RNA, 63 nt, hsa
uucuaaaagguauuuuuauaagcaguucaaguuacugaaaaccuuuuaaaccuuucugaaguu

SEQ ID NO: 499808 - RNA, 63 nt, hsa
aaacuuaucagaauccucguucuuuuucagacuacugaaaaaugacauuuacucuguuaaaug

SEQ ID NO: 499809 - RNA, 63 nt, hsa
ggagugcuuuuuauguauguugucuucuucaauacugaaaauuuguccuugguucuuaaaagc

SEQ ID NO: 499810 - RNA, 63 nt, hsa
gaguccgggaggugccugugguuugcacccaccacugaaaaagccgcggagaugcgcagcgcg

SEQ ID NO: 499811 - RNA, 63 nt, hsa
gcuguuuagaagggauggcuugaaaggaaggagacugaaaaacacucugagagcauacacugu

SEQ ID NO: 499812 - RNA, 63 nt, hsa
ugacugaggucucucuuggccuggaagaauaacacugaaaaaaccugacgcugcggucacuua

SEQ ID NO: 499813 - RNA, 63 nt, hsa
gcacuccagccggggugacagagugagacuccgacugaaaauaaauaaauaaauaaauaaaua

SEQ ID NO: 499814 - RNA, 63 nt, hsa
auagcuacuuauucagauacugaagaccaacggacugaaaaaaagaacaaacauuagcuauuu

SEQ ID NO: 499815 - RNA, 63 nt, hsa
uaggcccucucuagcaaaguuaugggcugcuuuacugaaaacagaauggaagcccugaaguca

SEQ ID NO: 499816 - RNA, 63 nt, hsa
cagauaucagugugaaaagucuggggauuucaaacugaaaauccaaaagauaaguaaaugagu

SEQ ID NO: 499817 - RNA, 63 nt, hsa
ccagccuggccaacguggugaauccccgucucuacugaaaacacaaaaauuagacgggcaugg

SEQ ID NO: 499818 - RNA, 63 nt, hsa
cugcuaagagguacauguggguauuuuggaguuacugaaaaauuauuuuugggauaagagaau

SEQ ID NO: 499819 - RNA, 63 nt, hsa
aaaguaggaaccagauagagaugaaaaggggccacugaaaagugaauuugauagcucagcauu

SEQ ID NO: 499820 - RNA, 63 nt, hsa
agguaauuuacauauuuucuuucuguugaaauaacugaaaauguuaaaucuaccaguuuaugu

SEQ ID NO: 499821 - RNA, 63 nt, hsa
uuuugugaccacuugugaauggguguauggagaacugaaaaggguaucugcaugaaggcuccu

SEQ ID NO: 499822 - RNA, 63 nt, hsa
ggaaacuugaaaggucugaggaugauguagauuacugaaaaaugcaaauugcaaucauauaaa

SEQ ID NO: 499823 - RNA, 63 nt, hsa
ugaaugccucccucaaaggaccugcaggcagagacugaaaauugcagacagaggggcacgucu

SEQ ID NO: 499824 - RNA, 63 nt, hsa
uauuucauaccaaugaaaucuuacuuuucagugacugaaaagauagaauuuauuugcuaauaa

SEQ ID NO: 499825 - RNA, 63 nt, hsa
ggguggggggaugguaagagaaaagagagaaacacugaaaagaaggaaagaugguuaaacauu

SEQ ID NO: 499826 - RNA, 63 nt, hsa
gaaggaaaaucacccagaaugcuucugcaagauacugaaaauucuccacugcauggacccugg

SEQ ID NO: 499827 - RNA, 63 nt, hsa
agaucaguggcggaucaaaaccuacaagauucaacugaaaaguuggcaguuaugguuuucuuu

SEQ ID NO: 499828 - RNA, 63 nt, hsa
auuugcacaacuagaacacaucccagaacaauuacugaaaagcugaaauuuaaugggugguga

SEQ ID NO: 499829 - RNA, 63 nt, hsa
uuggauuaacccucuauagacagaauagauagcacugaaaaaaaaucucuaugagcuaaaugu

SEQ ID NO: 499830 - RNA, 63 nt, hsa
auguugccaaacuuuggaaauguuaauguucagacugaaaaucuccacuacauguaacuuucu

SEQ ID NO: 499831 - RNA, 63 nt, hsa
guuuuguuuuuaaaucaaacuguaaaacuuaaaacugaaaaauuuuauugguaggauuuauau

SEQ ID NO: 499832 - RNA, 63 nt, hsa
agaacuccuuacucugaugucuguauauguugcacugaaaagguuaauauuuaauguuuuaau

SEQ ID NO: 499833 - RNA, 63 nt, hsa
agaucuagugguucacacagagagagagagaguacugaaaaagcaacuccucuucuuagucuu

SEQ ID NO: 499834 - RNA, 63 nt, hsa
cagacuucuacauuaaugauguauguguugcugacugaaaagcuauacugauuagaaaugucu

SEQ ID NO: 499835 - RNA, 63 nt, hsa
augucuucuaaggauggucuuccaggcuuuuaaacugaaaagcuuaauucagauaguagcuuu

SEQ ID NO: 499836 - RNA, 63 nt, hsa
ucacugugagcaacuuagaguaaaaauucgaaaacugaaaaauaaggcuaguguacuacaaaa

SEQ ID NO: 499837 - RNA, 63 nt, hsa
uaaagcgagguuguaaaaauuacaaguugcaugacugaaaaaaugcuuuagggggaaaaucag

SEQ ID NO: 499838 - RNA, 63 nt, hsa
cagugcauuauaccaaagagcgaagucagugccacugaaaauacagaacccauuaauaucgug

SEQ ID NO: 499839 - RNA, 63 nt, hsa
ugugcucucuuuaaaucaaguccuuuaauuaagacugaaaauauauaagcucagauuauuuaa

SEQ ID NO: 499840 - RNA, 63 nt, hsa
aaacccugauguaaagaucagucccaguuauaaacugaaaacagcuauuuacaaagcaguaaa

SEQ ID NO: 499841 - RNA, 63 nt, hsa
aguauccacucggaccaucuguuaucucucuacacugaaaauaaaaccucuuccacccacccc

SEQ ID NO: 499842 - RNA, 63 nt, hsa
uugauacgaucuugugaaaacacuguauuuucgacugaaaauuccacuuucuucaucuuguuu

SEQ ID NO: 499843 - RNA, 63 nt, hsa
gacuagaaagucuacuugagcauguuguaaucaacugaaaaaucuggggggaaaaaaaaaaaa

SEQ ID NO: 499844 - RNA, 63 nt, hsa
gauagaaaacuauuaacagugcggcuacaugguacugaaaaugcaggcauuacaccagcuguu

SEQ ID NO: 499845 - RNA, 63 nt, hsa
ggcucuaaaguugguguagcagcaguugaucagacugaaaaacgguuuuuagucucuggaaaa

SEQ ID NO: 499846 - RNA, 63 nt, hsa
aaguaucuuaaaagaaggaacuauaaacauugcacugaaaacuugcuuuaaagcuuuaccuga

SEQ ID NO: 499847 - RNA, 61 nt, hsa; identical to SEQ ID NO: 499126

SEQ ID NO: 499848 - RNA, 63 nt, hsa
cuuggguccccuuuccauguauguuuucuugucacugaaaacaaacaacgcugaguuuaucaa

SEQ ID NO: 499849 - RNA, 63 nt, hsa
gcugcuucaagucugugcaguugacuuggcuguacugaaaagugaacagcauggauuaacuca

SEQ ID NO: 499850 - RNA, 63 nt, hsa
ccuugugauguggcaauaaauuuuuuuuaaaaaacugaaaauacuuaggaaggauccgcauaa

SEQ ID NO: 499851 - RNA, 63 nt, hsa
aaaaaagguuacucaaguuguacuacccacauaacugaaaauauuggccauuuggccuuaucu

SEQ ID NO: 499852 - RNA, 63 nt, hsa
caaggaacuugucaagagaucaugguucauguuacugaaaagacuuuaaggauuuguaagguu

SEQ ID NO: 499853 - RNA, 63 nt, hsa
ccaggcuggccaacaugguaaaacccugucucuacugaaaaacaacaaaaacaaaaacacaaa

SEQ ID NO: 499854 - RNA, 63 nt, hsa
aaaaaaaguaguuuguaaacucauuugugaucuacugaaaagagguuauauuaaagcaaauua

SEQ ID NO: 499855 - RNA, 63 nt, hsa
guguuuauuuugaaucguuaacauuauuuaaagacugaaaauucauugcaauuagggaacgca

SEQ ID NO: 499856 - RNA, 63 nt, hsa
aaugguuggagauugcuggcgaugugaugcugcacugaaaaaacuggucacacaaaauguuua

SEQ ID NO: 499857 - RNA, 63 nt, hsa
guagaugauaaaggccagauuacaaauuacauuacugaaaacuucauucuuggguuaacagua

SEQ ID NO: 499858 - RNA, 63 nt, hsa
cucaggcuuucguagugauuagcuuacuaaggaacugaaaaugggccccuuguacaagcugag

SEQ ID NO: 499859 - RNA, 63 nt, hsa
ccagccuggccaacauagugaaaccccaucucuacugaaaauacaaaaauuagcugggugugg

SEQ ID NO: 499860 - RNA, 63 nt, hsa
uuuugauauguaagagauauucagaaugcucacacugaaaaugccucaacuuuuuaaagugua

SEQ ID NO: 499861 - RNA, 63 nt, hsa
gaaaaaacauuuuuacugcugcuuaguuuuuggacugaaaagauauuaaaacucaagaaggac

SEQ ID NO: 499862 - RNA, 63 nt, hsa
cacuuggucugacuuguaccaauucuagcacccacugaaaaacaaguugaguagagaguguag

SEQ ID NO: 499863 - RNA, 63 nt, hsa
ugcauuagcuguuuguaaauaaugcauuugcauacugaaaaaggaaugccaccugccacaguu

SEQ ID NO: 499864 - RNA, 63 nt, hsa
ccuuucaaucaaaacucaguaucauaaguagagacugaaaacuugccguuauugauuguuguu

SEQ ID NO: 499865 - RNA, 63 nt, hsa
agccugcugucccauggagaaaaaguuuuaagcacugaaaaaauuugauuaauguauuuaaau

SEQ ID NO: 499866 - RNA, 63 nt, hsa
guuuauuaguauugcuuuucauaauucugucucacugaaaaccuuauuugauggaagcaacau

SEQ ID NO: 499867 - RNA, 63 nt, hsa
guguaaaaacaaaguuugggcucugaaaauuuaacugaaaaagauuuccuuguuuuuguaaua

SEQ ID NO: 499868 - RNA, 63 nt, hsa
aauuuuuuaaaagccagucaaaacaaaaacuuuacugaaaauggacagaaauaggaaauggac

SEQ ID NO: 499869 - RNA, 63 nt, hsa
gaaguucuuuuuaaaaugacacuuaaaacaaucacugaaaacuugauccacaucacacccugu

SEQ ID NO: 499870 - RNA, 63 nt, hsa
uaugaaauucaugaguuuauuuaugucuaaaacacugaaaacuguguccaauaucguucaguu

SEQ ID NO: 499871 - RNA, 63 nt, hsa
agaaaucaugaguaaaauuggaaaacacuuuuaacugaaaaaaacaaaagcacaacaaaccaa

SEQ ID NO: 499872 - RNA, 63 nt, hsa
ugcuucuguuguaauaguccauggacaauauaaacugaaaaaugucagucugguuuauauaag

SEQ ID NO: 499873 - RNA, 63 nt, hsa
cccacaccaucgaucauagcaccaccuaucagcacugaaaacucuuuuguaaguuguuuaaaa

SEQ ID NO: 499874 - RNA, 63 nt, hsa
ugucucccaguuaugaaucagugggcaggauaaacugaaaacucccauuuacgugucugaauc

SEQ ID NO: 499875 - RNA, 63 nt, hsa
gaagaaaucucugaagaaaccaaaagagcugaaacugaaaaaagagcucccucccuuuuuuca

SEQ ID NO: 499876 - RNA, 63 nt, hsa
cgagccuuuaaacagcaguuuguaaacuaugcaacugaaaaacugaggaugauuguuagcucc

SEQ ID NO: 499877 - RNA, 63 nt, hsa
auuagucauguccauucagacauaaccugaacuacugaaaagaucaauuuccagaagguuuau

SEQ ID NO: 499878 - RNA, 63 nt, hsa
aguuuaaaaaaaaucuauaguuuccaauaaacaacugaaaaauuaucaugagauguguauuua

SEQ ID NO: 499879 - RNA, 63 nt, hsa
gguagucaaugaacuggcugccacuuuaauauaacugaaaauucauuuugagaccaagcagga

SEQ ID NO: 499880 - RNA, 63 nt, hsa
ugacauccacuuaggaugauacaaagcaguguaacugaaaauguuucuuuuaauugauuuaaa

SEQ ID NO: 499881 - RNA, 63 nt, hsa
aaauaggaaucaacuuaacaaaacaagugcaagacugaaaacuacaaaauuggaaagaaauua

SEQ ID NO: 499882 - RNA, 63 nt, hsa
uuucucugaauugacugauuuuguuuuuuucuuacugaaaauggaccugccuuucacugaauu

SEQ ID NO: 499883 - RNA, 63 nt, hsa
gaggucuugaggucuugacaucuugacauauacacugaaaaaaauggggguuguauguaugug

SEQ ID NO: 499884 - RNA, 63 nt, hsa
ggcucccugcaguuggcuggguguuuaauagucacugaaaacucccagcccugcugcacacua

SEQ ID NO: 499885 - RNA, 63 nt, hsa
aacuguacuuacuuuacaggaagaaauuuuaaaacugaaaacuaccugggaucauaguguuuc

SEQ ID NO: 499886 - RNA, 63 nt, hsa
ugaacuggacuugguuggcauuuuaguuuaaugacugaaaaaguagguugaaagcucucugua

SEQ ID NO: 499887 - RNA, 63 nt, hsa
gccauuguugcagaguuaucuguacuuuguuuaacugaaaaaaauguagaaauauauguaaag

SEQ ID NO: 499888 - RNA, 63 nt, hsa
ucgugugagccucggccuggcuggccaggacacacugaaaagcagccuuuuucaccauggcaa

SEQ ID NO: 499889 - RNA, 63 nt, hsa
uggacuggaccaagagcaggcaaagacacgggaacugaaaaacuccacaggguuuggagaaua

SEQ ID NO: 499890 - RNA, 63 nt, hsa
augaccgaaucucuuuucucuguaaaaauguagacugaaaagccauguguauuuuccuaugug

SEQ ID NO: 499891 - RNA, 63 nt, hsa
aagcuuauuuagcacauuuugacacaauguugcacugaaaacccaggccacaaauguguccca

SEQ ID NO: 499892 - RNA, 63 nt, hsa
ggggaagaaaaggggagggggaaggcaagaaucacugaaaaaucuuaaaucuguguuuucugg

SEQ ID NO: 499893 - RNA, 63 nt, hsa
gucauugcuauuuaucaauagcaauaauuuugcacugaaaacuuuuuauaguucaaaaauuaa

SEQ ID NO: 499894 - RNA, 63 nt, hsa
cuuugcagguaucacagccuugcagaagaaccaacugaaaaaaaaauucucaggcuuuacagc

SEQ ID NO: 499895 - RNA, 63 nt, hsa
cacauucuaccagcacaaggaaacauaggcagcacugaaaaaaaaaaaaaagcucauauuaau

SEQ ID NO: 499896 - RNA, 63 nt, hsa
agaagccccuuauuuuuagccauaauuuugcauacugaaaauccaauaaucagaaaaguaauu

SEQ ID NO: 499897 - RNA, 63 nt, hsa
uacauauacggcuuuggagacaaucaaguaacaacugaaaaugugaaaguaaccauaucugac

SEQ ID NO: 499898 - RNA, 63 nt, hsa
cuguguggucuuugggaggagucuaauacaaaaacugaaaaccuuugguccugggaauuuauu

SEQ ID NO: 499899 - RNA, 63 nt, hsa
aauaucuagaguucucuaauuuucaugugagcuacugaaaaaaaugaaaaugucacucaagcu

SEQ ID NO: 499900 - RNA, 63 nt, hsa
cuaacuggaggggcucuagugcuaaauaauaguacugaaaauugauauuauuuuccuuuucuu

SEQ ID NO: 499901 - RNA, 63 nt, hsa
ucaagaaaggauugguacugcaacuguagguaaacugaaaaaaaauaagaaagaaagaguugg

SEQ ID NO: 499902 - RNA, 63 nt, hsa
augauucccuuguucauuuuugcugugaaaugcacugaaaaaaauccucaaaaugaguuauag

SEQ ID NO: 499903 - RNA, 63 nt, hsa
gugauuuuccacaaagaaugugcuaaaauguccacugaaaacaaagccaagccucugcccugc

SEQ ID NO: 499904 - RNA, 63 nt, hsa
uaccucaaacucaaauuaguaugccauuuucauacugaaaauuaaauauuuuuauggauuuua

SEQ ID NO: 499905 - RNA, 63 nt, hsa
aguuuucuuccucuaccuccacauccccccaagacugaaaagagucacuaacucucuuuuccc

SEQ ID NO: 499906 - RNA, 63 nt, hsa
ccaguacuaauaaucccugaucugugugauuguacugaaaaaucaaaaacuauuuuauuauga

SEQ ID NO: 499907 - RNA, 63 nt, hsa
uuguuaugauuaagcuuaaacccuguuagcaaaacugaaaacugaaauguucucaauaucaac

SEQ ID NO: 499908 - RNA, 63 nt, hsa
aaacccaaagcccugguaaaagggauacacaggacugaaaagggaaucauuuuucacuguaca

SEQ ID NO: 499909 - RNA, 63 nt, hsa
cuccaagucuucagcgagacccuugcauuagaaacugaaaacuguaaauacaaaauaaaauua

SEQ ID NO: 499910 - RNA, 63 nt, hsa
aagaauuaaaugauaaacuuagagacugauuagacugaaaaugccuaaucgauauauauauuc

SEQ ID NO: 499911 - RNA, 63 nt, hsa
guguuauguguaaaugccaccuauuaauacgggacugaaaacguuagagacacacugcauugc

SEQ ID NO: 499912 - RNA, 63 nt, hsa
aacucagauuugugaugcuaggaacaugagcaaacugaaaauuacuaugcacuugucagaaac

SEQ ID NO: 499913 - RNA, 63 nt, hsa
uuuaaagacaauuugcaggggguugggagaaggacugaaaagguacauuaagugugcuguaag

SEQ ID NO: 499914 - RNA, 63 nt, hsa
acuauauauaaucaauucaucaagccaguuauuacugaaaaaucauugaaaugagacaguuua

SEQ ID NO: 499915 - RNA, 63 nt, hsa
gcuguuggagaggggaaaaguugugcauaaagaacugaaaaggguucuggaguguucauucag

SEQ ID NO: 499916 - RNA, 63 nt, hsa
caauuuccuaucacuauuucagugucagaacaaacugaaaauaauggcucguguuuauguuga

SEQ ID NO: 499917 - RNA, 63 nt, hsa
uugccuaaugauguuaucuaggcaccauuggagacugaaaaaaaaaaaucccugcucuguaaa

SEQ ID NO: 499918 - RNA, 63 nt, hsa
ugguugccucauagcuuuguacagauuaugaggacugaaaauaauugggcauuuacccaucuu

SEQ ID NO: 499919 - RNA, 63 nt, hsa
cauauuauauguauguauauuucaaaguaccacacugaaaauuagacauuuauuaaccaaauu

SEQ ID NO: 499920 - RNA, 63 nt, hsa
cucauccugucucuggcuguggcccggcaaagcacugaaaaccccucuggucucagagacagu

SEQ ID NO: 499921 - RNA, 63 nt, hsa
agcuauaauaccuaugccucagcaauacauagaacugaaaaaacagggcgggagugguaugug

SEQ ID NO: 499922 - RNA, 63 nt, hsa
uucuuuagaaacacaagaguauagauuuuucucacugaaaagugagaguuacgcauugcagcc

SEQ ID NO: 499923 - RNA, 63 nt, hsa
ccguguaagccaaaggcccacagaggagcauauacugaaaagaaggcaguaucacagaauuua

SEQ ID NO: 499924 - RNA, 63 nt, hsa
auuuucauucagaaucaaaauuaagaaaguuggacugaaaauaugaaaaaugcuuaacuauug

SEQ ID NO: 499925 - RNA, 63 nt, hsa
aucugcccugcucagcagucaccauagcagcugacugaaaaucagcacugccugaguaguuuu

SEQ ID NO: 499926 - RNA, 63 nt, hsa
aguuuugaucaguuuaacuugaaucacuaacugacugaaaauugaaugggcaaauaagugcuu

SEQ ID NO: 499927 - RNA, 63 nt, hsa
uauaaagacaaaguaauucuauuaaaugaacuaacugaaaauaauaauuauaggaagugauua

SEQ ID NO: 499928 - RNA, 63 nt, hsa
uauagaaccugucauacauucaugauaaguagcacugaaaaauuacucauucaaauuuccccu

SEQ ID NO: 499929 - RNA, 63 nt, hsa
gacugguuuuuaagugcacugcacuucuggaauacugaaaaagaaugaaaacaauauguuaga

SEQ ID NO: 499930 - RNA, 63 nt, hsa
uuaaucucauuucuggacucuuuaaguuuuaccacugaaaaccagagucgauuuuucuccuaa

SEQ ID NO: 499931 - RNA, 63 nt, hsa
ucuuuauuucuucuaaaaaucuguauaccaggaacugaaaaucuuugaacagauauuaaaauc

SEQ ID NO: 499932 - RNA, 63 nt, hsa
uaaccuaccuacugacaaguaaauuuauacaggacugaaaaccgccugaaaccugcugcaacu

SEQ ID NO: 499933 - RNA, 63 nt, hsa
auaugucucuauaugaaggaacuaaacuauuucacugaaaaaaaaaaaaagauuuuuucugga

SEQ ID NO: 499934 - RNA, 63 nt, hsa
uuaaagaaaguaacaagaugucuuuacacugacacugaaaauucauccauuuuagagccagga

SEQ ID NO: 499935 - RNA, 63 nt, hsa
ugccugucuuaaauuccaaagcuuuacauuucaacugaaaaagaaacuagaaauguccuaauu

SEQ ID NO: 499936 - RNA, 63 nt, hsa
caaauaaacaaggggagaaaauaaaacucaaggacugaaaaucaggagguguaauaaaauguu

SEQ ID NO: 499937 - RNA, 63 nt, hsa
aaguuucugacuggaaaaucuugucauucuaacacugaaaagugcacacgcaugacaaaaugu

SEQ ID NO: 499938 - RNA, 63 nt, hsa
aguuuguggcuauaaaugauuauuuagaugaugacugaaaauguguauaaaguaauuaaaagu

SEQ ID NO: 499939 - RNA, 63 nt, hsa
cgauuaagaaucaucauuacauaacuuggugaaacugaaaaaguauaucauauggguacacaa

SEQ ID NO: 499940 - RNA, 63 nt, hsa
cggcguagggacagauguauucauccugguguuacugaaaaacaggugugauccuguuacuga

SEQ ID NO: 499941 - RNA, 63 nt, hsa
ccacuccagagacuucugccaccuggccgccacacugaaaacuguccugcucagugccaaggu

SEQ ID NO: 499942 - RNA, 63 nt, hsa
ucuuuccaucaaaucaauguagagauaauguaaacugaaaaaaaaucugcaagauaauguaac

SEQ ID NO: 499943 - RNA, 63 nt, hsa
acuaucagauauguuuuugcacuauuuuuuuuaacugaaaaagaaauaucuaagcuguacaug

SEQ ID NO: 499944 - RNA, 63 nt, hsa
uuuaagaauuaaaacugggaaauagaaacaugaacugaaaagucuugcaaugacaagagguuu

SEQ ID NO: 499945 - RNA, 63 nt, hsa
ugccuaaaucaaagacuauuucaagucaacaacacugaaaacugcuuuucgccuccacucuua

SEQ ID NO: 499946 - RNA, 63 nt, hsa
aauggugaagaauggacuuaauuaugcuaacaaacugaaaaaucuagacauagauccucugau

SEQ ID NO: 499947 - RNA, 63 nt, hsa
cagaagaaacaagguuuucaguccccacagauaacugaaaauuauuuaaaccgcuaaaagaaa

SEQ ID NO: 499948 - RNA, 63 nt, hsa
acccaguauaugcuauucaaugaucuuagaaguacugaaaaaaaaagacguuuuuaaaacgua

SEQ ID NO: 499949 - RNA, 63 nt, hsa
ugauauugagcucuaaaugcaaaacucuuuuauacugaaaaaacacuuaaaguaguuuugugu

SEQ ID NO: 499950 - RNA, 63 nt, hsa
acuggaauaaaggauguuuucuguuggacauguacugaaaauuaacacauguaguagccuuaa

SEQ ID NO: 499951 - RNA, 63 nt, hsa
augacauucagugaauuauuucaguggugacccacugaaaauuaauaaugguacuuaugauua

SEQ ID NO: 499952 - RNA, 63 nt, hsa
auugggacugcuuugagaaccaucuuucaaugcacugaaaagucaucugaaaaaauagcuucu

SEQ ID NO: 499953 - RNA, 63 nt, hsa
auagacauuuuguuucaaaugaaacuuuaaaagacugaaaaauuuuguaaauagguuugauuc

SEQ ID NO: 499954 - RNA, 63 nt, hsa
auuacuaaaucucuguuaauauucucucuuuuaacugaaaagggaugggauagaaggguuugc

SEQ ID NO: 499955 - RNA, 63 nt, hsa
guugagagguucuaaaaucaugaaacuuguuucacugaaaauuggacagauugccuguuucug

SEQ ID NO: 499956 - RNA, 63 nt, hsa
cagauguggccaaccuuuguccauaugcaaaccacugaaaaaugaucuggauuucuauagcaa

SEQ ID NO: 499957 - RNA, 63 nt, hsa
caaaaucugaacucucaaaagucuauuuuuuuaacugaaaauguaaauuuauaaauauauuca

SEQ ID NO: 499958 - RNA, 63 nt, hsa
gacuguuacuaaguaaaaagcugucaaacauuuacugaaaauagaauuggccccauggcuuga

SEQ ID NO: 499959 - RNA, 63 nt, hsa
guuauccuuuguauuuauaggcacaguuaucuuacugaaaaugcaugcauggugaauuaaaau

SEQ ID NO: 499960 - RNA, 63 nt, hsa
uuuuuuuuuuuuaaagcggguaaaagagaaaacacugaaaauugaauucuuaucuuccagagg

SEQ ID NO: 499961 - RNA, 63 nt, hsa
uaauccccuuucuacagugaguccacuacccucacugaaaaucauuuuguaccacuuacauuu

SEQ ID NO: 499962 - RNA, 63 nt, hsa
uuuagcucuuaaaacauacgaaguguugccuaaacugaaaauauuuaucuuuuauuuaaaauc

SEQ ID NO: 499963 - RNA, 63 nt, hsa
cucugugcugaaauuugaagaccagauaaugaaacugaaaagcaaacaauuuuacugaaucug

SEQ ID NO: 499964 - RNA, 63 nt, hsa
cagauucuuuauuccuauucgacacuggcuucuacugaaaaugaaacggauugcagagggaau

SEQ ID NO: 499965 - RNA, 63 nt, hsa
gugcgaaaaaguauugaagauuagcuuuuaaaaacugaaaaaaaaaaaugaaugacucacaua

SEQ ID NO: 499966 - RNA, 63 nt, hsa
agaaaggagggcaacuucuacucuucaaccucuacugaaaacacaaacaacaaagcagaagac

SEQ ID NO: 499967 - RNA, 63 nt, hsa
guugguugaauaauuauugaaaaaaagaacacgacugaaaaaguucaucugaugccucugagc

SEQ ID NO: 499968 - RNA, 63 nt, hsa
aguggcuuuuccuccauuaauacauauaugaguacugaaaaauuaaguugcauagcugcuuug

SEQ ID NO: 499969 - RNA, 63 nt, hsa
aaguuucaccuguauugaaucagaaugccuucaacugaaaaaaacauauccaaaauaaugagg

SEQ ID NO: 499970 - RNA, 63 nt, hsa
agaauugaaauaauuucaaauaacuguaaaggaacugaaaaucuucacagagaugaagugggg

SEQ ID NO: 499971 - RNA, 63 nt, hsa
cauguaaugacuucacaaguuuuacgagggaaaacugaaaaaggaaguaauauaaauuuugug

SEQ ID NO: 499972 - RNA, 63 nt, hsa
caguuaaacagcaggaaagcccauuaacuucguacugaaaaagcaacauacugugaugauacg

SEQ ID NO: 499973 - RNA, 63 nt, hsa
cucuugcucugcuauaucuccacucugccucagacugaaaagcuaguccuaacgucuuugccu

SEQ ID NO: 499974 - RNA, 63 nt, hsa
gauggggcaggggacuguuaggaugcauuauaaacugaaaagccuuuuuaaaauuuuauguau

SEQ ID NO: 499975 - RNA, 63 nt, hsa
uaguguuuaguuggauuaaucuuaccuaaaaguacugaaaaaugcuuuuuaguacuuuuucau

SEQ ID NO: 499976 - RNA, 63 nt, hsa
uuuuuaaauaagcgcuuuaaugaaaaugguuagacugaaaauaauuuugguccuuaaaaggag

SEQ ID NO: 499977 - RNA, 63 nt, hsa
gcuuggugauaaucaauuuugaaaauacaguggacugaaaagcaaauuuauucuuucgaagau

SEQ ID NO: 499978 - RNA, 63 nt, hsa
gugccauacauuuuauccucauggaugugaugcacugaaaaguuaguugcucuccuuuuuucu

SEQ ID NO: 499979 - RNA, 63 nt, hsa
cagggggaaagguaggaagaagagguaauuuuuacugaaaauuagggcaauguuggucgccuu

SEQ ID NO: 499980 - RNA, 63 nt, hsa
aauagaguugcuccauucauauuggacugauggacugaaaacauugaugugauucuugaaagg

SEQ ID NO: 499981 - RNA, 63 nt, hsa
gaaaacuagcucuucagagaagccucggguaacacugaaaaacaaaacaaaacaaaacaaaaa

SEQ ID NO: 499982 - RNA, 63 nt, hsa
ugaauucuucuguugccuuuuucuuacagaaugacugaaaauuugaaagaaaagccuauaaaa

SEQ ID NO: 499983 - RNA, 63 nt, hsa
caaccaccagugaaauguguguguauacaauaaacugaaaaaaaaaacuagccuuuggcuugu

SEQ ID NO: 499984 - RNA, 63 nt, hsa
cauucagggcauauuuuuucuucccaggaucaaacugaaaacauguuaaggcuauaguuuagc

SEQ ID NO: 499985 - RNA, 63 nt, hsa
uuacacuaaggucuccauauacuauuuuuuucuacugaaaacaauuuagaaagaagcuauugg

SEQ ID NO: 499986 - RNA, 63 nt, hsa
gccgguuaaauuccauaugcuccaggaucuuugacugaaaaaaaaaaagaagaagaagaagga

SEQ ID NO: 499987 - RNA, 63 nt, hsa
uucaagguggccaaauuauuuguguaauagaaaacugaaaaucuaauauuaaaaauauggaac

SEQ ID NO: 499988 - RNA, 63 nt, hsa
agaaaauguugcuuccacauuaacaaaacaaucacugaaaaacagcagauguuuaaauagauu

SEQ ID NO: 499989 - RNA, 63 nt, hsa
aauggcugccauuuugccauagauuuccauauaacugaaaaacugaauugucacuuuaucuuu

SEQ ID NO: 499990 - RNA, 63 nt, hsa
gaaaauucaucuguaaauauucacagucuagucacugaaaaaugggaaaaccucuaccaugcc

SEQ ID NO: 499991 - RNA, 63 nt, hsa
gaaugacuuugaaguaaaaccuuuuuucuugcuacugaaaaaaauggaguuguuuuggguggu

SEQ ID NO: 499992 - RNA, 63 nt, hsa
cugaagauggcauccugugaaguccuucaccucacugaaaacaucuggaaggggaucccaccc

SEQ ID NO: 499993 - RNA, 63 nt, hsa
ggccuucugagcugguggaauauuuuauuucagacugaaaacagagagcacucuccuugggaa

SEQ ID NO: 499994 - RNA, 63 nt, hsa
uugguccuuggaagaccuauauucucuguaguuacugaaaaccgaaagucaauucuaauuauu

SEQ ID NO: 499995 - RNA, 63 nt, hsa
uucauauucgaagugguugucucugcacuauuuacugaaaaguucauccuuuccccagugauu

SEQ ID NO: 499996 - RNA, 63 nt, hsa
gcuucaaagaaucaguguaagccacuaaaaggaacugaaaaccuaggugucacaauaaacagu

SEQ ID NO: 499997 - RNA, 63 nt, hsa
cucugccaugaacuggaggccaggaaucuccucacugaaaauuacaguaugguaacuuugcaa

SEQ ID NO: 499998 - RNA, 63 nt, hsa
cuugucuuuuacccccacaggguuccugagcucacugaaaagacuauugugccuuaggaaaag

SEQ ID NO: 499999 - RNA, 63 nt, hsa
uggcuaaaacaggaugauugcuuuugucuguuuacugaaaaaugaguuuagaaaggcuagccc

SEQ ID NO: 500000 - RNA, 63 nt, hsa
gcuuuucacaccaucucagagguugaggagcauacugaaaauugcccuggggggugcugggug

SEQ ID NO: 500001 - RNA, 63 nt, hsa
uugacuuuuguguauggguaguaaaucuagcucacugaaaaucagagugaaacgccuuuacau

SEQ ID NO: 500002 - RNA, 63 nt, hsa
ugggaaggagaggggugcaacaggaccgccugcacugaaaacucacugcugccaugcccuggg

SEQ ID NO: 500003 - RNA, 59 nt, hsa; identical to SEQ ID NO: 499282

SEQ ID NO: 500004 - RNA, 63 nt, hsa
auaaugaugugugauuggauggaauugaaucaaacugaaaaaguauuuccuuauagcuuaaug

SEQ ID NO: 500005 - RNA, 63 nt, hsa
gugaaagaaaaauauagauuaaaauugcugggcacugaaaaggggugggaguuggaaaucaga

SEQ ID NO: 500006 - RNA, 63 nt, hsa
uuuccacucucaaguuuucuacuuugucuuugaacugaaaauaaacauggaucuagaaaacca

SEQ ID NO: 500007 - RNA, 63 nt, hsa
acguuuccaacagcacuucucaccuauucaauaacugaaaaagacauuaccauagugcuuuac

SEQ ID NO: 500008 - RNA, 63 nt, hsa
uacgugcacugagcugcaacuucuuacuucccuacugaaaauaagaaucugaauauaaauuug

SEQ ID NO: 500009 - RNA, 63 nt, hsa
guuuuuauuaauuaucuggauaacagcaaaaaaacugaaaauaaagagagagagagaucuggg

SEQ ID NO: 500010 - RNA, 63 nt, hsa
ucugaaucucguugaggccaaggaaugauccauacugaaaaaaugcugagccagccaucuuug

SEQ ID NO: 500011 - RNA, 63 nt, hsa
uaaaauggaaaacagucauauaaaugcuuacagacugaaaaaugucucauacauauuuugcag

SEQ ID NO: 500012 - RNA, 63 nt, hsa
aaguagcugaugugcaguugagaaaacuagaggacugaaaaaacaaauuuuaacuagcaaaug

SEQ ID NO: 500013 - RNA, 63 nt, hsa
aaucuagcuuauauaaggucauuacauuuuuuaacugaaaaaccuaguuaccugauuauugca

SEQ ID NO: 500014 - RNA, 63 nt, hsa
ugacauugacacuaguauuauuuuacaaaacagacugaaaaagacauuagcaagcauagucua

SEQ ID NO: 500015 - RNA, 63 nt, hsa
ucugaaacaaaagaggcauuuuucaauaaaacuacugaaaauuugacauggcauguuucuuuc

SEQ ID NO: 500016 - RNA, 52 nt, hsa; identical to SEQ ID NO: 499295

SEQ ID NO: 500017 - RNA, 63 nt, hsa
aauugaccuauuuauucauucuugauuaaaugcacugaaaaguaaagggucuguuugugucau

SEQ ID NO: 500018 - RNA, 63 nt, hsa
uggacucauuugaacaaaaaucuaggccaaaauacugaaaagccuauguguuuuuuuaauugg

SEQ ID NO: 500019 - RNA, 63 nt, hsa
uuuacguuuucaugcugcuuauuguuuuauucuacugaaaaaaaugaauuucaagauucucaa

SEQ ID NO: 500020 - RNA, 63 nt, hsa
agcuguuacacuuucucugaucugcugugauccacugaaaaugugcugggguuuguucugcug

SEQ ID NO: 500021 - RNA, 63 nt, hsa
aguagaucauguuuacuucccaguggaaggagcacugaaaaccucuuaaagaaaaagcauuug

SEQ ID NO: 500022 - RNA, 63 nt, hsa
aaauagcaucuaguccaacuccuugauuguaaaacugaaaaacuaagguuauuugaauguucu

SEQ ID NO: 500023 - RNA, 63 nt, hsa
gaugauccuguauugggcuguacuuacugugauacugaaaagcuguccugcugaagcagcuau

SEQ ID NO: 500024 - RNA, 63 nt, hsa
ucagaaaacauugauuugagcauagacgcagagacugaaaaaaaaauuuacuuugaucucugu

SEQ ID NO: 500025 - RNA, 63 nt, hsa
gauguuuaaagacuuccacugcaauauauaaauacugaaaaugugauguucugcuuauuugga

SEQ ID NO: 500026 - RNA, 63 nt, hsa
ggggauaggugccauuugguggugagaaugcugacugaaaaauagaaugaucaauuuaaucug

SEQ ID NO: 500027 - RNA, 63 nt, hsa
uaguagcaaggaauuggugguauuauggaccgaacugaaaauuuuauguugaagccauauccc

SEQ ID NO: 500028 - RNA, 63 nt, hsa
uuagacaguuauuuguuucuucugcaucuugcuacugaaaacaaaaacaaugaaaauauucau

SEQ ID NO: 500029 - RNA, 63 nt, hsa
augaaugaacaaagguaauaugucuagcacugcacugaaaaaggacuucugcauuucugacau

SEQ ID NO: 500030 - RNA, 63 nt, hsa
agggaauuuuuuuguacuguaauuuugaauggaacugaaaaauuaugcacgaauaaaguacuu

SEQ ID NO: 500031 - RNA, 63 nt, hsa
uaaaggauacaaggauuauuucaauguuacugcacugaaaaacguguauguauuagugugcua

SEQ ID NO: 500032 - RNA, 63 nt, hsa
uuuauugaucgugauaugacuuguuacuaggguacugaaaaaaaugucuaaggccuuuacaga

SEQ ID NO: 500033 - RNA, 63 nt, hsa
cauggaauuuuuugaauaugccuuaauuuagaaacugaaaaauaucugguuauaucauucugg

SEQ ID NO: 500034 - RNA, 63 nt, hsa
cugaggaggaacaaauuacaaguguacccaauaacugaaaauguuuuaacucacucucauuug

SEQ ID NO: 500035 - RNA, 63 nt, hsa
ccaauccucaaaccucacuaaacauaagauaauacugaaaacuuuacaaaccugaaugaugug

SEQ ID NO: 500036 - RNA, 63 nt, hsa
accaauucucaaaucuuacuaaacaaaauuaauacugaaaauguuacaaaccagaaaaaugug

SEQ ID NO: 500037 - RNA, 63 nt, hsa
ugagaauuacaaugaauaauaauuugcuuugucacugaaaaccaccagugaagugcaauuugg

SEQ ID NO: 500038 - RNA, 63 nt, hsa
gcacgauggcgaggaagccagccccaaggaaacacugaaaacacauaucacgccaaugccgug

SEQ ID NO: 500039 - RNA, 63 nt, hsa
uccaucucaaaaaaaaaaaaaagaaagaaagaaacugaaaagugagguguggaacuccaggca

SEQ ID NO: 500040 - RNA, 63 nt, hsa
acugagguuuguaaacuguccuuuuuaaaucaaacugaaaacaaaaagcuuuaaccuuucaac

SEQ ID NO: 500041 - RNA, 63 nt, hsa
cucaauauaaaaacauucauuuggaauguacauacugaaaaauacagguuuuuuugaccaaaa

SEQ ID NO: 500042 - RNA, 63 nt, hsa
uggauauaguuuuacuuuuaaacuguguacauaacugaaaaugugcuauacugcauacuuuuu

SEQ ID NO: 500043 - RNA, 63 nt, hsa
uaguuuaaaaauaaaguuccugauaauaaagugacugaaaauggcauccccaaagugucuccg

SEQ ID NO: 500044 - RNA, 63 nt, hsa
acugugaccaauucauuauaacauuuggauauuacugaaaauguaaggaagcaggaaaaauua

SEQ ID NO: 500045 - RNA, 63 nt, hsa
guuagcuacugaauccugggggcgagugaaacuacugaaaauccgagugaugauguugugaau

SEQ ID NO: 500046 - RNA, 63 nt, hsa
aucuaguauuugcacuuagcaaaauauuuaaaaacugaaaaaaaugugcaugaucugucacuu

SEQ ID NO: 500047 - RNA, 63 nt, hsa
agaacauuuuggggcaguuuaaugugguaccaaacugaaaauaggagcuauuuauagauggag

SEQ ID NO: 500048 - RNA, 63 nt, hsa
aaguuaacuccuggacacaaguauauacugugcacugaaaaaauauccaucuacacagcaccc

SEQ ID NO: 500049 - RNA, 63 nt, hsa
uauuacagugggcagguauuugcuuuugcuugcacugaaaauuaaauugcuaucaagaauaaa

SEQ ID NO: 500050 - RNA, 63 nt, hsa
gcagugagcagguauguguuugcuuuugcuugcacugaaaauuaaauugcuaucaagagcaaa

SEQ ID NO: 500051 - RNA, 63 nt, hsa
cuacguuuuggaagugauguauguuauuugaugacugaaaaugaacuguaaaugcuccuagag

SEQ ID NO: 500052 - RNA, 63 nt, hsa
agauuugaggcuuuucuauauacuucucagagcacugaaaagaaaggaaggguuugcagagga

SEQ ID NO: 500053 - RNA, 63 nt, hsa
aaacagugauuuagguuuguaacauccggcaaaacugaaaaaaaaaaucuguaaacgcgaaaa

SEQ ID NO: 500054 - RNA, 62 nt, hsa
uuguccucuugccagcucauuuguuaauaaaauacugaaaacacucuuacggguugagucug

SEQ ID NO: 500055 - RNA, 63 nt, hsa
ugaaaccugcuuccaggcuacuuuggcagcagaacugaaaaaggcuuuuuuuccagauauaug

SEQ ID NO: 500056 - RNA, 60 nt, hsa; identical to SEQ ID NO: 499335

SEQ ID NO: 500057 - RNA, 63 nt, hsa
uugcucaugucuguuuugcuuuguuuuuaagacacugaaaagaaaagcuagaauuuauuuauu

SEQ ID NO: 500058 - RNA, 63 nt, hsa
agcaaagaaacuugugcuuuaccaaggggaauuacugaaaaaggugauuacuccugaagugag

SEQ ID NO: 500059 - RNA, 63 nt, hsa
uccacuggaggucauuacugccauuaaauaauaacugaaaagacuauguagugaaauguauuu

SEQ ID NO: 500060 - RNA, 63 nt, hsa
ccaugcuucaaaagaucuaagaaaugcaaauauacugaaaauugacauccucugaaaauucca

SEQ ID NO: 500061 - RNA, 63 nt, hsa
uaucucacaagucaaaaaugaagauuuugcagcacugaaaaucuauuaaagcuccaaauuuua

SEQ ID NO: 500062 - RNA, 63 nt, hsa
acucaggaagagauuuaucuguauauacacauaacugaaaaccaaguuuaagcccaccaaugc

SEQ ID NO: 500063 - RNA, 63 nt, hsa
caaacaucuuugccaaaagcuaagcaguggugaacugaaaagggcauauugccccaagguuac

SEQ ID NO: 500064 - RNA, 63 nt, hsa
aaagaaaggaauucauauggggaaguucggaaaacugaaaaagauucauguguaaagcuuuuu

SEQ ID NO: 500065 - RNA, 63 nt, hsa
ucuuugucauggcaaccagcuucugaaaagcccacugaaaauugccuguccugcugguaacug

SEQ ID NO: 500066 - RNA, 63 nt, hsa
auaaaaauugaauucguuucugacauaccuuagacugaaaaacuguugguucauccagaagug

SEQ ID NO: 500067 - RNA, 63 nt, hsa
uuaguuuucuguauaugauauauauuaucuuauacugaaaaaaaauuccuuucagauuggggu

SEQ ID NO: 500068 - RNA, 63 nt, hsa
uucuuaaaucugagggaccaugcuuugaaauagacugaaaauuaagggucaccaccuaauuuu

SEQ ID NO: 500069 - RNA, 63 nt, hsa
uagaucccagaggagggaagaaaauuugcagugacugaaaacaguaaaaaaaaaaaaaaaaaa

SEQ ID NO: 500070 - RNA, 63 nt, hsa
aguuggcuguaaucacuccucgccgugucuggcacugaaaauaaggaaaaaaaaccuacuacu

SEQ ID NO: 500071 - RNA, 63 nt, hsa
uucuucuucccuccuccccccauuaauauguauacugaaaaaugugcauuugucugaggaauu

SEQ ID NO: 500072 - RNA, 63 nt, hsa
auauagguuuuggggcuuccauaucaucaaaagacugaaaaauuauaauuuuagaauuaaacu

SEQ ID NO: 500073 - RNA, 63 nt, hsa
gugaugugauacagaacaaaguguucguuuuugacugaaaauaguagaucagaaaucucaguu

SEQ ID NO: 500074 - RNA, 63 nt, hsa
uuuaguuuacaauuuuuaaaaaguucuuaaaauacugaaaaugcaguugacacuuguguaugg

SEQ ID NO: 500075 - RNA, 63 nt, hsa
uuaccuuggaauuggaauuacuguaaacagccuacugaaaaugcauuuuuaucauguaacauu

SEQ ID NO: 500076 - RNA, 63 nt, hsa
ugcaaagauuuacauugcugccaaaucauuucaacugaaaagaacaguauugcuuuguaauag

SEQ ID NO: 500077 - RNA, 63 nt, hsa
uaguuuuucugucauuguuaaauacacauuaucacugaaaaaauguagcuuuuaugugauaug

SEQ ID NO: 500078 - RNA, 63 nt, hsa
agaaaaaaauaaugguaguaaagaaacugacaaacugaaaauaagaaaacaaaaaucaaaugc

SEQ ID NO: 500079 - RNA, 63 nt, hsa
aaccuuuucauuuuauguuuuuguacucugcagacugaaaagacaaaguuuaucuuggccuua

SEQ ID NO: 500080 - RNA, 63 nt, hsa
uuguggauaacaaagauaucuuuucuuuagagaacugaaaagagagcagagaauauaacauga

SEQ ID NO: 500081 - RNA, 63 nt, hsa
aagcucuuagcgguuauccacgaacuucgaccuacugaaaaggugguguugguauccaacuau

SEQ ID NO: 500082 - RNA, 63 nt, hsa
guguuuccugcugacuacaacccucuccuguuuacugaaaaggagucaggaaaacuacaggug

SEQ ID NO: 500083 - RNA, 63 nt, hsa
uuauuuuguuuaaauaguaccacagagaaaacaacugaaaaaccacauuuuucuacauacagc

SEQ ID NO: 500084 - RNA, 63 nt, hsa
aaacauuuguacugagugguacaagccuuggggacugaaaaaaaaaagauuaaaaccauuaaa

SEQ ID NO: 500085 - RNA, 63 nt, hsa
aaaaauauuuuggucuagccacuaaacauaaugacugaaaaaaauuauuauuauaaaucacca

SEQ ID NO: 500086 - RNA, 63 nt, hsa
gaugugccagcuaaaauugugugccauuuaaaaacugaaaauauuuuaaaauuauuugucuau

SEQ ID NO: 500087 - RNA, 63 nt, hsa
ccagugaaauauuguauaacaccauuuggaacuacugaaaagacaguggcuuuucuacaguac

SEQ ID NO: 500088 - RNA, 63 nt, hsa
uguuccuaacaaugcaguauucucaauuguguuacugaaaaugcaacauuagcaaagaggugg

SEQ ID NO: 500089 - RNA, 63 nt, hsa
uucagagauuagucuuagguuuccacguaagucacugaaaacaguaaaacaggcugcuuagau

SEQ ID NO: 500090 - RNA, 63 nt, hsa
augcaggcaaugugggacuuaaaaggcccaagcacugaaaauggaaccuggcgaaagcagagg

SEQ ID NO: 500091 - RNA, 63 nt, hsa
guaagacaguuaaucagcauuauugugagagggacugaaaagaaauucuccauuaugaggaau

SEQ ID NO: 500092 - RNA, 63 nt, hsa
ugucuuaguuauaauuagauugugaaucagccaacugaaaauccuuuuugcauauuucaaugu

SEQ ID NO: 500093 - RNA, 63 nt, hsa
aauucuaacaagucauagguuaauauuuaagacacugaaaaaucuaagugauauaaaucagau

SEQ ID NO: 500094 - RNA, 63 nt, hsa
accagccuggccaacauggugaaacccuucucuacugaaaauacaaaaauuagccaggugugg

SEQ ID NO: 500095 - RNA, 63 nt, hsa
agguugaauaaagaaacagaaaaaauagaacauacugaaaauaaucuaaguuccaaccauaga

SEQ ID NO: 500096 - RNA, 63 nt, hsa
auauuuugagcuaauaauugcaaaaauuagaagacugaaaauggacccaugagaguauauuuu

SEQ ID NO: 500097 - RNA, 63 nt, hsa
acaagcuugauuucagugcuuauugugucuucaacugaaaaauacaaucuguggauuaugacu

SEQ ID NO: 500098 - RNA, 63 nt, hsa
ccagccuagccaacaugacgaaaccccaucucuacugaaaauagaaaaaaaaaauuagccagg

SEQ ID NO: 500099 - RNA, 63 nt, hsa
cugcuucuacggccaugagacugaucccuggccacugaaaagcuuuccugacaauaaaaaugu

SEQ ID NO: 500100 - RNA, 63 nt, hsa
aaacuggagaaaguuugucauccucauuuucaaacugaaaacuaaucaaauauagugccuauu

SEQ ID NO: 500101 - RNA, 63 nt, hsa
uuuaaguuauccaggacuccaagaaccauaguuacugaaaagggaguccugauacaucuaaua

SEQ ID NO: 500102 - RNA, 63 nt, hsa
acagaaauacagcagacgaacauauuuauugguacugaaaagagacguaguaaauuaaauaga

SEQ ID NO: 500103 - RNA, 63 nt, hsa
agguccuuuuauaggcaggcacuaguaacuaaaacugaaaacuaaguaaguuuauuuuugagg

SEQ ID NO: 500104 - RNA, 63 nt, hsa
guguguagaauuacuguaauacuucugcaaucaacugaaaacuagagccuuuaaaugauuuca

SEQ ID NO: 500105 - RNA, 63 nt, hsa
ugcugguuugggggaggggacuggaaagcugagacugaaaaucaagagggaagaggugaggaa

SEQ ID NO: 500106 - RNA, 63 nt, hsa
ugucagguccuaugaagaaagauacgguuucagacugaaaacauguuucacagguguuugcuu

SEQ ID NO: 500107 - RNA, 63 nt, hsa
guuuauuacuguucagcaucaucuugguuauauacugaaaaucaaacacuuuacuacaguugu

SEQ ID NO: 500108 - RNA, 63 nt, hsa
ggcauuaaaauuuguaauugaaauguugcuuucacugaaaaagugucuugauguuucaguuau

SEQ ID NO: 500109 - RNA, 63 nt, hsa
ccaagugcuggugccagccuguuaccuguucucacugaaaagucuggcuaaugcucuugugua

SEQ ID NO: 500110 - RNA, 63 nt, hsa
agaugacuauaaaauguucaugagggacugaauacugaaaacugugaaauguacuaaauaaaa

SEQ ID NO: 500111 - RNA, 63 nt, hsa
aaaauagaaccaauuagguugaaaaugccccuuacugaaaaucuguauuaaaaauaaaauuaa

SEQ ID NO: 500112 - RNA, 63 nt, hsa
aucauagagaaaugaagaugcuuaccugcaggaacugaaaacaucagccauggccaggccccc

SEQ ID NO: 500113 - RNA, 63 nt, hsa
ucacccuugaggaccaggagccuccauauccugacugaaaaccuuuucugagacuuagaguaa

SEQ ID NO: 500114 - RNA, 63 nt, hsa
ccaucuuugccaacauggugaaacuccaucucuacugaaaauacaaaaauuagcugggcgugg

SEQ ID NO: 500115 - RNA, 63 nt, hsa
ccagccugaccaacauggagaaacccagucucuacugaaaauacagaaaaguuagccaggcgu

SEQ ID NO: 500116 - RNA, 63 nt, hsa
aguaugguuucaugaaauuggagcucuguauaaacugaaaaagacaaaauaaguaaagcacuu

SEQ ID NO: 500117 - RNA, 63 nt, hsa
uuucauuuaaugauagacggaaaaugugugguuacugaaaacuguauaugauacagaauuuca

SEQ ID NO: 500118 - RNA, 63 nt, hsa
ccagccuggccaucauggugaaacccugucucuacugaaaauacaaaaauuagccgggcgugg

SEQ ID NO: 500119 - RNA, 63 nt, hsa
uuugaguaaccaucaacacgauuaguuuacagaacugaaaaggaaucugagaucuguacugua

SEQ ID NO: 500120 - RNA, 63 nt, hsa
cauuucuuuuuuaugugacauggagcacaaagaacugaaaauauguuuugagggagcaugaca

SEQ ID NO: 500121 - RNA, 63 nt, hsa
cucauaguagguauauaugaguuuucacagaagacugaaaaauaaugcaugauauuuguuugu

SEQ ID NO: 500122 - RNA, 63 nt, hsa
ccaagucauuuaacuucaguaaaccucgguaugacugaaaagggaguuuucuguauggccguc

SEQ ID NO: 500123 - RNA, 63 nt, hsa
gggauaaaacaccaugaaaauaaacuugaauaaacugaaaauggaccuuuuuuuuuuuaaugg

SEQ ID NO: 500124 - RNA, 63 nt, hsa
cucaggcuuuguuugagguccuguauauacagcacugaaaagagagauaaagucccugccugc

SEQ ID NO: 500125 - RNA, 63 nt, hsa
agagauguaaggguuauuuagauauguucccucacugaaaaaucacucauucaaaauauuuaa

SEQ ID NO: 500126 - RNA, 63 nt, hsa
gcuuuaucucaaagcuuucacugaagggcuguaacugaaaauuauuaaauguuagucuuuagu

SEQ ID NO: 500127 - RNA, 63 nt, hsa
aacugccaagcccagguugccucucaugaggcaacugaaaaaauccugugucuugauagcaug

SEQ ID NO: 500128 - RNA, 63 nt, hsa
uucugucuaguacuugucuuauagguaaccaacacugaaaacuuuguagugaugacuaccaaa

SEQ ID NO: 500129 - RNA, 63 nt, hsa
caagaauguguaucuguuggauauaaucagagaacugaaaaguaauuuaucaguaauuuuuaa

SEQ ID NO: 500130 - RNA, 63 nt, hsa
gccugugcagggggcuggcuggauguucucuuuacugaaaagacaguggcaaggaaaagcaca

SEQ ID NO: 500131 - RNA, 63 nt, hsa
acccuucauagcuuuguuacaaugaaaccuugaacugaaaauauuuaauaaaauaaccuuuaa

SEQ ID NO: 500132 - RNA, 54 nt, hsa; identical to SEQ ID NO: 499411

SEQ ID NO: 500133 - RNA, 63 nt, hsa
uauuuaagugcuagggcuggucacacacaaccaacugaaaaagacuagagggauuaguacaaa

SEQ ID NO: 500134 - RNA, 63 nt, hsa
ccaauauugcuaauauaauagaugacaguggcaacugaaaacagucccagaaugaccccaucg

SEQ ID NO: 500135 - RNA, 63 nt, hsa
ucauaaggaguugguguaaucauuuuaaauuccacugaaaauuuaacaguauccccuucucau

SEQ ID NO: 500136 - RNA, 63 nt, hsa
gcaguguccaaaccuaguuucccaugaguugcgacugaaaaugugaaacgacacuguauugcu

SEQ ID NO: 500137 - RNA, 63 nt, hsa
auuucagcacaacucauucuucagugccucaugacugaaaacaaaaaacaaaaaaacgaaagc

SEQ ID NO: 500138 - RNA, 63 nt, hsa
ccacuucagacuuuagccuguuuaguuuuaaggacugaaaaugguagguuugggcagaagaau

SEQ ID NO: 500139 - RNA, 63 nt, hsa
agacaugggucugucauagaauggggacauuagacugaaaacugggacaacccccuuccuuau

SEQ ID NO: 500140 - RNA, 63 nt, hsa
gacuccaugggaccccaaagaagcagauggaaaacugaaaaagaaaaccccucaagugagcca

SEQ ID NO: 500141 - RNA, 63 nt, hsa
uuaaauauaaaaauaaauauuguucugauuauuacugaaaagaugucagccauuucaaugucu

SEQ ID NO: 500142 - RNA, 63 nt, hsa
aguuugaccucacagugacccuucccaaucagcacugaaaauaccaucaggccuaaucucaua

SEQ ID NO: 500143 - RNA, 63 nt, hsa
aaucucauaccucugaccaacaggcuguucugcacugaaaagguucuucaucccuuuccaguu

SEQ ID NO: 500144 - RNA, 63 nt, hsa
aaaaauggcucuuuuugcaauaaguagauacauacugaaaaaaucuaaacuuacaauguuuau

SEQ ID NO: 500145 - RNA, 63 nt, hsa
ccguggaagauacacauguuugcauccuaagauacugaaaaaagggcaccuuugucacuugaa

SEQ ID NO: 500146 - RNA, 63 nt, hsa
uguccuuggcgaaucgauaaucauugcauagugacugaaaagccuaagugcaaaaaaaaaaaa

SEQ ID NO: 500147 - RNA, 63 nt, hsa
cucuuacuagaaaacuauuuucuaaauauuaacacugaaaauguuuuguuagcuuuuccuucu

SEQ ID NO: 500148 - RNA, 63 nt, hsa
cacgggacuucccgaacuaauuuuuuuaaggauacugaaaaaugagagagaguggucgaaugc

SEQ ID NO: 500149 - RNA, 63 nt, hsa
cagaggcccagacaggcucacucaagcucuuuaacugaaaagcaacaagccacuccaggacaa

SEQ ID NO: 500150 - RNA, 63 nt, hsa
uuuuuagccuaaguauaagaguccuacagauggacugaaaaaaaucagucugagaguauuagu

SEQ ID NO: 500151 - RNA, 63 nt, hsa
uacuacaugcuggcaaaggugaaggaucagaggacugaaaaaugauucugcaacucucuuaaa

SEQ ID NO: 500152 - RNA, 63 nt, hsa
ggccuccagacccacacucacagucugugaaaaacugaaaauccccuggugggcacucccugg

SEQ ID NO: 500153 - RNA, 63 nt, hsa
cugccuuuuucuuugguugcuccuguggaaaauacugaaaagauuacuuuguuuuauuuuguu

SEQ ID NO: 500154 - RNA, 63 nt, hsa
ugguguuaaauaucagcuccuaauaagauguggacugaaaacacuaucacaacacuaugagaa

SEQ ID NO: 500155 - RNA, 63 nt, hsa
gugccugccccucccccagcuguuuuuaaugaaacugaaaaaauagacuugaucccggcagga

SEQ ID NO: 500156 - RNA, 63 nt, hsa
ccuugaagggcagcaggcccaagugcugcucugacugaaaacugaguuaacaagaugaaaucu

SEQ ID NO: 500157 - RNA, 63 nt, hsa
auacaugccuucuauauggaacauggcagaaagacugaaaaauaacaguaauuaauuguguaa

SEQ ID NO: 500158 - RNA, 63 nt, hsa
ggaaaugaaaacuguuugugaucuuccguauucacugaaaaauaaaugcuuguuuaguaucaa

SEQ ID NO: 500159 - RNA, 63 nt, hsa
cuugcacaaggaaggaucuucagauauucaugcacugaaaaaugcuguuaucuuuuguuuuua

SEQ ID NO: 500160 - RNA, 63 nt, hsa
uaccacagcauuuguacuguuccuuuuuaauauacugaaaauauaaaaggaaggguguguguu

SEQ ID NO: 500161 - RNA, 63 nt, hsa
ccauccuggcuaacacggugaaaccccgucucuacugaaaauacaaaaaauuagccaggcaug

SEQ ID NO: 500162 - RNA, 63 nt, hsa
ccauccuggcuaacauggugaaaccccgucucuacugaaaauacaaaaaauuagccgggugug

SEQ ID NO: 500163 - RNA, 63 nt, hsa
guuguagccaucugagagaggaaaguuuaagugacugaaaauguagaauacuucaacgugcau

SEQ ID NO: 500164 - RNA, 63 nt, hsa
ugauaauguugugguuuguugccguugccaagaacugaaaacauaaaaaguuaaaaaaaauaa

SEQ ID NO: 500165 - RNA, 63 nt, hsa
aaaaaaguuugucuuugagauucaauguaaagaacugaaaacaauguauauguuguaaauauu

SEQ ID NO: 500166 - RNA, 63 nt, hsa
uuccaaaugagcccaaauuccacuggcuccuccacugaaaacuacuaaaccgguggaaucuga

SEQ ID NO: 500167 - RNA, 63 nt, hsa
aaauguccccaaaguauuaaagaauuaaaugauacugaaaauuuguaugauucaaauuuguuu

SEQ ID NO: 500168 - RNA, 63 nt, hsa
ccagggaacgguagauuuauuccccaacucuuaacugaaaauguguuagacaagccacaaagu

SEQ ID NO: 500169 - RNA, 63 nt, hsa
gccugggugacagagugagacuccaucucaaaaacugaaaauaaaaauaaaaauauguauucu

SEQ ID NO: 500170 - RNA, 63 nt, hsa
uauuuuuaagcugaaaaggggauccuugaaaacacugaaaaccucuacaacaaucuucaggaa

SEQ ID NO: 500171 - RNA, 63 nt, hsa
gauuucuuuuuaaaguuuuaaacgaauauuuugacugaaaaauuuuggcagucuuguaugcaa

SEQ ID NO: 500172 - RNA, 63 nt, hsa
cacucauuuucaauuucuaaauuugcaggggauacugaaaaauacggcagguggccuaaggcu

SEQ ID NO: 500173 - RNA, 63 nt, hsa
gggugggaugaaacauguuuuggggggggaugcacugaaaaucugagaacuauuuaccuauca

SEQ ID NO: 500174 - RNA, 63 nt, hsa
ucuccccucccuucaggaauaacuuauuggaaaacugaaaagaaucacugaauggaauguuca

SEQ ID NO: 500175 - RNA, 63 nt, hsa
aacuugagaaaauuacuucauaaacauauggaaacugaaaauggacucucuuugugacaaaga

SEQ ID NO: 500176 - RNA, 63 nt, hsa
gcugacuucauggaauggacauccuguauaagcacugaaaaacaacaacacaauaacacuaaa

SEQ ID NO: 500177 - RNA, 63 nt, hsa
gaaguguaccuguguacauaacucuguaaaaacacugaaaaauuauacuaacuuauuuauguu

SEQ ID NO: 500178 - RNA, 63 nt, hsa
guaugaaucugcucauguggagacuggcuauaaacugaaaaguguauuccaaauugcagaaca

SEQ ID NO: 500179 - RNA, 63 nt, hsa
ccacuacagaacagggcuaaauuagccaccaccacugaaaacucagccgaauuuuuuuauacc

SEQ ID NO: 500180 - RNA, 63 nt, hsa
cccaccacccccccgcccccccgaagccaugucacugaaaaggccugggggggaugguauaug

SEQ ID NO: 500181 - RNA, 63 nt, hsa
accucuuaagucccaguauaccucauuuuucauacugaaaaaaaaagcuuguggccaauggaa

SEQ ID NO: 500182 - RNA, 63 nt, hsa
aacaguucucaugagaacuugguaguaagcuaaacugaaaauaaggugggcuucacuggagaa

SEQ ID NO: 500183 - RNA, 63 nt, hsa
ucugcgugggaccaugccugaacuccccgaauaacugaaaaauggcugaauauuuuuaugguu

SEQ ID NO: 500184 - RNA, 63 nt, hsa
caaacaguucucauuacaaaggaccaauucagaacugaaaagcuaugcauaggacaaggaaga

SEQ ID NO: 500185 - RNA, 63 nt, hsa
cgagccuggccaacauggugaaacccuguagcuacugaaaauacaaaaauaagccaggcgugg

SEQ ID NO: 500186 - RNA, 63 nt, hsa
uucaguguagggaagacauuuguaauaaugaaaacugaaaauggaguaauugugaguaacuca

SEQ ID NO: 500187 - RNA, 63 nt, hsa
ugcuguuaacguauuugccaguuacgaaguuccacugaaaauuuuccuauuaauucuuaagua

SEQ ID NO: 500188 - RNA, 63 nt, hsa
ucccagguuuuuagaucccacugagcccagcugacugaaaacaaggacagucagggugaaacu

SEQ ID NO: 500189 - RNA, 63 nt, hsa
uagaaauuauauagcagauucuuuguugggaagacugaaaaaaauaaagauagguauaggaua

SEQ ID NO: 500190 - RNA, 63 nt, hsa
cagugucugccagaguuuaguucuuuauaccuuacugaaaaaugccucguggucuucgcagag

SEQ ID NO: 500191 - RNA, 63 nt, hsa
gacugggacugcucuggguuagguuuucuguggacugaaaaaucguguccuuuucucuaaaug

SEQ ID NO: 500192 - RNA, 63 nt, hsa
aaugugaagcaaacaaaaaaaauuuguauguaaacugaaaauaagaaaauacauuagcaagcu

SEQ ID NO: 500193 - RNA, 63 nt, hsa
ggauuugcuucuaggcccauuauuuuuauuaaaacugaaaaaauuuaaacugaauuuuuugac

SEQ ID NO: 500194 - RNA, 63 nt, hsa
uuucauaacuuuauggcuuaauaaauguaugacacugaaaagauuugagugugaaucuacuga

SEQ ID NO: 500195 - RNA, 63 nt, hsa
uacuuugguggcuaaguuuuacuaaggaaaauaacugaaaagauuaaaagugagagcugaaaa

SEQ ID NO: 500196 - RNA, 63 nt, hsa
gccuucucucagacugccuggccagccuggggcacugaaaauacggcucauguuaaugaguua

SEQ ID NO: 500197 - RNA, 63 nt, hsa
aucugcaaagugcaauuucaacauguaccauuaacugaaaaucauacauaacugugauugaaa

SEQ ID NO: 500198 - RNA, 63 nt, hsa
uuccugaagaaccaguccccccacccucauucuacugaaaaggaggggucuggguacuucuug

SEQ ID NO: 500199 - RNA, 63 nt, hsa
acccacugggucuaccaguaugcagguugggauacugaaaauuuccagaugagcucuucuuuc

SEQ ID NO: 500200 - RNA, 63 nt, hsa
ugccuuuuauauauuauguuuuuacugaaauuaacugaaaaaauaugaaaccaaaaguacaaa

SEQ ID NO: 500201 - RNA, 63 nt, hsa
ccgcaccagaucaaguaguuuggacaucacccuacugaaaacuugcgauucuucuuaguuuuc

SEQ ID NO: 500202 - RNA, 63 nt, hsa
uagcccacugaccaggaauuauuuaaccaacccacugaaaacuuguguguugagcagcucuga

SEQ ID NO: 500203 - RNA, 63 nt, hsa
acacacacauucacccuaaggauccaauggaauacugaaaagaaaucacuuccuugaaaauuu

SEQ ID NO: 500204 - RNA, 63 nt, hsa
ccuagcucucugugaauguguuuuauccauucaacugaaaauugguaucaagaaaguccacug

SEQ ID NO: 500205 - RNA, 63 nt, hsa
gccuggagccaaagaugacacaaggggaaggguacugaaaacaccauccauuugggaaagaag

SEQ ID NO: 500206 - RNA, 63 nt, hsa
acaugugauaacuauggaaaucaagauuaugugacugaaaaacauaaaggaagagacccaucu

SEQ ID NO: 500207 - RNA, 63 nt, hsa
ggcugguuaccucuuugcuggcugugacaacagacugaaaaaggauuggcacugucucacuug

SEQ ID NO: 500208 - RNA, 63 nt, hsa
ggaaaggagaaaaaucacgacuacuguuuacagacugaaaaauuauugcuuuuuauacuacug

SEQ ID NO: 500209 - RNA, 63 nt, hsa
uuugucucuugguccacaguauuuggaaaggucacugaaaaugggucuuucagucuuggcauu

SEQ ID NO: 500210 - RNA, 63 nt, hsa
cacagccaaagccuuaaaucaaacccacacacaacugaaaauugccuccuccaucucucaccu

SEQ ID NO: 500211 - RNA, 63 nt, hsa
uucugggggagauggagauuugacuguuuaaaaacugaaaacagcgaggagucuuucuagaac

SEQ ID NO: 500212 - RNA, 63 nt, hsa
uuaaaauaagaaagcugagacugaggaggugaaacugaaaauaaaaagagaaaguucauccuc

SEQ ID NO: 500213 - RNA, 63 nt, hsa
ucacggagcugaccaucuuuaccugguccuggaacugaaaaacuguagcuugugugaaaauga

SEQ ID NO: 500214 - RNA, 63 nt, hsa
ccagcccaaccaacauggugaaacccugucuccacugaaaauacauaaaauuagccgggugca

SEQ ID NO: 500215 - RNA, 63 nt, hsa
gcugagaaaggggcaggcaaaaugaagcuggccacugaaaacuguaagauggucaaaagcuga

SEQ ID NO: 500216 - RNA, 63 nt, hsa
ucagccuggccaacauggugaaaccccuucucuacugaaaauacaaaaauuagccagacguga

SEQ ID NO: 500217 - RNA, 63 nt, hsa
ccagccuggccaacauggugaaaccccaucucuacugaaaauacaaaaauuaggcauaguggu

SEQ ID NO: 500218 - RNA, 63 nt, hsa
uuuuaaagcugcuugcaaaguguuggugauuuuacugaaaacuuuugagaucuucauuuuaca

SEQ ID NO: 500219 - RNA, 63 nt, hsa
acacacuuuaaaaauaugucuuuuuucaaucuaacugaaaaccuucuuaacuucuaauauauu

SEQ ID NO: 500220 - RNA, 63 nt, hsa
uuauuuauauaacugcauuuaagcaguaccaagacugaaaaaaaagguaauaaaugaaauguu

SEQ ID NO: 500221 - RNA, 63 nt, hsa
uuuuaauuauaaguguuauggcuaaaguuauuuacugaaaauuucaguaaaaugugugaaugu

SEQ ID NO: 500222 - RNA, 63 nt, hsa
ccuuucucuguaccucuaagaagaaagaaucuaacugaaaauaccaaaaaaaaaaaaaaaaaa

SEQ ID NO: 500223 - RNA, 63 nt, hsa
aucuaacuuauuagacagcaagcaauauauaauacugaaaaaguauucagaaauggaaaauuu

SEQ ID NO: 500224 - RNA, 63 nt, hsa
aguuagguugucuccaggccaugauggccuuacacugaaaaugucacauucuauuuuggguau

SEQ ID NO: 500225 - RNA, 63 nt, hsa
gagcccauacuuuuggcuccucuaguaagaugcacugaaaacuuagccagaguuagguugucu

SEQ ID NO: 500226 - RNA, 63 nt, hsa
aaaaaagaauaaaaaguagcaguaaaauuauauacugaaaacaccaaaaauuuagaugccuua

SEQ ID NO: 500227 - RNA, 62 nt, hsa
aaauaagcagagaaaaaaaaaugugaauaaacuacugaaaacacuugguguuuuguguucaa

SEQ ID NO: 500228 - RNA, 63 nt, hsa
uuuucuuguuuccugauaauaaauguauuuaggacugaaaauacuccugaguacucccuuggc

SEQ ID NO: 500229 - RNA, 63 nt, hsa
uuggaaaguaagaaaguuucauggauuagagugacugaaaaacauauccaguuagaaaauugu

SEQ ID NO: 500230 - RNA, 63 nt, hsa
cuagugcgauuucacagucuacugccuguuuccacugaaaacauuuuugucauauucuuguau

SEQ ID NO: 500231 - RNA, 63 nt, hsa
aaaucauucaaggauuauaguaauauuucauauacugaaaagugucucauaggaguccucuug

SEQ ID NO: 500232 - RNA, 63 nt, hsa
gcaugaauaggcucugcuaacgugaugagacaaacugaaaauuauugcaagcauugacuauaa

SEQ ID NO: 500233 - RNA, 63 nt, hsa
ccaccauucuacagaguuguacucaagacagauacugaaaaaaucuaauaccuucccuuguau

SEQ ID NO: 500234 - RNA, 63 nt, hsa
cagacuauguugcaagucuguuucaucuaguaaacugaaaauuauugcuuaaucaaacugccg

SEQ ID NO: 500235 - RNA, 63 nt, hsa
ggccauguaugaagccaaauauuaggcuuaaaaacugaaaaaucugguucauucuucagauau

SEQ ID NO: 500236 - RNA, 63 nt, hsa
aauccucauggccucuaaauuaguauguagaacacugaaaaguucuuaacauuuuuguguaau

SEQ ID NO: 500237 - RNA, 62 nt, hsa
acaaaccgaagacucuuugaagacaucguaacacugaaaaguacacuuucuacuaaagaugc

SEQ ID NO: 500238 - RNA, 63 nt, hsa
ccaucuuugaaaaaauuacccucuagcucuaacacugaaaauaauaauaaauuguagaucucu

SEQ ID NO: 500239 - RNA, 63 nt, hsa
ggacaaaauaaauugugaaaggaaguguaguugacugaaaacuacaguuguaauaagucuucc

SEQ ID NO: 500240 - RNA, 63 nt, hsa
agcaagccugaugguuugucuuauuucauucauacugaaaauucuuugcauauuuuuuuucug

SEQ ID NO: 500241 - RNA, 63 nt, hsa
cugcagguaucacuuugauccuaugugggagcgacugaaaauagaaugagcuugguuaagcac

SEQ ID NO: 500242 - RNA, 63 nt, hsa
uagaauugagauggccuuuuuuucacauuguagacugaaaagagacuuaaugguaugaugugu

SEQ ID NO: 500243 - RNA, 63 nt, hsa
aaaauguagcgggauuuuuaaggaaucagagagacugaaaaaaaaaaaaaaauuaaugauggu

SEQ ID NO: 500244 - RNA, 63 nt, hsa
aacccacacacccuacaaguugaucaugcaggaacugaaaaccagucuucucccuguccccuc

SEQ ID NO: 500245 - RNA, 63 nt, hsa
aauuuguuuaguauaaauugucauagcugguuuacugaaaacaaacacauuuaaaauugguuu

SEQ ID NO: 500246 - RNA, 63 nt, hsa
uucaccuaaagcuagaucucuuaaaaccaauuuacugaaaacuuguuugcuuaaaguuaauga

SEQ ID NO: 500247 - RNA, 63 nt, hsa
uugcugcagccgagugaccuccauaaauacuggacugaaaaaacauuguaauacuacaaguau

SEQ ID NO: 500248 - RNA, 63 nt, hsa
ucauucacguuucaugaccaacugguaguuggcacugaaaaaacuuuucagggcugugugaau

SEQ ID NO: 500249 - RNA, 63 nt, hsa
uuuaauguauauguuucucuucaggcgcuaugaacugaaaaauauguuuucuuacuguuuaau

SEQ ID NO: 500250 - RNA, 63 nt, hsa
guauuuguuaccaaaagugguucuacaaaugcuacugaaaaaaaucuggaaauuccuaauguc

SEQ ID NO: 500251 - RNA, 63 nt, hsa
ccgcugauguacaauaaccuugaggucccccauacugaaaacugaccaaggccugugcacagg

SEQ ID NO: 500252 - RNA, 63 nt, hsa
ggguggggaucuugcaaauuucuauucucuuuuacugaaaaagcaggggaugaguuccaucag

SEQ ID NO: 500253 - RNA, 63 nt, hsa
uggccguugcaaucugcucaaaccuaacaccaaacugaaaacauaaauacugaccacuccuau

SEQ ID NO: 500254 - RNA, 63 nt, hsa
agucaacugcuguuauuagaagaaaaguacuguacugaaaauucagaaaaaaaaucucaaccu

SEQ ID NO: 500255 - RNA, 63 nt, hsa
accagccuggccaacaugugaaaccccgucuccacugaaaauagaaaaauuagcugggcaugg

SEQ ID NO: 500256 - RNA, 63 nt, hsa
uauuuuuuaguaaucaagaaaggcuggaaaacuacugaaaaacugaucaagcuggacuugugc

SEQ ID NO: 500257 - RNA, 63 nt, hsa
uaaugauuuauauaucacuuaguguguagagggacugaaaauauuuauuuuguuauaaauaau

SEQ ID NO: 500258 - RNA, 63 nt, hsa
acacauuucuuaaaacacaugauaccagcagcaacugaaaaugaaugccgaauuugguacaca

SEQ ID NO: 500259 - RNA, 63 nt, hsa
uuuuaacuuuugaaaugugugagaguguuacuuacugaaaacugaaaggauaugacaugcugg

SEQ ID NO: 500260 - RNA, 63 nt, hsa
ugugggauuguaggcaaacccaccuguggcaucacugaaaauaaauuugaucauaccuaagag

SEQ ID NO: 500261 - RNA, 63 nt, hsa
uuccuuuuuugucacuuuuauccuuuuuuuaaaacugaaaauauuuuucucuugcuauuuaua

SEQ ID NO: 500262 - RNA, 63 nt, hsa
acuuaaaauaagaaaaggagcacuuuaauuacaacugaaaaaucagauuguuuugcaguccuu

SEQ ID NO: 500263 - RNA, 63 nt, hsa
acagugacacguuuggccagugacauuucaaucacugaaaaugugcucuacaucucguaugga

SEQ ID NO: 500264 - RNA, 63 nt, hsa
uauaaugggaaagggccuggguguuacccauguacugaaaaugaacuuuuaccaacauggcua

SEQ ID NO: 500265 - RNA, 63 nt, hsa
cuaaugaaacccaguagauguuuguugaauugaacugaaaauuuauguggccagacacagugg

SEQ ID NO: 500266 - RNA, 63 nt, hsa
gcuggggacagaagguuuucaugaacucuuuuuacugaaaaugcccugcauuuaaaaauguuu

SEQ ID NO: 500267 - RNA, 63 nt, hsa
cccgaaauaagaacccauuauuuccagugaguuacugaaaauacauuuuuaaagagaaaguac

SEQ ID NO: 500268 - RNA, 63 nt, hsa
uggagcuauucugguaccuuccccauggaggacacugaaaaggcuggguuggggacagggagu

SEQ ID NO: 500269 - RNA, 63 nt, hsa
guauaaauaccuucuauuuuuaauacaagcuccacugaaaaccaccuucguuuucaagguucu

SEQ ID NO: 500270 - RNA, 63 nt, hsa
uuucccugacugucauagagaaucaucaucgccacugaaaaccaggcccuguugccuuuuaag

SEQ ID NO: 500271 - RNA, 63 nt, hsa
auaucuuucauaagggcuguugcaaccauaugaacugaaaaaacacgcauuuuguaauccaaa

SEQ ID NO: 500272 - RNA, 63 nt, hsa
aaauuuucuuaguaguauauaaaagguaagaguacugaaaaauuaauaaaauugcaaguuaag

SEQ ID NO: 500273 - RNA, 63 nt, hsa
ggaggugcagaggcagcagaggauuggcauaaaacugaaaaggaguucugucugcaugagaaa

SEQ ID NO: 500274 - RNA, 63 nt, hsa
aaauacugucagaaguccagguauacugauaacacugaaaauucuauuagcaaccuucugggu

SEQ ID NO: 500275 - RNA, 63 nt, hsa
cagccugaccaaacauggcgaaaccccaucuguacugaaaauacaaaaauuaggcaugguggu

SEQ ID NO: 500276 - RNA, 63 nt, hsa
gugaaucagccagcaauauuuuaguugcaaaucacugaaaacccaacucaaagugacuuaagu

SEQ ID NO: 500277 - RNA, 63 nt, hsa
cacaucaugaaggcagaggcaugcacauuccucacugaaaaagaaaacacacacccacccaca

SEQ ID NO: 500278 - RNA, 63 nt, hsa
uuccuucccccugacccugacuccuugaacgucacugaaaacggcagcuauugcaaggagugg

SEQ ID NO: 500279 - RNA, 63 nt, hsa
uuuucaagccuuacacaauagcagagaauauaaacugaaaaaauccauacaaauauuaaaaau

SEQ ID NO: 500280 - RNA, 63 nt, hsa
caggguucagaaaaggcaaacucaugaaaugccacugaaaagaacuuucaacacagcauacuu

SEQ ID NO: 500281 - RNA, 63 nt, hsa
acugagaagucaagauccucccuggaggacaggacugaaaaccuugccaagcuguacacaguu

SEQ ID NO: 500282 - RNA, 63 nt, hsa
ucccuuuucucaucuuaccccuuuaugccaccuacugaaaagaaaaacaaauagcuagguuug

SEQ ID NO: 500283 - RNA, 63 nt, hsa
aggauggaggaaugugggcaguuugacuucagcacugaaaaccucuccaccugggccaggguu

SEQ ID NO: 500284 - RNA, 63 nt, hsa
aacuaucagggcaaaaucucacuggauuucuccacugaaaaccuacuugagguuucuggucug

SEQ ID NO: 500285 - RNA, 63 nt, hsa
uggaguacagcgggagaaacacaaaauaguauaacugaaaacauuaacauucagacacacucc

SEQ ID NO: 500286 - RNA, 63 nt, hsa
guuuuuuuaauguuaaauguguaacucaguauuacugaaaagguacccacauuuugaauagua

SEQ ID NO: 500287 - RNA, 63 nt, hsa
ccagccuggccaacaugaugaaauguugucucuacugaaaaugcaaaaauuagccagguauag

SEQ ID NO: 500288 - RNA, 63 nt, hsa
accuuuucccuuucauguucuuggaccuuuuguacugaaaauccaggcaucuagguucuuuuu

SEQ ID NO: 500289 - RNA, 63 nt, hsa
ugugcacccagcgcuccauagacgccuuugugaacugaaaagagacuggcagagucccgagaa

SEQ ID NO: 500290 - RNA, 63 nt, hsa
cuaaaggcuaugcgauaugaauuucagaaauggacugaaaauggagagcuauguaacagauac

SEQ ID NO: 500291 - RNA, 63 nt, hsa
aaggggauuucguguaaaugugaacacugacgaacugaaaagcuaacaccgacugcccgcccc

SEQ ID NO: 500292 - RNA, 63 nt, hsa
gucauaugaugcaaaaaagguuuugugucauuaacugaaaaguagcagcuucucuauccagga

SEQ ID NO: 500293 - RNA, 63 nt, hsa
cauuaccaaaauacuaaaacccaacaaaaugcaacugaaaaauaccuuccaaauuugccaaga

SEQ ID NO: 500294 - RNA, 63 nt, hsa
auaucaucaggucuuaaaaaaaaauaaagguaaacugaaaagacaacuggcuacaaagaagga

SEQ ID NO: 500295 - RNA, 63 nt, hsa
ggccauagaaacguuuuaauuuucaaugaagucacugaaaauccaacuccaggagcuauggca

SEQ ID NO: 500296 - RNA, 63 nt, hsa
cuaauauauuuaaaaauaagucaacaguaaaccacugaaaaaauauauguauauacacccaag

SEQ ID NO: 500297 - RNA, 63 nt, hsa
aaaacuuaaauuguauauuuugaaaaauaaaacacugaaaagaaaccaacaaaaaugaguugu

SEQ ID NO: 500298 - RNA, 63 nt, hsa
gugcugguuuuuaaaugugcaucaagaaagacuacugaaaaguauuauuuuguaacuaagauu

SEQ ID NO: 500299 - RNA, 63 nt, hsa
uuuuuagaauguuuuuaugaguaaauuuaauguacugaaaauaaaaauuuuaaaaaaggcugu

SEQ ID NO: 500300 - RNA, 63 nt, hsa
uucauuugaggucuagaucuaggcacuguggacacugaaaaacaguugggaaaucuuucgagc

SEQ ID NO: 500301 - RNA, 63 nt, hsa
caguagucugggacugggcauuuaucuucucugacugaaaaucucuccuuggucuuaaggaaa

SEQ ID NO: 500302 - RNA, 63 nt, hsa
uccacaagucucaagccucagugcuaaaguacuacugaaaaggaacuaggaaguuuggccaau

SEQ ID NO: 500303 - RNA, 63 nt, hsa
agaugacccagccaucuacaagaucugaauucuacugaaaauaucuagaaauguggaagagac

SEQ ID NO: 500304 - RNA, 63 nt, hsa
uuuuuuaauucuucccuuggauuaauauuuucuacugaaaagaaaugaaaucucaguuccacu

SEQ ID NO: 500305 - RNA, 63 nt, hsa
ccuuuuaaguaaccacucaaaacuuuucauuucacugaaaaaauaugaaaaaccaugacaaua

SEQ ID NO: 500306 - RNA, 63 nt, hsa
ccaaacuccaaagcuuugaacauucaugacugaacugaaaacaagccaugacuugagaaacaa

SEQ ID NO: 500307 - RNA, 63 nt, hsa
aacuuggacuaguguaacuccuucaugcaauaaacugaaaagagccaugcugucuagucuuga

SEQ ID NO: 500308 - RNA, 63 nt, hsa
uaaccagucaccagugcgauucuggauaaagccacugaaaauucgaaccaggaaauggaaccc

SEQ ID NO: 500309 - RNA, 63 nt, hsa
gauuucagaacauguguuaauaguauauaugccacugaaaacuuagguccuguaucauacuuu

SEQ ID NO: 500310 - RNA, 63 nt, hsa
uuguaucauccgggcuccuuccgggcagaaacaacugaaaaugcacuucagacccacuuauuu

SEQ ID NO: 500311 - RNA, 63 nt, hsa
aacugaucauuaucuccuucucuuugagaccugacugaaaaaauuaggugugcacaccuguaa

SEQ ID NO: 500312 - RNA, 63 nt, hsa
gcagggcccugugguuggacuucaccucucagcacugaaaacccaaaacccagcuggccuuaa

SEQ ID NO: 500313 - RNA, 63 nt, hsa
aaaaaaauaagacccaauauuggcaaagagacuacugaaaaaacauucccauacauugcgugu

SEQ ID NO: 500314 - RNA, 63 nt, hsa
agaacuaaaaauagaugguucuuaauucaacuuacugaaaauuuccccaaacaauagcaaauc

SEQ ID NO: 500315 - RNA, 63 nt, hsa
gaaaucucuggccucaccccugcuggggguuggacugaaaacccuccuccccaauuugggggg

SEQ ID NO: 500316 - RNA, 63 nt, hsa
guaauaauaacauaauaauaauaaaaauauaauacugaaaaggauuguucagggggaguuggg

SEQ ID NO: 500317 - RNA, 63 nt, hsa
gaauuuauugaccaauuuauuuuucagaaaugaacugaaaauuucgcuuuuauaguaggaagg

SEQ ID NO: 500318 - RNA, 63 nt, hsa
ugccagaaaaaugugcucugcaguguccucccaacugaaaacaacagugacauguuugaaaag

SEQ ID NO: 500319 - RNA, 63 nt, hsa
ggacucggguggccugcgcuagcuucuuuugauacugaaaacuuuuaaggugggaggguggca

SEQ ID NO: 500320 - RNA, 63 nt, hsa
ccacgagcuuguucuuuguucuuugucacagggacugaaaaccucuccucauguucugcuuuc

SEQ ID NO: 500321 - RNA, 61 nt, hsa
ccauguaccaaaauaaaccucuauucuauuggcacugaaaauugaauaugauucuuauucu

SEQ ID NO: 500322 - RNA, 63 nt, hsa
aagaaggcaagccuccccaacuuaagccauguaacugaaaaucuaauuauaggagcauuuguu

SEQ ID NO: 500323 - RNA, 63 nt, hsa
uccagaguuguacagcagaagccucucuccuagacugaaaaugaaugugaaacuaggaaauaa

SEQ ID NO: 500324 - RNA, 63 nt, hsa
ggagggagaaaggagaaauuuugguuuuucaacacugaaaaaauacuaccuauaggaaagucu

SEQ ID NO: 500325 - RNA, 63 nt, hsa
gagucgauggcaggaggggguuuugggugggccacugaaaagggguaccgaauagguugugug

SEQ ID NO: 500326 - RNA, 63 nt, hsa
gccgcccaguguucugugaccacccguguagcuacugaaaauggcuggguaagcaagucaagg

SEQ ID NO: 500327 - RNA, 63 nt, hsa
aauuuuuuaauuugagaauuuuuauuucuuuugacugaaaacacauuagaaccuaugaguaaa

SEQ ID NO: 500328 - RNA, 63 nt, hsa
gaaaaagcauggaaaggaagagaacugauuccuacugaaaauucaaauucuauuaccauucua

SEQ ID NO: 500329 - RNA, 63 nt, hsa
gugacuacugcucacaaacgucgcaaagcagaaacugaaaacugguagguacacuuuccuacc

SEQ ID NO: 500330 - RNA, 63 nt, hsa
agaaacaaaugugcccaccccacuuuccgcuuaacugaaaagcuuaaaauaaauuucugaauu

SEQ ID NO: 500331 - RNA, 63 nt, hsa
uaauucuucagaggcagggcuaagacuuucaagacugaaaagagacuagcauaaggagacuua

SEQ ID NO: 500332 - RNA, 63 nt, hsa
uguuuaucugcugcuuuuuuuaaauaaaauuugacugaaaauguuuaauuggcauuuuuuaau

SEQ ID NO: 500333 - RNA, 63 nt, hsa
ugacucacuuuuauauacaagaaaaaccuuuccacugaaaaaucccucugauuuaaaaguaac

SEQ ID NO: 500334 - RNA, 63 nt, hsa
uggaagagagaggaagaagucaaaccauaugaaacugaaaaaauaugacguacgaaauggaca

SEQ ID NO: 500335 - RNA, 63 nt, hsa
uuguauuuccauauugaagcagcuugaguuucuacugaaaaugagcccgaauuauuucacuau

SEQ ID NO: 500336 - RNA, 63 nt, hsa
agauugaaaaaaaaaaagcacugaaaaccaauuacugaaaaaaaauugacagcuaguguuuuu

SEQ ID NO: 500337 - RNA, 63 nt, hsa
aucaccuucucaucagauugaaaaaaaaaaagcacugaaaaccaauuacugaaaaaaaauuga

SEQ ID NO: 500338 - RNA, 63 nt, hsa
gcuuauaguaggacuucuuugcauauguaugguacugaaaaaucuuaauauacaucuuuaauc

SEQ ID NO: 500339 - RNA, 63 nt, hsa
uguuuacaugcagcagauaauuguucauaguggacugaaaacuaaugcaaggacuauggucuc

SEQ ID NO: 500340 - RNA, 63 nt, hsa
gcaaggagacagaaugcuuuguuccuuuaaaagacugaaaagcugaccuucaauggauugagg

SEQ ID NO: 500341 - RNA, 63 nt, hsa
caguaucauuaaaaugguuaaguuuacauuugaacugaaaauauguauaaaaucuagcaauuc

SEQ ID NO: 500342 - RNA, 63 nt, hsa
ugaaagugguaauccucuucuaaaauagcaauaacugaaaaugaaaguguuaauuuuaccuug

SEQ ID NO: 500343 - RNA, 63 nt, hsa
acaaguacccuaaaauugaaagguggucccuacacugaaaacgcacauaguuugucaaaagug

SEQ ID NO: 500344 - RNA, 63 nt, hsa
aauuauuaaauaugcaaguuagaaauuaagucuacugaaaaauuuacauuuugagucagguuu

SEQ ID NO: 500345 - RNA, 63 nt, hsa
uuuaacugcuaaaucuuauuauaaggaaaccauacugaaaaccuuuccaagccucuuuuuucc

SEQ ID NO: 500346 - RNA, 63 nt, hsa
uuucagcuucuuacaaauacauaagagacucacacugaaaaaaguuguaugaauauaaaaaug

SEQ ID NO: 500347 - RNA, 63 nt, hsa
uaugguugcuuaauuguucugugauugaggaccacugaaaaauaagucuuaauaaauguuggu

SEQ ID NO: 500348 - RNA, 63 nt, hsa
ccaucucagaaaaaaaaaaaaaagauaauucauacugaaaagaaacucuacaaacuugaaaga

SEQ ID NO: 500349 - RNA, 63 nt, hsa
gccccucucagcagacgcuucaugauaggaaggacugaaaagucuuguggacaccuggucuuu

SEQ ID NO: 500350 - RNA, 63 nt, hsa
caacaagacaucagaacuuauuccucuugucuaacugaaaaugcaugccugaugaccaaacuc

SEQ ID NO: 500351 - RNA, 63 nt, hsa
auuuacacuauugcccuaggcuugcuaggaaagacugaaaaaauuuuugugccuaacuuugug

SEQ ID NO: 500352 - RNA, 63 nt, hsa
uccucauccacacaccuuucuuuacccagagccacugaaaacuauuuuuauaucauuggcuuu

SEQ ID NO: 500353 - RNA, 63 nt, hsa
guugucuuuucaucuguucaagaggagauugaaacugaaaacaaaaugagaacaacaaaaaaa

SEQ ID NO: 500354 - RNA, 63 nt, hsa
agggcaacauggugagaccucaucucuacaaaaacugaaaaauaaaaaacuuuuaaaaaaugu

SEQ ID NO: 500355 - RNA, 63 nt, hsa
ccacccuggccaacauggugaaaccuugucucuacugaaaauacaaaaaauuuagccaggugu

SEQ ID NO: 500356 - RNA, 63 nt, hsa
caggugaauauuuaugaaaaagucaacauuagaacugaaaauggaaauaaacugcuugaaaag

SEQ ID NO: 500357 - RNA, 63 nt, hsa
ucuagcaauaugauagauaauucagucugucauacugaaaaugacagcacuuuuaacaccuuu

SEQ ID NO: 500358 - RNA, 63 nt, hsa
caaguagccuuaauaacguuaguuucaguaaguacugaaaaguauauaauacugccauccaua

SEQ ID NO: 500359 - RNA, 63 nt, hsa
ugaugauucauuucaaaauccugagugagucugacugaaaaauacgagagaaaagagaguggu

SEQ ID NO: 500360 - RNA, 63 nt, hsa
aauccaaaucuauuuuucucacguguuuaaaaaacugaaaagugacuacucagauauguugga

SEQ ID NO: 500361 - RNA, 63 nt, hsa
caacaggacaucagaacuuauuccucuugucaaacugaaaaugcgugccugaugaccaaacuc

SEQ ID NO: 500362 - RNA, 63 nt, hsa
gaugagauaauuggugucgggaguguugcagugacugaaaagcuucauaaggggcaguuggug

SEQ ID NO: 500363 - RNA, 63 nt, hsa
ggaggcagggcuggacucaggaacccacagcuuacugaaaaagccagaggccaugacugcccc

SEQ ID NO: 500364 - RNA, 63 nt, hsa
uuuaaugaccauuuccuggaaucaguuuauuauacugaaaacugggggugggaguagggagcu

SEQ ID NO: 500365 - RNA, 63 nt, hsa
aagagaccuuccuagagugaaugaagguagaaaacugaaaagggaguaaauuaaggaaugauu

SEQ ID NO: 500366 - RNA, 63 nt, hsa
ugaaacuagcugaagccuuuucuuguuuuagcaacugaaaauuguacuuggucacuuuugugc

SEQ ID NO: 500367 - RNA, 63 nt, hsa
agagugauaaacuaagucacauacagauaaagcacugaaaacaccacagugacccucccaccc

SEQ ID NO: 500368 - RNA, 63 nt, hsa
auugcuuuguauuguauauuacaaugaucaccgacugaaaauauuguuuuacaauaguucugu

SEQ ID NO: 500369 - RNA, 63 nt, hsa
aucuguccuggaaacuguagaauugaauaaaucacugaaaauagaacacuucuuggaggcuuu

SEQ ID NO: 500370 - RNA, 63 nt, hsa
uuuccaaagcuccugaucuuucccaagauuguaacugaaaacugcugucucuuguuuuguucg

SEQ ID NO: 500371 - RNA, 63 nt, hsa
auuugcaaacucaaucggggacuaaaauuucccacugaaaauguuaaacauuuuagauaacug

SEQ ID NO: 500372 - RNA, 63 nt, hsa
acccuguucuacugcaaaacacuggaaaaagagacugaaaaaaagcaauguacuguacauuug

SEQ ID NO: 500373 - RNA, 63 nt, hsa
gugagccugaauuuuguugcuguuuugauuuguacugaaaaaugguaauuguugcuaaucuuc

SEQ ID NO: 500374 - RNA, 63 nt, hsa
aaugagcaucucaaagaagucuguuaaaucaugacugaaaaaaaucaaucagauguaucuuca

SEQ ID NO: 500375 - RNA, 63 nt, hsa
ugaaucugaaacccuccuucuguggcaacuuguacugaaaaucuggugcucaauaaagaagcc

SEQ ID NO: 500376 - RNA, 63 nt, hsa
gagagaccuggcccucaaaaaggugugaacaagacugaaaaggagguccguucagcuccgccu

SEQ ID NO: 500377 - RNA, 63 nt, hsa
uuuaagccuauuuccuauccauuuauagcuacuacugaaaaugacuacugaauuuuaucaaau

SEQ ID NO: 500378 - RNA, 63 nt, hsa
uaugucccagaacugauguuuuuuuuuuaagguacugaaaagaaaugaaguugauguaugucc

SEQ ID NO: 500379 - RNA, 63 nt, hsa
ggccaugaaccauuauaaaaucccaacauauauacugaaaauacugaaacugcuuugaaaauu

SEQ ID NO: 500380 - RNA, 63 nt, hsa
ugaucucuguuuuuccugucagagauuuaaaaaacugaaaagguauaccucaacccaaaaaua

SEQ ID NO: 500381 - RNA, 63 nt, hsa
agagaauauguuuaauccauguauugguacuuuacugaaaaccagguuauauucuaaagaaga

SEQ ID NO: 500382 - RNA, 63 nt, hsa
uuaauuuuguuuuauagauaugauaggcaacagacugaaaaccauaaucuuuacuguauucua

SEQ ID NO: 500383 - RNA, 63 nt, hsa
cgcauagacuuuuaaacuucaaccaauguguuuacugaaaauaacaaauguuguaaauucccu

SEQ ID NO: 500384 - RNA, 63 nt, hsa
aagucuuugaucgaaggaaaauagaucuaugagacugaaaaaccuauuugcuugauuaccauu

SEQ ID NO: 500385 - RNA, 63 nt, hsa
acuuucaaauugaaaugacgguauaacacaucuacugaaaaagcaacgggaaaugugguccua

SEQ ID NO: 500386 - RNA, 63 nt, hsa
aauaagaggaggagaaagcucucuauaccaaagacugaaaaaaaaaauccugucuguuuuugu

SEQ ID NO: 500387 - RNA, 63 nt, hsa
cagauugauucaugauaauuguccuugacuaagacugaaaagacuaaugggaugccuuuuacu

SEQ ID NO: 500388 - RNA, 63 nt, hsa
uuuuccauuuuacuuaggaauaagcuuuuucgaacugaaaauucaugguaaaauaggauuucu

SEQ ID NO: 500389 - RNA, 63 nt, hsa
uucguggcagggaaagcagcgugcggggaagucacugaaaagugcugccuaaggaaguuugga

SEQ ID NO: 500390 - RNA, 63 nt, hsa
uuuuccagaaaugaaauguaaauccauuuuuauacugaaaauguuacugaaagucacuuuuau

SEQ ID NO: 500391 - RNA, 63 nt, hsa
guaauaggaaagauaacgggaagaugccaguugacugaaaauucaaagccuuucaauuugaag

SEQ ID NO: 500392 - RNA, 63 nt, hsa
caaaaaaaaaaaaaccagacugaauuaauuuuaacugaaaauuucucuuauguuccaaguaca

SEQ ID NO: 500393 - RNA, 63 nt, hsa
gaguaaaagcccaguuugcuaggaggucugcuuacugaaaacaaggagaccuggggugggugu

SEQ ID NO: 500394 - RNA, 63 nt, hsa
aaaaaauuauuuucucuuaacaagacuuuuuguacugaaaacaauuuuuuugaaucuuucgua

SEQ ID NO: 500395 - RNA, 63 nt, hsa
guaggaaauuuaaacucuaauuaugacagcuacacugaaaaauaauuguacugaaauuaacuu

SEQ ID NO: 500396 - RNA, 63 nt, hsa
gaaagacaccuucccggguggaagaaggaguucacugaaaacuuaucuuaaacugacccuucc

SEQ ID NO: 500397 - RNA, 63 nt, hsa
uauaauuugaacuguacuggacccauaguuuuaacugaaaagggccaaacaaguggugucugu

SEQ ID NO: 500398 - RNA, 63 nt, hsa
gugcggccuuagagguuucccuccuuccuuuccacugaaaagcacauggccuugggugacaaa

SEQ ID NO: 500399 - RNA, 63 nt, hsa
cucauauacagcaggcaaagagacagaaaauuaacugaaaagcaguuuagagacugggggagg

SEQ ID NO: 500400 - RNA, 63 nt, hsa
cucauauauaguagacaaagagccagaaaauuaacugaaaagcaguuuagacauugggggagg

SEQ ID NO: 500401 - RNA, 63 nt, hsa
agcaaagcuuuuuauuacuuuguaauuuaaaaaacugaaaaaaaaaaaacugaagaacuuugg

SEQ ID NO: 500402 - RNA, 63 nt, hsa
uucacacucugccuccccacuucuccccccguuacugaaaaauaaccauuuuagugucaggcu

SEQ ID NO: 500403 - RNA, 63 nt, hsa
uuauguauauauuuuucaaggucuguuuuucuaacugaaaagcuaagggcuugauuccuagcc

SEQ ID NO: 500404 - RNA, 63 nt, hsa
uuuugguuugguuuggcuuugacuaauucugguacugaaaaguuagcuauacacacacacaca

SEQ ID NO: 500405 - RNA, 63 nt, hsa
gcuuaaguuuuaucguguaaauacauuagcuaaacugaaaaguauaaguaacaugcuuuguug

SEQ ID NO: 500406 - RNA, 63 nt, hsa
agagacuguguucauguguaaagacugagcagaacugaaaaauuacuuauuggauauucauuc

SEQ ID NO: 500407 - RNA, 63 nt, hsa
uacuugaaauuacuugaauuuucuugucuuaaaacugaaaaaaaaauguaguuacacguuaaa

SEQ ID NO: 500408 - RNA, 63 nt, hsa
ugcaguuuguccucauaaacguuguagguugaaacugaaaaauaaguuaaaaugaucaaucaa

SEQ ID NO: 500409 - RNA, 63 nt, hsa
ucugaaauuuaauucuauuuugauaaaacuaagacugaaaauaaccacuuguaaacauuccua

SEQ ID NO: 500410 - RNA, 63 nt, hsa
gcagccuggccaagauggugaaaccccgucucuacugaaaauacaaaaauuagccaggugugg

SEQ ID NO: 500411 - RNA, 63 nt, hsa
uacacacauggcugaugucacauugaaaaugugacugaaaauuugaaaauucucucaauaaag

SEQ ID NO: 500412 - RNA, 63 nt, hsa
uuaacuuaaaaaguaguuagccaauaugcaaucacugaaaacuaugcaagagaaauuccaacc

SEQ ID NO: 500413 - RNA, 63 nt, hsa
guuucuugcuguugaaaaaaggaacaaagcguuacugaaaagaagguaaccuuuguuggaugu

SEQ ID NO: 500414 - RNA, 63 nt, hsa
gggaagcagauaucaacucacacuauucacacaacugaaaauauugggcaucaaauagauuag

SEQ ID NO: 500415 - RNA, 63 nt, hsa
gcccuaggagcccuguaacucccaggagagaccacugaaaauacuggagcaacaaugccccug

SEQ ID NO: 500416 - RNA, 63 nt, hsa
aaagugauaaacuaacaaacaaauauaacaacaacugaaaaggcacucuaaauuguggcuggc

SEQ ID NO: 500417 - RNA, 63 nt, hsa
ggaucauuuuguggaugccaaaugaauaucaaaacugaaaacacauuuguugauauuugucuu

SEQ ID NO: 500418 - RNA, 63 nt, hsa
uggauaugaguauccuuugcuuaucuuuguaguacugaaaauuugccgaaguaacuggcugug

SEQ ID NO: 500419 - RNA, 63 nt, hsa
uaaacauaucaguaaguuucuauauguaucaaaacugaaaaaauaguguuccaggcuaacaua

SEQ ID NO: 500420 - RNA, 63 nt, hsa
ccugaucagcacuaccacauccaaacauaagucacugaaaaacacuuaauauuuaugaguugg

SEQ ID NO: 500421 - RNA, 63 nt, hsa
acuuucuacaccuggaggaauguugcagaaagaacugaaaagguauaugaccggguaucagug

SEQ ID NO: 500422 - RNA, 63 nt, hsa
uguuauagguugaagcacacauauuugcaguuuacugaaaaguagauuucuuaugugacuuuu

SEQ ID NO: 500423 - RNA, 63 nt, hsa
guuuuaaaaaaugauuaucuuuuagagaaguauacugaaaaauguacaggugaaaugauaugu

SEQ ID NO: 500424 - RNA, 63 nt, hsa
guuuucuuuguauuguguucuaccuucccuuucacugaaaaugaucacuucauuugauacugu

SEQ ID NO: 500425 - RNA, 63 nt, hsa
auuuuaugaauaccaaauaaauagaccucuuguacugaaaacauauuugugacuuuaaucgug

SEQ ID NO: 500426 - RNA, 63 nt, hsa
ccacauuuuaaguuggauggugugcucuaaaauacugaaaaacaauagcccauauaccuaugu

SEQ ID NO: 500427 - RNA, 63 nt, hsa
aaugcugaaaauugccuuucuguguuuauucaaacugaaaagcugagaccaagagcaaggaag

SEQ ID NO: 500428 - RNA, 63 nt, hsa
ucuguucuauugaaugccuuguuaacagccaacacugaaaacacugugagaauuuguuuucag

SEQ ID NO: 500429 - RNA, 63 nt, hsa
auggaauauguuacuuaaaacgugugcauucuuacugaaaauguuuucaaaggaagguaucag

SEQ ID NO: 500430 - RNA, 63 nt, hsa
cuacaauaaaaauccagucuuaauuccagauuuacugaaaaugucagaucauuuuguauuaau

SEQ ID NO: 500431 - RNA, 63 nt, hsa
aaaaaggccuguacauacuucucccaaagcgccacugaaaagauggcauagcuuaaaagauga

SEQ ID NO: 500432 - RNA, 63 nt, hsa
cgcuguccauuguuugaggauguuaccuacuaaacugaaaacauucauuccauaucuacuuac

SEQ ID NO: 500433 - RNA, 63 nt, hsa
acaaaaauguaacaggggaaauuauauaccgugacugaaaacuagaguccuacuuacauaguu

SEQ ID NO: 500434 - RNA, 63 nt, hsa
ucuuuuauuuccaaaacaugcucuccuacuugaacugaaaaguaagagaaauaaauagaaucu

SEQ ID NO: 500435 - RNA, 63 nt, hsa
aggaggugcacgggccaccauagucacacuggcacugaaaagaaagcguugcccuggugauuc

SEQ ID NO: 500436 - RNA, 63 nt, hsa
ccaagguggucgggcaaaguauugccaggagauacugaaaaucauccagaagcacugugauau

SEQ ID NO: 500437 - RNA, 64 nt, hsa
aaaaaaauacugcauugauauauaauuauuucauguuacauaauaacccaaaacaaauaauuac

SEQ ID NO: 500438 - RNA, 64 nt, hsa
ugauuuuggaauuuuaugucaugcuaagguauguguuacauauggccaaguggaaaauauaucu

SEQ ID NO: 500439 - RNA, 64 nt, hsa
uuaucucaagacuaucuuaagcuaauguacuucuguuacauaauuaaacuauuucugcuauuau

SEQ ID NO: 500440 - RNA, 64 nt, hsa
gauuccaggaaugaagaauuaggcuugguuucagguuacauaaauaauagagcagaugguugcc

SEQ ID NO: 500441 - RNA, 64 nt, hsa
agcuaauuauuuuuucuuauaaaauccagccccgguuacauauaaucaucuguaucuuaucaug

SEQ ID NO: 500442 - RNA, 64 nt, hsa
uggguuauuuuguccuuuuacuuuuuuaaaaaauguuacauauuguaugcacugugcugaugca

SEQ ID NO: 500443 - RNA, 64 nt, hsa
gaaucuaauaagguucacuguugacacaguacaaguuacauagcuaaaauacauagcauugaag

SEQ ID NO: 500444 - RNA, 64 nt, hsa
acucaaaacauuuuucauuuuguuuaaaguagaaguuacauaauucuauauuuuaagucuuggg

SEQ ID NO: 500445 - RNA, 64 nt, hsa
cuagacaguucugugagaaagcagcaauugcacaguuacauacacagucaauuaaauuuuaaca

SEQ ID NO: 500446 - RNA, 64 nt, hsa
gcuacauguccgagugaguugcucuuccacagcaguuacauaaguuuuguauuauuuuuuuuau

SEQ ID NO: 500447 - RNA, 61 nt, hsa
aaauacuugucuguuuuaaaaaccuguucaagucuaccaaccuguucaagucuaccaauua

SEQ ID NO: 500448 - RNA, 61 nt, hsa
aaaaccuguucaagucuaccaaccuguucaagucuaccaauuauaagggcaaauuggagaa

SEQ ID NO: 500449 - RNA, 61 nt, hsa
uucacauuauauuggaaugaacaauucacaugucuaccacaagucuguaaacauaaccuua

SEQ ID NO: 500450 - RNA, 61 nt, hsa
ugcaaauucuguaauuucacucaacgauuaagucuaccaaagaacacacugcauguaaaag

SEQ ID NO: 500451 - RNA, 62 nt, hsa
cagcgaauugggaagucucaccaagcuagauugucuaccaucagcccagaacucuguaacuu

SEQ ID NO: 500452 - RNA, 62 nt, hsa
cauaaacaauauugcuagagguggcauguuuagucuaccaaaaacaauacuuuucaggcacu

SEQ ID NO: 500453 - RNA, 58 nt, hsa
cagccaguccagcaaaaugaacagcauugucuaccagaagcaguuccagucagccccu

SEQ ID NO: 500454 - RNA, 62 nt, hsa
cacauucuguuuaggaugacaguaauucuguugucuaccauuaaugcuacuaccuacuccau

SEQ ID NO: 500455 - RNA, 62 nt, hsa
cauuuccaacacugugugaauuaucuaaaugcgucuaccauuuugcacuagggaggaaggau

SEQ ID NO: 500456 - RNA, 62 nt, hsa
cuauauguauauuuauauauaucuggggucuugucuaccaccuccccuggucagagccugag

SEQ ID NO: 500457 - RNA, 62 nt, hsa
aggaaagggaagggaaaacagagaaccuaguggucuaccaagugguuggcaacuuucccaau

SEQ ID NO: 500458 - RNA, 62 nt, hsa
ugaucuccaaacaaccuucagccaaagaaucugucuaccaacuccucauagugagccagaag

SEQ ID NO: 500459 - RNA, 62 nt, hsa
aaauguucuauaugcauuuaauucugaaaucagucuaccaaggggcugcuaguauaugucag

SEQ ID NO: 500460 - RNA, 62 nt, hsa
cuacuucugccuuauggcuagggaacugucaugucuaccauguauuguacauaugacuuuau

SEQ ID NO: 500461 - RNA, 62 nt, hsa
ugauguuuuuacgugaauauguugaaguagaagucuaccauauuauuuuauaaaauguuuuc

SEQ ID NO: 500462 - RNA, 62 nt, hsa
uuuugugauguacuaaggauacugguccugaagucuaccaaauauuauagugcauuuuagcc

SEQ ID NO: 500463 - RNA, 62 nt, hsa
uuuuauuucuccccagguguggucacucaccugucuaccacucccgugaaauggcagcucgu

SEQ ID NO: 500464 - RNA, 62 nt, hsa
uuucuuuucuauuaaggguuuucuuuuucagugucuaccauuguacuuauaacuguuauuaa

SEQ ID NO: 500465 - RNA, 62 nt, hsa
ggaggcaauuguaaaauggacgucuagaauuggucuaccaguuacuauggaguaaaagaauu

SEQ ID NO: 500466 - RNA, 62 nt, hsa
cuuauaucuguauucuuuagauccuaaccucugucuaccaaccuuuuugcucaguaggaguc

SEQ ID NO: 500467 - RNA, 62 nt, hsa
uucucuccuaaaaauuugcacacuacuucauugucuaccaacuuuuuacauauuggaaaaua

SEQ ID NO: 500468 - RNA, 62 nt, hsa
gcuucuaaaucaaacuuccuucacagugccgugucuaccacuacaaggacugugcaucuaag

SEQ ID NO: 500469 - RNA, 62 nt, hsa
ggaguugagugaugcccgucaugugcacuugggucuaccaaugugcuuaaggccagaugggc

SEQ ID NO: 500470 - RNA, 62 nt, hsa
uagggaaauuucaugggauaauuagcaggcuggucuaccaccuggaccauguaacucuagug

SEQ ID NO: 500471 - RNA, 62 nt, hsa
augccuggugcaguauaauucccaaguguacugucuaccagaaaaaaaaaacaaaacuaaua

SEQ ID NO: 500472 - RNA, 62 nt, hsa
uaacuuccuaaagaauucaucuguuuauacaagucuaccacugccgauugacuaaaaaauac

SEQ ID NO: 500473 - RNA, 62 nt, hsa
uaauauuacuguuuauuucuguuucucauauggucuaccaguuugcugaugucccuagaaaa

SEQ ID NO: 500474 - RNA, 62 nt, hsa
uguaauagccaaaaaguggaaacaacccaaaugucuaccaacugaugaaugggaaauaaaau

SEQ ID NO: 500475 - RNA, 62 nt, hsa
ggauuggucagaaauugcuaucuguguaaaaugucuaccaguagccagaugcuuccagaguu

SEQ ID NO: 500476 - RNA, 62 nt, hsa
uuaggagaauauauccaauaaaagaugguuucgucuaccaauuggggaaguuucacccucuc

SEQ ID NO: 500477 - RNA, 62 nt, hsa
ucaauaaaugcaccuuagcagaaggucgaugugucuaccaggcagacgaagcucucuuacaa

SEQ ID NO: 500478 - RNA, 62 nt, hsa
ggugaaugugugagaaaaacuaacuugauagggucuaccaauacaaaauguauuacgaaugc

SEQ ID NO: 500479 - RNA, 62 nt, hsa
uuucuuuuggugcagaaccguugugcaguggggucuaccaugcaauuuucuuucagcacuga

SEQ ID NO: 500480 - RNA, 62 nt, hsa
uucuuuuucuuuugugcuggucuugcaaguuugucuaccaguaagagagcaaaguuuccuuc

SEQ ID NO: 500481 - RNA, 62 nt, hsa
cuacuuucaauuuggugaaaauguauuaaguugucuaccauguuuucuuuucuagcugaaua

SEQ ID NO: 500482 - RNA, 62 nt, hsa
ucuuggacacaucugaaauacaaaauguuuuugucuaccaaagaaaaauguugaaaaauaag

SEQ ID NO: 500483 - RNA, 62 nt, hsa
ugaguaaugaagauaaaaaccaagcuagguuagucuaccauuaguucauauguuuuuguagc

SEQ ID NO: 500484 - RNA, 62 nt, hsa
aaucugcugcauagcucuauuuuaaaguaaaagucuaccaccgaaucccuagucccccuguu

SEQ ID NO: 500485 - RNA, 62 nt, hsa
uaacuaugacugacguccccagaaguuucugggucuaccacacuccccaaccccccacuccu

SEQ ID NO: 500486 - RNA, 53 nt, hsa
agcagcaacaguuuguguagccagucuaccaccaccacagcaccccagacagc

SEQ ID NO: 500487 - RNA, 62 nt, hsa
gaguuggacuucagucuugccuaggcgauuuugucuaccauuuguguuuugaaagcccaagg

SEQ ID NO: 500488 - RNA, 62 nt, hsa
aaaauacuugucuguuuuaaaaaccuguucaagucuaccaaccuguucaagucuaccaauua

SEQ ID NO: 500489 - RNA, 62 nt, hsa
aaaaaccuguucaagucuaccaaccuguucaagucuaccaauuauaagggcaaauuggagaa

SEQ ID NO: 500490 - RNA, 62 nt, hsa
auuugccuacucauagggacuuugccuauuaagucuaccaaauuaaaagucuuaucauucag

SEQ ID NO: 500491 - RNA, 62 nt, hsa
gggagcaguguugaugccaaaauacccacggggucuaccagccaugggguuugcuugcuuag

SEQ ID NO: 500492 - RNA, 62 nt, hsa
agauccuggaaaucaggguuaguauuguccaggucuaccaaaaaucucaauauuucagauaa

SEQ ID NO: 500493 - RNA, 62 nt, hsa
guccucaucuggagccugaagggucaagugcugucuaccaucaacaccaaccagaugaacaa

SEQ ID NO: 500494 - RNA, 62 nt, hsa
uuuauauauaacuagcugcuauucaaaugugagucuaccauuuuuaauuuaugguucaacug

SEQ ID NO: 500495 - RNA, 62 nt, hsa
gaacaaagaacaauaucccaaagaggcccugugucuaccaggagcuucuuuuuccaaaugua

SEQ ID NO: 500496 - RNA, 62 nt, hsa
gucuggccaaugauucuuuuacuuaccuaucugucuaccaguagcgguccuugcccauuugg

SEQ ID NO: 500497 - RNA, 62 nt, hsa
cucccuugccccauuaucuuuucaccucccaggucuaccauuucaugguggucguugggucc

SEQ ID NO: 500498 - RNA, 62 nt, hsa
agcagccagccagcagccucucccaggcgggagucuaccauccgagacggcgaugacaaaga

SEQ ID NO: 500499 - RNA, 62 nt, hsa
ggaaggccaggagcccaguagccauguggccagucuaccauggggcccaggaguuggggaaa

SEQ ID NO: 500500 - RNA, 53 nt, hsa
uuauuagaagaaugaacuaaggugucuaccaugauuauuuuucuaagcugguu

SEQ ID NO: 500501 - RNA, 62 nt, hsa
cauggaggauugccugugaggaacuuaaacgagucuaccagugucuagacacgggggcaggu

SEQ ID NO: 500502 - RNA, 62 nt, hsa
uccaggaaacccaagaggcugagaauucuuuugucuaccauagaauuauuauccagacugga

SEQ ID NO: 500503 - RNA, 62 nt, hsa
gauggcgcaugcaugggaggaauucaucuucagucuaccagcccccgcugugucggauacac

SEQ ID NO: 500504 - RNA, 62 nt, hsa
uuuugugaaaagcagugguauguguacguguugucuaccaguacacaggcugcagaagacag

SEQ ID NO: 500505 - RNA, 62 nt, hsa
ucuccgaguacugcagaacugacauuuugacggucuaccagcguggcggcugguguugguca

SEQ ID NO: 500506 - RNA, 62 nt, hsa
cuccagucuccuggaggugggacuggacaggagucuaccagcuuguuuugagacucaugaaa

SEQ ID NO: 500507 - RNA, 62 nt, hsa
auauuuucuuuaucuaaauauuaacauucuaagucuaccaaaaaaaguuuuaaacucaagca

SEQ ID NO: 500508 - RNA, 62 nt, hsa
gaugaauauuaacauggagggcuuugccugaugucuaccagaagcccuguguguggauggug

SEQ ID NO: 500509 - RNA, 62 nt, hsa
agccaccccugcuuucuggccaucucuucuuugucuaccauuucaaauugacuugugaauac

SEQ ID NO: 500510 - RNA, 62 nt, hsa
ccauugcaaaggggagggaggggcagggagcugucuaccagcugagguccucccaaaacugg

SEQ ID NO: 500511 - RNA, 62 nt, hsa
cguggagugagcaagacagggcuuaccauccugucuaccagaugaggaaauggcaguucuga

SEQ ID NO: 500512 - RNA, 62 nt, hsa
agguuuuuuuguaguguaaugucuuaaucauagucuaccaucaaauauuuuaggaguaucuu

SEQ ID NO: 500513 - RNA, 62 nt, hsa
ggugguaaucaucugggggcccugguuuucuugucuaccagauaaaccaaaacugggaaggc

SEQ ID NO: 500514 - RNA, 62 nt, hsa
auucacauuauauuggaaugaacaauucacaugucuaccacaagucuguaaacauaaccuua

SEQ ID NO: 500515 - RNA, 62 nt, hsa
uugcaaauucuguaauuucacucaacgauuaagucuaccaaagaacacacugcauguaaaag

SEQ ID NO: 500516 - RNA, 62 nt, hsa
agggguacgaaaguaggaugagagccuucaaagucuaccagcacaaagaccccugagccccg

SEQ ID NO: 500517 - RNA, 62 nt, hsa
aacuguuaucaucagcugccauuucugauagggucuaccacaucuguaaugucuguccuuuc

SEQ ID NO: 500518 - RNA, 62 nt, hsa
uuuuuaauugccuuugagaauaaacucauaaggucuaccaagaaaauaaauguuaugauguu

SEQ ID NO: 500519 - RNA, 62 nt, hsa
cagcccaccuuaaagguguaggcacccacugggucuaccaguaugcagguugggauacugaa

SEQ ID NO: 500520 - RNA, 62 nt, hsa
auugguuuuauuuuuuucuuaaaaaaaaaaaagucuaccaaaggaauuugcauccagcagca

SEQ ID NO: 500521 - RNA, 62 nt, hsa
caacacgucuuuuauucaaaauaacaggcuuugucuaccaagaaaugaauuggauaauccac

SEQ ID NO: 500522 - RNA, 62 nt, hsa
caguccccuccugccugcuccuguccagccaggucuaccacccaccccaccccucuucuccg

SEQ ID NO: 500523 - RNA, 62 nt, hsa
uauucuuagaagggguguguaugucuagcugugucuaccauguguauguauucuugacaagc

SEQ ID NO: 500524 - RNA, 62 nt, hsa
auggcaccuagaaaugcaugccagcuuccugcgucuaccacucugcagcucaaacaagaagc

SEQ ID NO: 500525 - RNA, 62 nt, hsa
aggccagccugggcaacauggugaaacccggugucuaccaaaaauacaaaauguauccagac

SEQ ID NO: 500526 - RNA, 62 nt, hsa
auagagcagaggguuucugcugucuccagacugucuaccaaagagaaggcgacagaugccuc

SEQ ID NO: 500527 - RNA, 62 nt, hsa
uggcucccaucaccucuaacauccuugucugggucuaccaggaacgcuucauuuccuugggg

SEQ ID NO: 500528 - RNA, 62 nt, hsa
acccuccucgucugcaugguaacuccgucugagucuaccauuuucuugcucucccuccuucc

SEQ ID NO: 500529 - RNA, 62 nt, hsa
uacauagugucaugugcucagugguugccaaagucuaccaacuuuggggagcugcaggguuc

SEQ ID NO: 500530 - RNA, 62 nt, hsa
uguuccgagcacgaagaaacagcagcagggaugucuaccagccaccucucaccgcugccauu

SEQ ID NO: 500531 - RNA, 62 nt, hsa
gucugggggucaggaggcaggguuuuaucucugucuaccaucucccucgaacccacacugca

SEQ ID NO: 500532 - RNA, 62 nt, hsa
acagugaaggguggacaaaacucgacugcugcgucuaccaaguacgaugucuucagacaacu

SEQ ID NO: 500533 - RNA, 62 nt, hsa
cacugcucacuuuguggaugguagcaugagcugucuaccaagaagaaaccugcugcucucuu

SEQ ID NO: 500534 - RNA, 62 nt, hsa
uuuguaaugaaagucuacagccaauuuuacuugucuaccaccguguugugcucaaagagaca

SEQ ID NO: 500535 - RNA, 62 nt, hsa
uuuugaaaauuagucaaaauggacucuuuucagucuaccauaaguuaauauaacugauaccu

SEQ ID NO: 500536 - RNA, 62 nt, hsa
auuauuuauagauuuucuacaaauaaauauuugucuaccaaguaaaauauuuugacugaaau

SEQ ID NO: 500537 - RNA, 62 nt, hsa
gagauauauacacuuuugauuguuuucuagaugucuaccaauaaaugcaauuugugaccugu

SEQ ID NO: 500538 - RNA, 62 nt, hsa
ucauuuuguggcaagccuuaaguuaacaaugugucuaccaagaacaauugaguuuucuaaaa

SEQ ID NO: 500539 - RNA, 62 nt, hsa
acugacaguuucugaggcagaagccguaucaugucuaccaccugugagguccacacagugug

SEQ ID NO: 500540 - RNA, 62 nt, hsa
ggaaucuacucagagccugugugugcugcccagucuaccaaauaauuuauauacaucucagu

SEQ ID NO: 500541 - RNA, 62 nt, hsa
ggguccggggaagggcagaggucaccaggcuggucuaccagguaguuggggaggguccccag

SEQ ID NO: 500542 - RNA, 62 nt, hsa
uacaugcacaacacauauacaauacuagugaugucuaccaguccugcuacuucuggggugcc

SEQ ID NO: 500543 - RNA, 62 nt, hsa
auaaacucauaugcacuaaacaugcuauucaagucuaccaaacauccaggcagugaaagaag

SEQ ID NO: 500544 - RNA, 62 nt, hsa
aacaaugaaggaaacucuaaacuccccuuauggucuaccaguaauucauacuugaggaccau

SEQ ID NO: 500545 - RNA, 62 nt, hsa
agcaacguggcuuuuuuuuuuucccuuccugggucuaccacucagagaaacaauggcuaaga

SEQ ID NO: 500546 - RNA, 62 nt, hsa
uguucgggggccucuggcugcugaaggauucggucuaccacggagggcugugcuguuaggcu

SEQ ID NO: 500547 - RNA, 62 nt, hsa
acacuaaugcacuuaggauguuucugcaucaugucuaccagggagcaggguuccccacaguu

SEQ ID NO: 500548 - RNA, 62 nt, hsa
agcgccggguggacuggcuguuccgaggggccgucuaccacuccuaccucaccaucuucggg

SEQ ID NO: 500549 - RNA, 62 nt, hsa
aaucacuuuaaaccaaugccuauaaaaagcaagucuaccaaaauaaacuaagacuuucuaug

SEQ ID NO: 500550 - RNA, 62 nt, hsa
cuucagccagaagacugacaaagucauccuccgucuaccagagcgugcacuugugauccuaa

SEQ ID NO: 500551 - RNA, 62 nt, hsa
uguucuuguucugugucacucggcccuggguagucuaccauuuacuucaccccaaguccugc

SEQ ID NO: 500552 - RNA, 62 nt, hsa
uacagcaccucucagacagccggcacguggcugucuaccacaagggacgcuucuucaagcug

SEQ ID NO: 500553 - RNA, 62 nt, hsa
uuuguaaauuauuuuaugucauaguuuaauuggucuaccaaguaagacaucucaaauacagu

SEQ ID NO: 500554 - RNA, 62 nt, hsa
gcaagugugugccugugugccgaggagauggcgucuaccagaaggggauggacuucauuuug

SEQ ID NO: 500555 - RNA, 63 nt, hsa
ccagcgaauugggaagucucaccaagcuagauugucuaccaucagcccagaacucuguaacuu

SEQ ID NO: 500556 - RNA, 63 nt, hsa
gcauaaacaauauugcuagagguggcauguuuagucuaccaaaaacaauacuuuucaggcacu

SEQ ID NO: 500557 - RNA, 58 nt, hsa; identical to SEQ ID NO: 500453

SEQ ID NO: 500558 - RNA, 63 nt, hsa
ccacauucuguuuaggaugacaguaauucuguugucuaccauuaaugcuacuaccuacuccau

SEQ ID NO: 500559 - RNA, 63 nt, hsa
acauuuccaacacugugugaauuaucuaaaugcgucuaccauuuugcacuagggaggaaggau

SEQ ID NO: 500560 - RNA, 63 nt, hsa
ccuauauguauauuuauauauaucuggggucuugucuaccaccuccccuggucagagccugag

SEQ ID NO: 500561 - RNA, 63 nt, hsa
aaggaaagggaagggaaaacagagaaccuaguggucuaccaagugguuggcaacuuucccaau

SEQ ID NO: 500562 - RNA, 63 nt, hsa
uugaucuccaaacaaccuucagccaaagaaucugucuaccaacuccucauagugagccagaag

SEQ ID NO: 500563 - RNA, 63 nt, hsa
aaaauguucuauaugcauuuaauucugaaaucagucuaccaaggggcugcuaguauaugucag

SEQ ID NO: 500564 - RNA, 63 nt, hsa
gcuacuucugccuuauggcuagggaacugucaugucuaccauguauuguacauaugacuuuau

SEQ ID NO: 500565 - RNA, 63 nt, hsa
gugauguuuuuacgugaauauguugaaguagaagucuaccauauuauuuuauaaaauguuuuc

SEQ ID NO: 500566 - RNA, 63 nt, hsa
auuuugugauguacuaaggauacugguccugaagucuaccaaauauuauagugcauuuuagcc

SEQ ID NO: 500567 - RNA, 63 nt, hsa
uuuuuauuucuccccagguguggucacucaccugucuaccacucccgugaaauggcagcucgu

SEQ ID NO: 500568 - RNA, 63 nt, hsa
uuuucuuuucuauuaaggguuuucuuuuucagugucuaccauuguacuuauaacuguuauuaa

SEQ ID NO: 500569 - RNA, 63 nt, hsa
uggaggcaauuguaaaauggacgucuagaauuggucuaccaguuacuauggaguaaaagaauu

SEQ ID NO: 500570 - RNA, 63 nt, hsa
ucuuauaucuguauucuuuagauccuaaccucugucuaccaaccuuuuugcucaguaggaguc

SEQ ID NO: 500571 - RNA, 63 nt, hsa
uuucucuccuaaaaauuugcacacuacuucauugucuaccaacuuuuuacauauuggaaaaua

SEQ ID NO: 500572 - RNA, 63 nt, hsa
agcuucuaaaucaaacuuccuucacagugccgugucuaccacuacaaggacugugcaucuaag

SEQ ID NO: 500573 - RNA, 63 nt, hsa
uggaguugagugaugcccgucaugugcacuugggucuaccaaugugcuuaaggccagaugggc

SEQ ID NO: 500574 - RNA, 63 nt, hsa
uuagggaaauuucaugggauaauuagcaggcuggucuaccaccuggaccauguaacucuagug

SEQ ID NO: 500575 - RNA, 63 nt, hsa
uaugccuggugcaguauaauucccaaguguacugucuaccagaaaaaaaaaacaaaacuaaua

SEQ ID NO: 500576 - RNA, 63 nt, hsa
uuaacuuccuaaagaauucaucuguuuauacaagucuaccacugccgauugacuaaaaaauac

SEQ ID NO: 500577 - RNA, 63 nt, hsa
auaauauuacuguuuauuucuguuucucauauggucuaccaguuugcugaugucccuagaaaa

SEQ ID NO: 500578 - RNA, 63 nt, hsa
uuguaauagccaaaaaguggaaacaacccaaaugucuaccaacugaugaaugggaaauaaaau

SEQ ID NO: 500579 - RNA, 63 nt, hsa
uggauuggucagaaauugcuaucuguguaaaaugucuaccaguagccagaugcuuccagaguu

SEQ ID NO: 500580 - RNA, 63 nt, hsa
guuaggagaauauauccaauaaaagaugguuucgucuaccaauuggggaaguuucacccucuc

SEQ ID NO: 500581 - RNA, 63 nt, hsa
uucaauaaaugcaccuuagcagaaggucgaugugucuaccaggcagacgaagcucucuuacaa

SEQ ID NO: 500582 - RNA, 63 nt, hsa
uggugaaugugugagaaaaacuaacuugauagggucuaccaauacaaaauguauuacgaaugc

SEQ ID NO: 500583 - RNA, 63 nt, hsa
uuuucuuuuggugcagaaccguugugcaguggggucuaccaugcaauuuucuuucagcacuga

SEQ ID NO: 500584 - RNA, 63 nt, hsa
uuucuuuuucuuuugugcuggucuugcaaguuugucuaccaguaagagagcaaaguuuccuuc

SEQ ID NO: 500585 - RNA, 63 nt, hsa
acuacuuucaauuuggugaaaauguauuaaguugucuaccauguuuucuuuucuagcugaaua

SEQ ID NO: 500586 - RNA, 63 nt, hsa
aucuuggacacaucugaaauacaaaauguuuuugucuaccaaagaaaaauguugaaaaauaag

SEQ ID NO: 500587 - RNA, 63 nt, hsa
gugaguaaugaagauaaaaaccaagcuagguuagucuaccauuaguucauauguuuuuguagc

SEQ ID NO: 500588 - RNA, 63 nt, hsa
gaaucugcugcauagcucuauuuuaaaguaaaagucuaccaccgaaucccuagucccccuguu

SEQ ID NO: 500589 - RNA, 63 nt, hsa
guaacuaugacugacguccccagaaguuucugggucuaccacacuccccaaccccccacuccu

SEQ ID NO: 500590 - RNA, 53 nt, hsa; identical to SEQ ID NO: 500486

SEQ ID NO: 500591 - RNA, 63 nt, hsa
ugaguuggacuucagucuugccuaggcgauuuugucuaccauuuguguuuugaaagcccaagg

SEQ ID NO: 500592 - RNA, 63 nt, hsa
caaaauacuugucuguuuuaaaaaccuguucaagucuaccaaccuguucaagucuaccaauua

SEQ ID NO: 500593 - RNA, 63 nt, hsa
uaaaaaccuguucaagucuaccaaccuguucaagucuaccaauuauaagggcaaauuggagaa

SEQ ID NO: 500594 - RNA, 63 nt, hsa
gauuugccuacucauagggacuuugccuauuaagucuaccaaauuaaaagucuuaucauucag

SEQ ID NO: 500595 - RNA, 63 nt, hsa
ggggagcaguguugaugccaaaauacccacggggucuaccagccaugggguuugcuugcuuag

SEQ ID NO: 500596 - RNA, 63 nt, hsa
cagauccuggaaaucaggguuaguauuguccaggucuaccaaaaaucucaauauuucagauaa

SEQ ID NO: 500597 - RNA, 63 nt, hsa
uguccucaucuggagccugaagggucaagugcugucuaccaucaacaccaaccagaugaacaa

SEQ ID NO: 500598 - RNA, 63 nt, hsa
uuuuauauauaacuagcugcuauucaaaugugagucuaccauuuuuaauuuaugguucaacug

SEQ ID NO: 500599 - RNA, 63 nt, hsa
agaacaaagaacaauaucccaaagaggcccugugucuaccaggagcuucuuuuuccaaaugua

SEQ ID NO: 500600 - RNA, 63 nt, hsa
cgucuggccaaugauucuuuuacuuaccuaucugucuaccaguagcgguccuugcccauuugg

SEQ ID NO: 500601 - RNA, 63 nt, hsa
ccucccuugccccauuaucuuuucaccucccaggucuaccauuucaugguggucguugggucc

SEQ ID NO: 500602 - RNA, 63 nt, hsa
cagcagccagccagcagccucucccaggcgggagucuaccauccgagacggcgaugacaaaga

SEQ ID NO: 500603 - RNA, 63 nt, hsa
aggaaggccaggagcccaguagccauguggccagucuaccauggggcccaggaguuggggaaa

SEQ ID NO: 500604 - RNA, 53 nt, hsa; identical to SEQ ID NO: 500500

SEQ ID NO: 500605 - RNA, 63 nt, hsa
ccauggaggauugccugugaggaacuuaaacgagucuaccagugucuagacacgggggcaggu

SEQ ID NO: 500606 - RNA, 63 nt, hsa
uuccaggaaacccaagaggcugagaauucuuuugucuaccauagaauuauuauccagacugga

SEQ ID NO: 500607 - RNA, 63 nt, hsa
ggauggcgcaugcaugggaggaauucaucuucagucuaccagcccccgcugugucggauacac

SEQ ID NO: 500608 - RNA, 63 nt, hsa
auuuugugaaaagcagugguauguguacguguugucuaccaguacacaggcugcagaagacag

SEQ ID NO: 500609 - RNA, 63 nt, hsa
gucuccgaguacugcagaacugacauuuugacggucuaccagcguggcggcugguguugguca

SEQ ID NO: 500610 - RNA, 63 nt, hsa
ucuccagucuccuggaggugggacuggacaggagucuaccagcuuguuuugagacucaugaaa

SEQ ID NO: 500611 - RNA, 63 nt, hsa
aauauuuucuuuaucuaaauauuaacauucuaagucuaccaaaaaaaguuuuaaacucaagca

SEQ ID NO: 500612 - RNA, 63 nt, hsa
agaugaauauuaacauggagggcuuugccugaugucuaccagaagcccuguguguggauggug

SEQ ID NO: 500613 - RNA, 63 nt, hsa
gagccaccccugcuuucuggccaucucuucuuugucuaccauuucaaauugacuugugaauac

SEQ ID NO: 500614 - RNA, 63 nt, hsa
cccauugcaaaggggagggaggggcagggagcugucuaccagcugagguccucccaaaacugg

SEQ ID NO: 500615 - RNA, 63 nt, hsa
acguggagugagcaagacagggcuuaccauccugucuaccagaugaggaaauggcaguucuga

SEQ ID NO: 500616 - RNA, 63 nt, hsa
aagguuuuuuuguaguguaaugucuuaaucauagucuaccaucaaauauuuuaggaguaucuu

SEQ ID NO: 500617 - RNA, 63 nt, hsa
cggugguaaucaucugggggcccugguuuucuugucuaccagauaaaccaaaacugggaaggc

SEQ ID NO: 500618 - RNA, 63 nt, hsa
aauucacauuauauuggaaugaacaauucacaugucuaccacaagucuguaaacauaaccuua

SEQ ID NO: 500619 - RNA, 63 nt, hsa
uuugcaaauucuguaauuucacucaacgauuaagucuaccaaagaacacacugcauguaaaag

SEQ ID NO: 500620 - RNA, 63 nt, hsa
uagggguacgaaaguaggaugagagccuucaaagucuaccagcacaaagaccccugagccccg

SEQ ID NO: 500621 - RNA, 63 nt, hsa
uaacuguuaucaucagcugccauuucugauagggucuaccacaucuguaaugucuguccuuuc

SEQ ID NO: 500622 - RNA, 63 nt, hsa
uuuuuuaauugccuuugagaauaaacucauaaggucuaccaagaaaauaaauguuaugauguu

SEQ ID NO: 500623 - RNA, 63 nt, hsa
ucagcccaccuuaaagguguaggcacccacugggucuaccaguaugcagguugggauacugaa

SEQ ID NO: 500624 - RNA, 63 nt, hsa
aauugguuuuauuuuuuucuuaaaaaaaaaaaagucuaccaaaggaauuugcauccagcagca

SEQ ID NO: 500625 - RNA, 63 nt, hsa
ucaacacgucuuuuauucaaaauaacaggcuuugucuaccaagaaaugaauuggauaauccac

SEQ ID NO: 500626 - RNA, 63 nt, hsa
acaguccccuccugccugcuccuguccagccaggucuaccacccaccccaccccucuucuccg

SEQ ID NO: 500627 - RNA, 63 nt, hsa
auauucuuagaagggguguguaugucuagcugugucuaccauguguauguauucuugacaagc

SEQ ID NO: 500628 - RNA, 63 nt, hsa
cauggcaccuagaaaugcaugccagcuuccugcgucuaccacucugcagcucaaacaagaagc

SEQ ID NO: 500629 - RNA, 63 nt, hsa
gaggccagccugggcaacauggugaaacccggugucuaccaaaaauacaaaauguauccagac

SEQ ID NO: 500630 - RNA, 63 nt, hsa
aauagagcagaggguuucugcugucuccagacugucuaccaaagagaaggcgacagaugccuc

SEQ ID NO: 500631 - RNA, 63 nt, hsa
cuggcucccaucaccucuaacauccuugucugggucuaccaggaacgcuucauuuccuugggg

SEQ ID NO: 500632 - RNA, 63 nt, hsa
gacccuccucgucugcaugguaacuccgucugagucuaccauuuucuugcucucccuccuucc

SEQ ID NO: 500633 - RNA, 63 nt, hsa
auacauagugucaugugcucagugguugccaaagucuaccaacuuuggggagcugcaggguuc

SEQ ID NO: 500634 - RNA, 63 nt, hsa
uuguuccgagcacgaagaaacagcagcagggaugucuaccagccaccucucaccgcugccauu

SEQ ID NO: 500635 - RNA, 63 nt, hsa
ggucugggggucaggaggcaggguuuuaucucugucuaccaucucccucgaacccacacugca

SEQ ID NO: 500636 - RNA, 63 nt, hsa
cacagugaaggguggacaaaacucgacugcugcgucuaccaaguacgaugucuucagacaacu

SEQ ID NO: 500637 - RNA, 63 nt, hsa
ccacugcucacuuuguggaugguagcaugagcugucuaccaagaagaaaccugcugcucucuu

SEQ ID NO: 500638 - RNA, 63 nt, hsa
guuuguaaugaaagucuacagccaauuuuacuugucuaccaccguguugugcucaaagagaca

SEQ ID NO: 500639 - RNA, 63 nt, hsa
auuuugaaaauuagucaaaauggacucuuuucagucuaccauaaguuaauauaacugauaccu

SEQ ID NO: 500640 - RNA, 63 nt, hsa
uauuauuuauagauuuucuacaaauaaauauuugucuaccaaguaaaauauuuugacugaaau

SEQ ID NO: 500641 - RNA, 63 nt, hsa
agagauauauacacuuuugauuguuuucuagaugucuaccaauaaaugcaauuugugaccugu

SEQ ID NO: 500642 - RNA, 63 nt, hsa
aucauuuuguggcaagccuuaaguuaacaaugugucuaccaagaacaauugaguuuucuaaaa

SEQ ID NO: 500643 - RNA, 63 nt, hsa
cacugacaguuucugaggcagaagccguaucaugucuaccaccugugagguccacacagugug

SEQ ID NO: 500644 - RNA, 63 nt, hsa
gggaaucuacucagagccugugugugcugcccagucuaccaaauaauuuauauacaucucagu

SEQ ID NO: 500645 - RNA, 63 nt, hsa
gggguccggggaagggcagaggucaccaggcuggucuaccagguaguuggggaggguccccag

SEQ ID NO: 500646 - RNA, 63 nt, hsa
auacaugcacaacacauauacaauacuagugaugucuaccaguccugcuacuucuggggugcc

SEQ ID NO: 500647 - RNA, 63 nt, hsa
gauaaacucauaugcacuaaacaugcuauucaagucuaccaaacauccaggcagugaaagaag

SEQ ID NO: 500648 - RNA, 63 nt, hsa
uaacaaugaaggaaacucuaaacuccccuuauggucuaccaguaauucauacuugaggaccau

SEQ ID NO: 500649 - RNA, 63 nt, hsa
uagcaacguggcuuuuuuuuuuucccuuccugggucuaccacucagagaaacaauggcuaaga

SEQ ID NO: 500650 - RNA, 63 nt, hsa
guguucgggggccucuggcugcugaaggauucggucuaccacggagggcugugcuguuaggcu

SEQ ID NO: 500651 - RNA, 63 nt, hsa
uacacuaaugcacuuaggauguuucugcaucaugucuaccagggagcaggguuccccacaguu

SEQ ID NO: 500652 - RNA, 63 nt, hsa
gagcgccggguggacuggcuguuccgaggggccgucuaccacuccuaccucaccaucuucggg

SEQ ID NO: 500653 - RNA, 63 nt, hsa
gaaucacuuuaaaccaaugccuauaaaaagcaagucuaccaaaauaaacuaagacuuucuaug

SEQ ID NO: 500654 - RNA, 63 nt, hsa
ccuucagccagaagacugacaaagucauccuccgucuaccagagcgugcacuugugauccuaa

SEQ ID NO: 500655 - RNA, 63 nt, hsa
auguucuuguucugugucacucggcccuggguagucuaccauuuacuucaccccaaguccugc

SEQ ID NO: 500656 - RNA, 63 nt, hsa
cuacagcaccucucagacagccggcacguggcugucuaccacaagggacgcuucuucaagcug

SEQ ID NO: 500657 - RNA, 63 nt, hsa
cuuuguaaauuauuuuaugucauaguuuaauuggucuaccaaguaagacaucucaaauacagu

SEQ ID NO: 500658 - RNA, 63 nt, hsa
ggcaagugugugccugugugccgaggagauggcgucuaccagaaggggauggacuucauuuug

SEQ ID NO: 500659 - RNA, 64 nt, hsa; identical to SEQ ID NO: 130660

SEQ ID NO: 500660 - RNA, 64 nt, hsa; identical to SEQ ID NO: 130661

SEQ ID NO: 500661 - RNA, 64 nt, hsa; identical to SEQ ID NO: 130662

SEQ ID NO: 500662 - RNA, 64 nt, hsa; identical to SEQ ID NO: 130663

SEQ ID NO: 500663 - RNA, 64 nt, hsa; identical to SEQ ID NO: 130664

SEQ ID NO: 500664 - RNA, 64 nt, hsa; identical to SEQ ID NO: 130665

SEQ ID NO: 500665 - RNA, 64 nt, hsa; identical to SEQ ID NO: 130666

SEQ ID NO: 500666 - RNA, 64 nt, hsa; identical to SEQ ID NO: 130667

SEQ ID NO: 500667 - RNA, 64 nt, hsa; identical to SEQ ID NO: 130668

SEQ ID NO: 500668 - RNA, 64 nt, hsa; identical to SEQ ID NO: 130669

SEQ ID NO: 500669 - RNA, 64 nt, hsa; identical to SEQ ID NO: 130670

SEQ ID NO: 500670 - RNA, 64 nt, hsa; identical to SEQ ID NO: 130671

SEQ ID NO: 500671 - RNA, 64 nt, hsa; identical to SEQ ID NO: 130672

SEQ ID NO: 500672 - RNA, 64 nt, hsa; identical to SEQ ID NO: 130673

SEQ ID NO: 500673 - RNA, 64 nt, hsa; identical to SEQ ID NO: 130674

SEQ ID NO: 500674 - RNA, 64 nt, hsa; identical to SEQ ID NO: 130675

SEQ ID NO: 500675 - RNA, 64 nt, hsa; identical to SEQ ID NO: 130676

SEQ ID NO: 500676 - RNA, 64 nt, hsa; identical to SEQ ID NO: 130677

SEQ ID NO: 500677 - RNA, 64 nt, hsa; identical to SEQ ID NO: 130678

SEQ ID NO: 500678 - RNA, 64 nt, hsa; identical to SEQ ID NO: 130679

SEQ ID NO: 500679 - RNA, 64 nt, hsa; identical to SEQ ID NO: 130680

SEQ ID NO: 500680 - RNA, 64 nt, hsa; identical to SEQ ID NO: 130681

SEQ ID NO: 500681 - RNA, 64 nt, hsa; identical to SEQ ID NO: 130682

SEQ ID NO: 500682 - RNA, 64 nt, hsa; identical to SEQ ID NO: 130683

SEQ ID NO: 500683 - RNA, 64 nt, hsa; identical to SEQ ID NO: 130684

SEQ ID NO: 500684 - RNA, 64 nt, hsa; identical to SEQ ID NO: 130685

SEQ ID NO: 500685 - RNA, 64 nt, hsa; identical to SEQ ID NO: 130686

SEQ ID NO: 500686 - RNA, 64 nt, hsa; identical to SEQ ID NO: 130687

SEQ ID NO: 500687 - RNA, 64 nt, hsa; identical to SEQ ID NO: 130688

SEQ ID NO: 500688 - RNA, 64 nt, hsa; identical to SEQ ID NO: 130689

SEQ ID NO: 500689 - RNA, 64 nt, hsa; identical to SEQ ID NO: 130690

SEQ ID NO: 500690 - RNA, 64 nt, hsa; identical to SEQ ID NO: 130691

SEQ ID NO: 500691 - RNA, 64 nt, hsa; identical to SEQ ID NO: 130692

SEQ ID NO: 500692 - RNA, 64 nt, hsa; identical to SEQ ID NO: 130693

SEQ ID NO: 500693 - RNA, 64 nt, hsa; identical to SEQ ID NO: 130694

SEQ ID NO: 500694 - RNA, 64 nt, hsa; identical to SEQ ID NO: 130695

SEQ ID NO: 500695 - RNA, 64 nt, hsa; identical to SEQ ID NO: 130696

SEQ ID NO: 500696 - RNA, 64 nt, hsa; identical to SEQ ID NO: 130697

SEQ ID NO: 500697 - RNA, 64 nt, hsa; identical to SEQ ID NO: 130698

SEQ ID NO: 500698 - RNA, 64 nt, hsa; identical to SEQ ID NO: 130699

SEQ ID NO: 500699 - RNA, 64 nt, hsa; identical to SEQ ID NO: 130700

SEQ ID NO: 500700 - RNA, 64 nt, hsa; identical to SEQ ID NO: 130701

SEQ ID NO: 500701 - RNA, 64 nt, hsa; identical to SEQ ID NO: 130702

SEQ ID NO: 500702 - RNA, 64 nt, hsa; identical to SEQ ID NO: 130703

SEQ ID NO: 500703 - RNA, 64 nt, hsa; identical to SEQ ID NO: 130704

SEQ ID NO: 500704 - RNA, 64 nt, hsa; identical to SEQ ID NO: 130705

SEQ ID NO: 500705 - RNA, 64 nt, hsa; identical to SEQ ID NO: 130706

SEQ ID NO: 500706 - RNA, 64 nt, hsa; identical to SEQ ID NO: 130707

SEQ ID NO: 500707 - RNA, 64 nt, hsa; identical to SEQ ID NO: 130708

SEQ ID NO: 500708 - RNA, 64 nt, hsa; identical to SEQ ID NO: 130709

SEQ ID NO: 500709 - RNA, 63 nt, hsa
ggugacgggagguguccuggcugcuccaggacaaaagacaaucgucucugugggugccgggug

SEQ ID NO: 500710 - RNA, 63 nt, hsa
ccuguaaaaacaaaacaaacaaaacaaaacaaaaaagacaaaaccuaaaacugagcuaucuaa

SEQ ID NO: 500711 - RNA, 63 nt, hsa
cauucgaaaucagcuguacugugugaacgaaauaaagacaauaauacgaaccccucucuggcu

SEQ ID NO: 500712 - RNA, 63 nt, hsa
gcuuaggcaauacagcgagaccuugucucaaaaaaagacaaaaaaaacaaaaagaaauguaga

SEQ ID NO: 500713 - RNA, 63 nt, hsa
uuuuugaauauacauucuauaaaagauuauuugaaagacaaaauucauagaaaauggagcaaa

SEQ ID NO: 500714 - RNA, 63 nt, hsa
cucauccugggugggacgauggcuccugccuugaaagacaaaaaucccaccuugggcagagcu

SEQ ID NO: 500715 - RNA, 63 nt, hsa
guacauauuggagcucugggagaugcuggaauaaaagacaagaguuacaucuggacuuggauu

SEQ ID NO: 500716 - RNA, 63 nt, hsa
ugaaguacugcccaaguuaaauauugauagccuaaagacaaguuuauguaguacuuaauguac

SEQ ID NO: 500717 - RNA, 63 nt, hsa
aauaaaacuuugcuauguauuuacucuuuuuuaaaagacaaaagcaaaaccagacuuucuacg

SEQ ID NO: 500718 - RNA, 63 nt, hsa
acuccccucaggacccuaccccacccucuuugaaaagacaaagcucugccuacauagaagacu

SEQ ID NO: 500719 - RNA, 63 nt, hsa
cauaguacuaauaauuaaauuuucaguauuuaaaaagacaaaguauuuuguccauuugagauu

SEQ ID NO: 500720 - RNA, 63 nt, hsa
ggcuguuggguagaagugguggugggggggacaaaagacaaaaaaauccaccagagcuuugua

SEQ ID NO: 500721 - RNA, 63 nt, hsa
aauauugugaaaagcuuuuaaaaguuguuuugaaaagacaaucauuuuuuguuuuuguuuuaa

SEQ ID NO: 500722 - RNA, 63 nt, hsa
gcugaugaugcuaauggagaugaugguaaugauaaagacaacaacaaugauuaucaaguuccu

SEQ ID NO: 500723 - RNA, 63 nt, hsa
gagaauucaaaaacauccuugcagaaugauucaaaagacaaaagccaggcucaacuuauagaa

SEQ ID NO: 500724 - RNA, 63 nt, hsa
gauuggaaaggcugcgacagccccccaaacaggaaagacaaaaaacaaacaaaucaaccgacc

SEQ ID NO: 500725 - RNA, 63 nt, hsa
uucuaggcagacccucuuucuccuucgggacagaaagacaaugugaguucauuuuccuccauc

SEQ ID NO: 500726 - RNA, 63 nt, hsa
cuaauaucugagcaucuuuuagacaagagaggcaaagacaaacuggauuuaauggcccaacau

SEQ ID NO: 500727 - RNA, 63 nt, hsa
uaaaggcugaauguaggauucuucaguauguggaaagacaaggauucaacguguggucauaug

SEQ ID NO: 500728 - RNA, 63 nt, hsa
uuuaggcacagaaguuggagaagagauuucaugaaagacaacaucacugcauugagagaauag

SEQ ID NO: 500729 - RNA, 63 nt, hsa
aaacuggucuacugugucucuaggguuaagccaaaagacaaaaaaaauuuuacuacuuuugag

SEQ ID NO: 500730 - RNA, 63 nt, hsa
aaggccuuaaugaccucauaggcacucuuccaaaaagacaacagaacuggaaugagaggccug

SEQ ID NO: 500731 - RNA, 63 nt, hsa
gaggaaugccuucuccuaagagucaguugaaagaaagacaagagagucacaucuuagcuuuug

SEQ ID NO: 500732 - RNA, 63 nt, hsa
uggaagaccuaaggcagacaggaaggaagcacaaaagacaagcauugggucagacccauaaac

SEQ ID NO: 500733 - RNA, 63 nt, hsa
aaauaugaaagaacaaagguuauuuccuggagaaaagacaauuuauucaacaccaacgaggga

SEQ ID NO: 500734 - RNA, 62 nt, hsa
uaggaacugaccccaacaauaaacuuugauaauaaagacaauaggcuauggugauuuuauuu

SEQ ID NO: 500735 - RNA, 63 nt, hsa
ggaaguccuauuuuauuuaaucaguaucaguaaaaagacaaaaauuacagugugaacaagaga

SEQ ID NO: 500736 - RNA, 63 nt, hsa
uacagauuuuggcgggggaggggggaccuuuucaaagacaauagggggucuugacauguuugu

SEQ ID NO: 500737 - RNA, 63 nt, hsa
acuugaaugauuuaggaaaugagugugugcaccaaagacaaaaagauauugucuauuguuugu

SEQ ID NO: 500738 - RNA, 63 nt, hsa
aaggaucuggaccccaaagaauagacuggauggaaagacaaacugcacaggcagauguuugcc

SEQ ID NO: 500739 - RNA, 63 nt, hsa
gcaauguaaaauauauauauauuuaccuuuuuuaaagacaauggaaauuccaaguagcuaaaa

SEQ ID NO: 500740 - RNA, 63 nt, hsa
uuccaacugaucuauccauauuccuuaaguacuaaagacaaaauagagggcuucuuuuucucu

SEQ ID NO: 500741 - RNA, 63 nt, hsa
aguaguaguauguuuguaagcuauucugacagaaaagacaaagguuacuaauuguaugauagu

SEQ ID NO: 500742 - RNA, 63 nt, hsa
cuauccaaucugugaugacauucccugcuaauaaaagacaacauaacucaagucuggcagacu

SEQ ID NO: 500743 - RNA, 63 nt, hsa
ccucagccugcaaggguccgauuugccaucgaaaaagacaaccucuacuuuuuucuuuuguau

SEQ ID NO: 500744 - RNA, 63 nt, hsa
cuucugauuuuuaugugaccauagcuaugauguaaagacaauacuguccuucagagaacuggu

SEQ ID NO: 500745 - RNA, 63 nt, hsa
cuguuugcaaugucuuauuaaaaaacaacaaaaaaagacaaauggaacaaagaagcugugacc

SEQ ID NO: 500746 - RNA, 63 nt, hsa
cccugggcaguauagagacgucggacuucacgaaaagacaacuggcagugcagaguuuagcau

SEQ ID NO: 500747 - RNA, 63 nt, hsa
gauuacaaaguuuuucuucuuuaaccaaaaaggaaagacaacgguuugugugcacuucccgac

SEQ ID NO: 500748 - RNA, 57 nt, hsa
aggcaccuccuggugucuaacucccccaaagacaaugaguuaagggagagaauaaga

SEQ ID NO: 500749 - RNA, 63 nt, hsa
uucuuuucacuuugaaaauauaaagaacaaaauaaagacaaacauugcaaguuuaaaagaaag

SEQ ID NO: 500750 - RNA, 63 nt, hsa
uagagcaauaaccacuuuuuaaauguaaaauaaaaagacaaaugaaaaggcacauccuugucu

SEQ ID NO: 500751 - RNA, 63 nt, hsa
gagugaggcugaaggcuggguuugaaaaggcaaaaagacaagacauccaggcagggcuucucu

SEQ ID NO: 500752 - RNA, 63 nt, hsa
accaucccaugaggaaaaaaaaaaaaguaaaacaaagacaaaaaaaaucuuuuguacagagau

SEQ ID NO: 500753 - RNA, 63 nt, hsa
agccauggcacccggucuugguuuauauuuuaaaaagacaacuguguagcugggcgugguggu

SEQ ID NO: 500754 - RNA, 63 nt, hsa
uugggaaucaaagaaaauggaacuucuuuuugaaaagacaagcaaccauguuaacuguauuga

SEQ ID NO: 500755 - RNA, 63 nt, hsa
agaagcgugcugaauaggauucuucucaguuugaaagacaaugaaaaaugguuuuguaugacu

SEQ ID NO: 500756 - RNA, 63 nt, hsa
ccagccuugaggagagcagaagccuccauuuuuaaagacaauaaagaccuccaaggguacuuc

SEQ ID NO: 500757 - RNA, 63 nt, hsa
uuuagguuuugugauagaaugggauuugaugaaaaagacaaccaaaggaaaauggggaggcuu

SEQ ID NO: 500758 - RNA, 63 nt, hsa
aaagugaggcucgccugcauagcuaauccuguuaaagacaacuucucaaagcacaacgugcuu

SEQ ID NO: 500759 - RNA, 63 nt, hsa
ugcucauucugaaauuuaagcauuuuucuuuuaaaagacaaguguaauagacaucuaaaauuc

SEQ ID NO: 500760 - RNA, 63 nt, hsa
cucucaaagggugagauuugaaauuuacacuaaaaagacaacuuuacauuuaaugcuucacuu

SEQ ID NO: 500761 - RNA, 63 nt, hsa
acauuauuccuagaaaagauuuaaggaaagcaaaaagacaacugguaagauuaagaagccauu

SEQ ID NO: 500762 - RNA, 63 nt, hsa
ucuugugccauauucugucuuuuuauuacuuauaaagacaaaccaaaguaaaucugaaaggag

SEQ ID NO: 500763 - RNA, 63 nt, hsa
gcugacuaaagacuguguguguugugguaacacaaagacaauuuuguaaguuugcgcuucagu

SEQ ID NO: 500764 - RNA, 50 nt, hsa
acauccggcaagacuucugaaaagacaauuuagcagguagaagaaaaguu

SEQ ID NO: 500765 - RNA, 63 nt, hsa
cuuaaacauguggacccauaggugcaguuagaaaaagacaaccuauuuuuauuuauguuagaa

SEQ ID NO: 500766 - RNA, 63 nt, hsa
uccaaauaaacccugaauauuuaguaaguuuaaaaagacaaauugagaacaaguagacacacu

SEQ ID NO: 500767 - RNA, 63 nt, hsa
uggaaagagggagaaagagaagcugaacaggagaaagacaaacagaaagaauagagaacagga

SEQ ID NO: 500768 - RNA, 63 nt, hsa
uuuuuauauuauguuaaaguaaagaaaugcauaaaagacaagcacuuuggaagaauuauuuua

SEQ ID NO: 500769 - RNA, 63 nt, hsa
ggagcuaauuguucaagaaguguugaacuuuaaaaagacaagaccacuuguugaaauccagcg

SEQ ID NO: 500770 - RNA, 63 nt, hsa
cauuguuaaugugagaacauuucugaagaugggaaagacaaauuauguagcucacaaacuggu

SEQ ID NO: 500771 - RNA, 63 nt, hsa
agaaauaggaaagucaucuaugaauucaucaugaaagacaagcaauccaucaugaaauucguu

SEQ ID NO: 500772 - RNA, 63 nt, hsa
gaucuuggguccuaucccuucccggaugauccgaaagacaagaaagcagaaauauuuuuaccg

SEQ ID NO: 500773 - RNA, 63 nt, hsa
gagcuucugggccuuagcaccuucgauuuccucaaagacaacaacuaccugcccuaccccauc

SEQ ID NO: 500774 - RNA, 63 nt, hsa
ggugaugcuuucuuaguauucuacacaauaagaaaagacaaaguccucgagauucuuaugagu

SEQ ID NO: 500775 - RNA, 63 nt, hsa
ggugggggccucucuggaagcacauuuggagggaaagacaagagagccaugaggagagggcug

SEQ ID NO: 500776 - RNA, 63 nt, hsa
caccccugccuuuuuuuuuuuuuuuuuaaagaaaaagacaaaagaaaguggaagugguauucc

SEQ ID NO: 500777 - RNA, 63 nt, hsa
ucuuugguauuucaaaagggagaaaccacuauaaaagacaagaggaagggcagguacuaggug

SEQ ID NO: 500778 - RNA, 63 nt, hsa
auaaugcaugcauaauuuaaauggucaauuuauaaagacaaaucuaugaaugaauuuuucagu

SEQ ID NO: 500779 - RNA, 63 nt, hsa
gaguguccgaggucauaagcaauuggaaaagggaaagacaaaguagugggagcugaucaaacg

SEQ ID NO: 500780 - RNA, 63 nt, hsa
acaaagcagaauaguauuuuuauauuuaaauguaaagacaaaaaacuauauguaugguuuugu

SEQ ID NO: 500781 - RNA, 63 nt, hsa
acggccagaaagggccaggugggaccugaaagcaaagacaauguucuuuaccacacguuucac

SEQ ID NO: 500782 - RNA, 63 nt, hsa
uauaaucaaagaauuuucuguacauauuucacuaaagacaaguuuuugggcuggaugugguag

SEQ ID NO: 500783 - RNA, 63 nt, hsa
gcacaaaaugaaugaauaaauaaauaaaugaauaaagacaaaagccaagguguaugcucucaa

SEQ ID NO: 500784 - RNA, 63 nt, hsa
gaauuuuugcuuuaguauuuuaauaagaauuacaaagacaauggcauacuuggggugagaggg

SEQ ID NO: 500785 - RNA, 51 nt, hsa
gccaccguaaacuacauuagaaaagacaauuuuuuuucaaaugugcaauuu

SEQ ID NO: 500786 - RNA, 63 nt, hsa
agggaauagcccaaauguuuuaaacgcaaaaaaaaagacaaaaaaaaaccaaaaaaaaaaaac

SEQ ID NO: 500787 - RNA, 63 nt, hsa
gguccgguggagacugaccacccugcuugagccaaagacaaggugaugagagauggggagagg

SEQ ID NO: 500788 - RNA, 63 nt, hsa
ccuggccaacguggugaaagccuguaucuauuaaaagacaaaaauuagcugggcgugguagua

SEQ ID NO: 500789 - RNA, 63 nt, hsa
uuuaucuagaauggauucaacacugugcacggaaaagacaagagguaggucagggaggugggg

SEQ ID NO: 500790 - RNA, 63 nt, hsa
ucuguauuuccugcauuuccaucauccuaguaaaaagacaacaacccacaggauuggaauggu

SEQ ID NO: 500791 - RNA, 63 nt, hsa
gauuccuuaauaauuagucacuagagacagcccaaagacaaauauugggcaggaaaucaguuc

SEQ ID NO: 500792 - RNA, 63 nt, hsa
ugaccuugcuuuguuaauaauaucuuuaaaaacaaagacaauccuuaaagcuuugcuccucac

SEQ ID NO: 500793 - RNA, 63 nt, hsa
uguuucuaauuuuuuuuuuguugucgugugagcaaagacaaacauaaauugaaaaacauccug

SEQ ID NO: 500794 - RNA, 63 nt, hsa
uagagaauacaacaaagaguucuaagacuuagaaaagacaauuuuguggugucauuucaucca

SEQ ID NO: 500795 - RNA, 63 nt, hsa
acauagcgaauacaaaauuggaagcugucauaaaaagacaacucagaggccaggcgcaggggc

SEQ ID NO: 500796 - RNA, 63 nt, hsa
gacacagcagcuggugguuuuguguauaccuguaaagacaagcugagaagcuuacuuuuuggg

SEQ ID NO: 500797 - RNA, 63 nt, hsa
uuuaaagagaaaaaauauguguauaucauggaaaaagacaaggauauuuuaauaaaacauuac

SEQ ID NO: 500798 - RNA, 63 nt, hsa
cucgcauucuguuucuugcuuuaaaagaagaguaaagacaagaguguuggaccaguauugcag

SEQ ID NO: 500799 - RNA, 63 nt, hsa
ucugauuuuuuuuuucagaaauaauguuuuuuaaaagacaaaaacaaagggaagaauauuuaa

SEQ ID NO: 500800 - RNA, 63 nt, hsa
uuguaaacguuacuuaacacaguauaaagaugaaaagacaacaaaaguaucuucauacuuccu

SEQ ID NO: 500801 - RNA, 63 nt, hsa
uggaggcaaaauuuagaccaguauacuaauucaaaagacaaauauuucagaggaaguggagua

SEQ ID NO: 500802 - RNA, 63 nt, hsa
agguggaaaauggacuggcuuggccacaaccugaaagacaaaauaaacauuuuauuuucuaaa

SEQ ID NO: 500803 - RNA, 63 nt, hsa
cuggccaacaugacgaaaccccaucucuacuaaaaagacaaaaaauuagcugggcaugguggc

SEQ ID NO: 500804 - RNA, 63 nt, hsa
aggggcuuuucucugagccuccuucaucugcccaaagacaaauccucaaaaggaaauucaauc

SEQ ID NO: 500805 - RNA, 63 nt, hsa
gguggagucacuaauaaauuugcaaaugaaguuaaagacaaggcaaccaucuggcuuaugcua

SEQ ID NO: 500806 - RNA, 63 nt, hsa
aaaaaaaggaaguuaagucaucagaggcccaugaaagacaauuuuauuauuuuagaagaaaau

SEQ ID NO: 500807 - RNA, 63 nt, hsa
gacagaggaaaacaucacaagccaauggggcucaaagacaaaucccacauguucucaaggccg

SEQ ID NO: 500808 - RNA, 63 nt, hsa
auggauaaaauugggucuuucuggcuaauuaaaaaagacaacuuuauaaaauggcacuuuaag

SEQ ID NO: 500809 - RNA, 63 nt, hsa
uuaucaucccuaacuauugcaacuugaccuuaaaaagacaaaaccccacaaaacucuuccugc

SEQ ID NO: 500810 - RNA, 63 nt, hsa
uccugggaucacugaugacuuuuuauacuuuguaaagacaauuguuggagagccccucacaca

SEQ ID NO: 500811 - RNA, 63 nt, hsa
uaccaugaacaguguguugcuucagacuauuacaaagacaacuggggcagguacucuaauaua

SEQ ID NO: 500812 - RNA, 63 nt, hsa
gggcuucucuccuugaugcuucuuucuuuuuuuaaagacaaccugccauuaccacaugacuca

SEQ ID NO: 500813 - RNA, 63 nt, hsa
agucccagggaaagagaaccaugccaugcugaaaaagacaaaauugaagaagaaauguagccc

SEQ ID NO: 500814 - RNA, 63 nt, hsa
auuuuaaagucaaguugugagcaaauagaaauaaaagacaaaaggacaucacucuuaucaaau

SEQ ID NO: 500815 - RNA, 63 nt, hsa
cuuuuuuauaaaaaaagagagaugggggagaaaaaagacaagagggaaaguauuucucuugau

SEQ ID NO: 500816 - RNA, 63 nt, hsa
cugauuuuuuuucugauaaauucuuucuuugagaaagacaauuuuaauguuuacaacaauaaa

SEQ ID NO: 500817 - RNA, 63 nt, hsa
gaugguuggccauuugagucuuuguaaccuaggaaagacaaaggucugauucagauugcaugg

SEQ ID NO: 500818 - RNA, 63 nt, hsa
acagauaaagauuuuguuuugcccugcaaauaaaaagacaauuccuuauugucugaauguaau

SEQ ID NO: 500819 - RNA, 63 nt, hsa
caguggaaaacuccaguuguaaugcauauuuuuaaagacaauuuggaucuaaauauguauuuc

SEQ ID NO: 500820 - RNA, 63 nt, hsa
uuucuuuuaaaauaaacagcugggaccaucccaaaagacaagccaugcauacaacuuugguca

SEQ ID NO: 500821 - RNA, 63 nt, hsa
uuauuacaucuuucacauuggcuauuuaaagacaaagacaaauucuguuucuugagaagagaa

SEQ ID NO: 500822 - RNA, 63 nt, hsa
uguauuuuauuacaucuuucacauuggcuauuuaaagacaaagacaaauucuguuucuugaga

SEQ ID NO: 500823 - RNA, 63 nt, hsa
guauaugcaagugguauguguguaauuauggcuaaagacaaaccauuauucagugaauuacua

SEQ ID NO: 500824 - RNA, 63 nt, hsa
uauacuguaugugccaaagcuuuacuacuguggaaagacaacuguuuuaauaaaagauuuaca

SEQ ID NO: 500825 - RNA, 63 nt, hsa
ugcgggagcaacaaacagcucagggccaaaccaaaagacaaaaauuggaguaacguagaaugc

SEQ ID NO: 500826 - RNA, 63 nt, hsa
augauacaguggaccuggagaccauccccuuggaaagacaacccagagauguucagcauccug

SEQ ID NO: 500827 - RNA, 63 nt, hsa
aagcaguggagaagaggaagaccuggagcaauaaaagacaaaugcaacauuuuaaggcaaugg

SEQ ID NO: 500828 - RNA, 63 nt, hsa
ucaggaggacauggcacuaucuuuaaacgaaacaaagacaauuuauaauuugaauuuuaugcu

SEQ ID NO: 500829 - RNA, 63 nt, hsa
cucccagccccagguggaaggcucaguugucggaaagacaaaagcgauuucuucccacuccug

SEQ ID NO: 500830 - RNA, 63 nt, hsa
uucuuuuuaucuuuaguagacacuuuuaaaagaaaagacaaguuuguuguguuuaacucacca

SEQ ID NO: 500831 - RNA, 63 nt, hsa
uggcgguggggaccaagauccggaaagaugaauaaagacaaacaugacaaacuaagaaaacac

SEQ ID NO: 500832 - RNA, 63 nt, hsa
uuagauguacauuggcacuuggauuagauuccaaaagacaaaaguguugggugcuucuagcuu

SEQ ID NO: 500833 - RNA, 63 nt, hsa
accaaaaaagugaaagagaaauugaaagggaaaaaagacaaaaagcauaaggcuccaaaacga

SEQ ID NO: 500834 - RNA, 63 nt, hsa
uaugaugguucugcagccauugcaaacauuuuuaaagacaauuuaaugccauggggaaaugau

SEQ ID NO: 500835 - RNA, 63 nt, hsa
agggggcgaugucugcuggcccaggggaagggaaaagacaaaugucuugacuguugaccucgg

SEQ ID NO: 500836 - RNA, 63 nt, hsa
cccaggguucaggcccugucuaagguguugcuuaaagacaaaaaggcaacaugugccucacug

SEQ ID NO: 500837 - RNA, 63 nt, hsa
aaccaggcaacuuggaaucccuaaauucuguaaaaagacaauucaucucauugugaguggaag

SEQ ID NO: 500838 - RNA, 63 nt, hsa
acuguaauuuguguaguuuuucuuuuuuaacuuaaagacaacuuuaaaaaauacuuacauuaa

SEQ ID NO: 500839 - RNA, 63 nt, hsa
uuuacaauuaauguuuucuacaugucugucuucaaagacaacaugcuuuggaaacauaugucc

SEQ ID NO: 500840 - RNA, 63 nt, hsa
guugagugcaacaucauguauuaauaucaaaugaaagacaagggugcuguaucuuugauuauu

SEQ ID NO: 500841 - RNA, 63 nt, hsa
uuaauuuuagaguggucuuggauuacuaaagauaaagacaaagcacauuuucuagaaugaacu

SEQ ID NO: 500842 - RNA, 63 nt, hsa
gagguggcugaaaugugaugaaaagcaauacgaaaagacaauguaaacuuugaaaaggauuuu

SEQ ID NO: 500843 - RNA, 63 nt, hsa
uaauucuuuuaguugauagagauucauuuagucaaagacaaaagcuuuaacugugagggcaca

SEQ ID NO: 500844 - RNA, 63 nt, hsa
ucuuaaugccucucuaaagccaaaaaaaaaaaaaaagacaaagccucuuaauaaauuuaaugg

SEQ ID NO: 500845 - RNA, 63 nt, hsa
uccuuuauaucuguuuacaaaacugugaaucaaaaagacaaaacuuucuuccuaguuuuugua

SEQ ID NO: 500846 - RNA, 63 nt, hsa
acaauuuaugaugcaaauaauguaaaauguuuuaaagacaaauggcaaauaagauauggacca

SEQ ID NO: 500847 - RNA, 63 nt, hsa
gcugccgcuuauucauugccuugauuuucuucaaaagacaacuauaaucauucaaaaauucca

SEQ ID NO: 500848 - RNA, 63 nt, hsa
uacgugaauuuuuuagcuaagcuugacagauugaaagacaagugucauuuuuuuuuguagagg

SEQ ID NO: 500849 - RNA, 63 nt, hsa
aaucagagagugucacagauuuaaccuugaucuaaagacaaguuguacccagaguaugugaaa

SEQ ID NO: 500850 - RNA, 63 nt, hsa
aagacauccacauauugcauguuaaccagaagaaaagacaacauuuuccggaaauccacugca

SEQ ID NO: 500851 - RNA, 63 nt, hsa
auguucgucuauacccuaaguaaaaugaggacgaaagacaaauauuuugaaagccuaguccau

SEQ ID NO: 500852 - RNA, 63 nt, hsa
auaucaucaaugugacauuuacaccacacuuucaaagacaaucacugaaacaaaaauugucuu

SEQ ID NO: 500853 - RNA, 63 nt, hsa
uauucucugaagacaaccaagagaaaauugcaaaaagacaaguaugacuuuuauaugaacccc

SEQ ID NO: 500854 - RNA, 63 nt, hsa
augaaccagcaaguuguucauuuaaaacugaccaaagacaauuaauuccuggucuaguuuccu

SEQ ID NO: 500855 - RNA, 63 nt, hsa
aagaucguuucucuaaaauuaaaaaaaaaaaaaaaagacaaauaaaaauugcauguauuugua

SEQ ID NO: 500856 - RNA, 63 nt, hsa
augaucucaccacuuuaagaguuccagauggaaaaagacaaaaguuugcuucauccggggaug

SEQ ID NO: 500857 - RNA, 63 nt, hsa
caaacacugacauuaccuacacuuccacuacccaaagacaaaaugugcccacugugugcuuuu

SEQ ID NO: 500858 - RNA, 63 nt, hsa
gaaguuacacagaaaugcugcuggccaaauagcaaagacaaccugggaaggaaaggucuuugu

SEQ ID NO: 500859 - RNA, 63 nt, hsa
gaaaaaugaggggaacuucaauuaugauuuauuaaagacaauuucuauuacacccuccuuuau

SEQ ID NO: 500860 - RNA, 63 nt, hsa
caugaagucuacuugcagguucugaccaagaacaaagacaaccacaaccuaugacuggagcag

SEQ ID NO: 500861 - RNA, 63 nt, hsa
cuggaccucucuugugagccauagagauauuuaaaagacaaacaccuuauuugucggggaaga

SEQ ID NO: 500862 - RNA, 63 nt, hsa
ucaaccgacuuuguucuuccaaguccuaguggaaaagacaaaaaagaaacuaaguuacuuguc

SEQ ID NO: 500863 - RNA, 63 nt, hsa
uugugacagacuuaaaaacaacacauuauuuggaaagacaagccaugggaaagaaauauggcg

SEQ ID NO: 500864 - RNA, 63 nt, hsa
cuucauuuguuccauuccugauucuuggguaauaaagacaaacuuuguaccucucugugcuua

SEQ ID NO: 500865 - RNA, 63 nt, hsa
aagggcagagccuacaaaacauuguauauuucaaaagacaaaaagaagcagcagcaguaucuu

SEQ ID NO: 500866 - RNA, 63 nt, hsa
ucuauguuuucuuagaacauguggaagaaggaaaaagacaaaaaaggaaaucuggauucugag

SEQ ID NO: 500867 - RNA, 63 nt, hsa
aauuacagaaacauguuaaaggccggacaaaggaaagacaauaaaaucauaaauuaucggucc

SEQ ID NO: 500868 - RNA, 63 nt, hsa
caaaaaacaacacagucuacucuuucugcuuacaaagacaaagccuuacaaacucacuaugaa

SEQ ID NO: 500869 - RNA, 63 nt, hsa
aaauuuaaauaguaaauaaaacacaacauaaucaaagacaacucacucaggcaucuucuuucu

SEQ ID NO: 500870 - RNA, 63 nt, hsa
uaacaaugaaaaaaugagcaaacaaaaaaaucgaaagacaaacgggagagaaaaagaggaagg

SEQ ID NO: 500871 - RNA, 63 nt, hsa
agcagaacuauucagauugucaguaguaaauuuaaagacaaaugcccguuuuccuccagucca

SEQ ID NO: 500872 - RNA, 63 nt, hsa
uguuucuuuuguauguaaaugugcauucuuuuaaaagacaagacuucaguauguugucaaaga

SEQ ID NO: 500873 - RNA, 63 nt, hsa
auuguaaauacaaaauugcaugcgggauuguguaaagacaaugccagguuggacugccagaau

SEQ ID NO: 500874 - RNA, 63 nt, hsa
ccccaacacuaaaccuaaggacagcuacaaaggaaagacaacuggggaaagaagaccuaggac

SEQ ID NO: 500875 - RNA, 63 nt, hsa
guuugaaauaugugauaguaccugguugugaaaaaagacaaugaacugcuagugacauuccuc

SEQ ID NO: 500876 - RNA, 63 nt, hsa
uaacacccauuuuaaaauuuaaguuuuguccuuaaagacaacuucagugguuaauuauaaaag

SEQ ID NO: 500877 - RNA, 63 nt, hsa
acagcucccagcugggagaaaccaacaugacgaaaagacaaagaauacuggagaagagagagg

SEQ ID NO: 500878 - RNA, 63 nt, hsa
caaagagacucccacucagauucuaaagcauuuaaagacaauucuagcagaauuuaucaaaac

SEQ ID NO: 500879 - RNA, 63 nt, hsa
ugaaagcaauguucauaaauauuuaagcaaauuaaagacaauguuaacaaauuuucuauuaaa

SEQ ID NO: 500880 - RNA, 63 nt, hsa
cugugcuucagauuccuuauguguuguuguuuuaaagacaauuugcaggggguugggagaagg

SEQ ID NO: 500881 - RNA, 63 nt, hsa
aucaguuuuauuacugcaccauguuuacuucaaaaagacaaaacaaaaaaaaaauuauuuuuc

SEQ ID NO: 500882 - RNA, 63 nt, hsa
uguguguacuccuaaaucuuuaugcuguccucuaaagacaaacacaaacucucagacuuuuuu

SEQ ID NO: 500883 - RNA, 63 nt, hsa
uacagacaacugcaacaggugccaccacccacaaaagacaacacuacccucguaacuacugcu

SEQ ID NO: 500884 - RNA, 63 nt, hsa
uuuucuuuuguuuuuuuuuuaaaaaagacauuuaaagacaaagacauuauuucucauagcagg

SEQ ID NO: 500885 - RNA, 63 nt, hsa
augugacuuccggagauaaaggauucaaaagauaaagacaaaguacgcucagaguuguuaacc

SEQ ID NO: 500886 - RNA, 63 nt, hsa
ggagcacuuugauguaaaccagaauagcuuuaaaaagacaaaaaggaucguagaucugauuuu

SEQ ID NO: 500887 - RNA, 63 nt, hsa
aguguaaacacaagccuaggacauggacuagguaaagacaaaguccuugcauucuugacauac

SEQ ID NO: 500888 - RNA, 63 nt, hsa
cauacaauaaaauaaaagguaauucagggucccaaagacaaacuuacuaagaaaaaaucauua

SEQ ID NO: 500889 - RNA, 63 nt, hsa
aucauggugguccuaccuggauaauuuaacuauaaagacaaaguaauucuauuaaaugaacua

SEQ ID NO: 500890 - RNA, 63 nt, hsa
uugucaguguacagaaugcuaaaauaauuaaaaaaagacaaaauauaccucuuccuacaagau

SEQ ID NO: 500891 - RNA, 63 nt, hsa
auuugaacuuauuuacacauaguuugaaaaaaaaaagacaaaaauaguauucaggugagcaau

SEQ ID NO: 500892 - RNA, 63 nt, hsa
cugcaucugggccaggcuggggugcacccagccaaagacaaagcugccuccacgugcccaagg

SEQ ID NO: 500893 - RNA, 63 nt, hsa
uaugacauaugggaagggaacguaccuuuuugcaaagacaaaaagagauuacaaaaggaaaau

SEQ ID NO: 500894 - RNA, 63 nt, hsa
aucaaagacaccagggcagauuuuuaaguaaagaaagacaauuggacccuuaagaauuuaugc

SEQ ID NO: 500895 - RNA, 63 nt, hsa
caucugagaguuucuuguuucaguaaaaaaagaaaagacaaaaaaaucagcuuuggaaaguaa

SEQ ID NO: 500896 - RNA, 63 nt, hsa
aaguuucguaagucaggccaagugucaauuucaaaagacaagaaaugaaauugacagugaaua

SEQ ID NO: 500897 - RNA, 63 nt, hsa
caauuuaguguuugacauugcuuccucugccacaaagacaauacucuggugacacaugucuag

SEQ ID NO: 500898 - RNA, 63 nt, hsa
aacccagaaagguuuaaaaaacauaaggaaaaaaaagacaaauuaaaggaggggcuaggggag

SEQ ID NO: 500899 - RNA, 63 nt, hsa
gccucaaccaacuuagugacuuguuuagaaaaaaaagacaaaaaaguaaaaauaaaaacaaaa

SEQ ID NO: 500900 - RNA, 63 nt, hsa
ucaucucauccuaauuaaggugacuauuuucaaaaagacaaaaaauaugacagccgugguggu

SEQ ID NO: 500901 - RNA, 63 nt, hsa
uuaagguaaggucuguaggcaagauauguaaguaaagacaagcccuacaauuuuaaaauaaca

SEQ ID NO: 500902 - RNA, 63 nt, hsa
gaaauuggauguaauuuuaugcaauuuacuuuuaaagacaaacauaacuauuuagcagagaau

SEQ ID NO: 500903 - RNA, 63 nt, hsa
acccugaggucacugcuagagacgcugauccauaaagacaaucacugccaaccccucuuucgu

SEQ ID NO: 500904 - RNA, 63 nt, hsa
uaacuuuauggacacuaaacuggagccaauagaaaagacaaaaaugaaagagacacagggugu

SEQ ID NO: 500905 - RNA, 63 nt, hsa
uggaaagugugcauuggacaucuggaagccagaaaagacaaagaaauauccagaaaggaacaa

SEQ ID NO: 500906 - RNA, 63 nt, hsa
aaauccaccuuucccaucaucccuacucaucagaaagacaaauauaaaaucccagagaggugg

SEQ ID NO: 500907 - RNA, 63 nt, hsa
auaacucuggucuagauuuucauauaauguauuaaagacaaaguagugaacaucaaugaacau

SEQ ID NO: 500908 - RNA, 63 nt, hsa
ugaacagagagacccuuguggguccaugcuaacaaagacaaaagucugucuuuccugaaccau

SEQ ID NO: 500909 - RNA, 63 nt, hsa
augcucaaacuaugggaaaucuuugguaaaaauaaagacaauaaaaucuucacaauaacuuua

SEQ ID NO: 500910 - RNA, 63 nt, hsa
auuaguaauaaaaccucaucucaauagccacaaaaagacaaauguggucaccacacacuugca

SEQ ID NO: 500911 - RNA, 63 nt, hsa
aaaaauuuaaaaauuauuuuucuauuuuguuuaaaagacaaugcauggcuuuucaagugagua

SEQ ID NO: 500912 - RNA, 63 nt, hsa
uuuaauuuccaaccacacuucuuauuuuuuugaaaagacaauuuuccauuucaguauuacauu

SEQ ID NO: 500913 - RNA, 63 nt, hsa
auaaaauauguaaugucuuuuuuauaaagcaaaaaagacaauaauugcauuuaugagcucggc

SEQ ID NO: 500914 - RNA, 63 nt, hsa
uuucuguagcuuuacaauuaauuuaaguacuaaaaagacaaggauuucuuuuaagaaauuuau

SEQ ID NO: 500915 - RNA, 63 nt, hsa
guuuggacugaaucacaucuguaguacuuagccaaagacaauuuggaggagaauaucagccuu

SEQ ID NO: 500916 - RNA, 63 nt, hsa
auaaaagcaaacaggcaaacaugaguguaaauuaaagacaaaaagaaaacucugguuuuauau

SEQ ID NO: 500917 - RNA, 63 nt, hsa
uguugcugguuacuaaacuuuauggugucacaaaaagacaaaugauuguaggauccauggaag

SEQ ID NO: 500918 - RNA, 63 nt, hsa
agccuaagcguacgagugaaaacaaugaugucaaaagacaauagcaaguauaggcuacuauuu

SEQ ID NO: 500919 - RNA, 63 nt, hsa
cguuuugcacugauaaacaugagaaucuggaggaaagacaauuguuuucuuguuuaaaauaug

SEQ ID NO: 500920 - RNA, 63 nt, hsa
uuagacuaauugguacaaggaaggcaagaaaacaaagacaaauaaacagcggaaguuaucagu

SEQ ID NO: 500921 - RNA, 63 nt, hsa
uguaaguuacuuuaaagcuaauacaagaaaaacaaagacaagugaaaguaaggaaacagaaau

SEQ ID NO: 500922 - RNA, 63 nt, hsa
ccauccuugaaaaaauggggaaaaaagaagaaaaaagacaaaaucgaccauaaaagaccaaaa

SEQ ID NO: 500923 - RNA, 63 nt, hsa
uggugaggcugagaaaccagcccacaauuacacaaagacaaaaaaagggggacccaggucuuc

SEQ ID NO: 500924 - RNA, 63 nt, hsa
aguuuaaucugaauauguaaaugaauacauuuuaaagacaaaacuugaaaaauguauucuuga

SEQ ID NO: 500925 - RNA, 63 nt, hsa
gauugggcagugaggaauggggaguuuaguuuaaaagacaacacuagauacuuuuggaaguuu

SEQ ID NO: 500926 - RNA, 63 nt, hsa
auaccgccacacccagcuaauuuuauuuuuugaaaagacaagguucccuauguugcccagcug

SEQ ID NO: 500927 - RNA, 63 nt, hsa
uuauuaguuuuggaagcuuauccauaaguuuccaaagacaagaugauauaaaaguuaaaaagc

SEQ ID NO: 500928 - RNA, 63 nt, hsa
cagcgcuaaacacuguggaggcuaaaaaaagucaaagacaacauuauaacuaaaagucgaaag

SEQ ID NO: 500929 - RNA, 63 nt, hsa
aggaguagcauggcaacuggagaaaaugggaggaaagacaagaagaaauagaagcugauuuaa

SEQ ID NO: 500930 - RNA, 63 nt, hsa
uggucauuuuacuuagaugccagucuacuuuauaaagacaaauggauuauagacuuaaaaaua

SEQ ID NO: 500931 - RNA, 63 nt, hsa
acaaauacauuuuuuaaaaucaagaaaauuuaaaaagacaaaaaaaaaagaauucauugauaa

SEQ ID NO: 500932 - RNA, 63 nt, hsa
guuugcuuuuccggaccccacucugcccuccaaaaagacaaaaaaaaaaaaaaaaaaaaaaaa

SEQ ID NO: 500933 - RNA, 63 nt, hsa
auauuuauugugcccuaaaugugcaacucuccuaaagacaaaacuucucuuucugauguuaag

SEQ ID NO: 500934 - RNA, 63 nt, hsa
cagaauggacagugaggacaguuaugucuuguaaaagacaagaagcuucagauggguacccca

SEQ ID NO: 500935 - RNA, 63 nt, hsa
aaucugaccauuuuacgucucuacggcccaaaaaaagacaaaaauaaaaauuccuuuuuauuc

SEQ ID NO: 500936 - RNA, 63 nt, hsa
uccugggggcauuuuuacguaauuuuuuuaugaaaagacaaaugcauguugagauaacuucug

SEQ ID NO: 500937 - RNA, 63 nt, hsa
accaaggugauccccagccugcggcccucgugaaaagacaagaaaaugggguggcuuccuuuc

SEQ ID NO: 500938 - RNA, 63 nt, hsa
aaccuuuuauaaccaacacuagaguuaguuuuaaaagacaagauauuuauaaugacgacugua

SEQ ID NO: 500939 - RNA, 63 nt, hsa
auuaauacaauuaauauuaauauuaacuacagaaaagacaaacaguagagaacagcaaaaaaa

SEQ ID NO: 500940 - RNA, 63 nt, hsa
uacagugcuaauguauaugguugcaguucacauaaagacaaaagcaucuguuaugaaaugagu

SEQ ID NO: 500941 - RNA, 63 nt, hsa
uucuaaggaaugcacaaauugaaaacacacucaaaagacaaacaugcaaguaaagaaaaaaaa

SEQ ID NO: 500942 - RNA, 63 nt, hsa
aauguagacuuuugacacuuuuaaaaaacaaaaaaagacaagagagaugaaaacguuugauua

SEQ ID NO: 500943 - RNA, 63 nt, hsa
uguugcggcagagguuugagugaacccucuuucaaagacaauaaauagcacagaauuguccgu

SEQ ID NO: 500944 - RNA, 63 nt, hsa
aucacaaacaaaagccugaauguacuauguuuaaaagacaaaccaaaaauuaacccaaacuug

SEQ ID NO: 500945 - RNA, 63 nt, hsa
aauaguguuguaacuaugaaaaagaauacuuugaaagacaaagaacuuagacuaagcauguua

SEQ ID NO: 500946 - RNA, 63 nt, hsa
aaaucaugaauuuuuuuucuacgugugaguauaaaagacaaaaguugaacagcauggaaucuc

SEQ ID NO: 500947 - RNA, 63 nt, hsa
uugguuuuugaguuguucuugucauagacauaaaaagacaauucauuuucuuguuuuauuaac

SEQ ID NO: 500948 - RNA, 63 nt, hsa
gccuaauauuuaugacuuucacauuuggaauuuaaagacaaaaauacaucaaggaguuaugcu

SEQ ID NO: 500949 - RNA, 63 nt, hsa
caguagaacagaaaugaauauaugcuaaaucacaaagacaacucuccuugcaaaauacugcac

SEQ ID NO: 500950 - RNA, 63 nt, hsa
uuuauuuuuaauuauuauuuccccgucccuuaaaaagacaaaaaaaauaaggcaaaaggaaag

SEQ ID NO: 500951 - RNA, 63 nt, hsa
uacuucuacaauaacacaagauaccuguuccucaaagacaaugcauucugccauaauguucau

SEQ ID NO: 500952 - RNA, 63 nt, hsa
uauguucaaagacguuuauucauguucaacaggaaagacaaaguguacgugaaugcucgcugu

SEQ ID NO: 500953 - RNA, 63 nt, hsa
gaugguugucuugugugcuucucugcauuuuuaaaagacaagacauucuuguacauauuauca

SEQ ID NO: 500954 - RNA, 63 nt, hsa
uaccagaauugaauauaccauaugggauuggagaaagacaaauguggaagaaaucauagagcu

SEQ ID NO: 500955 - RNA, 63 nt, hsa
uuggcuagagagcgaguauugugauuuugcugaaaagacaaggugugaaggagcaacuucagu

SEQ ID NO: 500956 - RNA, 63 nt, hsa
aaacagaauguucauacugauguguugugccuuaaagacaagacagcauuuguguguuacaau

SEQ ID NO: 500957 - RNA, 63 nt, hsa
ugaaacuuuuccuagaugcaaaugcugacuaauaaagacaaagccacccugaaccugacgucu

SEQ ID NO: 500958 - RNA, 63 nt, hsa
ggaaauaaauuagugcgguucucuuugacccccaaagacaagacaagcacuuauuuuuauuuu

SEQ ID NO: 500959 - RNA, 63 nt, hsa
ggauuuugguuuaggaaaaaucucauagguauaaaagacaacugggaauguugaauguggauc

SEQ ID NO: 500960 - RNA, 63 nt, hsa
gucaacaagccugacccuguaaaauggagguggaaagacaagcucaaguguucacaaccugga

SEQ ID NO: 500961 - RNA, 63 nt, hsa
ucugaucugugugugagugugugugaacuucugaaagacaauauuaaagagacuuaguugauu

SEQ ID NO: 500962 - RNA, 63 nt, hsa
ccagaguuaaaaaucaucuguccaccuggcuccaaagacaaaaaauaaaaagaaaagaaaaag

SEQ ID NO: 500963 - RNA, 63 nt, hsa
uuucuuccauaaugcaucugaaaaacuguaaacaaagacaaccauuucuacuacgucggccau

SEQ ID NO: 500964 - RNA, 63 nt, hsa
guuaaaacucagggauucugugacuacaagaugaaagacaauuugguugcugagaugcaguua

SEQ ID NO: 500965 - RNA, 63 nt, hsa
aagaaaaagagaaagaugaaaauaggaacaaauaaagacaaacaacauuaagggccauauugu

SEQ ID NO: 500966 - RNA, 63 nt, hsa
uucaaaaaugacaaagucaguuuggagacagaaaaagacaaaagguccagucucauccaucuc

SEQ ID NO: 500967 - RNA, 63 nt, hsa
ugacaaggaaccugaccuaaccccauuuuucauaaagacaaagaacagcaauguuaaauugcc

SEQ ID NO: 500968 - RNA, 63 nt, hsa
ugauuuaaauguaaaccaaaagauggaagacaaaaagacaaacacacccacacgcagucuuug

SEQ ID NO: 500969 - RNA, 63 nt, hsa
auugaagguccuucccaccugugaccucaccucaaagacaauucauagccuguggucuccaca

SEQ ID NO: 500970 - RNA, 63 nt, hsa
uuuuuaagggauguugcaaagggauuacuagagaaagacaaaaugugaccaaaaaaaagcaug

SEQ ID NO: 500971 - RNA, 63 nt, hsa
acagaagcaaaggagagcuuggggguggggagaaaagacaaaugugcucuauguccuaguaac

SEQ ID NO: 500972 - RNA, 63 nt, hsa
cguauuuaucuaguuucagggaaggucuaauaaaaagacaagcggugggacagagggaaccua

SEQ ID NO: 500973 - RNA, 63 nt, hsa
aauuaugcacacaucuaacauugguagauuucuaaagacaacucauaaauaauuucuuaaccc

SEQ ID NO: 500974 - RNA, 63 nt, hsa
uaucuaguuaaucauaauauuugauggaaagaaaaagacaauaaaauuguaauauaauaaauu

SEQ ID NO: 500975 - RNA, 63 nt, hsa
uucuuagcaaucaauauuuuucugcauucuuuaaaagacaagagaauuugguuauaaaagaaa

SEQ ID NO: 500976 - RNA, 63 nt, hsa
ccaucauuuugaaaagauuuauuaaaacuagcuaaagacaacagacuggauagcuuuucuaau

SEQ ID NO: 500977 - RNA, 63 nt, hsa
acuguuucauauuuuucuuuugacaaaguagccaaagacaaucagcagaaagcauuuucugca

SEQ ID NO: 500978 - RNA, 63 nt, hsa
ucugacacauaagagguguguucugcucccuguaaagacaaggguggguauccagaugguccc

SEQ ID NO: 500979 - RNA, 63 nt, hsa
uuucaguguaccguaaauguuguguuuucagaaaaagacaaaacgauggugcugacugguuuu

SEQ ID NO: 500980 - RNA, 63 nt, hsa
ucauuuuaucaauguagcugugaaggccauuaaaaagacaaacuuaauguacagagcauuuau

SEQ ID NO: 500981 - RNA, 63 nt, hsa
uguugugauugaacaauacaaauaacaaacaagaaagacaaugcauuccauuagucugcuauu

SEQ ID NO: 500982 - RNA, 63 nt, hsa
augaauccaacugcuuaaaguugguauuaauaaaaagacaaccacauaguucguuuaccuuca

SEQ ID NO: 500983 - RNA, 63 nt, hsa
gcuggcuguccgcugcugacuggauggcagcacaaagacaauaugagcagagggaggagaaga

SEQ ID NO: 500984 - RNA, 63 nt, hsa
uguggagaagggucuugcauacaauaguuuaaaaaagacaaaaaaaaccuuugcuuaaauuca

SEQ ID NO: 500985 - RNA, 63 nt, hsa
gugucacagagauggugccgucauugcuggcuuaaagacaaggggccaggagccaacaccaga

SEQ ID NO: 500986 - RNA, 59 nt, hsa; identical to SEQ ID NO: 476518

SEQ ID NO: 500987 - RNA, 63 nt, hsa
cuucucgucuugugagcuaaggcuugugucaugaaagacaagaggccucucuuaacagcccag

SEQ ID NO: 500988 - RNA, 63 nt, hsa
auugugggaaucacaaagcaaauaguacuccagaaagacaaauaucagaagcuuccuauucuu

SEQ ID NO: 500989 - RNA, 63 nt, hsa
auauggauacaaaaaggauacgccgagccaaucaaagacaagcuuuaacuuuacuuugaagug

SEQ ID NO: 500990 - RNA, 63 nt, hsa
agcaaugugauuauaugaagagacacaaauuaaaaagacaaauuaaaccugaaauuauauuua

SEQ ID NO: 500991 - RNA, 63 nt, hsa
gaggacauguuaaguaaaauaagccaggcuuagaaagacaaaugcugcauaaucucacugugg

SEQ ID NO: 500992 - RNA, 63 nt, hsa
gaagaaaaaaucacuuuuaccuuccuaauuuaaaaagacaaaacagaaauguacguuccuucg

SEQ ID NO: 500993 - RNA, 63 nt, hsa
aaauauauuagaaguuacuaugaagaaugccccaaagacaaguuaccagcauauccugaguca

SEQ ID NO: 500994 - RNA, 63 nt, hsa
uagaaacaaauuuuuaugagcauaacccuauauaaagacaaaaugaauuucugaccuuaccau

SEQ ID NO: 500995 - RNA, 63 nt, hsa
accuauaguagucuguguuuaaagugaauuuuuaaagacaaagcauucuaaaugaacucaaua

SEQ ID NO: 500996 - RNA, 63 nt, hsa
uaggucauaaggucucuuccuuuucuaaaauugaaagacaagaaauuuagugccaauauugua

SEQ ID NO: 500997 - RNA, 63 nt, hsa
gaaaaccaaaacggaagaggagaaacucaauacaaagacaaguacaacuccauuagaaaaauu

SEQ ID NO: 500998 - RNA, 63 nt, hsa
uguaaauuuuuguacauaguagcauuagguagaaaagacaaaacccaaacaccuaguuaauug

SEQ ID NO: 500999 - RNA, 63 nt, hsa
cucauucuucuagaugucaucacaauggaucccaaagacaauuguucaaaagaugcaaauggu

SEQ ID NO: 501000 - RNA, 63 nt, hsa
uucgugcugugucucauggguuuccauagugauaaagacaaggaaacgcugcaggggccacag

SEQ ID NO: 501001 - RNA, 63 nt, hsa
acaauuuaauuucacguugacaaaacacagugaaaagacaacuuugugaagaucuaauuacaa

SEQ ID NO: 501002 - RNA, 63 nt, hsa
gcaaaagaggaggucagagugauccuguauaagaaagacaacuacuuuugaaggaaguuaaaa

SEQ ID NO: 501003 - RNA, 63 nt, hsa
uuaauuuccucuuaaacauguuaugaguucuacaaagacaauagugaaaaaggaaggagugag

SEQ ID NO: 501004 - RNA, 63 nt, hsa
uuucacagauccaccugucucuugaaaauauaaaaagacaaaacagguuugccuuggcaucag

SEQ ID NO: 501005 - RNA, 63 nt, hsa
aacacaggugucugagcuagaauuauucucuuaaaagacaacauaacuuuuuaugucuuuuau

SEQ ID NO: 501006 - RNA, 63 nt, hsa
uaucacagcaauucucaugcuaaaaauacaacaaaagacaaagcaaaaaauaaaccuuugcuu

SEQ ID NO: 501007 - RNA, 63 nt, hsa
auaugauuuucuagugaguguauguuaggaacaaaagacaaaauaguaucaacacauuauaaa

SEQ ID NO: 501008 - RNA, 63 nt, hsa
gcugguuaaaaaaaacagauuauauuaaaauuuaaagacaaaaagucaaaacaaaaauauuuu

SEQ ID NO: 501009 - RNA, 63 nt, hsa
acuugcuuuuagcaugauuauuuuccuaaauaaaaagacaaagaauuuacuuacuuuauguua

SEQ ID NO: 501010 - RNA, 63 nt, hsa
auccaggguggacauuuuuucaaccuuuauuaaaaagacaaauaaacuauuuuguagaagauc

SEQ ID NO: 501011 - RNA, 63 nt, hsa
cauuaagcaaaagaauguauuggaaguugauggaaagacaaauucaucuguaguaguaacugg

SEQ ID NO: 501012 - RNA, 63 nt, hsa
aauaaaauauacaccuuauacccaagggagagcaaagacaaaauacaccaguaacauuugacc

SEQ ID NO: 501013 - RNA, 63 nt, hsa
gggggacacuagaaugaaaaccaguguuaggguaaagacaaaacagacuauguacauaaucug

SEQ ID NO: 501014 - RNA, 63 nt, hsa
uguacggcagugccaucugguggcaagugguacaaagacaacgcugagggguagugacuccug

SEQ ID NO: 501015 - RNA, 63 nt, hsa
ggagcccggggguugggagggacagggauaaauaaagacaaagacugaagacaaaaaaaaaau

SEQ ID NO: 501016 - RNA, 63 nt, hsa
uaguaucaguuuuugaaccacaguaaugggaagaaagacaaauggauucccuuagaaguaaga

SEQ ID NO: 501017 - RNA, 63 nt, hsa
aauaaaaaucgaaauaauuuuuuuaaaaaagaaaaagacaauaguauuacccaugggacaaaa

SEQ ID NO: 501018 - RNA, 63 nt, hsa
aucaguacugagaaaccugguuugccacagaacaaagacaagaaguauacacuaacuuguaua

SEQ ID NO: 501019 - RNA, 63 nt, hsa
ggugagggaagccagaaugacacaaagcaaugcaaagacaagauugccaugcaaauggauggu

SEQ ID NO: 501020 - RNA, 63 nt, hsa
guugugcaaacugucgauucagcgaaacuuaaaaaagacaagaaacuacugaggagcuuagua

SEQ ID NO: 501021 - RNA, 63 nt, hsa
aaagacuuuuguauaaaguugaguacuuagaaaaaagacaaaccagauguaauauauuuugug

SEQ ID NO: 501022 - RNA, 63 nt, hsa
uccagaaauauaguccaagcuuucucuguggaaaaagacaaaacucauuaguagacauguuuc

SEQ ID NO: 501023 - RNA, 50 nt, hsa
caccacaucgacuacuauaaaaagacaaccaacgugagugccgacaaggc

SEQ ID NO: 501024 - RNA, 63 nt, hsa
gucagguuucucgugucuguguguuuggcuucuaaagacaagaaugacuuacaauacagccua

SEQ ID NO: 501025 - RNA, 63 nt, hsa
ucauagaugcauacaaaugagcucacuuauuacaaagacaaacguuuaauuugcuaaauauuu

SEQ ID NO: 501026 - RNA, 63 nt, hsa
guucacugaaauuaaguugaauuugaauggcugaaagacaaaauauauguuaauacaaucucu

SEQ ID NO: 501027 - RNA, 63 nt, hsa
guauucauacugugaauugugcucugaugguuaaaagacaagauugucaagcauuccguauua

SEQ ID NO: 501028 - RNA, 63 nt, hsa
aauugaaaauucagguggauaaauagucuuacaaaagacaaugugcuuuauguuauaccuaua

SEQ ID NO: 501029 - RNA, 63 nt, hsa
uuucauuuuauguuuuuguacucugcagacugaaaagacaaaguuuaucuuggccuuacugua

SEQ ID NO: 501030 - RNA, 63 nt, hsa
uacagaagcaauauccaaagaucuccugaucauaaagacaaggggucuuuucagucuucccuc

SEQ ID NO: 501031 - RNA, 63 nt, hsa
auaaaaagaauauuucucuguaaugcauuguugaaagacaaccagaauaucaagaaaauguau

SEQ ID NO: 501032 - RNA, 63 nt, hsa
guuagccuguuuuucuaccaacaauaagcuagaaaagacaaaaaaaacaaaaaacaaaaaaac

SEQ ID NO: 501033 - RNA, 63 nt, hsa
ccucgcuagacgugaacucagaacugucggaggaaagacaacacaaccaacgcgaaaccaauu

SEQ ID NO: 501034 - RNA, 63 nt, hsa
gaaaacaaaaagauguuagaaaaauaaaaguauaaagacaaaucauacuguccccauauccca

SEQ ID NO: 501035 - RNA, 63 nt, hsa
cuuuuguguguuuaauuauuauguguaaaucauaaagacaaauaaauuucacugugccaccca

SEQ ID NO: 501036 - RNA, 63 nt, hsa
cauuuuuaugcuguucccucuugggcuucaugcaaagacaauucuguguaaauguacaguuga

SEQ ID NO: 501037 - RNA, 63 nt, hsa
auucuauugcaagcuucaaggggcuuuuguuugaaagacaaaacuccccaccugaaucuguug

SEQ ID NO: 501038 - RNA, 63 nt, hsa
guacuguguuuuuaaauuuuguaugccaaucuuaaagacaaauuuugcauauucucuauuuua

SEQ ID NO: 501039 - RNA, 63 nt, hsa
agaaggauaugcaucacacaaguaagguacaggaaagacaaaauuaaacaauuuauuaauuuu

SEQ ID NO: 501040 - RNA, 63 nt, hsa
cauuuuaauaaaaaauguauuuaaaaaaagaaaaaagacaauauacugacagucuaaucauca

SEQ ID NO: 501041 - RNA, 63 nt, hsa
caugcccuugccuaucaaagaguauguuguaagaaagacaagacauuguguguauuagagacu

SEQ ID NO: 501042 - RNA, 63 nt, hsa
cgggaucccaaagaaugaggggaauuucuucagaaagacaaucucggcaugcauuauuucuuu

SEQ ID NO: 501043 - RNA, 63 nt, hsa
aaucagcugcuacaagaaugcaaaaaaucuuccaaagacaagaaaagaggaaaaaaagccguu

SEQ ID NO: 501044 - RNA, 63 nt, hsa
gcccuuaugugaagugaaauaagccaggcacagaaagacaaacaucacauguucucacuuauu

SEQ ID NO: 501045 - RNA, 63 nt, hsa
aaacagcagcuaugaagccuugaauuuugaaaaaaagacaagaaggugcaaaagguaagacau

SEQ ID NO: 501046 - RNA, 63 nt, hsa
cacucaaaacugaagacauagaggacucagaucaaagacaaaaucugauccauauauuggugc

SEQ ID NO: 501047 - RNA, 63 nt, hsa
gcuccaagcuuggaaagagcuguguuuugguucaaagacaagggaaauggcaaacaaaagacu

SEQ ID NO: 501048 - RNA, 63 nt, hsa
gaaggccaaaguauccaucauuagucagccacaaaagacaaucaaaguggcagaacugccuca

SEQ ID NO: 501049 - RNA, 63 nt, hsa
ucugaacuccccugugaaugcaguucuuggcacaaagacaaaagcugcagugaaaauuuugga

SEQ ID NO: 501050 - RNA, 63 nt, hsa
ugguggucgaagucagcagacacuagacacuccaaagacaacaggcccucccucugcccuccc

SEQ ID NO: 501051 - RNA, 63 nt, hsa
uuuuaaaaaugacagaacuuuuguucagauguaaaagacaaaauugcacuuuaauguuuuuug

SEQ ID NO: 501052 - RNA, 63 nt, hsa
aaagaaacgaaagaaagcaaagcaaagucagugaaagacaaucuuuauaguuucaggaguaaa

SEQ ID NO: 501053 - RNA, 63 nt, hsa
aaaugugacccccaaguccuauccuaaauaaaaaaagacaaauucggauguaugaucucucua

SEQ ID NO: 501054 - RNA, 63 nt, hsa
caucuccuuacagucacuaauauaguagauuuuaaagacaaaauuuuucuuuucuugauuuuu

SEQ ID NO: 501055 - RNA, 63 nt, hsa
ugagagaaaugaguuuauacagagcugacucaaaaagacaaaaaguaacuugggccaguuugg

SEQ ID NO: 501056 - RNA, 63 nt, hsa
agucacauugguaggaccaauaaagaauaauaaaaagacaaagcacauguuuguucucugugg

SEQ ID NO: 501057 - RNA, 63 nt, hsa
auguaaacaaugacuguaacguguuauagauguaaagacaaaauaaagguuaaagagggcaua

SEQ ID NO: 501058 - RNA, 63 nt, hsa
gugaguggauaaucaggaaaaaugaggaauccaaaagacaaaaaucaaagaacagaugggguc

SEQ ID NO: 501059 - RNA, 63 nt, hsa
cuuguuuuuuuguuacuauuauuccuuugaaaaaaagacaaaauaucuaaaaaauguuuauag

SEQ ID NO: 501060 - RNA, 63 nt, hsa
aucagucacgcaggaggacugacuugacagacgaaagacaagcccggaugacacagggugaga

SEQ ID NO: 501061 - RNA, 63 nt, hsa
guuucaugaaauuggagcucuguauaaacugaaaaagacaaaauaaguaaagcacuuguugcu

SEQ ID NO: 501062 - RNA, 63 nt, hsa
gcaagcuacagcaaagcccauuggccagaaaggaaagacaauaauuuuguuuuuucauuuuga

SEQ ID NO: 501063 - RNA, 63 nt, hsa
cuucagucaacuacagcugaguccauaggccagaaagacaauaaauuuuuaucauuuugaaau

SEQ ID NO: 501064 - RNA, 63 nt, hsa
cuggauguacuuagauaaugugaaauaaacauuaaagacaaggucuauuuuuaauagauuugc

SEQ ID NO: 501065 - RNA, 63 nt, hsa
uaaucuaaacaauauauuccuuaaauuaagaggaaagacaagugucguauuucgauccuguuu

SEQ ID NO: 501066 - RNA, 63 nt, hsa
acaagaaugaaaaacagaaauaaaagaaguagaaaagacaaagaaagaaagcccaaagucaaa

SEQ ID NO: 501067 - RNA, 63 nt, hsa
agugagccacugaggaaagaauaugcuuauuacaaagacaaaauguggugcagaaacuaucuu

SEQ ID NO: 501068 - RNA, 63 nt, hsa
auaauaaucccgggagaaugauuccccucauagaaagacaaaagcauccauccccucauaguu

SEQ ID NO: 501069 - RNA, 63 nt, hsa
ucugcagggacucaaagcuguacccaaaucaagaaagacaaaauaacaauagaaaccauucac

SEQ ID NO: 501070 - RNA, 63 nt, hsa
accacccaccacagaaaagcacaaaccucugggaaagacaacgucucucgggggccagggguc

SEQ ID NO: 501071 - RNA, 63 nt, hsa
gcuacaaaguccagccgagucaaaggaaagagaaaagacaagucaagagagaaagugggacca

SEQ ID NO: 501072 - RNA, 63 nt, hsa
uauaacugaauaagaaauuuuuuuaagcaagagaaagacaacuguucugcggguuggagaaaa

SEQ ID NO: 501073 - RNA, 63 nt, hsa
guacaguuuuuauauuuuugauaucuuguaaauaaagacaaccagcuuuuccagguucauaau

SEQ ID NO: 501074 - RNA, 63 nt, hsa
guccuaaaagcaaaauaaaaacuauucgaaugaaaagacaagaaaaucagguauuaaucuugg

SEQ ID NO: 501075 - RNA, 63 nt, hsa
guuuagauagggcugggcaaggaaaaagaaaauaaagacaaccauauuuagcagugcaguuga

SEQ ID NO: 501076 - RNA, 63 nt, hsa
uagauuguaugaguaagaaguauuaauuuuuuaaaagacaaaucaacuuugaagacacaaaag

SEQ ID NO: 501077 - RNA, 63 nt, hsa
ccugauacaauuugcccaagguaaacaguuugaaaagacaaaugggccugccaaacuguacag

SEQ ID NO: 501078 - RNA, 63 nt, hsa
ugugugcagaugcagaaugacaagcugcauucaaaagacaaacaauaugucuuuuuuuuuuuu

SEQ ID NO: 501079 - RNA, 63 nt, hsa
ggcaggaggaaagcacaauguuucuuagccaggaaagacaaauaauccaacgcugcuagucuu

SEQ ID NO: 501080 - RNA, 63 nt, hsa
ccugaugccucauucaccaggauggguaacuuuaaagacaaguuuuauaacuggcaucccauc

SEQ ID NO: 501081 - RNA, 63 nt, hsa
guaagcuacagcuaagcccaucggccggaaaagaaagacaauaauuuuguuuuucauuuugaa

SEQ ID NO: 501082 - RNA, 62 nt, hsa
ggcaacagagcaagauccugucuuuaaggaaaaaaagacaagaugagcauaccagcaguccu

SEQ ID NO: 501083 - RNA, 63 nt, hsa
uuugccuguuagacaugacugaugacauaucugaaagacaaguauguugagaguugcuggugu

SEQ ID NO: 501084 - RNA, 63 nt, hsa
ugaaugacacauaacagcuguacaaaguggggaaaagacaaauuguccgaagugcuaagaacu

SEQ ID NO: 501085 - RNA, 63 nt, hsa
uacagagaccaccagaucagguauagacuccugaaagacaauauaaugaagugcuccagucag

SEQ ID NO: 501086 - RNA, 63 nt, hsa
cucugcccucccucugagcaggacucucagaagaaagacaagcugcucugcagccagcuucag

SEQ ID NO: 501087 - RNA, 63 nt, hsa
aacucugggaaagauguuaccuuuggguuuuuaaaagacaagucaucauuugaaaauauauua

SEQ ID NO: 501088 - RNA, 63 nt, hsa
ggagaugcugaucccuucaaguggggacagcaaaaagacaagcaaaacugaugugcacuuuau

SEQ ID NO: 501089 - RNA, 63 nt, hsa
acugagccaaggugauggacuguauauuugaggaaagacaaacaaagaaacaaaauuaaaaug

SEQ ID NO: 501090 - RNA, 63 nt, hsa
gaaucugaguugugucacuucaguuccucuccuaaagacaaagguuagucugaucuccagacc

SEQ ID NO: 501091 - RNA, 63 nt, hsa
ucuccaacgcugcucccugucugcaacugacuuaaagacaaaaaggaagcuggaagaggcagc

SEQ ID NO: 501092 - RNA, 63 nt, hsa
aaggcauguuacuacuuuuaucaucuaaggaaaaaagacaagggaauuccagucaggcauuau

SEQ ID NO: 501093 - RNA, 63 nt, hsa
agaccccaguugugccuuugcuacagaucuggaaaagacaaggucaugggggccuccaguguc

SEQ ID NO: 501094 - RNA, 63 nt, hsa
gcugcauuaaaaaaauacaauauggacauguaaaaagacaaaaaccaaguuaucuguuuccug

SEQ ID NO: 501095 - RNA, 63 nt, hsa
uucuuuauguacaaaaacuaaaauaaagucaauaaagacaauucugacuacaaauuuugauau

SEQ ID NO: 501096 - RNA, 63 nt, hsa
uguugggcaaggaugcugucauuuuuugaaccaaaagacaaacagguuaaaaggaaaaaaagu

SEQ ID NO: 501097 - RNA, 63 nt, hsa
uguagauacugcauggcaggagagcuuuacgcuaaagacaaaagaaacagcuuugggggccgg

SEQ ID NO: 501098 - RNA, 63 nt, hsa
uauggauauucauaagguuauuucaaaguuaauaaagacaaaguggcaacuguagaaaguguu

SEQ ID NO: 501099 - RNA, 63 nt, hsa
cugcugggggacaugugagccucaaauccauagaaagacaaacggccaccuugggugcccagg

SEQ ID NO: 501100 - RNA, 63 nt, hsa
cugagaccccauucuccacaaaaaggaaaaauaaaagacaaaaaaacaaacaaaaaaccaaaa

SEQ ID NO: 501101 - RNA, 63 nt, hsa
acauguaaccggcauguuuccagcagaagacaaaaagacaaacaugaaagucuagaaauaaaa

SEQ ID NO: 501102 - RNA, 63 nt, hsa
acuauguguaaguccucaucaaaugaaaagcagaaagacaagaacaauuagucaagagcagua

SEQ ID NO: 501103 - RNA, 63 nt, hsa
cucagaugaaaacucacuuuuauuaaaaaaaaaaaagacaaggguuuauauucauauacacua

SEQ ID NO: 501104 - RNA, 63 nt, hsa
ggaaauguacgauagguagaauugugguucccuaaagacaaguacauaaaggugacccugaug

SEQ ID NO: 501105 - RNA, 63 nt, hsa
accugcucuccccagccuguuuucucuuuucuaaaagacaaauuaugguaccauaagcugcca

SEQ ID NO: 501106 - RNA, 63 nt, hsa
uuauaugaagaacauaggugucuuugugguuuuaaagacaacugugaaauaaaauuguuucac

SEQ ID NO: 501107 - RNA, 63 nt, hsa
cuuguagauuacauuuaucauuaaugcaagaauaaagacaauuccuccugucaguugcgugaa

SEQ ID NO: 501108 - RNA, 63 nt, hsa
uuuugcugucugcggaaguuaccauacccuguaaaagacaaauauuucuuucuccucucgaac

SEQ ID NO: 501109 - RNA, 63 nt, hsa
uucuaggcuuuguuucucugugugcuuaguuuuaaagacaacuuugaaguaaacaaugaaaua

SEQ ID NO: 501110 - RNA, 63 nt, hsa
uaaauaagauaaagggucagcaacaacaaagaaaaagacaauuacagaaaauaagcaagauuu

SEQ ID NO: 501111 - RNA, 63 nt, hsa
aggaccaguaagggaccuucgauuaaaaaaaaaaaagacaauaauaaaaaggcucauuaaugg

SEQ ID NO: 501112 - RNA, 63 nt, hsa
caguggcccaauguggccaacggaaguuuuauaaaagacaaaauguauaucaauaaacauuuu

SEQ ID NO: 501113 - RNA, 63 nt, hsa
gcggguguguuuuuuaauuuucuggggggaaaaaaagacaaaacaaaaaaccaacucugacuu

SEQ ID NO: 501114 - RNA, 63 nt, hsa
ugcgcacccugcacaaguacagauugaccaggaaaagacaagugucuucugugugucacaggg

SEQ ID NO: 501115 - RNA, 63 nt, hsa
uuguaagcauuacuuaacacaguauaaagaugaaaagacaacaaaaauaucuucauacuuccu

SEQ ID NO: 501116 - RNA, 63 nt, hsa
guaacuugauggaagaaaauggaauuacuccaaaaagacaagugcucaagcagcaaaauccuu

SEQ ID NO: 501117 - RNA, 63 nt, hsa
cuuacuuagaagguuuuuuauuauaguccuacaaaagacaauguauaagcuguaacagaauuu

SEQ ID NO: 501118 - RNA, 63 nt, hsa
ccaaagaguaugccugggagccuccagcuguuaaaagacaaugcuauuacuacuucuuaucaa

SEQ ID NO: 501119 - RNA, 63 nt, hsa
aauugcaaaauaaagaaaaaugccaaccuuagaaaagacaauaaaugcacaaaagauauaaac

SEQ ID NO: 501120 - RNA, 63 nt, hsa
uaauuccaaaucuaucugaguuguauacccaucaaagacaauacaguuauuaacauagaugaa

SEQ ID NO: 501121 - RNA, 63 nt, hsa
aaagcacuuacaccaguuugacugugcuagcuaaaagacaaauuuaaggggagcucuucaaca

SEQ ID NO: 501122 - RNA, 63 nt, hsa
aagaauccaucugugaggugauaggcaaggaugaaagacaaagaaggaaaagaguaucaaagg

SEQ ID NO: 501123 - RNA, 63 nt, hsa
caugcagcugggcugagugaugucagcgagacuaaagacaaaguucugagcuccucaucaacu

SEQ ID NO: 501124 - RNA, 63 nt, hsa
ccccgugguggccccgcucccuaaauuuuuuaaaaagacaaaaacaaaacaacaacaacaaca

SEQ ID NO: 501125 - RNA, 63 nt, hsa
ucuauaaauuaaguagaguagcuucuuuaugauaaagacaauuuucugaaaagugaacaauuc

SEQ ID NO: 501126 - RNA, 63 nt, hsa
aaaugcuacaguugauccucaucugucugggguaaagacaacaaaguaaauacaacccaaggc

SEQ ID NO: 501127 - RNA, 63 nt, hsa
guuaaaagcaguauuuuuaauguauuuuauaagaaagacaaucaaauaaaccucaucaauuaa

SEQ ID NO: 501128 - RNA, 63 nt, hsa
ucacuaauuccuaauaugaaauguaugauggccaaagacaaauuguauugauuauaauccuuu

SEQ ID NO: 501129 - RNA, 63 nt, hsa
cagcuggaccaauuuucaaacuuggauaaagaaaaagacaaacagaaauagacacacacacca

SEQ ID NO: 501130 - RNA, 63 nt, hsa
uguccaggggcugccuccugccuuuucuuuuguaaagacaagacccuugggaguuuuaauucu

SEQ ID NO: 501131 - RNA, 63 nt, hsa
auuuucagugcaaaagagaugucauucaguuaaaaagacaaaccucuagauguguaauuacau

SEQ ID NO: 501132 - RNA, 63 nt, hsa
uuuugucuguuaaaugaacuugauagcuaauaaaaagacaacuagccaucaaaaucauauguu

SEQ ID NO: 501133 - RNA, 63 nt, hsa
uggauucucuucacuauaacugagugguaauuuaaagacaacaauuuaaugucacuaauuuuc

SEQ ID NO: 501134 - RNA, 63 nt, hsa
aauggaaaagacuuucucuuuuccuuuaaagcuaaagacaagaauaucaugcuauacaggugc

SEQ ID NO: 501135 - RNA, 63 nt, hsa
agcaagacccugucuuaaaagaaaaaugggaagaaagacaagguaacaugaagaaagaagaga

SEQ ID NO: 501136 - RNA, 63 nt, hsa
aaagcugggaugcuugaggguauccaaguugaaaaagacaaaaucugaccaucagccagugac

SEQ ID NO: 501137 - RNA, 63 nt, hsa
uucuguugggaaggcccucuugguuuuggagagaaagacaaguuaugaguagcugcuacccug

SEQ ID NO: 501138 - RNA, 63 nt, hsa
cuguacccagcccaaaagcaguuuaaaaaaaaaaaagacaaaauauacaacucuugauaaaac

SEQ ID NO: 501139 - RNA, 63 nt, hsa
aauaaaaagagaaacaaguauuuugcuauauauaaagacaacaaaagaaaucuccuaacaaaa

SEQ ID NO: 501140 - RNA, 63 nt, hsa
aagaaaucaggggacauguuauagaaguuaugaaaagacaaccacauggucaggcucuugucu

SEQ ID NO: 501141 - RNA, 63 nt, hsa
ucagcaugucacuaaauuccugggauggaaguaaaagacaaugcuggcaacugggcucuaauc

SEQ ID NO: 501142 - RNA, 63 nt, hsa
uguuuaucaccuuagcagaaaaaccacaguccaaaagacaagcaaauuaagaauggagcuuaa

SEQ ID NO: 501143 - RNA, 63 nt, hsa
uagaaauaaauguuaccuaauuauuacagccuuaaagacaaaaauccuuguugaaguuuuuuu

SEQ ID NO: 501144 - RNA, 63 nt, hsa
gagcaaagaugguaaaaagaagaaaaagaagucaaagacaaaguguguaauuauguaaauaca

SEQ ID NO: 501145 - RNA, 63 nt, hsa
uuauuuuuaacuuggauaccugcuauucugccaaaagacaauuucuagaguaguuuugaaugg

SEQ ID NO: 501146 - RNA, 63 nt, hsa
ggucccguuucguugggucauugccugaaaugcaaagacaacacuuacccaggauguuucccc

SEQ ID NO: 501147 - RNA, 63 nt, hsa
ggggaacgugguuggcucaggguuugacagagaaaagacaaauaaauacuguauuaauaagau

SEQ ID NO: 501148 - RNA, 63 nt, hsa
gaguauuugguagggaaagcagguuuaaaauaaaaagacaacccacccccugcccuuuugcuu

SEQ ID NO: 501149 - RNA, 63 nt, hsa
uaaugaaugucggcggcgcugggguugcagggaaaagacaaauccucaaagcguggacgugug

SEQ ID NO: 501150 - RNA, 63 nt, hsa
uacauccauucaugccucuuucagaacuaaauuaaagacaaauccucccuguguugcacacuu

SEQ ID NO: 501151 - RNA, 63 nt, hsa
ugaaaccgugcuucagaaucccagcacauaguaaaagacaacacugauaauuauaccugucaa

SEQ ID NO: 501152 - RNA, 63 nt, hsa
agugacacuucaaaagugugcuuacauuuuuaaaaagacaaauaaaaacaguguuuuauagug

SEQ ID NO: 501153 - RNA, 63 nt, hsa
uuaccuagcacuuaaauauguauaaauguacauaaagacaaacuaguaagcaugaccugggga

SEQ ID NO: 501154 - RNA, 63 nt, hsa
uuaccaguuaggggaagacuuuuauuuucaugaaaagacaauaaaacaaaauggaaugugaug

SEQ ID NO: 501155 - RNA, 63 nt, hsa
ucuuucuagcagugcagggugaaacuaacuagcaaagacaaaaauucaggcaguuuguagaca

SEQ ID NO: 501156 - RNA, 63 nt, hsa
acaguucaaaagucaggugcugagagaugguuuaaagacaaauucaugaagguauauuuugug

SEQ ID NO: 501157 - RNA, 63 nt, hsa
aaguuuaaauaccgugugcucuuccccagcugcaaagacaauguugcucuccgccuacacuag

SEQ ID NO: 501158 - RNA, 63 nt, hsa
cagggaaggaaacuguuguguccaauccccauuaaagacaaauugaucagugcuucccacucc

SEQ ID NO: 501159 - RNA, 63 nt, hsa
accuugggaccuguuuagagaagccggcucuucaaagacaauggaaacuguaccauacacauu

SEQ ID NO: 501160 - RNA, 62 nt, hsa
guucagaacuuucuuuagacuaaaaaaaaaaaaaaagacaaaauacacguugaccauggacu

SEQ ID NO: 501161 - RNA, 63 nt, hsa
ucuagguggccgagaagauuugauuuucuuuaaaaagacaagaauaaggucugguuagggaau

SEQ ID NO: 501162 - RNA, 63 nt, hsa
cccacugggaaaaagacuuuuuguacauuuggaaaagacaagcgagagcacacuauucucauu

SEQ ID NO: 501163 - RNA, 63 nt, hsa
gcauaaagaauauaauucugaaucccaaauuccaaagacaagaacucuguguuugaauucauu

SEQ ID NO: 501164 - RNA, 63 nt, hsa
aacuccagauauaucagugucaaaagcccaagaaaagacaaaaaagaaaaaaacaauccccag

SEQ ID NO: 501165 - RNA, 63 nt, hsa
gccucugucccccuuuaaacguugacccauuuuaaagacaaacaugaacauuaacaucauaau

SEQ ID NO: 501166 - RNA, 63 nt, hsa
uauucugggauucggucauuggaauuuauauuaaaagacaaguuauuaaaaaggaaagguucu

SEQ ID NO: 501167 - RNA, 59 nt, hsa
guaguagugagucugauugaaaaaccuuaaaagacaauauacagaauugaauacuguag

SEQ ID NO: 501168 - RNA, 63 nt, hsa
uaaauuuauauugaguuuaacaccugugugauuaaagacaacuuuccaauguaguaucuguag

SEQ ID NO: 501169 - RNA, 63 nt, hsa
cucagugugcccuugaauccauacaguuucuuaaaagacaauaaaaucuuauuaauaaaguua

SEQ ID NO: 501170 - RNA, 63 nt, hsa
auagaaggauaauacagagccaagaucaaauuaaaagacaauaaauggaacagaagggaggca

SEQ ID NO: 501171 - RNA, 63 nt, hsa
acaaaccuaccaaccaccaaaaacuagacaaauaaagacaaacuaaaacaaaacagaacaaaa

SEQ ID NO: 501172 - RNA, 63 nt, hsa
uaggaaaacaauaauuuuaacuuuuaagguugaaaagacaauagcccaaagccaagaaagaaa

SEQ ID NO: 501173 - RNA, 63 nt, hsa
gguaaaguauuuacugacugcuuauaaacauuuaaagacaaagacauuucaaauaacugcaga

SEQ ID NO: 501174 - RNA, 63 nt, hsa
uuugguuacuaaaauuuuguuugacuccuaacaaaagacaauggauggccuuagcaucagaau

SEQ ID NO: 501175 - RNA, 63 nt, hsa
uguuuuaaaauaauaacauuuuuauauuuuuuaaaagacaaacuucauauuauccuguguucu

SEQ ID NO: 501176 - RNA, 63 nt, hsa
cauuuucagucaaagaaccaugauuaaaaaaaaaaagacaacuuacaauuuaaauccuuaaaa

SEQ ID NO: 501177 - RNA, 63 nt, hsa
uagguuuuaucaccugcugcuguauuuguaaacaaagacaaauguugcuuuaagaaguaauua

SEQ ID NO: 501178 - RNA, 63 nt, hsa
gcucaauaaaauuguucagaagaucaaagugguaaagacaauguaaaauuuaacauuuuaaua

SEQ ID NO: 501179 - RNA, 63 nt, hsa
cuauguaauuucagaguuuuuauuuuguuacaaaaagacaaaaaugaaauauauaacaacaau

SEQ ID NO: 501180 - RNA, 63 nt, hsa
cucaggccuuacuaauccauaccaaauuagccuaaagacaaggcauuuuauauucauuucuau

SEQ ID NO: 501181 - RNA, 63 nt, hsa
aguguuaccagcauucauguggaaaucaagagcaaagacaaaauaauguuaaacaauucugua

SEQ ID NO: 501182 - RNA, 63 nt, hsa
aguaggaaucugugaagcaaaauguuugcugccaaagacaaaucagacugucagucauuaaaa

SEQ ID NO: 501183 - RNA, 63 nt, hsa
gaucugugacugauugaaaugcaugcaaauaaaaaagacaauauuaaagucuguuaucaaacc

SEQ ID NO: 501184 - RNA, 63 nt, hsa
agguguacguguuaaugucccauuucacgacgaaaagacaagacucuggggaugggaaugacu

SEQ ID NO: 501185 - RNA, 63 nt, hsa
ccaacaggaggacaauucaugaacuucgcaucaaaagacaauucuuuauacaacagugcuaaa

SEQ ID NO: 501186 - RNA, 63 nt, hsa
uauauaacuuaauguuaagugucuugaggcauaaaagacaaaauguggcuuauuuuaggaucu

SEQ ID NO: 501187 - RNA, 63 nt, hsa
acaaguauacacuagaggcucuuaaaaguauugaaagacaauacugcuguuauauagcaagac

SEQ ID NO: 501188 - RNA, 63 nt, hsa
auuguauucaaaauucauuguguauauuacuacaaagacaaccccaaaccaauuuuuuuccug

SEQ ID NO: 501189 - RNA, 63 nt, hsa
gggggaggcuuaccacuuuccccaaacaacauaaaagacaaugucccuucuucaaaagugcca

SEQ ID NO: 501190 - RNA, 63 nt, hsa
agaaaaacauccuuuuggaccauuugaaauaagaaagacaaacacuaaacaauacaaccauga

SEQ ID NO: 501191 - RNA, 63 nt, hsa
uggguuccaaugggaaaugacucuuuacuauuaaaagacaaggaaagcucugacuucguacuu

SEQ ID NO: 501192 - RNA, 63 nt, hsa
ggucucugaaaagcuggggugagugguuaccucaaagacaauugccuccaguuugggggcucc

SEQ ID NO: 501193 - RNA, 63 nt, hsa
cccuaguugaguagccagaugaaauucaagccuaaagacaauucauucauuugcauccauggg

SEQ ID NO: 501194 - RNA, 63 nt, hsa
gugacuuggccccagacgcauagacugagguauaaagacaaguaugaauauuacucucaaaau

SEQ ID NO: 501195 - RNA, 63 nt, hsa
cuggccaacauggugaaaccccgucucuacuaaaaagacaaaaaauuagcugggcgugguggc

SEQ ID NO: 501196 - RNA, 63 nt, hsa
acuugauguuuuugcauucuuugaguucaguuuaaagacaacuacgagcaucuguaaccaauc

SEQ ID NO: 501197 - RNA, 63 nt, hsa
ccaccacuccuggagucccaaugacuucucuggaaagacaaagagguuaucacaaaaauuccu

SEQ ID NO: 501198 - RNA, 63 nt, hsa
uuacauucugaguaccaaccaaacccuaaauugaaagacaaaacuaugguuucagucaacaua

SEQ ID NO: 501199 - RNA, 63 nt, hsa
acugacccagagcaaagcuuucccuaugguuccaaagacaacuaguauucaacaaaccuugua

SEQ ID NO: 501200 - RNA, 63 nt, hsa
uuucaugaacaguuacccucuguccccacaaccaaagacaacucauggccuccuuuggcccuu

SEQ ID NO: 501201 - RNA, 63 nt, hsa
gacacugguauuccugccuccauauuuucuuuaaaagacaaaucaaagcagauauauuaagug

SEQ ID NO: 501202 - RNA, 63 nt, hsa
agaaagucacuggggccugccaagcugccaccuaaagacaagagugagagggcugaguucuuc

SEQ ID NO: 501203 - RNA, 63 nt, hsa; identical to SEQ ID NO: 501196

SEQ ID NO: 501204 - RNA, 63 nt, hsa
agaaacuaaauuauaacuuuugcauaugugagaaaagacaacauuggugcuaacagugaagua

SEQ ID NO: 501205 - RNA, 63 nt, hsa
gauuucauuauauucucccccucuuccugcuaaaaagacaaaaaacaaaaaacaaaaaaaaca

SEQ ID NO: 501206 - RNA, 63 nt, hsa
aagcgcauugcacacuuuuuccuuucuaaacuuaaagacaagucaaaaagccauucuuagaac

SEQ ID NO: 501207 - RNA, 63 nt, hsa
ucuugucuauaagucacucugcuuuaucuugcuaaagacaauuuuucaagcaauccuuuaguu

SEQ ID NO: 501208 - RNA, 63 nt, hsa
uugacuuuauaguuuuccacagcacaaugagcaaaagacaaaccucgugggaagaugacacug

SEQ ID NO: 501209 - RNA, 63 nt, hsa
guauuggccugaaauagaguccuuaagacaagcaaagacaagcaaggcaagcacgucuggaaa

SEQ ID NO: 501210 - RNA, 63 nt, hsa
uuaaaccuuuauaaaccaguauuucacuuuuaaaaagacaaggcaucucuacccauuaacucu

SEQ ID NO: 501211 - RNA, 63 nt, hsa
auguuuacucuuccaucauuuaaaaaaaauguaaaagacaaaaaaaaaauggaggaugauuua

SEQ ID NO: 501212 - RNA, 63 nt, hsa
guuugcuacauucuuuuuucuauucaauaugugaaagacaauaaaacacuuuugacuugauuc

SEQ ID NO: 501213 - RNA, 63 nt, hsa
uguacuguacuucccaauugccacauuuuaaauaaagacaaauuuuuauuucuucuaaaaugc

SEQ ID NO: 501214 - RNA, 63 nt, hsa
caguaugcaccacagaauaagaguuugccguguaaagacaauauccccauucgucaugcucuu

SEQ ID NO: 501215 - RNA, 63 nt, hsa
uaauauacuuggcacagcgaaaaaauggauuuaaaagacaaaaauggagguccagguagaugu

SEQ ID NO: 501216 - RNA, 63 nt, hsa
aucaggucuuaaaaaaaaauaaagguaaacugaaaagacaacuggcuacaaagaaggauguca

SEQ ID NO: 501217 - RNA, 63 nt, hsa
gaaugaaaauaaccuuggugaguuguacaaauuaaagacaaagaacuacaugugaagauagac

SEQ ID NO: 501218 - RNA, 63 nt, hsa
uauuugcagaguacacuuguaugguagacuguuaaagacaauuuuaugacuauuuaugcacau

SEQ ID NO: 501219 - RNA, 63 nt, hsa
cuccauccuccacuuauucugccuguuucccccaaagacaauggcuggacccugcaugcaggg

SEQ ID NO: 501220 - RNA, 63 nt, hsa
ccuuuaguauuuaauggaaaauugguuccugcaaaagacaaagggugagaguuagcguccugu

SEQ ID NO: 501221 - RNA, 63 nt, hsa
aauguaguggccuuggauauccuguuuguuaauaaagacaauucaaccagcucccaccaugca

SEQ ID NO: 501222 - RNA, 63 nt, hsa
ccuuguagcugauacuuggcaaaagugucacugaaagacaagcuaaauguaguuauuuuaucc

SEQ ID NO: 501223 - RNA, 63 nt, hsa
uuugugacgcagguugaagggggaggaauagaaaaagacaaacugccuuggaggagauaaacc

SEQ ID NO: 501224 - RNA, 63 nt, hsa
gucaauauguaguggaaagaagcauguagcaaaaaagacaaccuugaucuuuaauaaaaaaga

SEQ ID NO: 501225 - RNA, 63 nt, hsa
gguacccuuauuuccucgacacgcaacuggcucaaagacaauguuauuuuccuucccuuucuu

SEQ ID NO: 501226 - RNA, 63 nt, hsa
acuuuuccugcacuggacaguaaaaaaauaauaaaagacaaaaacaaauuuaaaaaaaaauuu

SEQ ID NO: 501227 - RNA, 63 nt, hsa
gaaugucccuuccaacuuuuauauuaaaaauaaaaagacaagaaaauugaagaucauuuuuca

SEQ ID NO: 501228 - RNA, 63 nt, hsa
uaguucuuccagcccucauugagguaacaagauaaagacaaauccacuucuuuggccaaauuc

SEQ ID NO: 501229 - RNA, 63 nt, hsa
uuuuguaauugagagcucauuucaaaagcagaaaaagacaacaaauauuaaagcaaggaaaag

SEQ ID NO: 501230 - RNA, 63 nt, hsa
uccuggaaaaaacaaaaacaaaaaacugcagugaaagacaagcugcaaaucagccaugugcug

SEQ ID NO: 501231 - RNA, 63 nt, hsa
aaaauaugggagcugagauuccguucguggaaaaaagacaaggccacccucucgcccucagag

SEQ ID NO: 501232 - RNA, 63 nt, hsa
aguuucaaguuaguuagaagcauguugucaacuaaagacaacaaacuaucagauucauucauu

SEQ ID NO: 501233 - RNA, 63 nt, hsa
ggcauaugaccaugcaagacugucagugccaacaaagacaacacuaaucagcacaucguacac

SEQ ID NO: 501234 - RNA, 63 nt, hsa
gcuuggucaaacuuuuuccagcaaaauggaagcaaagacaaaagaaacuuaccaauugauguu

SEQ ID NO: 501235 - RNA, 63 nt, hsa
ccagccuaaaugcccaucaagcaaugaguggauaaagacaaugcgguguacauauacaccaug

SEQ ID NO: 501236 - RNA, 63 nt, hsa
gaaaaacuaccagacuguuuuuugucuucucacaaagacaagaaaaaucagggcauuuuguga

SEQ ID NO: 501237 - RNA, 63 nt, hsa
ccuccuugagaagaccagaagucaacccaucccaaagacaaacugcaugaaaaggguacagcu

SEQ ID NO: 501238 - RNA, 63 nt, hsa
uuuuccuccucugaacuggauuuuauaggcauuaaagacaagucggguggcuagagggcuccu

SEQ ID NO: 501239 - RNA, 63 nt, hsa
gucagccccuuccuuucccccgaccuaaacauaaaagacaaggcaaagcccgcauaauuuuaa

SEQ ID NO: 501240 - RNA, 63 nt, hsa
aucugcuguccuccggggucaagaaaagcauggaaagacaauauaugauguacccagggacca

SEQ ID NO: 501241 - RNA, 63 nt, hsa
ucuguucuuccagaguccagagacauuguuaauaaagacaaugaaucaugaccgaaaggaugu

SEQ ID NO: 501242 - RNA, 63 nt, hsa
cacugcugcugccuuuagucgcugaggaaaaauaaagacaaaugcugcgcccuuccccagagu

SEQ ID NO: 501243 - RNA, 63 nt, hsa
gaagagggugguagaggagguaagacaguagggaaagacaagggcccaugcucuuagugggga

SEQ ID NO: 501244 - RNA, 63 nt, hsa
gggggugggaacaagauggauggaaagggagggaaagacaagaugcaacuaggaagagacaca

SEQ ID NO: 501245 - RNA, 63 nt, hsa
ggaaauccucagagaaggugauauuuucaggaaaaagacaaaugcccucauaguagugggaag

SEQ ID NO: 501246 - RNA, 63 nt, hsa
aucagacauuauuuauaaaacuuaguuuaaaaaaaagacaaaaaaaaaaaagccaagccguga

SEQ ID NO: 501247 - RNA, 63 nt, hsa
cucagugaaaagcugaagugcaaaagagcuaucaaagacaagaggauaaaagacugggauagu

SEQ ID NO: 501248 - RNA, 63 nt, hsa
aaccaccaaaaacugaaaccccagacccaccagaaagacaagugucuagcaaugccuugguac

SEQ ID NO: 501249 - RNA, 63 nt, hsa
uucuucaucuucuucuuuuuuuuuuuuuuuuguaaagacaaguuuauuccuuuacgcuucuug

SEQ ID NO: 501250 - RNA, 63 nt, hsa
uguuaacuucucccccuaacauaucagauauguaaagacaaagaacaaaagguuuaauauauu

SEQ ID NO: 501251 - RNA, 63 nt, hsa
acuaucauuguagugugauuucuuuguauuagcaaagacaaaaacgcuaacauugaaaaagua

SEQ ID NO: 501252 - RNA, 63 nt, hsa
uuuauuuuaguucuaaauuauguuucagaaacaaaagacaaugcuguacaguuuuauuccucu

SEQ ID NO: 501253 - RNA, 63 nt, hsa
aacgugcuaaaucuuuuauguauucuaacuuuaaaagacaagugcaacaaaguuagacugacu

SEQ ID NO: 501254 - RNA, 63 nt, hsa
guauuaugucgucugauacuaaaauggucuuauaaagacaaguggacuugggcccuauucagg

SEQ ID NO: 501255 - RNA, 63 nt, hsa
cuuuaaugguacugauuucugaaacgauaaguaaaagacaaaauauuuuguggugggagcagu

SEQ ID NO: 501256 - RNA, 63 nt, hsa
ggggacaccuguacauucuuccaucaucacuguaaagacaaauaaaugauuauauucacagac

SEQ ID NO: 501257 - RNA, 63 nt, hsa
cauugauuugcaguuaagaauaaaccuuaaagcaaagacaaccacauuuuaauuuguucacag

SEQ ID NO: 501258 - RNA, 63 nt, hsa
gaaaauggugaggaggguggggggaagugaaggaaagacaagcagggcuaauuccaaaaagca

SEQ ID NO: 501259 - RNA, 63 nt, hsa
ugaugaugguauaaaguuugcucauuaagaaaaaaagacaaggcugauuuugaagagaguugc

SEQ ID NO: 501260 - RNA, 53 nt, hsa
auuuuggucaagaaggcuaagccaaagacaaggaagaugcuuaccauauguau

SEQ ID NO: 501261 - RNA, 63 nt, hsa
uuauggaucaugccgaagugucacaacugcacuaaagacaaauagcacuagaggcuauugcca

SEQ ID NO: 501262 - RNA, 63 nt, hsa
aagaacaccccugccgacucccagcccggccaaaaagacaaaacacauagacgcacacacuca

SEQ ID NO: 501263 - RNA, 63 nt, hsa
cagaauguaucucuccaagaugagagcucauuaaaagacaauuacaaagcuuaucacauccaa

SEQ ID NO: 501264 - RNA, 63 nt, hsa
aggggacauccacccucugggguguggccaggaaaagacaagcucuucagcuuggggauccga

SEQ ID NO: 501265 - RNA, 63 nt, hsa
cauugcaccuucccgugcuguaauuggcuugacaaagacaagcaggcuucucuguugagacuu

SEQ ID NO: 501266 - RNA, 63 nt, hsa
ugguauuuugaugccaaggagcgggcagcagccaaagacaaguaucagcuagguaccugcuuc

SEQ ID NO: 501267 - RNA, 63 nt, hsa
agcaaggacaaauucagagacccugagcuuuagaaagacaaguggguggcuuugauggacggu

SEQ ID NO: 501268 - RNA, 63 nt, hsa
uguauaccuaaaggaauauaaucauuccaccauaaagacaaacacuuguauguucauugcagc

SEQ ID NO: 501269 - RNA, 63 nt, hsa
ucuguucaucaaaugaugcuguuaagauagggaaaagacaagaaacaggacuggaagaagaug

SEQ ID NO: 501270 - RNA, 63 nt, hsa
ggcaggcucaccauaguaaaaaugcugaaagccaaagacaaaauugggagaacaaaagaaaag

SEQ ID NO: 501271 - RNA, 63 nt, hsa
gguccucuuccaucuugcugaacuguucgaggcaaagacaaaacccaacuuugaccaagaaga

SEQ ID NO: 501272 - RNA, 63 nt, hsa
gcaagucaaccagcaugcagggggccuuccucuaaagacaaggacuccacaugcuuuucuuuu

SEQ ID NO: 501273 - RNA, 63 nt, hsa
gaacggccauguguuaauguuacgauguuuuuaaaagacaaaaaaaaaaaaaaaaccucaaaa

SEQ ID NO: 501274 - RNA, 63 nt, hsa
ugucuuuuaagaaaggggauauuaaaaaaaaaaaaagacaaaaguguuuuuaaaaaaaagcaa

SEQ ID NO: 501275 - RNA, 63 nt, hsa
uacaaguuacaaccaacuucuaugaaaaguugaaaagacaaaaaaaaaaaaaaaaagcgagcg

SEQ ID NO: 501276 - RNA, 63 nt, hsa
uuuuuuuuuugcuggugucugagcuucaguauaaaagacaaaacuuccuguuuguggaacaaa

SEQ ID NO: 501277 - RNA, 63 nt, hsa
aaauguuacaugacacuucuagaaggauucuuaaaagacaaauacacccuuucuucccccuuc

SEQ ID NO: 501278 - RNA, 63 nt, hsa
uguaaaaaaaaaaaaaaaaaaaaagacaaaacaaaagacaaaaaaaaaaaaaaaacccaacaa

SEQ ID NO: 501279 - RNA, 63 nt, hsa
gugauaaaaaacuguaaaaaaaaaaaaaaaaaaaaagacaaaacaaaagacaaaaaaaaaaaa

SEQ ID NO: 501280 - RNA, 63 nt, hsa
ggauucuugaacuugaaaaaaaaaaacacaaaaaaagacaaaaaaaaaaaaagaaaauauuuu

SEQ ID NO: 501281 - RNA, 63 nt, hsa
guaaauauuucaacgaaauggaaaagaaaaaaaaaagacaaaaaaaaaaaaaaagaaaagaaa

SEQ ID NO: 501282 - RNA, 63 nt, hsa
aucaaaaauauguuccgagugcaaugcccacugaaagacaaacuugcauauguugauuaacuu

SEQ ID NO: 501283 - RNA, 63 nt, hsa
ccaggggcauggacagagccuuuuucuaaagaaaaagacaaaaaguuaaaaaaaaaaaaaaga

SEQ ID NO: 501284 - RNA, 63 nt, hsa
uaaauuaagucaaacauuugguuuccagaaaauaaagacaaauagagaagguuagauuuuuuu

SEQ ID NO: 501285 - RNA, 63 nt, hsa
gaggagacaauggaugcaaacagcccacacaggaaagacaaagcaggagcgugcacgcucucu

SEQ ID NO: 501286 - RNA, 63 nt, hsa
uuuuuuuuuuuaagaaaaacaacaacaacaaaaaaagacaaugaaaaaaaaaacgucauguga

SEQ ID NO: 501287 - RNA, 63 nt, hsa
cacaaaaauaccugguccaaacaagaaaaacaaaaagacaagcaaaacuaaagaacugcaguc

SEQ ID NO: 501288 - RNA, 63 nt, hsa
cgaaaucauggggacaauuuggauuuuguuccaaaagacaaguguuuuuaaaaagaaccuuuc

SEQ ID NO: 501289 - RNA, 63 nt, hsa
gaaaaugugcauauuccucacuggcauuuuccaaaagacaaaaauuguccaagacauauacuc

SEQ ID NO: 501290 - RNA, 63 nt, hsa
uuaaguuaauguuaaguaaucauuucucauuccaaagacaaugcaaaaaacuucagcacugcu

SEQ ID NO: 501291 - RNA, 63 nt, hsa
ugauauuucuaauaauauaugguuuuaaacauuaaagacaaauguuuuuauacaaaugaauuu

SEQ ID NO: 501292 - RNA, 63 nt, hsa
aguuuuuaacuuuuuuuuauuuuaauaacugcaaaagacaaaaugacuauacagacuuuaguc

SEQ ID NO: 501293 - RNA, 63 nt, hsa
agggguuaggguucuuuccccaaaggaacuuaaaaagacaagcguggccaggcacaguggcuc

SEQ ID NO: 501294 - RNA, 63 nt, hsa
aguuaacucaaaaccaacacacagagugcaggaaaagacaauuagaaacuauuuuucuuauua

SEQ ID NO: 501295 - RNA, 63 nt, hsa
ugaaaacaauuuuuuugaaucuuucguagccuaaaagacaauuuuccuuggaacacauaagaa

SEQ ID NO: 501296 - RNA, 63 nt, hsa
uacauaauuugucuuucuuaguaauuuggcuucaaagacaaauuuuugaccacaccuccguuu

SEQ ID NO: 501297 - RNA, 63 nt, hsa
caaagacuucacuucuguuuccugaaucuaaagaaagacaacaugcugcuuuuuaaucauagg

SEQ ID NO: 501298 - RNA, 63 nt, hsa
gacaggcuggaagauagcugugacuucuauuuuaaagacaauguuaaacuuauaacccacuuu

SEQ ID NO: 501299 - RNA, 63 nt, hsa
gcaggacuuuguaguuguaugcuugauuuggggaaagacaaagagcugucccugagggccugu

SEQ ID NO: 501300 - RNA, 63 nt, hsa
ggcuggcugcauucccccaggaugggcuucgagaaagacaaacuugucuggaaaccagaguug

SEQ ID NO: 501301 - RNA, 63 nt, hsa
uuugcagcucaaugcagccaugacaaggaaagaaaagacaaaggaaggccagagagccgcgca

SEQ ID NO: 501302 - RNA, 63 nt, hsa
uaacuuaugaacacacgugaaguguugaguccaaaagacaaaggggcaucggcaugucagcgu

SEQ ID NO: 501303 - RNA, 63 nt, hsa
uggggguggguuuccuggcaccuacaugaaaaaaaagacaaguuauaugggugaugaagaaaa

SEQ ID NO: 501304 - RNA, 63 nt, hsa
aaaaaaaaagacguauuuuugcuuacucagauaaaagacaaccuguaaaaauauaauaauuaa

SEQ ID NO: 501305 - RNA, 63 nt, hsa
uugugugugcccucuacccuuaaauucagaaauaaagacaauaaaaaauuaaaauaauugccc

SEQ ID NO: 501306 - RNA, 63 nt, hsa
ccaucuuuuuuuuuaaauuuuuucugccuauuuaaagacaaauuaugggacguuuguagaacc

SEQ ID NO: 501307 - RNA, 63 nt, hsa
cacuagggcuacuguggcaucuauguagacaggaaagacaaacguguuucauaaaauucguug

SEQ ID NO: 501308 - RNA, 63 nt, hsa
aacuuuuaaaauauuaagccugaagacuucuaaaaagacaagaaacauggccuaaauaaccaa

SEQ ID NO: 501309 - RNA, 63 nt, hsa
uaagggcucacacauuuacuguacucagaucugaaagacaauguugcuucuugauuuuuuucu

SEQ ID NO: 501310 - RNA, 63 nt, hsa
gcaaaggaucaacuuuuagucaugauguucuguaaagacaacaaaucccuuuuuuuuucucaa

SEQ ID NO: 501311 - RNA, 63 nt, hsa
aacgauaaaagacagugaaagaaaauaacaauaaaagacaaggaaaaaauaacaaugaaaguu

SEQ ID NO: 501312 - RNA, 63 nt, hsa
auaccugcagcaucuuuagucaaguuggaggagaaagacaacacuuggucuaagacacggcag

SEQ ID NO: 501313 - RNA, 63 nt, hsa
cccacugaugcagacauccagagaguccuaugaaaagacaaggccauuaugcacagguugaau

SEQ ID NO: 501314 - RNA, 63 nt, hsa
uucuuauuccauauuagaaaacuuuguuaggccaaagacaaauaguaggcaagauggcacagg

SEQ ID NO: 501315 - RNA, 63 nt, hsa
gaaaacccugacaccuuuaaaaagcaguuuuugaaagacaaaauuuagauuuaauuuacgucu

SEQ ID NO: 501316 - RNA, 63 nt, hsa
guucuuggacuuugccccgaaagcacauccauaaaagacaaaaucugauauauuggacuucuu

SEQ ID NO: 501317 - RNA, 63 nt, hsa
aaacuaugacucuguucagaaaaaaaauuguccaaagacaacauggccaaggagagagcaucu

SEQ ID NO: 501318 - RNA, 63 nt, hsa
gcaaacagagccaaguauccuucaguccacuggaaagacaaguuccugcaucaccacagugua

SEQ ID NO: 501319 - RNA, 63 nt, hsa
ggcauaaccuagccugugaggaaccuaguuaggaaagacaacugacauuuauugaauaucaug

SEQ ID NO: 501320 - RNA, 63 nt, hsa
uuugaguauaacaucaagcuuuaacaaauauuuaaagacaaaaaaaucacgucaguaaaauac

SEQ ID NO: 501321 - RNA, 63 nt, hsa
gggcagguguguauuuacuuuagaaaaaaugaaaaagacaagauuuaugagaaauauuugaag

SEQ ID NO: 501322 - RNA, 63 nt, hsa
gagaacauaagagaaaaggaaaccuguuacagaaaagacaagaaucuguguuuuggaaugagu

SEQ ID NO: 501323 - RNA, 63 nt, hsa
aggaaaaagaguuaugaagauacagauuuagacaaagacaagagcaucagacaaaggaaaaga

SEQ ID NO: 501324 - RNA, 63 nt, hsa
aguuucuuggagaaucacauuucuuuacagguuaaagacaaacaagaccccaggguuuuuauc

SEQ ID NO: 501325 - RNA, 63 nt, hsa
uuuuuuuuuucuguaaucauagcccauaauggcaaagacaacuaaauuuaagugaaggucaug

SEQ ID NO: 501326 - RNA, 63 nt, hsa
uuacccucugguaauugauacagauauuggaaaaaagacaacauugauguuauuugugcucuu

SEQ ID NO: 501327 - RNA, 63 nt, hsa
uaaggcucagugccacucaccccucccuccccaaaagacaagagaaauuuggccagaugggga

SEQ ID NO: 501328 - RNA, 63 nt, hsa
gcaaaucuuccagacuauggcuugaguaggaugaaagacaaacacaucugcccaaugauccag

SEQ ID NO: 501329 - RNA, 63 nt, hsa
ugcauguaaaauuccuuccagccagaaagaaagaaagacaaggaguaagggggauuuagaguu

SEQ ID NO: 501330 - RNA, 63 nt, hsa
acuucagcagacuagucauuucaauacccaaagaaagacaagugacaggggcaauggaucuca

SEQ ID NO: 501331 - RNA, 63 nt, hsa
cuaugcagaacaggcagaaauauaaacacauuaaaagacaaauauguagaauguaauauacug

SEQ ID NO: 501332 - RNA, 63 nt, hsa
ugggguaauuaaauugccaccuucgugguuguaaaagacaaacaaaacauggcaaauuucauu

SEQ ID NO: 501333 - RNA, 63 nt, hsa
cugcuuucuauuuuacauugaguaaaguuuuaaaaagacaacagucaaguugauuuugauuag

SEQ ID NO: 501334 - RNA, 63 nt, hsa
auacagcggcuguucccgccaguuccacagaucaaagacaaacugaaugauaaccaugaggug

SEQ ID NO: 501335 - RNA, 64 nt, hsa; identical to SEQ ID NO: 130660

SEQ ID NO: 501336 - RNA, 64 nt, hsa; identical to SEQ ID NO: 130661

SEQ ID NO: 501337 - RNA, 64 nt, hsa; identical to SEQ ID NO: 130662

SEQ ID NO: 501338 - RNA, 64 nt, hsa; identical to SEQ ID NO: 130663

SEQ ID NO: 501339 - RNA, 64 nt, hsa; identical to SEQ ID NO: 130664

SEQ ID NO: 501340 - RNA, 64 nt, hsa; identical to SEQ ID NO: 130665

SEQ ID NO: 501341 - RNA, 64 nt, hsa; identical to SEQ ID NO: 130666

SEQ ID NO: 501342 - RNA, 64 nt, hsa; identical to SEQ ID NO: 130667

SEQ ID NO: 501343 - RNA, 64 nt, hsa; identical to SEQ ID NO: 130668

SEQ ID NO: 501344 - RNA, 64 nt, hsa; identical to SEQ ID NO: 130669

SEQ ID NO: 501345 - RNA, 64 nt, hsa; identical to SEQ ID NO: 130670

SEQ ID NO: 501346 - RNA, 64 nt, hsa; identical to SEQ ID NO: 130671

SEQ ID NO: 501347 - RNA, 64 nt, hsa; identical to SEQ ID NO: 130672

SEQ ID NO: 501348 - RNA, 64 nt, hsa; identical to SEQ ID NO: 130673

SEQ ID NO: 501349 - RNA, 64 nt, hsa; identical to SEQ ID NO: 130674

SEQ ID NO: 501350 - RNA, 64 nt, hsa; identical to SEQ ID NO: 130675

SEQ ID NO: 501351 - RNA, 64 nt, hsa; identical to SEQ ID NO: 130676

SEQ ID NO: 501352 - RNA, 64 nt, hsa; identical to SEQ ID NO: 130677

SEQ ID NO: 501353 - RNA, 64 nt, hsa; identical to SEQ ID NO: 130678

SEQ ID NO: 501354 - RNA, 64 nt, hsa; identical to SEQ ID NO: 130679

SEQ ID NO: 501355 - RNA, 64 nt, hsa; identical to SEQ ID NO: 130680

SEQ ID NO: 501356 - RNA, 64 nt, hsa; identical to SEQ ID NO: 130681

SEQ ID NO: 501357 - RNA, 64 nt, hsa; identical to SEQ ID NO: 130682

SEQ ID NO: 501358 - RNA, 64 nt, hsa; identical to SEQ ID NO: 130683

SEQ ID NO: 501359 - RNA, 64 nt, hsa; identical to SEQ ID NO: 130684

SEQ ID NO: 501360 - RNA, 64 nt, hsa; identical to SEQ ID NO: 130685

SEQ ID NO: 501361 - RNA, 64 nt, hsa; identical to SEQ ID NO: 130686

SEQ ID NO: 501362 - RNA, 64 nt, hsa; identical to SEQ ID NO: 130687

SEQ ID NO: 501363 - RNA, 64 nt, hsa; identical to SEQ ID NO: 130688

SEQ ID NO: 501364 - RNA, 64 nt, hsa; identical to SEQ ID NO: 130689

SEQ ID NO: 501365 - RNA, 64 nt, hsa; identical to SEQ ID NO: 130690

SEQ ID NO: 501366 - RNA, 64 nt, hsa; identical to SEQ ID NO: 130691

SEQ ID NO: 501367 - RNA, 64 nt, hsa; identical to SEQ ID NO: 130692

SEQ ID NO: 501368 - RNA, 64 nt, hsa; identical to SEQ ID NO: 130693

SEQ ID NO: 501369 - RNA, 64 nt, hsa; identical to SEQ ID NO: 130694

SEQ ID NO: 501370 - RNA, 64 nt, hsa; identical to SEQ ID NO: 130695

SEQ ID NO: 501371 - RNA, 64 nt, hsa; identical to SEQ ID NO: 130696

SEQ ID NO: 501372 - RNA, 64 nt, hsa; identical to SEQ ID NO: 130697

SEQ ID NO: 501373 - RNA, 64 nt, hsa; identical to SEQ ID NO: 130698

SEQ ID NO: 501374 - RNA, 64 nt, hsa; identical to SEQ ID NO: 130699

SEQ ID NO: 501375 - RNA, 64 nt, hsa; identical to SEQ ID NO: 130700

SEQ ID NO: 501376 - RNA, 64 nt, hsa; identical to SEQ ID NO: 130701

SEQ ID NO: 501377 - RNA, 64 nt, hsa; identical to SEQ ID NO: 130702

SEQ ID NO: 501378 - RNA, 64 nt, hsa; identical to SEQ ID NO: 130703

SEQ ID NO: 501379 - RNA, 64 nt, hsa; identical to SEQ ID NO: 130704

SEQ ID NO: 501380 - RNA, 64 nt, hsa; identical to SEQ ID NO: 130705

SEQ ID NO: 501381 - RNA, 64 nt, hsa; identical to SEQ ID NO: 130706

SEQ ID NO: 501382 - RNA, 64 nt, hsa; identical to SEQ ID NO: 130707

SEQ ID NO: 501383 - RNA, 64 nt, hsa; identical to SEQ ID NO: 130708

SEQ ID NO: 501384 - RNA, 64 nt, hsa; identical to SEQ ID NO: 130709

SEQ ID NO: 501385 - RNA, 63 nt, hsa; identical to SEQ ID NO: 500709

SEQ ID NO: 501386 - RNA, 63 nt, hsa; identical to SEQ ID NO: 500710

SEQ ID NO: 501387 - RNA, 63 nt, hsa; identical to SEQ ID NO: 500711

SEQ ID NO: 501388 - RNA, 63 nt, hsa; identical to SEQ ID NO: 500712

SEQ ID NO: 501389 - RNA, 63 nt, hsa; identical to SEQ ID NO: 500713

SEQ ID NO: 501390 - RNA, 63 nt, hsa; identical to SEQ ID NO: 500714

SEQ ID NO: 501391 - RNA, 63 nt, hsa; identical to SEQ ID NO: 500715

SEQ ID NO: 501392 - RNA, 63 nt, hsa; identical to SEQ ID NO: 500716

SEQ ID NO: 501393 - RNA, 63 nt, hsa; identical to SEQ ID NO: 500717

SEQ ID NO: 501394 - RNA, 63 nt, hsa; identical to SEQ ID NO: 500718

SEQ ID NO: 501395 - RNA, 63 nt, hsa; identical to SEQ ID NO: 500719

SEQ ID NO: 501396 - RNA, 63 nt, hsa; identical to SEQ ID NO: 500720

SEQ ID NO: 501397 - RNA, 63 nt, hsa; identical to SEQ ID NO: 500721

SEQ ID NO: 501398 - RNA, 63 nt, hsa; identical to SEQ ID NO: 500722

SEQ ID NO: 501399 - RNA, 63 nt, hsa; identical to SEQ ID NO: 500723

SEQ ID NO: 501400 - RNA, 63 nt, hsa; identical to SEQ ID NO: 500724

SEQ ID NO: 501401 - RNA, 63 nt, hsa; identical to SEQ ID NO: 500725

SEQ ID NO: 501402 - RNA, 63 nt, hsa; identical to SEQ ID NO: 500726

SEQ ID NO: 501403 - RNA, 63 nt, hsa; identical to SEQ ID NO: 500727

SEQ ID NO: 501404 - RNA, 63 nt, hsa; identical to SEQ ID NO: 500728

SEQ ID NO: 501405 - RNA, 63 nt, hsa; identical to SEQ ID NO: 500729

SEQ ID NO: 501406 - RNA, 63 nt, hsa; identical to SEQ ID NO: 500730

SEQ ID NO: 501407 - RNA, 63 nt, hsa; identical to SEQ ID NO: 500731

SEQ ID NO: 501408 - RNA, 63 nt, hsa; identical to SEQ ID NO: 500732

SEQ ID NO: 501409 - RNA, 63 nt, hsa; identical to SEQ ID NO: 500733

SEQ ID NO: 501410 - RNA, 62 nt, hsa; identical to SEQ ID NO: 500734

SEQ ID NO: 501411 - RNA, 63 nt, hsa; identical to SEQ ID NO: 500735

SEQ ID NO: 501412 - RNA, 63 nt, hsa; identical to SEQ ID NO: 500736

SEQ ID NO: 501413 - RNA, 63 nt, hsa; identical to SEQ ID NO: 500737

SEQ ID NO: 501414 - RNA, 63 nt, hsa; identical to SEQ ID NO: 500738

SEQ ID NO: 501415 - RNA, 63 nt, hsa; identical to SEQ ID NO: 500739

SEQ ID NO: 501416 - RNA, 63 nt, hsa; identical to SEQ ID NO: 500740

SEQ ID NO: 501417 - RNA, 63 nt, hsa; identical to SEQ ID NO: 500741

SEQ ID NO: 501418 - RNA, 63 nt, hsa; identical to SEQ ID NO: 500742

SEQ ID NO: 501419 - RNA, 63 nt, hsa; identical to SEQ ID NO: 500743

SEQ ID NO: 501420 - RNA, 63 nt, hsa; identical to SEQ ID NO: 500744

SEQ ID NO: 501421 - RNA, 63 nt, hsa; identical to SEQ ID NO: 500745

SEQ ID NO: 501422 - RNA, 63 nt, hsa; identical to SEQ ID NO: 500746

SEQ ID NO: 501423 - RNA, 63 nt, hsa; identical to SEQ ID NO: 500747

SEQ ID NO: 501424 - RNA, 57 nt, hsa; identical to SEQ ID NO: 500748

SEQ ID NO: 501425 - RNA, 63 nt, hsa; identical to SEQ ID NO: 500749

SEQ ID NO: 501426 - RNA, 63 nt, hsa; identical to SEQ ID NO: 500750

SEQ ID NO: 501427 - RNA, 63 nt, hsa; identical to SEQ ID NO: 500751

SEQ ID NO: 501428 - RNA, 63 nt, hsa; identical to SEQ ID NO: 500752

SEQ ID NO: 501429 - RNA, 63 nt, hsa; identical to SEQ ID NO: 500753

SEQ ID NO: 501430 - RNA, 63 nt, hsa; identical to SEQ ID NO: 500754

SEQ ID NO: 501431 - RNA, 63 nt, hsa; identical to SEQ ID NO: 500755

SEQ ID NO: 501432 - RNA, 63 nt, hsa; identical to SEQ ID NO: 500756

SEQ ID NO: 501433 - RNA, 63 nt, hsa; identical to SEQ ID NO: 500757

SEQ ID NO: 501434 - RNA, 63 nt, hsa; identical to SEQ ID NO: 500758

SEQ ID NO: 501435 - RNA, 63 nt, hsa; identical to SEQ ID NO: 500759

SEQ ID NO: 501436 - RNA, 63 nt, hsa; identical to SEQ ID NO: 500760

SEQ ID NO: 501437 - RNA, 63 nt, hsa; identical to SEQ ID NO: 500761

SEQ ID NO: 501438 - RNA, 63 nt, hsa; identical to SEQ ID NO: 500762

SEQ ID NO: 501439 - RNA, 63 nt, hsa; identical to SEQ ID NO: 500763

SEQ ID NO: 501440 - RNA, 50 nt, hsa; identical to SEQ ID NO: 500764

SEQ ID NO: 501441 - RNA, 63 nt, hsa; identical to SEQ ID NO: 500765

SEQ ID NO: 501442 - RNA, 63 nt, hsa; identical to SEQ ID NO: 500766

SEQ ID NO: 501443 - RNA, 63 nt, hsa; identical to SEQ ID NO: 500767

SEQ ID NO: 501444 - RNA, 63 nt, hsa; identical to SEQ ID NO: 500768

SEQ ID NO: 501445 - RNA, 63 nt, hsa; identical to SEQ ID NO: 500769

SEQ ID NO: 501446 - RNA, 63 nt, hsa; identical to SEQ ID NO: 500770

SEQ ID NO: 501447 - RNA, 63 nt, hsa; identical to SEQ ID NO: 500771

SEQ ID NO: 501448 - RNA, 63 nt, hsa; identical to SEQ ID NO: 500772

SEQ ID NO: 501449 - RNA, 63 nt, hsa; identical to SEQ ID NO: 500773

SEQ ID NO: 501450 - RNA, 63 nt, hsa; identical to SEQ ID NO: 500774

SEQ ID NO: 501451 - RNA, 63 nt, hsa; identical to SEQ ID NO: 500775

SEQ ID NO: 501452 - RNA, 63 nt, hsa; identical to SEQ ID NO: 500776

SEQ ID NO: 501453 - RNA, 63 nt, hsa; identical to SEQ ID NO: 500777

SEQ ID NO: 501454 - RNA, 63 nt, hsa; identical to SEQ ID NO: 500778

SEQ ID NO: 501455 - RNA, 63 nt, hsa; identical to SEQ ID NO: 500779

SEQ ID NO: 501456 - RNA, 63 nt, hsa; identical to SEQ ID NO: 500780

SEQ ID NO: 501457 - RNA, 63 nt, hsa; identical to SEQ ID NO: 500781

SEQ ID NO: 501458 - RNA, 63 nt, hsa; identical to SEQ ID NO: 500782

SEQ ID NO: 501459 - RNA, 63 nt, hsa; identical to SEQ ID NO: 500783

SEQ ID NO: 501460 - RNA, 63 nt, hsa; identical to SEQ ID NO: 500784

SEQ ID NO: 501461 - RNA, 51 nt, hsa; identical to SEQ ID NO: 500785

SEQ ID NO: 501462 - RNA, 63 nt, hsa; identical to SEQ ID NO: 500786

SEQ ID NO: 501463 - RNA, 63 nt, hsa; identical to SEQ ID NO: 500787

SEQ ID NO: 501464 - RNA, 63 nt, hsa; identical to SEQ ID NO: 500788

SEQ ID NO: 501465 - RNA, 63 nt, hsa; identical to SEQ ID NO: 500789

SEQ ID NO: 501466 - RNA, 63 nt, hsa; identical to SEQ ID NO: 500790

SEQ ID NO: 501467 - RNA, 63 nt, hsa; identical to SEQ ID NO: 500791

SEQ ID NO: 501468 - RNA, 63 nt, hsa; identical to SEQ ID NO: 500792

SEQ ID NO: 501469 - RNA, 63 nt, hsa; identical to SEQ ID NO: 500793

SEQ ID NO: 501470 - RNA, 63 nt, hsa; identical to SEQ ID NO: 500794

SEQ ID NO: 501471 - RNA, 63 nt, hsa; identical to SEQ ID NO: 500795

SEQ ID NO: 501472 - RNA, 63 nt, hsa; identical to SEQ ID NO: 500796

SEQ ID NO: 501473 - RNA, 63 nt, hsa; identical to SEQ ID NO: 500797

SEQ ID NO: 501474 - RNA, 63 nt, hsa; identical to SEQ ID NO: 500798

SEQ ID NO: 501475 - RNA, 63 nt, hsa; identical to SEQ ID NO: 500799

SEQ ID NO: 501476 - RNA, 63 nt, hsa; identical to SEQ ID NO: 500800

SEQ ID NO: 501477 - RNA, 63 nt, hsa; identical to SEQ ID NO: 500801

SEQ ID NO: 501478 - RNA, 63 nt, hsa; identical to SEQ ID NO: 500802

SEQ ID NO: 501479 - RNA, 63 nt, hsa; identical to SEQ ID NO: 500803

SEQ ID NO: 501480 - RNA, 63 nt, hsa; identical to SEQ ID NO: 500804

SEQ ID NO: 501481 - RNA, 63 nt, hsa; identical to SEQ ID NO: 500805

SEQ ID NO: 501482 - RNA, 63 nt, hsa; identical to SEQ ID NO: 500806

SEQ ID NO: 501483 - RNA, 63 nt, hsa; identical to SEQ ID NO: 500807

SEQ ID NO: 501484 - RNA, 63 nt, hsa; identical to SEQ ID NO: 500808

SEQ ID NO: 501485 - RNA, 63 nt, hsa; identical to SEQ ID NO: 500809

SEQ ID NO: 501486 - RNA, 63 nt, hsa; identical to SEQ ID NO: 500810

SEQ ID NO: 501487 - RNA, 63 nt, hsa; identical to SEQ ID NO: 500811

SEQ ID NO: 501488 - RNA, 63 nt, hsa; identical to SEQ ID NO: 500812

SEQ ID NO: 501489 - RNA, 63 nt, hsa; identical to SEQ ID NO: 500813

SEQ ID NO: 501490 - RNA, 63 nt, hsa; identical to SEQ ID NO: 500814

SEQ ID NO: 501491 - RNA, 63 nt, hsa; identical to SEQ ID NO: 500815

SEQ ID NO: 501492 - RNA, 63 nt, hsa; identical to SEQ ID NO: 500816

SEQ ID NO: 501493 - RNA, 63 nt, hsa; identical to SEQ ID NO: 500817

SEQ ID NO: 501494 - RNA, 63 nt, hsa; identical to SEQ ID NO: 500818

SEQ ID NO: 501495 - RNA, 63 nt, hsa; identical to SEQ ID NO: 500819

SEQ ID NO: 501496 - RNA, 63 nt, hsa; identical to SEQ ID NO: 500820

SEQ ID NO: 501497 - RNA, 63 nt, hsa; identical to SEQ ID NO: 500821

SEQ ID NO: 501498 - RNA, 63 nt, hsa; identical to SEQ ID NO: 500822

SEQ ID NO: 501499 - RNA, 63 nt, hsa; identical to SEQ ID NO: 500823

SEQ ID NO: 501500 - RNA, 63 nt, hsa; identical to SEQ ID NO: 500824

SEQ ID NO: 501501 - RNA, 63 nt, hsa; identical to SEQ ID NO: 500825

SEQ ID NO: 501502 - RNA, 63 nt, hsa; identical to SEQ ID NO: 500826

SEQ ID NO: 501503 - RNA, 63 nt, hsa; identical to SEQ ID NO: 500827

SEQ ID NO: 501504 - RNA, 63 nt, hsa; identical to SEQ ID NO: 500828

SEQ ID NO: 501505 - RNA, 63 nt, hsa; identical to SEQ ID NO: 500829

SEQ ID NO: 501506 - RNA, 63 nt, hsa; identical to SEQ ID NO: 500830

SEQ ID NO: 501507 - RNA, 63 nt, hsa; identical to SEQ ID NO: 500831

SEQ ID NO: 501508 - RNA, 63 nt, hsa; identical to SEQ ID NO: 500832

SEQ ID NO: 501509 - RNA, 63 nt, hsa; identical to SEQ ID NO: 500833

SEQ ID NO: 501510 - RNA, 63 nt, hsa; identical to SEQ ID NO: 500834

SEQ ID NO: 501511 - RNA, 63 nt, hsa; identical to SEQ ID NO: 500835

SEQ ID NO: 501512 - RNA, 63 nt, hsa; identical to SEQ ID NO: 500836

SEQ ID NO: 501513 - RNA, 63 nt, hsa; identical to SEQ ID NO: 500837

SEQ ID NO: 501514 - RNA, 63 nt, hsa; identical to SEQ ID NO: 500838

SEQ ID NO: 501515 - RNA, 63 nt, hsa; identical to SEQ ID NO: 500839

SEQ ID NO: 501516 - RNA, 63 nt, hsa; identical to SEQ ID NO: 500840

SEQ ID NO: 501517 - RNA, 63 nt, hsa; identical to SEQ ID NO: 500841

SEQ ID NO: 501518 - RNA, 63 nt, hsa; identical to SEQ ID NO: 500842

SEQ ID NO: 501519 - RNA, 63 nt, hsa; identical to SEQ ID NO: 500843

SEQ ID NO: 501520 - RNA, 63 nt, hsa; identical to SEQ ID NO: 500844

SEQ ID NO: 501521 - RNA, 63 nt, hsa; identical to SEQ ID NO: 500845

SEQ ID NO: 501522 - RNA, 63 nt, hsa; identical to SEQ ID NO: 500846

SEQ ID NO: 501523 - RNA, 63 nt, hsa; identical to SEQ ID NO: 500847

SEQ ID NO: 501524 - RNA, 63 nt, hsa; identical to SEQ ID NO: 500848

SEQ ID NO: 501525 - RNA, 63 nt, hsa; identical to SEQ ID NO: 500849

SEQ ID NO: 501526 - RNA, 63 nt, hsa; identical to SEQ ID NO: 500850

SEQ ID NO: 501527 - RNA, 63 nt, hsa; identical to SEQ ID NO: 500851

SEQ ID NO: 501528 - RNA, 63 nt, hsa; identical to SEQ ID NO: 500852

SEQ ID NO: 501529 - RNA, 63 nt, hsa; identical to SEQ ID NO: 500853

SEQ ID NO: 501530 - RNA, 63 nt, hsa; identical to SEQ ID NO: 500854

SEQ ID NO: 501531 - RNA, 63 nt, hsa; identical to SEQ ID NO: 500855

SEQ ID NO: 501532 - RNA, 63 nt, hsa; identical to SEQ ID NO: 500856

SEQ ID NO: 501533 - RNA, 63 nt, hsa; identical to SEQ ID NO: 500857

SEQ ID NO: 501534 - RNA, 63 nt, hsa; identical to SEQ ID NO: 500858

SEQ ID NO: 501535 - RNA, 63 nt, hsa; identical to SEQ ID NO: 500859

SEQ ID NO: 501536 - RNA, 63 nt, hsa; identical to SEQ ID NO: 500860

SEQ ID NO: 501537 - RNA, 63 nt, hsa; identical to SEQ ID NO: 500861

SEQ ID NO: 501538 - RNA, 63 nt, hsa; identical to SEQ ID NO: 500862

SEQ ID NO: 501539 - RNA, 63 nt, hsa; identical to SEQ ID NO: 500863

SEQ ID NO: 501540 - RNA, 63 nt, hsa; identical to SEQ ID NO: 500864

SEQ ID NO: 501541 - RNA, 63 nt, hsa; identical to SEQ ID NO: 500865

SEQ ID NO: 501542 - RNA, 63 nt, hsa; identical to SEQ ID NO: 500866

SEQ ID NO: 501543 - RNA, 63 nt, hsa; identical to SEQ ID NO: 500867

SEQ ID NO: 501544 - RNA, 63 nt, hsa; identical to SEQ ID NO: 500868

SEQ ID NO: 501545 - RNA, 63 nt, hsa; identical to SEQ ID NO: 500869

SEQ ID NO: 501546 - RNA, 63 nt, hsa; identical to SEQ ID NO: 500870

SEQ ID NO: 501547 - RNA, 63 nt, hsa; identical to SEQ ID NO: 500871

SEQ ID NO: 501548 - RNA, 63 nt, hsa; identical to SEQ ID NO: 500872

SEQ ID NO: 501549 - RNA, 63 nt, hsa; identical to SEQ ID NO: 500873

SEQ ID NO: 501550 - RNA, 63 nt, hsa; identical to SEQ ID NO: 500874

SEQ ID NO: 501551 - RNA, 63 nt, hsa; identical to SEQ ID NO: 500875

SEQ ID NO: 501552 - RNA, 63 nt, hsa; identical to SEQ ID NO: 500876

SEQ ID NO: 501553 - RNA, 63 nt, hsa; identical to SEQ ID NO: 500877

SEQ ID NO: 501554 - RNA, 63 nt, hsa; identical to SEQ ID NO: 500878

SEQ ID NO: 501555 - RNA, 63 nt, hsa; identical to SEQ ID NO: 500879

SEQ ID NO: 501556 - RNA, 63 nt, hsa; identical to SEQ ID NO: 500880

SEQ ID NO: 501557 - RNA, 63 nt, hsa; identical to SEQ ID NO: 500881

SEQ ID NO: 501558 - RNA, 63 nt, hsa; identical to SEQ ID NO: 500882

SEQ ID NO: 501559 - RNA, 63 nt, hsa; identical to SEQ ID NO: 500883

SEQ ID NO: 501560 - RNA, 63 nt, hsa; identical to SEQ ID NO: 500884

SEQ ID NO: 501561 - RNA, 63 nt, hsa; identical to SEQ ID NO: 500885

SEQ ID NO: 501562 - RNA, 63 nt, hsa; identical to SEQ ID NO: 500886

SEQ ID NO: 501563 - RNA, 63 nt, hsa; identical to SEQ ID NO: 500887

SEQ ID NO: 501564 - RNA, 63 nt, hsa; identical to SEQ ID NO: 500888

SEQ ID NO: 501565 - RNA, 63 nt, hsa; identical to SEQ ID NO: 500889

SEQ ID NO: 501566 - RNA, 63 nt, hsa; identical to SEQ ID NO: 500890

SEQ ID NO: 501567 - RNA, 63 nt, hsa; identical to SEQ ID NO: 500891

SEQ ID NO: 501568 - RNA, 63 nt, hsa; identical to SEQ ID NO: 500892

SEQ ID NO: 501569 - RNA, 63 nt, hsa; identical to SEQ ID NO: 500893

SEQ ID NO: 501570 - RNA, 63 nt, hsa; identical to SEQ ID NO: 500894

SEQ ID NO: 501571 - RNA, 63 nt, hsa; identical to SEQ ID NO: 500895

SEQ ID NO: 501572 - RNA, 63 nt, hsa; identical to SEQ ID NO: 500896

SEQ ID NO: 501573 - RNA, 63 nt, hsa; identical to SEQ ID NO: 500897

SEQ ID NO: 501574 - RNA, 63 nt, hsa; identical to SEQ ID NO: 500898

SEQ ID NO: 501575 - RNA, 63 nt, hsa; identical to SEQ ID NO: 500899

SEQ ID NO: 501576 - RNA, 63 nt, hsa; identical to SEQ ID NO: 500900

SEQ ID NO: 501577 - RNA, 63 nt, hsa; identical to SEQ ID NO: 500901

SEQ ID NO: 501578 - RNA, 63 nt, hsa; identical to SEQ ID NO: 500902

SEQ ID NO: 501579 - RNA, 63 nt, hsa; identical to SEQ ID NO: 500903

SEQ ID NO: 501580 - RNA, 63 nt, hsa; identical to SEQ ID NO: 500904

SEQ ID NO: 501581 - RNA, 63 nt, hsa; identical to SEQ ID NO: 500905

SEQ ID NO: 501582 - RNA, 63 nt, hsa; identical to SEQ ID NO: 500906

SEQ ID NO: 501583 - RNA, 63 nt, hsa; identical to SEQ ID NO: 500907

SEQ ID NO: 501584 - RNA, 63 nt, hsa; identical to SEQ ID NO: 500908

SEQ ID NO: 501585 - RNA, 63 nt, hsa; identical to SEQ ID NO: 500909

SEQ ID NO: 501586 - RNA, 63 nt, hsa; identical to SEQ ID NO: 500910

SEQ ID NO: 501587 - RNA, 63 nt, hsa; identical to SEQ ID NO: 500911

SEQ ID NO: 501588 - RNA, 63 nt, hsa; identical to SEQ ID NO: 500912

SEQ ID NO: 501589 - RNA, 63 nt, hsa; identical to SEQ ID NO: 500913

SEQ ID NO: 501590 - RNA, 63 nt, hsa; identical to SEQ ID NO: 500914

SEQ ID NO: 501591 - RNA, 63 nt, hsa; identical to SEQ ID NO: 500915

SEQ ID NO: 501592 - RNA, 63 nt, hsa; identical to SEQ ID NO: 500916

SEQ ID NO: 501593 - RNA, 63 nt, hsa; identical to SEQ ID NO: 500917

SEQ ID NO: 501594 - RNA, 63 nt, hsa; identical to SEQ ID NO: 500918

SEQ ID NO: 501595 - RNA, 63 nt, hsa; identical to SEQ ID NO: 500919

SEQ ID NO: 501596 - RNA, 63 nt, hsa; identical to SEQ ID NO: 500920

SEQ ID NO: 501597 - RNA, 63 nt, hsa; identical to SEQ ID NO: 500921

SEQ ID NO: 501598 - RNA, 63 nt, hsa; identical to SEQ ID NO: 500922

SEQ ID NO: 501599 - RNA, 63 nt, hsa; identical to SEQ ID NO: 500923

SEQ ID NO: 501600 - RNA, 63 nt, hsa; identical to SEQ ID NO: 500924

SEQ ID NO: 501601 - RNA, 63 nt, hsa; identical to SEQ ID NO: 500925

SEQ ID NO: 501602 - RNA, 63 nt, hsa; identical to SEQ ID NO: 500926

SEQ ID NO: 501603 - RNA, 63 nt, hsa; identical to SEQ ID NO: 500927

SEQ ID NO: 501604 - RNA, 63 nt, hsa; identical to SEQ ID NO: 500928

SEQ ID NO: 501605 - RNA, 63 nt, hsa; identical to SEQ ID NO: 500929

SEQ ID NO: 501606 - RNA, 63 nt, hsa; identical to SEQ ID NO: 500930

SEQ ID NO: 501607 - RNA, 63 nt, hsa; identical to SEQ ID NO: 500931

SEQ ID NO: 501608 - RNA, 63 nt, hsa; identical to SEQ ID NO: 500932

SEQ ID NO: 501609 - RNA, 63 nt, hsa; identical to SEQ ID NO: 500933

SEQ ID NO: 501610 - RNA, 63 nt, hsa; identical to SEQ ID NO: 500934

SEQ ID NO: 501611 - RNA, 63 nt, hsa; identical to SEQ ID NO: 500935

SEQ ID NO: 501612 - RNA, 63 nt, hsa; identical to SEQ ID NO: 500936

SEQ ID NO: 501613 - RNA, 63 nt, hsa; identical to SEQ ID NO: 500937

SEQ ID NO: 501614 - RNA, 63 nt, hsa; identical to SEQ ID NO: 500938

SEQ ID NO: 501615 - RNA, 63 nt, hsa; identical to SEQ ID NO: 500939

SEQ ID NO: 501616 - RNA, 63 nt, hsa; identical to SEQ ID NO: 500940

SEQ ID NO: 501617 - RNA, 63 nt, hsa; identical to SEQ ID NO: 500941

SEQ ID NO: 501618 - RNA, 63 nt, hsa; identical to SEQ ID NO: 500942

SEQ ID NO: 501619 - RNA, 63 nt, hsa; identical to SEQ ID NO: 500943

SEQ ID NO: 501620 - RNA, 63 nt, hsa; identical to SEQ ID NO: 500944

SEQ ID NO: 501621 - RNA, 63 nt, hsa; identical to SEQ ID NO: 500945

SEQ ID NO: 501622 - RNA, 63 nt, hsa; identical to SEQ ID NO: 500946

SEQ ID NO: 501623 - RNA, 63 nt, hsa; identical to SEQ ID NO: 500947

SEQ ID NO: 501624 - RNA, 63 nt, hsa; identical to SEQ ID NO: 500948

SEQ ID NO: 501625 - RNA, 63 nt, hsa; identical to SEQ ID NO: 500949

SEQ ID NO: 501626 - RNA, 63 nt, hsa; identical to SEQ ID NO: 500950

SEQ ID NO: 501627 - RNA, 63 nt, hsa; identical to SEQ ID NO: 500951

SEQ ID NO: 501628 - RNA, 63 nt, hsa; identical to SEQ ID NO: 500952

SEQ ID NO: 501629 - RNA, 63 nt, hsa; identical to SEQ ID NO: 500953

SEQ ID NO: 501630 - RNA, 63 nt, hsa; identical to SEQ ID NO: 500954

SEQ ID NO: 501631 - RNA, 63 nt, hsa; identical to SEQ ID NO: 500955

SEQ ID NO: 501632 - RNA, 63 nt, hsa; identical to SEQ ID NO: 500956

SEQ ID NO: 501633 - RNA, 63 nt, hsa; identical to SEQ ID NO: 500957

SEQ ID NO: 501634 - RNA, 63 nt, hsa; identical to SEQ ID NO: 500958

SEQ ID NO: 501635 - RNA, 63 nt, hsa; identical to SEQ ID NO: 500959

SEQ ID NO: 501636 - RNA, 63 nt, hsa; identical to SEQ ID NO: 500960

SEQ ID NO: 501637 - RNA, 63 nt, hsa; identical to SEQ ID NO: 500961

SEQ ID NO: 501638 - RNA, 63 nt, hsa; identical to SEQ ID NO: 500962

SEQ ID NO: 501639 - RNA, 63 nt, hsa; identical to SEQ ID NO: 500963

SEQ ID NO: 501640 - RNA, 63 nt, hsa; identical to SEQ ID NO: 500964

SEQ ID NO: 501641 - RNA, 63 nt, hsa; identical to SEQ ID NO: 500965

SEQ ID NO: 501642 - RNA, 63 nt, hsa; identical to SEQ ID NO: 500966

SEQ ID NO: 501643 - RNA, 63 nt, hsa; identical to SEQ ID NO: 500967

SEQ ID NO: 501644 - RNA, 63 nt, hsa; identical to SEQ ID NO: 500968

SEQ ID NO: 501645 - RNA, 63 nt, hsa; identical to SEQ ID NO: 500969

SEQ ID NO: 501646 - RNA, 63 nt, hsa; identical to SEQ ID NO: 500970

SEQ ID NO: 501647 - RNA, 63 nt, hsa; identical to SEQ ID NO: 500971

SEQ ID NO: 501648 - RNA, 63 nt, hsa; identical to SEQ ID NO: 500972

SEQ ID NO: 501649 - RNA, 63 nt, hsa; identical to SEQ ID NO: 500973

SEQ ID NO: 501650 - RNA, 63 nt, hsa; identical to SEQ ID NO: 500974

SEQ ID NO: 501651 - RNA, 63 nt, hsa; identical to SEQ ID NO: 500975

SEQ ID NO: 501652 - RNA, 63 nt, hsa; identical to SEQ ID NO: 500976

SEQ ID NO: 501653 - RNA, 63 nt, hsa; identical to SEQ ID NO: 500977

SEQ ID NO: 501654 - RNA, 63 nt, hsa; identical to SEQ ID NO: 500978

SEQ ID NO: 501655 - RNA, 63 nt, hsa; identical to SEQ ID NO: 500979

SEQ ID NO: 501656 - RNA, 63 nt, hsa; identical to SEQ ID NO: 500980

SEQ ID NO: 501657 - RNA, 63 nt, hsa; identical to SEQ ID NO: 500981

SEQ ID NO: 501658 - RNA, 63 nt, hsa; identical to SEQ ID NO: 500982

SEQ ID NO: 501659 - RNA, 63 nt, hsa; identical to SEQ ID NO: 500983

SEQ ID NO: 501660 - RNA, 63 nt, hsa; identical to SEQ ID NO: 500984

SEQ ID NO: 501661 - RNA, 63 nt, hsa; identical to SEQ ID NO: 500985

SEQ ID NO: 501662 - RNA, 59 nt, hsa; identical to SEQ ID NO: 476518

SEQ ID NO: 501663 - RNA, 63 nt, hsa; identical to SEQ ID NO: 500987

SEQ ID NO: 501664 - RNA, 63 nt, hsa; identical to SEQ ID NO: 500988

SEQ ID NO: 501665 - RNA, 63 nt, hsa; identical to SEQ ID NO: 500989

SEQ ID NO: 501666 - RNA, 63 nt, hsa; identical to SEQ ID NO: 500990

SEQ ID NO: 501667 - RNA, 63 nt, hsa; identical to SEQ ID NO: 500991

SEQ ID NO: 501668 - RNA, 63 nt, hsa; identical to SEQ ID NO: 500992

SEQ ID NO: 501669 - RNA, 63 nt, hsa; identical to SEQ ID NO: 500993

SEQ ID NO: 501670 - RNA, 63 nt, hsa; identical to SEQ ID NO: 500994

SEQ ID NO: 501671 - RNA, 63 nt, hsa; identical to SEQ ID NO: 500995

SEQ ID NO: 501672 - RNA, 63 nt, hsa; identical to SEQ ID NO: 500996

SEQ ID NO: 501673 - RNA, 63 nt, hsa; identical to SEQ ID NO: 500997

SEQ ID NO: 501674 - RNA, 63 nt, hsa; identical to SEQ ID NO: 500998

SEQ ID NO: 501675 - RNA, 63 nt, hsa; identical to SEQ ID NO: 500999

SEQ ID NO: 501676 - RNA, 63 nt, hsa; identical to SEQ ID NO: 501000

SEQ ID NO: 501677 - RNA, 63 nt, hsa; identical to SEQ ID NO: 501001

SEQ ID NO: 501678 - RNA, 63 nt, hsa; identical to SEQ ID NO: 501002

SEQ ID NO: 501679 - RNA, 63 nt, hsa; identical to SEQ ID NO: 501003

SEQ ID NO: 501680 - RNA, 63 nt, hsa; identical to SEQ ID NO: 501004

SEQ ID NO: 501681 - RNA, 63 nt, hsa; identical to SEQ ID NO: 501005

SEQ ID NO: 501682 - RNA, 63 nt, hsa; identical to SEQ ID NO: 501006

SEQ ID NO: 501683 - RNA, 63 nt, hsa; identical to SEQ ID NO: 501007

SEQ ID NO: 501684 - RNA, 63 nt, hsa; identical to SEQ ID NO: 501008

SEQ ID NO: 501685 - RNA, 63 nt, hsa; identical to SEQ ID NO: 501009

SEQ ID NO: 501686 - RNA, 63 nt, hsa; identical to SEQ ID NO: 501010

SEQ ID NO: 501687 - RNA, 63 nt, hsa; identical to SEQ ID NO: 501011

SEQ ID NO: 501688 - RNA, 63 nt, hsa; identical to SEQ ID NO: 501012

SEQ ID NO: 501689 - RNA, 63 nt, hsa; identical to SEQ ID NO: 501013

SEQ ID NO: 501690 - RNA, 63 nt, hsa; identical to SEQ ID NO: 501014

SEQ ID NO: 501691 - RNA, 63 nt, hsa; identical to SEQ ID NO: 501015

SEQ ID NO: 501692 - RNA, 63 nt, hsa; identical to SEQ ID NO: 501016

SEQ ID NO: 501693 - RNA, 63 nt, hsa; identical to SEQ ID NO: 501017

SEQ ID NO: 501694 - RNA, 63 nt, hsa; identical to SEQ ID NO: 501018

SEQ ID NO: 501695 - RNA, 63 nt, hsa; identical to SEQ ID NO: 501019

SEQ ID NO: 501696 - RNA, 63 nt, hsa; identical to SEQ ID NO: 501020

SEQ ID NO: 501697 - RNA, 63 nt, hsa; identical to SEQ ID NO: 501021

SEQ ID NO: 501698 - RNA, 63 nt, hsa; identical to SEQ ID NO: 501022

SEQ ID NO: 501699 - RNA, 50 nt, hsa; identical to SEQ ID NO: 501023

SEQ ID NO: 501700 - RNA, 63 nt, hsa; identical to SEQ ID NO: 501024

SEQ ID NO: 501701 - RNA, 63 nt, hsa; identical to SEQ ID NO: 501025

SEQ ID NO: 501702 - RNA, 63 nt, hsa; identical to SEQ ID NO: 501026

SEQ ID NO: 501703 - RNA, 63 nt, hsa; identical to SEQ ID NO: 501027

SEQ ID NO: 501704 - RNA, 63 nt, hsa; identical to SEQ ID NO: 501028

SEQ ID NO: 501705 - RNA, 63 nt, hsa; identical to SEQ ID NO: 501029

SEQ ID NO: 501706 - RNA, 63 nt, hsa; identical to SEQ ID NO: 501030

SEQ ID NO: 501707 - RNA, 63 nt, hsa; identical to SEQ ID NO: 501031

SEQ ID NO: 501708 - RNA, 63 nt, hsa; identical to SEQ ID NO: 501032

SEQ ID NO: 501709 - RNA, 63 nt, hsa; identical to SEQ ID NO: 501033

SEQ ID NO: 501710 - RNA, 63 nt, hsa; identical to SEQ ID NO: 501034

SEQ ID NO: 501711 - RNA, 63 nt, hsa; identical to SEQ ID NO: 501035

SEQ ID NO: 501712 - RNA, 63 nt, hsa; identical to SEQ ID NO: 501036

SEQ ID NO: 501713 - RNA, 63 nt, hsa; identical to SEQ ID NO: 501037

SEQ ID NO: 501714 - RNA, 63 nt, hsa; identical to SEQ ID NO: 501038

SEQ ID NO: 501715 - RNA, 63 nt, hsa; identical to SEQ ID NO: 501039

SEQ ID NO: 501716 - RNA, 63 nt, hsa; identical to SEQ ID NO: 501040

SEQ ID NO: 501717 - RNA, 63 nt, hsa; identical to SEQ ID NO: 501041

SEQ ID NO: 501718 - RNA, 63 nt, hsa; identical to SEQ ID NO: 501042

SEQ ID NO: 501719 - RNA, 63 nt, hsa; identical to SEQ ID NO: 501043

SEQ ID NO: 501720 - RNA, 63 nt, hsa; identical to SEQ ID NO: 501044

SEQ ID NO: 501721 - RNA, 63 nt, hsa; identical to SEQ ID NO: 501045

SEQ ID NO: 501722 - RNA, 63 nt, hsa; identical to SEQ ID NO: 501046

SEQ ID NO: 501723 - RNA, 63 nt, hsa; identical to SEQ ID NO: 501047

SEQ ID NO: 501724 - RNA, 63 nt, hsa; identical to SEQ ID NO: 501048

SEQ ID NO: 501725 - RNA, 63 nt, hsa; identical to SEQ ID NO: 501049

SEQ ID NO: 501726 - RNA, 63 nt, hsa; identical to SEQ ID NO: 501050

SEQ ID NO: 501727 - RNA, 63 nt, hsa; identical to SEQ ID NO: 501051

SEQ ID NO: 501728 - RNA, 63 nt, hsa; identical to SEQ ID NO: 501052

SEQ ID NO: 501729 - RNA, 63 nt, hsa; identical to SEQ ID NO: 501053

SEQ ID NO: 501730 - RNA, 63 nt, hsa; identical to SEQ ID NO: 501054

SEQ ID NO: 501731 - RNA, 63 nt, hsa; identical to SEQ ID NO: 501055

SEQ ID NO: 501732 - RNA, 63 nt, hsa; identical to SEQ ID NO: 501056

SEQ ID NO: 501733 - RNA, 63 nt, hsa; identical to SEQ ID NO: 501057

SEQ ID NO: 501734 - RNA, 63 nt, hsa; identical to SEQ ID NO: 501058

SEQ ID NO: 501735 - RNA, 63 nt, hsa; identical to SEQ ID NO: 501059

SEQ ID NO: 501736 - RNA, 63 nt, hsa; identical to SEQ ID NO: 501060

SEQ ID NO: 501737 - RNA, 63 nt, hsa; identical to SEQ ID NO: 501061

SEQ ID NO: 501738 - RNA, 63 nt, hsa; identical to SEQ ID NO: 501062

SEQ ID NO: 501739 - RNA, 63 nt, hsa; identical to SEQ ID NO: 501063

SEQ ID NO: 501740 - RNA, 63 nt, hsa; identical to SEQ ID NO: 501064

SEQ ID NO: 501741 - RNA, 63 nt, hsa; identical to SEQ ID NO: 501065

SEQ ID NO: 501742 - RNA, 63 nt, hsa; identical to SEQ ID NO: 501066

SEQ ID NO: 501743 - RNA, 63 nt, hsa; identical to SEQ ID NO: 501067

SEQ ID NO: 501744 - RNA, 63 nt, hsa; identical to SEQ ID NO: 501068

SEQ ID NO: 501745 - RNA, 63 nt, hsa; identical to SEQ ID NO: 501069

SEQ ID NO: 501746 - RNA, 63 nt, hsa; identical to SEQ ID NO: 501070

SEQ ID NO: 501747 - RNA, 63 nt, hsa; identical to SEQ ID NO: 501071

SEQ ID NO: 501748 - RNA, 63 nt, hsa; identical to SEQ ID NO: 501072

SEQ ID NO: 501749 - RNA, 63 nt, hsa; identical to SEQ ID NO: 501073

SEQ ID NO: 501750 - RNA, 63 nt, hsa; identical to SEQ ID NO: 501074

SEQ ID NO: 501751 - RNA, 63 nt, hsa; identical to SEQ ID NO: 501075

SEQ ID NO: 501752 - RNA, 63 nt, hsa; identical to SEQ ID NO: 501076

SEQ ID NO: 501753 - RNA, 63 nt, hsa; identical to SEQ ID NO: 501077

SEQ ID NO: 501754 - RNA, 63 nt, hsa; identical to SEQ ID NO: 501078

SEQ ID NO: 501755 - RNA, 63 nt, hsa; identical to SEQ ID NO: 501079

SEQ ID NO: 501756 - RNA, 63 nt, hsa; identical to SEQ ID NO: 501080

SEQ ID NO: 501757 - RNA, 63 nt, hsa; identical to SEQ ID NO: 501081

SEQ ID NO: 501758 - RNA, 62 nt, hsa; identical to SEQ ID NO: 501082

SEQ ID NO: 501759 - RNA, 63 nt, hsa; identical to SEQ ID NO: 501083

SEQ ID NO: 501760 - RNA, 63 nt, hsa; identical to SEQ ID NO: 501084

SEQ ID NO: 501761 - RNA, 63 nt, hsa; identical to SEQ ID NO: 501085

SEQ ID NO: 501762 - RNA, 63 nt, hsa; identical to SEQ ID NO: 501086

SEQ ID NO: 501763 - RNA, 63 nt, hsa; identical to SEQ ID NO: 501087

SEQ ID NO: 501764 - RNA, 63 nt, hsa; identical to SEQ ID NO: 501088

SEQ ID NO: 501765 - RNA, 63 nt, hsa; identical to SEQ ID NO: 501089

SEQ ID NO: 501766 - RNA, 63 nt, hsa; identical to SEQ ID NO: 501090

SEQ ID NO: 501767 - RNA, 63 nt, hsa; identical to SEQ ID NO: 501091

SEQ ID NO: 501768 - RNA, 63 nt, hsa; identical to SEQ ID NO: 501092

SEQ ID NO: 501769 - RNA, 63 nt, hsa; identical to SEQ ID NO: 501093

SEQ ID NO: 501770 - RNA, 63 nt, hsa; identical to SEQ ID NO: 501094

SEQ ID NO: 501771 - RNA, 63 nt, hsa; identical to SEQ ID NO: 501095

SEQ ID NO: 501772 - RNA, 63 nt, hsa; identical to SEQ ID NO: 501096

SEQ ID NO: 501773 - RNA, 63 nt, hsa; identical to SEQ ID NO: 501097

SEQ ID NO: 501774 - RNA, 63 nt, hsa; identical to SEQ ID NO: 501098

SEQ ID NO: 501775 - RNA, 63 nt, hsa; identical to SEQ ID NO: 501099

SEQ ID NO: 501776 - RNA, 63 nt, hsa; identical to SEQ ID NO: 501100

SEQ ID NO: 501777 - RNA, 63 nt, hsa; identical to SEQ ID NO: 501101

SEQ ID NO: 501778 - RNA, 63 nt, hsa; identical to SEQ ID NO: 501102

SEQ ID NO: 501779 - RNA, 63 nt, hsa; identical to SEQ ID NO: 501103

SEQ ID NO: 501780 - RNA, 63 nt, hsa; identical to SEQ ID NO: 501104

SEQ ID NO: 501781 - RNA, 63 nt, hsa; identical to SEQ ID NO: 501105

SEQ ID NO: 501782 - RNA, 63 nt, hsa; identical to SEQ ID NO: 501106

SEQ ID NO: 501783 - RNA, 63 nt, hsa; identical to SEQ ID NO: 501107

SEQ ID NO: 501784 - RNA, 63 nt, hsa; identical to SEQ ID NO: 501108

SEQ ID NO: 501785 - RNA, 63 nt, hsa; identical to SEQ ID NO: 501109

SEQ ID NO: 501786 - RNA, 63 nt, hsa; identical to SEQ ID NO: 501110

SEQ ID NO: 501787 - RNA, 63 nt, hsa; identical to SEQ ID NO: 501111

SEQ ID NO: 501788 - RNA, 63 nt, hsa; identical to SEQ ID NO: 501112

SEQ ID NO: 501789 - RNA, 63 nt, hsa; identical to SEQ ID NO: 501113

SEQ ID NO: 501790 - RNA, 63 nt, hsa; identical to SEQ ID NO: 501114

SEQ ID NO: 501791 - RNA, 63 nt, hsa; identical to SEQ ID NO: 501115

SEQ ID NO: 501792 - RNA, 63 nt, hsa; identical to SEQ ID NO: 501116

SEQ ID NO: 501793 - RNA, 63 nt, hsa; identical to SEQ ID NO: 501117

SEQ ID NO: 501794 - RNA, 63 nt, hsa; identical to SEQ ID NO: 501118

SEQ ID NO: 501795 - RNA, 63 nt, hsa; identical to SEQ ID NO: 501119

SEQ ID NO: 501796 - RNA, 63 nt, hsa; identical to SEQ ID NO: 501120

SEQ ID NO: 501797 - RNA, 63 nt, hsa; identical to SEQ ID NO: 501121

SEQ ID NO: 501798 - RNA, 63 nt, hsa; identical to SEQ ID NO: 501122

SEQ ID NO: 501799 - RNA, 63 nt, hsa; identical to SEQ ID NO: 501123

SEQ ID NO: 501800 - RNA, 63 nt, hsa; identical to SEQ ID NO: 501124

SEQ ID NO: 501801 - RNA, 63 nt, hsa; identical to SEQ ID NO: 501125

SEQ ID NO: 501802 - RNA, 63 nt, hsa; identical to SEQ ID NO: 501126

SEQ ID NO: 501803 - RNA, 63 nt, hsa; identical to SEQ ID NO: 501127

SEQ ID NO: 501804 - RNA, 63 nt, hsa; identical to SEQ ID NO: 501128

SEQ ID NO: 501805 - RNA, 63 nt, hsa; identical to SEQ ID NO: 501129

SEQ ID NO: 501806 - RNA, 63 nt, hsa; identical to SEQ ID NO: 501130

SEQ ID NO: 501807 - RNA, 63 nt, hsa; identical to SEQ ID NO: 501131

SEQ ID NO: 501808 - RNA, 63 nt, hsa; identical to SEQ ID NO: 501132

SEQ ID NO: 501809 - RNA, 63 nt, hsa; identical to SEQ ID NO: 501133

SEQ ID NO: 501810 - RNA, 63 nt, hsa; identical to SEQ ID NO: 501134

SEQ ID NO: 501811 - RNA, 63 nt, hsa; identical to SEQ ID NO: 501135

SEQ ID NO: 501812 - RNA, 63 nt, hsa; identical to SEQ ID NO: 501136

SEQ ID NO: 501813 - RNA, 63 nt, hsa; identical to SEQ ID NO: 501137

SEQ ID NO: 501814 - RNA, 63 nt, hsa; identical to SEQ ID NO: 501138

SEQ ID NO: 501815 - RNA, 63 nt, hsa; identical to SEQ ID NO: 501139

SEQ ID NO: 501816 - RNA, 63 nt, hsa; identical to SEQ ID NO: 501140

SEQ ID NO: 501817 - RNA, 63 nt, hsa; identical to SEQ ID NO: 501141

SEQ ID NO: 501818 - RNA, 63 nt, hsa; identical to SEQ ID NO: 501142

SEQ ID NO: 501819 - RNA, 63 nt, hsa; identical to SEQ ID NO: 501143

SEQ ID NO: 501820 - RNA, 63 nt, hsa; identical to SEQ ID NO: 501144

SEQ ID NO: 501821 - RNA, 63 nt, hsa; identical to SEQ ID NO: 501145

SEQ ID NO: 501822 - RNA, 63 nt, hsa; identical to SEQ ID NO: 501146

SEQ ID NO: 501823 - RNA, 63 nt, hsa; identical to SEQ ID NO: 501147

SEQ ID NO: 501824 - RNA, 63 nt, hsa; identical to SEQ ID NO: 501148

SEQ ID NO: 501825 - RNA, 63 nt, hsa; identical to SEQ ID NO: 501149

SEQ ID NO: 501826 - RNA, 63 nt, hsa; identical to SEQ ID NO: 501150

SEQ ID NO: 501827 - RNA, 63 nt, hsa; identical to SEQ ID NO: 501151

SEQ ID NO: 501828 - RNA, 63 nt, hsa; identical to SEQ ID NO: 501152

SEQ ID NO: 501829 - RNA, 63 nt, hsa; identical to SEQ ID NO: 501153

SEQ ID NO: 501830 - RNA, 63 nt, hsa; identical to SEQ ID NO: 501154

SEQ ID NO: 501831 - RNA, 63 nt, hsa; identical to SEQ ID NO: 501155

SEQ ID NO: 501832 - RNA, 63 nt, hsa; identical to SEQ ID NO: 501156

SEQ ID NO: 501833 - RNA, 63 nt, hsa; identical to SEQ ID NO: 501157

SEQ ID NO: 501834 - RNA, 63 nt, hsa; identical to SEQ ID NO: 501158

SEQ ID NO: 501835 - RNA, 63 nt, hsa; identical to SEQ ID NO: 501159

SEQ ID NO: 501836 - RNA, 62 nt, hsa; identical to SEQ ID NO: 501160

SEQ ID NO: 501837 - RNA, 63 nt, hsa; identical to SEQ ID NO: 501161

SEQ ID NO: 501838 - RNA, 63 nt, hsa; identical to SEQ ID NO: 501162

SEQ ID NO: 501839 - RNA, 63 nt, hsa; identical to SEQ ID NO: 501163

SEQ ID NO: 501840 - RNA, 63 nt, hsa; identical to SEQ ID NO: 501164

SEQ ID NO: 501841 - RNA, 63 nt, hsa; identical to SEQ ID NO: 501165

SEQ ID NO: 501842 - RNA, 63 nt, hsa; identical to SEQ ID NO: 501166

SEQ ID NO: 501843 - RNA, 59 nt, hsa; identical to SEQ ID NO: 501167

SEQ ID NO: 501844 - RNA, 63 nt, hsa; identical to SEQ ID NO: 501168

SEQ ID NO: 501845 - RNA, 63 nt, hsa; identical to SEQ ID NO: 501169

SEQ ID NO: 501846 - RNA, 63 nt, hsa; identical to SEQ ID NO: 501170

SEQ ID NO: 501847 - RNA, 63 nt, hsa; identical to SEQ ID NO: 501171

SEQ ID NO: 501848 - RNA, 63 nt, hsa; identical to SEQ ID NO: 501172

SEQ ID NO: 501849 - RNA, 63 nt, hsa; identical to SEQ ID NO: 501173

SEQ ID NO: 501850 - RNA, 63 nt, hsa; identical to SEQ ID NO: 501174

SEQ ID NO: 501851 - RNA, 63 nt, hsa; identical to SEQ ID NO: 501175

SEQ ID NO: 501852 - RNA, 63 nt, hsa; identical to SEQ ID NO: 501176

SEQ ID NO: 501853 - RNA, 63 nt, hsa; identical to SEQ ID NO: 501177

SEQ ID NO: 501854 - RNA, 63 nt, hsa; identical to SEQ ID NO: 501178

SEQ ID NO: 501855 - RNA, 63 nt, hsa; identical to SEQ ID NO: 501179

SEQ ID NO: 501856 - RNA, 63 nt, hsa; identical to SEQ ID NO: 501180

SEQ ID NO: 501857 - RNA, 63 nt, hsa; identical to SEQ ID NO: 501181

SEQ ID NO: 501858 - RNA, 63 nt, hsa; identical to SEQ ID NO: 501182

SEQ ID NO: 501859 - RNA, 63 nt, hsa; identical to SEQ ID NO: 501183

SEQ ID NO: 501860 - RNA, 63 nt, hsa; identical to SEQ ID NO: 501184

SEQ ID NO: 501861 - RNA, 63 nt, hsa; identical to SEQ ID NO: 501185

SEQ ID NO: 501862 - RNA, 63 nt, hsa; identical to SEQ ID NO: 501186

SEQ ID NO: 501863 - RNA, 63 nt, hsa; identical to SEQ ID NO: 501187

SEQ ID NO: 501864 - RNA, 63 nt, hsa; identical to SEQ ID NO: 501188

SEQ ID NO: 501865 - RNA, 63 nt, hsa; identical to SEQ ID NO: 501189

SEQ ID NO: 501866 - RNA, 63 nt, hsa; identical to SEQ ID NO: 501190

SEQ ID NO: 501867 - RNA, 63 nt, hsa; identical to SEQ ID NO: 501191

SEQ ID NO: 501868 - RNA, 63 nt, hsa; identical to SEQ ID NO: 501192

SEQ ID NO: 501869 - RNA, 63 nt, hsa; identical to SEQ ID NO: 501193

SEQ ID NO: 501870 - RNA, 63 nt, hsa; identical to SEQ ID NO: 501194

SEQ ID NO: 501871 - RNA, 63 nt, hsa; identical to SEQ ID NO: 501195

SEQ ID NO: 501872 - RNA, 63 nt, hsa; identical to SEQ ID NO: 501196

SEQ ID NO: 501873 - RNA, 63 nt, hsa; identical to SEQ ID NO: 501197

SEQ ID NO: 501874 - RNA, 63 nt, hsa; identical to SEQ ID NO: 501198

SEQ ID NO: 501875 - RNA, 63 nt, hsa; identical to SEQ ID NO: 501199

SEQ ID NO: 501876 - RNA, 63 nt, hsa; identical to SEQ ID NO: 501200

SEQ ID NO: 501877 - RNA, 63 nt, hsa; identical to SEQ ID NO: 501201

SEQ ID NO: 501878 - RNA, 63 nt, hsa; identical to SEQ ID NO: 501202

SEQ ID NO: 501879 - RNA, 63 nt, hsa; identical to SEQ ID NO: 501196

SEQ ID NO: 501880 - RNA, 63 nt, hsa; identical to SEQ ID NO: 501204

SEQ ID NO: 501881 - RNA, 63 nt, hsa; identical to SEQ ID NO: 501205

SEQ ID NO: 501882 - RNA, 63 nt, hsa; identical to SEQ ID NO: 501206

SEQ ID NO: 501883 - RNA, 63 nt, hsa; identical to SEQ ID NO: 501207

SEQ ID NO: 501884 - RNA, 63 nt, hsa; identical to SEQ ID NO: 501208

SEQ ID NO: 501885 - RNA, 63 nt, hsa; identical to SEQ ID NO: 501209

SEQ ID NO: 501886 - RNA, 63 nt, hsa; identical to SEQ ID NO: 501210

SEQ ID NO: 501887 - RNA, 63 nt, hsa; identical to SEQ ID NO: 501211

SEQ ID NO: 501888 - RNA, 63 nt, hsa; identical to SEQ ID NO: 501212

SEQ ID NO: 501889 - RNA, 63 nt, hsa; identical to SEQ ID NO: 501213

SEQ ID NO: 501890 - RNA, 63 nt, hsa; identical to SEQ ID NO: 501214

SEQ ID NO: 501891 - RNA, 63 nt, hsa; identical to SEQ ID NO: 501215

SEQ ID NO: 501892 - RNA, 63 nt, hsa; identical to SEQ ID NO: 501216

SEQ ID NO: 501893 - RNA, 63 nt, hsa; identical to SEQ ID NO: 501217

SEQ ID NO: 501894 - RNA, 63 nt, hsa; identical to SEQ ID NO: 501218

SEQ ID NO: 501895 - RNA, 63 nt, hsa; identical to SEQ ID NO: 501219

SEQ ID NO: 501896 - RNA, 63 nt, hsa; identical to SEQ ID NO: 501220

SEQ ID NO: 501897 - RNA, 63 nt, hsa; identical to SEQ ID NO: 501221

SEQ ID NO: 501898 - RNA, 63 nt, hsa; identical to SEQ ID NO: 501222

SEQ ID NO: 501899 - RNA, 63 nt, hsa; identical to SEQ ID NO: 501223

SEQ ID NO: 501900 - RNA, 63 nt, hsa; identical to SEQ ID NO: 501224

SEQ ID NO: 501901 - RNA, 63 nt, hsa; identical to SEQ ID NO: 501225

SEQ ID NO: 501902 - RNA, 63 nt, hsa; identical to SEQ ID NO: 501226

SEQ ID NO: 501903 - RNA, 63 nt, hsa; identical to SEQ ID NO: 501227

SEQ ID NO: 501904 - RNA, 63 nt, hsa; identical to SEQ ID NO: 501228

SEQ ID NO: 501905 - RNA, 63 nt, hsa; identical to SEQ ID NO: 501229

SEQ ID NO: 501906 - RNA, 63 nt, hsa; identical to SEQ ID NO: 501230

SEQ ID NO: 501907 - RNA, 63 nt, hsa; identical to SEQ ID NO: 501231

SEQ ID NO: 501908 - RNA, 63 nt, hsa; identical to SEQ ID NO: 501232

SEQ ID NO: 501909 - RNA, 63 nt, hsa; identical to SEQ ID NO: 501233

SEQ ID NO: 501910 - RNA, 63 nt, hsa; identical to SEQ ID NO: 501234

SEQ ID NO: 501911 - RNA, 63 nt, hsa; identical to SEQ ID NO: 501235

SEQ ID NO: 501912 - RNA, 63 nt, hsa; identical to SEQ ID NO: 501236

SEQ ID NO: 501913 - RNA, 63 nt, hsa; identical to SEQ ID NO: 501237

SEQ ID NO: 501914 - RNA, 63 nt, hsa; identical to SEQ ID NO: 501238

SEQ ID NO: 501915 - RNA, 63 nt, hsa; identical to SEQ ID NO: 501239

SEQ ID NO: 501916 - RNA, 63 nt, hsa; identical to SEQ ID NO: 501240

SEQ ID NO: 501917 - RNA, 63 nt, hsa; identical to SEQ ID NO: 501241

SEQ ID NO: 501918 - RNA, 63 nt, hsa; identical to SEQ ID NO: 501242

SEQ ID NO: 501919 - RNA, 63 nt, hsa; identical to SEQ ID NO: 501243

SEQ ID NO: 501920 - RNA, 63 nt, hsa; identical to SEQ ID NO: 501244

SEQ ID NO: 501921 - RNA, 63 nt, hsa; identical to SEQ ID NO: 501245

SEQ ID NO: 501922 - RNA, 63 nt, hsa; identical to SEQ ID NO: 501246

SEQ ID NO: 501923 - RNA, 63 nt, hsa; identical to SEQ ID NO: 501247

SEQ ID NO: 501924 - RNA, 63 nt, hsa; identical to SEQ ID NO: 501248

SEQ ID NO: 501925 - RNA, 63 nt, hsa; identical to SEQ ID NO: 501249

SEQ ID NO: 501926 - RNA, 63 nt, hsa; identical to SEQ ID NO: 501250

SEQ ID NO: 501927 - RNA, 63 nt, hsa; identical to SEQ ID NO: 501251

SEQ ID NO: 501928 - RNA, 63 nt, hsa; identical to SEQ ID NO: 501252

SEQ ID NO: 501929 - RNA, 63 nt, hsa; identical to SEQ ID NO: 501253

SEQ ID NO: 501930 - RNA, 63 nt, hsa; identical to SEQ ID NO: 501254

SEQ ID NO: 501931 - RNA, 63 nt, hsa; identical to SEQ ID NO: 501255

SEQ ID NO: 501932 - RNA, 63 nt, hsa; identical to SEQ ID NO: 501256

SEQ ID NO: 501933 - RNA, 63 nt, hsa; identical to SEQ ID NO: 501257

SEQ ID NO: 501934 - RNA, 63 nt, hsa; identical to SEQ ID NO: 501258

SEQ ID NO: 501935 - RNA, 63 nt, hsa; identical to SEQ ID NO: 501259

SEQ ID NO: 501936 - RNA, 53 nt, hsa; identical to SEQ ID NO: 501260

SEQ ID NO: 501937 - RNA, 63 nt, hsa; identical to SEQ ID NO: 501261

SEQ ID NO: 501938 - RNA, 63 nt, hsa; identical to SEQ ID NO: 501262

SEQ ID NO: 501939 - RNA, 63 nt, hsa; identical to SEQ ID NO: 501263

SEQ ID NO: 501940 - RNA, 63 nt, hsa; identical to SEQ ID NO: 501264

SEQ ID NO: 501941 - RNA, 63 nt, hsa; identical to SEQ ID NO: 501265

SEQ ID NO: 501942 - RNA, 63 nt, hsa; identical to SEQ ID NO: 501266

SEQ ID NO: 501943 - RNA, 63 nt, hsa; identical to SEQ ID NO: 501267

SEQ ID NO: 501944 - RNA, 63 nt, hsa; identical to SEQ ID NO: 501268

SEQ ID NO: 501945 - RNA, 63 nt, hsa; identical to SEQ ID NO: 501269

SEQ ID NO: 501946 - RNA, 63 nt, hsa; identical to SEQ ID NO: 501270

SEQ ID NO: 501947 - RNA, 63 nt, hsa; identical to SEQ ID NO: 501271

SEQ ID NO: 501948 - RNA, 63 nt, hsa; identical to SEQ ID NO: 501272

SEQ ID NO: 501949 - RNA, 63 nt, hsa; identical to SEQ ID NO: 501273

SEQ ID NO: 501950 - RNA, 63 nt, hsa; identical to SEQ ID NO: 501274

SEQ ID NO: 501951 - RNA, 63 nt, hsa; identical to SEQ ID NO: 501275

SEQ ID NO: 501952 - RNA, 63 nt, hsa; identical to SEQ ID NO: 501276

SEQ ID NO: 501953 - RNA, 63 nt, hsa; identical to SEQ ID NO: 501277

SEQ ID NO: 501954 - RNA, 63 nt, hsa; identical to SEQ ID NO: 501278

SEQ ID NO: 501955 - RNA, 63 nt, hsa; identical to SEQ ID NO: 501279

SEQ ID NO: 501956 - RNA, 63 nt, hsa; identical to SEQ ID NO: 501280

SEQ ID NO: 501957 - RNA, 63 nt, hsa; identical to SEQ ID NO: 501281

SEQ ID NO: 501958 - RNA, 63 nt, hsa; identical to SEQ ID NO: 501282

SEQ ID NO: 501959 - RNA, 63 nt, hsa; identical to SEQ ID NO: 501283

SEQ ID NO: 501960 - RNA, 63 nt, hsa; identical to SEQ ID NO: 501284

SEQ ID NO: 501961 - RNA, 63 nt, hsa; identical to SEQ ID NO: 501285

SEQ ID NO: 501962 - RNA, 63 nt, hsa; identical to SEQ ID NO: 501286

SEQ ID NO: 501963 - RNA, 63 nt, hsa; identical to SEQ ID NO: 501287

SEQ ID NO: 501964 - RNA, 63 nt, hsa; identical to SEQ ID NO: 501288

SEQ ID NO: 501965 - RNA, 63 nt, hsa; identical to SEQ ID NO: 501289

SEQ ID NO: 501966 - RNA, 63 nt, hsa; identical to SEQ ID NO: 501290

SEQ ID NO: 501967 - RNA, 63 nt, hsa; identical to SEQ ID NO: 501291

SEQ ID NO: 501968 - RNA, 63 nt, hsa; identical to SEQ ID NO: 501292

SEQ ID NO: 501969 - RNA, 63 nt, hsa; identical to SEQ ID NO: 501293

SEQ ID NO: 501970 - RNA, 63 nt, hsa; identical to SEQ ID NO: 501294

SEQ ID NO: 501971 - RNA, 63 nt, hsa; identical to SEQ ID NO: 501295

SEQ ID NO: 501972 - RNA, 63 nt, hsa; identical to SEQ ID NO: 501296

SEQ ID NO: 501973 - RNA, 63 nt, hsa; identical to SEQ ID NO: 501297

SEQ ID NO: 501974 - RNA, 63 nt, hsa; identical to SEQ ID NO: 501298

SEQ ID NO: 501975 - RNA, 63 nt, hsa; identical to SEQ ID NO: 501299

SEQ ID NO: 501976 - RNA, 63 nt, hsa; identical to SEQ ID NO: 501300

SEQ ID NO: 501977 - RNA, 63 nt, hsa; identical to SEQ ID NO: 501301

SEQ ID NO: 501978 - RNA, 63 nt, hsa; identical to SEQ ID NO: 501302

SEQ ID NO: 501979 - RNA, 63 nt, hsa; identical to SEQ ID NO: 501303

SEQ ID NO: 501980 - RNA, 63 nt, hsa; identical to SEQ ID NO: 501304

SEQ ID NO: 501981 - RNA, 63 nt, hsa; identical to SEQ ID NO: 501305

SEQ ID NO: 501982 - RNA, 63 nt, hsa; identical to SEQ ID NO: 501306

SEQ ID NO: 501983 - RNA, 63 nt, hsa; identical to SEQ ID NO: 501307

SEQ ID NO: 501984 - RNA, 63 nt, hsa; identical to SEQ ID NO: 501308

SEQ ID NO: 501985 - RNA, 63 nt, hsa; identical to SEQ ID NO: 501309

SEQ ID NO: 501986 - RNA, 63 nt, hsa; identical to SEQ ID NO: 501310

SEQ ID NO: 501987 - RNA, 63 nt, hsa; identical to SEQ ID NO: 501311

SEQ ID NO: 501988 - RNA, 63 nt, hsa; identical to SEQ ID NO: 501312

SEQ ID NO: 501989 - RNA, 63 nt, hsa; identical to SEQ ID NO: 501313

SEQ ID NO: 501990 - RNA, 63 nt, hsa; identical to SEQ ID NO: 501314

SEQ ID NO: 501991 - RNA, 63 nt, hsa; identical to SEQ ID NO: 501315

SEQ ID NO: 501992 - RNA, 63 nt, hsa; identical to SEQ ID NO: 501316

SEQ ID NO: 501993 - RNA, 63 nt, hsa; identical to SEQ ID NO: 501317

SEQ ID NO: 501994 - RNA, 63 nt, hsa; identical to SEQ ID NO: 501318

SEQ ID NO: 501995 - RNA, 63 nt, hsa; identical to SEQ ID NO: 501319

SEQ ID NO: 501996 - RNA, 63 nt, hsa; identical to SEQ ID NO: 501320

SEQ ID NO: 501997 - RNA, 63 nt, hsa; identical to SEQ ID NO: 501321

SEQ ID NO: 501998 - RNA, 63 nt, hsa; identical to SEQ ID NO: 501322

SEQ ID NO: 501999 - RNA, 63 nt, hsa; identical to SEQ ID NO: 501323

SEQ ID NO: 502000 - RNA, 63 nt, hsa; identical to SEQ ID NO: 501324

SEQ ID NO: 502001 - RNA, 63 nt, hsa; identical to SEQ ID NO: 501325

SEQ ID NO: 502002 - RNA, 63 nt, hsa; identical to SEQ ID NO: 501326

SEQ ID NO: 502003 - RNA, 63 nt, hsa; identical to SEQ ID NO: 501327

SEQ ID NO: 502004 - RNA, 63 nt, hsa; identical to SEQ ID NO: 501328

SEQ ID NO: 502005 - RNA, 63 nt, hsa; identical to SEQ ID NO: 501329

SEQ ID NO: 502006 - RNA, 63 nt, hsa; identical to SEQ ID NO: 501330

SEQ ID NO: 502007 - RNA, 63 nt, hsa; identical to SEQ ID NO: 501331

SEQ ID NO: 502008 - RNA, 63 nt, hsa; identical to SEQ ID NO: 501332

SEQ ID NO: 502009 - RNA, 63 nt, hsa; identical to SEQ ID NO: 501333

SEQ ID NO: 502010 - RNA, 63 nt, hsa; identical to SEQ ID NO: 501334

SEQ ID NO: 502011 - RNA, 64 nt, hsa
guuguaaaccugcuuuaucuuuuaggauuauuccuaaaugcaucuucuuuauaaacuugacuug

SEQ ID NO: 502012 - RNA, 64 nt, hsa
uguuacccugggguauaaucauguuguagguacuuaaaugcauuccgcaaaucaaaauaucuug

SEQ ID NO: 502013 - RNA, 64 nt, hsa
guaggaagugaaaauagguauacaguggauuaauuaaaugcagcgaaccaauauuuguagaagg

SEQ ID NO: 502014 - RNA, 64 nt, hsa
acaauugaacuuaaauaaaugucauuaaaauaaauaaaugcaauauguauuaauauucauugua

SEQ ID NO: 502015 - RNA, 64 nt, hsa
aaguuuguuauauauuaauaugcaugcuucuuuauaaaugcauuaaauaagaguuaauagcuau

SEQ ID NO: 502016 - RNA, 64 nt, hsa
aaagccuaugaaugccuucuuaaaaucauguuuuuaaaugcauaaaauauauaggauuacaaag

SEQ ID NO: 502017 - RNA, 64 nt, hsa
aaaaaagcuaaucccuaaaauaguuagaucuuuguaaaugcauauuaaauaauaaaguaugacc

SEQ ID NO: 502018 - RNA, 64 nt, hsa
caauguauugagaaccaaagcaaccacaaaugcauaaaugcauaauuuauggucuucaaccaag

SEQ ID NO: 502019 - RNA, 64 nt, hsa
cuuuaauccgccuaauucuuguuguucuguagguuaaaugcagguauuuuaacugugugaacgc

SEQ ID NO: 502020 - RNA, 64 nt, hsa
caacaauguucuuuuuuguuacagcuaugcacuguaaaugcagccuucuuuucaaaacugcuaa

SEQ ID NO: 502021 - RNA, 64 nt, hsa
uggauuuguucagccauuuacauuaaugagcauuuaaaugcaacagauaucauuucaggugacu

SEQ ID NO: 502022 - RNA, 64 nt, hsa
gccuggauuaaucaguaugggaaacaaucuuuuguaaaugcaaagcuguuuuuuguauauacug

SEQ ID NO: 502023 - RNA, 64 nt, hsa
cuaacugauaagacaaauugaguuauugagcuauuaaaugcacauuuuaauauaaaugcagaaa

SEQ ID NO: 502024 - RNA, 64 nt, hsa
ugaguuauugagcuauuaaaugcacauuuuaauauaaaugcagaaaucccaaauaaaaugcuaa

SEQ ID NO: 502025 - RNA, 64 nt, hsa
ugcuaauugugaaauggaaaugcuuuacaggaaguaaaugcaaauuacuuuuaagugugcuuua

SEQ ID NO: 502026 - RNA, 64 nt, hsa
uugauagcaccaugggacauuuuucuaacaaaaauaaaugcaugaagagacauagccuuuuagu

SEQ ID NO: 502027 - RNA, 64 nt, hsa
uuaaaacaaauuuucauggucugaauuguauauguaaaugcauaucuguguaaguauaugcaag

SEQ ID NO: 502028 - RNA, 64 nt, hsa
ugcugucaccagaaaaugcucucccacugcuagauaaaugcagaggcaaaguguagacaucugu

SEQ ID NO: 502029 - RNA, 64 nt, hsa
aguuugaaaaccagguucauuuacgugagauugcuaaaugcaugggggaaagcagugguccuag

SEQ ID NO: 502030 - RNA, 64 nt, hsa
agaaaaugacgauuaaucuauaggaaagcucaaguaaaugcauuaucaacugcagaaguuugaa

SEQ ID NO: 502031 - RNA, 64 nt, hsa
uuauaauaauaauagcgccauauucuaaguugaguaaaugcauccuaccauucaagguuaucau

SEQ ID NO: 502032 - RNA, 64 nt, hsa
uuugagaauuguacugacaucacauguuagcuacuaaaugcaaaauguauaaaaguauuguuuu

SEQ ID NO: 502033 - RNA, 64 nt, hsa
cucguagguugaauuucuucugguagcuucaugguaaaugcauccgaauaagccauacuggauu

SEQ ID NO: 502034 - RNA, 64 nt, hsa
ccauuuaacuuuuuuacaagucuuuguaaaauuuuaaaugcauaaaggggguuggggcagggga

SEQ ID NO: 502035 - RNA, 64 nt, hsa
aaggaugggauggguuccagagguauuccucucuuaaaugcaagugccuagauuagguagacuu

SEQ ID NO: 502036 - RNA, 64 nt, hsa
acugcacaugaaaguuuugcaaagggaaacaggcuaaaugcaccaagaaagcuucuucagagug

SEQ ID NO: 502037 - RNA, 64 nt, hsa
aaugaacacauauacuuuuguaaucagaaaauauuaaaugcauguauuuuucaaaaucaaauug

SEQ ID NO: 502038 - RNA, 64 nt, hsa
uucuuuucaacagugauaccuacgaaaaucaaaauaaaugcaagcugagguuuugugcucacug

SEQ ID NO: 502039 - RNA, 64 nt, hsa
auaaaugccuuaucuuuacccuuugggaucuuacuaaaugcauuuuaccugcuacuauuuauua

SEQ ID NO: 502040 - RNA, 64 nt, hsa
ucuugcaagggcaaagaaggcauuuuuaaaauucuaaaugcacaccuccuaagguaaauagucu

SEQ ID NO: 502041 - RNA, 64 nt, hsa
uugugauuucuuuuaaauacuauucauuuuuauuuaaaugcacaguauuuccccuauauuuuag

SEQ ID NO: 502042 - RNA, 64 nt, hsa
caucccuauuuauguucaaccguacaucaaauuauaaaugcaaaacagguucagauuucaucuu

SEQ ID NO: 502043 - RNA, 64 nt, hsa
uuacacuuuuuguuaccuuguagacucuuauugauaaaugcaacuacuuauuaaaauuguucac

SEQ ID NO: 502044 - RNA, 64 nt, hsa
auucucggccucugugggauuuagggaagcauuauaaaugcauuaauccuuauagucaauucug

SEQ ID NO: 502045 - RNA, 64 nt, hsa
ucuagaauuaaauguacucauuuagacaacauauuaaaugcauauuuuagccacuuuagagaaa

SEQ ID NO: 502046 - RNA, 64 nt, hsa
uaagauuuccuuuaauucuaugauucucuggauuuaaaugcauuauucauauuucuugaagcuu

SEQ ID NO: 502047 - RNA, 64 nt, hsa
gcuuuugaugacugguaacugguauccuuccaaauaaaugcauugcuugguaacaaauguuagc

SEQ ID NO: 502048 - RNA, 64 nt, hsa
aaaaaagcccagacaucuucaguccuuuggugauuaaaugcacauuagcaaaucuaugucuugu

SEQ ID NO: 502049 - RNA, 64 nt, hsa
agugagcugagcaauaaaaugguccaauaauagguaaaugcaacagaaacagaaggagaccugg

SEQ ID NO: 502050 - RNA, 64 nt, hsa
uugaguauaugcacauuuaaaaaauaucauauaguaaaugcaaacaugccaaguauuuuauaaa

SEQ ID NO: 502051 - RNA, 64 nt, hsa
uaugaggacuugugucucugugcuuuuaaaugcauaaaugcauuauaggaucauuuguuggaau

SEQ ID NO: 502052 - RNA, 64 nt, hsa
acuucauauaugaggacuugugucucugugcuuuuaaaugcauaaaugcauuauaggaucauuu

SEQ ID NO: 502053 - RNA, 64 nt, hsa
cgccggccucacccucccaaagugcugggauuacaggcaugagccaccaugccagacuucccau

SEQ ID NO: 502054 - RNA, 64 nt, hsa
uuuacaauggggcuguugacagccauaauuagggaggcaugaauuaugcggcuauaaugcagag

SEQ ID NO: 502055 - RNA, 64 nt, hsa
acuuucucuagggagaaaaauuaauuuacuagaaaggcaugaaaugaucaugggaagagugguu

SEQ ID NO: 502056 - RNA, 64 nt, hsa
caccugccucggccucccaaagugcugcgauuacaggcaugagccaccgcgccuggccgcuuuc

SEQ ID NO: 502057 - RNA, 64 nt, hsa
cucccaccucagcuucucaaaguucugggacuacaggcaugaaauacugugccuggccugggga

SEQ ID NO: 502058 - RNA, 64 nt, hsa
uguuacugcuacuacacuuugcuccucuggcccaaggcaugaggagagaggcugugucagaaac

SEQ ID NO: 502059 - RNA, 64 nt, hsa
cacccgccucgaccucccaaagugcugggauuacaggcaugagccaccaugcccagucgauauc

SEQ ID NO: 502060 - RNA, 64 nt, hsa
cacccgccucggccucccaaagugcugggauuacaggcaugagccaucacaccuggucaacuuu

SEQ ID NO: 502061 - RNA, 64 nt, hsa
cucccacaucagacuccccaagugcuaggauuacaggcaugagccauugcacccagccauguuc

SEQ ID NO: 502062 - RNA, 64 nt, hsa
cucccaccucagccucccaaaguguugggauuacaggcaugagccaccauguagccugaaguuu

SEQ ID NO: 502063 - RNA, 64 nt, hsa
caccugccucagccucccaaagugcugggauuacaggcaugagccaccacacccagccccuuuc

SEQ ID NO: 502064 - RNA, 61 nt, hsa
ccauaaaacccugcaaauaaacggaaacaucaggcaugaacacuguuuaugucugaaucaa

SEQ ID NO: 502065 - RNA, 64 nt, hsa
ucuccuaccucggccuuccaagggcuaggauuacaggcaugagccacugugcuugguccagaug

SEQ ID NO: 502066 - RNA, 64 nt, hsa
guaauggacgauccacuguucaguuucauauauuaggcaugaaauguaagauuugugaauccua

SEQ ID NO: 502067 - RNA, 64 nt, hsa
caccugccuuagccucccaaagugcugggauuacaggcaugagccacugcaccuggcuauauuu

SEQ ID NO: 502068 - RNA, 64 nt, hsa
cacccgccuuggccucccaaagugcuggaauuacaggcaugagccaccgcgccuggccuguaua

SEQ ID NO: 502069 - RNA, 64 nt, hsa
ggcuuccuuccuccacccaguggagacccccccaaggcaugaggggaaagccauuaaguggggu

SEQ ID NO: 502070 - RNA, 64 nt, hsa
gccauccagguauaauggugagagagcaagagagaggcaugaacacacagucaccuccacuccc

SEQ ID NO: 502071 - RNA, 64 nt, hsa
cugcccguccagccucccaaagugcugggauugcaggcaugagccacugcucccggcccuauua

SEQ ID NO: 502072 - RNA, 64 nt, hsa
uauuuaaugugugaccuuggagaaguuacucuguaggcaugacagcagaggagaaaaucauuug

SEQ ID NO: 502073 - RNA, 64 nt, hsa
cgcccgccucagccucccaaaguguugggauuacaggcaugagccacugcgccuggccagcaaa

SEQ ID NO: 502074 - RNA, 64 nt, hsa
caccugccucagccucccagacuguugggauuacaggcaugagccaccacgccuggccaguuuc

SEQ ID NO: 502075 - RNA, 64 nt, hsa
cccccaaccuuggccuccaaagugcugggauuacaggcaugagccaccgcgccuggccucaagu

SEQ ID NO: 502076 - RNA, 64 nt, hsa
cacacacuuguaaucccagcuacucaggaggcugaggcaugagaaucgcuuaaacccaggaggc

SEQ ID NO: 502077 - RNA, 64 nt, hsa
cuccugccuuggccucccaaaauguugcaauuacaggcaugagccacugugcuuggcaagcuaa

SEQ ID NO: 502078 - RNA, 64 nt, hsa
uugaacuccuggccucccaaggugcugauaguacaggcaugaaccacugugcuuggccuuuuaa

SEQ ID NO: 502079 - RNA, 64 nt, hsa
uuguagccuuagccuccuaaagugcugggauuauaggcaugagucacuguacccggccugcucu

SEQ ID NO: 502080 - RNA, 64 nt, hsa
uccuucucagccugagagggggcccuucggacucaggcaugacucagcccggcugaugccucug

SEQ ID NO: 502081 - RNA, 64 nt, hsa
accaccaccucagaguauggagcucagagagggcaggcaugaaguuuccuuggcuggugcaccu

SEQ ID NO: 502082 - RNA, 64 nt, hsa
gauuucuugaaaaggguguuagcuaaaggaucuuaggcaugacuguagaauuuguaguugcaau

SEQ ID NO: 502083 - RNA, 64 nt, hsa
aacccugucucuacuaaaaauacaaaaauuagccaggcaugauggugcaugccuuuaaacccag

SEQ ID NO: 502084 - RNA, 64 nt, hsa
ugcaugccuuuaaacccagcuacugaggaggcugaggcaugagaauugcuugaaccaggagacg

SEQ ID NO: 502085 - RNA, 64 nt, hsa
acucagcagggaugacucagcaccgccccucaacaggcaugacucugcagagaugacucagcac

SEQ ID NO: 502086 - RNA, 64 nt, hsa
acucagcagggaugacucagcaccgccccucaacaggcaugacucugcagagaugacuuaguac

SEQ ID NO: 502087 - RNA, 64 nt, hsa; identical to SEQ ID NO: 502085

SEQ ID NO: 502088 - RNA, 64 nt, hsa
cacccaccucagccucccaaagugcagggauuacaggcaugagccaccaugccgggccaugauu

SEQ ID NO: 502089 - RNA, 64 nt, hsa
cacccgccucagccucccaaagugcugggauuacaggcaugagccacugugcccggccuaugau

SEQ ID NO: 502090 - RNA, 64 nt, hsa
ucccccaaggguucugcgaagaggcaguggaagaaggcaugaggagagggucucuugagaauuu

SEQ ID NO: 502091 - RNA, 64 nt, hsa
cucccaccucagccugccaaagcacugggauuacaggcaugagccaccaugccuggccaggaca

SEQ ID NO: 502092 - RNA, 64 nt, hsa
cuugugccccaaacuuccgaguagcugggacuacaggcaugagucaccacaccuggcugauuuu

SEQ ID NO: 502093 - RNA, 64 nt, hsa
cacccgccuuggccucccaaaguguugggauuacaggcaugagccacugcgccugguugccugc

SEQ ID NO: 502094 - RNA, 64 nt, hsa
ccccugccucggccucccaaagugcugggauuacaggcaugagccaccacgccuguccgguuau

SEQ ID NO: 502095 - RNA, 64 nt, hsa
cacccgccucagccucccaaagugcugggauuacaggcaugagccaccgcacccagccugguua

SEQ ID NO: 502096 - RNA, 64 nt, hsa
ugugugccuguaaugccagcuacucaggaggcugaggcaugagaaucgcuugaaccggggaggc

SEQ ID NO: 502097 - RNA, 64 nt, hsa
ggcucaagcgauccucccaaagugcuuggauugcaggcaugagccacuucgccuagccaagccu

SEQ ID NO: 502098 - RNA, 64 nt, hsa
gcacgccugccuugcucugccccaugcccugaacaggcaugagagcuccacguccccuagugca

SEQ ID NO: 502099 - RNA, 64 nt, hsa
gguuuuuagaaaagcaggauuuguuuuguuagggaggcaugauuuuggugagaucuuucuggaa

SEQ ID NO: 502100 - RNA, 64 nt, hsa; identical to SEQ ID NO: 157786

SEQ ID NO: 502101 - RNA, 64 nt, hsa; identical to SEQ ID NO: 157787

SEQ ID NO: 502102 - RNA, 64 nt, hsa; identical to SEQ ID NO: 157788

SEQ ID NO: 502103 - RNA, 64 nt, hsa; identical to SEQ ID NO: 157789

SEQ ID NO: 502104 - RNA, 64 nt, hsa; identical to SEQ ID NO: 157790

SEQ ID NO: 502105 - RNA, 64 nt, hsa; identical to SEQ ID NO: 157791

SEQ ID NO: 502106 - RNA, 64 nt, hsa; identical to SEQ ID NO: 157792

SEQ ID NO: 502107 - RNA, 64 nt, hsa; identical to SEQ ID NO: 157793

SEQ ID NO: 502108 - RNA, 64 nt, hsa; identical to SEQ ID NO: 157794

SEQ ID NO: 502109 - RNA, 64 nt, hsa; identical to SEQ ID NO: 157795

SEQ ID NO: 502110 - RNA, 64 nt, hsa; identical to SEQ ID NO: 157796

SEQ ID NO: 502111 - RNA, 64 nt, hsa; identical to SEQ ID NO: 157797

SEQ ID NO: 502112 - RNA, 64 nt, hsa; identical to SEQ ID NO: 157798

SEQ ID NO: 502113 - RNA, 64 nt, hsa; identical to SEQ ID NO: 157799

SEQ ID NO: 502114 - RNA, 64 nt, hsa; identical to SEQ ID NO: 157800

SEQ ID NO: 502115 - RNA, 64 nt, hsa; identical to SEQ ID NO: 157801

SEQ ID NO: 502116 - RNA, 61 nt, hsa; identical to SEQ ID NO: 157802

SEQ ID NO: 502117 - RNA, 64 nt, hsa; identical to SEQ ID NO: 157803

SEQ ID NO: 502118 - RNA, 64 nt, hsa; identical to SEQ ID NO: 157804

SEQ ID NO: 502119 - RNA, 64 nt, hsa; identical to SEQ ID NO: 157805

SEQ ID NO: 502120 - RNA, 64 nt, hsa; identical to SEQ ID NO: 157806

SEQ ID NO: 502121 - RNA, 64 nt, hsa; identical to SEQ ID NO: 157807

SEQ ID NO: 502122 - RNA, 64 nt, hsa; identical to SEQ ID NO: 157808

SEQ ID NO: 502123 - RNA, 64 nt, hsa; identical to SEQ ID NO: 157809

SEQ ID NO: 502124 - RNA, 64 nt, hsa; identical to SEQ ID NO: 157810

SEQ ID NO: 502125 - RNA, 64 nt, hsa; identical to SEQ ID NO: 157811

SEQ ID NO: 502126 - RNA, 64 nt, hsa; identical to SEQ ID NO: 157812

SEQ ID NO: 502127 - RNA, 64 nt, hsa; identical to SEQ ID NO: 157813

SEQ ID NO: 502128 - RNA, 64 nt, hsa; identical to SEQ ID NO: 157814

SEQ ID NO: 502129 - RNA, 64 nt, hsa
uuuagaggcuuuauauguuguacugaccaagguagguuuguauagcagcccuauacuuugggga

SEQ ID NO: 502130 - RNA, 64 nt, hsa
gucauauuauuaguaugaaucucauuucccaaaggguuuguauucugcuaaaaggagaugccaa

SEQ ID NO: 502131 - RNA, 64 nt, hsa
ucaccuaugcagccuuguuugauuuauuuucucugguuuguacuguuauuaaaagcauauugua

SEQ ID NO: 502132 - RNA, 64 nt, hsa
guggaaggagggaauuuaaaaaugggacuugagugguuuguagaauuuguguucauaaguucag

SEQ ID NO: 502133 - RNA, 64 nt, hsa
acuggauuaguacuaauuuuauacaugcuuaacugguuuguacacuuugggaugcuacuuagug

SEQ ID NO: 502134 - RNA, 64 nt, hsa; identical to SEQ ID NO: 279822

SEQ ID NO: 502135 - RNA, 64 nt, hsa; identical to SEQ ID NO: 279823

SEQ ID NO: 502136 - RNA, 64 nt, hsa; identical to SEQ ID NO: 279824

SEQ ID NO: 502137 - RNA, 64 nt, hsa; identical to SEQ ID NO: 279825

SEQ ID NO: 502138 - RNA, 64 nt, hsa; identical to SEQ ID NO: 279826

SEQ ID NO: 502139 - RNA, 64 nt, hsa; identical to SEQ ID NO: 279827

SEQ ID NO: 502140 - RNA, 64 nt, hsa; identical to SEQ ID NO: 279828

SEQ ID NO: 502141 - RNA, 64 nt, hsa; identical to SEQ ID NO: 279829

SEQ ID NO: 502142 - RNA, 64 nt, hsa; identical to SEQ ID NO: 279830

SEQ ID NO: 502143 - RNA, 64 nt, hsa; identical to SEQ ID NO: 279831

SEQ ID NO: 502144 - RNA, 64 nt, hsa; identical to SEQ ID NO: 279832

SEQ ID NO: 502145 - RNA, 62 nt, hsa; identical to SEQ ID NO: 279833

SEQ ID NO: 502146 - RNA, 64 nt, hsa; identical to SEQ ID NO: 279834

SEQ ID NO: 502147 - RNA, 64 nt, hsa; identical to SEQ ID NO: 279835

SEQ ID NO: 502148 - RNA, 64 nt, hsa; identical to SEQ ID NO: 279836

SEQ ID NO: 502149 - RNA, 64 nt, hsa; identical to SEQ ID NO: 279837

SEQ ID NO: 502150 - RNA, 64 nt, hsa; identical to SEQ ID NO: 279838

SEQ ID NO: 502151 - RNA, 64 nt, hsa; identical to SEQ ID NO: 279839

SEQ ID NO: 502152 - RNA, 64 nt, hsa
ggggugucugcaugucccuucacauaauugauaaugguaccaccuucuauaauaauaauauaaa

SEQ ID NO: 502153 - RNA, 64 nt, hsa
caccugggggucccagggugguggggguggcaggugguaccacagcucugagagcagauaccag

SEQ ID NO: 502154 - RNA, 64 nt, hsa
caaaggacacuuucagcgacagcuauggacagcaugguaccaaggaguuaaguugaggcuuuuu

SEQ ID NO: 502155 - RNA, 64 nt, hsa
uaaugauauggaucaucacccagauucucucacuugguaccagcauuucuguagguauuagaga

SEQ ID NO: 502156 - RNA, 64 nt, hsa
aaggucuuuggcaagaaucccaggcuugaccaacugguaccaggucaaagauuuuuguauucuu

SEQ ID NO: 502157 - RNA, 64 nt, hsa
gggucccgggcggccuuguggcucugguaauguuugguaccaaacuugggggccaaaaagggca

SEQ ID NO: 502158 - RNA, 64 nt, hsa
aucuaaacaugacaauaauagacauaucuuuguaugguaccaguuaguuuugccguggaucaga

SEQ ID NO: 502159 - RNA, 64 nt, hsa
gacagaaacuuuucuggucaaaaaugaaagguccugguaccaucuuccccagaaacgaucaaga

SEQ ID NO: 502160 - RNA, 64 nt, hsa
ccugcuuccuuugccuuacaauugaagcagcccgugguaccaucacaguaugcagagacuuccu

SEQ ID NO: 502161 - RNA, 64 nt, hsa
ggcugguuuccccaccccagaaacauguaacgguugguaccaugcuaagcccuugccaugcuaa

SEQ ID NO: 502162 - RNA, 64 nt, hsa
agauguuuuuauuuuauauuauuauuauagaaggugguaccauuaucaauuaugugaagggaca

SEQ ID NO: 502163 - RNA, 64 nt, hsa
gacccagcucccuuuagucacguuugcuuggcucugguaccaaauaguugggauuaccgaagag

SEQ ID NO: 502164 - RNA, 64 nt, hsa
uggcuuuggcgaaggucaguguacagacauuccaugguaccagagugcucagaaacucaagaua

SEQ ID NO: 502165 - RNA, 64 nt, hsa
uuaccucuguaucaacucaggaaaucucauaagcugguaccacucaggagaaguuuauucuucc

SEQ ID NO: 502166 - RNA, 64 nt, hsa
cugccaacuccaguaucagcucucacaguguacuugguaccaucccugggcucugcuggcgaga

SEQ ID NO: 502167 - RNA, 64 nt, hsa
ccuccuugauuuuuuggcauaguuucagcaggauugguaccaguuauucuuucugcaucuugua

SEQ ID NO: 502168 - RNA, 64 nt, hsa
ccccaaaucccuagagugcuuucuggucucacuuugguaccaaggaagccucacauagugguac

SEQ ID NO: 502169 - RNA, 64 nt, hsa
ccgagccaacgccucaggaaucaggaggccagccugguaccaaaaggaguacccagggccuggu

SEQ ID NO: 502170 - RNA, 64 nt, hsa
auuuccacuaaauggaacccaaauauuaauguuaugguaccauauacugauguaaaaaucaugc

SEQ ID NO: 502171 - RNA, 64 nt, hsa
aaaagcauuaacaguuauguuccuguuucguuauugguaccaaaacucuugccagauaaccagu

SEQ ID NO: 502172 - RNA, 64 nt, hsa
aauauaaauuucucuauccugcucugaggcuaauugguaccauauuuucccuuugugucuugug

SEQ ID NO: 502173 - RNA, 64 nt, hsa
acguugaucccaguaaggacaucaccucuacccuugguaccacaacucuguaugggguugccca

SEQ ID NO: 502174 - RNA, 64 nt, hsa
gggcaguaccugagggucuguagguugcacacuuugguaccagauaacuuuuuuuuuucuuuau

SEQ ID NO: 502175 - RNA, 64 nt, hsa
gcaguacugugaauuuugaaguuaaacuaaauuuugguaccauaccaacuggaauuuaggcuuu

SEQ ID NO: 502176 - RNA, 64 nt, hsa
cucuguucuguuccauugaucuauaucuuuguuuugguaccaguaccaugcuguuuugguuacu

SEQ ID NO: 502177 - RNA, 64 nt, hsa
cccuugugaggagggggcacuccucuccagccccugguaccacaguccucacgauggugcagug

SEQ ID NO: 502178 - RNA, 64 nt, hsa
uucagcccgggagagggggugggcguguucuuugugguaccaaagugggacuaggacaaaaauu

SEQ ID NO: 502179 - RNA, 64 nt, hsa
auuuuggguauuucuucagcaggucccaaucuacugguaccaauuuacuguauuaguccguuuu

SEQ ID NO: 502180 - RNA, 64 nt, hsa; identical to SEQ ID NO: 502175

SEQ ID NO: 502181 - RNA, 64 nt, hsa
uagccccucuguucugugcuuacuggccaggaaaugguaccaauuuuucaguguuggacuugac

SEQ ID NO: 502182 - RNA, 64 nt, hsa
acauccaggaaucugaagucagauaguaaggaugugguaccaauccucccgagugcaaugcuaa

SEQ ID NO: 502183 - RNA, 64 nt, hsa
uuugugauucaaaguucaggggugguaaggacucugguaccagggaagagggagaauuaauuua

SEQ ID NO: 502184 - RNA, 64 nt, hsa
gagucuaaucuuucaaggaggugggcucccaggaugguaccauugcucuuuccuagcuaacccu

SEQ ID NO: 502185 - RNA, 64 nt, hsa
caguccagaauaagugcuguuugagaugugaugcugguaccacuggaaucgaucuguacuguaa

SEQ ID NO: 502186 - RNA, 64 nt, hsa
ugcuuguuuacaacuaugaucuucuaugaaauggugguaccaaggggcgcccaacagcuuuuau

SEQ ID NO: 502187 - RNA, 64 nt, hsa
uaaaccucagcagccaucaguuuggccaagugguugguaccaguggaaugaagucuuugauggg

SEQ ID NO: 502188 - RNA, 64 nt, hsa
ggaaugugggucugcaccuuguccccucauaggaugguaccaagcauuuagugcacaguggccc

SEQ ID NO: 502189 - RNA, 64 nt, hsa
gccucaaaccucuuacggagcuucuccucagaagugguaccaucgccuuccaaagucagcacuc

SEQ ID NO: 502190 - RNA, 64 nt, hsa
cccaggacacucaguucuuucaaagaccaggaugugguaccaacuuuggaaacgaaaggucucu

SEQ ID NO: 502191 - RNA, 64 nt, hsa
gauguuuaucaauacaacugccauuuuagcuaugugguaccaagauuagcaaaugaccuucaua

SEQ ID NO: 502192 - RNA, 64 nt, hsa
uccucugcuuaauguuaauacauguaacccacagugguaccaugagaugucaaaaccugggggc

SEQ ID NO: 502193 - RNA, 64 nt, hsa
ugcucuccuuagucuuggucaucagaaccucacuugguaccauauagaucaaaagcuuuguaac

SEQ ID NO: 502194 - RNA, 64 nt, hsa
guuacaguauaugaucacuaauauaguaugcucuugguaccaggagcucugauauauaucuggu

SEQ ID NO: 502195 - RNA, 64 nt, hsa
caaaaguccccagauggcaauacaaaguauccccugguaccacauauauucauuugugaguuug

SEQ ID NO: 502196 - RNA, 64 nt, hsa
auuuuuauuuggugcuuuuuaggaaguagaucuuugguaccacuucacuacguagagcauucga

SEQ ID NO: 502197 - RNA, 64 nt, hsa
ccuuuuuuucaaaaaagaaaauguguuuuuuguuugguaccauagugugaaaugcugggaacaa

SEQ ID NO: 502198 - RNA, 64 nt, hsa
guaagcacugucaugaucacagaaugcaagcuucugguaccaugauccucaacuuagagaggaa

SEQ ID NO: 502199 - RNA, 64 nt, hsa
ccuagugauugcuggugaaguaauauuggaauuuugguaccaugagaagacuuauaaaggauuu

SEQ ID NO: 502200 - RNA, 64 nt, hsa
uccucccuuacugaaccacucucccaccuccuggugguaccauuauuauagaagcccucuacag

SEQ ID NO: 502201 - RNA, 64 nt, hsa
uuggucuucuccugaaauucccaaauucacugaaugguaccaugccgaucucugagaaguuaug

SEQ ID NO: 502202 - RNA, 64 nt, hsa
ugagggucacuuuucuaauacuuuuacuauaaugugguaccaccucagcccuaauaaauaauau

SEQ ID NO: 502203 - RNA, 64 nt, hsa
acauauauacuguuuaaguauggcaaguuuucuuugguaccaauuuguuuagauaauuuuaaaa

SEQ ID NO: 502204 - RNA, 64 nt, hsa
gagaugguaaaauaggccgggaaaaaaaaaucuuugguaccaaagauuacacuuguguuucuac

SEQ ID NO: 502205 - RNA, 64 nt, hsa
uuugagagccuagcccaggccuaagggcuauguuugguaccaguguuuugucuuuagcuuuucu

SEQ ID NO: 502206 - RNA, 64 nt, hsa
ucugaaaaugcucaguguguacucuaauuauuuaugguaccauuugaauuguaacuugcauuuu

SEQ ID NO: 502207 - RNA, 64 nt, hsa
ugcguuacuuuaaguacuaaguaugcagguuuccugguaccauugaguugcugcuauuaaagcu

SEQ ID NO: 502208 - RNA, 64 nt, hsa
ucauucaauuauucauaugacaguuguuugaguuugguaccaucuuauuuuccccuuauacaga

SEQ ID NO: 502209 - RNA, 64 nt, hsa
cgugaagggcaccgagaacucgaagcccuuccagugguaccagcucacucccugggaaaggggu

SEQ ID NO: 502210 - RNA, 64 nt, hsa
ccuguuuuuccuugcaaacucaaaucugugagcuugguaccaaguccagguauaacauuccuau

SEQ ID NO: 502211 - RNA, 64 nt, hsa
uggugcuaaagaaaggacuagcauaugagacuucugguaccaauggggcuggugggcaugcugu

SEQ ID NO: 502212 - RNA, 64 nt, hsa
uaaaaaugaaauacuuuaugcaaacaggcaaaauugguaccaaagggaaacauuaaccaugagg

SEQ ID NO: 502213 - RNA, 64 nt, hsa
ucugagggccucauuaggcccagacugcugcugcugguaccagucuccugagacacugccuccc

SEQ ID NO: 502214 - RNA, 64 nt, hsa
guuugccuauuuuucaaauuauuuaauagauguaugguaccauuuaaaagugguuguaucugaa

SEQ ID NO: 502215 - RNA, 64 nt, hsa
uucuuagcauuuuuaccugcagaaaaacuuuguaugguaccacuguguugguuauauggugaau

SEQ ID NO: 502216 - RNA, 64 nt, hsa
uugggaaacgcuuuggugcuuuucuccaguuuucugguaccaguuacuuguuuauaaacugaac

SEQ ID NO: 502217 - RNA, 64 nt, hsa
ccuacccggccucaaauggugcugcugcccaugaugguaccacaccagggccucagccuggccc

SEQ ID NO: 502218 - RNA, 64 nt, hsa
gaaugcuacaaaguguauguucaagaaaauuaaaugguaccacucuuccacaguuuggaauaau

SEQ ID NO: 502219 - RNA, 64 nt, hsa
ccucucccgacccaggcuuuguggggcaggcaccugguaccaaggguaacccggcuccugguau

SEQ ID NO: 502220 - RNA, 64 nt, hsa
agggaggauggacagaccucuugcccucacacucugguaccaggacuguucgcuuuuaugauug

SEQ ID NO: 502221 - RNA, 64 nt, hsa
cagcacagccucuuagaugcaguucugaagaagaugguaccaccagucugacuguuuccaucaa

SEQ ID NO: 502222 - RNA, 64 nt, hsa
uuggggucacagaacauuuuggggcaguuuaaugugguaccaaacugaaaauaggagcuauuua

SEQ ID NO: 502223 - RNA, 64 nt, hsa
ccacauuggagauguuuaguaaucauauuguuacugguaccaagacuacuagggaaaugccuuu

SEQ ID NO: 502224 - RNA, 64 nt, hsa
uggucagaaaaagcuguaaauggcaauagaguuuugguaccagaggcuagaguggacaaaugag

SEQ ID NO: 502225 - RNA, 64 nt, hsa
aaaugcuagauauuggucugggaggcaacauuaaugguaccagccugucacaacugagcaguuc

SEQ ID NO: 502226 - RNA, 64 nt, hsa
agugagcucauaucuccauuugucagugcuggacugguaccagaucguaaccuucccguugguc

SEQ ID NO: 502227 - RNA, 64 nt, hsa
aacuuacauaaugcucugcuuuuuuuuuuucucuugguaccauugguauuauaauaaagagcaa

SEQ ID NO: 502228 - RNA, 64 nt, hsa
ugaaggguaauaaaauguacuggauuuuuuaaggugguaccaaaaaugaaugucugucauauau

SEQ ID NO: 502229 - RNA, 64 nt, hsa
uuuccauuucuaaagauggacaggcccuuuggcgugguaccaaccagauaaugacugcaucagg

SEQ ID NO: 502230 - RNA, 64 nt, hsa
gcccgacaugguggugccaccuccgcgggagcacugguaccaccccauccuccggcugcaggag

SEQ ID NO: 502231 - RNA, 64 nt, hsa
ggcuggcaucucccccacccugugccccuuuucaugguaccaggcccgcacugggggcaauuga

SEQ ID NO: 502232 - RNA, 64 nt, hsa
cccuacgcugccagcagguggccaugacuacccgugguaccaaucucagucuuaaagcucaggc

SEQ ID NO: 502233 - RNA, 64 nt, hsa
uuccgauacuaguuugcuuugcugaccaaaugccugguaccagaggauggugaggcgaaggcca

SEQ ID NO: 502234 - RNA, 64 nt, hsa
cauuuuuaaauguccguguuaagaauuggcccacugguaccaacucaccucuauuuugucaguu

SEQ ID NO: 502235 - RNA, 64 nt, hsa
gguuuuuuguuuuguuuuguucugaagagaagagugguaccauauguugcaggaagucaaacug

SEQ ID NO: 502236 - RNA, 64 nt, hsa
cuacugguuuugcauagaucauucaucuuaauuuugguaccaguuaaaaauacaaauguacuau

SEQ ID NO: 502237 - RNA, 64 nt, hsa
uguucucggaguguguaugccaagagugcacccaugguaccaaucaugaaucuuuguuucaggu

SEQ ID NO: 502238 - RNA, 64 nt, hsa
auggaaaugcuauacguuuuugacauuuauuaaaugguaccaauaaaguauuuuauuaccaaaa

SEQ ID NO: 502239 - RNA, 64 nt, hsa
cugggccaagaccucccacuccgcccucugaggaugguaccaagaaugggccuuugggacuucu

SEQ ID NO: 502240 - RNA, 64 nt, hsa
agaaaaaaaaaugcacucuucccuugccggcuccugguaccauuggucugaacagcuguaguug

SEQ ID NO: 502241 - RNA, 64 nt, hsa
ccaaaugaaaaauaacaguuuuuucagggcuuuuugguaccagaacucaggcacuuggauuuua

SEQ ID NO: 502242 - RNA, 64 nt, hsa
uuuuccuguuuuuuguuuuuuccauuuacggcagugguaccauguuuuggaugugugauguuua

SEQ ID NO: 502243 - RNA, 64 nt, hsa
caacgcaacgucuaacuggacuucccaagauaaaugguaccagcguccucuuaaaagaugccuu

SEQ ID NO: 502244 - RNA, 64 nt, hsa
aaagcagucccccaacuacccccagcugugcuuaugguaccagaugcagcucaagagaucccaa

SEQ ID NO: 502245 - RNA, 64 nt, hsa
acauuucaccuuuagagauggaggauggaaggauugguaccagaagagggcuaagauacguuuu

SEQ ID NO: 502246 - RNA, 64 nt, hsa
accagggcuacccagaaaaagugacuugauaacaugguaccaauaaguaagggaugcucucucg

SEQ ID NO: 502247 - RNA, 64 nt, hsa
ggccaaaguguacauugagacuggcagccaucuaugguaccacugaaacccugacccagaaaag

SEQ ID NO: 502248 - RNA, 64 nt, hsa
cugcugggcuggggccugauggggagggucucggugguaccaggucuccuccaccgccauggcu

SEQ ID NO: 502249 - RNA, 64 nt, hsa
aucaugguucuggaggcugggagguccaagagcaugguaccagcaucugcuuggcaucugguga

SEQ ID NO: 502250 - RNA, 64 nt, hsa
ugaaccuacugcaaaccaagaauaacucaugaggugguaccaaagaugaaagcccagacuucag

SEQ ID NO: 502251 - RNA, 64 nt, hsa
ccagccuguuuucucuuuucuaaaagacaaauuaugguaccauaagcugccaaagauccccucc

SEQ ID NO: 502252 - RNA, 64 nt, hsa
ccuucucacaccccccgacuccccacccauauuuugguaccaguuucuccucaugaaaugcagu

SEQ ID NO: 502253 - RNA, 64 nt, hsa
uuugauuugugccauuccuucagaugaagaaauuugguaccaaaguaauaauaauaauauaaau

SEQ ID NO: 502254 - RNA, 64 nt, hsa
gaaguuucuauuaguauauccaauuuagcaaaauugguaccaaaaugauuucuuugguaauugu

SEQ ID NO: 502255 - RNA, 64 nt, hsa
ucacucugccagggcagugcuagugagcugggcaugguaccagcccuggggcugggccccccag

SEQ ID NO: 502256 - RNA, 64 nt, hsa
uucugugguugugguggugguaagaaggagauauugguaccaagaaaaauuuccaaaacuauug

SEQ ID NO: 502257 - RNA, 64 nt, hsa
aaggcagacacucuccacuguccagguuauaaccugguaccagcagacuuugcagggaagaaag

SEQ ID NO: 502258 - RNA, 64 nt, hsa
auugucuccucucccucugcaugugucuaaaaggugguaccaggcaucccuuuccuggcuuaug

SEQ ID NO: 502259 - RNA, 64 nt, hsa
ggcacauccuaugcaauauaucuaaauugaauaaugguaccagauaaaauuauagaugggaaug

SEQ ID NO: 502260 - RNA, 64 nt, hsa
caauaccucauauaauacuugcucaacaguauagugguaccaauggcauuaagaugguguuuuu

SEQ ID NO: 502261 - RNA, 64 nt, hsa
ccucagacguguucugcacaucccuucuuccuggugguaccaucccuauuuccuggagcaccag

SEQ ID NO: 502262 - RNA, 64 nt, hsa
auguuguaauuaaugcaagauauuaccauguacaugguaccaccaucuuacuguaacauuuuuc

SEQ ID NO: 502263 - RNA, 64 nt, hsa
uggcagcugaacucggguaguccaguggccuagcugguaccacaucuauucccauccagagaca

SEQ ID NO: 502264 - RNA, 64 nt, hsa
ccaaggaacaccggccuguuuaugaggggaaggaugguaccaucgaggacaucaucacaggugg

SEQ ID NO: 502265 - RNA, 64 nt, hsa
uuaacuguaaaguaaccugacucaguauaguuacugguaccacagugaggugaauaaaacggga

SEQ ID NO: 502266 - RNA, 64 nt, hsa
aucuaaaaaaaccgauucccuaauucgaauuuauugguaccaaagcucucuuuggcuauagaca

SEQ ID NO: 502267 - RNA, 64 nt, hsa
uaucaacuguguguucgacagugaauauucaaucugguaccaguugaaauuuuugguuauaaau

SEQ ID NO: 502268 - RNA, 64 nt, hsa
cagcaguuuuuuuuuauugucacagggaaauaaaugguaccagaagucccuuuccuguucuguc

SEQ ID NO: 502269 - RNA, 64 nt, hsa
acuguugaaauccauuggaagggaaaaaagaaagugguaccaguguuaccagcucaacuaaaac

SEQ ID NO: 502270 - RNA, 64 nt, hsa
cuuuacuaaugggaaugauuucuguauguucccuugguaccaagagguacuaugcaaaguaacc

SEQ ID NO: 502271 - RNA, 64 nt, hsa
guggggcggacggaaaaggggugggcaucccuccugguaccaagcugcugggugcgaaggcaga

SEQ ID NO: 502272 - RNA, 64 nt, hsa
uuauauccccuuugcuucuacugcucugauuuugugguaccaguacucucugccacugaacauu

SEQ ID NO: 502273 - RNA, 64 nt, hsa
guucuguucauguagcacagauaagcauugcacuugguaccaugcuuuaccucauuucaagaaa

SEQ ID NO: 502274 - RNA, 64 nt, hsa
cccaaacuccaagacagccauacuuccagcgaaaugguaccaaggagaggucuugcucacaggg

SEQ ID NO: 502275 - RNA, 64 nt, hsa
cuaccuuaauuuaaccuguggccaaacucagagaugguaccagccaggggcaagcaugaccaga

SEQ ID NO: 502276 - RNA, 64 nt, hsa
gaucccuacucaugacacggaggugacucgugagugguaccaacaaacucaugagcagcagcaa

SEQ ID NO: 502277 - RNA, 64 nt, hsa
gaagaguacagugagagguuaauuucugcucaagugguaccacuuaaaggcauguauucuuuua

SEQ ID NO: 502278 - RNA, 64 nt, hsa
uuuggggguacuuagcuuccaugccuauaaagucugguaccagacugacuugaaauucauaaac

SEQ ID NO: 502279 - RNA, 64 nt, hsa
cucccuaaaauuucuauguugaagucuuaacccuugguaccacagaauaucacuguauuuggag

SEQ ID NO: 502280 - RNA, 64 nt, hsa
ggcuuccaggggccccaggagaagcugggcugugugguaccaacagccccgagggguggccuug

SEQ ID NO: 502281 - RNA, 64 nt, hsa
cagcuuugguugcacugaauuugggggagcugcaugguaccagggguuuauuggguugcagaua

SEQ ID NO: 502282 - RNA, 64 nt, hsa
ucucaucucacacugugaguccagcggcgcagggugguaccaggaaagaggauauucuaggcuu

SEQ ID NO: 502283 - RNA, 64 nt, hsa
agcugaugcaacaggauuugucugcagcagccucugguaccaccucugagucaaggguuguguc

SEQ ID NO: 502284 - RNA, 64 nt, hsa
uuucuucgggaaaguuuugauccgagugcuuuuuugguaccacgagacccggcccucugccagc

SEQ ID NO: 502285 - RNA, 64 nt, hsa
caugggcccacaggguaccaggauaaagccgaacugguaccaucuacucuuuugaaguguuuua

SEQ ID NO: 502286 - RNA, 64 nt, hsa
cagcgagucaguagaagcccuggcuggccccacuugguaccaauccaccaggcagcucagggcu

SEQ ID NO: 502287 - RNA, 64 nt, hsa
uccgucaggaauuuuguagaagggcuucaugugcugguaccaauaggacaggaagauuuuaauc

SEQ ID NO: 502288 - RNA, 64 nt, hsa
aaagacuuuugaauaaauaaacugaacucacaccugguaccacucagaaccuccaacugacuga

SEQ ID NO: 502289 - RNA, 64 nt, hsa
auuuuaaaaaaucucuuacagguuuucuugcagcugguaccauccaugucucacagcccuggcc

SEQ ID NO: 502290 - RNA, 64 nt, hsa
augugguaaagccuucaguaguuccaguuccuuuugguaccaugaaaggacucacacuggagag

SEQ ID NO: 502291 - RNA, 64 nt, hsa
gcuacaaggcuacauaaccaaaauagcaugguacugguaccaaaacagagauauagaucaauag

SEQ ID NO: 502292 - RNA, 64 nt, hsa
accuucucaagaccucagugggagcaccagccaaugguaccaucggcugggcugccagguaccc

SEQ ID NO: 502293 - RNA, 64 nt, hsa
gcuggaggccccggcggcuaggaggaggccucggugguaccagaagaggaggggcugaugugaa

SEQ ID NO: 502294 - RNA, 64 nt, hsa
aggguggaggggcuguguuuauuggaacaaagggugguaccaaaaugcauccccaugacccaca

SEQ ID NO: 502295 - RNA, 64 nt, hsa
uuguuucuugaguguuuccuaaucacuugaugggugguaccaccuagaauucuuccagcagccu

SEQ ID NO: 502296 - RNA, 64 nt, hsa
guuccguaaguggaagcccagcccccucaacaucugguaccagcacuccgcggcggggccgccg

SEQ ID NO: 502297 - RNA, 64 nt, hsa
cauggagggggcugagugacagagaugguucagcugguaccagaguagaaacaaggugcauccu

SEQ ID NO: 502298 - RNA, 64 nt, hsa
gccugccaaucgaagcccgucccugcauccaggaugguaccagcucccgccccucgccccccac

SEQ ID NO: 502299 - RNA, 64 nt, hsa
aauuuucuuuaaaccaucugguuuuuaagaaauuugguaccaaaaauugaugaguagaggcaaa

SEQ ID NO: 502300 - RNA, 64 nt, hsa
aagcaauauggaugugugagugugugauuuauuaugguaccaaaaauguccaccuucuuuccug

SEQ ID NO: 502301 - RNA, 64 nt, hsa
gcagaagagguucgaguccagggucacaagucucugguaccaaaagggacccauggcugacuga

SEQ ID NO: 502302 - RNA, 64 nt, hsa
uacugguauuuuuuucacgugccugagaccagccugguaccaggaccuuuuguucacagcgugc

SEQ ID NO: 502303 - RNA, 64 nt, hsa
gacuccaggaggcgcaggcugcagugagcucugaugguaccacugcacuccagccugggugaca

SEQ ID NO: 502304 - RNA, 64 nt, hsa
ccccggcacacuuagugacagugaugcucugugcugguaccaaacaaggcagacuugcaagaac

SEQ ID NO: 502305 - RNA, 64 nt, hsa
uaggugucugugucucaaaauuuauuguaaucauugguaccauugguggccucaacagaggcca

SEQ ID NO: 502306 - RNA, 64 nt, hsa
gaugccccugacccuugacaaaucuaucggugcuugguaccagcaugagcuaacuuuauggcuc

SEQ ID NO: 502307 - RNA, 64 nt, hsa
aaaggggagcgaugagcuguggaggaagcccuggugguaccagaggccagaauggugggaaaga

SEQ ID NO: 502308 - RNA, 64 nt, hsa
ggugcccuuacugaggugacagccucacagggucugguaccagggguugugcccucagcaguga

SEQ ID NO: 502309 - RNA, 64 nt, hsa
aaccuggccugggugugcagggagggguuccccuugguaccaggagagcugcucacuuagggcc

SEQ ID NO: 502310 - RNA, 64 nt, hsa
auuguacugugauuuucauaacccguugccuuuuugguaccagagcuacgugguuugaauucug

SEQ ID NO: 502311 - RNA, 64 nt, hsa
aaaaugucaccuuuuuauuauugacauuaaguaaugguaccauauauuuuuuaaaauacauauu

SEQ ID NO: 502312 - RNA, 64 nt, hsa
caaggcauccucacaacaaagaagagaugugauuugguaccauuucacaccagcaggugucugg

SEQ ID NO: 502313 - RNA, 64 nt, hsa
ggugggggcaaagagacccagucaauuacauguuugguaccaagaaaggaaccugucagggcag

SEQ ID NO: 502314 - RNA, 64 nt, hsa
gaaguuucuagaggugaaaaggcagaaucuuaaaugguaccauuggugucacugggaggagaaa

SEQ ID NO: 502315 - RNA, 64 nt, hsa
aagaggagacagcugugaaguugggcgugcucugugguaccagcugugacuuuucuauuucucc

SEQ ID NO: 502316 - RNA, 64 nt, hsa
caacagcccugugaagugaccucagugagauauuugguaccaugguguaagcugauagcacaag

SEQ ID NO: 502317 - RNA, 64 nt, hsa
gacugacccaugggacuccucccaucccccaggcugguaccaguucuguaccauaugagaaagu

SEQ ID NO: 502318 - RNA, 64 nt, hsa
gaauggugggcuccagaguaggugggucuuggauugguaccagagccuauggaaaggguguggc

SEQ ID NO: 502319 - RNA, 64 nt, hsa
gaauucaguggaacuuaucuucauuaaauuuagcugguaccagguugauaugacuugucaauau

SEQ ID NO: 502320 - RNA, 64 nt, hsa
ccaaacaagaauugauuauauugcuucugugcuaugguaccagcagauuauucagccaugcuuc

SEQ ID NO: 502321 - RNA, 64 nt, hsa
ucagcaugacuucaccuccauccugguggacaugugguaccagaccgugaacaccugcuuccuc

SEQ ID NO: 502322 - RNA, 64 nt, hsa
ucaucugaugaaauuuuguuuuagguaauuuccuugguaccagcaucucauuggauuuuggauu

SEQ ID NO: 502323 - RNA, 64 nt, hsa
ucuuugcaaaguaaggaggacuaagggaaaaugaugguaccauguaacagaaugagagcuaauu

SEQ ID NO: 502324 - RNA, 64 nt, hsa
gcccucccuuggccgcccuacuccccaguuuccuggcgaugagccauuuauugugucucacacc

SEQ ID NO: 502325 - RNA, 64 nt, hsa
uguuucugaaguguucgaggguaccaggagagcuggcgaugacugaacugcugauggacaaaug

SEQ ID NO: 502326 - RNA, 64 nt, hsa
ggaacaaguguaauuuccuucccuccuuuaaccuggcgaugagcguccuuuaaaccacugugcc

SEQ ID NO: 502327 - RNA, 64 nt, hsa
auuuaauguuugauuuaguaauaguccaauauuuggcgaugagguaauucucccuaaggaaucu

SEQ ID NO: 502328 - RNA, 64 nt, hsa
ucugggagguguacccaacagcucauugagagcgggcgaugaugacaguggcggcuuuguggag

SEQ ID NO: 502329 - RNA, 64 nt, hsa
acuuugccagagccugagagagcgauguccucgaggcgaugauauucucaccauccugacugaa

SEQ ID NO: 502330 - RNA, 64 nt, hsa
uccccccacacugcucaggggaggggagggaucaggcgaugagacugugaggccaaaagaaggg

SEQ ID NO: 502331 - RNA, 64 nt, hsa
agaaaaggcaauaaacggcccaacuagugcuucuggcgaugacauuucuaagcuacagcguacu

SEQ ID NO: 502332 - RNA, 64 nt, hsa
cuggagacuuggaagaguuggaggguuggcagggggcgaugauaauuuacuuaauggguacaau

SEQ ID NO: 502333 - RNA, 64 nt, hsa
cuaccuuuuuugccuuuuguccuuuuguggagagggcgaugaauuaagaguaguggggugggug

SEQ ID NO: 502334 - RNA, 64 nt, hsa
cacacuccccgccguacaguucuccagaaucccaggcgaugacaagucugaacccacgaaaaua

SEQ ID NO: 502335 - RNA, 64 nt, hsa
agccucucccaggcgggagucuaccauccgagacggcgaugacaaagagcuucauuccacauuc

SEQ ID NO: 502336 - RNA, 64 nt, hsa
uuuaaacuuuuaaaggaucaugagcuguuucuugggcgaugaauguucucaaucagaaaacuga

SEQ ID NO: 502337 - RNA, 64 nt, hsa
gccaggagcccgguggccccuuccccaggggcagggcgaugaaugcuuuuugcacgacacaggg

SEQ ID NO: 502338 - RNA, 64 nt, hsa
cagagauguguuaguguugugcuuugccuucuuuggcgaugaaugucagaaauugaaugccaca

SEQ ID NO: 502339 - RNA, 64 nt, hsa
guugcugcaggcggaacugagaccagccucucugggcgaugaaggacaauggugguagggccac

SEQ ID NO: 502340 - RNA, 64 nt, hsa
ugggaacugagaggugccagcaauugcugaagguggcgaugaacacccgaaggugggagggagg

SEQ ID NO: 502341 - RNA, 64 nt, hsa
caguugccuuucugacggccccccucagagggacggcgaugagcacuaaaugcuuuuuugacua

SEQ ID NO: 502342 - RNA, 64 nt, hsa
ccucuccucaaaugcugugugcugcaauuguccaggcgaugacaauggugauggcuccagagaa

SEQ ID NO: 502343 - RNA, 64 nt, hsa
cccaguauuagcacaaguuagggaggaagaggcaggcgaugagucuaguagcacccaggacggc

SEQ ID NO: 502344 - RNA, 64 nt, hsa
ccuggacguggauggcgccagugacuccggcagcggcgaugagggcgagggcgcggggaggggu

SEQ ID NO: 502345 - RNA, 64 nt, hsa
gaaccucaggccuagacuagguugccuuugugggggcgaugaagcagaguccccuggucaaguc

SEQ ID NO: 502346 - RNA, 64 nt, hsa
gacccagacauauccuuugcacugucccuagaggggcgaugagcuuugcagcauuaaaaaaugg

SEQ ID NO: 502347 - RNA, 64 nt, hsa
ugcccugaugggccaugagaugcuggggagaucuggcgaugacuguggcucccgcucucugacc

SEQ ID NO: 502348 - RNA, 64 nt, hsa
guugcaauuuuuugaauuuuuccaaucacaccuuggcgaugaccuugagcaguaggauauaaau

SEQ ID NO: 502349 - RNA, 64 nt, hsa
agagguaccugguggcugcccuguucgcaucaguggcgaugacuuuauuugcggagcauuucug

SEQ ID NO: 502350 - RNA, 64 nt, hsa
uuuuucagaaucaagagggaggacagugugagaaggcgaugauccaaagaagacagagagguca

SEQ ID NO: 502351 - RNA, 64 nt, hsa
gcugagcccgcccgcccucgcccccugcuugugcggcgaugaucuguuuugugcgucucuucuc

SEQ ID NO: 502352 - RNA, 64 nt, hsa
ccuugucccgccucauccacagaaagggaggaugggcgaugacaguuguuucuaugccuucuga

SEQ ID NO: 502353 - RNA, 64 nt, hsa
uuucugaccugaaugaaauauucagggacuuaggggcgaugauuguagaacagguacgugagcu

SEQ ID NO: 502354 - RNA, 64 nt, hsa
gccccacauggucagugaguuucuccccauguguggcgaugagagaguguagaaauaaagacac

SEQ ID NO: 502355 - RNA, 64 nt, hsa
uacgagaucuagccugcccugccugccugcccugggcgaugagguacgguggggaaggugccua

SEQ ID NO: 502356 - RNA, 64 nt, hsa
ucggcaacaucuggagaagcauaagcuaauuaagggcgaugauuauuauuacaagaagaaacca

SEQ ID NO: 502357 - RNA, 64 nt, hsa
gagaaaccaaauuggacaaaucaucaccacugauggcgaugauuacaauaaaaucaaguuuaag

SEQ ID NO: 502358 - RNA, 64 nt, hsa
gagaaaccaaauuggacaaauccucacuaccaauggcgaugauuacaauaaaaucaaguuugag

SEQ ID NO: 502359 - RNA, 64 nt, hsa
cucagaagaggagagccggcacagcagaggcaccggcgaugaaguggcacagccccagucggaa

SEQ ID NO: 502360 - RNA, 63 nt, hsa
uuuuguuuucuuuguuuuuucccccuucuccugaaucagcagggauggaaggaggguagggaa

SEQ ID NO: 502361 - RNA, 63 nt, hsa
gauacuaaaugacagccuuguuucuccccuuugaaucagcagacaccauggauuauauucuuu

SEQ ID NO: 502362 - RNA, 63 nt, hsa
gaaaugaccauuucccuuguauuuuuauaauuaaaucagcaaaauauuguaauaaagaaaucu

SEQ ID NO: 502363 - RNA, 63 nt, hsa
aaauuucaacaaagguuccagaggugacauucgaaucagcaaugaaauuuucauaguuaaauu

SEQ ID NO: 502364 - RNA, 63 nt, hsa
gggguuaucuuuuuuuuuuuccccuccuauuuuaaucagcaaaauccauaccaaaacaacgac

SEQ ID NO: 502365 - RNA, 63 nt, hsa
ugcucagauuuguguguucaaucaaugggcuuaaaucagcaaaauauuaugccuaaaguaaau

SEQ ID NO: 502366 - RNA, 63 nt, hsa
cauggugggagaguuuacaucacaaccacuacaaaucagcacuugcuuucuucuucuuaaaga

SEQ ID NO: 502367 - RNA, 63 nt, hsa
acuaauuucugcugcagcaucacgaucagggcaaaucagcacagccccccagccaucaguggu

SEQ ID NO: 502368 - RNA, 63 nt, hsa
ucuguaccuggagagagaguuuaggcaaauaacaaucagcaaggaaaccuucaccagugagaa

SEQ ID NO: 502369 - RNA, 63 nt, hsa
acaaaaaaccauacacacacacacacacacacaaaucagcaucauaagggaauguagccuucc

SEQ ID NO: 502370 - RNA, 63 nt, hsa
gaaaaugggggcaggugagaaguccauuuugagaaucagcauaguaaauuacauuucuaaucc

SEQ ID NO: 502371 - RNA, 63 nt, hsa
uuaauauuuucuuuugucaccccagaggugaaaaaucagcaguugaagccugacaggccucag

SEQ ID NO: 502372 - RNA, 63 nt, hsa
aaaugcacccaucagcacucuguaaaacgcaccaaucagcacucuguaaaaugcaccaaucag

SEQ ID NO: 502373 - RNA, 63 nt, hsa
aaacgcaccaaucagcacucuguaaaaugcaccaaucagcaggauucuaaaaguagacaauca

SEQ ID NO: 502374 - RNA, 63 nt, hsa
cucuguaucuagcucaagguuuguaaacacaccaaucagcacccugugucuagcucaguguuu

SEQ ID NO: 502375 - RNA, 63 nt, hsa
cuuugugucuagcucagggaucguaaacgcaccaaucagcacccugucaaaacagaccacuug

SEQ ID NO: 502376 - RNA, 63 nt, hsa
aaacagaccacuugacucucuguaaaauggaccaaucagcaggauguggguggggcgagacaa

SEQ ID NO: 502377 - RNA, 63 nt, hsa
cuauaauaaagauuucccugagacgggagucaaaaucagcaucccucagauaacugcuuuaug

SEQ ID NO: 502378 - RNA, 63 nt, hsa
ugacuuuggagaguuucaaagugaaaagcccaaaaucagcaaauuugacuucuuaguagccac

SEQ ID NO: 502379 - RNA, 63 nt, hsa
ugauuuuuguacgaaaaaaagcuuuguuauagaaaucagcauacuauuuuuuuaaaucuggag

SEQ ID NO: 502380 - RNA, 63 nt, hsa
uacgguaaaugaggacucagcacagccaaccauaaucagcaugucugggauagacuggucuag

SEQ ID NO: 502381 - RNA, 63 nt, hsa
agauggaccaaucagcgcucuguaaaauggaccaaucagcaggacaugggcggggacaauaag

SEQ ID NO: 502382 - RNA, 63 nt, hsa
uuucugucuuacaagaggauuguaaaauggaccaaucagcacucuguaagauggaccaaucag

SEQ ID NO: 502383 - RNA, 64 nt, hsa; identical to SEQ ID NO: 154250

SEQ ID NO: 502384 - RNA, 64 nt, hsa; identical to SEQ ID NO: 154251

SEQ ID NO: 502385 - RNA, 64 nt, hsa; identical to SEQ ID NO: 154252

SEQ ID NO: 502386 - RNA, 64 nt, hsa; identical to SEQ ID NO: 154253

SEQ ID NO: 502387 - RNA, 64 nt, hsa; identical to SEQ ID NO: 154254

SEQ ID NO: 502388 - RNA, 64 nt, hsa; identical to SEQ ID NO: 154255

SEQ ID NO: 502389 - RNA, 64 nt, hsa; identical to SEQ ID NO: 154256

SEQ ID NO: 502390 - RNA, 64 nt, hsa; identical to SEQ ID NO: 154257

SEQ ID NO: 502391 - RNA, 64 nt, hsa; identical to SEQ ID NO: 154258

SEQ ID NO: 502392 - RNA, 64 nt, hsa; identical to SEQ ID NO: 154259

SEQ ID NO: 502393 - RNA, 64 nt, hsa; identical to SEQ ID NO: 154260

SEQ ID NO: 502394 - RNA, 64 nt, hsa; identical to SEQ ID NO: 154261

SEQ ID NO: 502395 - RNA, 64 nt, hsa; identical to SEQ ID NO: 154262

SEQ ID NO: 502396 - RNA, 64 nt, hsa; identical to SEQ ID NO: 154263

SEQ ID NO: 502397 - RNA, 64 nt, hsa; identical to SEQ ID NO: 154264

SEQ ID NO: 502398 - RNA, 64 nt, hsa; identical to SEQ ID NO: 154265

SEQ ID NO: 502399 - RNA, 64 nt, hsa; identical to SEQ ID NO: 154266

SEQ ID NO: 502400 - RNA, 64 nt, hsa; identical to SEQ ID NO: 154267

SEQ ID NO: 502401 - RNA, 64 nt, hsa; identical to SEQ ID NO: 154268

SEQ ID NO: 502402 - RNA, 64 nt, hsa; identical to SEQ ID NO: 154269

SEQ ID NO: 502403 - RNA, 64 nt, hsa; identical to SEQ ID NO: 154270

SEQ ID NO: 502404 - RNA, 64 nt, hsa; identical to SEQ ID NO: 154271

SEQ ID NO: 502405 - RNA, 64 nt, hsa; identical to SEQ ID NO: 154272

SEQ ID NO: 502406 - RNA, 64 nt, hsa; identical to SEQ ID NO: 154273

SEQ ID NO: 502407 - RNA, 64 nt, hsa; identical to SEQ ID NO: 154274

SEQ ID NO: 502408 - RNA, 64 nt, hsa; identical to SEQ ID NO: 154275

SEQ ID NO: 502409 - RNA, 64 nt, hsa; identical to SEQ ID NO: 154276

SEQ ID NO: 502410 - RNA, 64 nt, hsa; identical to SEQ ID NO: 154277

SEQ ID NO: 502411 - RNA, 64 nt, hsa; identical to SEQ ID NO: 154278

SEQ ID NO: 502412 - RNA, 64 nt, hsa; identical to SEQ ID NO: 376100

SEQ ID NO: 502413 - RNA, 64 nt, hsa; identical to SEQ ID NO: 376101

SEQ ID NO: 502414 - RNA, 64 nt, hsa; identical to SEQ ID NO: 376102

SEQ ID NO: 502415 - RNA, 64 nt, hsa; identical to SEQ ID NO: 376103

SEQ ID NO: 502416 - RNA, 64 nt, hsa; identical to SEQ ID NO: 376104

SEQ ID NO: 502417 - RNA, 64 nt, hsa; identical to SEQ ID NO: 376105

SEQ ID NO: 502418 - RNA, 64 nt, hsa; identical to SEQ ID NO: 376106

SEQ ID NO: 502419 - RNA, 64 nt, hsa; identical to SEQ ID NO: 376107

SEQ ID NO: 502420 - RNA, 64 nt, hsa; identical to SEQ ID NO: 376108

SEQ ID NO: 502421 - RNA, 64 nt, hsa; identical to SEQ ID NO: 376109

SEQ ID NO: 502422 - RNA, 64 nt, hsa; identical to SEQ ID NO: 376110

SEQ ID NO: 502423 - RNA, 64 nt, hsa; identical to SEQ ID NO: 376111

SEQ ID NO: 502424 - RNA, 64 nt, hsa; identical to SEQ ID NO: 376112

SEQ ID NO: 502425 - RNA, 64 nt, hsa; identical to SEQ ID NO: 376113

SEQ ID NO: 502426 - RNA, 64 nt, hsa; identical to SEQ ID NO: 376114

SEQ ID NO: 502427 - RNA, 57 nt, hsa; identical to SEQ ID NO: 376115

SEQ ID NO: 502428 - RNA, 64 nt, hsa; identical to SEQ ID NO: 376116

SEQ ID NO: 502429 - RNA, 64 nt, hsa; identical to SEQ ID NO: 376117

SEQ ID NO: 502430 - RNA, 64 nt, hsa; identical to SEQ ID NO: 376118

SEQ ID NO: 502431 - RNA, 64 nt, hsa; identical to SEQ ID NO: 376119

SEQ ID NO: 502432 - RNA, 64 nt, hsa; identical to SEQ ID NO: 376120

SEQ ID NO: 502433 - RNA, 64 nt, hsa; identical to SEQ ID NO: 376121

SEQ ID NO: 502434 - RNA, 64 nt, hsa; identical to SEQ ID NO: 376122

SEQ ID NO: 502435 - RNA, 64 nt, hsa; identical to SEQ ID NO: 376123

SEQ ID NO: 502436 - RNA, 64 nt, hsa; identical to SEQ ID NO: 376124

SEQ ID NO: 502437 - RNA, 64 nt, hsa; identical to SEQ ID NO: 376125

SEQ ID NO: 502438 - RNA, 64 nt, hsa; identical to SEQ ID NO: 376126

SEQ ID NO: 502439 - RNA, 64 nt, hsa; identical to SEQ ID NO: 376127

SEQ ID NO: 502440 - RNA, 64 nt, hsa; identical to SEQ ID NO: 376128

SEQ ID NO: 502441 - RNA, 64 nt, hsa; identical to SEQ ID NO: 376129

SEQ ID NO: 502442 - RNA, 64 nt, hsa; identical to SEQ ID NO: 376130

SEQ ID NO: 502443 - RNA, 64 nt, hsa; identical to SEQ ID NO: 376131

SEQ ID NO: 502444 - RNA, 64 nt, hsa; identical to SEQ ID NO: 376132

SEQ ID NO: 502445 - RNA, 64 nt, hsa; identical to SEQ ID NO: 376133

SEQ ID NO: 502446 - RNA, 64 nt, hsa; identical to SEQ ID NO: 376134

SEQ ID NO: 502447 - RNA, 64 nt, hsa; identical to SEQ ID NO: 376135

SEQ ID NO: 502448 - RNA, 64 nt, hsa; identical to SEQ ID NO: 376136

SEQ ID NO: 502449 - RNA, 64 nt, hsa; identical to SEQ ID NO: 376137

SEQ ID NO: 502450 - RNA, 64 nt, hsa; identical to SEQ ID NO: 376138

SEQ ID NO: 502451 - RNA, 64 nt, hsa; identical to SEQ ID NO: 376139

SEQ ID NO: 502452 - RNA, 64 nt, hsa; identical to SEQ ID NO: 376140

SEQ ID NO: 502453 - RNA, 64 nt, hsa; identical to SEQ ID NO: 376141

SEQ ID NO: 502454 - RNA, 64 nt, hsa; identical to SEQ ID NO: 376142

SEQ ID NO: 502455 - RNA, 64 nt, hsa; identical to SEQ ID NO: 376143

SEQ ID NO: 502456 - RNA, 64 nt, hsa; identical to SEQ ID NO: 376144

SEQ ID NO: 502457 - RNA, 64 nt, hsa; identical to SEQ ID NO: 376145

SEQ ID NO: 502458 - RNA, 64 nt, hsa; identical to SEQ ID NO: 376146

SEQ ID NO: 502459 - RNA, 64 nt, hsa; identical to SEQ ID NO: 376147

SEQ ID NO: 502460 - RNA, 64 nt, hsa; identical to SEQ ID NO: 376148

SEQ ID NO: 502461 - RNA, 64 nt, hsa; identical to SEQ ID NO: 376149

SEQ ID NO: 502462 - RNA, 64 nt, hsa; identical to SEQ ID NO: 376150

SEQ ID NO: 502463 - RNA, 64 nt, hsa
ucuugccucagccucccaaguagcugggaugacaggcgcacaccaccacgcccagcaaauuuuu

SEQ ID NO: 502464 - RNA, 64 nt, hsa
uugugccucggccucccuaguagcugggauuacaggcgcacaccaccacacacagcuaauuuuu

SEQ ID NO: 502465 - RNA, 64 nt, hsa
cacccccaccccgcggaucacagcucacccacgcggcgcacaccccuccugccguugucaucug

SEQ ID NO: 502466 - RNA, 64 nt, hsa
cuccccaaaagagagucaggagagcagcaggagaggcgcacagaaggcccaguucucagggguu

SEQ ID NO: 502467 - RNA, 64 nt, hsa
cgcugccagggagccgccauccgagcuugagcugggcgcacagaggugcccgccaggaucugug

SEQ ID NO: 502468 - RNA, 64 nt, hsa
uccugcaguugggccagcugucgcaucucagcggggcgcacauguuauccacaagcaauggacc

SEQ ID NO: 502469 - RNA, 64 nt, hsa
ucuacugaaaacacaaaaauuagacgggcaugguggcgcacaccuguaaucccagcuacuuggg

SEQ ID NO: 502470 - RNA, 64 nt, hsa
acugacucccacaggagaggcuacaaaaugaucuggcgcacagggauguuuuguuuagcuugcg

SEQ ID NO: 502471 - RNA, 61 nt, hsa
ggaucuuuaaaaaggauugagcauuauucuuggcgcacaguccaaaauacaaauuggacag

SEQ ID NO: 502472 - RNA, 64 nt, hsa
uacuaaaaauacgaaaaaauuagcugggcaugguggcgcacaccuguagucccagcuacuccgg

SEQ ID NO: 502473 - RNA, 64 nt, hsa
cucuacuaaaaauacaaaauuagccagaugugguggcgcacaccuguaaucccagcuacucagg

SEQ ID NO: 502474 - RNA, 64 nt, hsa
caugcauuaaaaaauuuuucaagcugggccuaguggcgcacaccugcaaucccaacacuuuggg

SEQ ID NO: 502475 - RNA, 64 nt, hsa
ucuacaaaaaacacaaaaauuagcugggcauuguggcgcacaccuguauucccaucuagucagg

SEQ ID NO: 502476 - RNA, 64 nt, hsa
cggagacgccacccggugcuugaggcgggaccgaggcgcacagagaccgaggcgcauagagacc

SEQ ID NO: 502477 - RNA, 64 nt, hsa
accaugccccauauaacgcuugggugcgugggagggcgcacaucagggcagaggccaaguucca

SEQ ID NO: 502478 - RNA, 64 nt, hsa
ccucucaagacugaauggugaggccagguacaguggcgcacaccuguaaucccagcuacucuga

SEQ ID NO: 502479 - RNA, 64 nt, hsa
ccaggcucaagccucccgaauagcugggacuacaggcgcacaccaccauccccggcuaauuuuu

SEQ ID NO: 502480 - RNA, 64 nt, hsa
aguaggcaguuugggggcgguagagggaaacugaggcgcacacccaugcagccccugauguucu

SEQ ID NO: 502481 - RNA, 64 nt, hsa
ccuagcuggggagcagaguuagggugcacgcuauggcgcacacacacagugcacguccacagug

SEQ ID NO: 502482 - RNA, 64 nt, hsa
ggaacucauuuggaacuccccgugaggaggucgaggcgcacagggcaagcaggaagaggcgagg

SEQ ID NO: 502483 - RNA, 64 nt, hsa
cggucucagucuuuaauccuggcagggauucacgggcgcacacacacacacucaggauucagau

SEQ ID NO: 502484 - RNA, 64 nt, hsa
cucuacuaaaaauauaaaaucagccaggcaugguggcgcacaccuauaaucucagcuacucagg

SEQ ID NO: 502485 - RNA, 64 nt, hsa
ccgacguguccugaagguguaggcucuccacuuaggcgcacaagcugacggcugcagccagcag

SEQ ID NO: 502486 - RNA, 64 nt, hsa
cagcaccaagcaccacgcucucauccugcaagucggcgcacacaguggaugaaggcaggagacc

SEQ ID NO: 502487 - RNA, 64 nt, hsa
uccggcugcaggaccagguggugaucaucgacgaggcgcacaaccugaucgacaccaucacggg

SEQ ID NO: 502488 - RNA, 64 nt, hsa
uuguguuuuggauuuuaggagaauacuuaucucuggcgcacaucacuauauuuggcugccucug

SEQ ID NO: 502489 - RNA, 64 nt, hsa
aagaaccauguuuuaggaagaacgugcacacauaggcgcacacauccagacuguucccuucgca

SEQ ID NO: 502490 - RNA, 64 nt, hsa
cuucagugcagugugguguagguguuacgcgaagggcgcacagugucuagaaauacuugaucgu

SEQ ID NO: 502491 - RNA, 64 nt, hsa
ugggccucgguggcgagguggucguucuggcaaaggcgcacacugacuuugacguccaggccuu

SEQ ID NO: 502492 - RNA, 64 nt, hsa
gagacccaggagugccugauugucccacagggguggcgcacagcucugggaccacucagaagau

SEQ ID NO: 502493 - RNA, 64 nt, hsa
ucuacuaaaauacaaaaaauuagcugggcaugguggcgcacaccuguagucccagcuacucugg

SEQ ID NO: 502494 - RNA, 64 nt, hsa
uuuaacugcuuuguuauguaagcuuacccagcccggcgcacagugacucacgccuguaauccca

SEQ ID NO: 502495 - RNA, 64 nt, hsa
gaaguccccuuccaucccagagggugggcuucagggcgcacagcaugagaggcucugugccccc

SEQ ID NO: 502496 - RNA, 64 nt, hsa
gcagggcugugggcugcauacuggccgagcugcuggcgcacaggccucuucuccccggcacuuc

SEQ ID NO: 502497 - RNA, 64 nt, hsa
ugagcaccacacccagugggaagagugugggggaggcgcacagugugagcccgcccccacgucg

SEQ ID NO: 502498 - RNA, 64 nt, hsa
ucuacuaaaaaugcaaaaacuagccgggcaugguggcgcacaccuguaauccuagcuacucggg

SEQ ID NO: 502499 - RNA, 64 nt, hsa
gugauugagguuaugcuggcaccacucgcacacaggcgcacaaugguguuagcugggcagaaag

SEQ ID NO: 502500 - RNA, 64 nt, hsa
uagccccgcgcgccaggcaggcggagcggggcggggcgcacaagcucggccccgccccggcuuu

SEQ ID NO: 502501 - RNA, 64 nt, hsa
ugccaucaugacucacugcagccuugaccucccaggcgcacaaaauccuccucucagccugagu

SEQ ID NO: 502502 - RNA, 64 nt, hsa
agaccucucgccucuacguggcaccuggaauuggggcgcacagggaggggccgaugcugccacc

SEQ ID NO: 502503 - RNA, 64 nt, hsa
cgcagaagagcaacaugaagcugcacaugaagcgggcgcacagcuaugcuggugagaaugcugc

SEQ ID NO: 502504 - RNA, 64 nt, hsa
uucaucccucucaaguaauggcucagcuaauaaaggcgcacaugacuccaguccuuugcgcagc

SEQ ID NO: 502505 - RNA, 64 nt, hsa
aggaagggggcagagagaguuaugaccccgagagggcgcacagaccaagcgugagcuccacgcg

SEQ ID NO: 502506 - RNA, 64 nt, hsa
caggggcgcgcuccacuucguugcacgcggguccggcgcacaguucccgggcgagugggcugug

SEQ ID NO: 502507 - RNA, 64 nt, hsa
uccugccucagccucuugaguagcugggacuacaggcgcacaccaccacgccaggcuaauuuuu

SEQ ID NO: 502508 - RNA, 64 nt, hsa
uuagcagcaaagaauucucacaaaugugaauaugggcgcacauuugccucauaaagcacagcau

SEQ ID NO: 502509 - RNA, 64 nt, hsa
ccgcuggggcccggggguguggggcgguguggcgggcgcacacuguauguaccuauaauaaacc

SEQ ID NO: 502510 - RNA, 64 nt, hsa
agggccuggaguggugggauuggucccagugccuggcgcacauuggccugcagaguagauuaac

SEQ ID NO: 502511 - RNA, 64 nt, hsa
ucccgccucagccuccugagcagcugggauuacaggcgcacaucaccaugcccaaccuccaagu

SEQ ID NO: 502512 - RNA, 64 nt, hsa
ggccucaugaagucucagguccguguucccgcagggcgcacaugcuuggagaguccucagcagg

SEQ ID NO: 502513 - RNA, 64 nt, hsa
gugggcggcuuccucaagcccggaggagcucccaggcgcacaggggccgccgguaacaggggcc

SEQ ID NO: 502514 - RNA, 64 nt, hsa
agcauccugagauuuuaaauccugaaguguggguggcgcacacaccaaguagggagcuagucag

SEQ ID NO: 502515 - RNA, 64 nt, hsa
uucugccucagcuucccaaguagcugagauuacaggcgcacaccaccacgcccaacugauuuuu

SEQ ID NO: 502516 - RNA, 64 nt, hsa
ucucgcuggcaucuguaguaucauugggagcuuaggcgcacauggaaaugagagcccggcgcau

SEQ ID NO: 502517 - RNA, 64 nt, hsa
caagugcccuguuguguggaacacuucacauauuggcgcacaguacguaaggaggucucaugug

SEQ ID NO: 502518 - RNA, 64 nt, hsa
gcugagugacaucccaagcuugggcuuggguagugagugacaugugcacacguccagcugcgcc

SEQ ID NO: 502519 - RNA, 64 nt, hsa
gucccgggccgagugaggucgggccuggggagcugagugacaucccaagcuugggcuuggguag

SEQ ID NO: 502520 - RNA, 64 nt, hsa
cagaucgcgacacugcacuccagccugggcaacagagugacacucugucucaaaaaauaaaaua

SEQ ID NO: 502521 - RNA, 64 nt, hsa
ccaccaagaggccaccugucacucauggccaggagagugacaccauggaggguacaauugccag

SEQ ID NO: 502522 - RNA, 64 nt, hsa
agacauaagaaaggaaagaaaagacuuaaaacuggagugacaggacaaauaaucauuacuuuca

SEQ ID NO: 502523 - RNA, 64 nt, hsa
aaaugcuuuggauuuagaagcgucaugaaagcacgagugacagcuccuaaccucuccuuguuuu

SEQ ID NO: 502524 - RNA, 64 nt, hsa
caaugagccaugauuucccacugcacuccagccugagugacagagcgagacuccaucucuuuaa

SEQ ID NO: 502525 - RNA, 64 nt, hsa
cccaguccaugcuccagggucaggcggagcugcugagugacagcuuuccucaaaaagcagaagg

SEQ ID NO: 502526 - RNA, 64 nt, hsa
auuucaaaaccaaggaagcagccucagaguggucgagugacacaccucacgcaggcugagucca

SEQ ID NO: 502527 - RNA, 64 nt, hsa
uugcuuguaaucaagccuuuauggcugcugggcugagugacacaagcacuuuaauggccuggag

SEQ ID NO: 502528 - RNA, 64 nt, hsa
cccagcagaggccuuagucccauuuggggcuugggagugacauuugcuugaggcuuauacacug

SEQ ID NO: 502529 - RNA, 64 nt, hsa
agugaacagagacagugccacugcacaucagccugagugacagagagacuuugucucaaaaaaa

SEQ ID NO: 502530 - RNA, 64 nt, hsa
cucacucuuccuucucugaaaugcagacagcugugagugacaugggccucuggagaaugcaagu

SEQ ID NO: 502531 - RNA, 64 nt, hsa
cuuuucagugaucuggauaaguguucugaccagggagugacagguuaugacauuuccaugucaa

SEQ ID NO: 502532 - RNA, 64 nt, hsa
ugauuguacaacuuaaagcuccuuucucuuggcugagugacagguggcuguucagguggaccaa

SEQ ID NO: 502533 - RNA, 64 nt, hsa
gcuucgugggcacagacaccuccugggcugggcagagugacagugcuagaagaccccagagaga

SEQ ID NO: 502534 - RNA, 64 nt, hsa
ccugggcccugccccucuccccacauguaucccucggucugaauuagacauuccugggcacagg

SEQ ID NO: 502535 - RNA, 64 nt, hsa
agaauuuucccuuuuuuuuuuuuuuuuugagacacggucugacucugucacccaggcuagagua

SEQ ID NO: 502536 - RNA, 64 nt, hsa
ccuccugccggagagucugcuuccugagcuuuuccggucugaggauagcauugucauuucuucu

SEQ ID NO: 502537 - RNA, 59 nt, hsa
ccaaccucacguuuucuuaggucugaggccggucugaggccggucagaggccaggauug

SEQ ID NO: 502538 - RNA, 64 nt, hsa
gacucgaguauccaacaggcagucagagcucucccggucugaaaguugcauugccacugcuaac

SEQ ID NO: 502539 - RNA, 64 nt, hsa
ugucccccacucugcaccccaaaugggaagcauacggucugaauaaauccaaguuuuauucucu

SEQ ID NO: 502540 - RNA, 64 nt, hsa
acagggcugacugcacaaagcuggacccauccuucggucugaccuuagcauggggcuagauuaa

SEQ ID NO: 502541 - RNA, 64 nt, hsa
ccucgggcugcaacccugucugugccagauugcccggucugacccugcaggaagcaaagaggug

SEQ ID NO: 502542 - RNA, 64 nt, hsa
agauuuuucauguaucuuauagucacucauucuucggucugaauuuuagacgaucacagaaacg

SEQ ID NO: 502543 - RNA, 64 nt, hsa
ugagcuggacgucgcgguguguccucugugcccacggucugagcuagcuagcgcaccgccgagu

SEQ ID NO: 502544 - RNA, 64 nt, hsa
agcauauucccacauuccauuugguagcaauaugcggucugaaugcaugcauucaugaguccau

SEQ ID NO: 502545 - RNA, 64 nt, hsa
ccaaacaauaucaauggugaugccguccccugugcggucugaugcgccuuccuccgugacgccu

SEQ ID NO: 502546 - RNA, 64 nt, hsa
cuauggcccagaaacaacaggggaaacuagaguucggucugacaguccuugggguuaagucucc

SEQ ID NO: 502547 - RNA, 64 nt, hsa
gucugcaccgucaucuagauuguauuguacaucucggucugaacuucauccuggcaaaaacaaa

SEQ ID NO: 502548 - RNA, 64 nt, hsa
acaggcauccggccuugcccaggcaucucgccugcggucugaggaagggaacagaaggucauga

SEQ ID NO: 502549 - RNA, 64 nt, hsa
aauauacauauguuaauucuaguccuggaugacucggucugagaagauucaauuuaaaaucaga

SEQ ID NO: 502550 - RNA, 64 nt, hsa
ugaaugcaccuggaaugacauuuguaacagaagacggucugacuugcuuucaguauucacaagu

SEQ ID NO: 502551 - RNA, 64 nt, hsa
aaauaauuuguaguaaccuuacucugagguuuuacggucugauaaugaagcacuugcaugagua

SEQ ID NO: 502552 - RNA, 64 nt, hsa
auuaccugagacgaccagcacugggaguuagguacggucugaaguuaugucuagauaagacuuc

SEQ ID NO: 502553 - RNA, 64 nt, hsa
ugacaacuguggaaaggcgagcagaaaacuccggcggucugaggccauggaggugguugcugca

SEQ ID NO: 502554 - RNA, 64 nt, hsa
gucccagccacccaccccccacucccaggacuugcggucugagccuuuuuggauaauuaauaaa

SEQ ID NO: 502555 - RNA, 64 nt, hsa
cugcuguuguggguugcuuugucaaucucugccccggucugauguuuccuacagggagaugccu

SEQ ID NO: 502556 - RNA, 64 nt, hsa
gccuuaaaacuuaccuggcaguggcuuugcugcacggucugaaaccaccuguucccacccucuu

SEQ ID NO: 502557 - RNA, 64 nt, hsa
ugcccccaccucugucucccugucuucuuuagaucggucugauugauuuuaaaaguggacccaa

SEQ ID NO: 502558 - RNA, 64 nt, hsa
gaggacguccuuuucuaagcaacacagucuuccucggucugagagaaaagcagcccacucuugu

SEQ ID NO: 502559 - RNA, 64 nt, hsa
acuuuccauggguucaguuaucugcggucaaccacggucugacaauauuaaauggaaaauucuu

SEQ ID NO: 502560 - RNA, 64 nt, hsa
aauuauugcaaaguaaaggaucuuugaguagguucggucugaaagguguggccuuuauauuuga

SEQ ID NO: 502561 - RNA, 64 nt, hsa
gcgggcacuggacccccgggccccacggaggccgcggucugaacugcuuuccaugcugccaucu

SEQ ID NO: 502562 - RNA, 64 nt, hsa
ucaguaaacaguggagcuggaauucaaacauguacggucugacuucuugagcccauacucaaua

SEQ ID NO: 502563 - RNA, 64 nt, hsa
cuagucaggaugcuccuauuccuucuaaaaauuacggucugacuagugagcaaagucuugaauu

SEQ ID NO: 502564 - RNA, 64 nt, hsa
agaagaagcaacaauggccaacgaagcacugaugcggucugaggagacagcugaccuguuggcu

SEQ ID NO: 502565 - RNA, 64 nt, hsa
guucccguugcgcaguugaggacaccgagguucacggucugaguaacaccucauuacaccgaag

SEQ ID NO: 502566 - RNA, 64 nt, hsa
ucgcccucccacuccgccaccuccguccacaccucggucugaugggcgaggucagccugcugcu

SEQ ID NO: 502567 - RNA, 64 nt, hsa
caaaaaaaaaaaaaaaaagcgagcgagagagagagcgagagagagagcgagagcagaagaaauu

SEQ ID NO: 502568 - RNA, 64 nt, hsa
aaguugaaaagacaaaaaaaaaaaaaaaaagcgagcgagagagagagcgagagagagagcgaga

SEQ ID NO: 502569 - RNA, 59 nt, hsa
augcuguaugaauggaaaucauuuugcaauugagugacacuucauuguaauucacagug

SEQ ID NO: 502570 - RNA, 59 nt, hsa
uuucuccagacaggaaagcuuuagaaaacuugagugaaauggagcaagcuugaaggagu

SEQ ID NO: 502571 - RNA, 59 nt, hsa
aaggccucgggcuuggcaaauggaagaacuugagugagaguucagucugcaguccucug

SEQ ID NO: 502572 - RNA, 59 nt, hsa
auucuuucauugacagcugacauaauucauugagugaaauauuuuaagccaaaaaaaaa

SEQ ID NO: 502573 - RNA, 59 nt, hsa
cagauggagauaaggauuccagauggcacuugagugaagaugagaauagauccuaugug

SEQ ID NO: 502574 - RNA, 59 nt, hsa
cacugacccccguugaccaggcugccuucuugagugaggugcugcggcggaccugccac

SEQ ID NO: 502575 - RNA, 59 nt, hsa
aggcucuccccaucuccccugcuuugguguugagugaugagcugagucagggauaggga

SEQ ID NO: 502576 - RNA, 59 nt, hsa
uuaaugaaucuugcuuucuaauaaauaaauugagugauucugguugcauuccuauuucc

SEQ ID NO: 502577 - RNA, 59 nt, hsa
acuuacucauagugguuguuucucuggucuugagugacuguguccacaguucauuuuuu

SEQ ID NO: 502578 - RNA, 59 nt, hsa
guuuuuaauggcucaacugucugauguaauugagugaagguuugcacugagaaauuagc

SEQ ID NO: 502579 - RNA, 59 nt, hsa
auuuugagcuuaucugucuuauuuaugcuuugagugaaucaucuguugaggucuaaugc

SEQ ID NO: 502580 - RNA, 59 nt, hsa
gcacuggaaacaguuucauggaguuuaaguugagugaacaucggccaugaaaauccauc

SEQ ID NO: 502581 - RNA, 59 nt, hsa
cuuuugagaugacauuauugucuccauaauugagugauagcuuuaaaaaaaagauuagu

SEQ ID NO: 502582 - RNA, 59 nt, hsa
acuaaacguuucgguagaaugcuucauacuugagugaugcuggauaagguauuguauuu

SEQ ID NO: 502583 - RNA, 59 nt, hsa
ugaaaucauuccaguauauuugggaagaauugagugaaugagaaugcucuuccuuauuc

SEQ ID NO: 502584 - RNA, 59 nt, hsa
agccaugguugcaccacugcucuccaggcuugagugacagagcaagacuguaucucaaa

SEQ ID NO: 502585 - RNA, 59 nt, hsa
uuggguauaggguugaggggaaauaaguuuugagugagaaauaaacguuuuagcugaaa

SEQ ID NO: 502586 - RNA, 59 nt, hsa
ugcacaauuuuuaugucuaguauguaugcuugagugaaugugcgaguaugaaugauuag

SEQ ID NO: 502587 - RNA, 59 nt, hsa
cugucuucugggcaauauuucuaaaauauuugagugacauugauguuuaagugaccucc

SEQ ID NO: 502588 - RNA, 59 nt, hsa
acaucucaaguacguaaauuaaguugucauugagugaaagguucacuuggaccuagugc

SEQ ID NO: 502589 - RNA, 59 nt, hsa
auagguuauauuucccaaaucuuuaauuauugagugaaagagcuauagaugaauugaua

SEQ ID NO: 502590 - RNA, 59 nt, hsa
cauuugacugagaccacauggugugccccuugagugaggcuaaucuuuagguuuuuccu

SEQ ID NO: 502591 - RNA, 59 nt, hsa
aucauugugcguugugugcgguuaccugcuugagugauccugaacuuguugcgacagag

SEQ ID NO: 502592 - RNA, 59 nt, hsa
aggcacuugaccuggcuguagccuaggucuugagugaaccccaaaaacuugcuuucucu

SEQ ID NO: 502593 - RNA, 59 nt, hsa
ugccuccugcagaacuuugaaaagcuggguugagugaggcuaucagcacagccuuccuu

SEQ ID NO: 502594 - RNA, 59 nt, hsa
gggcccaggacccagucuuggccauucaguugagugaggcugaaggcuggguuugaaaa

SEQ ID NO: 502595 - RNA, 59 nt, hsa
cauuuccuugcacaaacaguaagaugacuuugagugauggcacugggagaucagggcag

SEQ ID NO: 502596 - RNA, 59 nt, hsa
cuuacaaauucuucaauaaagacacauucuugagugaaaucccaaucauguccuguuuu

SEQ ID NO: 502597 - RNA, 59 nt, hsa
caaagaaguggauaagagggaggagaucauugagugacccagaaagcucuuuugaaaag

SEQ ID NO: 502598 - RNA, 59 nt, hsa
uugugagccacauauugggaguucuagauuugagugaauggcaggaaagggccaucucc

SEQ ID NO: 502599 - RNA, 59 nt, hsa
uuugcaguauucuccccugauuggaaugguugagugaggguaagggaaagaauaucuua

SEQ ID NO: 502600 - RNA, 59 nt, hsa
gaacuauaguuuuuacuaguaucaccaaauugagugauacaaauuucaucuauuuuauu

SEQ ID NO: 502601 - RNA, 59 nt, hsa
guggaagaaaccaugggcaggaguaggaauugagugauaaacaauugggcuaaugaaga

SEQ ID NO: 502602 - RNA, 59 nt, hsa
guauguuuggcucauuacugguuuaccccuugagugaaugccuguuuaugaugacugag

SEQ ID NO: 502603 - RNA, 59 nt, hsa
auaucugugcagaacacgguguuuuaagcuugagugaaaggagggugaggcugccgaug

SEQ ID NO: 502604 - RNA, 59 nt, hsa
cauuugccuucgguccucaaugcaugucuuugagugacuucuuaucugaaauuuugcua

SEQ ID NO: 502605 - RNA, 59 nt, hsa
cagccagaccugcguugugugucuguguguugagugagcuggucagcuaacaagucuuc

SEQ ID NO: 502606 - RNA, 59 nt, hsa
uguauauauuuauauauaaauauaucuauuugagugaaaccuugugaacucuuuaauua

SEQ ID NO: 502607 - RNA, 59 nt, hsa
uauucauucuuuaugcaaugaggguauuuuugagugaauuuuaacugcucugaacuaag

SEQ ID NO: 502608 - RNA, 59 nt, hsa
aacaguuugguuuuuaauggcugugguauuugagugaggcaacucuggggcauuuguua

SEQ ID NO: 502609 - RNA, 59 nt, hsa
uugucacuuagaauaauauguacuacuacuugagugagcgcuuuuggaaguuauaucaa

SEQ ID NO: 502610 - RNA, 59 nt, hsa
uggaccaggaaggcauauguauuuugaacuugagugaaaagguugaaguuacagacuuu

SEQ ID NO: 502611 - RNA, 59 nt, hsa
augaaggaaauuuuuuucugaauguagguuugagugaggggcaccucugcuuucccuua

SEQ ID NO: 502612 - RNA, 59 nt, hsa
ccaaggagacccugccacaugcuggcccuuugagugagaaugcugcaucuuucuacaua

SEQ ID NO: 502613 - RNA, 59 nt, hsa
uaugccaguaauauaguguuguaugccuauugagugauuguggcaagaaaagcuacagc

SEQ ID NO: 502614 - RNA, 59 nt, hsa
aaaaaauaaauuaggcccaauccaagaaauugagugagaaggaaacacuuguuuuauuc

SEQ ID NO: 502615 - RNA, 59 nt, hsa
caguccaauugccagagaagacuguccuuuugagugacucaaccugcaaaccuuuaaga

SEQ ID NO: 502616 - RNA, 59 nt, hsa
auguauagaagagaucugauccaguguuguugagugaaaaucugacagaucauucuaga

SEQ ID NO: 502617 - RNA, 59 nt, hsa
auuccucugaaagcaaaacaaauucauaauugagugauauuaaauagagagguuuucgg

SEQ ID NO: 502618 - RNA, 59 nt, hsa
aacauuguucgguucacacguuccaaacuuugagugauuucuggaguuagacauagauu

SEQ ID NO: 502619 - RNA, 59 nt, hsa
acgaggaguugggagccugccugguggaguugagugaugcccgucaugugcacuugggu

SEQ ID NO: 502620 - RNA, 59 nt, hsa
cuggauauucauauaaacuuuuuaaagaguugagugauagagcuaacccuuaucuguaa

SEQ ID NO: 502621 - RNA, 59 nt, hsa
auagauauaaagcuuuacuuagauauaacuugagugaguagggaaaaaaaucuacagua

SEQ ID NO: 502622 - RNA, 59 nt, hsa
auuacuacuagguaauaauaaugggagacuugagugauaauaggggauuuuaaaacucu

SEQ ID NO: 502623 - RNA, 59 nt, hsa
uauuccuugauuuaaauuggcuuuugugauugagugaaacuuuauaaagcauaugguca

SEQ ID NO: 502624 - RNA, 59 nt, hsa
agggcgguauggaaggcaggcuguacugguugagugaauggaaaguuggggaguagaac

SEQ ID NO: 502625 - RNA, 59 nt, hsa
ggaguaggugugaguugauaauguugaaguugagugaucaguacguggguuuauuacac

SEQ ID NO: 502626 - RNA, 59 nt, hsa
gaauuuauugcugaaucaugcuccaguauuugagugauguuuuaaauauccuaugucug

SEQ ID NO: 502627 - RNA, 59 nt, hsa
uuaaccucagugcucaacuauuugaacuguugagugauaaaggaaacaaauauaacugu

SEQ ID NO: 502628 - RNA, 59 nt, hsa
gugggauaggucccaugucaaaggaacuuuugagugaugacucugagaaguugaauugc

SEQ ID NO: 502629 - RNA, 59 nt, hsa
uuuuuagcuauuuuuuccaugugugaaccuugagugauacuaaucauguaaaguaagag

SEQ ID NO: 502630 - RNA, 59 nt, hsa
gagacugauguauaauggacagguguuccuugagugacagacuuacaaagggaguguuu

SEQ ID NO: 502631 - RNA, 59 nt, hsa
uaauaaaauuaguuugcaucauguagucauugagugagggggagauauaagccaaggau

SEQ ID NO: 502632 - RNA, 59 nt, hsa
uccccugcagcagucgaggacugagcagauugagugaugcuggggcagagaggccuggg

SEQ ID NO: 502633 - RNA, 59 nt, hsa
agaggcaauauuuucuacuugcaaucaauuugagugacucaggugaaauuuagagucau

SEQ ID NO: 502634 - RNA, 59 nt, hsa
cucugaaguuuucuacaacaaaaaaagaguugagugaaucuguuuacauuuagaauaau

SEQ ID NO: 502635 - RNA, 59 nt, hsa
caggcgcacguugguuucuuggucguccuuugagugacaacuucuccgugaaccugcug

SEQ ID NO: 502636 - RNA, 59 nt, hsa
cugcugaagguuguaaguggucgcuuacuuugagugauccuccaacuucauuugaugcu

SEQ ID NO: 502637 - RNA, 59 nt, hsa
cucaagacuggaaaacaauagcauuugucuugagugaggaagugaagcccgcuguguuc

SEQ ID NO: 502638 - RNA, 59 nt, hsa
gcacacaacacacacugaguaaauauuuguugagugaaauaaaaucaagaaacaaguaa

SEQ ID NO: 502639 - RNA, 59 nt, hsa
gagaaaaagagguugauugaauugugccuuugagugaacccaguuuuuaaauaccgcug

SEQ ID NO: 502640 - RNA, 59 nt, hsa
auuuuguuaauuacaguguuuuugguucauugagugaagauucugccgggugggaucuu

SEQ ID NO: 502641 - RNA, 59 nt, hsa
uagcccucacuuucaugccauuuccauuguugagugaagcguauuugaaguaacugaga

SEQ ID NO: 502642 - RNA, 59 nt, hsa
ucacucauuucuauucauuccucaggcacuugagugacaguuguuuaccaggcacugug

SEQ ID NO: 502643 - RNA, 59 nt, hsa
uccuuauguaucaucuaauacaaugaugguugagugaaaauacagaagggguguuugag

SEQ ID NO: 502644 - RNA, 59 nt, hsa
guuagcucucaccuguagguuuaaucaccuugagugacugggcagcagcgguggagucu

SEQ ID NO: 502645 - RNA, 59 nt, hsa
aauauguuacuguauuaauuaaucuaauauugagugauuauuuguaaaauuaugaauau

SEQ ID NO: 502646 - RNA, 59 nt, hsa
uucuucagauuauguuuuauuucuuugcauugagugaggaacauaaaauggcuugguaa

SEQ ID NO: 502647 - RNA, 59 nt, hsa
auuuuuguguguaguugauuacucuuccauugagugaaugaugaauaccugugaggaua

SEQ ID NO: 502648 - RNA, 59 nt, hsa
aauagucaaaaauguguuuaccugucugauugagugagccuuuuggugagcucagcuga

SEQ ID NO: 502649 - RNA, 59 nt, hsa
aguguaacugcauuucuaauaaaaauuuauugagugaaacaaucuuuguacaaugacua

SEQ ID NO: 502650 - RNA, 59 nt, hsa
cuuuuuuuuaaugugcauuauuaaaaauauugagugaagcuaauugucaacuuuauuaa

SEQ ID NO: 502651 - RNA, 59 nt, hsa
uuucucuccccuauggauuuugcuaaugguugagugauaccuaaaggccuuguugcauu

SEQ ID NO: 502652 - RNA, 59 nt, hsa
guuuccucuagaacugaauuccucuggaauugagugauggacuucacaacaacuagcca

SEQ ID NO: 502653 - RNA, 59 nt, hsa
uuuaagcuguaaaaagagagaaaacuuauuugagugauuauuuguuauuuguacaguuc

SEQ ID NO: 502654 - RNA, 59 nt, hsa
gacgcugcauuccagaaacgucuuaacacuugagugaaucuucaaaggacccugacauu

SEQ ID NO: 502655 - RNA, 58 nt, hsa
uggaccuaggggaugugugaccuguuuguugagugauugugaaagaggaaugugggag

SEQ ID NO: 502656 - RNA, 59 nt, hsa
aacaggugcuagagaccacuguuguuguuuugagugaauggugguuaggagaaagacuu

SEQ ID NO: 502657 - RNA, 59 nt, hsa
agccugucaugauauguuuuagauaaaguuugagugaguucauugggauaaauggucca

SEQ ID NO: 502658 - RNA, 59 nt, hsa
acauuaucaauauaccaauguuuuaaaaauugagugaggguuauuauuuguauuugaug

SEQ ID NO: 502659 - RNA, 59 nt, hsa
uauaagacaguauguauaguaauaguagcuugagugaauaugcaaaaguuuaauuuuua

SEQ ID NO: 502660 - RNA, 59 nt, hsa
uguuaaagcauuagccugugucaaguucuuugagugauacuagugaaaccaaauagaaa

SEQ ID NO: 502661 - RNA, 59 nt, hsa
acaaauaaagaauucaauucuuuacaugauugagugagaguauguauaaccuggugggu

SEQ ID NO: 502662 - RNA, 59 nt, hsa
ggacuugauacccucugagaugaguggcuuugagugacaugcuaacagcaauuucauag

SEQ ID NO: 502663 - RNA, 59 nt, hsa
agaacuggaaggagacaucugucccgucuuugagugacaagcccgggacaacagccagu

SEQ ID NO: 502664 - RNA, 59 nt, hsa
ugugcaucuggagguguugcggcagagguuugagugaacccucuuucaaagacaauaaa

SEQ ID NO: 502665 - RNA, 59 nt, hsa
auuuuauaaaugaggaaacggaggcuuaguugagugagcugaccaauaucacccagcca

SEQ ID NO: 502666 - RNA, 59 nt, hsa
aguuaucaugauggugcugauugcccaccuugagugagggguggauaaacuaccccugc

SEQ ID NO: 502667 - RNA, 59 nt, hsa
uugcugcgggaguuuggcuggccaggaacuugagugacauugaccucauggcaccucag

SEQ ID NO: 502668 - RNA, 59 nt, hsa
aaggcccuucuaacuuccagauuguaugcuugagugauggguccccagcccaagcccac

SEQ ID NO: 502669 - RNA, 59 nt, hsa
gaggaagaguuucuauuaaaaucugucacuugagugaugucauucaaguccuauuuuag

SEQ ID NO: 502670 - RNA, 59 nt, hsa
gcaaaaccaaauaaaguggagaugagugauugagugagguagauugcugucccguuaac

SEQ ID NO: 502671 - RNA, 59 nt, hsa
aaauugcuggacuauuuguggcuccugaguugagugauuuuggugaaagaaagcacauc

SEQ ID NO: 502672 - RNA, 59 nt, hsa
cggcucacugcaaccucugccucccggguuugagugauucuccugcgucagccucccga

SEQ ID NO: 502673 - RNA, 59 nt, hsa
aaaaccagugucaggccuuugcaguaggcuugagugaacuucugaucuagauuugaaag

SEQ ID NO: 502674 - RNA, 59 nt, hsa
gguguggacggaaaggguggccaaauggauugagugaugagcagacauguuuaaggguc

SEQ ID NO: 502675 - RNA, 59 nt, hsa
ucaacuauuuaaucaucaugauucauauuuugagugaauacaucaggcacagaccuuca

SEQ ID NO: 502676 - RNA, 59 nt, hsa
uacaaaaaagaaugauguuuaaaauugcuuugagugauucauacagagauguauauaug

SEQ ID NO: 502677 - RNA, 59 nt, hsa
aagaggcuguuuguguuuaacuuauaauauugagugauccaugaaguagguuuucagag

SEQ ID NO: 502678 - RNA, 59 nt, hsa
agagaggcucuugugguuaacugauaauauugagugaugcaugagguagguguucagag

SEQ ID NO: 502679 - RNA, 59 nt, hsa
ccgacuucccccuugcuguucucgugauauugagugagcgcuugugggaucugguuguu

SEQ ID NO: 502680 - RNA, 59 nt, hsa
aguauacuagggcaugauaugguauccuuuugagugagguauauacucaucucacaagu

SEQ ID NO: 502681 - RNA, 59 nt, hsa
uggagagaauccccuccagauaagagauuuugagugaaaaacauaaugauccugccauu

SEQ ID NO: 502682 - RNA, 59 nt, hsa
acuuugauagaacuaaggaaauagugguuuugagugaagggaaaggaaacccagaaaca

SEQ ID NO: 502683 - RNA, 59 nt, hsa
uagaugggucuggcugagcugaacccauuuugagugacucgaggguuggguucaucuga

SEQ ID NO: 502684 - RNA, 59 nt, hsa
aaggugcugacaaagaugaccugcugcuguugagugagaucuucaaugcuuccuccuug

SEQ ID NO: 502685 - RNA, 59 nt, hsa
cuccuguauauuggauuuugugauuauauuugagugaauaggagaaaacaauauauaac

SEQ ID NO: 502686 - RNA, 59 nt, hsa
caguucuuccaucgguguaguuguugcauuugagugaauacucucuugauuuauguauu

SEQ ID NO: 502687 - RNA, 59 nt, hsa
aguaaacacuuauugucaggugccuagucuugagugaauuguuagaugugcacugaacu

SEQ ID NO: 502688 - RNA, 59 nt, hsa
uugggggaaaacaggaaaucuuguuaggcuugagugagguguuugcuuccuucuugccc

SEQ ID NO: 502689 - RNA, 59 nt, hsa
aauuguaaaaauuuuuguugauccagcauuugagugacacuguugaauguuucuaaaaa

SEQ ID NO: 502690 - RNA, 59 nt, hsa
aaguugggaaacagaaugggccagggagguugagugacugaagaccaaggguuggugca

SEQ ID NO: 502691 - RNA, 59 nt, hsa
ucuuagucccucugcccucuguaaauguguugagugauauagcuaucagauguauugaa

SEQ ID NO: 502692 - RNA, 59 nt, hsa
cucauagugugguuuuuaaauauaugcaguugagugaugauuggauacuauucaucaua

SEQ ID NO: 502693 - RNA, 59 nt, hsa
uuuuaaagaaggauacauuuuuaauauauuugagugauugcugggaagugugaaaauau

SEQ ID NO: 502694 - RNA, 59 nt, hsa
agaagcacgaggcccuugagaacuguguguugagugaacuaauaacuguauuauagaaa

SEQ ID NO: 502695 - RNA, 59 nt, hsa
uuacauaccuucucuguuguaucaguacuuugagugagaagacaguuuauuuaaaacuu

SEQ ID NO: 502696 - RNA, 59 nt, hsa
acaaucagguauuauguuuuuaaaccaaguugagugaauugguaguggacuugggaaau

SEQ ID NO: 502697 - RNA, 59 nt, hsa
cacuaauauuuugcauguaauuugcucauuugagugagggcacuuuuuuuguacauaug

SEQ ID NO: 502698 - RNA, 59 nt, hsa
cugcgccaauugugagggcgcuuuagcauuugagugauucaauaguuacgaugaccagu

SEQ ID NO: 502699 - RNA, 59 nt, hsa
gcugccuauugccauugcugucucaaaaguugagugaauuuugaggcgucuuuuuuuuu

SEQ ID NO: 502700 - RNA, 59 nt, hsa
cagcucacugcagccucgaccucccuggcuugagugauccucccgccccagccuccuga

SEQ ID NO: 502701 - RNA, 59 nt, hsa
ggagaacggcugugauaaguagguuuugauugagugaaagcaugagcuuguucagagug

SEQ ID NO: 502702 - RNA, 59 nt, hsa
uuuaaucacaaaucauuuuuuaugaaugauugagugaaaauaguguuuauaaagguuaa

SEQ ID NO: 502703 - RNA, 59 nt, hsa
gucugaguuaauauucaagugaucagacuuugagugacaucaagaaaagaugauaucag

SEQ ID NO: 502704 - RNA, 59 nt, hsa
caaaaucacagauauucaugaguuucuacuugagugagaaaacugggugaaggaauaga

SEQ ID NO: 502705 - RNA, 59 nt, hsa
cggcuuccaggucccaacccaggguuggguugagugagucccacaaagggcaagugggg

SEQ ID NO: 502706 - RNA, 59 nt, hsa
cucaacucacugcaaccuccgcucccgguuugagugauucucaugccucagccucccga

SEQ ID NO: 502707 - RNA, 59 nt, hsa
cucuuuaauguuuagcaugcuugucaaccuugagugagugucauuuuuaagaacaguug

SEQ ID NO: 502708 - RNA, 59 nt, hsa
uuccuagccuucaaauuauuaaacacuccuugagugaaauaauuuugcauugcaaagug

SEQ ID NO: 502709 - RNA, 59 nt, hsa
auaagcacacacauuuucaauucucauguuugagugauuuuaaaauguuuuggugaaug

SEQ ID NO: 502710 - RNA, 59 nt, hsa
auccccuccuagcacaaggagugcccgccuugagugacaugcggcugcccacgcuccug

SEQ ID NO: 502711 - RNA, 59 nt, hsa
aauuuucuaaaaacacacacagaaaucgcuugagugaggaaaaguccacauggcagaga

SEQ ID NO: 502712 - RNA, 59 nt, hsa
caucuauacuucaucuuacaucgucaugauugagugaucuuuacauuugauuccagagg

SEQ ID NO: 502713 - RNA, 59 nt, hsa
uuccaggguucuuccugagagaggcagauuugagugaggugcauaggauugccaaaacu

SEQ ID NO: 502714 - RNA, 59 nt, hsa
gcaauuuauuugaaacuucuaauggauuuuugagugauaaaacauuuacuaccuugucc

SEQ ID NO: 502715 - RNA, 59 nt, hsa
ucagcuccacccauggccaacagcccuuguugagugacgggagucggaaugugcuaccc

SEQ ID NO: 502716 - RNA, 59 nt, hsa
ggaaauauugcuuaauuuuucuucaaucauugagugaaaaaccuuuaacuuuggccugc

SEQ ID NO: 502717 - RNA, 59 nt, hsa
uaugaggaagaagugauuccuuccugguuuugagugacaccacagcugucagccuucaa

SEQ ID NO: 502718 - RNA, 59 nt, hsa
cuuuuaaagucuuaaacuuuucaauaaaauugagugagacuuauaggcccaaagaauug

SEQ ID NO: 502719 - RNA, 59 nt, hsa
agauaacaucugucaucuuccuugguuuauugagugaaaugccucucagucuuagggga

SEQ ID NO: 502720 - RNA, 59 nt, hsa
cucucuuuaugcgcaggaacaaacagcuguugagugagcugcuaugacuuugguagaga

SEQ ID NO: 502721 - RNA, 59 nt, hsa
gaggucaccccgacuuuucuaaaucuuguuugagugaagucauuuuuucauguguucau

SEQ ID NO: 502722 - RNA, 59 nt, hsa
acuuauuuauggaagauuacugcucuaauuugagugaaauaaaaguuauuagugcgagg

SEQ ID NO: 502723 - RNA, 59 nt, hsa
ucaucuuucaaaagagaaaaauuggacacuugagugacuuuguuuuuaguuuuguuuuu

SEQ ID NO: 502724 - RNA, 59 nt, hsa
uucuguacuucucaguuaagacuuguucuuugagugauguauuaaaugcugcuagaaaa

SEQ ID NO: 502725 - RNA, 59 nt, hsa
uuugugcaccaggcccggcugcguagcaguugagugaugcugguuagcuauuaaggugg

SEQ ID NO: 502726 - RNA, 59 nt, hsa
aggaugauggaauuagaugcagucugucuuugagugagacuggucaccaucagaggagu

SEQ ID NO: 502727 - RNA, 59 nt, hsa
aguagucaguacacuuuucuagauaaaucuugagugaaaaccagcaauuucuuuuuccu

SEQ ID NO: 502728 - RNA, 59 nt, hsa
ggugcuccauauauauucauauauauuuguugagugaauuaaugaauuaagaguggcug

SEQ ID NO: 502729 - RNA, 59 nt, hsa
cuuuucuauauuuauaagaagagaagaucuugagugaagcagcacgcgacccaggugug

SEQ ID NO: 502730 - RNA, 59 nt, hsa
ucaaauuaaccagguugugagccaguggcuugagugaauguuaggccuugggggcugag

SEQ ID NO: 502731 - RNA, 59 nt, hsa
ggaggaauccguuuuugcuccaccucuuuuugagugaacagaggacaaaccuuggguca

SEQ ID NO: 502732 - RNA, 59 nt, hsa
cagaugaggaaauccguaggcaggagcgguugagugauuuuccuaaggucacccagcug

SEQ ID NO: 502733 - RNA, 59 nt, hsa
uguauuaccaagcuuaagaaauaaaacaguugagugaucucucauuuaugacuaaauua

SEQ ID NO: 502734 - RNA, 59 nt, hsa
gggaccaguccaccaccaucuccuccacguugagugaagcucaucccaagcaaggagcc

SEQ ID NO: 502735 - RNA, 59 nt, hsa
ccuguuaguuuuguaaaaacugaagaauuuugagugaauuagaccuuuauuuuucuauc

SEQ ID NO: 502736 - RNA, 59 nt, hsa
uucucugucgcugcuaaauuauucuucacuugagugaagcaaauauuuagcuuccaaau

SEQ ID NO: 502737 - RNA, 59 nt, hsa
auaguuuaccucauagaguuuggggagaauugagugaauuaaugugugugaggacacua

SEQ ID NO: 502738 - RNA, 59 nt, hsa
agaaugcugacacuuuuucagggcugugauugagugagggcauggguaaaaauauuucu

SEQ ID NO: 502739 - RNA, 59 nt, hsa
ggaguugcacagaaucauggaauuuuguguugagugacauaauagguauggaaauauga

SEQ ID NO: 502740 - RNA, 59 nt, hsa
cauauucuuuuuaaacuauaaauaccauuuugagugagaaaguacuuuuaaacaagaaa

SEQ ID NO: 502741 - RNA, 59 nt, hsa
aaugccagucagugaugaucgcaucacaguugagugaaauggccuuccuguucagcugu

SEQ ID NO: 502742 - RNA, 59 nt, hsa
uuuuucaaacuguccaugggaaggcugaauugagugacuccccagaaugaagaugagaa

SEQ ID NO: 502743 - RNA, 59 nt, hsa
ugguguggaagagcuccuugauauccucuuugagugaagcugggagaaccaaaaagagg

SEQ ID NO: 502744 - RNA, 59 nt, hsa
uuuauucucugccuaaaaaguggaagaaauugagugaaugacaauuuuguaauuuagga

SEQ ID NO: 502745 - RNA, 59 nt, hsa
aagaauauagcagacguauauuguaucauuugagugaauguucccaaguaggcauucua

SEQ ID NO: 502746 - RNA, 59 nt, hsa
guugauaccaagugcauaagauucaaacuuugagugacauuuaguccauuuaugguuga

SEQ ID NO: 502747 - RNA, 59 nt, hsa
ggaugggagggaagguuaaaguugccagcuugagugaugugcuugggugacuugggggu

SEQ ID NO: 502748 - RNA, 59 nt, hsa
guaggcccaugggucccuuacuagagagguugagugaauuugccuucaguuaacauggg

SEQ ID NO: 502749 - RNA, 59 nt, hsa
uacuuuguugaauuuuuuuuuuuggcauuuugagugaaauauaacuaucauuaauucuc

SEQ ID NO: 502750 - RNA, 59 nt, hsa
cgaggccugagccgcaaugccugcccguguugagugagacuucuccauccuggauccug

SEQ ID NO: 502751 - RNA, 59 nt, hsa
cuuaagcaacuggauggauaaugaugccauugagugagugaaaaacuugauggaagugg

SEQ ID NO: 502752 - RNA, 59 nt, hsa
ugugaagugacuuauuaaauccacagacauugagugacuucuuacaacauccacauaag

SEQ ID NO: 502753 - RNA, 59 nt, hsa
ccccauuuuuauauacugaauguggccuuuugagugaaauaggaagcuucaugguguug

SEQ ID NO: 502754 - RNA, 59 nt, hsa
gagcccucugaugugaggagggacuugaguugagugacgcuguggugugagguguucug

SEQ ID NO: 502755 - RNA, 59 nt, hsa
uuaccauucaccucccaaagccaaggaacuugagugagcuuccuuggcaagccucccau

SEQ ID NO: 502756 - RNA, 59 nt, hsa
uuuuaucaauaaauauuuuuauacuuacauugagugauguguuuaacaacaaauuguga

SEQ ID NO: 502757 - RNA, 59 nt, hsa
aucugcauccaaggccuucucaggcuggcuugagugaauuguguaccugaaguacagua

SEQ ID NO: 502758 - RNA, 59 nt, hsa
auggggaucccagcacaucacuguagaauuugagugaucuaugcugaauaaacagugga

SEQ ID NO: 502759 - RNA, 59 nt, hsa
aauguguuuugggguggguaacuaaauuuuugagugaaauaucauaagaugagaaugga

SEQ ID NO: 502760 - RNA, 59 nt, hsa
ucuguaaauccaguugcauuuuauaauacuugagugacuaacugaauugaaaccuauua

SEQ ID NO: 502761 - RNA, 59 nt, hsa
ugcucucugguccaugaacucauuuccauuugagugaguucccuuagugaauuuugucu

SEQ ID NO: 502762 - RNA, 59 nt, hsa
cucaucagcagagagcaacagauguuuuauugagugaagccuuaaaaagcacacaccac

SEQ ID NO: 502763 - RNA, 59 nt, hsa
guguugugacuuauucguccugagcacaguugagugauuuauccucaccagacauuccu

SEQ ID NO: 502764 - RNA, 59 nt, hsa
aaccuguguugcgcaaaugccgcauaaauuugagugauuguuaauguugucuuaaaauu

SEQ ID NO: 502765 - RNA, 59 nt, hsa
uuccucuagcuuuucuauuuuugauuguguugagugaaguuuggagauuuuucauacuu

SEQ ID NO: 502766 - RNA, 59 nt, hsa
aguuuuuucaaaaauggaguaucacaaaauugagugaaacacaauacuuaauguauugu

SEQ ID NO: 502767 - RNA, 59 nt, hsa
aucauugaaauucauuuggggucaaagacuugagugacccaguauugagccaugaauaa

SEQ ID NO: 502768 - RNA, 59 nt, hsa
ggauuucaccucacccuuuguaccagauguugagugaccagcucuguggcccugugucg

SEQ ID NO: 502769 - RNA, 59 nt, hsa
cuaaaauccuuaaaaauacucuaauagccuugagugaccaacuuuuuuuuuaaagcaca

SEQ ID NO: 502770 - RNA, 59 nt, hsa
gaauuuugguaccuacaacaugcuugauuuugagugauuaaaaaaaaauaauuuggcug

SEQ ID NO: 502771 - RNA, 59 nt, hsa
caccggcccccuccccccagacucuuuuuuugagugacagcuuucugggaugucacagu

SEQ ID NO: 502772 - RNA, 59 nt, hsa
auuugacauuguccaaaccuuuuucauuuuugagugauuaaaaaugaaauguccuuugu

SEQ ID NO: 502773 - RNA, 59 nt, hsa
cuuuaaagagaacuagaagaauuuuuuguuugagugauuccaggcuguaguaugaucau

SEQ ID NO: 502774 - RNA, 59 nt, hsa
gcgggcuauugugcugccuuuaauaaaauuugagugauguauacauaacauuguuuuug

SEQ ID NO: 502775 - RNA, 59 nt, hsa
uggugaugacacguuucuuaaguaggaguuugagugaauuauuugauauauuacuuugu

SEQ ID NO: 502776 - RNA, 59 nt, hsa
uucaaaugaauauuauuugggggauuagauugagugaaauuaaccugcuauuaaauagu

SEQ ID NO: 502777 - RNA, 59 nt, hsa
uuacauuucccaagagagucaggugacacuugagugaguuugauggauaaugagcuaau

SEQ ID NO: 502778 - RNA, 59 nt, hsa
gugaggacaagaaugcaaauggcucuuccuugagugaaagaaauggggagucuagagcc

SEQ ID NO: 502779 - RNA, 59 nt, hsa
ggcugucuggagguguuuggaaaggcuucuugagugagguggccuuugaacugaacuua

SEQ ID NO: 502780 - RNA, 59 nt, hsa
caaggaguagggcacagggacaucuuucuuugagugaccgucugugcaggcccuguagu

SEQ ID NO: 502781 - RNA, 59 nt, hsa
uucugggaguccauccagcuggaguggcuuugagugaguuacacagcuagaaggugcca

SEQ ID NO: 502782 - RNA, 59 nt, hsa
ucuuuucuguauucgcuguucaauaaacauugagugagcaccuccccagauggagcaug

SEQ ID NO: 502783 - RNA, 59 nt, hsa
aaauuuucuuaaaauauccacaauauuccuugagugagucagaaucuauagccgguuag

SEQ ID NO: 502784 - RNA, 59 nt, hsa
cagacagacaccucccucuggagaugcaguugagugacaaccuuguuacauuguagccu

SEQ ID NO: 502785 - RNA, 59 nt, hsa
uuuccucaaccgagagugaauuuauguaauugagugaaagucuacgaaucauaauugua

SEQ ID NO: 502786 - RNA, 59 nt, hsa
gggcccccuguucuuucuuucccauuaacuugagugaccugugugagagacagacagau

SEQ ID NO: 502787 - RNA, 59 nt, hsa
uguggcaggaggcaaagaguaggguguaauugagugaaggaauccuggguagagaccau

SEQ ID NO: 502788 - RNA, 59 nt, hsa
auucuggacuccugagaggcaguggccucuugagugaacaggggaggccaguagaugcc

SEQ ID NO: 502789 - RNA, 59 nt, hsa
auaucauugaugugcugucacacuauauauugagugacuuucugaacaaauuuauccag

SEQ ID NO: 502790 - RNA, 59 nt, hsa
cuuuugcacugaagauagagaccaccuuuuugagugacuugagcccaaaggcaagcgua

SEQ ID NO: 502791 - RNA, 59 nt, hsa
caagacccggacagagcuucagaggaguguugagugacaccugaggaugcggcugcaca

SEQ ID NO: 502792 - RNA, 59 nt, hsa
aguccugggguccgagaugcuagggacgcuugagugagggagguggugugagggccagg

SEQ ID NO: 502793 - RNA, 59 nt, hsa
gucuguauuuuauauuugauuauuugggcuugagugaaagguagauuuauuuccauuug

SEQ ID NO: 502794 - RNA, 59 nt, hsa
uguuggaaccuuacccagccaugaacauguugagugagcaugcuggagaaugagagacc

SEQ ID NO: 502795 - RNA, 59 nt, hsa
gacuauuagggcuuggucuuaaaacccaauugagugauuugcaaacccagauauuguac

SEQ ID NO: 502796 - RNA, 59 nt, hsa
ugcccacguccgcccaggacccagccguguugagugaagcucuuggggccagcgugcgu

SEQ ID NO: 502797 - RNA, 59 nt, hsa
guaaguucuagccccacccucccgccuucuugagugauaccuauuacggaugaguucug

SEQ ID NO: 502798 - RNA, 59 nt, hsa
ccucugcuuucucccugccuugauugagcuugagugauguggaauaaauuguccgucuc

SEQ ID NO: 502799 - RNA, 59 nt, hsa
guacuaugucugaacauagaaacucgggcuugagugagaagagcuugcacagccaacga

SEQ ID NO: 502800 - RNA, 59 nt, hsa
uuaucuguauuuagcagaguauuuucaacuugagugaucugagcugaauuugaagacua

SEQ ID NO: 502801 - RNA, 59 nt, hsa
cauguccuuagcacaggggggccgccgguuugagugaggguuucugagcugcucugaau

SEQ ID NO: 502802 - RNA, 59 nt, hsa
agaucuucuuagcccagagagcaguggaguugagugaggaggcagauguccugucugug

SEQ ID NO: 502803 - RNA, 59 nt, hsa
acuccaagaugaagauguggucccugcccuugagugacagcccagggacuuaauguggc

SEQ ID NO: 502804 - RNA, 59 nt, hsa
cuguguaagaaaaagccaagagacugcuuuugagugacauuuauuuagcagcuaguaac

SEQ ID NO: 502805 - RNA, 59 nt, hsa
uuuggcucuaccccuagaaauguccaguuuugagugacuguaguauggauggguuuucu

SEQ ID NO: 502806 - RNA, 59 nt, hsa
cccugaggaccagaacugcucauuuuagcuugagugauggcuucagggguuggaaguuc

SEQ ID NO: 502807 - RNA, 59 nt, hsa
ugcggccuuugguuuguggcugaaagcuguugagugacucaucgccaagauuugcugua

SEQ ID NO: 502808 - RNA, 59 nt, hsa
gagaaucgcuugaaccugggaaguggagguugagugagccgggaccgugccauuguacu

SEQ ID NO: 502809 - RNA, 59 nt, hsa
agagauaauaaauguuuuaauuuggcaguuugagugauugggaaaaggaaucuuaaacu

SEQ ID NO: 502810 - RNA, 59 nt, hsa
ugggcugcgaggagaagcuguacuuuggcuugagugaguacagcaagucucugcagugg

SEQ ID NO: 502811 - RNA, 59 nt, hsa
ccaccguguugugcucaaagagacacuacuugagugaagauuucuucuuucccuguacc

SEQ ID NO: 502812 - RNA, 59 nt, hsa
auuuacauuuuucugguuuuuuuuuuuuuuugagugagguacgaguauuaccaaaugau

SEQ ID NO: 502813 - RNA, 59 nt, hsa
uuucugcacuaguuuuccuuguaaaugauuugagugaguagguuugguuucugacgaaa

SEQ ID NO: 502814 - RNA, 59 nt, hsa
gauaaucuuuacugcaaguguaaugauauuugagugaauuaaaaugcaugacagacaag

SEQ ID NO: 502815 - RNA, 59 nt, hsa
cuuuuuggggaugagguucacaguagacuuugagugaccgucccaccgugaagugaauu

SEQ ID NO: 502816 - RNA, 59 nt, hsa
acaugucuagcuuucaccuccaggaucuauugagugaacagaauugcaaauagucucua

SEQ ID NO: 502817 - RNA, 59 nt, hsa
cuggcuccaggggcggcuuuuguuggaaguugagugaagcccucccccuguccucagcg

SEQ ID NO: 502818 - RNA, 59 nt, hsa
gagaggcucuuugugguuaacuuauaauauugagugaugcaugagguagguguucagaa

SEQ ID NO: 502819 - RNA, 59 nt, hsa
uggacaagcaguaaugauauuuaaauauuuugagugagggggagugggucaaagaggaa

SEQ ID NO: 502820 - RNA, 59 nt, hsa
uggaaacccucuccucccuccuccacaccuugagugaugaccacaccaaucacuguauu

SEQ ID NO: 502821 - RNA, 59 nt, hsa
uuuuuuuaaauagagggauugacucggauuugagugaucauuagggcugaggucuguuu

SEQ ID NO: 502822 - RNA, 59 nt, hsa
gcccccacccaagccugcgucagcggaacuugagugaggggcguugugcaauuuguggc

SEQ ID NO: 502823 - RNA, 59 nt, hsa
uuggaaggacucauauaugcauacauuccuugagugacuaugaaugacugccgggcagu

SEQ ID NO: 502824 - RNA, 59 nt, hsa
gugcuuuuuuguuuguguguguguguaauuugagugauuguaaauggcauugauguuug

SEQ ID NO: 502825 - RNA, 59 nt, hsa
gaaucaggacugaaugugaaagggaaguauugagugaggacauucccaaaaccaaagga

SEQ ID NO: 502826 - RNA, 59 nt, hsa
uucuugacauccaccaagauaccagacauuugagugaaauuuuggauccaccagaccag

SEQ ID NO: 502827 - RNA, 59 nt, hsa
cccuccccuucugguagucauaggcaggauugagugacgguugggaagggggcucagaa

SEQ ID NO: 502828 - RNA, 59 nt, hsa
cugcuguaaacuauuuguggcugugcugcuugagugacgucucugucgugugggugcca

SEQ ID NO: 502829 - RNA, 59 nt, hsa
caaauaauccagaaauauaccuaauaagauugagugaaaaauuugagucaaauaucuag

SEQ ID NO: 502830 - RNA, 59 nt, hsa
uuuuaaaccccaggaacagagacuccuaguugagugauagcugggaaaguuuuacauug

SEQ ID NO: 502831 - RNA, 59 nt, hsa
cuuucagucaaucucuuccacucuaaggauugagugagcgcgagcuggggacucucuca

SEQ ID NO: 502832 - RNA, 59 nt, hsa
acagaagugaagaguuucagagcaucagauugagugaaaaguugucagauucuguauuu

SEQ ID NO: 502833 - RNA, 59 nt, hsa
cugcugaaucugguacuuucugcacagccuugagugauuggaguccccuaaugacuaau

SEQ ID NO: 502834 - RNA, 59 nt, hsa
gguguuuccaguuugauguugcugggugguugagugagugaauuuucauguggcugggu

SEQ ID NO: 502835 - RNA, 59 nt, hsa
cgguuggccgguguuagaacucgcucucuuugagugacuggcuacaagggccugagagg

SEQ ID NO: 502836 - RNA, 59 nt, hsa
gugaauuugcugauguucuuccaacucaguugagugauuuuaagguuuuccaaaucuuc

SEQ ID NO: 502837 - RNA, 59 nt, hsa
agugaguugggggagggcacaggguggguuugagugaagggagagcacgguccuaaguc

SEQ ID NO: 502838 - RNA, 59 nt, hsa
ugggacgguucguuugaauggaggagguguugagugagcaacacgcagaagcucgccua

SEQ ID NO: 502839 - RNA, 59 nt, hsa
gcugggcuguuuucugucuuauuucucaguugagugagcaaggauacgaaaacagugug

SEQ ID NO: 502840 - RNA, 59 nt, hsa
ggaaagcacuugauuguacccguaaguguuugagugaugacaugugaugauuuucagaa

SEQ ID NO: 502841 - RNA, 59 nt, hsa
cuacucugaaaugcaaaacuucuauucuguugagugaaagaauaaaauguagacaaaau

SEQ ID NO: 502842 - RNA, 59 nt, hsa
ucuaguucugauucugucacucauuggcuuugagugacauauuuuuauuuccugggccu

SEQ ID NO: 502843 - RNA, 59 nt, hsa
gaaaacuuaucuuaaacugacccuucccuuugagugagucuucauuccucucccaugug

SEQ ID NO: 502844 - RNA, 59 nt, hsa
guaaaaauaugaaguguuuuaguuguauguugagugauugguugguauuaucaacacug

SEQ ID NO: 502845 - RNA, 59 nt, hsa
aacuuaaaugaacaagcuuacaucccauuuugagugaagauuuugagguuuuuaauuua

SEQ ID NO: 502846 - RNA, 59 nt, hsa
uucagggacaguagaaaguguuuuguuuuuugagugaaacaacuuauuaauaaaaaucc

SEQ ID NO: 502847 - RNA, 59 nt, hsa
cacuuuaauuuagaagauaggugagcaacuugagugaucccaaaccaaacuaacagugc

SEQ ID NO: 502848 - RNA, 59 nt, hsa
aaagucugucuguacugcagugggaauucuugagugaggucuuaccucuucuuuaaacc

SEQ ID NO: 502849 - RNA, 59 nt, hsa
gugagaacuuaguaaacaagaaaauacucuugagugaaaugcaauguauuucuuuugua

SEQ ID NO: 502850 - RNA, 59 nt, hsa
uuucagggucuuucaugaaguuccaauaguugagugaguuaaaagguuuguuucccaga

SEQ ID NO: 502851 - RNA, 59 nt, hsa
guaaaccauuaaugaaaacuuuuucacaguugagugaaauuaaaaucacuauaucucaa

SEQ ID NO: 502852 - RNA, 59 nt, hsa
ugaaaaaauucucuuaaaccacagcacuauugagugaaacauugaacucauaucuguaa

SEQ ID NO: 502853 - RNA, 59 nt, hsa
aaugacuacauuggcuguugguuauuugcuugagugagcccuugaaaaaugaacugccc

SEQ ID NO: 502854 - RNA, 59 nt, hsa
agggggaaauggguaugagagacugaggcuugagugaacugaaggcaaacagagccaag

SEQ ID NO: 502855 - RNA, 59 nt, hsa
aaucguuaaucuuuaguugcauucucucuuugagugauucauacauucuguuucuuuaa

SEQ ID NO: 502856 - RNA, 59 nt, hsa
cuccaauucugaccuuacaaaagugucccuugagugaggcagugaccacgcauugucac

SEQ ID NO: 502857 - RNA, 59 nt, hsa
gcugacucagucuguucacugguugagcuuugagugaaaagauaacacaggucuauuga

SEQ ID NO: 502858 - RNA, 64 nt, hsa; identical to SEQ ID NO: 179520

SEQ ID NO: 502859 - RNA, 64 nt, hsa; identical to SEQ ID NO: 179521

SEQ ID NO: 502860 - RNA, 64 nt, hsa; identical to SEQ ID NO: 179522

SEQ ID NO: 502861 - RNA, 64 nt, hsa; identical to SEQ ID NO: 179523

SEQ ID NO: 502862 - RNA, 64 nt, hsa; identical to SEQ ID NO: 179524

SEQ ID NO: 502863 - RNA, 64 nt, hsa; identical to SEQ ID NO: 179525

SEQ ID NO: 502864 - RNA, 64 nt, hsa; identical to SEQ ID NO: 179526

SEQ ID NO: 502865 - RNA, 64 nt, hsa; identical to SEQ ID NO: 179527

SEQ ID NO: 502866 - RNA, 64 nt, hsa; identical to SEQ ID NO: 179528

SEQ ID NO: 502867 - RNA, 64 nt, hsa; identical to SEQ ID NO: 179529

SEQ ID NO: 502868 - RNA, 64 nt, hsa; identical to SEQ ID NO: 179530

SEQ ID NO: 502869 - RNA, 64 nt, hsa; identical to SEQ ID NO: 179531

SEQ ID NO: 502870 - RNA, 64 nt, hsa; identical to SEQ ID NO: 179532

SEQ ID NO: 502871 - RNA, 64 nt, hsa; identical to SEQ ID NO: 179533

SEQ ID NO: 502872 - RNA, 64 nt, hsa; identical to SEQ ID NO: 179534

SEQ ID NO: 502873 - RNA, 64 nt, hsa; identical to SEQ ID NO: 179535

SEQ ID NO: 502874 - RNA, 64 nt, hsa; identical to SEQ ID NO: 179536

SEQ ID NO: 502875 - RNA, 64 nt, hsa; identical to SEQ ID NO: 179537

SEQ ID NO: 502876 - RNA, 64 nt, hsa; identical to SEQ ID NO: 179538

SEQ ID NO: 502877 - RNA, 64 nt, hsa; identical to SEQ ID NO: 179539

SEQ ID NO: 502878 - RNA, 64 nt, hsa; identical to SEQ ID NO: 179540

SEQ ID NO: 502879 - RNA, 64 nt, hsa; identical to SEQ ID NO: 179541

SEQ ID NO: 502880 - RNA, 64 nt, hsa; identical to SEQ ID NO: 179542

SEQ ID NO: 502881 - RNA, 64 nt, hsa; identical to SEQ ID NO: 179543

SEQ ID NO: 502882 - RNA, 64 nt, hsa; identical to SEQ ID NO: 179544

SEQ ID NO: 502883 - RNA, 64 nt, hsa; identical to SEQ ID NO: 179545

SEQ ID NO: 502884 - RNA, 64 nt, hsa; identical to SEQ ID NO: 179546

SEQ ID NO: 502885 - RNA, 64 nt, hsa; identical to SEQ ID NO: 179547

SEQ ID NO: 502886 - RNA, 64 nt, hsa; identical to SEQ ID NO: 179548

SEQ ID NO: 502887 - RNA, 64 nt, hsa; identical to SEQ ID NO: 179549

SEQ ID NO: 502888 - RNA, 64 nt, hsa; identical to SEQ ID NO: 179550

SEQ ID NO: 502889 - RNA, 64 nt, hsa; identical to SEQ ID NO: 179551

SEQ ID NO: 502890 - RNA, 64 nt, hsa; identical to SEQ ID NO: 179552

SEQ ID NO: 502891 - RNA, 64 nt, hsa; identical to SEQ ID NO: 179553

SEQ ID NO: 502892 - RNA, 64 nt, hsa; identical to SEQ ID NO: 179554

SEQ ID NO: 502893 - RNA, 64 nt, hsa; identical to SEQ ID NO: 179555

SEQ ID NO: 502894 - RNA, 64 nt, hsa; identical to SEQ ID NO: 179556

SEQ ID NO: 502895 - RNA, 64 nt, hsa; identical to SEQ ID NO: 179557

SEQ ID NO: 502896 - RNA, 64 nt, hsa; identical to SEQ ID NO: 179558

SEQ ID NO: 502897 - RNA, 64 nt, hsa; identical to SEQ ID NO: 179559

SEQ ID NO: 502898 - RNA, 64 nt, hsa; identical to SEQ ID NO: 179560

SEQ ID NO: 502899 - RNA, 64 nt, hsa; identical to SEQ ID NO: 179561

SEQ ID NO: 502900 - RNA, 64 nt, hsa; identical to SEQ ID NO: 179562

SEQ ID NO: 502901 - RNA, 64 nt, hsa; identical to SEQ ID NO: 179563

SEQ ID NO: 502902 - RNA, 64 nt, hsa; identical to SEQ ID NO: 179564

SEQ ID NO: 502903 - RNA, 64 nt, hsa; identical to SEQ ID NO: 179565

SEQ ID NO: 502904 - RNA, 64 nt, hsa; identical to SEQ ID NO: 179566

SEQ ID NO: 502905 - RNA, 64 nt, hsa; identical to SEQ ID NO: 179567

SEQ ID NO: 502906 - RNA, 64 nt, hsa; identical to SEQ ID NO: 179568

SEQ ID NO: 502907 - RNA, 64 nt, hsa; identical to SEQ ID NO: 179569

SEQ ID NO: 502908 - RNA, 64 nt, hsa; identical to SEQ ID NO: 179570

SEQ ID NO: 502909 - RNA, 64 nt, hsa; identical to SEQ ID NO: 179571

SEQ ID NO: 502910 - RNA, 64 nt, hsa; identical to SEQ ID NO: 179572

SEQ ID NO: 502911 - RNA, 64 nt, hsa; identical to SEQ ID NO: 179573

SEQ ID NO: 502912 - RNA, 64 nt, hsa; identical to SEQ ID NO: 179574

SEQ ID NO: 502913 - RNA, 64 nt, hsa; identical to SEQ ID NO: 179575

SEQ ID NO: 502914 - RNA, 64 nt, hsa; identical to SEQ ID NO: 179576

SEQ ID NO: 502915 - RNA, 64 nt, hsa; identical to SEQ ID NO: 179577

SEQ ID NO: 502916 - RNA, 64 nt, hsa; identical to SEQ ID NO: 179578

SEQ ID NO: 502917 - RNA, 64 nt, hsa; identical to SEQ ID NO: 179579

SEQ ID NO: 502918 - RNA, 64 nt, hsa; identical to SEQ ID NO: 179580

SEQ ID NO: 502919 - RNA, 64 nt, hsa
cggacucccgggccacgccccagcccgacaaugucgaguauauuauuauuaauauuauuaugaa

SEQ ID NO: 502920 - RNA, 64 nt, hsa
aaggaaaccacaaauucagcuaauaauagcauuucgaguauauuucguaaacuaaggaaauaca

SEQ ID NO: 502921 - RNA, 64 nt, hsa
acuuuuaguucucacaauggucuuugauccauuucgaguauauuuuuauauaugaugugaugua

SEQ ID NO: 502922 - RNA, 64 nt, hsa
aaaauaagucacuguugacagggucaugaguuuccgaguauaguuuucuuuuuaucuuauuuuu

SEQ ID NO: 502923 - RNA, 64 nt, hsa
uauuaaacuuauuuuguugccaauuauuguuuaccgaguauaauguugcuauuuagcaaugugc

SEQ ID NO: 502924 - RNA, 64 nt, hsa
uuugguugcuaaagaaaaaagcauaaucuuuaaccgaguauaaguacuugcuguguauuuagug

SEQ ID NO: 502925 - RNA, 64 nt, hsa
gacuuuuguuuucugaguugauuagaaugcuguucgaguauaccuacccuaguuucagaagcau

SEQ ID NO: 502926 - RNA, 64 nt, hsa
uuuuguagaaaauguuauaauuuaacagucuuugcgaguauacauguuuuuuaacaaguugaaa

SEQ ID NO: 502927 - RNA, 64 nt, hsa
accucagucuccuguaagaccuccuaccacauggcgaguauacaccaaucaggagaggguagcu

SEQ ID NO: 502928 - RNA, 64 nt, hsa
gcaucacagugagcagugagcacagagggaguuucgaguauaagaaucauugucaugaaguuag

SEQ ID NO: 502929 - RNA, 64 nt, hsa
uucccagggagaaaaccugucagaacuuuccauacgaguauaucagaacacacccuuccaaggu

SEQ ID NO: 502930 - RNA, 64 nt, hsa
cccuugugguuucagaacaagcuuuauuuuauuacgaguauauuaaugacaacuaauuccuguu

SEQ ID NO: 502931 - RNA, 64 nt, hsa
agcucuaacaucucccacaagcuagaggaacuugcgaguauauuaacaaggacacaucugacau

SEQ ID NO: 502932 - RNA, 64 nt, hsa
cccauuguacuuuguggaggcuuaacugccgaugcgaguauacauucgaaugacugacuauugg

SEQ ID NO: 502933 - RNA, 64 nt, hsa
acaacagguuuggaaaaccucugugggggaggggcgaguauaaaguuuuccucuuuuuuaacug

SEQ ID NO: 502934 - RNA, 64 nt, hsa
uuugaauacuugcacauuucaauaauuccuuucccgaguauaaccacucaagggggagcaaauu

SEQ ID NO: 502935 - RNA, 64 nt, hsa
uggagcauuacuggcuacugcaucuuaugauacucgaguauauaucugggauccacauaaugga

SEQ ID NO: 502936 - RNA, 64 nt, hsa
ucaagacaaacgagaaaauccuggcuacccaagucgaguauauacaggaauacaaaucgguaac

SEQ ID NO: 502937 - RNA, 64 nt, hsa
gaugaugcagaaaacuccaauucaggagcccuugcgaguauaucugaagcacuuauuugcuaag

SEQ ID NO: 502938 - RNA, 64 nt, hsa
guguuauuuuuaucgucauaauaaaaauuauauacgaguauaaaugaaauucauuucuaaauuc

SEQ ID NO: 502939 - RNA, 64 nt, hsa
uagagcuaaccguacucucuucucugcguacguucgaguauacguugcccauaucccucccaua

SEQ ID NO: 502940 - RNA, 64 nt, hsa
aauaaugauauaugguauuuccaucgucaguuaccgaguauagccacuggguaucacuacuuug

SEQ ID NO: 502941 - RNA, 64 nt, hsa
auaacaauaguacaucuuccaucuuacuuuuaaucgaguauaaggaaauguuucuuuauggcca

SEQ ID NO: 502942 - RNA, 64 nt, hsa
cuggugccuaauuuauuaaagagaauuagcuuagcgaguauaugcugauauucuucgacacacg

SEQ ID NO: 502943 - RNA, 64 nt, hsa
cagugcuggcaaagcugcaguauugagaugcuaaggagcugaugccaccucuuugucuuccccu

SEQ ID NO: 502944 - RNA, 64 nt, hsa
acuggggccauuggaggcccacuguaggugggagggagcugauuuugggguggggggugggacu

SEQ ID NO: 502945 - RNA, 64 nt, hsa
gaggugguggccguggguuccugaugucggugcaggagcugaaggugaguggagugcugccaag

SEQ ID NO: 502946 - RNA, 64 nt, hsa
ugcucacccccaggauguguacccgguuguaguaggagcugaaauccaugcugagcuguaccag

SEQ ID NO: 502947 - RNA, 64 nt, hsa
ucucagcagcuuugcuuguggcaggggugagaguggagcugaguggggucugggcucugccccu

SEQ ID NO: 502948 - RNA, 64 nt, hsa
cugagccugguucugcaggggaggaaggcugccaggagcugaggggcuagcaccugcauugagg

SEQ ID NO: 502949 - RNA, 64 nt, hsa
auguggacuuguaugcugcccacauacgugagggggagcugaaagggagccccuccucugagca

SEQ ID NO: 502950 - RNA, 64 nt, hsa
gagcccucggagccaaugaacagcuccuccucuuggagcugagaugagccccacguggagcucg

SEQ ID NO: 502951 - RNA, 64 nt, hsa
ugugaaaucccuacuucuuauaaugcagaguuaaggagcugagcccccaugauuuuguagcugu

SEQ ID NO: 502952 - RNA, 64 nt, hsa
uggaauggauagguaacuugggugggcaacuuggggagcugaccauucucuuuugguaaauguu

SEQ ID NO: 502953 - RNA, 64 nt, hsa
gagcacugccaggacccaccacuggaagcaggauggagcugacuacggaacugcacacucagug

SEQ ID NO: 502954 - RNA, 64 nt, hsa
uuuguuuuuuuaaauauuaugcugcuuuaacaguggagcugaauuuucuggaaaaugcuucuug

SEQ ID NO: 502955 - RNA, 64 nt, hsa
ccacgcaguguaaacccaguggcuucucugaccuggagcugaugggccgugaagggggccuauu

SEQ ID NO: 502956 - RNA, 64 nt, hsa
uuguguucguaaucgggcuugagccagaggcuggggagcugagucccagccaaaccucacuggc

SEQ ID NO: 502957 - RNA, 64 nt, hsa
ggcuggggaggggguaccucaugaggaccaggguggagcugagaagaggaggaggugggggcug

SEQ ID NO: 502958 - RNA, 64 nt, hsa
ccccgacccccgcagaggcagaaugaacccauagggagcugaucguaauguuuaucauguuacu

SEQ ID NO: 502959 - RNA, 64 nt, hsa
ucucagcccuggggaucagaaaggugggcuugcuggagcugagcuguuucacugccucucgcag

SEQ ID NO: 502960 - RNA, 64 nt, hsa
ccugaaguccugggcaugcaucugggacccccguggagcugacaaguuuuccuugcuuuccuga

SEQ ID NO: 502961 - RNA, 64 nt, hsa
uguguggacaugcagagaagcagagaagaagaaaggagcugaggaggagaagccaaagaggagg

SEQ ID NO: 502962 - RNA, 64 nt, hsa
aucccaauacacagagucugucacagacagggacggagcugaagaccaucaacgacuuucucuu

SEQ ID NO: 502963 - RNA, 64 nt, hsa
gaacaggaugggcagagaaaggguagugugugagggagcugaguaggccagguaggcgauugga

SEQ ID NO: 502964 - RNA, 64 nt, hsa
gccucaggaguccuuggggagaugaaggggguggggagcugagcaggcugggcaauuugcccuc

SEQ ID NO: 502965 - RNA, 64 nt, hsa
aguucccacccaagcccuccuuuggagcaaagaaggagcugagaacaagccgaaugaggaguuu

SEQ ID NO: 502966 - RNA, 64 nt, hsa
uucaguuucaggagugcaagcagcacucaaaccuggagcugaggaaucuaauucagacagagac

SEQ ID NO: 502967 - RNA, 64 nt, hsa
acgagcagcgggccgagccacgcagcggcuucgaggagcugaacaacgagaacaagagcacacu

SEQ ID NO: 502968 - RNA, 64 nt, hsa
acaagagcacacugcaguuggagcagcaaguaaaggagcugaagaagucgggugagcugaaaga

SEQ ID NO: 502969 - RNA, 64 nt, hsa
ggagcagcaaguaaaggagcugaagaagucggguggagcugaagagccaagaggcuccgagucu

SEQ ID NO: 502970 - RNA, 64 nt, hsa
cugguguucccagccccaccagagccccgugccgggagcugacagcuuucacgcuuaaggcacg

SEQ ID NO: 502971 - RNA, 64 nt, hsa
ccugcccacaucugcugguuuggggcuucaguggggagcugacagcugugagcacaccacuguc

SEQ ID NO: 502972 - RNA, 64 nt, hsa
cuugcaggccuguucccuaaggggccccagccaaggagcugagcgaggcugucuggcuuggggg

SEQ ID NO: 502973 - RNA, 64 nt, hsa
uucuccugcagcuggguggucugcaguuugacaaggagcugaggucgcucauugccuaccuuac

SEQ ID NO: 502974 - RNA, 64 nt, hsa
ggucuuaacucugauuguagcaaaaguucugagaggagcugagcccuguuguggcccauuaaag

SEQ ID NO: 502975 - RNA, 64 nt, hsa
guugaccucggagugcgcuaccucccccaugugaggagcugagaacggaagcugcagaaagaua

SEQ ID NO: 502976 - RNA, 64 nt, hsa
cccagccacuguuagugucgccaccgcccauaaaggagcugagcccagcaggggcacugccugg

SEQ ID NO: 502977 - RNA, 64 nt, hsa
cugccuggggcccuguagccaaaaggcuacagcaggagcugaugacccucaugaugccugguga

SEQ ID NO: 502978 - RNA, 64 nt, hsa
gucuggaaggagaacaggcugaggggagcugagaggagcugaggugcuacccggagccccauuc

SEQ ID NO: 502979 - RNA, 64 nt, hsa
agcucucugggucuggaaggagaacaggcugaggggagcugagaggagcugaggugcuacccgg

SEQ ID NO: 502980 - RNA, 64 nt, hsa; identical to SEQ ID NO: 315746

SEQ ID NO: 502981 - RNA, 64 nt, hsa; identical to SEQ ID NO: 315747

SEQ ID NO: 502982 - RNA, 64 nt, hsa; identical to SEQ ID NO: 315748

SEQ ID NO: 502983 - RNA, 64 nt, hsa; identical to SEQ ID NO: 315749

SEQ ID NO: 502984 - RNA, 64 nt, hsa
cuuucucguuuguggacaaagcagcacguaucaccucauucaucacuuggacacaucgccuuug

SEQ ID NO: 502985 - RNA, 64 nt, hsa
agccccacucuccacuuucugagccucagacaaccucauucagccucuugggcuccuuuucaag

SEQ ID NO: 502986 - RNA, 64 nt, hsa
uuaaaaguuuuugagaaaaaaaggaagaaaccaacucauucagaaggcucggauuccucuucca

SEQ ID NO: 502987 - RNA, 64 nt, hsa
ucacauucaaggucuaggucuccaucaucuagaucucauucacgaaauaaauacagugaucauu

SEQ ID NO: 502988 - RNA, 64 nt, hsa
ggugaagaaaaauccaagucugaacgggaaugcccucauucaaaaaaaagaacuuugaaagaga

SEQ ID NO: 502989 - RNA, 64 nt, hsa
uuuuauccauuugauaauuuuacaguaaguaggucucauucauuuugacaguuaucaaagaugu

SEQ ID NO: 502990 - RNA, 64 nt, hsa
gcuuuuacuguuuccacaguauuucaggucuuugcucauucacucaguaauacugagcacuuac

SEQ ID NO: 502991 - RNA, 64 nt, hsa
uaaaucccagacugacagacuuagaaccugaggucucauucauccuuaugguuuaggccuugcc

SEQ ID NO: 502992 - RNA, 64 nt, hsa
uucagaugaaaagaaaacuuaaagaggaauggcccucauucaguaaguucugugguuccaguaa

SEQ ID NO: 502993 - RNA, 64 nt, hsa
guuacuaaugucccagccuuuuuaaggagacacacucauucauccccuacuaugugcuggcagc

SEQ ID NO: 502994 - RNA, 64 nt, hsa
ccacuggcuuucugaaguguuuuccagugaaugacucauucagccagugcuuguugcauuuaug

SEQ ID NO: 502995 - RNA, 64 nt, hsa
acaagagugaaggucaagggcccuccccaggcaucucauucauuacucagcuuccuuccugacc

SEQ ID NO: 502996 - RNA, 64 nt, hsa
uccucugcucaagguuccccucugcucaucccuccucauucagacauccuccaccauaccagug

SEQ ID NO: 502997 - RNA, 64 nt, hsa
uucugugaucauugguacugaagccagaaaagcucucauucaggaacucugaagagcaaaaagg

SEQ ID NO: 502998 - RNA, 64 nt, hsa
uccagggaucccugucccccgacauugaagagaucucauucaggccagagacacagagaccaca

SEQ ID NO: 502999 - RNA, 64 nt, hsa
ccaucaugggaagucaaguuucagaaacaaaagucucauucauaagaggucuuagaagaaaaua

SEQ ID NO: 503000 - RNA, 64 nt, hsa
ccuucuugcuucucucuccuucuuucccccaagccucauucauucuugggauuggcccuuucuu

SEQ ID NO: 503001 - RNA, 64 nt, hsa
ugauugugugaaauccuuuagccagcguuucaaccucauucaacaccagaaaguucacagugga

SEQ ID NO: 503002 - RNA, 64 nt, hsa
uaacagauggaaauccguuagccacaccuccagucucauucaacacuggacaguuuacaaugug

SEQ ID NO: 503003 - RNA, 64 nt, hsa
auuuccuuucugcuuuagcaaaaauaaccacugucucauucaugggaaaaggccgccaaacaaa

SEQ ID NO: 503004 - RNA, 64 nt, hsa
cccagaagggcaagcucuccuggguauacauuuucucauucaaucuucuccugacauuaggagg

SEQ ID NO: 503005 - RNA, 64 nt, hsa
ucuccuuuugagaaguuagauuguuaaagauagucucauucagcuaccaaccacuccuugaucc

SEQ ID NO: 503006 - RNA, 64 nt, hsa
gcagcaaagccgggugcgaugagcucagccuuuacucauucacauacaccaucacacuuuaauu

SEQ ID NO: 503007 - RNA, 64 nt, hsa; identical to SEQ ID NO: 305640

SEQ ID NO: 503008 - RNA, 64 nt, hsa; identical to SEQ ID NO: 305641

SEQ ID NO: 503009 - RNA, 64 nt, hsa; identical to SEQ ID NO: 125569

SEQ ID NO: 503010 - RNA, 64 nt, hsa; identical to SEQ ID NO: 125570

SEQ ID NO: 503011 - RNA, 64 nt, hsa; identical to SEQ ID NO: 125571

SEQ ID NO: 503012 - RNA, 64 nt, hsa; identical to SEQ ID NO: 125572

SEQ ID NO: 503013 - RNA, 64 nt, hsa; identical to SEQ ID NO: 125573

SEQ ID NO: 503014 - RNA, 64 nt, hsa; identical to SEQ ID NO: 125574

SEQ ID NO: 503015 - RNA, 64 nt, hsa; identical to SEQ ID NO: 125575

SEQ ID NO: 503016 - RNA, 64 nt, hsa; identical to SEQ ID NO: 125576

SEQ ID NO: 503017 - RNA, 64 nt, hsa; identical to SEQ ID NO: 125577

SEQ ID NO: 503018 - RNA, 64 nt, hsa; identical to SEQ ID NO: 125578

SEQ ID NO: 503019 - RNA, 64 nt, hsa; identical to SEQ ID NO: 125579

SEQ ID NO: 503020 - RNA, 64 nt, hsa; identical to SEQ ID NO: 125580

SEQ ID NO: 503021 - RNA, 64 nt, hsa; identical to SEQ ID NO: 125581

SEQ ID NO: 503022 - RNA, 64 nt, hsa; identical to SEQ ID NO: 125582

SEQ ID NO: 503023 - RNA, 64 nt, hsa; identical to SEQ ID NO: 125583

SEQ ID NO: 503024 - RNA, 64 nt, hsa; identical to SEQ ID NO: 125584

SEQ ID NO: 503025 - RNA, 64 nt, hsa; identical to SEQ ID NO: 125585

SEQ ID NO: 503026 - RNA, 64 nt, hsa; identical to SEQ ID NO: 125586

SEQ ID NO: 503027 - RNA, 64 nt, hsa; identical to SEQ ID NO: 125587

SEQ ID NO: 503028 - RNA, 64 nt, hsa; identical to SEQ ID NO: 125588

SEQ ID NO: 503029 - RNA, 64 nt, hsa; identical to SEQ ID NO: 125589

SEQ ID NO: 503030 - RNA, 64 nt, hsa; identical to SEQ ID NO: 125590

SEQ ID NO: 503031 - RNA, 64 nt, hsa; identical to SEQ ID NO: 125591

SEQ ID NO: 503032 - RNA, 64 nt, hsa; identical to SEQ ID NO: 125592

SEQ ID NO: 503033 - RNA, 64 nt, hsa; identical to SEQ ID NO: 125593

SEQ ID NO: 503034 - RNA, 64 nt, hsa; identical to SEQ ID NO: 125594

SEQ ID NO: 503035 - RNA, 64 nt, hsa; identical to SEQ ID NO: 125595

SEQ ID NO: 503036 - RNA, 64 nt, hsa; identical to SEQ ID NO: 125596

SEQ ID NO: 503037 - RNA, 64 nt, hsa; identical to SEQ ID NO: 125597

SEQ ID NO: 503038 - RNA, 64 nt, hsa; identical to SEQ ID NO: 125598

SEQ ID NO: 503039 - RNA, 64 nt, hsa; identical to SEQ ID NO: 125599

SEQ ID NO: 503040 - RNA, 64 nt, hsa; identical to SEQ ID NO: 125600

SEQ ID NO: 503041 - RNA, 64 nt, hsa; identical to SEQ ID NO: 125601

SEQ ID NO: 503042 - RNA, 64 nt, hsa; identical to SEQ ID NO: 125602

SEQ ID NO: 503043 - RNA, 64 nt, hsa; identical to SEQ ID NO: 125603

SEQ ID NO: 503044 - RNA, 64 nt, hsa; identical to SEQ ID NO: 125604

SEQ ID NO: 503045 - RNA, 64 nt, hsa; identical to SEQ ID NO: 125605

SEQ ID NO: 503046 - RNA, 64 nt, hsa; identical to SEQ ID NO: 125606

SEQ ID NO: 503047 - RNA, 64 nt, hsa; identical to SEQ ID NO: 125607

SEQ ID NO: 503048 - RNA, 64 nt, hsa; identical to SEQ ID NO: 125608

SEQ ID NO: 503049 - RNA, 64 nt, hsa; identical to SEQ ID NO: 125609

SEQ ID NO: 503050 - RNA, 64 nt, hsa; identical to SEQ ID NO: 125610

SEQ ID NO: 503051 - RNA, 64 nt, hsa; identical to SEQ ID NO: 125611

SEQ ID NO: 503052 - RNA, 64 nt, hsa; identical to SEQ ID NO: 125612

SEQ ID NO: 503053 - RNA, 64 nt, hsa; identical to SEQ ID NO: 125613

SEQ ID NO: 503054 - RNA, 64 nt, hsa; identical to SEQ ID NO: 125614

SEQ ID NO: 503055 - RNA, 64 nt, hsa; identical to SEQ ID NO: 125615

SEQ ID NO: 503056 - RNA, 64 nt, hsa; identical to SEQ ID NO: 125616

SEQ ID NO: 503057 - RNA, 64 nt, hsa; identical to SEQ ID NO: 125617

SEQ ID NO: 503058 - RNA, 64 nt, hsa; identical to SEQ ID NO: 125618

SEQ ID NO: 503059 - RNA, 64 nt, hsa; identical to SEQ ID NO: 125619

SEQ ID NO: 503060 - RNA, 64 nt, hsa; identical to SEQ ID NO: 125620

SEQ ID NO: 503061 - RNA, 64 nt, hsa; identical to SEQ ID NO: 125621

SEQ ID NO: 503062 - RNA, 64 nt, hsa; identical to SEQ ID NO: 125622

SEQ ID NO: 503063 - RNA, 64 nt, hsa; identical to SEQ ID NO: 125623

SEQ ID NO: 503064 - RNA, 64 nt, hsa; identical to SEQ ID NO: 125624

SEQ ID NO: 503065 - RNA, 64 nt, hsa; identical to SEQ ID NO: 125625

SEQ ID NO: 503066 - RNA, 64 nt, hsa; identical to SEQ ID NO: 125626

SEQ ID NO: 503067 - RNA, 64 nt, hsa; identical to SEQ ID NO: 125627

SEQ ID NO: 503068 - RNA, 64 nt, hsa; identical to SEQ ID NO: 125628

SEQ ID NO: 503069 - RNA, 64 nt, hsa; identical to SEQ ID NO: 125629

SEQ ID NO: 503070 - RNA, 64 nt, hsa; identical to SEQ ID NO: 125630

SEQ ID NO: 503071 - RNA, 64 nt, hsa; identical to SEQ ID NO: 125631

SEQ ID NO: 503072 - RNA, 64 nt, hsa; identical to SEQ ID NO: 125632

SEQ ID NO: 503073 - RNA, 64 nt, hsa; identical to SEQ ID NO: 125633

SEQ ID NO: 503074 - RNA, 64 nt, hsa; identical to SEQ ID NO: 125634

SEQ ID NO: 503075 - RNA, 64 nt, hsa; identical to SEQ ID NO: 125635

SEQ ID NO: 503076 - RNA, 64 nt, hsa; identical to SEQ ID NO: 125636

SEQ ID NO: 503077 - RNA, 64 nt, hsa; identical to SEQ ID NO: 125637

SEQ ID NO: 503078 - RNA, 64 nt, hsa; identical to SEQ ID NO: 125638

SEQ ID NO: 503079 - RNA, 64 nt, hsa; identical to SEQ ID NO: 125639

SEQ ID NO: 503080 - RNA, 64 nt, hsa; identical to SEQ ID NO: 125640

SEQ ID NO: 503081 - RNA, 64 nt, hsa; identical to SEQ ID NO: 125641

SEQ ID NO: 503082 - RNA, 64 nt, hsa; identical to SEQ ID NO: 125642

SEQ ID NO: 503083 - RNA, 64 nt, hsa
ugugcuaggucagucuggcacguaagaugaacaucccuaccaauacagagcucaccaucucuua

SEQ ID NO: 503084 - RNA, 64 nt, hsa
uauguucccugacacauaucuugaauggagaccucccuaccaagugaugaaaguguugaaaaac

SEQ ID NO: 503085 - RNA, 64 nt, hsa
acuccuguucccuuauucuucauucccaguaauucccuaccaaaugguggggacccugagccca

SEQ ID NO: 503086 - RNA, 64 nt, hsa
cccaacacgucacccgaguagaagcugggcaaggcccuaccauccuggccgucuguucacaagc

SEQ ID NO: 503087 - RNA, 64 nt, hsa
acugagcaccuuuuaaaccccucccucuucugcccccuaccacuuuucugcuguugccucucuu

SEQ ID NO: 503088 - RNA, 64 nt, hsa
agcaguauagacaauuaugaguuugcccucuuuccccuaccaaguucaaaauauaucuaagaaa

SEQ ID NO: 503089 - RNA, 64 nt, hsa
ccucccgccaaacaaaaccccaagagagcaaugccccuaccacccaagggugccauggucccgg

SEQ ID NO: 503090 - RNA, 64 nt, hsa
aagagggaaugcggugaggcacucuggaauaugacccuaccagagguuggagaacaaacuuggg

SEQ ID NO: 503091 - RNA, 64 nt, hsa
aaggaugcuagacacucauuuagugcccagggaguccagcgaaugacgucuguggccaagcgag

SEQ ID NO: 503092 - RNA, 64 nt, hsa
guuuucaaagcaguuaucuugggaaacuguuuauuccagcgaugugacuuuuuucagaauauuu

SEQ ID NO: 503093 - RNA, 64 nt, hsa
cgacaaagauucuguuucaaauauagccacagaaauaaaggagggaccaauaucugggacaggu

SEQ ID NO: 503094 - RNA, 64 nt, hsa
caagacagauucugcuuugaauauagcuacagaaauaaaggauggacuacagugugggacaggu

SEQ ID NO: 503095 - RNA, 64 nt, hsa
cgaggaagacucuguuucgaauauagccacagaaauaaaggauggagaaaaaucugggacaggu

SEQ ID NO: 503096 - RNA, 64 nt, hsa
ugagaaagauucuguuucgaacauagccacagaaauaaaggauggagaaaaaucugggacaggu

SEQ ID NO: 503097 - RNA, 64 nt, hsa
guuaauuguauguaccacacaucuccagacguuaauaaaggacucaaagagguuuuuguacuug

SEQ ID NO: 503098 - RNA, 64 nt, hsa
aggguuuugguuuuuuccaaaguggaacauugaaauaaaggaaguguuccuuaguucccgugug

SEQ ID NO: 503099 - RNA, 64 nt, hsa
gagaaauuuuaguaugguuugaggaaaucaagugauaaaggaguaugcugaauaugcaaucauu

SEQ ID NO: 503100 - RNA, 64 nt, hsa
guuggaaaaugaaguuggauuuuuguauucauguauaaaggaaagucucccagugcugucaaag

SEQ ID NO: 503101 - RNA, 64 nt, hsa
agaaaaagaguugagauuuaaccaauagcggagcauaaaggaucaugacaaaaucaaauuauaa

SEQ ID NO: 503102 - RNA, 64 nt, hsa
ggguuucagcauccaccaaugaacugaaaggugaauaaaggacguucaugagaaaucgacuacc

SEQ ID NO: 503103 - RNA, 64 nt, hsa
gcuguucacucacaucccuaccuugcaugguaauauaaaggacuaggaagcagucauacuucca

SEQ ID NO: 503104 - RNA, 64 nt, hsa
cagaccuaguuuaaaaggaauaaucaacaauuuuauaaaggagauggcuuauucaaccauagcc

SEQ ID NO: 503105 - RNA, 64 nt, hsa
cauguuuuuuuaauuauuauuuuaaagcuauuguauaaaggaugguucccauacuuuguuauuu

SEQ ID NO: 503106 - RNA, 54 nt, hsa; identical to SEQ ID NO: 375573

SEQ ID NO: 503107 - RNA, 64 nt, hsa
cuuuaaaaauuauucauaaaacagugggcaauagauaaaggaaauucuggagaaaaugaaggua

SEQ ID NO: 503108 - RNA, 64 nt, hsa
gaggaacaggaacauuguuuucuagagcaagauaauaaaggagaugggccauacaaauguuuuc

SEQ ID NO: 503109 - RNA, 64 nt, hsa
uauaagaauguauaucuuuuuugcaaccaauuuaauaaaggaguugaaagaaagagugcacuga

SEQ ID NO: 503110 - RNA, 64 nt, hsa
guuucacaaaugaaugauuaaggaauuaugcaucauaaaggaaccuaagugagguauaugauga

SEQ ID NO: 503111 - RNA, 64 nt, hsa
uaaauaaacaggaaauuagaaguguuaggguuagauaaaggaaaagugaaaaagcauaagaaau

SEQ ID NO: 503112 - RNA, 64 nt, hsa
gauuuggucuccucuggcaggcugugguggccacauaaaggaucuuccauuagagggacacagg

SEQ ID NO: 503113 - RNA, 64 nt, hsa
accaguuuugaauuggaauugcaccauuucguagauaaaggaaacuaaguauauugcugcacuu

SEQ ID NO: 503114 - RNA, 64 nt, hsa
cuucuguuuaaguugaaagcaagagucccugaguauaaaggaaaaacagcaaaacaaaaagcaa

SEQ ID NO: 503115 - RNA, 64 nt, hsa
agaauuaaaaaaauacaaaaaagaaaaaaugaaaauaaaggaauaagaaguuaccuacuccaua

SEQ ID NO: 503116 - RNA, 64 nt, hsa
aacagaguaaaguggaaggaaguuuauucagaaaauaaaggaguaucacagcucuuuuagaauu

SEQ ID NO: 503117 - RNA, 64 nt, hsa
acacaaaauuguuaguguuuaugauguuuuuaucauaaaggaugucagagaaacuuuaugcaua

SEQ ID NO: 503118 - RNA, 64 nt, hsa
gucuguuaaagccauugucagcaaagcuuugaaaauaaaggacuucacaaaaacgguaauguaa

SEQ ID NO: 503119 - RNA, 64 nt, hsa
uguauauuuugauuacuuguuuucguuuuugacuauaaaggagcuuuuuuauuuugggagggga

SEQ ID NO: 503120 - RNA, 64 nt, hsa
gaguucucaaaggugaaaccagaugaucauucugauaaaggaaauuuaaauuugauacauaugc

SEQ ID NO: 503121 - RNA, 64 nt, hsa
gagagggaaaauguuuuguaagaaaccaaucaagauaaaggacagugaaguaauccguaccuug

SEQ ID NO: 503122 - RNA, 64 nt, hsa
ucauuucugauauagaauugcaauuuuaacacacauaaaggauaaacuuuuagaaacuuaucuu

SEQ ID NO: 503123 - RNA, 64 nt, hsa
aguuguauggaaaaauaguagaauuacacagcaugaaaagcagcccaugguuuaaauuauugga

SEQ ID NO: 503124 - RNA, 64 nt, hsa
ugguuguuaucuuacuucuacaguggaagagauugaaaagcauuugucagguuaaugcuaaauc

SEQ ID NO: 503125 - RNA, 64 nt, hsa
gaguaacggcuaagaaccuccuuccucugguuuugaaaagcaguucggguuguccaauucugua

SEQ ID NO: 503126 - RNA, 64 nt, hsa
uucugcaguccacgcugaacaugggaaacaaccugaaaagcaggcaggccucccggucagggag

SEQ ID NO: 503127 - RNA, 64 nt, hsa
uuguuugcuuaauaaauuauaaaaugauggcuuggaaaagcaggcuagucuaaccauggugcua

SEQ ID NO: 503128 - RNA, 64 nt, hsa
aacuuccuagaguugcacccuagcaaccuagccagaaaagcaaguggcaagaggauuauggcua

SEQ ID NO: 503129 - RNA, 64 nt, hsa
ucguauauaugagcuauacuuuaacauuaugagagaaaagcauaaaacaaaaauagguaguucu

SEQ ID NO: 503130 - RNA, 64 nt, hsa
gguaacuuuaugucuagcaaauauuuuaugccaagaaaagcauacuauaaagcaaauaucuauu

SEQ ID NO: 503131 - RNA, 64 nt, hsa
aggaaauacagaagccugaauaaucuauggguuagaaaagcaucccugaauaaucaaaaauugg

SEQ ID NO: 503132 - RNA, 64 nt, hsa
aacaaacucuagaauauugacauucucugugggggaaaagcaguguccacuggaccccuucugg

SEQ ID NO: 503133 - RNA, 64 nt, hsa
acauagaauuugugaauuacuuucugacuacaaagaaaagcagaugccaaaauacucuucugaa

SEQ ID NO: 503134 - RNA, 64 nt, hsa
uggaauauuacacgaugagauucugauucaugaagaaaagcagauagaagugguugaaaaaaug

SEQ ID NO: 503135 - RNA, 64 nt, hsa
uuaugcuauauaauacuucauuuaaagaagaaaggaaaagcaaaugcacuugcagcuuuugagg

SEQ ID NO: 503136 - RNA, 64 nt, hsa
ucuuagcaccuuuucaagggguuugaguuuguuggaaaagcaguuaacuggggggaaauggaca

SEQ ID NO: 503137 - RNA, 64 nt, hsa
uaugaggaauguuuuaauaccuccaaauuuuuaagaaaagcaucaaaggguugauauuuuuuaa

SEQ ID NO: 503138 - RNA, 64 nt, hsa
cugaaauuuuacauccgaacaaaauuuuacauccgaaaagcaaccaacuucuucauggaacuca

SEQ ID NO: 503139 - RNA, 64 nt, hsa
agugaauuaucccugcuggcuuucuuuucucuaugaaaagcaacugaguacaauuguuaugauc

SEQ ID NO: 503140 - RNA, 64 nt, hsa
cuacuaaccugacaucaccaaguguggaauuggagaaaagcacaaucaacuuuucugagcuggu

SEQ ID NO: 503141 - RNA, 64 nt, hsa
ucucacaagcaucuuugucuugcaaauccuaagggaaaagcaagucccugcagugagcacuagg

SEQ ID NO: 503142 - RNA, 64 nt, hsa
gacuuccgaauagaauguuuucuuuaagaggcaugaaaagcaacuauuguuguguuacaguguu

SEQ ID NO: 503143 - RNA, 64 nt, hsa
ccucaguaagcagcuugccaaucacuccaggucugaaaagcaagucccccagccccaccccagg

SEQ ID NO: 503144 - RNA, 64 nt, hsa
aaaaagugauuuaaaaaugaucuuaccuguaccagaaaagcaaaguuaaaggaaacaaaauuug

SEQ ID NO: 503145 - RNA, 64 nt, hsa
ugaaaagcaagguuugugcugcgcuuccaguuccgaaaagcagauguuuaagcccuuggacuga

SEQ ID NO: 503146 - RNA, 64 nt, hsa
cgagauggggccgccgagagaccccagcgccuuugaaaagcaagguuugugcugcgcuuccagu

SEQ ID NO: 503147 - RNA, 64 nt, hsa
acuucgucagaaccuucugugggagccauugagagaaaagcaugguccagugccuucugagaaa

SEQ ID NO: 503148 - RNA, 64 nt, hsa
uuuauagaaacacaggagaggaagaauuuggaaugaaaagcacuucgucagaaccuucuguggg

SEQ ID NO: 503149 - RNA, 64 nt, hsa
aaaagggaguuacagaggcugcuuaaaagauggagaaaagcaaaacccaguauuuaaagucuau

SEQ ID NO: 503150 - RNA, 64 nt, hsa
caaaugccuacuauuuuauaugcauauauuaaaagaaaagcaaagaccugagccgaggagagga

SEQ ID NO: 503151 - RNA, 64 nt, hsa
uguucaaagaguuuucuaaagugauaaaaccaaagaaaagcauguggaaaagcagaagcuuaga

SEQ ID NO: 503152 - RNA, 64 nt, hsa
uuucuaaagugauaaaaccaaagaaaagcauguggaaaagcagaagcuuagaaaguugugguca

SEQ ID NO: 503153 - RNA, 64 nt, hsa
aaaaggagaauugcaaauuuuaccaaaagauggagaaaagcacauuaaaaagauaccaacauuc

SEQ ID NO: 503154 - RNA, 64 nt, hsa
ugcccucucaaauguugcuaggaauucauacugcgaaaagcaaugaauaagcaugccuguuuuc

SEQ ID NO: 503155 - RNA, 64 nt, hsa
ccgcgcccccaccccagaccccgagccaccccaggaaaagcacaaggacugccgccuucucgcu

SEQ ID NO: 503156 - RNA, 64 nt, hsa
caaaugucugggaagcccuccaagaaaaaaaauagaaaagcacuugaagaauauucccaauauu

SEQ ID NO: 503157 - RNA, 64 nt, hsa
aaauguuguucaacaccagaaaauuuauauuggagaaaagcacuguaaauguaaugcauuugug

SEQ ID NO: 503158 - RNA, 64 nt, hsa
ucaaauuauauuuuuucuugaaaaauuaguuuuugaaaagcaaaugauguaauucaacucaaau

SEQ ID NO: 503159 - RNA, 64 nt, hsa
ucacuuaaaggauuugacuuaccaccagagcauagaaaagcaugcaaggaagaccagaugggcu

SEQ ID NO: 503160 - RNA, 64 nt, hsa
uugaaaggcaggcuucacagugccgaguuggcgggaaaagcaaauucuuuugaagucuuagucu

SEQ ID NO: 503161 - RNA, 64 nt, hsa
uucagaugaacucugcuguuuagaaguaaccacagaaaagcaaagucaguguacacucugagug

SEQ ID NO: 503162 - RNA, 64 nt, hsa
uuuaacucauuuccuugagcuuauacaaaacauagaaaagcaaacuguuaaaguagucaauaau

SEQ ID NO: 503163 - RNA, 64 nt, hsa
guuuuuaauauaacccauaaucaagaacaugagcgaaaagcagacauaaaucgauauggauggu

SEQ ID NO: 503164 - RNA, 64 nt, hsa
cuccauguauugguuagcacaguuuauaguaagugaaaagcaagggacccaccuacauuaccuu

SEQ ID NO: 503165 - RNA, 64 nt, hsa
cagccugaaaugugaacugaacaggagaaaaaaagaaaagcaaaaaacuccuguaacccuugag

SEQ ID NO: 503166 - RNA, 64 nt, hsa
gagaacuacauuuguuuuuaacauauguguuugagaaaagcauauggaguguuucaccgcaggc

SEQ ID NO: 503167 - RNA, 64 nt, hsa
cgcgcauaccugcuuccaagaauaaaacaguucugaaaagcaaccgcaaagccgggcgcggugg

SEQ ID NO: 503168 - RNA, 64 nt, hsa
aaaaaaaaaagaaagaaagaaagagaaaagaaaagaaaagcaaccacagccagccuuagggaaa

SEQ ID NO: 503169 - RNA, 64 nt, hsa
gaggcccagacaggcucacucaagcucuuuaacugaaaagcaacaagccacuccaggacaaggu

SEQ ID NO: 503170 - RNA, 64 nt, hsa
aggaguaggagagaggaaacauuugacuuaucuggaaaagcaaaauguacuuaagaauaagaau

SEQ ID NO: 503171 - RNA, 64 nt, hsa
gcagcaaguaacuauguguaaguccucaucaaaugaaaagcagaaagacaagaacaauuaguca

SEQ ID NO: 503172 - RNA, 64 nt, hsa
aguuucuuaugugcccuuaaagacuguuagacaagaaaagcauucacuggcuaauaauccauag

SEQ ID NO: 503173 - RNA, 64 nt, hsa
aaagcugaaaauuuagaagcaagaugaaaaaaaggaaaagcaggugcuuuuuaaaaaucagaac

SEQ ID NO: 503174 - RNA, 64 nt, hsa
caaugaaagaaaacuguuuauauagaccccauuggaaaagcaaaacgcucucacugagaucagg

SEQ ID NO: 503175 - RNA, 64 nt, hsa
aauguucacugaauaaauaaguaaauacauuauugaaaagcaaaucuguauaaaugugaaauuu

SEQ ID NO: 503176 - RNA, 64 nt, hsa
gagauccaacuauuucuuucaucagaaaaaguccgaaaagcaaaccuuaauuugaaauaacagc

SEQ ID NO: 503177 - RNA, 64 nt, hsa
cucuuucaaaaagcacagugcaucaugagcaacagaaaagcaguagaauccuaaaggacauaac

SEQ ID NO: 503178 - RNA, 64 nt, hsa
aaagcagagauggaaauaaugcgccucuugaggagaaaagcaauaaugaauaaaaggacuuucc

SEQ ID NO: 503179 - RNA, 64 nt, hsa
uggaauauuacaagaugagauucugauucaugaagaaaagcagauagaaguggcugaaaaugaa

SEQ ID NO: 503180 - RNA, 64 nt, hsa
cugacaauggugaugauggauuaauuccaccaaggaaaagcagaacaccugaaagccagcaauu

SEQ ID NO: 503181 - RNA, 64 nt, hsa
uguaaagaacaacacuuguuugucuguggggaaagaaaagcagaauacuugagaugaaaguugg

SEQ ID NO: 503182 - RNA, 64 nt, hsa
auuuuauguaaucuuuauaaguaugauuucugaagaaaagcaaaugcauuaguauguuugccuu

SEQ ID NO: 503183 - RNA, 64 nt, hsa
ccauaccuccuugaacuacuucauaacuugucaagaaaagcaguuugcagcaagggcauguggu

SEQ ID NO: 503184 - RNA, 64 nt, hsa
agacugcuuaucucagagugaagauacugcggcugaaaagcacuaguuugauauaaaauuaaaa

SEQ ID NO: 503185 - RNA, 64 nt, hsa
uuuuuugcagcuugcugauauuuuauauaaaaaagaaaagcaaagcaaaagagaagcugauagu

SEQ ID NO: 503186 - RNA, 64 nt, hsa
uuuccccauccuuggugagauaacaagcuaucgcgaaaagcacuugggagauuuggaugauuug

SEQ ID NO: 503187 - RNA, 64 nt, hsa
acuggagagaaacccugugaauguaagaaauguagaaaagcauuccauaauuucucuucuuugc

SEQ ID NO: 503188 - RNA, 64 nt, hsa
aauggagagaaacccuaugaauguaaagaaugcagaaaagcauucagcuugccuacuuccuuuc

SEQ ID NO: 503189 - RNA, 64 nt, hsa
acuggagauaaacccuuugaguguaaaaaauguggaaaagcauuuagauacuacuacucagcuc

SEQ ID NO: 503190 - RNA, 64 nt, hsa
acuggagauaaacccuuuaaguguaaagaauguggaaaagcauuccgauaccaccaaucugcuc

SEQ ID NO: 503191 - RNA, 64 nt, hsa
uggcaggggguggggauuaucuuggggagaggcugaaaagcacaaaagauagucuucccuguac

SEQ ID NO: 503192 - RNA, 64 nt, hsa
caguuuauaggguuggguuuuuuuuccaacuugugaaaagcaguuuagcugcaucugucucccc

SEQ ID NO: 503193 - RNA, 64 nt, hsa
uuccuacccccuaccuccagaguuguugaaagcugaaaagcauacaagauucuuccuuuuaacu

SEQ ID NO: 503194 - RNA, 64 nt, hsa
uaggcaucauuucacaaggucaguaaugcugcaggaaaagcaaaauugcaaucuacguaucuau

SEQ ID NO: 503195 - RNA, 64 nt, hsa
gggacucagguaagcccagccugggaugagagcagaaaagcauucaagauuugcaggccuugcu

SEQ ID NO: 503196 - RNA, 64 nt, hsa
uucuuugccuagccaagcagccaauuuuauuggagaaaagcaaguuauauguucacaaaaugga

SEQ ID NO: 503197 - RNA, 64 nt, hsa; identical to SEQ ID NO: 199847

SEQ ID NO: 503198 - RNA, 64 nt, hsa; identical to SEQ ID NO: 199848

SEQ ID NO: 503199 - RNA, 64 nt, hsa; identical to SEQ ID NO: 199849

SEQ ID NO: 503200 - RNA, 64 nt, hsa; identical to SEQ ID NO: 199850

SEQ ID NO: 503201 - RNA, 64 nt, hsa; identical to SEQ ID NO: 199851

SEQ ID NO: 503202 - RNA, 64 nt, hsa; identical to SEQ ID NO: 199852

SEQ ID NO: 503203 - RNA, 64 nt, hsa; identical to SEQ ID NO: 199853

SEQ ID NO: 503204 - RNA, 64 nt, hsa; identical to SEQ ID NO: 199854

SEQ ID NO: 503205 - RNA, 55 nt, hsa; identical to SEQ ID NO: 199855

SEQ ID NO: 503206 - RNA, 64 nt, hsa; identical to SEQ ID NO: 199856

SEQ ID NO: 503207 - RNA, 64 nt, hsa; identical to SEQ ID NO: 199857

SEQ ID NO: 503208 - RNA, 64 nt, hsa; identical to SEQ ID NO: 199858

SEQ ID NO: 503209 - RNA, 64 nt, hsa; identical to SEQ ID NO: 199859

SEQ ID NO: 503210 - RNA, 64 nt, hsa; identical to SEQ ID NO: 199860

SEQ ID NO: 503211 - RNA, 64 nt, hsa; identical to SEQ ID NO: 199861

SEQ ID NO: 503212 - RNA, 64 nt, hsa; identical to SEQ ID NO: 199862

SEQ ID NO: 503213 - RNA, 64 nt, hsa; identical to SEQ ID NO: 199863

SEQ ID NO: 503214 - RNA, 64 nt, hsa; identical to SEQ ID NO: 199864

SEQ ID NO: 503215 - RNA, 64 nt, hsa; identical to SEQ ID NO: 199865

SEQ ID NO: 503216 - RNA, 64 nt, hsa; identical to SEQ ID NO: 199866

SEQ ID NO: 503217 - RNA, 64 nt, hsa
uggaaagugaggagcgucucugcccggccgccaucccaucuaggaagugaggagcgccucuucc

SEQ ID NO: 503218 - RNA, 64 nt, hsa
uaggaagugaggagcgccucuucccacccgccaucccaucuaggaagugaggagcuucucugcc

SEQ ID NO: 503219 - RNA, 64 nt, hsa
uggaaagugaggagcgccucugcccggccgccaucccaucuaggaagugaggagcgccucuucc

SEQ ID NO: 503220 - RNA, 64 nt, hsa
uaggaagugaggagcgccucuucccagccgccaucccaucuaggaagugaggagcgucucugcc

SEQ ID NO: 503221 - RNA, 64 nt, hsa; identical to SEQ ID NO: 415214

SEQ ID NO: 503222 - RNA, 64 nt, hsa; identical to SEQ ID NO: 415215

SEQ ID NO: 503223 - RNA, 64 nt, hsa; identical to SEQ ID NO: 415216

SEQ ID NO: 503224 - RNA, 64 nt, hsa; identical to SEQ ID NO: 415217

SEQ ID NO: 503225 - RNA, 64 nt, hsa; identical to SEQ ID NO: 415218

SEQ ID NO: 503226 - RNA, 64 nt, hsa; identical to SEQ ID NO: 415219

SEQ ID NO: 503227 - RNA, 64 nt, hsa; identical to SEQ ID NO: 415220

SEQ ID NO: 503228 - RNA, 64 nt, hsa; identical to SEQ ID NO: 415221

SEQ ID NO: 503229 - RNA, 55 nt, hsa; identical to SEQ ID NO: 415222

SEQ ID NO: 503230 - RNA, 64 nt, hsa; identical to SEQ ID NO: 415223

SEQ ID NO: 503231 - RNA, 64 nt, hsa; identical to SEQ ID NO: 415224

SEQ ID NO: 503232 - RNA, 64 nt, hsa; identical to SEQ ID NO: 415225

SEQ ID NO: 503233 - RNA, 64 nt, hsa; identical to SEQ ID NO: 415226

SEQ ID NO: 503234 - RNA, 64 nt, hsa; identical to SEQ ID NO: 415227

SEQ ID NO: 503235 - RNA, 64 nt, hsa; identical to SEQ ID NO: 415228

SEQ ID NO: 503236 - RNA, 50 nt, hsa; identical to SEQ ID NO: 415229

SEQ ID NO: 503237 - RNA, 64 nt, hsa; identical to SEQ ID NO: 415230

SEQ ID NO: 503238 - RNA, 64 nt, hsa; identical to SEQ ID NO: 415231

SEQ ID NO: 503239 - RNA, 64 nt, hsa; identical to SEQ ID NO: 415232

SEQ ID NO: 503240 - RNA, 64 nt, hsa; identical to SEQ ID NO: 415233

SEQ ID NO: 503241 - RNA, 64 nt, hsa; identical to SEQ ID NO: 415234

SEQ ID NO: 503242 - RNA, 64 nt, hsa; identical to SEQ ID NO: 415235

SEQ ID NO: 503243 - RNA, 64 nt, hsa; identical to SEQ ID NO: 415236

SEQ ID NO: 503244 - RNA, 64 nt, hsa; identical to SEQ ID NO: 415237

SEQ ID NO: 503245 - RNA, 64 nt, hsa; identical to SEQ ID NO: 415238

SEQ ID NO: 503246 - RNA, 64 nt, hsa; identical to SEQ ID NO: 415239

SEQ ID NO: 503247 - RNA, 64 nt, hsa; identical to SEQ ID NO: 415240

SEQ ID NO: 503248 - RNA, 64 nt, hsa; identical to SEQ ID NO: 415241

SEQ ID NO: 503249 - RNA, 64 nt, hsa; identical to SEQ ID NO: 415242

SEQ ID NO: 503250 - RNA, 64 nt, hsa; identical to SEQ ID NO: 415243

SEQ ID NO: 503251 - RNA, 64 nt, hsa; identical to SEQ ID NO: 415244

SEQ ID NO: 503252 - RNA, 64 nt, hsa; identical to SEQ ID NO: 415245

SEQ ID NO: 503253 - RNA, 64 nt, hsa; identical to SEQ ID NO: 415246

SEQ ID NO: 503254 - RNA, 64 nt, hsa; identical to SEQ ID NO: 415247

SEQ ID NO: 503255 - RNA, 64 nt, hsa; identical to SEQ ID NO: 415248

SEQ ID NO: 503256 - RNA, 64 nt, hsa; identical to SEQ ID NO: 415249

SEQ ID NO: 503257 - RNA, 64 nt, hsa; identical to SEQ ID NO: 415250

SEQ ID NO: 503258 - RNA, 64 nt, hsa; identical to SEQ ID NO: 415251

SEQ ID NO: 503259 - RNA, 64 nt, hsa; identical to SEQ ID NO: 415252

SEQ ID NO: 503260 - RNA, 64 nt, hsa; identical to SEQ ID NO: 415253

SEQ ID NO: 503261 - RNA, 64 nt, hsa; identical to SEQ ID NO: 415254

SEQ ID NO: 503262 - RNA, 64 nt, hsa; identical to SEQ ID NO: 415255

SEQ ID NO: 503263 - RNA, 64 nt, hsa; identical to SEQ ID NO: 415256

SEQ ID NO: 503264 - RNA, 64 nt, hsa; identical to SEQ ID NO: 216073

SEQ ID NO: 503265 - RNA, 64 nt, hsa; identical to SEQ ID NO: 216074

SEQ ID NO: 503266 - RNA, 64 nt, hsa; identical to SEQ ID NO: 216075

SEQ ID NO: 503267 - RNA, 64 nt, hsa; identical to SEQ ID NO: 216076

SEQ ID NO: 503268 - RNA, 64 nt, hsa; identical to SEQ ID NO: 216077

SEQ ID NO: 503269 - RNA, 64 nt, hsa; identical to SEQ ID NO: 216078

SEQ ID NO: 503270 - RNA, 64 nt, hsa; identical to SEQ ID NO: 216079

SEQ ID NO: 503271 - RNA, 64 nt, hsa; identical to SEQ ID NO: 216080

SEQ ID NO: 503272 - RNA, 64 nt, hsa; identical to SEQ ID NO: 216081

SEQ ID NO: 503273 - RNA, 64 nt, hsa; identical to SEQ ID NO: 216082

SEQ ID NO: 503274 - RNA, 64 nt, hsa; identical to SEQ ID NO: 216083

SEQ ID NO: 503275 - RNA, 64 nt, hsa; identical to SEQ ID NO: 216084

SEQ ID NO: 503276 - RNA, 64 nt, hsa; identical to SEQ ID NO: 216085

SEQ ID NO: 503277 - RNA, 64 nt, hsa; identical to SEQ ID NO: 216086

SEQ ID NO: 503278 - RNA, 64 nt, hsa; identical to SEQ ID NO: 216087

SEQ ID NO: 503279 - RNA, 64 nt, hsa; identical to SEQ ID NO: 216088

SEQ ID NO: 503280 - RNA, 64 nt, hsa; identical to SEQ ID NO: 216089

SEQ ID NO: 503281 - RNA, 64 nt, hsa; identical to SEQ ID NO: 216090

SEQ ID NO: 503282 - RNA, 64 nt, hsa; identical to SEQ ID NO: 216091

SEQ ID NO: 503283 - RNA, 64 nt, hsa; identical to SEQ ID NO: 216092

SEQ ID NO: 503284 - RNA, 64 nt, hsa; identical to SEQ ID NO: 216093

SEQ ID NO: 503285 - RNA, 64 nt, hsa; identical to SEQ ID NO: 216094

SEQ ID NO: 503286 - RNA, 64 nt, hsa; identical to SEQ ID NO: 216095

SEQ ID NO: 503287 - RNA, 64 nt, hsa; identical to SEQ ID NO: 216096

SEQ ID NO: 503288 - RNA, 64 nt, hsa; identical to SEQ ID NO: 216097

SEQ ID NO: 503289 - RNA, 64 nt, hsa; identical to SEQ ID NO: 216098

SEQ ID NO: 503290 - RNA, 64 nt, hsa; identical to SEQ ID NO: 216099

SEQ ID NO: 503291 - RNA, 64 nt, hsa; identical to SEQ ID NO: 216100

SEQ ID NO: 503292 - RNA, 64 nt, hsa; identical to SEQ ID NO: 216101

SEQ ID NO: 503293 - RNA, 64 nt, hsa; identical to SEQ ID NO: 216102

SEQ ID NO: 503294 - RNA, 64 nt, hsa; identical to SEQ ID NO: 216103

SEQ ID NO: 503295 - RNA, 64 nt, hsa; identical to SEQ ID NO: 216104

SEQ ID NO: 503296 - RNA, 64 nt, hsa; identical to SEQ ID NO: 216105

SEQ ID NO: 503297 - RNA, 64 nt, hsa; identical to SEQ ID NO: 216106

SEQ ID NO: 503298 - RNA, 64 nt, hsa; identical to SEQ ID NO: 216107

SEQ ID NO: 503299 - RNA, 64 nt, hsa; identical to SEQ ID NO: 216108

SEQ ID NO: 503300 - RNA, 64 nt, hsa; identical to SEQ ID NO: 216109

SEQ ID NO: 503301 - RNA, 64 nt, hsa; identical to SEQ ID NO: 216110

SEQ ID NO: 503302 - RNA, 64 nt, hsa; identical to SEQ ID NO: 216111

SEQ ID NO: 503303 - RNA, 64 nt, hsa; identical to SEQ ID NO: 216112

SEQ ID NO: 503304 - RNA, 64 nt, hsa; identical to SEQ ID NO: 216113

SEQ ID NO: 503305 - RNA, 64 nt, hsa; identical to SEQ ID NO: 216114

SEQ ID NO: 503306 - RNA, 64 nt, hsa; identical to SEQ ID NO: 216115

SEQ ID NO: 503307 - RNA, 64 nt, hsa; identical to SEQ ID NO: 216116

SEQ ID NO: 503308 - RNA, 64 nt, hsa; identical to SEQ ID NO: 216117

SEQ ID NO: 503309 - RNA, 64 nt, hsa; identical to SEQ ID NO: 216118

SEQ ID NO: 503310 - RNA, 64 nt, hsa; identical to SEQ ID NO: 216119

SEQ ID NO: 503311 - RNA, 64 nt, hsa; identical to SEQ ID NO: 216120

SEQ ID NO: 503312 - RNA, 64 nt, hsa; identical to SEQ ID NO: 216121

SEQ ID NO: 503313 - RNA, 64 nt, hsa; identical to SEQ ID NO: 216121

SEQ ID NO: 503314 - RNA, 64 nt, hsa; identical to SEQ ID NO: 216123

SEQ ID NO: 503315 - RNA, 64 nt, hsa; identical to SEQ ID NO: 216124

SEQ ID NO: 503316 - RNA, 64 nt, hsa; identical to SEQ ID NO: 216125

SEQ ID NO: 503317 - RNA, 64 nt, hsa; identical to SEQ ID NO: 216126

SEQ ID NO: 503318 - RNA, 64 nt, hsa; identical to SEQ ID NO: 216127

SEQ ID NO: 503319 - RNA, 64 nt, hsa; identical to SEQ ID NO: 216128

SEQ ID NO: 503320 - RNA, 64 nt, hsa; identical to SEQ ID NO: 216129

SEQ ID NO: 503321 - RNA, 64 nt, hsa; identical to SEQ ID NO: 216130

SEQ ID NO: 503322 - RNA, 64 nt, hsa; identical to SEQ ID NO: 216131

SEQ ID NO: 503323 - RNA, 64 nt, hsa; identical to SEQ ID NO: 216132

SEQ ID NO: 503324 - RNA, 64 nt, hsa; identical to SEQ ID NO: 216133

SEQ ID NO: 503325 - RNA, 64 nt, hsa; identical to SEQ ID NO: 216134

SEQ ID NO: 503326 - RNA, 64 nt, hsa; identical to SEQ ID NO: 216135

SEQ ID NO: 503327 - RNA, 64 nt, hsa; identical to SEQ ID NO: 216136

SEQ ID NO: 503328 - RNA, 64 nt, hsa; identical to SEQ ID NO: 216137

SEQ ID NO: 503329 - RNA, 64 nt, hsa; identical to SEQ ID NO: 216138

SEQ ID NO: 503330 - RNA, 64 nt, hsa; identical to SEQ ID NO: 216139

SEQ ID NO: 503331 - RNA, 64 nt, hsa; identical to SEQ ID NO: 216140

SEQ ID NO: 503332 - RNA, 64 nt, hsa; identical to SEQ ID NO: 216141

SEQ ID NO: 503333 - RNA, 64 nt, hsa; identical to SEQ ID NO: 216142

SEQ ID NO: 503334 - RNA, 64 nt, hsa; identical to SEQ ID NO: 216143

SEQ ID NO: 503335 - RNA, 64 nt, hsa
aagccaauccuuuuucuuuuuuuuggaggucccaccgagauagauaggaacuuggauugcugaa

SEQ ID NO: 503336 - RNA, 64 nt, hsa
gacuuuucaugaaacugaauaaaagaaauccuuuccgagauagaggagauuuguaggugaaugc

SEQ ID NO: 503337 - RNA, 64 nt, hsa
uggcgugaauccgggaggcggagcuugcagggagccgagauagugucacugcacuccagccugg

SEQ ID NO: 503338 - RNA, 64 nt, hsa
ccucagaucuucuguggguuucuaaagcugccagccgagauagccaaggccaaaggaagcacau

SEQ ID NO: 503339 - RNA, 64 nt, hsa
uuuugugguaugagaacaggcaaaaagagaugccccgagauagaaggggagccuuguguuucuu

SEQ ID NO: 503340 - RNA, 64 nt, hsa
guguggagaaugcauugacagguucuuugcggagccgagauaccaugcagacauuuugcuuguu

SEQ ID NO: 503341 - RNA, 64 nt, hsa
ccaccagacagagagagagagcacuugauucuucccgagauagccaccuggaaacacuaggugc

SEQ ID NO: 503342 - RNA, 64 nt, hsa
ucgcuugaaccuggcaggcggagguugcagugagccgagauagugccacagcucuccagccugg

SEQ ID NO: 503343 - RNA, 64 nt, hsa
ugcuugaacccaggaggcagaggguugcagugagccgagauagcaccauugcacuccagccugg

SEQ ID NO: 503344 - RNA, 64 nt, hsa
gaguauuaguacauaaauuuucuacucaacaauuccgagauaggauuaugccuaguuugucaua

SEQ ID NO: 503345 - RNA, 64 nt, hsa
gguugacucuucacaugauggagguaugaggccuccgagauagcugagggaaguucuuugccug

SEQ ID NO: 503346 - RNA, 64 nt, hsa
uggcucaugccuguaauccuagcacuuugagaggccgagauaggcggauugcuugagcccagga

SEQ ID NO: 503347 - RNA, 64 nt, hsa
aguugagggaaacccccagccacccucccggaauccgagauaggguggcacaucuguccugaca

SEQ ID NO: 503348 - RNA, 64 nt, hsa
uggcaugaacccgggaggaggagcuugcagugagccgagauagcgccacugcaguccggccugg

SEQ ID NO: 503349 - RNA, 64 nt, hsa
cuuccaaugcuuuaacucacuuaauccucacaacccgagauagguacuguuaccauccucucug

SEQ ID NO: 503350 - RNA, 64 nt, hsa
auuauuuugcuuuauuaaaagucuuccuucaccaccgagauaugcuaauuuaacuuacaaauga

SEQ ID NO: 503351 - RNA, 64 nt, hsa
uucugaaugaucaauauagcuuggugagacagugccgagauagauagccaugucugccuugggc

SEQ ID NO: 503352 - RNA, 64 nt, hsa
gagccacugugcccagcccagguuuugaaguuguccgagauagcagucugcucucuacugccuu

SEQ ID NO: 503353 - RNA, 64 nt, hsa
ugggagggaaguggagguugcuguacaggaaaaaccgagauaggggaggggggagggggaagca

SEQ ID NO: 503354 - RNA, 64 nt, hsa
cucggcgucccccagucuccaggagccucucccuccgagauacccacccagcuuugucaaucac

SEQ ID NO: 503355 - RNA, 64 nt, hsa
cucccuaaaugaucucuccuuccccccccccaccccgagauacgggguuccaggaaaggggagg

SEQ ID NO: 503356 - RNA, 64 nt, hsa
ucgcuugaacccuagaggcggaguuugcagugagccgagauagugccauuguacuccagcuugg

SEQ ID NO: 503357 - RNA, 64 nt, hsa
ccugccacuccugugucccugccucccugggcucccgagauaggcaccacuguauccuccagcu

SEQ ID NO: 503358 - RNA, 64 nt, hsa
ugguucacaccuguaaucccggcauuuugggaggccgagauagguggaucaccugaagucaggu

SEQ ID NO: 503359 - RNA, 64 nt, hsa
ggaaggaacuggauaucucuccugcagcccagcaccgagauacccaggacgggccuggggggcg

SEQ ID NO: 503360 - RNA, 64 nt, hsa
ucacuugaaccugggagacagagguugcaaugaaccgagauagugccauugcacuccggccugg

SEQ ID NO: 503361 - RNA, 64 nt, hsa
gucacagagcccgcgugugcaggagccugcuccuccgagauacguggcguguagguugcuguag

SEQ ID NO: 503362 - RNA, 64 nt, hsa
ugacagccucccagccagggcuggcgauaaaggaccgagauagauggagggggcgaguagggaa

SEQ ID NO: 503363 - RNA, 64 nt, hsa
gcugagaucgcgcuacugcauuccagccugggcgccgagauagcgccauugcacuccagccugg

SEQ ID NO: 503364 - RNA, 64 nt, hsa
accaacccuccugcauccuugccuugcagcgugaccgagauaggucaucagcccagggcuucag

SEQ ID NO: 503365 - RNA, 64 nt, hsa
cuucaagccaaggaacacacggggcuaccagaagccgagauagaagcauggaacauauguucua

SEQ ID NO: 503366 - RNA, 64 nt, hsa
agaaccugcggagggacugagugccccugccacuccgagauaaccaguggaugcccaggaucuu

SEQ ID NO: 503367 - RNA, 64 nt, hsa
guuuuaacaaauggauccaggauggauaaauccaccgagauaaggguuuuggucacugucucca

SEQ ID NO: 503368 - RNA, 64 nt, hsa
ggucucgcagggaaaagggcuggcuucuagguccccgagauaagugugcagggggaugggccag

SEQ ID NO: 503369 - RNA, 64 nt, hsa
uuuuagacaauguuuauaguugagggacuaucagccgagauacuuguaauuagaaccaucccca

SEQ ID NO: 503370 - RNA, 64 nt, hsa
gaacccgggaggaggaggaggagguugcagugagccgagauagcggcacugcacuccagccugg

SEQ ID NO: 503371 - RNA, 64 nt, hsa
uggcgugaaccugggagguggagcuugcagugagccgagauaucgccacugcacuccagccugg

SEQ ID NO: 503372 - RNA, 64 nt, hsa
cuguuuucucaugaugccuuuuuauauuuaaaccccgagauagugcuggaacacugcugagguu

SEQ ID NO: 503373 - RNA, 64 nt, hsa
ccugucggaccuucacuucacaucaugguggggaccgagauagagagggagaccccauuccaag

SEQ ID NO: 503374 - RNA, 64 nt, hsa
cgaagacaaccaaaagaaugcaaacuggauuuauccgagauauuugacuuuuaaaaaucucaau

SEQ ID NO: 503375 - RNA, 64 nt, hsa
uguauaccacacccugggccccuaaucccaggccccgagauaggaaagccagcuagucucuucu

SEQ ID NO: 503376 - RNA, 64 nt, hsa; identical to SEQ ID NO: 355656

SEQ ID NO: 503377 - RNA, 64 nt, hsa; identical to SEQ ID NO: 355657

SEQ ID NO: 503378 - RNA, 64 nt, hsa; identical to SEQ ID NO: 355658

SEQ ID NO: 503379 - RNA, 64 nt, hsa; identical to SEQ ID NO: 355659

SEQ ID NO: 503380 - RNA, 64 nt, hsa; identical to SEQ ID NO: 355660

SEQ ID NO: 503381 - RNA, 64 nt, hsa; identical to SEQ ID NO: 355661

SEQ ID NO: 503382 - RNA, 64 nt, hsa; identical to SEQ ID NO: 355662

SEQ ID NO: 503383 - RNA, 64 nt, hsa; identical to SEQ ID NO: 355663

SEQ ID NO: 503384 - RNA, 64 nt, hsa; identical to SEQ ID NO: 355664

SEQ ID NO: 503385 - RNA, 64 nt, hsa; identical to SEQ ID NO: 355665

SEQ ID NO: 503386 - RNA, 64 nt, hsa; identical to SEQ ID NO: 355666

SEQ ID NO: 503387 - RNA, 64 nt, hsa; identical to SEQ ID NO: 355667

SEQ ID NO: 503388 - RNA, 64 nt, hsa; identical to SEQ ID NO: 355668

SEQ ID NO: 503389 - RNA, 64 nt, hsa; identical to SEQ ID NO: 355669

SEQ ID NO: 503390 - RNA, 64 nt, hsa; identical to SEQ ID NO: 324319

SEQ ID NO: 503391 - RNA, 64 nt, hsa; identical to SEQ ID NO: 324320

SEQ ID NO: 503392 - RNA, 64 nt, hsa
acccacggucacugcuguguucagccccucagcucggccccagccuauuucccgccuccauuug

SEQ ID NO: 503393 - RNA, 64 nt, hsa
ugcuucagccagugcagugagaacagcagccccacggccccaugggaggcggcgcugcucuccc

SEQ ID NO: 503394 - RNA, 64 nt, hsa
uggccccacucacaccauccuaugagcccacgcccggccccacucccaccauccugugaacccc

SEQ ID NO: 503395 - RNA, 64 nt, hsa
cggccccauucacuccauccugugagaccacgcccggccccacucacucuauccugugagacca

SEQ ID NO: 503396 - RNA, 64 nt, hsa
cggccccacucacaacaucuuguaagacugugcccggccccauucacuccauccugugagacca

SEQ ID NO: 503397 - RNA, 64 nt, hsa
agccccacucacaccaaccugugagccccacucccggccccacucacaacaucuuguaagacug

SEQ ID NO: 503398 - RNA, 64 nt, hsa
agccccacucccaccauccugugagccccacucccggccccacucacuccauccugugagcccc

SEQ ID NO: 503399 - RNA, 64 nt, hsa
ggccccacucacaccaaccugugagccccacucccggccccacucacuccaucuuguaagacua

SEQ ID NO: 503400 - RNA, 64 nt, hsa
cagccccacucccaccauccugugagcccaugcccggccccacucacaccaaccugugagcccc

SEQ ID NO: 503401 - RNA, 64 nt, hsa
cggccccucucacaccauccugugagaccacgcccggccccacucccaccaucuuguaagacug

SEQ ID NO: 503402 - RNA, 64 nt, hsa
gcagagggaggagggggcacagcugugccaagcccggccccacugguguguccucacaauguga

SEQ ID NO: 503403 - RNA, 64 nt, hsa
guaguagaauaaaacuagccuaguccugucccuccggccccaguggagacaggcgucuaagaac

SEQ ID NO: 503404 - RNA, 64 nt, hsa
cuacucagcgugacccaacuuuucuagugugccacggccccaccaccuccugcaguacccacac

SEQ ID NO: 503405 - RNA, 64 nt, hsa
cccuggacagccaugccagagagaggccuuugaccggccccagagcuaaaagcaccagagaaaa

SEQ ID NO: 503406 - RNA, 64 nt, hsa
cgggggcggcgacugccgagcuccgcccuccaggcggccccacccgccugccguccuggggcgc

SEQ ID NO: 503407 - RNA, 64 nt, hsa
gaccgacgcggacaacugacccgccaggcgggagcggccccacacguguuugcuuaaagucugc

SEQ ID NO: 503408 - RNA, 64 nt, hsa; identical to SEQ ID NO: 443317

SEQ ID NO: 503409 - RNA, 64 nt, hsa; identical to SEQ ID NO: 443318

SEQ ID NO: 503410 - RNA, 64 nt, hsa; identical to SEQ ID NO: 443319

SEQ ID NO: 503411 - RNA, 64 nt, hsa; identical to SEQ ID NO: 443320

SEQ ID NO: 503412 - RNA, 64 nt, hsa; identical to SEQ ID NO: 443321

SEQ ID NO: 503413 - RNA, 64 nt, hsa; identical to SEQ ID NO: 443322

SEQ ID NO: 503414 - RNA, 64 nt, hsa; identical to SEQ ID NO: 443323

SEQ ID NO: 503415 - RNA, 64 nt, hsa; identical to SEQ ID NO: 443324

SEQ ID NO: 503416 - RNA, 64 nt, hsa; identical to SEQ ID NO: 443325

SEQ ID NO: 503417 - RNA, 64 nt, hsa; identical to SEQ ID NO: 443326

SEQ ID NO: 503418 - RNA, 64 nt, hsa; identical to SEQ ID NO: 443327

SEQ ID NO: 503419 - RNA, 64 nt, hsa; identical to SEQ ID NO: 443328

SEQ ID NO: 503420 - RNA, 64 nt, hsa; identical to SEQ ID NO: 443329

SEQ ID NO: 503421 - RNA, 64 nt, hsa; identical to SEQ ID NO: 443330

SEQ ID NO: 503422 - RNA, 64 nt, hsa; identical to SEQ ID NO: 443331

SEQ ID NO: 503423 - RNA, 64 nt, hsa; identical to SEQ ID NO: 443332

SEQ ID NO: 503424 - RNA, 64 nt, hsa; identical to SEQ ID NO: 443333

SEQ ID NO: 503425 - RNA, 64 nt, hsa; identical to SEQ ID NO: 443334

SEQ ID NO: 503426 - RNA, 64 nt, hsa; identical to SEQ ID NO: 443335

SEQ ID NO: 503427 - RNA, 64 nt, hsa; identical to SEQ ID NO: 443336

SEQ ID NO: 503428 - RNA, 64 nt, hsa; identical to SEQ ID NO: 443337

SEQ ID NO: 503429 - RNA, 64 nt, hsa; identical to SEQ ID NO: 443338

SEQ ID NO: 503430 - RNA, 64 nt, hsa; identical to SEQ ID NO: 443339

SEQ ID NO: 503431 - RNA, 64 nt, hsa; identical to SEQ ID NO: 443340

SEQ ID NO: 503432 - RNA, 64 nt, hsa; identical to SEQ ID NO: 443341

SEQ ID NO: 503433 - RNA, 64 nt, hsa; identical to SEQ ID NO: 443342

SEQ ID NO: 503434 - RNA, 64 nt, hsa; identical to SEQ ID NO: 443343

SEQ ID NO: 503435 - RNA, 64 nt, hsa; identical to SEQ ID NO: 443344

SEQ ID NO: 503436 - RNA, 64 nt, hsa; identical to SEQ ID NO: 85116

SEQ ID NO: 503437 - RNA, 64 nt, hsa; identical to SEQ ID NO: 85117

SEQ ID NO: 503438 - RNA, 64 nt, hsa; identical to SEQ ID NO: 85118

SEQ ID NO: 503439 - RNA, 64 nt, hsa; identical to SEQ ID NO: 85119

SEQ ID NO: 503440 - RNA, 64 nt, hsa; identical to SEQ ID NO: 85120

SEQ ID NO: 503441 - RNA, 64 nt, hsa; identical to SEQ ID NO: 85121

SEQ ID NO: 503442 - RNA, 64 nt, hsa
auaaauguuuuccugcuuugguuaccuuuccuuuccccuuuaaaaggaauuagcuauagaacug

SEQ ID NO: 503443 - RNA, 64 nt, hsa
ucagcaagaaaacacacgcccugcccugccaccuccccuuuauuucacacugcugcgaucuguu

SEQ ID NO: 503444 - RNA, 64 nt, hsa
aacuuuugauauauaugccuuacugaguacaugcccccuuuaauguuaacaugacuuggaguaa

SEQ ID NO: 503445 - RNA, 64 nt, hsa
uaaucugaagguguuugagucagaggcuacuuuuccccuuuauauuuuauauagaagccuauuu

SEQ ID NO: 503446 - RNA, 64 nt, hsa
cucccaugcucacacccacagaaggucuucccauccccuuuagauucgugccucacuccaccag

SEQ ID NO: 503447 - RNA, 64 nt, hsa
caacagagaugcaaaaagcuaaaaagacacccccccccuuuaaaugguuuucuuuuugaggcaa

SEQ ID NO: 503448 - RNA, 64 nt, hsa
auaacucggacaauuucuggguggugacugaguaccccuuuagugaguaccccuuuagugcuau

SEQ ID NO: 503449 - RNA, 64 nt, hsa
ucuggguggugacugaguaccccuuuagugaguaccccuuuagugcuauauuugugccauucau

SEQ ID NO: 503450 - RNA, 64 nt, hsa
ugcggucagcagucucaggccagcuucucugugaccccuuuacuccucuggagggcucuguggg

SEQ ID NO: 503451 - RNA, 64 nt, hsa
aaacuucauccuaaggugugcagcccaggcccugccccuuuacagucuaggccgccugccaugg

SEQ ID NO: 503452 - RNA, 64 nt, hsa
caccacccaacuggggcuagaguggggaagauuuccccuuuagaucaaacugccccuuccaugg

SEQ ID NO: 503453 - RNA, 64 nt, hsa
aggguagggauaguggcccuggccgucuauccuaccccuuuagugaccgcccccaucccggcuu

SEQ ID NO: 503454 - RNA, 64 nt, hsa
aaaaaaaaagauacauuggucuuuaaacccaaacccccuuuaaggcauguuggucucaagggga

SEQ ID NO: 503455 - RNA, 64 nt, hsa
uuccucagcggaaaacuguacuuuaaucccaaacccccuuuaagacauauuggggcugggcgca

SEQ ID NO: 503456 - RNA, 64 nt, hsa
cuaguuuuccucaacaggacacuugaucccaaaaccccuuuaagaccuuagguuuccucagcgg

SEQ ID NO: 503457 - RNA, 64 nt, hsa
ggacaagccucccuggaugaucgagguccccaguagcucugaacaagaguccagccaacccucu

SEQ ID NO: 503458 - RNA, 64 nt, hsa
cuuccuaaacucucuuccagcaucgauguucuguagcucugaccuugauagggauacagcuuug

SEQ ID NO: 503459 - RNA, 64 nt, hsa
ccucagccccagccccagcuccagcccugaggacagcucugaugggagagcugggcccccugag

SEQ ID NO: 503460 - RNA, 64 nt, hsa
ucugucucuccuggcuccacucuugccgccuuccagcucugagucuugggaauguuguuacccu

SEQ ID NO: 503461 - RNA, 64 nt, hsa
uggcagcugaacgaggugcuguugugggugucucagcucugagggucuuugugagcucccacug

SEQ ID NO: 503462 - RNA, 64 nt, hsa
ggucuuugugagcucccacuguugugggugucucagcucugagggucuuugugagcucccacug

SEQ ID NO: 503463 - RNA, 64 nt, hsa
ggucuuugugagcucccacuguugugggugucucagcucugagggucuuugugaguucccacca

SEQ ID NO: 503464 - RNA, 64 nt, hsa
cagaagaguaucaagauuaauauauuaauaguauagcucugacugguaaauuucuuuuuuuuaa

SEQ ID NO: 503465 - RNA, 64 nt, hsa
aggugcuccucacuucccagagggugcaggagccagcucugacuaguaaauuucuaaggauacc

SEQ ID NO: 503466 - RNA, 64 nt, hsa
cuucagagaauauaaagugaaugccuuuagggguagcucugaaagagaaacccaacaacuucau

SEQ ID NO: 503467 - RNA, 64 nt, hsa
gaaaaaucaacaaacaaaucaaagccaggcucagagcucugaaauuaaaaagcacugaaauagu

SEQ ID NO: 503468 - RNA, 64 nt, hsa
uucucccuauaaaaguaaagccuuuuucugccccagcucugagacacuugcagaucuuaagguc

SEQ ID NO: 503469 - RNA, 64 nt, hsa
cuccagccuuucucccucacaucaggagguagauagcucugaaaugacagcgccacagccauag

SEQ ID NO: 503470 - RNA, 64 nt, hsa
ggucacugcccuuaccugacccucacagaaagagagcucugagcaggugagggggucugcggug

SEQ ID NO: 503471 - RNA, 64 nt, hsa
caguugcuuaauuauacccauagguaauacaaaaagcucugaagacccaaagaugacauuacua

SEQ ID NO: 503472 - RNA, 64 nt, hsa
aucuucuguguaggugaccggagcacugagaggcagcucugaugcacuauugugugucagcagc

SEQ ID NO: 503473 - RNA, 64 nt, hsa
uccaaucauuaucaaguuccauaauucauuauuaagcucugaaauucaggacacauacauuuau

SEQ ID NO: 503474 - RNA, 64 nt, hsa
cugaucugugguuuaacacugugcagggcuguggagcucugagacaccugaaccccuacccauc

SEQ ID NO: 503475 - RNA, 64 nt, hsa
agccugggggagcuuuuagguguugagauggggcagcucugaauccuagacccuggaauagccu

SEQ ID NO: 503476 - RNA, 64 nt, hsa
caggagccggcugccgggggggacucaacagcagagcucugagcagcagcaggcaacuucgaga

SEQ ID NO: 503477 - RNA, 64 nt, hsa
aaagagauucuugaccuuauuucuaaacgucuagagcucugaaaugucuugauggaagguauua

SEQ ID NO: 503478 - RNA, 64 nt, hsa
ugauguauaccaugaagucauugucaguuguaguagcucugauguugaaugagauaucauguuu

SEQ ID NO: 503479 - RNA, 64 nt, hsa
uggaaccauggcucuaacugggucaaguccuccuagcucugaagcuaaggcugcagagcugucc

SEQ ID NO: 503480 - RNA, 64 nt, hsa
uccauuccgcaaacucuugugaucuuccaaaauuagcucugauuagcuuucacuuccuguagaa

SEQ ID NO: 503481 - RNA, 64 nt, hsa
gacugaaagaauuccagucagccagagccuuggcagcucugaagcuaaccuuagcaucuaagug

SEQ ID NO: 503482 - RNA, 64 nt, hsa
cugcugcagagcugggcugagaguucugcagucuagcucugacuuaggucaggggccuguuggu

SEQ ID NO: 503483 - RNA, 64 nt, hsa
aaauaacaagagcucuguaauaacaguaauaaauagcucugaaauaacaguccuaagaacuccu

SEQ ID NO: 503484 - RNA, 64 nt, hsa
ccucuuucuguugguugugcccaagggcuacaguagcucugaaauaacaagagcucuguaauaa

SEQ ID NO: 503485 - RNA, 64 nt, hsa
ucauccucucucuaaggcuccaugguuccuacgaagcucugaaaggugggaacaccacagaggc

SEQ ID NO: 503486 - RNA, 64 nt, hsa
uaagcaaaagcaguccccacagccacagccuggcagcucugaucaggaaagugaggaacagcaa

SEQ ID NO: 503487 - RNA, 64 nt, hsa
ugggcuagcagaggccggcccuggccaucgggagagcucugaccugcacaccgcgggaggccag

SEQ ID NO: 503488 - RNA, 64 nt, hsa
uacagggaggggcccugggucuaugcacagcuggagcucugagccuuccacagcccgugugacu

SEQ ID NO: 503489 - RNA, 64 nt, hsa
agccaggaggcuggcaagauggccgaauaggaacagcucugaucugcaguucccagugagauca

SEQ ID NO: 503490 - RNA, 64 nt, hsa
acagcuucagcagacuuaaacauuccugccugccagcucugaagagagcagcaguucuuccagc

SEQ ID NO: 503491 - RNA, 64 nt, hsa
ugucucagcucugaaccugcugucccugcugagaagcucugagggccccucccuggaggaccug

SEQ ID NO: 503492 - RNA, 64 nt, hsa
ugcagaucugugcuggccacgugcccggugucucagcucugaaccugcugucccugcugagaag

SEQ ID NO: 503493 - RNA, 64 nt, hsa
ugccuucuccaucccaguguccacacucuccuccagcucugagcccucccucuccuaggagcac

SEQ ID NO: 503494 - RNA, 64 nt, hsa
agaguuauccgcaccagugauuguugacauugacagcucugagacaaugaaacccugcaaggug

SEQ ID NO: 503495 - RNA, 64 nt, hsa; identical to SEQ ID NO: 305658

SEQ ID NO: 503496 - RNA, 64 nt, hsa; identical to SEQ ID NO: 305659

SEQ ID NO: 503497 - RNA, 64 nt, hsa; identical to SEQ ID NO: 305660

SEQ ID NO: 503498 - RNA, 64 nt, hsa; identical to SEQ ID NO: 305661

SEQ ID NO: 503499 - RNA, 64 nt, hsa; identical to SEQ ID NO: 305662

SEQ ID NO: 503500 - RNA, 64 nt, hsa; identical to SEQ ID NO: 305663

SEQ ID NO: 503501 - RNA, 64 nt, hsa; identical to SEQ ID NO: 305664

SEQ ID NO: 503502 - RNA, 64 nt, hsa; identical to SEQ ID NO: 305665

SEQ ID NO: 503503 - RNA, 64 nt, hsa; identical to SEQ ID NO: 305666

SEQ ID NO: 503504 - RNA, 64 nt, hsa; identical to SEQ ID NO: 305667

SEQ ID NO: 503505 - RNA, 64 nt, hsa; identical to SEQ ID NO: 305668

SEQ ID NO: 503506 - RNA, 64 nt, hsa; identical to SEQ ID NO: 305669

SEQ ID NO: 503507 - RNA, 64 nt, hsa; identical to SEQ ID NO: 305670

SEQ ID NO: 503508 - RNA, 64 nt, hsa; identical to SEQ ID NO: 305671

SEQ ID NO: 503509 - RNA, 64 nt, hsa; identical to SEQ ID NO: 305672

SEQ ID NO: 503510 - RNA, 64 nt, hsa; identical to SEQ ID NO: 305673

SEQ ID NO: 503511 - RNA, 64 nt, hsa; identical to SEQ ID NO: 305674

SEQ ID NO: 503512 - RNA, 64 nt, hsa; identical to SEQ ID NO: 305675

SEQ ID NO: 503513 - RNA, 64 nt, hsa; identical to SEQ ID NO: 305676

SEQ ID NO: 503514 - RNA, 64 nt, hsa; identical to SEQ ID NO: 305677

SEQ ID NO: 503515 - RNA, 64 nt, hsa; identical to SEQ ID NO: 305678

SEQ ID NO: 503516 - RNA, 64 nt, hsa; identical to SEQ ID NO: 305679

SEQ ID NO: 503517 - RNA, 64 nt, hsa; identical to SEQ ID NO: 305680

SEQ ID NO: 503518 - RNA, 64 nt, hsa; identical to SEQ ID NO: 305681

SEQ ID NO: 503519 - RNA, 64 nt, hsa; identical to SEQ ID NO: 305682

SEQ ID NO: 503520 - RNA, 64 nt, hsa; identical to SEQ ID NO: 305683

SEQ ID NO: 503521 - RNA, 64 nt, hsa; identical to SEQ ID NO: 305684

SEQ ID NO: 503522 - RNA, 64 nt, hsa; identical to SEQ ID NO: 305685

SEQ ID NO: 503523 - RNA, 64 nt, hsa; identical to SEQ ID NO: 305686

SEQ ID NO: 503524 - RNA, 64 nt, hsa; identical to SEQ ID NO: 305687

SEQ ID NO: 503525 - RNA, 64 nt, hsa; identical to SEQ ID NO: 305688

SEQ ID NO: 503526 - RNA, 64 nt, hsa; identical to SEQ ID NO: 305689

SEQ ID NO: 503527 - RNA, 64 nt, hsa; identical to SEQ ID NO: 305690

SEQ ID NO: 503528 - RNA, 64 nt, hsa; identical to SEQ ID NO: 305691

SEQ ID NO: 503529 - RNA, 64 nt, hsa; identical to SEQ ID NO: 305692

SEQ ID NO: 503530 - RNA, 64 nt, hsa; identical to SEQ ID NO: 305693

SEQ ID NO: 503531 - RNA, 64 nt, hsa; identical to SEQ ID NO: 305694

SEQ ID NO: 503532 - RNA, 64 nt, hsa; identical to SEQ ID NO: 156567

SEQ ID NO: 503533 - RNA, 64 nt, hsa; identical to SEQ ID NO: 156568

SEQ ID NO: 503534 - RNA, 64 nt, hsa; identical to SEQ ID NO: 156569

SEQ ID NO: 503535 - RNA, 64 nt, hsa; identical to SEQ ID NO: 156570

SEQ ID NO: 503536 - RNA, 64 nt, hsa; identical to SEQ ID NO: 156571

SEQ ID NO: 503537 - RNA, 64 nt, hsa; identical to SEQ ID NO: 156572

SEQ ID NO: 503538 - RNA, 64 nt, hsa; identical to SEQ ID NO: 156573

SEQ ID NO: 503539 - RNA, 64 nt, hsa; identical to SEQ ID NO: 156574

SEQ ID NO: 503540 - RNA, 64 nt, hsa; identical to SEQ ID NO: 156575

SEQ ID NO: 503541 - RNA, 64 nt, hsa; identical to SEQ ID NO: 156576

SEQ ID NO: 503542 - RNA, 64 nt, hsa; identical to SEQ ID NO: 156577

SEQ ID NO: 503543 - RNA, 64 nt, hsa; identical to SEQ ID NO: 156578

SEQ ID NO: 503544 - RNA, 64 nt, hsa; identical to SEQ ID NO: 156579

SEQ ID NO: 503545 - RNA, 64 nt, hsa; identical to SEQ ID NO: 156580

SEQ ID NO: 503546 - RNA, 64 nt, hsa; identical to SEQ ID NO: 156581

SEQ ID NO: 503547 - RNA, 64 nt, hsa; identical to SEQ ID NO: 156582

SEQ ID NO: 503548 - RNA, 64 nt, hsa; identical to SEQ ID NO: 156583

SEQ ID NO: 503549 - RNA, 64 nt, hsa; identical to SEQ ID NO: 156584

SEQ ID NO: 503550 - RNA, 64 nt, hsa; identical to SEQ ID NO: 156585

SEQ ID NO: 503551 - RNA, 64 nt, hsa; identical to SEQ ID NO: 156586

SEQ ID NO: 503552 - RNA, 64 nt, hsa; identical to SEQ ID NO: 156587

SEQ ID NO: 503553 - RNA, 64 nt, hsa; identical to SEQ ID NO: 156588

SEQ ID NO: 503554 - RNA, 64 nt, hsa; identical to SEQ ID NO: 156589

SEQ ID NO: 503555 - RNA, 64 nt, hsa; identical to SEQ ID NO: 156590

SEQ ID NO: 503556 - RNA, 64 nt, hsa; identical to SEQ ID NO: 156591

SEQ ID NO: 503557 - RNA, 64 nt, hsa; identical to SEQ ID NO: 156592

SEQ ID NO: 503558 - RNA, 64 nt, hsa; identical to SEQ ID NO: 156593

SEQ ID NO: 503559 - RNA, 64 nt, hsa; identical to SEQ ID NO: 156594

SEQ ID NO: 503560 - RNA, 64 nt, hsa; identical to SEQ ID NO: 156595

SEQ ID NO: 503561 - RNA, 64 nt, hsa; identical to SEQ ID NO: 156596

SEQ ID NO: 503562 - RNA, 64 nt, hsa; identical to SEQ ID NO: 156597

SEQ ID NO: 503563 - RNA, 64 nt, hsa; identical to SEQ ID NO: 156598

SEQ ID NO: 503564 - RNA, 64 nt, hsa; identical to SEQ ID NO: 156599

SEQ ID NO: 503565 - RNA, 64 nt, hsa; identical to SEQ ID NO: 156600

SEQ ID NO: 503566 - RNA, 64 nt, hsa; identical to SEQ ID NO: 156601

SEQ ID NO: 503567 - RNA, 64 nt, hsa; identical to SEQ ID NO: 156602

SEQ ID NO: 503568 - RNA, 64 nt, hsa; identical to SEQ ID NO: 156603

SEQ ID NO: 503569 - RNA, 64 nt, hsa; identical to SEQ ID NO: 156604

SEQ ID NO: 503570 - RNA, 64 nt, hsa; identical to SEQ ID NO: 156605

SEQ ID NO: 503571 - RNA, 64 nt, hsa; identical to SEQ ID NO: 156606

SEQ ID NO: 503572 - RNA, 64 nt, hsa; identical to SEQ ID NO: 156607

SEQ ID NO: 503573 - RNA, 64 nt, hsa
uguccuuggucuucugaagauucagguccuccucuccggguagcuuagaaguaaggagguuggu

SEQ ID NO: 503574 - RNA, 64 nt, hsa
uuugguuuacugcuuuguaaauaaaaggaaaaacuccggguauauguauagauguucuucauua

SEQ ID NO: 503575 - RNA, 64 nt, hsa
uguuguauagcaaucgcuuuuuaccuuucaaaguuccggguaaaaauguguuauaucuguaguu

SEQ ID NO: 503576 - RNA, 64 nt, hsa
caauuuacaaauuuucaacuuuaugauagguuuauccggguacuaaaugcauuucaacuugaua

SEQ ID NO: 503577 - RNA, 64 nt, hsa
agaucacugacacugcaaaaacaaagcaaacugcuccggguaccaggacuuccuccaaccuggc

SEQ ID NO: 503578 - RNA, 64 nt, hsa
cccaguucaucucuauguccuguucacugaauauuccggguaauugaaagaaaauauaauggau

SEQ ID NO: 503579 - RNA, 64 nt, hsa
acagccgcugcaauacacagucuugacggugccauccggguacucccuccucuugaaccgggcu

SEQ ID NO: 503580 - RNA, 64 nt, hsa
uuuuccccacucugucugccugcaucuccucuguuccggguaggccuugauaucaccucuggga

SEQ ID NO: 503581 - RNA, 64 nt, hsa
caucucuacaaaaaauaaaaacacuuaaaaauuauccggguaccgugcaugugcagucccagcu

SEQ ID NO: 503582 - RNA, 64 nt, hsa
cucccgggcuugagcgauucuugugucucagucuuccggguagcugggacuacaggugugcacc

SEQ ID NO: 503583 - RNA, 64 nt, hsa
gccaccccccggcugagacuuugcccugaacuuguccggguagggagggccggaggcauguggc

SEQ ID NO: 503584 - RNA, 64 nt, hsa
gccuugcaacacauuuugauauauuagccaugcuuccggguaaaggcaagccccaaacuccuua

SEQ ID NO: 503585 - RNA, 64 nt, hsa
gccucucaaccaaaagguguuccucuuuaagggcuccggguacuggcagugggacgagcuagcc

SEQ ID NO: 503586 - RNA, 64 nt, hsa
ccgaggcaggugcaggauucgccauggugcagccuccggguacaaacaucugaggcacuggcga

SEQ ID NO: 503587 - RNA, 64 nt, hsa
ccaucagugucauuaccaaagcuggcugcgcuucuccggguauuuaguacuguggugaggagca

SEQ ID NO: 503588 - RNA, 64 nt, hsa
ccaucagugucaucaccaaagcuggcugcgcuucuccggguauuuaguacugugcugaggagca

SEQ ID NO: 503589 - RNA, 63 nt, hsa
acuucuuuuuuauaaagcaauaaauccauuuuccuccggguaagggaugccccuucuggcaua

SEQ ID NO: 503590 - RNA, 64 nt, hsa
ucagcuucccuuccccaccuggagccagggacuguccggguagccaguuuugguccugccagcu

SEQ ID NO: 503591 - RNA, 64 nt, hsa
ugauuaaaguauaaauuaagacacccuauugacuuccggguaaggggagucaauugauuaccca

SEQ ID NO: 503592 - RNA, 64 nt, hsa
cuggggcccagcaccccuccucgccccauccccguccggguacgggggcgcggcaggggucccc

SEQ ID NO: 503593 - RNA, 64 nt, hsa
cuuuuccuccaugucuguuacucacuuucagcaguccggguaaaaucuguggaucaggguuaaa

SEQ ID NO: 503594 - RNA, 64 nt, hsa
cuugacaagcaccgcucuguaugaauuuuacuaguccggguaccucauauaagaaaacuuaagu

SEQ ID NO: 503595 - RNA, 64 nt, hsa
uccucuacuuccuucugaguccucuacaaagacauccggguacuacauuuccaucccuucccua

SEQ ID NO: 503596 - RNA, 64 nt, hsa
gcuccucuuccuccuuucuuggcgggugggagacuccggguagccgcacugcagaagcaacagc

SEQ ID NO: 503597 - RNA, 64 nt, hsa
aggcaggaggguugaagucagaauuucacgacaguccggguaacauaaugagaccuguccucua

SEQ ID NO: 503598 - RNA, 64 nt, hsa
ggauuacuuugaaaaggguuuacuagugugguccuccggguagaauuuagcuguaagcauguug

SEQ ID NO: 503599 - RNA, 64 nt, hsa
guauauguucuuuauauuuuaaugugaguauauacacuaagaacaaacuaaauugugauuuaug

SEQ ID NO: 503600 - RNA, 64 nt, hsa
uuuuucugugaaacuucauauugcugaagacauacacuaagaauuuauguagauaauguacuuu

SEQ ID NO: 503601 - RNA, 64 nt, hsa
ucugggggcaggcucagcaucugcccacuggucucacuaagagcuuucagauuucccuccauag

SEQ ID NO: 503602 - RNA, 64 nt, hsa
aagaaaaaaaucaaaaugcagaaaauguguggugcacuaagaugaucacacagcauuaaaacua

SEQ ID NO: 503603 - RNA, 64 nt, hsa
aucuaaaaaacccucgacccgaaacccucaccagauaaacuacaguuuguuuaggaggcccuga

SEQ ID NO: 503604 - RNA, 64 nt, hsa
aauaaauaauuuuagaacagccuuuuuuucuuccauaaacuacuauugugaucuauuuuuucca

SEQ ID NO: 503605 - RNA, 64 nt, hsa
uuaauguuauuucuguaaacuuugagcuuuguuaauaaacuauuaugcagcaucuacacuuuga

SEQ ID NO: 503606 - RNA, 64 nt, hsa
uauaguaucagaacuuggguugauuucaauguuaauaaacuaggcaaaacaaauaacuguuaga

SEQ ID NO: 503607 - RNA, 64 nt, hsa
gcuuauuuuuauuguugcuauuuucaguguauacauaaacuaaaaauuaggguugauuuuuuug

SEQ ID NO: 503608 - RNA, 64 nt, hsa
auuuuuaaauauuuguaauauuguugacugacuaauaaacuauuaaguuauuggcauaguugug

SEQ ID NO: 503609 - RNA, 64 nt, hsa
cgagcaucacaagcuuuugagcgcauggaacuccauaaacuaacaaauuacauaaacuaaaggg

SEQ ID NO: 503610 - RNA, 64 nt, hsa
ugagcgcauggaacuccauaaacuaacaaauuacauaaacuaaagggggauuuucuuucuucuu

SEQ ID NO: 503611 - RNA, 64 nt, hsa
uaaaauggcaugcuauuuggaaauuuaguuugagauaaacuaaaguguguugaugccagaaugu

SEQ ID NO: 503612 - RNA, 64 nt, hsa
caaaaucuuuguuaaaccaaacauucaacacaaaauaaacuagaaggccagaggauaauggaau

SEQ ID NO: 503613 - RNA, 64 nt, hsa
caaaauuaccgaaugccauuuuuaaaaguaugcuauaaacuaugcuacucucauacaggggacc

SEQ ID NO: 503614 - RNA, 64 nt, hsa
gauacuuguuuuuauuaaacauuuugagauuuagauaaacuacauuuuaacugaaugucuaaag

SEQ ID NO: 503615 - RNA, 64 nt, hsa
acuaaauuuuucuaguuucuuaugauacagguucauaaacuacaauauuuggauuuuuuucccc

SEQ ID NO: 503616 - RNA, 64 nt, hsa
aaccagcuuccaaaagaaaccagcauauggcacuauaaacuauuucauuugagcaccauucuuu

SEQ ID NO: 503617 - RNA, 64 nt, hsa
aucagaauuguuaaaacuuuugccaguggaauggauaaacuauugaugaauuguuuccuggguc

SEQ ID NO: 503618 - RNA, 64 nt, hsa
ugaagugaaguuauaaaagggcaaauccagauucauaaacuaucaccucggauuucuuguaauc

SEQ ID NO: 503619 - RNA, 64 nt, hsa
gagcagaauucucacagauuuuaccauuccuguuauaaacuaguauuuguuguuuagccaaaac

SEQ ID NO: 503620 - RNA, 64 nt, hsa
uugcccaaauaacagaaauuuuguucgggaagggauaaacuagauauagcauacagagccuguu

SEQ ID NO: 503621 - RNA, 64 nt, hsa
gugaucaaguuuaaucacaaaucucuuaauauuuauaaacuaccugaugccaggagcuuagggc

SEQ ID NO: 503622 - RNA, 64 nt, hsa
uuugauacaucugugauuuaggucauuaauuuagauaaacuagcucauuauuuccaucuuugga

SEQ ID NO: 503623 - RNA, 64 nt, hsa
acauuugugauucucauuuucucaccauuaaauuaccuuggaggguagggcugugguuuacucc

SEQ ID NO: 503624 - RNA, 64 nt, hsa
uguuuaauggauuccaccccugccuuccuaggugaccuuggacaaauucucgaacccauucacc

SEQ ID NO: 503625 - RNA, 64 nt, hsa
uaaaacauuugaaugaacuguaaaguacagccauaccuuggacaugcaaauauaaaucuaugga

SEQ ID NO: 503626 - RNA, 64 nt, hsa
auuaaaacugaaaaaauuuaaacugaauuuuuugaccuuggaaaauauuuuucuuacuuuacca

SEQ ID NO: 503627 - RNA, 64 nt, hsa
gauuaggaggagccuaugugggguggauuucagcaccuuggacaggagcagauguguggugggg

SEQ ID NO: 503628 - RNA, 64 nt, hsa
cuguggucagaucaagaaagguaugagaggcacaaccuuggaggguaccaagguugcagaagag

SEQ ID NO: 503629 - RNA, 64 nt, hsa
aagccugggaacuugggcaucguugggccagcaggaugagcagcaaagggucugaggacagggu

SEQ ID NO: 503630 - RNA, 64 nt, hsa
gaaguuuaaaaaugggccuuuucugagccccccugaugagcagucagugcuucugggcccagcu

SEQ ID NO: 503631 - RNA, 64 nt, hsa
auuuccuagcuguucuaauuaagaaaacuauuaagaugagcaaccacauuuagaaauguuuauu

SEQ ID NO: 503632 - RNA, 64 nt, hsa
uuguuuguuuuauuuggggcugggggagguauaugaugagcagacuucucggaauucauaauaa

SEQ ID NO: 503633 - RNA, 64 nt, hsa
gguaccccccgccgccccccuggaaagcacaagugaugagcaagaaggcauuuuccuugggaga

SEQ ID NO: 503634 - RNA, 64 nt, hsa
aacuuucccucugugggagacuaugaauauuccugaugagcacaaguaaaacuaaggcuucagc

SEQ ID NO: 503635 - RNA, 64 nt, hsa
gggccuccucacaacauggugucuggauucccaggaugagcaucccaggaucgcaagagccaug

SEQ ID NO: 503636 - RNA, 64 nt, hsa
uggguuuucaucaagacuggaagguggggacagggaugagcauggagcuggccgugggccuggg

SEQ ID NO: 503637 - RNA, 64 nt, hsa; identical to SEQ ID NO: 127462

SEQ ID NO: 503638 - RNA, 64 nt, hsa; identical to SEQ ID NO: 127463

SEQ ID NO: 503639 - RNA, 64 nt, hsa; identical to SEQ ID NO: 127464

SEQ ID NO: 503640 - RNA, 64 nt, hsa; identical to SEQ ID NO: 127465

SEQ ID NO: 503641 - RNA, 64 nt, hsa; identical to SEQ ID NO: 127466

SEQ ID NO: 503642 - RNA, 64 nt, hsa; identical to SEQ ID NO: 127467

SEQ ID NO: 503643 - RNA, 64 nt, hsa; identical to SEQ ID NO: 127468

SEQ ID NO: 503644 - RNA, 64 nt, hsa; identical to SEQ ID NO: 127469

SEQ ID NO: 503645 - RNA, 64 nt, hsa; identical to SEQ ID NO: 127470

SEQ ID NO: 503646 - RNA, 64 nt, hsa; identical to SEQ ID NO: 127471

SEQ ID NO: 503647 - RNA, 64 nt, hsa; identical to SEQ ID NO: 127472

SEQ ID NO: 503648 - RNA, 64 nt, hsa; identical to SEQ ID NO: 127473

SEQ ID NO: 503649 - RNA, 64 nt, hsa; identical to SEQ ID NO: 127474

SEQ ID NO: 503650 - RNA, 64 nt, hsa; identical to SEQ ID NO: 127475

SEQ ID NO: 503651 - RNA, 64 nt, hsa; identical to SEQ ID NO: 127476

SEQ ID NO: 503652 - RNA, 64 nt, hsa; identical to SEQ ID NO: 127477

SEQ ID NO: 503653 - RNA, 64 nt, hsa; identical to SEQ ID NO: 127476

SEQ ID NO: 503654 - RNA, 64 nt, hsa; identical to SEQ ID NO: 127477

SEQ ID NO: 503655 - RNA, 64 nt, hsa; identical to SEQ ID NO: 127480

SEQ ID NO: 503656 - RNA, 64 nt, hsa; identical to SEQ ID NO: 127477

SEQ ID NO: 503657 - RNA, 64 nt, hsa; identical to SEQ ID NO: 127482

SEQ ID NO: 503658 - RNA, 64 nt, hsa; identical to SEQ ID NO: 127483

SEQ ID NO: 503659 - RNA, 64 nt, hsa; identical to SEQ ID NO: 127484

SEQ ID NO: 503660 - RNA, 64 nt, hsa; identical to SEQ ID NO: 127485

SEQ ID NO: 503661 - RNA, 64 nt, hsa; identical to SEQ ID NO: 127486

SEQ ID NO: 503662 - RNA, 64 nt, hsa; identical to SEQ ID NO: 127487

SEQ ID NO: 503663 - RNA, 64 nt, hsa; identical to SEQ ID NO: 127488

SEQ ID NO: 503664 - RNA, 64 nt, hsa; identical to SEQ ID NO: 127489

SEQ ID NO: 503665 - RNA, 64 nt, hsa; identical to SEQ ID NO: 127490

SEQ ID NO: 503666 - RNA, 64 nt, hsa; identical to SEQ ID NO: 127491

SEQ ID NO: 503667 - RNA, 64 nt, hsa; identical to SEQ ID NO: 127492

SEQ ID NO: 503668 - RNA, 64 nt, hsa; identical to SEQ ID NO: 127493

SEQ ID NO: 503669 - RNA, 64 nt, hsa; identical to SEQ ID NO: 127494

SEQ ID NO: 503670 - RNA, 64 nt, hsa; identical to SEQ ID NO: 127495

SEQ ID NO: 503671 - RNA, 64 nt, hsa
gaagcauccugcauugucuuuacccaccaucaucuucacuaagagaaacaugccuacccaugaa

SEQ ID NO: 503672 - RNA, 64 nt, hsa
uuagcugggaccuaaaucuucuggugaaaagcuuuucacuaagugagguuccuucccugcaaau

SEQ ID NO: 503673 - RNA, 64 nt, hsa
guggcucucccccaacccuccccaccguccccccuucacuaaacaucuuucuugccuuaugugc

SEQ ID NO: 503674 - RNA, 64 nt, hsa
guucacugcaagccccagaagcauauggcauguguucacuaagaggccuuuaauccuggggagu

SEQ ID NO: 503675 - RNA, 64 nt, hsa
cucaagcuccuauuacuauuugugguuguauuauuucacuaaucauuaguuaagacugugcuag

SEQ ID NO: 503676 - RNA, 64 nt, hsa
aaaaguguaacacuaaggugaacuugcuucccuuuucacuaauuuugcuaaacuuuguaaugca

SEQ ID NO: 503677 - RNA, 64 nt, hsa
aggagguagaacucaguccucucccuugugagucuucacuaaaaucagugacucacuuccaaag

SEQ ID NO: 503678 - RNA, 64 nt, hsa
aaaauuuugaaaguuguauucucauaugacuaaguucacuaaaacccuggauugaaagugaaaa

SEQ ID NO: 503679 - RNA, 64 nt, hsa
ucaauucaugugaauuuuagcucaauuuucaaaguucacuaauauucucaauauuuaaugcuaa

SEQ ID NO: 503680 - RNA, 64 nt, hsa
uaguaugcaaauuauaaauauacagucuucccacuucacuaaccaaauuccuacuuuccagugu

SEQ ID NO: 503681 - RNA, 64 nt, hsa
cuaaaaugcauuccugcaauucuguuugcagugcuucacuaaacauugaaauaaaguuguaaau

SEQ ID NO: 503682 - RNA, 64 nt, hsa
uucuguguauuaaacuacgaauuacaaauaucacuucacuaaccacuauaauuauuuuuggcuu

SEQ ID NO: 503683 - RNA, 64 nt, hsa
uuuucuagucaguaaacauuuguaaaaauacuguuucacuaauacuuacuguuaacugucuuga

SEQ ID NO: 503684 - RNA, 64 nt, hsa
auugaucaaaaucaaaagguaaugcacauccucauucacuaagccaugccaugcccaggagacu

SEQ ID NO: 503685 - RNA, 64 nt, hsa
caugauauuugacuuuucauaaguaguggaagguuucacuaaguaaaacucucaguuucuuggu

SEQ ID NO: 503686 - RNA, 64 nt, hsa
aaugguauuugacuuuucauaaguaguggaagguuucacuaaguaaagaucugaguuucuuggu

SEQ ID NO: 503687 - RNA, 64 nt, hsa
acauacuccuuguaaccaucaguccaagguucaguucacuaaagugcauguucuaaaacaagag

SEQ ID NO: 503688 - RNA, 64 nt, hsa
uacaacaaucuucaggaagccugcuaucuugggauucacuaauaauaggccaagaacaaaggca

SEQ ID NO: 503689 - RNA, 64 nt, hsa
uucaaaaauaguacaaagagcucucuuacccagauucacuaauuguucauacgugcuuuaucuu

SEQ ID NO: 503690 - RNA, 64 nt, hsa
guugaauagauuauauauuuauucucauaauacuuucacuaauacuaaauaaaauuuggggaac

SEQ ID NO: 503691 - RNA, 64 nt, hsa
uuucucaaucuucaaggcucuaagugcuuaagaauucacuaacagacagaccaucuggaggagc

SEQ ID NO: 503692 - RNA, 64 nt, hsa
gacuuuuuagcauuuugaccuagggccuuuggcuuucacuaaaaguggggaccucaguauccca

SEQ ID NO: 503693 - RNA, 64 nt, hsa
augaacauaaugaaacaccucauuuauuugauaauucacuaauguuuuauauucauauauuagg

SEQ ID NO: 503694 - RNA, 64 nt, hsa
accaacuuucaaaugagcuaacuugggugagacguucacuaaaguaccaagcacaauacaaaug

SEQ ID NO: 503695 - RNA, 64 nt, hsa
gaagucagccuggccaacguggugaaaccccaucuucacuaaaaauacaaaacuuagcugguua

SEQ ID NO: 503696 - RNA, 64 nt, hsa
accccacccucccugcccaucaacuguaucugauuucacuaauuuugacagcacccccaguagg

SEQ ID NO: 503697 - RNA, 64 nt, hsa
uuuauuuaaacugaauuuccaguauauuuuuguuuucacuaacaacagauaagguagagcagug

SEQ ID NO: 503698 - RNA, 64 nt, hsa
uuauacauauacaggucauauaaaauuaccuggauucacuaaauuuguuuguuguuguuguugu

SEQ ID NO: 503699 - RNA, 64 nt, hsa
cauucgguucuacauuauuaacuuuuuuuuucuauauccugaugaccaguaaauuagagccaca

SEQ ID NO: 503700 - RNA, 64 nt, hsa
uuaguuuaacaugcaaacaaccauuguugcuaccuauccugaaucaagccuugagccuaaauca

SEQ ID NO: 503701 - RNA, 64 nt, hsa
ugagaagccuaaaacaaacaaaaaccuuguguguuauccugauauaguugacuaaauguauuug

SEQ ID NO: 503702 - RNA, 64 nt, hsa
cauuagcuauugacuuagagugaauugccuuuuguauccugauucacaacaccuauuccuguuc

SEQ ID NO: 503703 - RNA, 64 nt, hsa
guauugcacuauuuuauuuuauucugcaaaucuguauccugaaguguacauuucaacccauauu

SEQ ID NO: 503704 - RNA, 64 nt, hsa
caugcuuauuccuuaaaaacaacagaagaguguuuauccugagauugguauugcacuauuuuau

SEQ ID NO: 503705 - RNA, 64 nt, hsa
aaagggguuuuucuuaaucaaaguuuuacauuugguagcauaaguaguucuuuaugcuucacag

SEQ ID NO: 503706 - RNA, 64 nt, hsa
caagauaagauuuucuguuuuuugaaauaagucuguagcauaaagguuaaacuauuuuaagaca

SEQ ID NO: 503707 - RNA, 64 nt, hsa; identical to SEQ ID NO: 144070

SEQ ID NO: 503708 - RNA, 64 nt, hsa; identical to SEQ ID NO: 144071

SEQ ID NO: 503709 - RNA, 64 nt, hsa; identical to SEQ ID NO: 144072

SEQ ID NO: 503710 - RNA, 64 nt, hsa; identical to SEQ ID NO: 144073

SEQ ID NO: 503711 - RNA, 64 nt, hsa; identical to SEQ ID NO: 144074

SEQ ID NO: 503712 - RNA, 64 nt, hsa; identical to SEQ ID NO: 144075

SEQ ID NO: 503713 - RNA, 64 nt, hsa; identical to SEQ ID NO: 144076

SEQ ID NO: 503714 - RNA, 64 nt, hsa; identical to SEQ ID NO: 144077

SEQ ID NO: 503715 - RNA, 64 nt, hsa; identical to SEQ ID NO: 144078

SEQ ID NO: 503716 - RNA, 64 nt, hsa; identical to SEQ ID NO: 144079

SEQ ID NO: 503717 - RNA, 64 nt, hsa; identical to SEQ ID NO: 144080

SEQ ID NO: 503718 - RNA, 64 nt, hsa; identical to SEQ ID NO: 144081

SEQ ID NO: 503719 - RNA, 64 nt, hsa; identical to SEQ ID NO: 144082

SEQ ID NO: 503720 - RNA, 64 nt, hsa; identical to SEQ ID NO: 144083

SEQ ID NO: 503721 - RNA, 64 nt, hsa; identical to SEQ ID NO: 144084

SEQ ID NO: 503722 - RNA, 64 nt, hsa; identical to SEQ ID NO: 144085

SEQ ID NO: 503723 - RNA, 64 nt, hsa; identical to SEQ ID NO: 144086

SEQ ID NO: 503724 - RNA, 64 nt, hsa; identical to SEQ ID NO: 144087

SEQ ID NO: 503725 - RNA, 64 nt, hsa; identical to SEQ ID NO: 144088

SEQ ID NO: 503726 - RNA, 64 nt, hsa; identical to SEQ ID NO: 144089

SEQ ID NO: 503727 - RNA, 64 nt, hsa; identical to SEQ ID NO: 144090

SEQ ID NO: 503728 - RNA, 64 nt, hsa; identical to SEQ ID NO: 144091

SEQ ID NO: 503729 - RNA, 64 nt, hsa; identical to SEQ ID NO: 144092

SEQ ID NO: 503730 - RNA, 64 nt, hsa; identical to SEQ ID NO: 144093

SEQ ID NO: 503731 - RNA, 64 nt, hsa; identical to SEQ ID NO: 144094

SEQ ID NO: 503732 - RNA, 64 nt, hsa; identical to SEQ ID NO: 144095

SEQ ID NO: 503733 - RNA, 64 nt, hsa; identical to SEQ ID NO: 144096

SEQ ID NO: 503734 - RNA, 64 nt, hsa; identical to SEQ ID NO: 144097

SEQ ID NO: 503735 - RNA, 64 nt, hsa; identical to SEQ ID NO: 144098

SEQ ID NO: 503736 - RNA, 64 nt, hsa; identical to SEQ ID NO: 144099

SEQ ID NO: 503737 - RNA, 64 nt, hsa; identical to SEQ ID NO: 144100

SEQ ID NO: 503738 - RNA, 64 nt, hsa; identical to SEQ ID NO: 144101

SEQ ID NO: 503739 - RNA, 64 nt, hsa; identical to SEQ ID NO: 144102

SEQ ID NO: 503740 - RNA, 64 nt, hsa; identical to SEQ ID NO: 144103

SEQ ID NO: 503741 - RNA, 64 nt, hsa; identical to SEQ ID NO: 144104

SEQ ID NO: 503742 - RNA, 64 nt, hsa; identical to SEQ ID NO: 144105

SEQ ID NO: 503743 - RNA, 64 nt, hsa; identical to SEQ ID NO: 144106

SEQ ID NO: 503744 - RNA, 64 nt, hsa; identical to SEQ ID NO: 144107

SEQ ID NO: 503745 - RNA, 64 nt, hsa; identical to SEQ ID NO: 144108

SEQ ID NO: 503746 - RNA, 64 nt, hsa; identical to SEQ ID NO: 144109

SEQ ID NO: 503747 - RNA, 64 nt, hsa; identical to SEQ ID NO: 144110

SEQ ID NO: 503748 - RNA, 64 nt, hsa; identical to SEQ ID NO: 144111

SEQ ID NO: 503749 - RNA, 64 nt, hsa; identical to SEQ ID NO: 144112

SEQ ID NO: 503750 - RNA, 64 nt, hsa; identical to SEQ ID NO: 144113

SEQ ID NO: 503751 - RNA, 64 nt, hsa; identical to SEQ ID NO: 144114

SEQ ID NO: 503752 - RNA, 64 nt, hsa; identical to SEQ ID NO: 144115

SEQ ID NO: 503753 - RNA, 64 nt, hsa; identical to SEQ ID NO: 144116

SEQ ID NO: 503754 - RNA, 64 nt, hsa; identical to SEQ ID NO: 144117

SEQ ID NO: 503755 - RNA, 64 nt, hsa; identical to SEQ ID NO: 144118

SEQ ID NO: 503756 - RNA, 64 nt, hsa; identical to SEQ ID NO: 144119

SEQ ID NO: 503757 - RNA, 64 nt, hsa; identical to SEQ ID NO: 144120

SEQ ID NO: 503758 - RNA, 64 nt, hsa; identical to SEQ ID NO: 144121

SEQ ID NO: 503759 - RNA, 64 nt, hsa; identical to SEQ ID NO: 144122

SEQ ID NO: 503760 - RNA, 64 nt, hsa; identical to SEQ ID NO: 144123

SEQ ID NO: 503761 - RNA, 64 nt, hsa; identical to SEQ ID NO: 144124

SEQ ID NO: 503762 - RNA, 64 nt, hsa; identical to SEQ ID NO: 144125

SEQ ID NO: 503763 - RNA, 64 nt, hsa; identical to SEQ ID NO: 144126

SEQ ID NO: 503764 - RNA, 64 nt, hsa; identical to SEQ ID NO: 144127

SEQ ID NO: 503765 - RNA, 64 nt, hsa; identical to SEQ ID NO: 144128

SEQ ID NO: 503766 - RNA, 64 nt, hsa; identical to SEQ ID NO: 144129

SEQ ID NO: 503767 - RNA, 64 nt, hsa; identical to SEQ ID NO: 144130

SEQ ID NO: 503768 - RNA, 64 nt, hsa; identical to SEQ ID NO: 144131

SEQ ID NO: 503769 - RNA, 64 nt, hsa; identical to SEQ ID NO: 144132

SEQ ID NO: 503770 - RNA, 64 nt, hsa; identical to SEQ ID NO: 144133

SEQ ID NO: 503771 - RNA, 64 nt, hsa; identical to SEQ ID NO: 144134

SEQ ID NO: 503772 - RNA, 64 nt, hsa; identical to SEQ ID NO: 144135

SEQ ID NO: 503773 - RNA, 64 nt, hsa; identical to SEQ ID NO: 144136

SEQ ID NO: 503774 - RNA, 64 nt, hsa; identical to SEQ ID NO: 144137

SEQ ID NO: 503775 - RNA, 64 nt, hsa; identical to SEQ ID NO: 144138

SEQ ID NO: 503776 - RNA, 64 nt, hsa; identical to SEQ ID NO: 144139

SEQ ID NO: 503777 - RNA, 64 nt, hsa; identical to SEQ ID NO: 144140

SEQ ID NO: 503778 - RNA, 64 nt, hsa; identical to SEQ ID NO: 144141

SEQ ID NO: 503779 - RNA, 64 nt, hsa; identical to SEQ ID NO: 144142

SEQ ID NO: 503780 - RNA, 64 nt, hsa; identical to SEQ ID NO: 144143

SEQ ID NO: 503781 - RNA, 64 nt, hsa; identical to SEQ ID NO: 144144

SEQ ID NO: 503782 - RNA, 64 nt, hsa; identical to SEQ ID NO: 144145

SEQ ID NO: 503783 - RNA, 64 nt, hsa; identical to SEQ ID NO: 144146

SEQ ID NO: 503784 - RNA, 64 nt, hsa; identical to SEQ ID NO: 144147

SEQ ID NO: 503785 - RNA, 64 nt, hsa; identical to SEQ ID NO: 144148

SEQ ID NO: 503786 - RNA, 64 nt, hsa; identical to SEQ ID NO: 144149

SEQ ID NO: 503787 - RNA, 64 nt, hsa; identical to SEQ ID NO: 144150

SEQ ID NO: 503788 - RNA, 64 nt, hsa; identical to SEQ ID NO: 144151

SEQ ID NO: 503789 - RNA, 64 nt, hsa; identical to SEQ ID NO: 144152

SEQ ID NO: 503790 - RNA, 64 nt, hsa; identical to SEQ ID NO: 144153

SEQ ID NO: 503791 - RNA, 64 nt, hsa; identical to SEQ ID NO: 144154

SEQ ID NO: 503792 - RNA, 64 nt, hsa; identical to SEQ ID NO: 144155

SEQ ID NO: 503793 - RNA, 64 nt, hsa
uucaguguaauccuuuauaucagaguaaucuuucaggaacuaaaauagcaauuguuaauaaaau

SEQ ID NO: 503794 - RNA, 64 nt, hsa
cuucgaggcuguagauuccaaguaucuuaaaagaaggaacuauaaacauugcacugaaaacuug

SEQ ID NO: 503795 - RNA, 64 nt, hsa
uuaaaaaucuauggcagaaaaauggucaaggaauaggaacuacaacuucauaaaugaggaacca

SEQ ID NO: 503796 - RNA, 64 nt, hsa
uaguauugccuaugauaaucguuagucaucauuaaggaacuaaguauuauguacuccuugccuu

SEQ ID NO: 503797 - RNA, 64 nt, hsa
uucgcuacuaguuauucagagcguacuuuguuccaggaacuaugcuggaaacugauaguucacu

SEQ ID NO: 503798 - RNA, 64 nt, hsa
uuacuacauaguuauucagagccuacuguguuccaggaacuaugcuagaaacugucucucuagg

SEQ ID NO: 503799 - RNA, 64 nt, hsa
gcagcagccuguguagucugcccccgggaaacugaggaacuaaagaaagcugaaggugcccacc

SEQ ID NO: 503800 - RNA, 64 nt, hsa
cccugccagccccuaacuacccuccccagccuccaggaacuauccauccacucuuaucuccaug

SEQ ID NO: 503801 - RNA, 64 nt, hsa
cugugucugcauguaagagugagggagggaaggaaggaacuacaagagagucggagaugaugca

SEQ ID NO: 503802 - RNA, 64 nt, hsa
caagcagcuagacuggugaauugggggaaauagaaggaacuaguaacugagacuccuccagccu

SEQ ID NO: 503803 - RNA, 64 nt, hsa
cuuggcagauucuacaagucuauuaugacaaaccaggaacuaauucuauaauggaaaacuaucc

SEQ ID NO: 503804 - RNA, 64 nt, hsa
cuccuaugcuaaauuaccuguaaauauucuggauaggaacuacuugaaauaguaauuuguuaaa

SEQ ID NO: 503805 - RNA, 64 nt, hsa
gcuggauccgaguagauucccuagggcuuguuggaggaacuaguuugacucccuuauacugugg

SEQ ID NO: 503806 - RNA, 64 nt, hsa
cacaucccagccuaacaccugugagguucauuuuaggaacuaaccucauuagcuauaaggauca

SEQ ID NO: 503807 - RNA, 64 nt, hsa; identical to SEQ ID NO: 74555

SEQ ID NO: 503808 - RNA, 64 nt, hsa; identical to SEQ ID NO: 74556

SEQ ID NO: 503809 - RNA, 64 nt, hsa; identical to SEQ ID NO: 74557

SEQ ID NO: 503810 - RNA, 64 nt, hsa; identical to SEQ ID NO: 74558

SEQ ID NO: 503811 - RNA, 64 nt, hsa; identical to SEQ ID NO: 74559

SEQ ID NO: 503812 - RNA, 64 nt, hsa; identical to SEQ ID NO: 74560

SEQ ID NO: 503813 - RNA, 64 nt, hsa; identical to SEQ ID NO: 56439

SEQ ID NO: 503814 - RNA, 64 nt, hsa; identical to SEQ ID NO: 56440

SEQ ID NO: 503815 - RNA, 64 nt, hsa; identical to SEQ ID NO: 56441

SEQ ID NO: 503816 - RNA, 64 nt, hsa; identical to SEQ ID NO: 56442

SEQ ID NO: 503817 - RNA, 64 nt, hsa; identical to SEQ ID NO: 56443

SEQ ID NO: 503818 - RNA, 64 nt, hsa; identical to SEQ ID NO: 56444

SEQ ID NO: 503819 - RNA, 64 nt, hsa; identical to SEQ ID NO: 56445

SEQ ID NO: 503820 - RNA, 64 nt, hsa; identical to SEQ ID NO: 56446

SEQ ID NO: 503821 - RNA, 64 nt, hsa; identical to SEQ ID NO: 56447

SEQ ID NO: 503822 - RNA, 64 nt, hsa; identical to SEQ ID NO: 56448

SEQ ID NO: 503823 - RNA, 64 nt, hsa; identical to SEQ ID NO: 56449

SEQ ID NO: 503824 - RNA, 64 nt, hsa; identical to SEQ ID NO: 56450

SEQ ID NO: 503825 - RNA, 64 nt, hsa; identical to SEQ ID NO: 56451

SEQ ID NO: 503826 - RNA, 64 nt, hsa; identical to SEQ ID NO: 56452

SEQ ID NO: 503827 - RNA, 64 nt, hsa; identical to SEQ ID NO: 56453

SEQ ID NO: 503828 - RNA, 64 nt, hsa; identical to SEQ ID NO: 56454

SEQ ID NO: 503829 - RNA, 64 nt, hsa; identical to SEQ ID NO: 56455

SEQ ID NO: 503830 - RNA, 64 nt, hsa; identical to SEQ ID NO: 56456

SEQ ID NO: 503831 - RNA, 64 nt, hsa; identical to SEQ ID NO: 56457

SEQ ID NO: 503832 - RNA, 64 nt, hsa; identical to SEQ ID NO: 56458

SEQ ID NO: 503833 - RNA, 64 nt, hsa; identical to SEQ ID NO: 56459

SEQ ID NO: 503834 - RNA, 64 nt, hsa; identical to SEQ ID NO: 56460

SEQ ID NO: 503835 - RNA, 64 nt, hsa; identical to SEQ ID NO: 56461

SEQ ID NO: 503836 - RNA, 64 nt, hsa; identical to SEQ ID NO: 56462

SEQ ID NO: 503837 - RNA, 64 nt, hsa; identical to SEQ ID NO: 56463

SEQ ID NO: 503838 - RNA, 64 nt, hsa; identical to SEQ ID NO: 56464

SEQ ID NO: 503839 - RNA, 64 nt, hsa; identical to SEQ ID NO: 56465

SEQ ID NO: 503840 - RNA, 64 nt, hsa; identical to SEQ ID NO: 56466

SEQ ID NO: 503841 - RNA, 64 nt, hsa; identical to SEQ ID NO: 56467

SEQ ID NO: 503842 - RNA, 50 nt, hsa; identical to SEQ ID NO: 56468

SEQ ID NO: 503843 - RNA, 64 nt, hsa; identical to SEQ ID NO: 56469

SEQ ID NO: 503844 - RNA, 64 nt, hsa; identical to SEQ ID NO: 56470

SEQ ID NO: 503845 - RNA, 64 nt, hsa; identical to SEQ ID NO: 56471

SEQ ID NO: 503846 - RNA, 64 nt, hsa; identical to SEQ ID NO: 56472

SEQ ID NO: 503847 - RNA, 64 nt, hsa; identical to SEQ ID NO: 56473

SEQ ID NO: 503848 - RNA, 64 nt, hsa; identical to SEQ ID NO: 56474

SEQ ID NO: 503849 - RNA, 64 nt, hsa; identical to SEQ ID NO: 56475

SEQ ID NO: 503850 - RNA, 64 nt, hsa; identical to SEQ ID NO: 56476

SEQ ID NO: 503851 - RNA, 64 nt, hsa; identical to SEQ ID NO: 56477

SEQ ID NO: 503852 - RNA, 64 nt, hsa; identical to SEQ ID NO: 56478

SEQ ID NO: 503853 - RNA, 64 nt, hsa; identical to SEQ ID NO: 56479

SEQ ID NO: 503854 - RNA, 64 nt, hsa; identical to SEQ ID NO: 56480

SEQ ID NO: 503855 - RNA, 64 nt, hsa; identical to SEQ ID NO: 56481

SEQ ID NO: 503856 - RNA, 64 nt, hsa; identical to SEQ ID NO: 56482

SEQ ID NO: 503857 - RNA, 64 nt, hsa; identical to SEQ ID NO: 56483

SEQ ID NO: 503858 - RNA, 64 nt, hsa; identical to SEQ ID NO: 56484

SEQ ID NO: 503859 - RNA, 64 nt, hsa; identical to SEQ ID NO: 56485

SEQ ID NO: 503860 - RNA, 64 nt, hsa; identical to SEQ ID NO: 56486

SEQ ID NO: 503861 - RNA, 64 nt, hsa; identical to SEQ ID NO: 56487

SEQ ID NO: 503862 - RNA, 64 nt, hsa; identical to SEQ ID NO: 56488

SEQ ID NO: 503863 - RNA, 64 nt, hsa; identical to SEQ ID NO: 56489

SEQ ID NO: 503864 - RNA, 64 nt, hsa; identical to SEQ ID NO: 56490

SEQ ID NO: 503865 - RNA, 64 nt, hsa; identical to SEQ ID NO: 56491

SEQ ID NO: 503866 - RNA, 64 nt, hsa; identical to SEQ ID NO: 56492

SEQ ID NO: 503867 - RNA, 64 nt, hsa; identical to SEQ ID NO: 56493

SEQ ID NO: 503868 - RNA, 64 nt, hsa; identical to SEQ ID NO: 56494

SEQ ID NO: 503869 - RNA, 64 nt, hsa; identical to SEQ ID NO: 56495

SEQ ID NO: 503870 - RNA, 64 nt, hsa; identical to SEQ ID NO: 56496

SEQ ID NO: 503871 - RNA, 64 nt, hsa; identical to SEQ ID NO: 56497

SEQ ID NO: 503872 - RNA, 64 nt, hsa; identical to SEQ ID NO: 56498

SEQ ID NO: 503873 - RNA, 64 nt, hsa; identical to SEQ ID NO: 56499

SEQ ID NO: 503874 - RNA, 64 nt, hsa; identical to SEQ ID NO: 56500

SEQ ID NO: 503875 - RNA, 64 nt, hsa; identical to SEQ ID NO: 56501

SEQ ID NO: 503876 - RNA, 64 nt, hsa; identical to SEQ ID NO: 56502

SEQ ID NO: 503877 - RNA, 64 nt, hsa; identical to SEQ ID NO: 56503

SEQ ID NO: 503878 - RNA, 64 nt, hsa; identical to SEQ ID NO: 56504

SEQ ID NO: 503879 - RNA, 64 nt, hsa; identical to SEQ ID NO: 56505

SEQ ID NO: 503880 - RNA, 64 nt, hsa; identical to SEQ ID NO: 56506

SEQ ID NO: 503881 - RNA, 64 nt, hsa; identical to SEQ ID NO: 56507

SEQ ID NO: 503882 - RNA, 64 nt, hsa; identical to SEQ ID NO: 56508

SEQ ID NO: 503883 - RNA, 64 nt, hsa; identical to SEQ ID NO: 56509

SEQ ID NO: 503884 - RNA, 64 nt, hsa; identical to SEQ ID NO: 56510

SEQ ID NO: 503885 - RNA, 64 nt, hsa; identical to SEQ ID NO: 56511

SEQ ID NO: 503886 - RNA, 64 nt, hsa; identical to SEQ ID NO: 56512

SEQ ID NO: 503887 - RNA, 64 nt, hsa; identical to SEQ ID NO: 56513

SEQ ID NO: 503888 - RNA, 64 nt, hsa; identical to SEQ ID NO: 56514

SEQ ID NO: 503889 - RNA, 64 nt, hsa; identical to SEQ ID NO: 56515

SEQ ID NO: 503890 - RNA, 64 nt, hsa; identical to SEQ ID NO: 56516

SEQ ID NO: 503891 - RNA, 64 nt, hsa; identical to SEQ ID NO: 56517

SEQ ID NO: 503892 - RNA, 64 nt, hsa; identical to SEQ ID NO: 56518

SEQ ID NO: 503893 - RNA, 64 nt, hsa; identical to SEQ ID NO: 56519

SEQ ID NO: 503894 - RNA, 64 nt, hsa; identical to SEQ ID NO: 56520

SEQ ID NO: 503895 - RNA, 64 nt, hsa; identical to SEQ ID NO: 56521

SEQ ID NO: 503896 - RNA, 64 nt, hsa; identical to SEQ ID NO: 56522

SEQ ID NO: 503897 - RNA, 64 nt, hsa; identical to SEQ ID NO: 56523

SEQ ID NO: 503898 - RNA, 64 nt, hsa; identical to SEQ ID NO: 56524

SEQ ID NO: 503899 - RNA, 64 nt, hsa; identical to SEQ ID NO: 56525

SEQ ID NO: 503900 - RNA, 64 nt, hsa; identical to SEQ ID NO: 56526

SEQ ID NO: 503901 - RNA, 64 nt, hsa; identical to SEQ ID NO: 56527

SEQ ID NO: 503902 - RNA, 64 nt, hsa; identical to SEQ ID NO: 56528

SEQ ID NO: 503903 - RNA, 64 nt, hsa; identical to SEQ ID NO: 56529

SEQ ID NO: 503904 - RNA, 64 nt, hsa; identical to SEQ ID NO: 56530

SEQ ID NO: 503905 - RNA, 64 nt, hsa; identical to SEQ ID NO: 56531

SEQ ID NO: 503906 - RNA, 64 nt, hsa; identical to SEQ ID NO: 56532

SEQ ID NO: 503907 - RNA, 64 nt, hsa; identical to SEQ ID NO: 56533

SEQ ID NO: 503908 - RNA, 64 nt, hsa; identical to SEQ ID NO: 56534

SEQ ID NO: 503909 - RNA, 59 nt, hsa; identical to SEQ ID NO: 56535

SEQ ID NO: 503910 - RNA, 64 nt, hsa; identical to SEQ ID NO: 56536

SEQ ID NO: 503911 - RNA, 64 nt, hsa; identical to SEQ ID NO: 56537

SEQ ID NO: 503912 - RNA, 64 nt, hsa; identical to SEQ ID NO: 56538

SEQ ID NO: 503913 - RNA, 64 nt, hsa; identical to SEQ ID NO: 56539

SEQ ID NO: 503914 - RNA, 64 nt, hsa; identical to SEQ ID NO: 56540

SEQ ID NO: 503915 - RNA, 64 nt, hsa; identical to SEQ ID NO: 56541

SEQ ID NO: 503916 - RNA, 64 nt, hsa; identical to SEQ ID NO: 56542

SEQ ID NO: 503917 - RNA, 64 nt, hsa; identical to SEQ ID NO: 56543

SEQ ID NO: 503918 - RNA, 64 nt, hsa; identical to SEQ ID NO: 56544

SEQ ID NO: 503919 - RNA, 64 nt, hsa; identical to SEQ ID NO: 56545

SEQ ID NO: 503920 - RNA, 64 nt, hsa; identical to SEQ ID NO: 56546

SEQ ID NO: 503921 - RNA, 64 nt, hsa; identical to SEQ ID NO: 56547

SEQ ID NO: 503922 - RNA, 64 nt, hsa; identical to SEQ ID NO: 56548

SEQ ID NO: 503923 - RNA, 64 nt, hsa; identical to SEQ ID NO: 56549

SEQ ID NO: 503924 - RNA, 64 nt, hsa; identical to SEQ ID NO: 56550

SEQ ID NO: 503925 - RNA, 64 nt, hsa; identical to SEQ ID NO: 56551

SEQ ID NO: 503926 - RNA, 64 nt, hsa; identical to SEQ ID NO: 56552

SEQ ID NO: 503927 - RNA, 64 nt, hsa; identical to SEQ ID NO: 56553

SEQ ID NO: 503928 - RNA, 64 nt, hsa; identical to SEQ ID NO: 56554

SEQ ID NO: 503929 - RNA, 64 nt, hsa; identical to SEQ ID NO: 56555

SEQ ID NO: 503930 - RNA, 64 nt, hsa; identical to SEQ ID NO: 56556

SEQ ID NO: 503931 - RNA, 62 nt, hsa; identical to SEQ ID NO: 56557

SEQ ID NO: 503932 - RNA, 58 nt, hsa; identical to SEQ ID NO: 56558

SEQ ID NO: 503933 - RNA, 64 nt, hsa; identical to SEQ ID NO: 56559

SEQ ID NO: 503934 - RNA, 64 nt, hsa; identical to SEQ ID NO: 56560

SEQ ID NO: 503935 - RNA, 64 nt, hsa; identical to SEQ ID NO: 56561

SEQ ID NO: 503936 - RNA, 64 nt, hsa; identical to SEQ ID NO: 56562

SEQ ID NO: 503937 - RNA, 64 nt, hsa; identical to SEQ ID NO: 56563

SEQ ID NO: 503938 - RNA, 64 nt, hsa; identical to SEQ ID NO: 56564

SEQ ID NO: 503939 - RNA, 64 nt, hsa; identical to SEQ ID NO: 56565

SEQ ID NO: 503940 - RNA, 64 nt, hsa; identical to SEQ ID NO: 56566

SEQ ID NO: 503941 - RNA, 64 nt, hsa; identical to SEQ ID NO: 56567

SEQ ID NO: 503942 - RNA, 64 nt, hsa; identical to SEQ ID NO: 56568

SEQ ID NO: 503943 - RNA, 64 nt, hsa; identical to SEQ ID NO: 56569

SEQ ID NO: 503944 - RNA, 64 nt, hsa; identical to SEQ ID NO: 56570

SEQ ID NO: 503945 - RNA, 64 nt, hsa; identical to SEQ ID NO: 56571

SEQ ID NO: 503946 - RNA, 64 nt, hsa; identical to SEQ ID NO: 56572

SEQ ID NO: 503947 - RNA, 64 nt, hsa; identical to SEQ ID NO: 56573

SEQ ID NO: 503948 - RNA, 64 nt, hsa; identical to SEQ ID NO: 56574

SEQ ID NO: 503949 - RNA, 64 nt, hsa; identical to SEQ ID NO: 56575

SEQ ID NO: 503950 - RNA, 64 nt, hsa; identical to SEQ ID NO: 56576

SEQ ID NO: 503951 - RNA, 64 nt, hsa; identical to SEQ ID NO: 56577

SEQ ID NO: 503952 - RNA, 64 nt, hsa; identical to SEQ ID NO: 56578

SEQ ID NO: 503953 - RNA, 64 nt, hsa; identical to SEQ ID NO: 56579

SEQ ID NO: 503954 - RNA, 64 nt, hsa; identical to SEQ ID NO: 56580

SEQ ID NO: 503955 - RNA, 64 nt, hsa; identical to SEQ ID NO: 56581

SEQ ID NO: 503956 - RNA, 64 nt, hsa; identical to SEQ ID NO: 56582

SEQ ID NO: 503957 - RNA, 64 nt, hsa
cugggcugugugcucuuaugggaaugaggguuggguguccaagaugcccugggcuguguccuuc

SEQ ID NO: 503958 - RNA, 64 nt, hsa
cugggcuguguacuccccuaggaaugagggcuggguguccaagauacccugggcuguguccucc

SEQ ID NO: 503959 - RNA, 64 nt, hsa
cuguccuuuguaagaagucaggaaaucugaugcuguguccaaaauuaugcacuguuuguugaag

SEQ ID NO: 503960 - RNA, 64 nt, hsa
ccugcuucuggcauaacugcuuugccucugucuaguguccaagcaucuuagcuguucaagagga

SEQ ID NO: 503961 - RNA, 64 nt, hsa; identical to SEQ ID NO: 494526

SEQ ID NO: 503962 - RNA, 64 nt, hsa; identical to SEQ ID NO: 494527

SEQ ID NO: 503963 - RNA, 64 nt, hsa; identical to SEQ ID NO: 494528

SEQ ID NO: 503964 - RNA, 64 nt, hsa; identical to SEQ ID NO: 494529

SEQ ID NO: 503965 - RNA, 64 nt, hsa; identical to SEQ ID NO: 494530

SEQ ID NO: 503966 - RNA, 64 nt, hsa; identical to SEQ ID NO: 494531

SEQ ID NO: 503967 - RNA, 64 nt, hsa; identical to SEQ ID NO: 494532

SEQ ID NO: 503968 - RNA, 64 nt, hsa; identical to SEQ ID NO: 494533

SEQ ID NO: 503969 - RNA, 64 nt, hsa; identical to SEQ ID NO: 494534

SEQ ID NO: 503970 - RNA, 64 nt, hsa; identical to SEQ ID NO: 494535

SEQ ID NO: 503971 - RNA, 64 nt, hsa; identical to SEQ ID NO: 494536

SEQ ID NO: 503972 - RNA, 64 nt, hsa; identical to SEQ ID NO: 494537

SEQ ID NO: 503973 - RNA, 64 nt, hsa; identical to SEQ ID NO: 494538

SEQ ID NO: 503974 - RNA, 64 nt, hsa; identical to SEQ ID NO: 494539

SEQ ID NO: 503975 - RNA, 64 nt, hsa; identical to SEQ ID NO: 494540

SEQ ID NO: 503976 - RNA, 64 nt, hsa; identical to SEQ ID NO: 494541

SEQ ID NO: 503977 - RNA, 64 nt, hsa; identical to SEQ ID NO: 209384

SEQ ID NO: 503978 - RNA, 64 nt, hsa; identical to SEQ ID NO: 209385

SEQ ID NO: 503979 - RNA, 64 nt, hsa; identical to SEQ ID NO: 209386

SEQ ID NO: 503980 - RNA, 64 nt, hsa; identical to SEQ ID NO: 209387

SEQ ID NO: 503981 - RNA, 64 nt, hsa; identical to SEQ ID NO: 209388

SEQ ID NO: 503982 - RNA, 64 nt, hsa; identical to SEQ ID NO: 209389

SEQ ID NO: 503983 - RNA, 64 nt, hsa; identical to SEQ ID NO: 209390

SEQ ID NO: 503984 - RNA, 64 nt, hsa; identical to SEQ ID NO: 209391

SEQ ID NO: 503985 - RNA, 64 nt, hsa; identical to SEQ ID NO: 209392

SEQ ID NO: 503986 - RNA, 64 nt, hsa; identical to SEQ ID NO: 209393

SEQ ID NO: 503987 - RNA, 64 nt, hsa; identical to SEQ ID NO: 209394

SEQ ID NO: 503988 - RNA, 64 nt, hsa; identical to SEQ ID NO: 209395

SEQ ID NO: 503989 - RNA, 61 nt, hsa; identical to SEQ ID NO: 209396

SEQ ID NO: 503990 - RNA, 64 nt, hsa; identical to SEQ ID NO: 209397

SEQ ID NO: 503991 - RNA, 64 nt, hsa; identical to SEQ ID NO: 209398

SEQ ID NO: 503992 - RNA, 64 nt, hsa; identical to SEQ ID NO: 209399

SEQ ID NO: 503993 - RNA, 64 nt, hsa; identical to SEQ ID NO: 209400

SEQ ID NO: 503994 - RNA, 64 nt, hsa; identical to SEQ ID NO: 209401

SEQ ID NO: 503995 - RNA, 64 nt, hsa; identical to SEQ ID NO: 209402

SEQ ID NO: 503996 - RNA, 64 nt, hsa; identical to SEQ ID NO: 209403

SEQ ID NO: 503997 - RNA, 64 nt, hsa; identical to SEQ ID NO: 209404

SEQ ID NO: 503998 - RNA, 64 nt, hsa; identical to SEQ ID NO: 209405

SEQ ID NO: 503999 - RNA, 64 nt, hsa; identical to SEQ ID NO: 209406

SEQ ID NO: 504000 - RNA, 64 nt, hsa; identical to SEQ ID NO: 209407

SEQ ID NO: 504001 - RNA, 64 nt, hsa; identical to SEQ ID NO: 86201

SEQ ID NO: 504002 - RNA, 64 nt, hsa; identical to SEQ ID NO: 86202

SEQ ID NO: 504003 - RNA, 64 nt, hsa; identical to SEQ ID NO: 86203

SEQ ID NO: 504004 - RNA, 64 nt, hsa; identical to SEQ ID NO: 86204

SEQ ID NO: 504005 - RNA, 64 nt, hsa; identical to SEQ ID NO: 86205

SEQ ID NO: 504006 - RNA, 64 nt, hsa; identical to SEQ ID NO: 86206

SEQ ID NO: 504007 - RNA, 64 nt, hsa; identical to SEQ ID NO: 86207

SEQ ID NO: 504008 - RNA, 64 nt, hsa; identical to SEQ ID NO: 86208

SEQ ID NO: 504009 - RNA, 64 nt, hsa; identical to SEQ ID NO: 86209

SEQ ID NO: 504010 - RNA, 64 nt, hsa; identical to SEQ ID NO: 86210

SEQ ID NO: 504011 - RNA, 64 nt, hsa; identical to SEQ ID NO: 86211

SEQ ID NO: 504012 - RNA, 64 nt, hsa; identical to SEQ ID NO: 86212

SEQ ID NO: 504013 - RNA, 64 nt, hsa; identical to SEQ ID NO: 86213

SEQ ID NO: 504014 - RNA, 64 nt, hsa; identical to SEQ ID NO: 86214

SEQ ID NO: 504015 - RNA, 64 nt, hsa; identical to SEQ ID NO: 86215

SEQ ID NO: 504016 - RNA, 64 nt, hsa; identical to SEQ ID NO: 86216

SEQ ID NO: 504017 - RNA, 64 nt, hsa; identical to SEQ ID NO: 86217

SEQ ID NO: 504018 - RNA, 64 nt, hsa; identical to SEQ ID NO: 86218

SEQ ID NO: 504019 - RNA, 64 nt, hsa; identical to SEQ ID NO: 86219

SEQ ID NO: 504020 - RNA, 64 nt, hsa; identical to SEQ ID NO: 86220

SEQ ID NO: 504021 - RNA, 64 nt, hsa; identical to SEQ ID NO: 86221

SEQ ID NO: 504022 - RNA, 64 nt, hsa; identical to SEQ ID NO: 86222

SEQ ID NO: 504023 - RNA, 64 nt, hsa; identical to SEQ ID NO: 86223

SEQ ID NO: 504024 - RNA, 64 nt, hsa; identical to SEQ ID NO: 86224

SEQ ID NO: 504025 - RNA, 64 nt, hsa; identical to SEQ ID NO: 86225

SEQ ID NO: 504026 - RNA, 64 nt, hsa; identical to SEQ ID NO: 86226

SEQ ID NO: 504027 - RNA, 64 nt, hsa; identical to SEQ ID NO: 86227

SEQ ID NO: 504028 - RNA, 64 nt, hsa; identical to SEQ ID NO: 86228

SEQ ID NO: 504029 - RNA, 64 nt, hsa; identical to SEQ ID NO: 86229

SEQ ID NO: 504030 - RNA, 64 nt, hsa; identical to SEQ ID NO: 86230

SEQ ID NO: 504031 - RNA, 64 nt, hsa; identical to SEQ ID NO: 86231

SEQ ID NO: 504032 - RNA, 64 nt, hsa; identical to SEQ ID NO: 86232

SEQ ID NO: 504033 - RNA, 64 nt, hsa; identical to SEQ ID NO: 86233

SEQ ID NO: 504034 - RNA, 64 nt, hsa; identical to SEQ ID NO: 86234

SEQ ID NO: 504035 - RNA, 64 nt, hsa; identical to SEQ ID NO: 86235

SEQ ID NO: 504036 - RNA, 64 nt, hsa; identical to SEQ ID NO: 86236

SEQ ID NO: 504037 - RNA, 64 nt, hsa; identical to SEQ ID NO: 86237

SEQ ID NO: 504038 - RNA, 64 nt, hsa; identical to SEQ ID NO: 86238

SEQ ID NO: 504039 - RNA, 64 nt, hsa; identical to SEQ ID NO: 86239

SEQ ID NO: 504040 - RNA, 64 nt, hsa; identical to SEQ ID NO: 86240

SEQ ID NO: 504041 - RNA, 64 nt, hsa; identical to SEQ ID NO: 86241

SEQ ID NO: 504042 - RNA, 64 nt, hsa; identical to SEQ ID NO: 86242

SEQ ID NO: 504043 - RNA, 64 nt, hsa; identical to SEQ ID NO: 86243

SEQ ID NO: 504044 - RNA, 64 nt, hsa; identical to SEQ ID NO: 86244

SEQ ID NO: 504045 - RNA, 64 nt, hsa; identical to SEQ ID NO: 86245

SEQ ID NO: 504046 - RNA, 64 nt, hsa; identical to SEQ ID NO: 86246

SEQ ID NO: 504047 - RNA, 64 nt, hsa; identical to SEQ ID NO: 86247

SEQ ID NO: 504048 - RNA, 64 nt, hsa; identical to SEQ ID NO: 86248

SEQ ID NO: 504049 - RNA, 64 nt, hsa; identical to SEQ ID NO: 86249

SEQ ID NO: 504050 - RNA, 64 nt, hsa; identical to SEQ ID NO: 86250

SEQ ID NO: 504051 - RNA, 64 nt, hsa; identical to SEQ ID NO: 86251

SEQ ID NO: 504052 - RNA, 64 nt, hsa; identical to SEQ ID NO: 86252

SEQ ID NO: 504053 - RNA, 64 nt, hsa; identical to SEQ ID NO: 86253

SEQ ID NO: 504054 - RNA, 64 nt, hsa; identical to SEQ ID NO: 86254

SEQ ID NO: 504055 - RNA, 64 nt, hsa; identical to SEQ ID NO: 86255

SEQ ID NO: 504056 - RNA, 64 nt, hsa; identical to SEQ ID NO: 86256

SEQ ID NO: 504057 - RNA, 55 nt, hsa; identical to SEQ ID NO: 86257

SEQ ID NO: 504058 - RNA, 64 nt, hsa; identical to SEQ ID NO: 86258

SEQ ID NO: 504059 - RNA, 64 nt, hsa; identical to SEQ ID NO: 86259

SEQ ID NO: 504060 - RNA, 64 nt, hsa; identical to SEQ ID NO: 86260

SEQ ID NO: 504061 - RNA, 64 nt, hsa; identical to SEQ ID NO: 86261

SEQ ID NO: 504062 - RNA, 64 nt, hsa; identical to SEQ ID NO: 86262

SEQ ID NO: 504063 - RNA, 64 nt, hsa; identical to SEQ ID NO: 86263

SEQ ID NO: 504064 - RNA, 64 nt, hsa; identical to SEQ ID NO: 86264

SEQ ID NO: 504065 - RNA, 64 nt, hsa; identical to SEQ ID NO: 86265

SEQ ID NO: 504066 - RNA, 64 nt, hsa; identical to SEQ ID NO: 86266

SEQ ID NO: 504067 - RNA, 64 nt, hsa; identical to SEQ ID NO: 86267

SEQ ID NO: 504068 - RNA, 64 nt, hsa; identical to SEQ ID NO: 86268

SEQ ID NO: 504069 - RNA, 64 nt, hsa; identical to SEQ ID NO: 86269

SEQ ID NO: 504070 - RNA, 64 nt, hsa; identical to SEQ ID NO: 86270

SEQ ID NO: 504071 - RNA, 64 nt, hsa; identical to SEQ ID NO: 86271

SEQ ID NO: 504072 - RNA, 64 nt, hsa; identical to SEQ ID NO: 86272

SEQ ID NO: 504073 - RNA, 64 nt, hsa; identical to SEQ ID NO: 86273

SEQ ID NO: 504074 - RNA, 64 nt, hsa; identical to SEQ ID NO: 86274

SEQ ID NO: 504075 - RNA, 64 nt, hsa; identical to SEQ ID NO: 86275

SEQ ID NO: 504076 - RNA, 64 nt, hsa; identical to SEQ ID NO: 86276

SEQ ID NO: 504077 - RNA, 64 nt, hsa; identical to SEQ ID NO: 86277

SEQ ID NO: 504078 - RNA, 64 nt, hsa; identical to SEQ ID NO: 86278

SEQ ID NO: 504079 - RNA, 64 nt, hsa; identical to SEQ ID NO: 21144

SEQ ID NO: 504080 - RNA, 64 nt, hsa; identical to SEQ ID NO: 21145

SEQ ID NO: 504081 - RNA, 64 nt, hsa; identical to SEQ ID NO: 21146

SEQ ID NO: 504082 - RNA, 64 nt, hsa; identical to SEQ ID NO: 21147

SEQ ID NO: 504083 - RNA, 64 nt, hsa; identical to SEQ ID NO: 21148

SEQ ID NO: 504084 - RNA, 64 nt, hsa; identical to SEQ ID NO: 21149

SEQ ID NO: 504085 - RNA, 58 nt, hsa
ggcccacuugcggaaccugacucaggcugcuggcaagcguagcuauguguuggcccug

SEQ ID NO: 504086 - RNA, 58 nt, hsa
ucuacagccucauuccuuaguucccggagcuggcaagggcuggagccccgccuggguc

SEQ ID NO: 504087 - RNA, 58 nt, hsa
acuagaaaaccugacuaauggugucacugcuggcaauggugauaauggauuaauuccu

SEQ ID NO: 504088 - RNA, 58 nt, hsa
cccagaaaaccugacuaauggugccacugcuggcaauggugaugauggauuaauuccu

SEQ ID NO: 504089 - RNA, 58 nt, hsa
agucuguuuacagcuggcaaacagacuggcuggcaaguuguggggcugggucagaaag

SEQ ID NO: 504090 - RNA, 58 nt, hsa
gagaggcagccugggcagucuguuuacagcuggcaaacagacuggcuggcaaguugug

SEQ ID NO: 504091 - RNA, 58 nt, hsa
aaauaguuaacaucaggaaguuaauuuggcuggcaaaauucuagggaaacuuggccag

SEQ ID NO: 504092 - RNA, 58 nt, hsa
uguggugcuguagguaacguguggcacugcuggcaaaugaaggucaugagaugaguuc

SEQ ID NO: 504093 - RNA, 58 nt, hsa
ucaaucaacucuaacucggagacgucuagcuggcaauguuucuaaaacuuucacugga

SEQ ID NO: 504094 - RNA, 58 nt, hsa
cuuguucucuacuguucaccgggaccuggcuggcaaaugacuuagcuauuaguauauu

SEQ ID NO: 504095 - RNA, 58 nt, hsa
aacaacagugcugacuguccggauaagagcuggcaagugcccuuaggaugccgcaugg

SEQ ID NO: 504096 - RNA, 58 nt, hsa
ucugcccaagaccagaggagugugcugugcuggcaaguguaagucccccaguugcucu

SEQ ID NO: 504097 - RNA, 58 nt, hsa
ggugggguagagcacucuccguccugcugcuggcaaggaaugggaacaguggcugucu

SEQ ID NO: 504098 - RNA, 58 nt, hsa; identical to SEQ ID NO: 234416

SEQ ID NO: 504099 - RNA, 58 nt, hsa
aauuuagccuuacucccaaguuauaaaugcuggcaacaaaucacaguaguaaaagcag

SEQ ID NO: 504100 - RNA, 64 nt, hsa
agguuuggguuuuugagauuugcuggugaagucagugacgaaaaauaaaccuucccuuaucuuc

SEQ ID NO: 504101 - RNA, 64 nt, hsa
agcccuucugagcaucaguggugugggggaguaggugacgaaacacuagaccucuccugagaga

SEQ ID NO: 504102 - RNA, 64 nt, hsa
uuuuuuacaacgugacaggaagaggagggagagggugacgaacaccaggcauuuccaggggcua

SEQ ID NO: 504103 - RNA, 64 nt, hsa
caauuuccugacacugagaaugaagaguaucacagugacgaacaaaaugauacucagaagcaau

SEQ ID NO: 504104 - RNA, 64 nt, hsa
guggcuuggguucacagugcauauacacaauaaugugacgaaaguggaaauggagaugguccug

SEQ ID NO: 504105 - RNA, 64 nt, hsa
aaacaaaagugucucccuguggaaaggcauaacugugacgaaagcaacuuuuauaggcaaagca

SEQ ID NO: 504106 - RNA, 64 nt, hsa
auuuuaagcuuauucuuuuucuuaaaagagagaggugacgaaggaaggcaggaaugaagaagca

SEQ ID NO: 504107 - RNA, 64 nt, hsa
gagguaaaauaauuugcccgaagacauacagcuagugacgaauggacugaugguuugaacuuaa

SEQ ID NO: 504108 - RNA, 64 nt, hsa
uaugcagaugcucuuaaaagcauugauaaccuuugugacgaacauaaagagauccuuaaauuau

SEQ ID NO: 504109 - RNA, 64 nt, hsa
gaggagccuauggaauguggaucaaaugccaguugugacgaaaugaggaauguauauguuggcu

SEQ ID NO: 504110 - RNA, 64 nt, hsa
auuugacaugaggguaccuucgcccucaggagaugugacgaaggaacaaggucuaauuugugcg

SEQ ID NO: 504111 - RNA, 64 nt, hsa
uccccccucccugguggucuuaggucuauaaucagugacgaacagagggugcccuuggccaaug

SEQ ID NO: 504112 - RNA, 64 nt, hsa
ucaguuuuuagccuuuacacaugaggucaaaggagugacgaaaauacaaagcaaggaaaaaaug

SEQ ID NO: 504113 - RNA, 64 nt, hsa
acuuacauagccccacucagcugcuucggaaagcgugacgaagcaguaguccucagugugugug

SEQ ID NO: 504114 - RNA, 64 nt, hsa
uuuuaaacgcgugaugaagacagaaggcuccggggugacgaauuuggccgauggcagauguuuu

SEQ ID NO: 504115 - RNA, 64 nt, hsa
uucucauuucgugccgaaaugagacagaaauucagugacgaaggugcguuguagggguauugau

SEQ ID NO: 504116 - RNA, 64 nt, hsa
acuuugacacuuuucauaucauuucuuaacccaagugacgaaaacauuguccccaaugaauaua

SEQ ID NO: 504117 - RNA, 64 nt, hsa
cagauaauucacaccagagagaaacccucugaaugugacgaaugaagaaaagguauuaguguua

SEQ ID NO: 504118 - RNA, 64 nt, hsa
agccuuguugauugaagauuggauaauagaauuugugacgaaagcugauaugcaauggucuugg

SEQ ID NO: 504119 - RNA, 64 nt, hsa
gucaauucauuuuuucccaugagaugaagcacaugugacgaauacggacuagauaaccucuaag

SEQ ID NO: 504120 - RNA, 64 nt, hsa
ugucugcacaguaucuuauguguuguuuuccguugugacgaaugugauuggaacauuuggggag

SEQ ID NO: 504121 - RNA, 64 nt, hsa
aacuccaugugguugauuuuacuggcaugucuuggugacgaagaguuggccaagugaaugaugc

SEQ ID NO: 504122 - RNA, 64 nt, hsa
uucuuauuugcaguuuuaccagucuucauguacagugacgaaacuguguagaaacuaaaucauc

SEQ ID NO: 504123 - RNA, 64 nt, hsa
agaaaagaacaucaggguggguggggacaggccagugacgaagagagggacagaggagggaugg

SEQ ID NO: 504124 - RNA, 64 nt, hsa
gugggaauugugaauucugaagauacagaugacagugacgaaugccuucugucucaugauugac

SEQ ID NO: 504125 - RNA, 64 nt, hsa
aggagguggaggaggaggaagaggagaaggaaaagugacgaagagagaggaggaggggggcccc

SEQ ID NO: 504126 - RNA, 64 nt, hsa
cagagauggcucaaaaaugggguuucagaucuuugugacgaaauagaauacuguuucauauuug

SEQ ID NO: 504127 - RNA, 64 nt, hsa
ccuuuggcuuugcugagagaggacucagaugauagugacgaaugucuggcagugaggacacauu

SEQ ID NO: 504128 - RNA, 64 nt, hsa
gucgggagaagggagggagagaauuuuauuaaaugugacgaacugccccccccccccccccagc

SEQ ID NO: 504129 - RNA, 64 nt, hsa
cuuugcacuuuucuuggucuuggccacagccugagugacgaauuuccuacugaauguaccaagu

SEQ ID NO: 504130 - RNA, 64 nt, hsa
ugagcugagaucacaccacugcacucuagcucgggugacgaagccugacuuugucucaaaaaau

SEQ ID NO: 504131 - RNA, 64 nt, hsa
cccuaucugcgcacccggagguggggugaggacggugacgaagguacccaggucuggggcugca

SEQ ID NO: 504132 - RNA, 64 nt, hsa
cccuaugugcacacccggagguggggugaggacggugacgaagguacccaggucuggggcugca

SEQ ID NO: 504133 - RNA, 64 nt, hsa; identical to SEQ ID NO: 45025

SEQ ID NO: 504134 - RNA, 64 nt, hsa; identical to SEQ ID NO: 45026

SEQ ID NO: 504135 - RNA, 64 nt, hsa; identical to SEQ ID NO: 45027

SEQ ID NO: 504136 - RNA, 64 nt, hsa; identical to SEQ ID NO: 45028

SEQ ID NO: 504137 - RNA, 64 nt, hsa; identical to SEQ ID NO: 45029

SEQ ID NO: 504138 - RNA, 64 nt, hsa; identical to SEQ ID NO: 45030

SEQ ID NO: 504139 - RNA, 64 nt, hsa; identical to SEQ ID NO: 45031

SEQ ID NO: 504140 - RNA, 64 nt, hsa; identical to SEQ ID NO: 45032

SEQ ID NO: 504141 - RNA, 64 nt, hsa; identical to SEQ ID NO: 45033

SEQ ID NO: 504142 - RNA, 64 nt, hsa; identical to SEQ ID NO: 45034

SEQ ID NO: 504143 - RNA, 64 nt, hsa; identical to SEQ ID NO: 45035

SEQ ID NO: 504144 - RNA, 64 nt, hsa; identical to SEQ ID NO: 45036

SEQ ID NO: 504145 - RNA, 64 nt, hsa; identical to SEQ ID NO: 45037

SEQ ID NO: 504146 - RNA, 64 nt, hsa; identical to SEQ ID NO: 45038

SEQ ID NO: 504147 - RNA, 64 nt, hsa; identical to SEQ ID NO: 45039

SEQ ID NO: 504148 - RNA, 64 nt, hsa; identical to SEQ ID NO: 45040

SEQ ID NO: 504149 - RNA, 64 nt, hsa; identical to SEQ ID NO: 45041

SEQ ID NO: 504150 - RNA, 64 nt, hsa; identical to SEQ ID NO: 45042

SEQ ID NO: 504151 - RNA, 64 nt, hsa; identical to SEQ ID NO: 45043

SEQ ID NO: 504152 - RNA, 64 nt, hsa; identical to SEQ ID NO: 45044

SEQ ID NO: 504153 - RNA, 64 nt, hsa; identical to SEQ ID NO: 45045

SEQ ID NO: 504154 - RNA, 64 nt, hsa; identical to SEQ ID NO: 45046

SEQ ID NO: 504155 - RNA, 64 nt, hsa; identical to SEQ ID NO: 45047

SEQ ID NO: 504156 - RNA, 64 nt, hsa; identical to SEQ ID NO: 45048

SEQ ID NO: 504157 - RNA, 64 nt, hsa; identical to SEQ ID NO: 45049

SEQ ID NO: 504158 - RNA, 64 nt, hsa; identical to SEQ ID NO: 45050

SEQ ID NO: 504159 - RNA, 64 nt, hsa; identical to SEQ ID NO: 45051

SEQ ID NO: 504160 - RNA, 64 nt, hsa; identical to SEQ ID NO: 45052

SEQ ID NO: 504161 - RNA, 64 nt, hsa; identical to SEQ ID NO: 45053

SEQ ID NO: 504162 - RNA, 64 nt, hsa; identical to SEQ ID NO: 45054

SEQ ID NO: 504163 - RNA, 64 nt, hsa; identical to SEQ ID NO: 45055

SEQ ID NO: 504164 - RNA, 64 nt, hsa; identical to SEQ ID NO: 45056

SEQ ID NO: 504165 - RNA, 64 nt, hsa; identical to SEQ ID NO: 45057

SEQ ID NO: 504166 - RNA, 64 nt, hsa; identical to SEQ ID NO: 45058

SEQ ID NO: 504167 - RNA, 64 nt, hsa; identical to SEQ ID NO: 45059

SEQ ID NO: 504168 - RNA, 64 nt, hsa; identical to SEQ ID NO: 45060

SEQ ID NO: 504169 - RNA, 64 nt, hsa; identical to SEQ ID NO: 45061

SEQ ID NO: 504170 - RNA, 64 nt, hsa; identical to SEQ ID NO: 45062

SEQ ID NO: 504171 - RNA, 64 nt, hsa; identical to SEQ ID NO: 45063

SEQ ID NO: 504172 - RNA, 64 nt, hsa; identical to SEQ ID NO: 45064

SEQ ID NO: 504173 - RNA, 64 nt, hsa; identical to SEQ ID NO: 45065

SEQ ID NO: 504174 - RNA, 64 nt, hsa; identical to SEQ ID NO: 45066

SEQ ID NO: 504175 - RNA, 64 nt, hsa; identical to SEQ ID NO: 366326

SEQ ID NO: 504176 - RNA, 64 nt, hsa; identical to SEQ ID NO: 366327

SEQ ID NO: 504177 - RNA, 64 nt, hsa; identical to SEQ ID NO: 366328

SEQ ID NO: 504178 - RNA, 64 nt, hsa; identical to SEQ ID NO: 366329

SEQ ID NO: 504179 - RNA, 64 nt, hsa; identical to SEQ ID NO: 366330

SEQ ID NO: 504180 - RNA, 64 nt, hsa; identical to SEQ ID NO: 366331

SEQ ID NO: 504181 - RNA, 64 nt, hsa; identical to SEQ ID NO: 366332

SEQ ID NO: 504182 - RNA, 64 nt, hsa; identical to SEQ ID NO: 366333

SEQ ID NO: 504183 - RNA, 64 nt, hsa; identical to SEQ ID NO: 366334

SEQ ID NO: 504184 - RNA, 64 nt, hsa; identical to SEQ ID NO: 366335

SEQ ID NO: 504185 - RNA, 64 nt, hsa; identical to SEQ ID NO: 366336

SEQ ID NO: 504186 - RNA, 64 nt, hsa; identical to SEQ ID NO: 366337

SEQ ID NO: 504187 - RNA, 64 nt, hsa; identical to SEQ ID NO: 366338

SEQ ID NO: 504188 - RNA, 64 nt, hsa; identical to SEQ ID NO: 366339

SEQ ID NO: 504189 - RNA, 64 nt, hsa; identical to SEQ ID NO: 366340

SEQ ID NO: 504190 - RNA, 64 nt, hsa; identical to SEQ ID NO: 366341

SEQ ID NO: 504191 - RNA, 64 nt, hsa; identical to SEQ ID NO: 366342

SEQ ID NO: 504192 - RNA, 64 nt, hsa; identical to SEQ ID NO: 366343

SEQ ID NO: 504193 - RNA, 64 nt, hsa; identical to SEQ ID NO: 366344

SEQ ID NO: 504194 - RNA, 64 nt, hsa; identical to SEQ ID NO: 366345

SEQ ID NO: 504195 - RNA, 64 nt, hsa; identical to SEQ ID NO: 366346

SEQ ID NO: 504196 - RNA, 64 nt, hsa; identical to SEQ ID NO: 366347

SEQ ID NO: 504197 - RNA, 64 nt, hsa; identical to SEQ ID NO: 366348

SEQ ID NO: 504198 - RNA, 64 nt, hsa; identical to SEQ ID NO: 366349

SEQ ID NO: 504199 - RNA, 64 nt, hsa; identical to SEQ ID NO: 366350

SEQ ID NO: 504200 - RNA, 64 nt, hsa; identical to SEQ ID NO: 366351

SEQ ID NO: 504201 - RNA, 64 nt, hsa; identical to SEQ ID NO: 366352

SEQ ID NO: 504202 - RNA, 64 nt, hsa; identical to SEQ ID NO: 366353

SEQ ID NO: 504203 - RNA, 64 nt, hsa; identical to SEQ ID NO: 366354

SEQ ID NO: 504204 - RNA, 64 nt, hsa; identical to SEQ ID NO: 366355

SEQ ID NO: 504205 - RNA, 64 nt, hsa; identical to SEQ ID NO: 366356

SEQ ID NO: 504206 - RNA, 64 nt, hsa; identical to SEQ ID NO: 366357

SEQ ID NO: 504207 - RNA, 64 nt, hsa; identical to SEQ ID NO: 366358

SEQ ID NO: 504208 - RNA, 64 nt, hsa; identical to SEQ ID NO: 366359

SEQ ID NO: 504209 - RNA, 64 nt, hsa; identical to SEQ ID NO: 366360

SEQ ID NO: 504210 - RNA, 64 nt, hsa; identical to SEQ ID NO: 366361

SEQ ID NO: 504211 - RNA, 64 nt, hsa; identical to SEQ ID NO: 366362

SEQ ID NO: 504212 - RNA, 64 nt, hsa; identical to SEQ ID NO: 366363

SEQ ID NO: 504213 - RNA, 64 nt, hsa; identical to SEQ ID NO: 366364

SEQ ID NO: 504214 - RNA, 64 nt, hsa; identical to SEQ ID NO: 366365

SEQ ID NO: 504215 - RNA, 64 nt, hsa; identical to SEQ ID NO: 366366

SEQ ID NO: 504216 - RNA, 64 nt, hsa; identical to SEQ ID NO: 366367

SEQ ID NO: 504217 - RNA, 64 nt, hsa; identical to SEQ ID NO: 366368

SEQ ID NO: 504218 - RNA, 64 nt, hsa; identical to SEQ ID NO: 366369

SEQ ID NO: 504219 - RNA, 64 nt, hsa; identical to SEQ ID NO: 366370

SEQ ID NO: 504220 - RNA, 64 nt, hsa; identical to SEQ ID NO: 366371

SEQ ID NO: 504221 - RNA, 64 nt, hsa; identical to SEQ ID NO: 366372

SEQ ID NO: 504222 - RNA, 64 nt, hsa; identical to SEQ ID NO: 366373

SEQ ID NO: 504223 - RNA, 64 nt, hsa; identical to SEQ ID NO: 366374

SEQ ID NO: 504224 - RNA, 64 nt, hsa; identical to SEQ ID NO: 366375

SEQ ID NO: 504225 - RNA, 64 nt, hsa; identical to SEQ ID NO: 366376

SEQ ID NO: 504226 - RNA, 64 nt, hsa; identical to SEQ ID NO: 366377

SEQ ID NO: 504227 - RNA, 64 nt, hsa; identical to SEQ ID NO: 366378

SEQ ID NO: 504228 - RNA, 64 nt, hsa; identical to SEQ ID NO: 366379

SEQ ID NO: 504229 - RNA, 64 nt, hsa; identical to SEQ ID NO: 366380

SEQ ID NO: 504230 - RNA, 64 nt, hsa; identical to SEQ ID NO: 366381

SEQ ID NO: 504231 - RNA, 64 nt, hsa; identical to SEQ ID NO: 366382

SEQ ID NO: 504232 - RNA, 64 nt, hsa; identical to SEQ ID NO: 366383

SEQ ID NO: 504233 - RNA, 64 nt, hsa; identical to SEQ ID NO: 366384

SEQ ID NO: 504234 - RNA, 64 nt, hsa; identical to SEQ ID NO: 366385

SEQ ID NO: 504235 - RNA, 64 nt, hsa; identical to SEQ ID NO: 366386

SEQ ID NO: 504236 - RNA, 64 nt, hsa; identical to SEQ ID NO: 366387

SEQ ID NO: 504237 - RNA, 64 nt, hsa; identical to SEQ ID NO: 366388

SEQ ID NO: 504238 - RNA, 64 nt, hsa; identical to SEQ ID NO: 366389

SEQ ID NO: 504239 - RNA, 64 nt, hsa; identical to SEQ ID NO: 366390

SEQ ID NO: 504240 - RNA, 64 nt, hsa; identical to SEQ ID NO: 366391

SEQ ID NO: 504241 - RNA, 64 nt, hsa; identical to SEQ ID NO: 366392

SEQ ID NO: 504242 - RNA, 64 nt, hsa; identical to SEQ ID NO: 366393

SEQ ID NO: 504243 - RNA, 64 nt, hsa; identical to SEQ ID NO: 366394

SEQ ID NO: 504244 - RNA, 64 nt, hsa; identical to SEQ ID NO: 366395

SEQ ID NO: 504245 - RNA, 64 nt, hsa; identical to SEQ ID NO: 366396

SEQ ID NO: 504246 - RNA, 64 nt, hsa; identical to SEQ ID NO: 366397

SEQ ID NO: 504247 - RNA, 64 nt, hsa; identical to SEQ ID NO: 366398

SEQ ID NO: 504248 - RNA, 64 nt, hsa; identical to SEQ ID NO: 366399

SEQ ID NO: 504249 - RNA, 64 nt, hsa; identical to SEQ ID NO: 366400

SEQ ID NO: 504250 - RNA, 64 nt, hsa; identical to SEQ ID NO: 366401

SEQ ID NO: 504251 - RNA, 64 nt, hsa; identical to SEQ ID NO: 366402

SEQ ID NO: 504252 - RNA, 64 nt, hsa; identical to SEQ ID NO: 366403

SEQ ID NO: 504253 - RNA, 64 nt, hsa; identical to SEQ ID NO: 366404

SEQ ID NO: 504254 - RNA, 64 nt, hsa; identical to SEQ ID NO: 366405

SEQ ID NO: 504255 - RNA, 64 nt, hsa; identical to SEQ ID NO: 366406

SEQ ID NO: 504256 - RNA, 64 nt, hsa; identical to SEQ ID NO: 366407

SEQ ID NO: 504257 - RNA, 64 nt, hsa; identical to SEQ ID NO: 366408

SEQ ID NO: 504258 - RNA, 64 nt, hsa; identical to SEQ ID NO: 366409

SEQ ID NO: 504259 - RNA, 64 nt, hsa; identical to SEQ ID NO: 366410

SEQ ID NO: 504260 - RNA, 64 nt, hsa; identical to SEQ ID NO: 366411

SEQ ID NO: 504261 - RNA, 64 nt, hsa; identical to SEQ ID NO: 366412

SEQ ID NO: 504262 - RNA, 64 nt, hsa; identical to SEQ ID NO: 366413

SEQ ID NO: 504263 - RNA, 64 nt, hsa; identical to SEQ ID NO: 366414

SEQ ID NO: 504264 - RNA, 64 nt, hsa; identical to SEQ ID NO: 366415

SEQ ID NO: 504265 - RNA, 64 nt, hsa; identical to SEQ ID NO: 366416

SEQ ID NO: 504266 - RNA, 64 nt, hsa; identical to SEQ ID NO: 366417

SEQ ID NO: 504267 - RNA, 64 nt, hsa; identical to SEQ ID NO: 366418

SEQ ID NO: 504268 - RNA, 64 nt, hsa; identical to SEQ ID NO: 366419

SEQ ID NO: 504269 - RNA, 64 nt, hsa; identical to SEQ ID NO: 366420

SEQ ID NO: 504270 - RNA, 64 nt, hsa; identical to SEQ ID NO: 366421

SEQ ID NO: 504271 - RNA, 64 nt, hsa; identical to SEQ ID NO: 366422

SEQ ID NO: 504272 - RNA, 64 nt, hsa; identical to SEQ ID NO: 366423

SEQ ID NO: 504273 - RNA, 64 nt, hsa; identical to SEQ ID NO: 366424

SEQ ID NO: 504274 - RNA, 64 nt, hsa; identical to SEQ ID NO: 366425

SEQ ID NO: 504275 - RNA, 64 nt, hsa; identical to SEQ ID NO: 366426

SEQ ID NO: 504276 - RNA, 64 nt, hsa; identical to SEQ ID NO: 366427

SEQ ID NO: 504277 - RNA, 64 nt, hsa; identical to SEQ ID NO: 366428

SEQ ID NO: 504278 - RNA, 64 nt, hsa; identical to SEQ ID NO: 366429

SEQ ID NO: 504279 - RNA, 64 nt, hsa; identical to SEQ ID NO: 366430

SEQ ID NO: 504280 - RNA, 64 nt, hsa; identical to SEQ ID NO: 366431

SEQ ID NO: 504281 - RNA, 64 nt, hsa; identical to SEQ ID NO: 366432

SEQ ID NO: 504282 - RNA, 64 nt, hsa; identical to SEQ ID NO: 366433

SEQ ID NO: 504283 - RNA, 64 nt, hsa; identical to SEQ ID NO: 366434

SEQ ID NO: 504284 - RNA, 64 nt, hsa; identical to SEQ ID NO: 366435

SEQ ID NO: 504285 - RNA, 64 nt, hsa; identical to SEQ ID NO: 366436

SEQ ID NO: 504286 - RNA, 64 nt, hsa; identical to SEQ ID NO: 366437

SEQ ID NO: 504287 - RNA, 64 nt, hsa; identical to SEQ ID NO: 366438

SEQ ID NO: 504288 - RNA, 64 nt, hsa; identical to SEQ ID NO: 366439

SEQ ID NO: 504289 - RNA, 64 nt, hsa; identical to SEQ ID NO: 366440

SEQ ID NO: 504290 - RNA, 64 nt, hsa; identical to SEQ ID NO: 366441

SEQ ID NO: 504291 - RNA, 64 nt, hsa; identical to SEQ ID NO: 366442

SEQ ID NO: 504292 - RNA, 64 nt, hsa; identical to SEQ ID NO: 366443

SEQ ID NO: 504293 - RNA, 64 nt, hsa; identical to SEQ ID NO: 366444

SEQ ID NO: 504294 - RNA, 64 nt, hsa; identical to SEQ ID NO: 366445

SEQ ID NO: 504295 - RNA, 64 nt, hsa; identical to SEQ ID NO: 366446

SEQ ID NO: 504296 - RNA, 64 nt, hsa; identical to SEQ ID NO: 366447

SEQ ID NO: 504297 - RNA, 64 nt, hsa; identical to SEQ ID NO: 366448

SEQ ID NO: 504298 - RNA, 64 nt, hsa; identical to SEQ ID NO: 366449

SEQ ID NO: 504299 - RNA, 64 nt, hsa; identical to SEQ ID NO: 366450

SEQ ID NO: 504300 - RNA, 64 nt, hsa; identical to SEQ ID NO: 366451

SEQ ID NO: 504301 - RNA, 64 nt, hsa; identical to SEQ ID NO: 366452

SEQ ID NO: 504302 - RNA, 64 nt, hsa; identical to SEQ ID NO: 366453

SEQ ID NO: 504303 - RNA, 64 nt, hsa; identical to SEQ ID NO: 366454

SEQ ID NO: 504304 - RNA, 64 nt, hsa; identical to SEQ ID NO: 366455

SEQ ID NO: 504305 - RNA, 64 nt, hsa; identical to SEQ ID NO: 366456

SEQ ID NO: 504306 - RNA, 64 nt, hsa; identical to SEQ ID NO: 366457

SEQ ID NO: 504307 - RNA, 64 nt, hsa; identical to SEQ ID NO: 366458

SEQ ID NO: 504308 - RNA, 64 nt, hsa; identical to SEQ ID NO: 366459

SEQ ID NO: 504309 - RNA, 64 nt, hsa; identical to SEQ ID NO: 366460

SEQ ID NO: 504310 - RNA, 64 nt, hsa; identical to SEQ ID NO: 366461

SEQ ID NO: 504311 - RNA, 64 nt, hsa; identical to SEQ ID NO: 366462

SEQ ID NO: 504312 - RNA, 64 nt, hsa; identical to SEQ ID NO: 366463

SEQ ID NO: 504313 - RNA, 64 nt, hsa; identical to SEQ ID NO: 366464

SEQ ID NO: 504314 - RNA, 64 nt, hsa; identical to SEQ ID NO: 366465

SEQ ID NO: 504315 - RNA, 64 nt, hsa; identical to SEQ ID NO: 366466

SEQ ID NO: 504316 - RNA, 64 nt, hsa; identical to SEQ ID NO: 366467

SEQ ID NO: 504317 - RNA, 64 nt, hsa; identical to SEQ ID NO: 366468

SEQ ID NO: 504318 - RNA, 64 nt, hsa; identical to SEQ ID NO: 366469

SEQ ID NO: 504319 - RNA, 64 nt, hsa; identical to SEQ ID NO: 366470

SEQ ID NO: 504320 - RNA, 64 nt, hsa; identical to SEQ ID NO: 366471

SEQ ID NO: 504321 - RNA, 64 nt, hsa; identical to SEQ ID NO: 366472

SEQ ID NO: 504322 - RNA, 64 nt, hsa; identical to SEQ ID NO: 366473

SEQ ID NO: 504323 - RNA, 64 nt, hsa; identical to SEQ ID NO: 366474

SEQ ID NO: 504324 - RNA, 64 nt, hsa; identical to SEQ ID NO: 366475

SEQ ID NO: 504325 - RNA, 64 nt, hsa; identical to SEQ ID NO: 366476

SEQ ID NO: 504326 - RNA, 64 nt, hsa; identical to SEQ ID NO: 366477

SEQ ID NO: 504327 - RNA, 64 nt, hsa; identical to SEQ ID NO: 366478

SEQ ID NO: 504328 - RNA, 64 nt, hsa; identical to SEQ ID NO: 366479

SEQ ID NO: 504329 - RNA, 64 nt, hsa; identical to SEQ ID NO: 366480

SEQ ID NO: 504330 - RNA, 64 nt, hsa; identical to SEQ ID NO: 366481

SEQ ID NO: 504331 - RNA, 64 nt, hsa; identical to SEQ ID NO: 366482

SEQ ID NO: 504332 - RNA, 64 nt, hsa; identical to SEQ ID NO: 366483

SEQ ID NO: 504333 - RNA, 64 nt, hsa; identical to SEQ ID NO: 366484

SEQ ID NO: 504334 - RNA, 64 nt, hsa; identical to SEQ ID NO: 366485

SEQ ID NO: 504335 - RNA, 64 nt, hsa; identical to SEQ ID NO: 366486

SEQ ID NO: 504336 - RNA, 64 nt, hsa; identical to SEQ ID NO: 366487

SEQ ID NO: 504337 - RNA, 64 nt, hsa; identical to SEQ ID NO: 366488

SEQ ID NO: 504338 - RNA, 64 nt, hsa; identical to SEQ ID NO: 366489

SEQ ID NO: 504339 - RNA, 64 nt, hsa; identical to SEQ ID NO: 366490

SEQ ID NO: 504340 - RNA, 64 nt, hsa
ugaacaucucuugaaaccuguuaaaacaaccaguuaaagccacagauggcuuucagggcaguag

SEQ ID NO: 504341 - RNA, 64 nt, hsa
caaagucacauccacaacuaaugagggaaaucuguaaagccaguuagauagaagaauuuuauuu

SEQ ID NO: 504342 - RNA, 64 nt, hsa
gguugguaaugugacuuuguagauauuccuugauuaaagccagacccuauugguauccuuuuug

SEQ ID NO: 504343 - RNA, 64 nt, hsa
auucacuguagcaacugugauauauuuacccuaauaaagccaccacuuggucuuuuccagugcu

SEQ ID NO: 504344 - RNA, 64 nt, hsa
auuuuuauuuauuaaauauuugggguuuugguuuuaaagccagaauuacggcuagcaccuagca

SEQ ID NO: 504345 - RNA, 64 nt, hsa
aaccauuacuccagcugccucccagauuaaugcauaaagccaaggaacuaccccgcucccugcg

SEQ ID NO: 504346 - RNA, 64 nt, hsa
uuuuuguuuguuuguuuuuuguuuuuuuucuugguaaagccaugcaccacagacuucugggcag

SEQ ID NO: 504347 - RNA, 64 nt, hsa
uguuauuguccuuuugaacuguuuuuuuuuuuauuaaagccaaauuuguguuguauauauucgu

SEQ ID NO: 504348 - RNA, 64 nt, hsa
ucuucuccccuaaacaacuucugccaaacaauaauaaagccaacuggaaacgaaucggagccau

SEQ ID NO: 504349 - RNA, 64 nt, hsa
uagcagacugcauguguugauacuuuuuuuuucuuaaagccaauuauuuugaugcaaaagaaau

SEQ ID NO: 504350 - RNA, 64 nt, hsa
aacagagugaccaagggacaagaagggacuugccuaaagccacccagcaacucagcagcagaac

SEQ ID NO: 504351 - RNA, 64 nt, hsa
uggcauaacugagauaaggugaauaagugacaaauaaagccaguuuuuuacaagguacuugauc

SEQ ID NO: 504352 - RNA, 64 nt, hsa
cauuauauguauacaucaguauaguguuuuauuauaaagccaauuaucugauuaagcauucuuu

SEQ ID NO: 504353 - RNA, 64 nt, hsa
auuaugcaagucaggaaucauuaauuucaaaauuuaaagccaugcuaaaauuaaaaagaaaaua

SEQ ID NO: 504354 - RNA, 64 nt, hsa
aucccuucuuuuucuuuuuuucuuugguuuaauuuaaagccacaaccacauacaacacaaagag

SEQ ID NO: 504355 - RNA, 64 nt, hsa
ucaguuuuucccacccaguguagcauccuaaagauaaagccagaagcuaagcugcagugaggcu

SEQ ID NO: 504356 - RNA, 64 nt, hsa
aagucaaucaagcaggaaucauuuaaaaaccagauaaagccauguuuuucuucugugacaauuu

SEQ ID NO: 504357 - RNA, 64 nt, hsa
cuucacacuauagacacagaauauagcuuuuucuuaaagccaaauuugggugauaggacacuuu

SEQ ID NO: 504358 - RNA, 64 nt, hsa
aauuacuguaacugauuacacuugguaauuguacuaaagccaaacauauauauacuauuaaaaa

SEQ ID NO: 504359 - RNA, 64 nt, hsa
uguuuauucuauaguuauuaaguucuuuaaaauguaaagccaugcuggaaaauaauacugcuga

SEQ ID NO: 504360 - RNA, 64 nt, hsa
ggcucuccuugaauaagaaagccagcagaacucuuaaagccaguuguaguacggaguugucagc

SEQ ID NO: 504361 - RNA, 64 nt, hsa
caguauuuucccucuuccccuuuauaaauuaugcuaaagccacaaagcacauuuuuggggauca

SEQ ID NO: 504362 - RNA, 64 nt, hsa
ggaacauugguuugugaaggaaaaacagauuaucuaaagccaucucuauguuucuguucagaua

SEQ ID NO: 504363 - RNA, 64 nt, hsa
uuucauuuggggagcuggucuucuaagaaacggauaaagccacauaauuaaagcaguugaacua

SEQ ID NO: 504364 - RNA, 64 nt, hsa
uggagggagccgugggcguggggacgugacugaauaaagccaccauggguggaugugcuuggag

SEQ ID NO: 504365 - RNA, 64 nt, hsa
gaagagcccaagcguccccgucccguggagucgcuaaagccagcccucccuguccuuuccagag

SEQ ID NO: 504366 - RNA, 64 nt, hsa
gcuuuaauuucacuuucugaucacgguacguccauaaagccaguauuacacuuaaaugaaguau

SEQ ID NO: 504367 - RNA, 64 nt, hsa
cuuucgaggccagugagcucagccuccaaggcuuuaaagccacauuucagcaagagaaagcgcu

SEQ ID NO: 504368 - RNA, 64 nt, hsa
agcccagcuuugccagcccuaauaagaagcaugcuaaagccacagcagcuacugugguucuuca

SEQ ID NO: 504369 - RNA, 64 nt, hsa
gugugaugaucagcacuaaguccugcauuccuguuaaagccacuugggucauaagaagggagua

SEQ ID NO: 504370 - RNA, 64 nt, hsa; identical to SEQ ID NO: 68831

SEQ ID NO: 504371 - RNA, 64 nt, hsa; identical to SEQ ID NO: 68832

SEQ ID NO: 504372 - RNA, 64 nt, hsa; identical to SEQ ID NO: 68833

SEQ ID NO: 504373 - RNA, 64 nt, hsa; identical to SEQ ID NO: 68834

SEQ ID NO: 504374 - RNA, 64 nt, hsa; identical to SEQ ID NO: 68835

SEQ ID NO: 504375 - RNA, 64 nt, hsa; identical to SEQ ID NO: 68836

SEQ ID NO: 504376 - RNA, 64 nt, hsa; identical to SEQ ID NO: 68837

SEQ ID NO: 504377 - RNA, 64 nt, hsa; identical to SEQ ID NO: 68838

SEQ ID NO: 504378 - RNA, 64 nt, hsa; identical to SEQ ID NO: 68839

SEQ ID NO: 504379 - RNA, 64 nt, hsa; identical to SEQ ID NO: 68840

SEQ ID NO: 504380 - RNA, 64 nt, hsa; identical to SEQ ID NO: 68841

SEQ ID NO: 504381 - RNA, 64 nt, hsa; identical to SEQ ID NO: 68842

SEQ ID NO: 504382 - RNA, 64 nt, hsa; identical to SEQ ID NO: 68843

SEQ ID NO: 504383 - RNA, 64 nt, hsa; identical to SEQ ID NO: 68844

SEQ ID NO: 504384 - RNA, 64 nt, hsa; identical to SEQ ID NO: 68845

SEQ ID NO: 504385 - RNA, 64 nt, hsa; identical to SEQ ID NO: 68846

SEQ ID NO: 504386 - RNA, 64 nt, hsa; identical to SEQ ID NO: 68847

SEQ ID NO: 504387 - RNA, 64 nt, hsa; identical to SEQ ID NO: 68848

SEQ ID NO: 504388 - RNA, 64 nt, hsa; identical to SEQ ID NO: 68849

SEQ ID NO: 504389 - RNA, 64 nt, hsa; identical to SEQ ID NO: 68850

SEQ ID NO: 504390 - RNA, 64 nt, hsa; identical to SEQ ID NO: 68851

SEQ ID NO: 504391 - RNA, 64 nt, hsa; identical to SEQ ID NO: 68852

SEQ ID NO: 504392 - RNA, 64 nt, hsa; identical to SEQ ID NO: 68853

SEQ ID NO: 504393 - RNA, 64 nt, hsa; identical to SEQ ID NO: 68854

SEQ ID NO: 504394 - RNA, 64 nt, hsa; identical to SEQ ID NO: 68855

SEQ ID NO: 504395 - RNA, 64 nt, hsa; identical to SEQ ID NO: 68856

SEQ ID NO: 504396 - RNA, 64 nt, hsa; identical to SEQ ID NO: 68857

SEQ ID NO: 504397 - RNA, 64 nt, hsa; identical to SEQ ID NO: 68858

SEQ ID NO: 504398 - RNA, 64 nt, hsa; identical to SEQ ID NO: 68859

SEQ ID NO: 504399 - RNA, 64 nt, hsa; identical to SEQ ID NO: 68860

SEQ ID NO: 504400 - RNA, 64 nt, hsa; identical to SEQ ID NO: 68861

SEQ ID NO: 504401 - RNA, 64 nt, hsa; identical to SEQ ID NO: 68862

SEQ ID NO: 504402 - RNA, 64 nt, hsa; identical to SEQ ID NO: 68863

SEQ ID NO: 504403 - RNA, 64 nt, hsa; identical to SEQ ID NO: 68864

SEQ ID NO: 504404 - RNA, 64 nt, hsa; identical to SEQ ID NO: 68865

SEQ ID NO: 504405 - RNA, 64 nt, hsa; identical to SEQ ID NO: 68866

SEQ ID NO: 504406 - RNA, 64 nt, hsa; identical to SEQ ID NO: 68867

SEQ ID NO: 504407 - RNA, 64 nt, hsa; identical to SEQ ID NO: 68868

SEQ ID NO: 504408 - RNA, 64 nt, hsa; identical to SEQ ID NO: 68869

SEQ ID NO: 504409 - RNA, 64 nt, hsa; identical to SEQ ID NO: 68870

SEQ ID NO: 504410 - RNA, 64 nt, hsa; identical to SEQ ID NO: 68871

SEQ ID NO: 504411 - RNA, 64 nt, hsa; identical to SEQ ID NO: 68872

SEQ ID NO: 504412 - RNA, 64 nt, hsa; identical to SEQ ID NO: 68873

SEQ ID NO: 504413 - RNA, 64 nt, hsa; identical to SEQ ID NO: 68874

SEQ ID NO: 504414 - RNA, 64 nt, hsa; identical to SEQ ID NO: 68875

SEQ ID NO: 504415 - RNA, 64 nt, hsa; identical to SEQ ID NO: 68876

SEQ ID NO: 504416 - RNA, 64 nt, hsa; identical to SEQ ID NO: 68877

SEQ ID NO: 504417 - RNA, 64 nt, hsa; identical to SEQ ID NO: 68877

SEQ ID NO: 504418 - RNA, 64 nt, hsa; identical to SEQ ID NO: 68879

SEQ ID NO: 504419 - RNA, 64 nt, hsa; identical to SEQ ID NO: 68880

SEQ ID NO: 504420 - RNA, 64 nt, hsa; identical to SEQ ID NO: 68881

SEQ ID NO: 504421 - RNA, 64 nt, hsa; identical to SEQ ID NO: 68882

SEQ ID NO: 504422 - RNA, 64 nt, hsa; identical to SEQ ID NO: 68883

SEQ ID NO: 504423 - RNA, 64 nt, hsa; identical to SEQ ID NO: 68884

SEQ ID NO: 504424 - RNA, 64 nt, hsa; identical to SEQ ID NO: 68885

SEQ ID NO: 504425 - RNA, 64 nt, hsa; identical to SEQ ID NO: 68886

SEQ ID NO: 504426 - RNA, 64 nt, hsa; identical to SEQ ID NO: 68887

SEQ ID NO: 504427 - RNA, 64 nt, hsa; identical to SEQ ID NO: 68888

SEQ ID NO: 504428 - RNA, 64 nt, hsa; identical to SEQ ID NO: 68889

SEQ ID NO: 504429 - RNA, 64 nt, hsa; identical to SEQ ID NO: 68890

SEQ ID NO: 504430 - RNA, 64 nt, hsa; identical to SEQ ID NO: 68891

SEQ ID NO: 504431 - RNA, 64 nt, hsa; identical to SEQ ID NO: 68892

SEQ ID NO: 504432 - RNA, 64 nt, hsa; identical to SEQ ID NO: 68893

SEQ ID NO: 504433 - RNA, 64 nt, hsa; identical to SEQ ID NO: 68894

SEQ ID NO: 504434 - RNA, 64 nt, hsa; identical to SEQ ID NO: 68895

SEQ ID NO: 504435 - RNA, 64 nt, hsa; identical to SEQ ID NO: 68896

SEQ ID NO: 504436 - RNA, 64 nt, hsa; identical to SEQ ID NO: 68897

SEQ ID NO: 504437 - RNA, 64 nt, hsa; identical to SEQ ID NO: 68898

SEQ ID NO: 504438 - RNA, 64 nt, hsa; identical to SEQ ID NO: 68899

SEQ ID NO: 504439 - RNA, 64 nt, hsa; identical to SEQ ID NO: 68900

SEQ ID NO: 504440 - RNA, 64 nt, hsa; identical to SEQ ID NO: 68901

SEQ ID NO: 504441 - RNA, 64 nt, hsa; identical to SEQ ID NO: 68902

SEQ ID NO: 504442 - RNA, 64 nt, hsa; identical to SEQ ID NO: 68903

SEQ ID NO: 504443 - RNA, 64 nt, hsa; identical to SEQ ID NO: 68904

SEQ ID NO: 504444 - RNA, 64 nt, hsa; identical to SEQ ID NO: 68905

SEQ ID NO: 504445 - RNA, 64 nt, hsa; identical to SEQ ID NO: 68906

SEQ ID NO: 504446 - RNA, 64 nt, hsa; identical to SEQ ID NO: 68907

SEQ ID NO: 504447 - RNA, 64 nt, hsa; identical to SEQ ID NO: 68908

SEQ ID NO: 504448 - RNA, 64 nt, hsa; identical to SEQ ID NO: 68909

SEQ ID NO: 504449 - RNA, 64 nt, hsa; identical to SEQ ID NO: 68910

SEQ ID NO: 504450 - RNA, 64 nt, hsa; identical to SEQ ID NO: 68911

SEQ ID NO: 504451 - RNA, 64 nt, hsa; identical to SEQ ID NO: 68912

SEQ ID NO: 504452 - RNA, 64 nt, hsa; identical to SEQ ID NO: 68913

SEQ ID NO: 504453 - RNA, 64 nt, hsa; identical to SEQ ID NO: 68914

SEQ ID NO: 504454 - RNA, 64 nt, hsa; identical to SEQ ID NO: 68915

SEQ ID NO: 504455 - RNA, 64 nt, hsa; identical to SEQ ID NO: 68916

SEQ ID NO: 504456 - RNA, 64 nt, hsa; identical to SEQ ID NO: 68917

SEQ ID NO: 504457 - RNA, 64 nt, hsa; identical to SEQ ID NO: 68918

SEQ ID NO: 504458 - RNA, 64 nt, hsa; identical to SEQ ID NO: 68919

SEQ ID NO: 504459 - RNA, 64 nt, hsa; identical to SEQ ID NO: 68920

SEQ ID NO: 504460 - RNA, 64 nt, hsa; identical to SEQ ID NO: 68921

SEQ ID NO: 504461 - RNA, 64 nt, hsa; identical to SEQ ID NO: 68922

SEQ ID NO: 504462 - RNA, 64 nt, hsa; identical to SEQ ID NO: 68923

SEQ ID NO: 504463 - RNA, 64 nt, hsa; identical to SEQ ID NO: 68924

SEQ ID NO: 504464 - RNA, 64 nt, hsa; identical to SEQ ID NO: 68925

SEQ ID NO: 504465 - RNA, 64 nt, hsa; identical to SEQ ID NO: 68926

SEQ ID NO: 504466 - RNA, 64 nt, hsa; identical to SEQ ID NO: 68927

SEQ ID NO: 504467 - RNA, 64 nt, hsa; identical to SEQ ID NO: 68928

SEQ ID NO: 504468 - RNA, 64 nt, hsa; identical to SEQ ID NO: 68929

SEQ ID NO: 504469 - RNA, 64 nt, hsa; identical to SEQ ID NO: 68930

SEQ ID NO: 504470 - RNA, 64 nt, hsa; identical to SEQ ID NO: 68931

SEQ ID NO: 504471 - RNA, 64 nt, hsa; identical to SEQ ID NO: 68932

SEQ ID NO: 504472 - RNA, 64 nt, hsa; identical to SEQ ID NO: 68933

SEQ ID NO: 504473 - RNA, 64 nt, hsa; identical to SEQ ID NO: 68934

SEQ ID NO: 504474 - RNA, 64 nt, hsa; identical to SEQ ID NO: 68935

SEQ ID NO: 504475 - RNA, 64 nt, hsa
cgaguagcugggauuacaggugcaugccaccauggcuggcuaauuuuuguauuuuuaguagaga

SEQ ID NO: 504476 - RNA, 64 nt, hsa
caucacugcaguggcccugggaggugaggaagaagcuggcuagaggagggggcucccaccuacc

SEQ ID NO: 504477 - RNA, 64 nt, hsa
gacuguugaguaacuccuccuuuacuuuuuuccugcuggcuacagcauggggugcccuauaggc
